United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 86

SEQ ID NO: 3933589 - RNA, 15 nt, Human adenovirus E
cuggcgggggcacaa

SEQ ID NO: 3933590 - RNA, 17 nt, Human adenovirus E
cuggcuccuggaccugg

SEQ ID NO: 3933591 - RNA, 23 nt, Human adenovirus E
cuggcugacguccugcaggacca

SEQ ID NO: 3933592 - RNA, 13 nt, Human adenovirus E
cugggcagcgacg

SEQ ID NO: 3933593 - RNA, 15 nt, Human adenovirus E
cuggggcgacggggg

SEQ ID NO: 3933594 - RNA, 21 nt, Human adenovirus E
cuggggguauaggcagggaga

SEQ ID NO: 3933595 - RNA, 22 nt, Human adenovirus E
cugggguucauguugugcagga

SEQ ID NO: 3933596 - RNA, 18 nt, Human adenovirus E
cugggugaaggccacggg

SEQ ID NO: 3933597 - RNA, 19 nt, Human adenovirus E
cugguacuuggccagccac

SEQ ID NO: 3933598 - RNA, 19 nt, Human adenovirus E
cugguccgggcgcugcaca

SEQ ID NO: 3933599 - RNA, 19 nt, Human adenovirus E
cugguggcgguguugcuuu

SEQ ID NO: 3933600 - RNA, 13 nt, Human adenovirus E
cuguaucccaccc

SEQ ID NO: 3933601 - RNA, 15 nt, Human adenovirus E
cuguggaccucggcc

SEQ ID NO: 3933602 - RNA, 20 nt, Human adenovirus E
cugugggaccugcuggaggc

SEQ ID NO: 3933603 - RNA, 23 nt, Human adenovirus E
cugugggacgauguggacagcag

SEQ ID NO: 3933604 - RNA, 18 nt, Human adenovirus E
gugacaaagagcuguccg

SEQ ID NO: 3933605 - RNA, 15 nt, Human adenovirus E
gugaccguggagcug

SEQ ID NO: 3933606 - RNA, 23 nt, Human adenovirus E
gugacggcgcgcccguccucgcg

SEQ ID NO: 3933607 - RNA, 14 nt, Human adenovirus E
gugagcucgucggg

SEQ ID NO: 3933608 - RNA, 20 nt, Human adenovirus E
gugagcucgucggggucgcu

SEQ ID NO: 3933609 - RNA, 13 nt, Human adenovirus E
gugcaacacagaa

SEQ ID NO: 3933610 - RNA, 19 nt, Human adenovirus E
gugcacgaagcccugcagg

SEQ ID NO: 3933611 - RNA, 21 nt, Human adenovirus E
gugcaggagcgcgggcugccg

SEQ ID NO: 3933612 - RNA, 16 nt, Human adenovirus E
gugcaucuuggccugg

SEQ ID NO: 3933613 - RNA, 23 nt, Human adenovirus E
gugcccauagacaaggaggugaa

SEQ ID NO: 3933614 - RNA, 13 nt, Human adenovirus E
gugcccccuccag

SEQ ID NO: 3933615 - RNA, 13 nt, Human adenovirus E
gugccgcgguccu

SEQ ID NO: 3933616 - RNA, 17 nt, Human adenovirus E
gugccggacugggggac

SEQ ID NO: 3933617 - RNA, 16 nt, Human adenovirus E
gugcgacugggcuuuu

SEQ ID NO: 3933618 - RNA, 16 nt, Human adenovirus E
gugcgcgccgggcugg

SEQ ID NO: 3933619 - RNA, 20 nt, Human adenovirus E
gugcgcgccgggcugggcgc

SEQ ID NO: 3933620 - RNA, 17 nt, Human adenovirus E
gugcgcgugcgcgggca

SEQ ID NO: 3933621 - RNA, 20 nt, Human adenovirus E
gugcgcuucuuguaggcggg

SEQ ID NO: 3933622 - RNA, 19 nt, Human adenovirus E
gugcugccgcggcggugcc

SEQ ID NO: 3933623 - RNA, 19 nt, Human adenovirus E
guggaaaauaacagccagg

SEQ ID NO: 3933624 - RNA, 17 nt, Human adenovirus E
guggaagaagcagccgc

SEQ ID NO: 3933625 - RNA, 21 nt, Human adenovirus E
guggacguuuagagccucggg

SEQ ID NO: 3933626 - RNA, 14 nt, Human adenovirus E
guggagccacugcu

SEQ ID NO: 3933627 - RNA, 20 nt, Human adenovirus E
guggaggauuuggaggaaga

SEQ ID NO: 3933628 - RNA, 20 nt, Human adenovirus E
guggagucguggcgccugca

SEQ ID NO: 3933629 - RNA, 12 nt, Human adenovirus E
guggaucuuuuc

SEQ ID NO: 3933630 - RNA, 17 nt, Human adenovirus E
guggaucuuuuccagga

SEQ ID NO: 3933631 - RNA, 16 nt, Human adenovirus E
guggcagcggccgagg

SEQ ID NO: 3933632 - RNA, 17 nt, Human adenovirus E
guggcagcggccgaggc

SEQ ID NO: 3933633 - RNA, 22 nt, Human adenovirus E
guggccaccucgccgcgcaggg

SEQ ID NO: 3933634 - RNA, 18 nt, Human adenovirus E
guggcccccuucacggac

SEQ ID NO: 3933635 - RNA, 14 nt, Human adenovirus E
guggcgaaggagcc

SEQ ID NO: 3933636 - RNA, 23 nt, Human adenovirus E
gugggcguaggagucuugcagcu

SEQ ID NO: 3933637 - RNA, 14 nt, Human adenovirus E
gugggcguggggca

SEQ ID NO: 3933638 - RNA, 16 nt, Human adenovirus E
gugggcguggggcagu

SEQ ID NO: 3933639 - RNA, 12 nt, Human adenovirus E
guggugcaggag

SEQ ID NO: 3933640 - RNA, 19 nt, Human adenovirus E
guguaccaguccgggccgg

SEQ ID NO: 3933641 - RNA, 13 nt, Human adenovirus E
gugucgagccugc

SEQ ID NO: 3933642 - RNA, 19 nt, Human adenovirus E
guguuguaaaucacccagu

SEQ ID NO: 3933643 - RNA, 16 nt, Human adenovirus E
guuagaguuuggaagc

SEQ ID NO: 3933644 - RNA, 15 nt, Human adenovirus E
guucagggcggccag

SEQ ID NO: 3933645 - RNA, 22 nt, Human adenovirus E
guuccgcaccgaaggaagaggc

SEQ ID NO: 3933646 - RNA, 14 nt, Human adenovirus E
guucgugcccgagg

SEQ ID NO: 3933647 - RNA, 14 nt, Human adenovirus E
guucuacacgggcg

SEQ ID NO: 3933648 - RNA, 11 nt, Human adenovirus E
guugcagaggc

SEQ ID NO: 3933649 - RNA, 15 nt, Human adenovirus E
guuggcacagcacag

SEQ ID NO: 3933650 - RNA, 20 nt, Human adenovirus E
guuggcacagcacaggcaua

SEQ ID NO: 3933651 - RNA, 18 nt, Human adenovirus E
guuuaaaauuugaagaug

SEQ ID NO: 3933652 - RNA, 14 nt, Human adenovirus E
uaaaaguccacggc

SEQ ID NO: 3933653 - RNA, 21 nt, Human adenovirus E
uaacgagcgccccuuguggaa

SEQ ID NO: 3933654 - RNA, 14 nt, Human adenovirus E
uaaguacucuuuca

SEQ ID NO: 3933655 - RNA, 19 nt, Human adenovirus E
uaaugagaaaauuacuauu

SEQ ID NO: 3933656 - RNA, 15 nt, Human adenovirus E
uaauuacuccccucc

SEQ ID NO: 3933657 - RNA, 14 nt, Human adenovirus E
uacaaaucuguuga

SEQ ID NO: 3933658 - RNA, 19 nt, Human adenovirus E
  misc_feature (8)..(8): n is a, c, g or u
uacacucnugcaccauccc

SEQ ID NO: 3933659 - RNA, 16 nt, Human adenovirus E
uaccaccacuacagcc

SEQ ID NO: 3933660 - RNA, 22 nt, Human adenovirus E
uaccaggaaauuccccagccca

SEQ ID NO: 3933661 - RNA, 23 nt, Human adenovirus E
uaccgcgaggccaucggccaggc

SEQ ID NO: 3933662 - RNA, 20 nt, Human adenovirus E
uaccucugcucuaugcaauu

SEQ ID NO: 3933663 - RNA, 19 nt, Human adenovirus E
uacgagagcgugaugcagc

SEQ ID NO: 3933664 - RNA, 18 nt, Human adenovirus E
uacgcccgcgccaagagc

SEQ ID NO: 3933665 - RNA, 12 nt, Human adenovirus E
uacggcgcggcc

SEQ ID NO: 3933666 - RNA, 16 nt, Human adenovirus E
uagaaagccuggugga

SEQ ID NO: 3933667 - RNA, 19 nt, Human adenovirus E
uagacagcagccccaggcc

SEQ ID NO: 3933668 - RNA, 15 nt, Human adenovirus E
uagaggaaccccgcc

SEQ ID NO: 3933669 - RNA, 18 nt, Human adenovirus E
uagcuuaccgagcagcag

SEQ ID NO: 3933670 - RNA, 15 nt, Human adenovirus E
uaggacguccagagc

SEQ ID NO: 3933671 - RNA, 15 nt, Human adenovirus E
uagguuuuggaucag

SEQ ID NO: 3933672 - RNA, 19 nt, Human adenovirus E
uagucgagggucuccugga

SEQ ID NO: 3933673 - RNA, 20 nt, Human adenovirus E
uagucgagggucuccuggau

SEQ ID NO: 3933674 - RNA, 17 nt, Human adenovirus E
uauaccuucucauacau

SEQ ID NO: 3933675 - RNA, 15 nt, Human adenovirus E
ucaucaaguuucaau

SEQ ID NO: 3933676 - RNA, 20 nt, Human adenovirus E
ucauccuggccguguugcuc

SEQ ID NO: 3933677 - RNA, 16 nt, Human adenovirus E
ucaucugcauguucau

SEQ ID NO: 3933678 - RNA, 18 nt, Human adenovirus E
ucaugggcaccuggagcg

SEQ ID NO: 3933679 - RNA, 16 nt, Human adenovirus E
ucaugguauuguuauu

SEQ ID NO: 3933680 - RNA, 13 nt, Human adenovirus E
ucauguacagcaa

SEQ ID NO: 3933681 - RNA, 19 nt, Human adenovirus E
uccaacguggagcugacca

SEQ ID NO: 3933682 - RNA, 19 nt, Human adenovirus E
uccaagaagaggcagcagc

SEQ ID NO: 3933683 - RNA, 22 nt, Human adenovirus E
uccaagaccccauagccagccg

SEQ ID NO: 3933684 - RNA, 12 nt, Human adenovirus E
uccaagccagcc

SEQ ID NO: 3933685 - RNA, 20 nt, Human adenovirus E
uccacacugguggccaccuc

SEQ ID NO: 3933686 - RNA, 18 nt, Human adenovirus E
uccacagcggcggcagca

SEQ ID NO: 3933687 - RNA, 14 nt, Human adenovirus E
uccacccucccagg

SEQ ID NO: 3933688 - RNA, 15 nt, Human adenovirus E
uccaccugcggggcg

SEQ ID NO: 3933689 - RNA, 19 nt, Human adenovirus E
uccacugucgagagccaca

SEQ ID NO: 3933690 - RNA, 14 nt, Human adenovirus E
uccagcaccaggca

SEQ ID NO: 3933691 - RNA, 15 nt, Human adenovirus E
uccagcgcagccagg

SEQ ID NO: 3933692 - RNA, 14 nt, Human adenovirus E
uccaguucguggag

SEQ ID NO: 3933693 - RNA, 18 nt, Human adenovirus E
uccaucauccccacgccg

SEQ ID NO: 3933694 - RNA, 17 nt, Human adenovirus E
uccaucccgcuggacca

SEQ ID NO: 3933695 - RNA, 14 nt, Human adenovirus E
ucccaacaaaugcc

SEQ ID NO: 3933696 - RNA, 15 nt, Human adenovirus E
ucccaacaaaugcca

SEQ ID NO: 3933697 - RNA, 17 nt, Human adenovirus E
ucccagacaugcaagag

SEQ ID NO: 3933698 - RNA, 13 nt, Human adenovirus E
ucccaggacaugg

SEQ ID NO: 3933699 - RNA, 11 nt, Human adenovirus E
ucccagggcac

SEQ ID NO: 3933700 - RNA, 17 nt, Human adenovirus E
uccccgucuccugccgc

SEQ ID NO: 3933701 - RNA, 19 nt, Human adenovirus E
ucccgugcaggcaccgcag

SEQ ID NO: 3933702 - RNA, 15 nt, Human adenovirus E
ucccuggccugcaac

SEQ ID NO: 3933703 - RNA, 21 nt, Human adenovirus E
ucccuggccugcaacccccag

SEQ ID NO: 3933704 - RNA, 13 nt, Human adenovirus E
uccgagaagcugg

SEQ ID NO: 3933705 - RNA, 17 nt, Human adenovirus E
uccgccgacgacagcag

SEQ ID NO: 3933706 - RNA, 19 nt, Human adenovirus E
uccggccgcgagggugcug

SEQ ID NO: 3933707 - RNA, 18 nt, Human adenovirus E
uccgggcacucccgcauc

SEQ ID NO: 3933708 - RNA, 12 nt, Human adenovirus E
uccggggcagaa

SEQ ID NO: 3933709 - RNA, 13 nt, Human adenovirus E
uccgucaagcugc

SEQ ID NO: 3933710 - RNA, 15 nt, Human adenovirus E
uccuagaacagucag

SEQ ID NO: 3933711 - RNA, 21 nt, Human adenovirus E
uccucaauaucacgaaaucau

SEQ ID NO: 3933712 - RNA, 21 nt, Human adenovirus E
uccuccaagucugugccaccc

SEQ ID NO: 3933713 - RNA, 15 nt, Human adenovirus E
uccuccagaagacgg

SEQ ID NO: 3933714 - RNA, 16 nt, Human adenovirus E
uccucccggaggaggg

SEQ ID NO: 3933715 - RNA, 14 nt, Human adenovirus E
uccucccucagcaa

SEQ ID NO: 3933716 - RNA, 20 nt, Human adenovirus E
uccuccgcggccggccauug

SEQ ID NO: 3933717 - RNA, 22 nt, Human adenovirus E
uccugcggaaccacagggccag

SEQ ID NO: 3933718 - RNA, 19 nt, Human adenovirus E
uccugcguuacgugcagca

SEQ ID NO: 3933719 - RNA, 22 nt, Human adenovirus E
uccugcguuacgugcagcagaa

SEQ ID NO: 3933720 - RNA, 23 nt, Human adenovirus E
uccuggccguguugcucuacuac

SEQ ID NO: 3933721 - RNA, 20 nt, Human adenovirus E
uccugguucaccugcagcag

SEQ ID NO: 3933722 - RNA, 22 nt, Human adenovirus E
uccugguucaccugcagcagau

SEQ ID NO: 3933723 - RNA, 20 nt, Human adenovirus E
uccugugggacgauguggac

SEQ ID NO: 3933724 - RNA, 13 nt, Human adenovirus E
uccuucucgguga

SEQ ID NO: 3933725 - RNA, 18 nt, Human adenovirus E
ucgaaggcgggcaugacc

SEQ ID NO: 3933726 - RNA, 18 nt, Human adenovirus E
ucgaaucaggcuggagcc

SEQ ID NO: 3933727 - RNA, 15 nt, Human adenovirus E
ucgacaccuggacca

SEQ ID NO: 3933728 - RNA, 17 nt, Human adenovirus E
ucgacgagcgcaccacc

SEQ ID NO: 3933729 - RNA, 14 nt, Human adenovirus E
ucgacgccaucagc

SEQ ID NO: 3933730 - RNA, 18 nt, Human adenovirus E
ucgacuccguggccugga

SEQ ID NO: 3933731 - RNA, 21 nt, Human adenovirus E
ucgagcaguuauuuuuccucc

SEQ ID NO: 3933732 - RNA, 21 nt, Human adenovirus E
ucgaggacgucagcggcgagg

SEQ ID NO: 3933733 - RNA, 19 nt, Human adenovirus E
ucgagggucuccuggauga

SEQ ID NO: 3933734 - RNA, 16 nt, Human adenovirus E
ucgagggucugggcag

SEQ ID NO: 3933735 - RNA, 17 nt, Human adenovirus E
ucgagggucugggcagc

SEQ ID NO: 3933736 - RNA, 19 nt, Human adenovirus E
ucgagggucugggcagcga

SEQ ID NO: 3933737 - RNA, 13 nt, Human adenovirus E
ucgagugccacug

SEQ ID NO: 3933738 - RNA, 15 nt, Human adenovirus E
ucgaucuccuccucu

SEQ ID NO: 3933739 - RNA, 23 nt, Human adenovirus E
ucgauggugaagaugccgggcag

SEQ ID NO: 3933740 - RNA, 15 nt, Human adenovirus E
ucgauuccucgggaa

SEQ ID NO: 3933741 - RNA, 23 nt, Human adenovirus E
ucgauuccucgggaaaacucauc

SEQ ID NO: 3933742 - RNA, 16 nt, Human adenovirus E
ucgcccaucuccgagg

SEQ ID NO: 3933743 - RNA, 15 nt, Human adenovirus E
ucgcccgucucucag

SEQ ID NO: 3933744 - RNA, 20 nt, Human adenovirus E
ucgcccugcucgggcaucag

SEQ ID NO: 3933745 - RNA, 21 nt, Human adenovirus E
ucgcccugcucgggcaucagc

SEQ ID NO: 3933746 - RNA, 22 nt, Human adenovirus E
ucgcgccugcugcugcugcugg

SEQ ID NO: 3933747 - RNA, 19 nt, Human adenovirus E
ucgcguucccauuacgggc

SEQ ID NO: 3933748 - RNA, 22 nt, Human adenovirus E
ucgcuguugagacccgagcggg

SEQ ID NO: 3933749 - RNA, 18 nt, Human adenovirus E
ucggaucuucagccagcg

SEQ ID NO: 3933750 - RNA, 12 nt, Human adenovirus E
ucggccaugggc

SEQ ID NO: 3933751 - RNA, 18 nt, Human adenovirus E
ugacaguacaggagccau

SEQ ID NO: 3933752 - RNA, 13 nt, Human adenovirus E
ugaccacaaccac

SEQ ID NO: 3933753 - RNA, 18 nt, Human adenovirus E
ugaccaccguggugcaga

SEQ ID NO: 3933754 - RNA, 16 nt, Human adenovirus E
ugaccagcaugaaggg

SEQ ID NO: 3933755 - RNA, 12 nt, Human adenovirus E
ugacccugggcc

SEQ ID NO: 3933756 - RNA, 13 nt, Human adenovirus E
ugacccugggccu

SEQ ID NO: 3933757 - RNA, 13 nt, Human adenovirus E
ugacgcuccuggu

SEQ ID NO: 3933758 - RNA, 17 nt, Human adenovirus E
ugacggguuccuguggg

SEQ ID NO: 3933759 - RNA, 23 nt, Human adenovirus E
ugacggguuccugugggacgaug

SEQ ID NO: 3933760 - RNA, 13 nt, Human adenovirus E
ugacggugccggc

SEQ ID NO: 3933761 - RNA, 14 nt, Human adenovirus E
ugacugacccacug

SEQ ID NO: 3933762 - RNA, 22 nt, Human adenovirus E
ugagccgcgcccugggccagga

SEQ ID NO: 3933763 - RNA, 16 nt, Human adenovirus E
ugagcgacgaucuggg

SEQ ID NO: 3933764 - RNA, 14 nt, Human adenovirus E
ugagcggggcugga

SEQ ID NO: 3933765 - RNA, 19 nt, Human adenovirus E
ugagggagagacagcugcc

SEQ ID NO: 3933766 - RNA, 15 nt, Human adenovirus E
ugagguacaugggca

SEQ ID NO: 3933767 - RNA, 18 nt, Human adenovirus E
ugagguacaugggcauga

SEQ ID NO: 3933768 - RNA, 14 nt, Human adenovirus E
ugaucaccagcugg

SEQ ID NO: 3933769 - RNA, 22 nt, Human adenovirus E
ugaugcaaaacuaacacuuugc

SEQ ID NO: 3933770 - RNA, 12 nt, Human adenovirus E
ugauggacaugc

SEQ ID NO: 3933771 - RNA, 20 nt, Human adenovirus E
ugcaacaacaacagccaccu

SEQ ID NO: 3933772 - RNA, 22 nt, Human adenovirus E
ugcaacuuuuuuuuggaggccg

SEQ ID NO: 3933773 - RNA, 22 nt, Human adenovirus E
ugcaagacccggucaccuuccg

SEQ ID NO: 3933774 - RNA, 13 nt, Human adenovirus E
ugcaagcgccgca

SEQ ID NO: 3933775 - RNA, 14 nt, Human adenovirus E
ugcacaccaacaug

SEQ ID NO: 3933776 - RNA, 15 nt, Human adenovirus E
ugcacccgugcagcc

SEQ ID NO: 3933777 - RNA, 22 nt, Human adenovirus E
ugcacgagaaccgccuggggca

SEQ ID NO: 3933778 - RNA, 18 nt, Human adenovirus E
ugcacgccgcaccgcucc

SEQ ID NO: 3933779 - RNA, 13 nt, Human adenovirus E
ugcagcaggcgau

SEQ ID NO: 3933780 - RNA, 11 nt, Human adenovirus E
ugcagcccccg

SEQ ID NO: 3933781 - RNA, 15 nt, Human adenovirus E
ugcagcucacuacca

SEQ ID NO: 3933782 - RNA, 22 nt, Human adenovirus E
ugcaggacagcgaaccccgcag

SEQ ID NO: 3933783 - RNA, 17 nt, Human adenovirus E
ugcaggagcgcgggcug

SEQ ID NO: 3933784 - RNA, 21 nt, Human adenovirus E
ugcaggagcgcgggcugccgc

SEQ ID NO: 3933785 - RNA, 18 nt, Human adenovirus E
ugcaggccucucagcgcc

SEQ ID NO: 3933786 - RNA, 19 nt, Human adenovirus E
ugcaggccugcgggggcaa

SEQ ID NO: 3933787 - RNA, 23 nt, Human adenovirus E
ugcagggccuguggggcgugcag

SEQ ID NO: 3933788 - RNA, 17 nt, Human adenovirus E
ugcagggcgcccagcag

SEQ ID NO: 3933789 - RNA, 18 nt, Human adenovirus E
ugcaggggcggcaggggc

SEQ ID NO: 3933790 - RNA, 15 nt, Human adenovirus E
ugcagggggaucagc

SEQ ID NO: 3933791 - RNA, 15 nt, Human adenovirus E
ugcaguggcgcgggc

SEQ ID NO: 3933792 - RNA, 13 nt, Human adenovirus E
ugcaucucccagg

SEQ ID NO: 3933793 - RNA, 16 nt, Human adenovirus E
ugcaucucuucagcac

SEQ ID NO: 3933794 - RNA, 14 nt, Human adenovirus E
ugcaucugcugcug

SEQ ID NO: 3933795 - RNA, 10 nt, Human adenovirus E
ugccagcuga

SEQ ID NO: 3933796 - RNA, 15 nt, Human adenovirus E
ugccauucgcgcacg

SEQ ID NO: 3933797 - RNA, 20 nt, Human adenovirus E
ugccauucgcgcacggccag

SEQ ID NO: 3933798 - RNA, 13 nt, Human adenovirus E
ugccccagagcga

SEQ ID NO: 3933799 - RNA, 16 nt, Human adenovirus E
ugcccgaggacuacca

SEQ ID NO: 3933800 - RNA, 15 nt, Human adenovirus E
ugcccgcgcggggca

SEQ ID NO: 3933801 - RNA, 19 nt, Human adenovirus E
ugcccuucaucaacccccc

SEQ ID NO: 3933802 - RNA, 19 nt, Human adenovirus E
ugcccuucgcccuagccgc

SEQ ID NO: 3933803 - RNA, 22 nt, Human adenovirus E
ugccgaaaaagaaaaacagcca

SEQ ID NO: 3933804 - RNA, 14 nt, Human adenovirus E
ugccgcccaggacu

SEQ ID NO: 3933805 - RNA, 16 nt, Human adenovirus E
ugccgcugaccuuccg

SEQ ID NO: 3933806 - RNA, 21 nt, Human adenovirus E
ugccgcuguccgagaagcugg

SEQ ID NO: 3933807 - RNA, 20 nt, Human adenovirus E
ugccugagcauucacaugcu

SEQ ID NO: 3933808 - RNA, 19 nt, Human adenovirus E
ugccugauggcucugauca

SEQ ID NO: 3933809 - RNA, 13 nt, Human adenovirus E
ugccugcgccgcu

SEQ ID NO: 3933810 - RNA, 13 nt, Human adenovirus E
ugccuucugcuac

SEQ ID NO: 3933811 - RNA, 17 nt, Human adenovirus E
ugccuuggcaguacagu

SEQ ID NO: 3933812 - RNA, 18 nt, Human adenovirus E
ugcgagccgauggggaag

SEQ ID NO: 3933813 - RNA, 19 nt, Human adenovirus E
ugcgagccgauggggaaga

SEQ ID NO: 3933814 - RNA, 22 nt, Human adenovirus E
ugcgagggggcgaggagccccg

SEQ ID NO: 3933815 - RNA, 17 nt, Human adenovirus E
ugcgccaccacccccag

SEQ ID NO: 3933816 - RNA, 14 nt, Human adenovirus E
ugcgcgccgggcug

SEQ ID NO: 3933817 - RNA, 15 nt, Human adenovirus E
ugcgcgugcgcgggc

SEQ ID NO: 3933818 - RNA, 17 nt, Human adenovirus E
ugcggcccaugagcugc

SEQ ID NO: 3933819 - RNA, 12 nt, Human adenovirus E
ugcggcgggcgc

SEQ ID NO: 3933820 - RNA, 21 nt, Human adenovirus E
ugcgguacacgggguugcagc

SEQ ID NO: 3933821 - RNA, 19 nt, Human adenovirus E
ugcgguggugaaggaggaa

SEQ ID NO: 3933822 - RNA, 19 nt, Human adenovirus E
ugcgucucgggacccugcc

SEQ ID NO: 3933823 - RNA, 13 nt, Human adenovirus E
ugcguuccagcau

SEQ ID NO: 3933824 - RNA, 20 nt, Human adenovirus E
ugcuaccgccaaaaaucaga

SEQ ID NO: 3933825 - RNA, 16 nt, Human adenovirus E
ugcuccgcgcugcccu

SEQ ID NO: 3933826 - RNA, 23 nt, Human adenovirus E
ugcuccugguucaccugcagcag

SEQ ID NO: 3933827 - RNA, 18 nt, Human adenovirus E
ugcucgaucuccuccucu

SEQ ID NO: 3933828 - RNA, 17 nt, Human adenovirus E
ugcugaaaaagggccgc

SEQ ID NO: 3933829 - RNA, 17 nt, Human adenovirus E
ugcuggagcgcguggcc

SEQ ID NO: 3933830 - RNA, 13 nt, Human adenovirus E
uggaaacauaaag

SEQ ID NO: 3933831 - RNA, 22 nt, Human adenovirus E
uggaagagggcgaggggcuggc

SEQ ID NO: 3933832 - RNA, 17 nt, Human adenovirus E
agucauaaucaucugca

SEQ ID NO: 3933833 - RNA, 18 nt, Human adenovirus E
agucauucagccggugga

SEQ ID NO: 3933834 - RNA, 21 nt, Human adenovirus E
  misc_feature (8)..(8): n is a, c, g or u
aguccugnugagcggcccugc

SEQ ID NO: 3933835 - RNA, 20 nt, Human adenovirus E
agucucaaguccagcaaagc

SEQ ID NO: 3933836 - RNA, 17 nt, Human adenovirus E
agugcugacccugagcg

SEQ ID NO: 3933837 - RNA, 21 nt, Human adenovirus E
aguggcauuuuugaugugggc

SEQ ID NO: 3933838 - RNA, 13 nt, Human adenovirus E
agugucuggagga

SEQ ID NO: 3933839 - RNA, 14 nt, Human adenovirus E
aguucaaggcgcgg

SEQ ID NO: 3933840 - RNA, 17 nt, Human adenovirus E
aguugagcgugguggcg

SEQ ID NO: 3933841 - RNA, 15 nt, Human adenovirus E
aguuucaauguggau

SEQ ID NO: 3933842 - RNA, 23 nt, Human adenovirus E
auaaucacacacgcccagcacac

SEQ ID NO: 3933843 - RNA, 22 nt, Human adenovirus E
auaauuuucauuuuuccagccu

SEQ ID NO: 3933844 - RNA, 17 nt, Human adenovirus E
auacaccacccucuccc

SEQ ID NO: 3933845 - RNA, 23 nt, Human adenovirus E
auacagcucgugcgagggggcga

SEQ ID NO: 3933846 - RNA, 22 nt, Human adenovirus E
auaucgccuccuuggaagaggu

SEQ ID NO: 3933847 - RNA, 13 nt, Human adenovirus E
auaugcucaugca

SEQ ID NO: 3933848 - RNA, 20 nt, Human adenovirus E
auauuaacgcgcacaaaaag

SEQ ID NO: 3933849 - RNA, 20 nt, Human adenovirus E
aucaaaacacgacuuucaaa

SEQ ID NO: 3933850 - RNA, 22 nt, Human adenovirus E
aucaaguggugcccccuccaga

SEQ ID NO: 3933851 - RNA, 22 nt, Human adenovirus E
aucacccagucauagcaggggc

SEQ ID NO: 3933852 - RNA, 12 nt, Human adenovirus E
aucacgguuauc

SEQ ID NO: 3933853 - RNA, 23 nt, Human adenovirus E
aucacuauucuuaucugccuccu

SEQ ID NO: 3933854 - RNA, 13 nt, Human adenovirus E
aucaucggcaccu

SEQ ID NO: 3933855 - RNA, 16 nt, Human adenovirus E
auccccgcgcuccugg

SEQ ID NO: 3933856 - RNA, 18 nt, Human adenovirus E
auccccgucuccugccgc

SEQ ID NO: 3933857 - RNA, 22 nt, Human adenovirus E
aucccugagcuccucccucagc

SEQ ID NO: 3933858 - RNA, 13 nt, Human adenovirus E
auccuccaccaga

SEQ ID NO: 3933859 - RNA, 23 nt, Human adenovirus E
auccuggaggccguggugcccuc

SEQ ID NO: 3933860 - RNA, 14 nt, Human adenovirus E
aucgccaaccucgc

SEQ ID NO: 3933861 - RNA, 19 nt, Human adenovirus E
aucgccuccuuggaagagg

SEQ ID NO: 3933862 - RNA, 17 nt, Human adenovirus E
aucguggugcaggagcg

SEQ ID NO: 3933863 - RNA, 16 nt, Human adenovirus E
aucguucucuccagca

SEQ ID NO: 3933864 - RNA, 18 nt, Human adenovirus E
aucuccaacguggagcug

SEQ ID NO: 3933865 - RNA, 15 nt, Human adenovirus E
aucucgcucaggucg

SEQ ID NO: 3933866 - RNA, 16 nt, Human adenovirus E
aucucgucgaagccgu

SEQ ID NO: 3933867 - RNA, 13 nt, Human adenovirus E
aucugggccuggu

SEQ ID NO: 3933868 - RNA, 15 nt, Human adenovirus E
augaccaccugggcg

SEQ ID NO: 3933869 - RNA, 16 nt, Human adenovirus E
augaccaucgaccuga

SEQ ID NO: 3933870 - RNA, 19 nt, Human adenovirus E
augaggccgagccacagcg

SEQ ID NO: 3933871 - RNA, 16 nt, Human adenovirus E
augauauucuggagca

SEQ ID NO: 3933872 - RNA, 23 nt, Human adenovirus E
augauauucuggagcaggcggcc

SEQ ID NO: 3933873 - RNA, 19 nt, Human adenovirus E
augaugauauucuggagca

SEQ ID NO: 3933874 - RNA, 23 nt, Human adenovirus E
augcaagcggugcguuccagcau

SEQ ID NO: 3933875 - RNA, 12 nt, Human adenovirus E
augcaggagggg

SEQ ID NO: 3933876 - RNA, 17 nt, Human adenovirus E
augcaggagggggccac

SEQ ID NO: 3933877 - RNA, 14 nt, Human adenovirus E
augcaggggcggca

SEQ ID NO: 3933878 - RNA, 13 nt, Human adenovirus E
augcgcaggagca

SEQ ID NO: 3933879 - RNA, 21 nt, Human adenovirus E
augcggaugaagcacaaaauu

SEQ ID NO: 3933880 - RNA, 18 nt, Human adenovirus E
augcgggcggcgcugcag

SEQ ID NO: 3933881 - RNA, 17 nt, Human adenovirus E
augcgucgccaccacca

SEQ ID NO: 3933882 - RNA, 19 nt, Human adenovirus E
auggacucugacgcuccug

SEQ ID NO: 3933883 - RNA, 23 nt, Human adenovirus E
auggaggugcagacggaucccug

SEQ ID NO: 3933884 - RNA, 22 nt, Human adenovirus E
auggcuggcagagccccuuccg

SEQ ID NO: 3933885 - RNA, 16 nt, Human adenovirus E
augggacgagaccgga

SEQ ID NO: 3933886 - RNA, 13 nt, Human adenovirus E
augggcaccugga

SEQ ID NO: 3933887 - RNA, 17 nt, Human adenovirus E
augggcgcggaccugca

SEQ ID NO: 3933888 - RNA, 21 nt, Human adenovirus E
augggcgcggaccugcacugg

SEQ ID NO: 3933889 - RNA, 19 nt, Human adenovirus E
augguagaauucaaggaca

SEQ ID NO: 3933890 - RNA, 18 nt, Human adenovirus E
auggugaagaugccgggc

SEQ ID NO: 3933891 - RNA, 23 nt, Human adenovirus E
auggugaccgacgugcgcgaggc

SEQ ID NO: 3933892 - RNA, 19 nt, Human adenovirus E
augguguacuaugccuucu

SEQ ID NO: 3933893 - RNA, 23 nt, Human adenovirus E
auuaccucugcucuaugcaauuc

SEQ ID NO: 3933894 - RNA, 18 nt, Human adenovirus E
auucccacggagcccaug

SEQ ID NO: 3933895 - RNA, 12 nt, Human adenovirus E
auuccccagccc

SEQ ID NO: 3933896 - RNA, 23 nt, Human adenovirus E
auucuggccugcacccucaucuc

SEQ ID NO: 3933897 - RNA, 17 nt, Human adenovirus E
auucuuaucugccuccu

SEQ ID NO: 3933898 - RNA, 13 nt, Human adenovirus E
auugaccugggcu

SEQ ID NO: 3933899 - RNA, 23 nt, Human adenovirus E
auugcuauuuuggaucugacacu

SEQ ID NO: 3933900 - RNA, 18 nt, Human adenovirus E
auugucggugugcuuucg

SEQ ID NO: 3933901 - RNA, 19 nt, Human adenovirus E
auuucaaucccaacaaaug

SEQ ID NO: 3933902 - RNA, 21 nt, Human adenovirus E
auuucaccaacgccauccuga

SEQ ID NO: 3933903 - RNA, 21 nt, Human adenovirus E
caaaagaaaaauccuccaggu

SEQ ID NO: 3933904 - RNA, 17 nt, Human adenovirus E
caaacuaaccuccacca

SEQ ID NO: 3933905 - RNA, 17 nt, Human adenovirus E
caaacugucaaauacuc

SEQ ID NO: 3933906 - RNA, 14 nt, Human adenovirus E
caaauaaucacaca

SEQ ID NO: 3933907 - RNA, 18 nt, Human adenovirus E
caaaucuguugagcuggg

SEQ ID NO: 3933908 - RNA, 17 nt, Human adenovirus E
caacaaaugccagcuga

SEQ ID NO: 3933909 - RNA, 16 nt, Human adenovirus E
caacaucuccuucacc

SEQ ID NO: 3933910 - RNA, 15 nt, Human adenovirus E
caaccaccccugccg

SEQ ID NO: 3933911 - RNA, 18 nt, Human adenovirus E
caaccaccccugccgccc

SEQ ID NO: 3933912 - RNA, 20 nt, Human adenovirus E
caaccacgugcgcacccuga

SEQ ID NO: 3933913 - RNA, 14 nt, Human adenovirus E
caacgaugaaguaa

SEQ ID NO: 3933914 - RNA, 15 nt, Human adenovirus E
caacuccuccuccag

SEQ ID NO: 3933915 - RNA, 15 nt, Human adenovirus E
caacucguaccuggg

SEQ ID NO: 3933916 - RNA, 16 nt, Human adenovirus E
caacucguaccugggc

SEQ ID NO: 3933917 - RNA, 19 nt, Human adenovirus E
caagaauucuugcugaaaa

SEQ ID NO: 3933918 - RNA, 15 nt, Human adenovirus E
caagacccccaaugg

SEQ ID NO: 3933919 - RNA, 14 nt, Human adenovirus E
caagagauggagga

SEQ ID NO: 3933920 - RNA, 12 nt, Human adenovirus E
caagaugagccg

SEQ ID NO: 3933921 - RNA, 20 nt, Human adenovirus E
caagaugagccgcuggaaga

SEQ ID NO: 3933922 - RNA, 13 nt, Human adenovirus E
caagcccagcacc

SEQ ID NO: 3933923 - RNA, 14 nt, Human adenovirus E
caagcccagcacca

SEQ ID NO: 3933924 - RNA, 21 nt, Human adenovirus E
caagcccgugaccuugcagca

SEQ ID NO: 3933925 - RNA, 16 nt, Human adenovirus E
caagcgccgcagcagu

SEQ ID NO: 3933926 - RNA, 20 nt, Human adenovirus E
caagcgccgcagcaguggca

SEQ ID NO: 3933927 - RNA, 17 nt, Human adenovirus E
caagcuccugcagaaga

SEQ ID NO: 3933928 - RNA, 14 nt, Human adenovirus E
caagcugcugcuca

SEQ ID NO: 3933929 - RNA, 17 nt, Human adenovirus E
caagcugcugcucaggg

SEQ ID NO: 3933930 - RNA, 19 nt, Human adenovirus E
caaggagaaggaggagagc

SEQ ID NO: 3933931 - RNA, 12 nt, Human adenovirus E
caaggaggugaa

SEQ ID NO: 3933932 - RNA, 23 nt, Human adenovirus E
caaggccauccgcggcgacgagg

SEQ ID NO: 3933933 - RNA, 18 nt, Human adenovirus E
caaggccauggcgaccag

SEQ ID NO: 3933934 - RNA, 21 nt, Human adenovirus E
caaggccgagcugucggccug

SEQ ID NO: 3933935 - RNA, 22 nt, Human adenovirus E
caaggggggucugaaacucacc

SEQ ID NO: 3933936 - RNA, 22 nt, Human adenovirus E
caaggugcggcccaucaagcag

SEQ ID NO: 3933937 - RNA, 20 nt, Human adenovirus E
caaguacggcgcggccagcc

SEQ ID NO: 3933938 - RNA, 21 nt, Human adenovirus E
caaguccuggcgggggcacaa

SEQ ID NO: 3933939 - RNA, 21 nt, Human adenovirus E
caagucuacuggucgcugccc

SEQ ID NO: 3933940 - RNA, 19 nt, Human adenovirus E
caagucuauguuggcacag

SEQ ID NO: 3933941 - RNA, 14 nt, Human adenovirus E
caaguuccggagca

SEQ ID NO: 3933942 - RNA, 15 nt, Human adenovirus E
caaucaggcagcacc

SEQ ID NO: 3933943 - RNA, 14 nt, Human adenovirus E
caauggcaccugcg

SEQ ID NO: 3933944 - RNA, 14 nt, Human adenovirus E
cacaaaauucucag

SEQ ID NO: 3933945 - RNA, 22 nt, Human adenovirus E
cacaauuacucacaccacacac

SEQ ID NO: 3933946 - RNA, 14 nt, Human adenovirus E
cacacacgcccagc

SEQ ID NO: 3933947 - RNA, 12 nt, Human adenovirus E
cacaccuggcag

SEQ ID NO: 3933948 - RNA, 16 nt, Human adenovirus E
cacacgcccagcacac

SEQ ID NO: 3933949 - RNA, 15 nt, Human adenovirus E
cacagccuugaacau

SEQ ID NO: 3933950 - RNA, 17 nt, Human adenovirus E
cacagcgcccuggucga

SEQ ID NO: 3933951 - RNA, 22 nt, Human adenovirus E
cacagcggcggcagcaggugga

SEQ ID NO: 3933952 - RNA, 19 nt, Human adenovirus E
cacaggcauaugcucaugc

SEQ ID NO: 3933953 - RNA, 15 nt, Human adenovirus E
cacagggccagcacc

SEQ ID NO: 3933954 - RNA, 23 nt, Human adenovirus E
cacaugcuuggucuugcgggguu

SEQ ID NO: 3933955 - RNA, 16 nt, Human adenovirus E
caccaacgccaccguc

SEQ ID NO: 3933956 - RNA, 16 nt, Human adenovirus E
caccaacgccauccug

SEQ ID NO: 3933957 - RNA, 21 nt, Human adenovirus E
caccaacgugcagaccaaccu

SEQ ID NO: 3933958 - RNA, 22 nt, Human adenovirus E
caccaaggccgccgccccucuc

SEQ ID NO: 3933959 - RNA, 15 nt, Human adenovirus E
caccaaucagucccg

SEQ ID NO: 3933960 - RNA, 15 nt, Human adenovirus E
caccacagcaaccuc

SEQ ID NO: 3933961 - RNA, 14 nt, Human adenovirus E
caccacagcgcccu

SEQ ID NO: 3933962 - RNA, 19 nt, Human adenovirus E
caccacagcuaccuccagu

SEQ ID NO: 3933963 - RNA, 21 nt, Human adenovirus E
caccacagcuaccuccagugc

SEQ ID NO: 3933964 - RNA, 12 nt, Human adenovirus E
caccacccagac

SEQ ID NO: 3933965 - RNA, 17 nt, Human adenovirus E
caccaccugcaucugcu

SEQ ID NO: 3933966 - RNA, 20 nt, Human adenovirus E
caccaccugcaucugcugcu

SEQ ID NO: 3933967 - RNA, 19 nt, Human adenovirus E
caccacgcugcgcccccag

SEQ ID NO: 3933968 - RNA, 17 nt, Human adenovirus E
caccagcggguccaccu

SEQ ID NO: 3933969 - RNA, 18 nt, Human adenovirus E
caccauggaggugcagac

SEQ ID NO: 3933970 - RNA, 13 nt, Human adenovirus E
cacccacgugagc

SEQ ID NO: 3933971 - RNA, 12 nt, Human adenovirus E
cacccucgcucu

SEQ ID NO: 3933972 - RNA, 18 nt, Human adenovirus E
caccgcgaguccaaccug

SEQ ID NO: 3933973 - RNA, 20 nt, Human adenovirus E
caccgcgaguccaaccuggg

SEQ ID NO: 3933974 - RNA, 20 nt, Human adenovirus E
caccgguuggggccugcgcg

SEQ ID NO: 3933975 - RNA, 22 nt, Human adenovirus E
caccguaagcagugcucaggug

SEQ ID NO: 3933976 - RNA, 23 nt, Human adenovirus E
caccgugcggugagcgccagcag

SEQ ID NO: 3933977 - RNA, 15 nt, Human adenovirus E
caccucacagcucaa

SEQ ID NO: 3933978 - RNA, 20 nt, Human adenovirus E
caccugaucccgaauaccac

SEQ ID NO: 3933979 - RNA, 18 nt, Human adenovirus E
caccugcgagcccaaccc

SEQ ID NO: 3933980 - RNA, 16 nt, Human adenovirus E
caccuggaccacugcc

SEQ ID NO: 3933981 - RNA, 22 nt, Human adenovirus E
caccuggaccacugccgccgcu

SEQ ID NO: 3933982 - RNA, 15 nt, Human adenovirus E
cacgaagcccugcag

SEQ ID NO: 3933983 - RNA, 16 nt, Human adenovirus E
cacgaagcccugcagg

SEQ ID NO: 3933984 - RNA, 18 nt, Human adenovirus E
cacgagaaccgccugggg

SEQ ID NO: 3933985 - RNA, 16 nt, Human adenovirus E
cacgaggaggagcugg

SEQ ID NO: 3933986 - RNA, 22 nt, Human adenovirus E
cacgcccagcacacgcccagaa

SEQ ID NO: 3933987 - RNA, 21 nt, Human adenovirus E
cacgccccgcaaucaccucaa

SEQ ID NO: 3933988 - RNA, 22 nt, Human adenovirus E
cacgcgcccgcgcuugcugggc

SEQ ID NO: 3933989 - RNA, 17 nt, Human adenovirus E
cacgcggggcgggagcu

SEQ ID NO: 3933990 - RNA, 13 nt, Human adenovirus E
cacgcuccagccg

SEQ ID NO: 3933991 - RNA, 16 nt, Human adenovirus E
cacggacagcggcagc

SEQ ID NO: 3933992 - RNA, 16 nt, Human adenovirus E
cacggcaaccccacgc

SEQ ID NO: 3933993 - RNA, 14 nt, Human adenovirus E
cacgggguugcagc

SEQ ID NO: 3933994 - RNA, 17 nt, Human adenovirus E
cacgguggcuuccagca

SEQ ID NO: 3933995 - RNA, 19 nt, Human adenovirus E
cacgugcgcacccugaucg

SEQ ID NO: 3933996 - RNA, 13 nt, Human adenovirus E
cacucaggcagag

SEQ ID NO: 3933997 - RNA, 18 nt, Human adenovirus E
cacucaggcagaggagga

SEQ ID NO: 3933998 - RNA, 23 nt, Human adenovirus E
cacuccgagacgaaagcccgggu

SEQ ID NO: 3933999 - RNA, 23 nt, Human adenovirus E
cacucucucagaccgugcagcag

SEQ ID NO: 3934000 - RNA, 14 nt, Human adenovirus E
cacuggcagcccag

SEQ ID NO: 3934001 - RNA, 23 nt, Human adenovirus E
cacuuagcauuaccacacagaca

SEQ ID NO: 3934002 - RNA, 19 nt, Human adenovirus E
cacuuccgcgcucccuggg

SEQ ID NO: 3934003 - RNA, 15 nt, Human adenovirus E
cagaaaaugaugcaa

SEQ ID NO: 3934004 - RNA, 22 nt, Human adenovirus E
cagaaccugaaagagcucugca

SEQ ID NO: 3934005 - RNA, 17 nt, Human adenovirus E
cagaacggggugcugga

SEQ ID NO: 3934006 - RNA, 15 nt, Human adenovirus E
cagaacgugcugcac

SEQ ID NO: 3934007 - RNA, 18 nt, Human adenovirus E
cagaagcacacagcucaa

SEQ ID NO: 3934008 - RNA, 17 nt, Human adenovirus E
cagaccagucgccaggg

SEQ ID NO: 3934009 - RNA, 16 nt, Human adenovirus E
cagaccgagcccauga

SEQ ID NO: 3934010 - RNA, 16 nt, Human adenovirus E
cagaccgugcagcaga

SEQ ID NO: 3934011 - RNA, 16 nt, Human adenovirus E
cagaccuaccaggaga

SEQ ID NO: 3934012 - RNA, 19 nt, Human adenovirus E
cagaccucggcgcgagcgg

SEQ ID NO: 3934013 - RNA, 19 nt, Human adenovirus E
cagacggaucccuggaugc

SEQ ID NO: 3934014 - RNA, 20 nt, Human adenovirus E
cagagaaugagcagagucag

SEQ ID NO: 3934015 - RNA, 16 nt, Human adenovirus E
cagagacaggagcggc

SEQ ID NO: 3934016 - RNA, 20 nt, Human adenovirus E
cagagcaucguggugcagga

SEQ ID NO: 3934017 - RNA, 11 nt, Human adenovirus E
cagagccagcc

SEQ ID NO: 3934018 - RNA, 22 nt, Human adenovirus E
cagaggaggacagccugcaaga

SEQ ID NO: 3934019 - RNA, 19 nt, Human adenovirus E
cagaggaggaggagaugga

SEQ ID NO: 3934020 - RNA, 18 nt, Human adenovirus E
cagaggagggacuugagg

SEQ ID NO: 3934021 - RNA, 21 nt, Human adenovirus E
cagaggcgcucuaucucccgc

SEQ ID NO: 3934022 - RNA, 15 nt, Human adenovirus E
cagagguugccagcu

SEQ ID NO: 3934023 - RNA, 22 nt, Human adenovirus E
cagauaaaccgaaguccucccc

SEQ ID NO: 3934024 - RNA, 14 nt, Human adenovirus E
cagauccucaggua

SEQ ID NO: 3934025 - RNA, 16 nt, Human adenovirus E
cagaucguccagggca

SEQ ID NO: 3934026 - RNA, 16 nt, Human adenovirus E
cagaugaaaagggacg

SEQ ID NO: 3934027 - RNA, 15 nt, Human adenovirus E
cagaugcgcccccac

SEQ ID NO: 3934028 - RNA, 15 nt, Human adenovirus E
cagcaaagccuccac

SEQ ID NO: 3934029 - RNA, 14 nt, Human adenovirus E
cagcaaccugcugg

SEQ ID NO: 3934030 - RNA, 15 nt, Human adenovirus E
cagcaaccugcuggg

SEQ ID NO: 3934031 - RNA, 20 nt, Human adenovirus E
cagcaacuuccagccacgac

SEQ ID NO: 3934032 - RNA, 23 nt, Human adenovirus E
cagcaaggcguggaacagcacca

SEQ ID NO: 3934033 - RNA, 14 nt, Human adenovirus E
cagcacacaacagg

SEQ ID NO: 3934034 - RNA, 18 nt, Human adenovirus E
cagcaccaggcaggccac

SEQ ID NO: 3934035 - RNA, 12 nt, Human adenovirus E
cagcacccagac

SEQ ID NO: 3934036 - RNA, 14 nt, Human adenovirus E
cagcacccagcccg

SEQ ID NO: 3934037 - RNA, 17 nt, Human adenovirus E
cagcaccgaggaggagc

SEQ ID NO: 3934038 - RNA, 15 nt, Human adenovirus E
cagcacucaggcaga

SEQ ID NO: 3934039 - RNA, 23 nt, Human adenovirus E
cagcagagucgggggcaggagca

SEQ ID NO: 3934040 - RNA, 21 nt, Human adenovirus E
cagcagcacacaacaggcgca

SEQ ID NO: 3934041 - RNA, 22 nt, Human adenovirus E
cagcagcacacaacaggcgcaa

SEQ ID NO: 3934042 - RNA, 16 nt, Human adenovirus E
cagcagccccaggcca

SEQ ID NO: 3934043 - RNA, 16 nt, Human adenovirus E
cagcagcgagcugggc

SEQ ID NO: 3934044 - RNA, 14 nt, Human adenovirus E
cagcagucaggcag

SEQ ID NO: 3934045 - RNA, 17 nt, Human adenovirus E
cagcagucaggcagagg

SEQ ID NO: 3934046 - RNA, 18 nt, Human adenovirus E
cagcagucaggcagagga

SEQ ID NO: 3934047 - RNA, 20 nt, Human adenovirus E
cagcagucgcugccgccgcc

SEQ ID NO: 3934048 - RNA, 17 nt, Human adenovirus E
cagcagugucuggagga

SEQ ID NO: 3934049 - RNA, 21 nt, Human adenovirus E
cagcagugucuggaggagcag

SEQ ID NO: 3934050 - RNA, 22 nt, Human adenovirus E
cagcaucaucugggccuggucg

SEQ ID NO: 3934051 - RNA, 20 nt, Human adenovirus E
cagccaacugaacgggggcg

SEQ ID NO: 3934052 - RNA, 21 nt, Human adenovirus E
cagccacagcgcgcacccggu

SEQ ID NO: 3934053 - RNA, 14 nt, Human adenovirus E
cagccagagcagga

SEQ ID NO: 3934054 - RNA, 16 nt, Human adenovirus E
cagcccaauggcaccu

SEQ ID NO: 3934055 - RNA, 19 nt, Human adenovirus E
cagcccccuccacagccgg

SEQ ID NO: 3934056 - RNA, 14 nt, Human adenovirus E
cagccccgccaccu

SEQ ID NO: 3934057 - RNA, 22 nt, Human adenovirus E
cagcccgauggcaaucggugcg

SEQ ID NO: 3934058 - RNA, 15 nt, Human adenovirus E
cagcccgccaacgug

SEQ ID NO: 3934059 - RNA, 12 nt, Human adenovirus E
cagccgccgcca

SEQ ID NO: 3934060 - RNA, 15 nt, Human adenovirus E
cagccggagccgcuu

SEQ ID NO: 3934061 - RNA, 22 nt, Human adenovirus E
cagcgaucccauuugagcugga

SEQ ID NO: 3934062 - RNA, 21 nt, Human adenovirus E
cagcgcacucucgaggacgcc

SEQ ID NO: 3934063 - RNA, 15 nt, Human adenovirus E
cagcgcagccagggu

SEQ ID NO: 3934064 - RNA, 14 nt, Human adenovirus E
cagcgcccuggucg

SEQ ID NO: 3934065 - RNA, 21 nt, Human adenovirus E
cagcgcccuggucgaguugga

SEQ ID NO: 3934066 - RNA, 21 nt, Human adenovirus E
cagcgccggcaggacccggag

SEQ ID NO: 3934067 - RNA, 12 nt, Human adenovirus E
cagcgcgagcgg

SEQ ID NO: 3934068 - RNA, 17 nt, Human adenovirus E
agaacggggugcuggag

SEQ ID NO: 3934069 - RNA, 20 nt, Human adenovirus E
agaaggccgaucccugcuug

SEQ ID NO: 3934070 - RNA, 17 nt, Human adenovirus E
agaccgugaaccugagc

SEQ ID NO: 3934071 - RNA, 16 nt, Human adenovirus E
agaccgugcagcagau

SEQ ID NO: 3934072 - RNA, 18 nt, Human adenovirus E
agacgccgcaccugcccc

SEQ ID NO: 3934073 - RNA, 21 nt, Human adenovirus E
agacgcgcggccacggcggcg

SEQ ID NO: 3934074 - RNA, 18 nt, Human adenovirus E
agacguaugcgcaggagc

SEQ ID NO: 3934075 - RNA, 23 nt, Human adenovirus E
agacugauggccacgggcagccc

SEQ ID NO: 3934076 - RNA, 13 nt, Human adenovirus E
agagacaggagcg

SEQ ID NO: 3934077 - RNA, 13 nt, Human adenovirus E
agagcgacaucgg

SEQ ID NO: 3934078 - RNA, 16 nt, Human adenovirus E
agagcgcccuccaccg

SEQ ID NO: 3934079 - RNA, 20 nt, Human adenovirus E
agagcgugaugcagcaggcg

SEQ ID NO: 3934080 - RNA, 18 nt, Human adenovirus E
agagggcgaggggcuggc

SEQ ID NO: 3934081 - RNA, 15 nt, Human adenovirus E
agagguucccaagau

SEQ ID NO: 3934082 - RNA, 22 nt, Human adenovirus E
agaucuucgagggucugggcag

SEQ ID NO: 3934083 - RNA, 16 nt, Human adenovirus E
agaugccgggcaggag

SEQ ID NO: 3934084 - RNA, 14 nt, Human adenovirus E
agauggagccauag

SEQ ID NO: 3934085 - RNA, 17 nt, Human adenovirus E
agauggauuccaagaga

SEQ ID NO: 3934086 - RNA, 15 nt, Human adenovirus E
agauggcaccucucg

SEQ ID NO: 3934087 - RNA, 14 nt, Human adenovirus E
agauguugaagugg

SEQ ID NO: 3934088 - RNA, 15 nt, Human adenovirus E
agcaagcagcacgga

SEQ ID NO: 3934089 - RNA, 14 nt, Human adenovirus E
agcaagcuccagcu

SEQ ID NO: 3934090 - RNA, 24 nt, Human adenovirus E
agcacaggcauaugcucaugcauc

SEQ ID NO: 3934091 - RNA, 17 nt, Human adenovirus E
agcaccaggcaggccac

SEQ ID NO: 3934092 - RNA, 18 nt, Human adenovirus E
agcacccucagggcccgg

SEQ ID NO: 3934093 - RNA, 14 nt, Human adenovirus E
agcaccgaggagga

SEQ ID NO: 3934094 - RNA, 17 nt, Human adenovirus E
agcaccgggugauccuc

SEQ ID NO: 3934095 - RNA, 19 nt, Human adenovirus E
  misc_feature (9)..(9): n is a, c, g or u
agcacgaangaggccacgu

SEQ ID NO: 3934096 - RNA, 13 nt, Human adenovirus E
agcacucaggcag

SEQ ID NO: 3934097 - RNA, 19 nt, Human adenovirus E
agcagaaaaagaccagcag

SEQ ID NO: 3934098 - RNA, 17 nt, Human adenovirus E
agcagaaaaccagcagc

SEQ ID NO: 3934099 - RNA, 18 nt, Human adenovirus E
agcagaagcgugggccug

SEQ ID NO: 3934100 - RNA, 19 nt, Human adenovirus E
agcagagguugccagcucg

SEQ ID NO: 3934101 - RNA, 19 nt, Human adenovirus E
agcagaucuagggccucag

SEQ ID NO: 3934102 - RNA, 23 nt, Human adenovirus E
agcagcaacuuccagccacgacc

SEQ ID NO: 3934103 - RNA, 22 nt, Human adenovirus E
agcagcacggauaccaucuccg

SEQ ID NO: 3934104 - RNA, 11 nt, Human adenovirus E
agcagccgccg

SEQ ID NO: 3934105 - RNA, 14 nt, Human adenovirus E
agcagccgccgcca

SEQ ID NO: 3934106 - RNA, 13 nt, Human adenovirus E
agcagccgcggcc

SEQ ID NO: 3934107 - RNA, 14 nt, Human adenovirus E
agcagcuggcccgg

SEQ ID NO: 3934108 - RNA, 15 nt, Human adenovirus E
agcagcuggcccggu

SEQ ID NO: 3934109 - RNA, 14 nt, Human adenovirus E
agcaggggcgcagg

SEQ ID NO: 3934110 - RNA, 17 nt, Human adenovirus E
agcaggucgggcgcgga

SEQ ID NO: 3934111 - RNA, 20 nt, Human adenovirus E
agcagucaggcagaggagga

SEQ ID NO: 3934112 - RNA, 18 nt, Human adenovirus E
agcagugucuggaggagc

SEQ ID NO: 3934113 - RNA, 19 nt, Human adenovirus E
agcaucaucugggccuggu

SEQ ID NO: 3934114 - RNA, 14 nt, Human adenovirus E
agccacaguacaga

SEQ ID NO: 3934115 - RNA, 14 nt, Human adenovirus E
agccacucucucag

SEQ ID NO: 3934116 - RNA, 15 nt, Human adenovirus E
agccagaugaugcaa

SEQ ID NO: 3934117 - RNA, 18 nt, Human adenovirus E
agccagccaugauaaaga

SEQ ID NO: 3934118 - RNA, 18 nt, Human adenovirus E
agcccacggccgccagcu

SEQ ID NO: 3934119 - RNA, 19 nt, Human adenovirus E
agcccacggccgccagcuc

SEQ ID NO: 3934120 - RNA, 20 nt, Human adenovirus E
agcccccgcuggaggcuccu

SEQ ID NO: 3934121 - RNA, 17 nt, Human adenovirus E
agcccgagggccgcugg

SEQ ID NO: 3934122 - RNA, 19 nt, Human adenovirus E
agcccgccaacgugccccg

SEQ ID NO: 3934123 - RNA, 22 nt, Human adenovirus E
agcccgugcugcucgagcgccc

SEQ ID NO: 3934124 - RNA, 18 nt, Human adenovirus E
agccgccgggccuuggag

SEQ ID NO: 3934125 - RNA, 20 nt, Human adenovirus E
agccgcgcccugggccagga

SEQ ID NO: 3934126 - RNA, 18 nt, Human adenovirus E
agccuccacgcgcacauc

SEQ ID NO: 3934127 - RNA, 18 nt, Human adenovirus E
agccuggcgaacaggugg

SEQ ID NO: 3934128 - RNA, 19 nt, Human adenovirus E
agccuuguugcgcagggcc

SEQ ID NO: 3934129 - RNA, 14 nt, Human adenovirus E
agccuuuagacagc

SEQ ID NO: 3934130 - RNA, 16 nt, Human adenovirus E
agcgcaugcggaucuc

SEQ ID NO: 3934131 - RNA, 16 nt, Human adenovirus E
agcgccacugagacac

SEQ ID NO: 3934132 - RNA, 16 nt, Human adenovirus E
agcgccgcgcucgaca

SEQ ID NO: 3934133 - RNA, 19 nt, Human adenovirus E
agcgcgcgucgcccaucuc

SEQ ID NO: 3934134 - RNA, 23 nt, Human adenovirus E
agcgcuagcagccgcggccaggg

SEQ ID NO: 3934135 - RNA, 14 nt, Human adenovirus E
agcgcucaccgcca

SEQ ID NO: 3934136 - RNA, 15 nt, Human adenovirus E
agcgcucgcgguggg

SEQ ID NO: 3934137 - RNA, 21 nt, Human adenovirus E
agcggcacccgcgcgugcaga

SEQ ID NO: 3934138 - RNA, 17 nt, Human adenovirus E
agcggcgagggccugcu

SEQ ID NO: 3934139 - RNA, 14 nt, Human adenovirus E
agcggcggcggaga

SEQ ID NO: 3934140 - RNA, 21 nt, Human adenovirus E
agcggcucgacuccguggccu

SEQ ID NO: 3934141 - RNA, 22 nt, Human adenovirus E
agcggcucgacuccguggccug

SEQ ID NO: 3934142 - RNA, 12 nt, Human adenovirus E
agcggggcugga

SEQ ID NO: 3934143 - RNA, 21 nt, Human adenovirus E
agcgguguccggggcugcuag

SEQ ID NO: 3934144 - RNA, 15 nt, Human adenovirus E
agcucaaccccggcu

SEQ ID NO: 3934145 - RNA, 15 nt, Human adenovirus E
agcucagccgcgccu

SEQ ID NO: 3934146 - RNA, 17 nt, Human adenovirus E
agcucugcaagcuccug

SEQ ID NO: 3934147 - RNA, 19 nt, Human adenovirus E
agcucuucgcugggucugc

SEQ ID NO: 3934148 - RNA, 18 nt, Human adenovirus E
agcugaccuagcucggcu

SEQ ID NO: 3934149 - RNA, 18 nt, Human adenovirus E
agcugauggugcccaagc

SEQ ID NO: 3934150 - RNA, 20 nt, Human adenovirus E
agcugccgcccguggaggau

SEQ ID NO: 3934151 - RNA, 16 nt, Human adenovirus E
agcugcugcucagggg

SEQ ID NO: 3934152 - RNA, 15 nt, Human adenovirus E
agcuggagggcgaga

SEQ ID NO: 3934153 - RNA, 13 nt, Human adenovirus E
agcuggagugccu

SEQ ID NO: 3934154 - RNA, 14 nt, Human adenovirus E
agcuggccuuggaa

SEQ ID NO: 3934155 - RNA, 22 nt, Human adenovirus E
agcuugccauucgcgcacggcc

SEQ ID NO: 3934156 - RNA, 12 nt, Human adenovirus E
agcuugguggcg

SEQ ID NO: 3934157 - RNA, 14 nt, Human adenovirus E
aggaagagaugcuc

SEQ ID NO: 3934158 - RNA, 17 nt, Human adenovirus E
aggacccggagacgcgc

SEQ ID NO: 3934159 - RNA, 17 nt, Human adenovirus E
aggacgucagcggcgag

SEQ ID NO: 3934160 - RNA, 21 nt, Human adenovirus E
aggacgucagcggcgagggcc

SEQ ID NO: 3934161 - RNA, 14 nt, Human adenovirus E
aggagaaccugcac

SEQ ID NO: 3934162 - RNA, 16 nt, Human adenovirus E
aggagaugcgcgcggc

SEQ ID NO: 3934163 - RNA, 14 nt, Human adenovirus E
aggagauggaggaa

SEQ ID NO: 3934164 - RNA, 17 nt, Human adenovirus E
aggagcacccucagggc

SEQ ID NO: 3934165 - RNA, 16 nt, Human adenovirus E
aggagcagaaccugaa

SEQ ID NO: 3934166 - RNA, 22 nt, Human adenovirus E
  misc_feature (11)..(11): n is a, c, g or u
aggagccguanagggcguugga

SEQ ID NO: 3934167 - RNA, 17 nt, Human adenovirus E
aggagcucaaccccggc

SEQ ID NO: 3934168 - RNA, 14 nt, Human adenovirus E
aggagcuggcagug

SEQ ID NO: 3934169 - RNA, 23 nt, Human adenovirus E
aggaggagauggaggaagacugg

SEQ ID NO: 3934170 - RNA, 14 nt, Human adenovirus E
aggaugagcugaag

SEQ ID NO: 3934171 - RNA, 18 nt, Human adenovirus E
aggaugcagcagcugaag

SEQ ID NO: 3934172 - RNA, 22 nt, Human adenovirus E
aggcacacgcacuaccaccacu

SEQ ID NO: 3934173 - RNA, 23 nt, Human adenovirus E
aggcacuacaaugcucagucuca

SEQ ID NO: 3934174 - RNA, 17 nt, Human adenovirus E
aggccaucggccaggcg

SEQ ID NO: 3934175 - RNA, 22 nt, Human adenovirus E
aggccaucgugcagaaccccac

SEQ ID NO: 3934176 - RNA, 12 nt, Human adenovirus E
aggcccuggcca

SEQ ID NO: 3934177 - RNA, 19 nt, Human adenovirus E
aggccgaaguccagcugac

SEQ ID NO: 3934178 - RNA, 14 nt, Human adenovirus E
aggccgagccacag

SEQ ID NO: 3934179 - RNA, 10 nt, Human adenovirus E
aggccgccgc

SEQ ID NO: 3934180 - RNA, 19 nt, Human adenovirus E
aggccgccgccccucucag

SEQ ID NO: 3934181 - RNA, 20 nt, Human adenovirus E
aggcgaggguucagccgcca

SEQ ID NO: 3934182 - RNA, 21 nt, Human adenovirus E
aggcgcucgccaacgcuccac

SEQ ID NO: 3934183 - RNA, 21 nt, Human adenovirus E
aggcguccgcccuugcgcgag

SEQ ID NO: 3934184 - RNA, 14 nt, Human adenovirus E
aggcguggaacagc

SEQ ID NO: 3934185 - RNA, 15 nt, Human adenovirus E
caaguuccggagcag

SEQ ID NO: 3934186 - RNA, 16 nt, Human adenovirus E
caaguuucuccaccau

SEQ ID NO: 3934187 - RNA, 13 nt, Human adenovirus E
caauaacaaaaaa

SEQ ID NO: 3934188 - RNA, 20 nt, Human adenovirus E
caaucccauccgcccaaggc

SEQ ID NO: 3934189 - RNA, 22 nt, Human adenovirus E
caaugccaccucagcucaaaau

SEQ ID NO: 3934190 - RNA, 22 nt, Human adenovirus E
caaugguacugaugacagcaac

SEQ ID NO: 3934191 - RNA, 17 nt, Human adenovirus E
cacaauuacucacacca

SEQ ID NO: 3934192 - RNA, 14 nt, Human adenovirus E
cacaccaccacagc

SEQ ID NO: 3934193 - RNA, 18 nt, Human adenovirus E
cacacgcacuaccaccac

SEQ ID NO: 3934194 - RNA, 12 nt, Human adenovirus E
cacacugguggc

SEQ ID NO: 3934195 - RNA, 13 nt, Human adenovirus E
cacagacugaacg

SEQ ID NO: 3934196 - RNA, 19 nt, Human adenovirus E
cacagaucaaaccgcagca

SEQ ID NO: 3934197 - RNA, 20 nt, Human adenovirus E
cacagaucugcaucucccag

SEQ ID NO: 3934198 - RNA, 24 nt, Human adenovirus E
cacagcaaccucaggcacacgcac

SEQ ID NO: 3934199 - RNA, 12 nt, Human adenovirus E
cacagcacaggc

SEQ ID NO: 3934200 - RNA, 14 nt, Human adenovirus E
cacagcacaggcau

SEQ ID NO: 3934201 - RNA, 15 nt, Human adenovirus E
cacaucguaggugag

SEQ ID NO: 3934202 - RNA, 15 nt, Human adenovirus E
caccaacgccauccu

SEQ ID NO: 3934203 - RNA, 17 nt, Human adenovirus E
caccaacgugcagacca

SEQ ID NO: 3934204 - RNA, 22 nt, Human adenovirus E
caccaacuucaucagcgcccug

SEQ ID NO: 3934205 - RNA, 18 nt, Human adenovirus E
caccaagaacagccagag

SEQ ID NO: 3934206 - RNA, 19 nt, Human adenovirus E
caccaagaacagccagagc

SEQ ID NO: 3934207 - RNA, 20 nt, Human adenovirus E
caccaaggccgccgccccuc

SEQ ID NO: 3934208 - RNA, 21 nt, Human adenovirus E
caccacgcugcgcccccagcg

SEQ ID NO: 3934209 - RNA, 13 nt, Human adenovirus E
caccacuacagca

SEQ ID NO: 3934210 - RNA, 16 nt, Human adenovirus E
caccacuacagcagca

SEQ ID NO: 3934211 - RNA, 19 nt, Human adenovirus E
caccagcaagccgcugacg

SEQ ID NO: 3934212 - RNA, 14 nt, Human adenovirus E
caccaggcaggcca

SEQ ID NO: 3934213 - RNA, 12 nt, Human adenovirus E
caccaucaucuu

SEQ ID NO: 3934214 - RNA, 14 nt, Human adenovirus E
cacccaucaucaug

SEQ ID NO: 3934215 - RNA, 18 nt, Human adenovirus E
cacccccacggaggccag

SEQ ID NO: 3934216 - RNA, 12 nt, Human adenovirus E
cacccgccccgc

SEQ ID NO: 3934217 - RNA, 17 nt, Human adenovirus E
cacccgugcagccacag

SEQ ID NO: 3934218 - RNA, 23 nt, Human adenovirus E
cacccucugguugaacaugcagc

SEQ ID NO: 3934219 - RNA, 19 nt, Human adenovirus E
cacccugcaugccaacccu

SEQ ID NO: 3934220 - RNA, 15 nt, Human adenovirus E
caccgagagccgccu

SEQ ID NO: 3934221 - RNA, 23 nt, Human adenovirus E
caccgcuaucgugugccugagca

SEQ ID NO: 3934222 - RNA, 22 nt, Human adenovirus E
caccggcauucuuaagcacacc

SEQ ID NO: 3934223 - RNA, 21 nt, Human adenovirus E
caccguggaaugggccagacc

SEQ ID NO: 3934224 - RNA, 16 nt, Human adenovirus E
caccuccacagccccu

SEQ ID NO: 3934225 - RNA, 14 nt, Human adenovirus E
caccucgcccugcu

SEQ ID NO: 3934226 - RNA, 18 nt, Human adenovirus E
caccucgcuuacgcacgu

SEQ ID NO: 3934227 - RNA, 21 nt, Human adenovirus E
caccugauccaucaccaaacu

SEQ ID NO: 3934228 - RNA, 17 nt, Human adenovirus E
caccugcaucugcugcu

SEQ ID NO: 3934229 - RNA, 19 nt, Human adenovirus E
caccugcuccgcgcugccc

SEQ ID NO: 3934230 - RNA, 22 nt, Human adenovirus E
caccuggacaaaauaccaccuc

SEQ ID NO: 3934231 - RNA, 16 nt, Human adenovirus E
cacgaccgccgcggcc

SEQ ID NO: 3934232 - RNA, 22 nt, Human adenovirus E
cacgagaaccgccuggggcaga

SEQ ID NO: 3934233 - RNA, 17 nt, Human adenovirus E
cacgaggaggagcuggc

SEQ ID NO: 3934234 - RNA, 13 nt, Human adenovirus E
cacgcccagcaca

SEQ ID NO: 3934235 - RNA, 14 nt, Human adenovirus E
cacgccgcaccgcu

SEQ ID NO: 3934236 - RNA, 23 nt, Human adenovirus E
cacgccuagaaugaccacaacca

SEQ ID NO: 3934237 - RNA, 14 nt, Human adenovirus E
cacgcucgccagca

SEQ ID NO: 3934238 - RNA, 19 nt, Human adenovirus E
cacggauaccaucuccgcu

SEQ ID NO: 3934239 - RNA, 14 nt, Human adenovirus E
cacggcccucagca

SEQ ID NO: 3934240 - RNA, 23 nt, Human adenovirus E
cacgguggcuuccagcaaagccu

SEQ ID NO: 3934241 - RNA, 20 nt, Human adenovirus E
cacuaccaccacuacagccu

SEQ ID NO: 3934242 - RNA, 15 nt, Human adenovirus E
cacucaacccacccc

SEQ ID NO: 3934243 - RNA, 19 nt, Human adenovirus E
cacuccccucuucccagcu

SEQ ID NO: 3934244 - RNA, 17 nt, Human adenovirus E
cacugcuaccugcugcg

SEQ ID NO: 3934245 - RNA, 17 nt, Human adenovirus E
cacuggcucccgccgcc

SEQ ID NO: 3934246 - RNA, 17 nt, Human adenovirus E
cacuguaucccacccug

SEQ ID NO: 3934247 - RNA, 21 nt, Human adenovirus E
cacuuagcauuaccacacaga

SEQ ID NO: 3934248 - RNA, 17 nt, Human adenovirus E
cacuucacuccccucuu

SEQ ID NO: 3934249 - RNA, 17 nt, Human adenovirus E
cagaaaaagccacagaa

SEQ ID NO: 3934250 - RNA, 12 nt, Human adenovirus E
cagaacagggca

SEQ ID NO: 3934251 - RNA, 17 nt, Human adenovirus E
cagaaccccaccagcaa

SEQ ID NO: 3934252 - RNA, 18 nt, Human adenovirus E
cagaaccugaaagagcuc

SEQ ID NO: 3934253 - RNA, 21 nt, Human adenovirus E
cagaaccuguucagagacagg

SEQ ID NO: 3934254 - RNA, 15 nt, Human adenovirus E
cagaacgaccacagc

SEQ ID NO: 3934255 - RNA, 19 nt, Human adenovirus E
cagaacgugcugcacacca

SEQ ID NO: 3934256 - RNA, 14 nt, Human adenovirus E
cagaacuuccagca

SEQ ID NO: 3934257 - RNA, 21 nt, Human adenovirus E
cagaagagcggcggugggaau

SEQ ID NO: 3934258 - RNA, 18 nt, Human adenovirus E
cagaagcaagcuccagcu

SEQ ID NO: 3934259 - RNA, 17 nt, Human adenovirus E
cagaaggggggcagggg

SEQ ID NO: 3934260 - RNA, 23 nt, Human adenovirus E
  misc_feature (7)..(7): n is a, c, g or u
cagaagnuggaagacgugcugga

SEQ ID NO: 3934261 - RNA, 20 nt, Human adenovirus E
cagaccgugaaggaggagag

SEQ ID NO: 3934262 - RNA, 22 nt, Human adenovirus E
cagacgcgcggcuucaggcgcc

SEQ ID NO: 3934263 - RNA, 20 nt, Human adenovirus E
cagacggcggcaugcaaugg

SEQ ID NO: 3934264 - RNA, 12 nt, Human adenovirus E
cagacggucccg

SEQ ID NO: 3934265 - RNA, 14 nt, Human adenovirus E
cagagacaggagcg

SEQ ID NO: 3934266 - RNA, 15 nt, Human adenovirus E
cagagacaggagcgg

SEQ ID NO: 3934267 - RNA, 20 nt, Human adenovirus E
cagagauccacggccagggc

SEQ ID NO: 3934268 - RNA, 15 nt, Human adenovirus E
cagagcaggaagcag

SEQ ID NO: 3934269 - RNA, 16 nt, Human adenovirus E
cagagcaucguggugc

SEQ ID NO: 3934270 - RNA, 15 nt, Human adenovirus E
cagagccccuuccgc

SEQ ID NO: 3934271 - RNA, 16 nt, Human adenovirus E
cagagcucggugaugu

SEQ ID NO: 3934272 - RNA, 11 nt, Human adenovirus E
cagagcuggaa

SEQ ID NO: 3934273 - RNA, 15 nt, Human adenovirus E
cagaggaggacagcc

SEQ ID NO: 3934274 - RNA, 21 nt, Human adenovirus E
cagagguugccagcucgucug

SEQ ID NO: 3934275 - RNA, 22 nt, Human adenovirus E
cagagucgggggcaggagcagg

SEQ ID NO: 3934276 - RNA, 16 nt, Human adenovirus E
cagaugcggcgguaca

SEQ ID NO: 3934277 - RNA, 16 nt, Human adenovirus E
cagaugggccuggccg

SEQ ID NO: 3934278 - RNA, 17 nt, Human adenovirus E
cagaugggccuggccgc

SEQ ID NO: 3934279 - RNA, 20 nt, Human adenovirus E
cagaugugggacgaugagga

SEQ ID NO: 3934280 - RNA, 22 nt, Human adenovirus E
cagcaacuuccugaccaccgug

SEQ ID NO: 3934281 - RNA, 15 nt, Human adenovirus E
cagcaaggcguggaa

SEQ ID NO: 3934282 - RNA, 11 nt, Human adenovirus E
cagcacaggca

SEQ ID NO: 3934283 - RNA, 19 nt, Human adenovirus E
cagcaccauggaggugcag

SEQ ID NO: 3934284 - RNA, 14 nt, Human adenovirus E
cagcaccgccccgc

SEQ ID NO: 3934285 - RNA, 20 nt, Human adenovirus E
cagcaccgccccgcccgcca

SEQ ID NO: 3934286 - RNA, 14 nt, Human adenovirus E
cagcacucaggcag

SEQ ID NO: 3934287 - RNA, 18 nt, Human adenovirus E
cagcacucaggcagagga

SEQ ID NO: 3934288 - RNA, 19 nt, Human adenovirus E
cagcacucucaacuccucg

SEQ ID NO: 3934289 - RNA, 18 nt, Human adenovirus E
cagcagaaaaccagcagc

SEQ ID NO: 3934290 - RNA, 20 nt, Human adenovirus E
cagcagaaaaccagcagcua

SEQ ID NO: 3934291 - RNA, 19 nt, Human adenovirus E
cagcagagucgggggcagg

SEQ ID NO: 3934292 - RNA, 22 nt, Human adenovirus E
cagcagcugaagcaacugcagc

SEQ ID NO: 3934293 - RNA, 15 nt, Human adenovirus E
cagcaguggcagcgg

SEQ ID NO: 3934294 - RNA, 22 nt, Human adenovirus E
cagcagugucuggaggagcaga

SEQ ID NO: 3934295 - RNA, 17 nt, Human adenovirus E
cagcaguuugggcagcg

SEQ ID NO: 3934296 - RNA, 21 nt, Human adenovirus E
cagcaugucccgcccgcggcg

SEQ ID NO: 3934297 - RNA, 14 nt, Human adenovirus E
cagccaccuccuga

SEQ ID NO: 3934298 - RNA, 17 nt, Human adenovirus E
cagccagagcaggaagc

SEQ ID NO: 3934299 - RNA, 17 nt, Human adenovirus E
cagccaucgccaaccuc

SEQ ID NO: 3934300 - RNA, 13 nt, Human adenovirus E
cagccccggauga

SEQ ID NO: 3934301 - RNA, 19 nt, Human adenovirus E
ccacagcuaccuccagugc

SEQ ID NO: 3934302 - RNA, 12 nt, Human adenovirus E
ccacaguacaga

SEQ ID NO: 3934303 - RNA, 16 nt, Human adenovirus E
ccacaucacccucugg

SEQ ID NO: 3934304 - RNA, 23 nt, Human adenovirus E
ccaccacagcaaccucaggcaca

SEQ ID NO: 3934305 - RNA, 18 nt, Human adenovirus E
ccaccacccccaguaccg

SEQ ID NO: 3934306 - RNA, 15 nt, Human adenovirus E
ccaccaugcagcuga

SEQ ID NO: 3934307 - RNA, 23 nt, Human adenovirus E
ccacccgcagaagcaagcuccag

SEQ ID NO: 3934308 - RNA, 13 nt, Human adenovirus E
ccacccucccagg

SEQ ID NO: 3934309 - RNA, 16 nt, Human adenovirus E
ccaccuaccacaucuu

SEQ ID NO: 3934310 - RNA, 12 nt, Human adenovirus E
ccaccuccugau

SEQ ID NO: 3934311 - RNA, 12 nt, Human adenovirus E
ccaccugcaucu

SEQ ID NO: 3934312 - RNA, 22 nt, Human adenovirus E
ccacgagcgccagcuguugggg

SEQ ID NO: 3934313 - RNA, 22 nt, Human adenovirus E
ccacgcggggcgggagcugcgg

SEQ ID NO: 3934314 - RNA, 12 nt, Human adenovirus E
ccacggagccca

SEQ ID NO: 3934315 - RNA, 16 nt, Human adenovirus E
ccacggcccucagcau

SEQ ID NO: 3934316 - RNA, 17 nt, Human adenovirus E
ccacggcccucagcauc

SEQ ID NO: 3934317 - RNA, 14 nt, Human adenovirus E
ccacggcggcggca

SEQ ID NO: 3934318 - RNA, 18 nt, Human adenovirus E
ccacgguggcuuccagca

SEQ ID NO: 3934319 - RNA, 19 nt, Human adenovirus E
ccacgugagccgcgcccug

SEQ ID NO: 3934320 - RNA, 20 nt, Human adenovirus E
ccacgugcgcacccugaucg

SEQ ID NO: 3934321 - RNA, 15 nt, Human adenovirus E
ccacuaugcagcuca

SEQ ID NO: 3934322 - RNA, 16 nt, Human adenovirus E
ccacuaugcagcucac

SEQ ID NO: 3934323 - RNA, 22 nt, Human adenovirus E
ccacugccgcugcaaccucugc

SEQ ID NO: 3934324 - RNA, 19 nt, Human adenovirus E
ccacugucgagagccacac

SEQ ID NO: 3934325 - RNA, 14 nt, Human adenovirus E
ccagacgccgcacc

SEQ ID NO: 3934326 - RNA, 14 nt, Human adenovirus E
ccagacgcgcggcu

SEQ ID NO: 3934327 - RNA, 18 nt, Human adenovirus E
ccagacgcgcggcuucag

SEQ ID NO: 3934328 - RNA, 21 nt, Human adenovirus E
ccagaucauguacgaggaucu

SEQ ID NO: 3934329 - RNA, 16 nt, Human adenovirus E
ccagcaccagcaccau

SEQ ID NO: 3934330 - RNA, 18 nt, Human adenovirus E
ccagcagcaacuuccagc

SEQ ID NO: 3934331 - RNA, 23 nt, Human adenovirus E
ccagcaggcggcgcgagcugagc

SEQ ID NO: 3934332 - RNA, 18 nt, Human adenovirus E
ccagcccacgaccguacu

SEQ ID NO: 3934333 - RNA, 17 nt, Human adenovirus E
ccagccgccgggccuug

SEQ ID NO: 3934334 - RNA, 14 nt, Human adenovirus E
ccagcugcaccacg

SEQ ID NO: 3934335 - RNA, 23 nt, Human adenovirus E
ccaggacauggaauacaccaccc

SEQ ID NO: 3934336 - RNA, 19 nt, Human adenovirus E
ccaggcggucccagagcuc

SEQ ID NO: 3934337 - RNA, 16 nt, Human adenovirus E
ccagggcgcgcgggag

SEQ ID NO: 3934338 - RNA, 21 nt, Human adenovirus E
ccagggggcgauccuggccca

SEQ ID NO: 3934339 - RNA, 21 nt, Human adenovirus E
ccagggucucaaagcuccgcu

SEQ ID NO: 3934340 - RNA, 12 nt, Human adenovirus E
ccaggucucugu

SEQ ID NO: 3934341 - RNA, 16 nt, Human adenovirus E
ccaguaauaacaccgg

SEQ ID NO: 3934342 - RNA, 22 nt, Human adenovirus E
ccaguaauaacaccgguugggg

SEQ ID NO: 3934343 - RNA, 18 nt, Human adenovirus E
ccauacuccaccuccacc

SEQ ID NO: 3934344 - RNA, 16 nt, Human adenovirus E
ccauagccagccgacu

SEQ ID NO: 3934345 - RNA, 22 nt, Human adenovirus E
ccauagcuuaccgagcagcagc

SEQ ID NO: 3934346 - RNA, 16 nt, Human adenovirus E
ccauaggaccaccagg

SEQ ID NO: 3934347 - RNA, 15 nt, Human adenovirus E
ccaucauccccacgc

SEQ ID NO: 3934348 - RNA, 22 nt, Human adenovirus E
ccaucccgaagggggucaucuu

SEQ ID NO: 3934349 - RNA, 22 nt, Human adenovirus E
ccauccuggaggccguggugcc

SEQ ID NO: 3934350 - RNA, 13 nt, Human adenovirus E
ccaucggccaggc

SEQ ID NO: 3934351 - RNA, 22 nt, Human adenovirus E
ccaucgugaacgcgcuggugga

SEQ ID NO: 3934352 - RNA, 11 nt, Human adenovirus E
ccaugaacucu

SEQ ID NO: 3934353 - RNA, 22 nt, Human adenovirus E
ccaugcgcgcggcgcggagccu

SEQ ID NO: 3934354 - RNA, 19 nt, Human adenovirus E
ccauggaaacgcagaccga

SEQ ID NO: 3934355 - RNA, 22 nt, Human adenovirus E
ccauuuaaacuuucgccagcuu

SEQ ID NO: 3934356 - RNA, 19 nt, Human adenovirus E
cccaacaaaugccagcuga

SEQ ID NO: 3934357 - RNA, 21 nt, Human adenovirus E
cccaauggggugacagugaca

SEQ ID NO: 3934358 - RNA, 17 nt, Human adenovirus E
cccaccccacccaguga

SEQ ID NO: 3934359 - RNA, 17 nt, Human adenovirus E
cccacggccgccagcuc

SEQ ID NO: 3934360 - RNA, 13 nt, Human adenovirus E
cccacuccccuga

SEQ ID NO: 3934361 - RNA, 12 nt, Human adenovirus E
cccagagcugga

SEQ ID NO: 3934362 - RNA, 21 nt, Human adenovirus E
cccagaucaucggcaccuucg

SEQ ID NO: 3934363 - RNA, 12 nt, Human adenovirus E
cccagcaccagc

SEQ ID NO: 3934364 - RNA, 19 nt, Human adenovirus E
cccagccccgccaccuccg

SEQ ID NO: 3934365 - RNA, 19 nt, Human adenovirus E
cccagcgaaggcgaggguu

SEQ ID NO: 3934366 - RNA, 14 nt, Human adenovirus E
cccagcgccgcgcu

SEQ ID NO: 3934367 - RNA, 11 nt, Human adenovirus E
cccaggccaug

SEQ ID NO: 3934368 - RNA, 17 nt, Human adenovirus E
cccagggauaggagcuc

SEQ ID NO: 3934369 - RNA, 20 nt, Human adenovirus E
cccagucauagcaggggcgc

SEQ ID NO: 3934370 - RNA, 15 nt, Human adenovirus E
cccauccgcccaagg

SEQ ID NO: 3934371 - RNA, 19 nt, Human adenovirus E
cccaucuccgaggacgagg

SEQ ID NO: 3934372 - RNA, 19 nt, Human adenovirus E
ccccagaugggccuggccg

SEQ ID NO: 3934373 - RNA, 14 nt, Human adenovirus E
ccccauagccagcc

SEQ ID NO: 3934374 - RNA, 13 nt, Human adenovirus E
cccccacccaguc

SEQ ID NO: 3934375 - RNA, 11 nt, Human adenovirus E
ccccgccgccc

SEQ ID NO: 3934376 - RNA, 22 nt, Human adenovirus E
  misc_feature (9)..(9): n is a, c, g or u
ccccgggcnugggcgugcagac

SEQ ID NO: 3934377 - RNA, 14 nt, Human adenovirus E
ccccggggccagga

SEQ ID NO: 3934378 - RNA, 14 nt, Human adenovirus E
ccccuacacaugau

SEQ ID NO: 3934379 - RNA, 14 nt, Human adenovirus E
cccgaauaccacag

SEQ ID NO: 3934380 - RNA, 15 nt, Human adenovirus E
cccgaauaccacagc

SEQ ID NO: 3934381 - RNA, 20 nt, Human adenovirus E
cccgccaaauaaucacacac

SEQ ID NO: 3934382 - RNA, 15 nt, Human adenovirus E
cccgccccagcagca

SEQ ID NO: 3934383 - RNA, 23 nt, Human adenovirus E
cccgccugaaccugacacaccac

SEQ ID NO: 3934384 - RNA, 17 nt, Human adenovirus E
cccgcgaugcgggcggc

SEQ ID NO: 3934385 - RNA, 23 nt, Human adenovirus E
cccgcgcgcgcgcacguggccgc

SEQ ID NO: 3934386 - RNA, 15 nt, Human adenovirus E
cccgcguucugcgcg

SEQ ID NO: 3934387 - RNA, 16 nt, Human adenovirus E
cccgcuacaacagcac

SEQ ID NO: 3934388 - RNA, 21 nt, Human adenovirus E
cccggagacgcgcggccacgg

SEQ ID NO: 3934389 - RNA, 17 nt, Human adenovirus E
cccggcaggccaccauc

SEQ ID NO: 3934390 - RNA, 15 nt, Human adenovirus E
cccggccacuacccg

SEQ ID NO: 3934391 - RNA, 18 nt, Human adenovirus E
cccgggcaaccuggaagc

SEQ ID NO: 3934392 - RNA, 18 nt, Human adenovirus E
cccgggcccagguuggug

SEQ ID NO: 3934393 - RNA, 18 nt, Human adenovirus E
cccgguuccacgcggggc

SEQ ID NO: 3934394 - RNA, 19 nt, Human adenovirus E
cccgguuguaccuggugga

SEQ ID NO: 3934395 - RNA, 13 nt, Human adenovirus E
cccgucuccugcc

SEQ ID NO: 3934396 - RNA, 15 nt, Human adenovirus E
cccgucucucagcca

SEQ ID NO: 3934397 - RNA, 18 nt, Human adenovirus E
cccgugaggcgcgcgcag

SEQ ID NO: 3934398 - RNA, 13 nt, Human adenovirus E
cccgugcagccac

SEQ ID NO: 3934399 - RNA, 12 nt, Human adenovirus E
cccuagccgccu

SEQ ID NO: 3934400 - RNA, 18 nt, Human adenovirus E
cccuccugcacaggcagc

SEQ ID NO: 3934401 - RNA, 17 nt, Human adenovirus E
cccugaagcaaacagac

SEQ ID NO: 3934402 - RNA, 23 nt, Human adenovirus E
cccugccaucacaccuuccaccu

SEQ ID NO: 3934403 - RNA, 18 nt, Human adenovirus E
cccugccgcgcgcgcgcu

SEQ ID NO: 3934404 - RNA, 23 nt, Human adenovirus E
cccugcgacuggccgaccccguc

SEQ ID NO: 3934405 - RNA, 16 nt, Human adenovirus E
cccugcgcggggaggc

SEQ ID NO: 3934406 - RNA, 13 nt, Human adenovirus E
cccuggccaccua

SEQ ID NO: 3934407 - RNA, 22 nt, Human adenovirus E
cccugggcauagucgcgccgcg

SEQ ID NO: 3934408 - RNA, 14 nt, Human adenovirus E
cccugggccugaug

SEQ ID NO: 3934409 - RNA, 21 nt, Human adenovirus E
ccgaagccuuuagacagcagc

SEQ ID NO: 3934410 - RNA, 13 nt, Human adenovirus E
ccgagcagcagca

SEQ ID NO: 3934411 - RNA, 14 nt, Human adenovirus E
ccgagcagcagcac

SEQ ID NO: 3934412 - RNA, 11 nt, Human adenovirus E
ccgagccacag

SEQ ID NO: 3934413 - RNA, 15 nt, Human adenovirus E
ccgagccacagcgac

SEQ ID NO: 3934414 - RNA, 17 nt, Human adenovirus E
ccgagcugucggccugc

SEQ ID NO: 3934415 - RNA, 18 nt, Human adenovirus E
ccgagcugucggccugcg

SEQ ID NO: 3934416 - RNA, 17 nt, Human adenovirus E
ccgaggacgagggcaug

SEQ ID NO: 3934417 - RNA, 20 nt, Human adenovirus E
ccgagucgcggaugaagugg

SEQ ID NO: 3934418 - RNA, 15 nt, Human adenovirus E
cgaugugcucgguga

SEQ ID NO: 3934419 - RNA, 23 nt, Human adenovirus E
cgcaacucguaccugggcuaccu

SEQ ID NO: 3934420 - RNA, 14 nt, Human adenovirus E
cgcaagaccaccac

SEQ ID NO: 3934421 - RNA, 21 nt, Human adenovirus E
cgcaagaggcagcccuuccag

SEQ ID NO: 3934422 - RNA, 16 nt, Human adenovirus E
cgcaaucaggcagcac

SEQ ID NO: 3934423 - RNA, 18 nt, Human adenovirus E
cgcaaucaggcagcaccg

SEQ ID NO: 3934424 - RNA, 22 nt, Human adenovirus E
cgcacguggccgcggccaaccu

SEQ ID NO: 3934425 - RNA, 23 nt, Human adenovirus E
cgcacguggccgcggccaaccug

SEQ ID NO: 3934426 - RNA, 17 nt, Human adenovirus E
cgcagcagcgagcuggg

SEQ ID NO: 3934427 - RNA, 21 nt, Human adenovirus E
cgcagcagcgagcugggcagg

SEQ ID NO: 3934428 - RNA, 13 nt, Human adenovirus E
cgcagggcauggu

SEQ ID NO: 3934429 - RNA, 16 nt, Human adenovirus E
cgcagggccaggcgca

SEQ ID NO: 3934430 - RNA, 17 nt, Human adenovirus E
cgcagggggccacgagc

SEQ ID NO: 3934431 - RNA, 23 nt, Human adenovirus E
cgcauccugcguuacgugcagca

SEQ ID NO: 3934432 - RNA, 15 nt, Human adenovirus E
cgcauggucucggug

SEQ ID NO: 3934433 - RNA, 19 nt, Human adenovirus E
cgccagacgccgcaccugc

SEQ ID NO: 3934434 - RNA, 21 nt, Human adenovirus E
cgccagcccaauggcaccugc

SEQ ID NO: 3934435 - RNA, 14 nt, Human adenovirus E
cgccaggccugcaa

SEQ ID NO: 3934436 - RNA, 13 nt, Human adenovirus E
cgccauugguggc

SEQ ID NO: 3934437 - RNA, 18 nt, Human adenovirus E
cgcccagguuuuccaugc

SEQ ID NO: 3934438 - RNA, 14 nt, Human adenovirus E
cgccccgcucaggg

SEQ ID NO: 3934439 - RNA, 17 nt, Human adenovirus E
cgcccgcccgcgcccac

SEQ ID NO: 3934440 - RNA, 20 nt, Human adenovirus E
cgcccggcggcaccggagca

SEQ ID NO: 3934441 - RNA, 17 nt, Human adenovirus E
cgccgaacacucgugcu

SEQ ID NO: 3934442 - RNA, 17 nt, Human adenovirus E
cgccgcaccgcucccug

SEQ ID NO: 3934443 - RNA, 12 nt, Human adenovirus E
cgccgcagcagu

SEQ ID NO: 3934444 - RNA, 15 nt, Human adenovirus E
cgccgccgcuccguc

SEQ ID NO: 3934445 - RNA, 14 nt, Human adenovirus E
cgccgcgcaggggc

SEQ ID NO: 3934446 - RNA, 20 nt, Human adenovirus E
cgccgcgcgugccccccaag

SEQ ID NO: 3934447 - RNA, 20 nt, Human adenovirus E
cgccgcuguggagccacugc

SEQ ID NO: 3934448 - RNA, 13 nt, Human adenovirus E
cgccggugccgcc

SEQ ID NO: 3934449 - RNA, 22 nt, Human adenovirus E
cgccgguggcacgacaggcagc

SEQ ID NO: 3934450 - RNA, 21 nt, Human adenovirus E
cgccucagcaaccugcugggc

SEQ ID NO: 3934451 - RNA, 22 nt, Human adenovirus E
cgccugcugcugcugcuggugg

SEQ ID NO: 3934452 - RNA, 11 nt, Human adenovirus E
cgccuggccaa

SEQ ID NO: 3934453 - RNA, 13 nt, Human adenovirus E
cgccuggggcaga

SEQ ID NO: 3934454 - RNA, 22 nt, Human adenovirus E
cgcgaggccaucggccaggcgc

SEQ ID NO: 3934455 - RNA, 15 nt, Human adenovirus E
cgcgaguccaaccug

SEQ ID NO: 3934456 - RNA, 20 nt, Human adenovirus E
cgcgaguucgccccccggcg

SEQ ID NO: 3934457 - RNA, 21 nt, Human adenovirus E
cgcgcagagcgcccuccaccg

SEQ ID NO: 3934458 - RNA, 17 nt, Human adenovirus E
cgcgcccugggccagga

SEQ ID NO: 3934459 - RNA, 15 nt, Human adenovirus E
cgcgccugcugcugc

SEQ ID NO: 3934460 - RNA, 16 nt, Human adenovirus E
cgcgcgaggaggugac

SEQ ID NO: 3934461 - RNA, 13 nt, Human adenovirus E
cgcgcgcugcccg

SEQ ID NO: 3934462 - RNA, 21 nt, Human adenovirus E
cgcgcucagcaccgaggagga

SEQ ID NO: 3934463 - RNA, 16 nt, Human adenovirus E
cgcgcuccacgguggc

SEQ ID NO: 3934464 - RNA, 15 nt, Human adenovirus E
cgcgcucccuggggc

SEQ ID NO: 3934465 - RNA, 21 nt, Human adenovirus E
cgcgcucgaaggcccccggga

SEQ ID NO: 3934466 - RNA, 14 nt, Human adenovirus E
cgcggagacccugc

SEQ ID NO: 3934467 - RNA, 19 nt, Human adenovirus E
cgcggagauggcaccucuc

SEQ ID NO: 3934468 - RNA, 13 nt, Human adenovirus E
cgcggcgacgagg

SEQ ID NO: 3934469 - RNA, 15 nt, Human adenovirus E
cgcggcgacgaggcc

SEQ ID NO: 3934470 - RNA, 23 nt, Human adenovirus E
cgcggcuucaggcgccagcgccg

SEQ ID NO: 3934471 - RNA, 13 nt, Human adenovirus E
cgcggggcgggag

SEQ ID NO: 3934472 - RNA, 20 nt, Human adenovirus E
cgcggggcgggagcugcggc

SEQ ID NO: 3934473 - RNA, 20 nt, Human adenovirus E
cgcgguagcgguccaucagc

SEQ ID NO: 3934474 - RNA, 18 nt, Human adenovirus E
cgcggucauaccagcagc

SEQ ID NO: 3934475 - RNA, 16 nt, Human adenovirus E
cgcggucauggaccag

SEQ ID NO: 3934476 - RNA, 17 nt, Human adenovirus E
cgcggucauggaccagg

SEQ ID NO: 3934477 - RNA, 16 nt, Human adenovirus E
cgcggugcccgaggcc

SEQ ID NO: 3934478 - RNA, 20 nt, Human adenovirus E
cgcgguggggcggccagcug

SEQ ID NO: 3934479 - RNA, 17 nt, Human adenovirus E
cgcgguugagaaggaac

SEQ ID NO: 3934480 - RNA, 15 nt, Human adenovirus E
cgcgucaguugcagg

SEQ ID NO: 3934481 - RNA, 20 nt, Human adenovirus E
cgcgucaguugcagggcgcc

SEQ ID NO: 3934482 - RNA, 22 nt, Human adenovirus E
cgcgucguuguuggccagcugc

SEQ ID NO: 3934483 - RNA, 22 nt, Human adenovirus E
cgcuagcagccgcggccagggg

SEQ ID NO: 3934484 - RNA, 19 nt, Human adenovirus E
cgcucaggucgcugcagua

SEQ ID NO: 3934485 - RNA, 16 nt, Human adenovirus E
cgcucccggcggcgcu

SEQ ID NO: 3934486 - RNA, 16 nt, Human adenovirus E
cgcucgcgguggggcg

SEQ ID NO: 3934487 - RNA, 21 nt, Human adenovirus E
cgcucgcgguggggcggccag

SEQ ID NO: 3934488 - RNA, 17 nt, Human adenovirus E
cgcugacggcgcagcug

SEQ ID NO: 3934489 - RNA, 15 nt, Human adenovirus E
cgcugcaaccucugc

SEQ ID NO: 3934490 - RNA, 12 nt, Human adenovirus E
cgcugcacggga

SEQ ID NO: 3934491 - RNA, 22 nt, Human adenovirus E
cgcugcccguucucgcucgcca

SEQ ID NO: 3934492 - RNA, 15 nt, Human adenovirus E
cgcugcucaccaccu

SEQ ID NO: 3934493 - RNA, 14 nt, Human adenovirus E
cgcugcuggagcgc

SEQ ID NO: 3934494 - RNA, 15 nt, Human adenovirus E
cgcuggcuccuggac

SEQ ID NO: 3934495 - RNA, 23 nt, Human adenovirus E
cgcuguccgagaagcuggcggcc

SEQ ID NO: 3934496 - RNA, 17 nt, Human adenovirus E
cggaauccugcccgcca

SEQ ID NO: 3934497 - RNA, 19 nt, Human adenovirus E
cggacgauuggacccaggc

SEQ ID NO: 3934498 - RNA, 21 nt, Human adenovirus E
cggacuacuucuuccagacca

SEQ ID NO: 3934499 - RNA, 15 nt, Human adenovirus E
cggagcacccccgcc

SEQ ID NO: 3934500 - RNA, 20 nt, Human adenovirus E
cggaggaaggaaguccagag

SEQ ID NO: 3934501 - RNA, 12 nt, Human adenovirus E
cggaggccagca

SEQ ID NO: 3934502 - RNA, 18 nt, Human adenovirus E
cggaggccagcacccaga

SEQ ID NO: 3934503 - RNA, 20 nt, Human adenovirus E
cggaggcgacgggcucucgc

SEQ ID NO: 3934504 - RNA, 16 nt, Human adenovirus E
cggauaccaucuccgc

SEQ ID NO: 3934505 - RNA, 15 nt, Human adenovirus E
cggauggcuggcaga

SEQ ID NO: 3934506 - RNA, 17 nt, Human adenovirus E
cggauggcuggcagagc

SEQ ID NO: 3934507 - RNA, 19 nt, Human adenovirus E
cggauggcuggcagagccc

SEQ ID NO: 3934508 - RNA, 24 nt, Human adenovirus E
cggcagaacggggugcuggagagc

SEQ ID NO: 3934509 - RNA, 20 nt, Human adenovirus E
cggcagcggccaucgccagc

SEQ ID NO: 3934510 - RNA, 12 nt, Human adenovirus E
cggcagcggcgg

SEQ ID NO: 3934511 - RNA, 19 nt, Human adenovirus E
cggccagccugcugaugcc

SEQ ID NO: 3934512 - RNA, 17 nt, Human adenovirus E
cggccauccuggaggcc

SEQ ID NO: 3934513 - RNA, 21 nt, Human adenovirus E
cggccauuuuuucggggguga

SEQ ID NO: 3934514 - RNA, 20 nt, Human adenovirus E
cggcccaucaagcagguggc

SEQ ID NO: 3934515 - RNA, 17 nt, Human adenovirus E
cggcccaugagcugcga

SEQ ID NO: 3934516 - RNA, 13 nt, Human adenovirus E
cggcccucagcau

SEQ ID NO: 3934517 - RNA, 14 nt, Human adenovirus E
cggcccucagcauc

SEQ ID NO: 3934518 - RNA, 16 nt, Human adenovirus E
cggccgaggcggcuga

SEQ ID NO: 3934519 - RNA, 15 nt, Human adenovirus E
cggcgcacgggcaga

SEQ ID NO: 3934520 - RNA, 21 nt, Human adenovirus E
cggcgcgcuccuuggcggcga

SEQ ID NO: 3934521 - RNA, 13 nt, Human adenovirus E
cggcggcagcagg

SEQ ID NO: 3934522 - RNA, 12 nt, Human adenovirus E
cggcggccuggg

SEQ ID NO: 3934523 - RNA, 16 nt, Human adenovirus E
cggcggcgaugcagcc

SEQ ID NO: 3934524 - RNA, 15 nt, Human adenovirus E
cggcgggcgcagcag

SEQ ID NO: 3934525 - RNA, 22 nt, Human adenovirus E
cggcgguacaccucgcccugcu

SEQ ID NO: 3934526 - RNA, 16 nt, Human adenovirus E
cggcgucgugcacgca

SEQ ID NO: 3934527 - RNA, 21 nt, Human adenovirus E
cggcgucgugcacgcagcagc

SEQ ID NO: 3934528 - RNA, 15 nt, Human adenovirus E
cggcuucccccagga

SEQ ID NO: 3934529 - RNA, 20 nt, Human adenovirus E
cggcuucgacaccuggacca

SEQ ID NO: 3934530 - RNA, 20 nt, Human adenovirus E
cgggacccugccgcugcgca

SEQ ID NO: 3934531 - RNA, 15 nt, Human adenovirus E
cgggaguuccuccac

SEQ ID NO: 3934532 - RNA, 21 nt, Human adenovirus E
cgggauagaaagccuggugga

SEQ ID NO: 3934533 - RNA, 19 nt, Human adenovirus E
cgggaugcgucgccaccac

SEQ ID NO: 3934534 - RNA, 14 nt, Human adenovirus E
uauguggcccccca

SEQ ID NO: 3934535 - RNA, 16 nt, Human adenovirus E
uauguuggagcaacau

SEQ ID NO: 3934536 - RNA, 12 nt, Human adenovirus E
uauuugcaauug

SEQ ID NO: 3934537 - RNA, 13 nt, Human adenovirus E
ucaaccccggcuu

SEQ ID NO: 3934538 - RNA, 18 nt, Human adenovirus E
ucaaccccuucuccggcu

SEQ ID NO: 3934539 - RNA, 15 nt, Human adenovirus E
ucaagcccagcacca

SEQ ID NO: 3934540 - RNA, 13 nt, Human adenovirus E
ucaaguccagcaa

SEQ ID NO: 3934541 - RNA, 18 nt, Human adenovirus E
ucacaccacacacacaga

SEQ ID NO: 3934542 - RNA, 22 nt, Human adenovirus E
ucaccaaacugucaaauacucg

SEQ ID NO: 3934543 - RNA, 23 nt, Human adenovirus E
ucaccaaggccauggcgaccagc

SEQ ID NO: 3934544 - RNA, 19 nt, Human adenovirus E
ucaccacuacuaucucuuc

SEQ ID NO: 3934545 - RNA, 16 nt, Human adenovirus E
ucacccgccccgcccc

SEQ ID NO: 3934546 - RNA, 15 nt, Human adenovirus E
ucaccgagagccgcc

SEQ ID NO: 3934547 - RNA, 20 nt, Human adenovirus E
ucaccgagagccgccucagc

SEQ ID NO: 3934548 - RNA, 19 nt, Human adenovirus E
ucaccgccccgcucagggu

SEQ ID NO: 3934549 - RNA, 13 nt, Human adenovirus E
ucaccuccacagc

SEQ ID NO: 3934550 - RNA, 18 nt, Human adenovirus E
ucacggacagcggcagca

SEQ ID NO: 3934551 - RNA, 20 nt, Human adenovirus E
ucagacccacugcugaaccu

SEQ ID NO: 3934552 - RNA, 15 nt, Human adenovirus E
ucagaccgugcagca

SEQ ID NO: 3934553 - RNA, 20 nt, Human adenovirus E
ucagauguaucuacugaacu

SEQ ID NO: 3934554 - RNA, 16 nt, Human adenovirus E
ucagcaaccugcuggg

SEQ ID NO: 3934555 - RNA, 16 nt, Human adenovirus E
ucagcaguuugggcag

SEQ ID NO: 3934556 - RNA, 21 nt, Human adenovirus E
ucagccaaucagcgccccgca

SEQ ID NO: 3934557 - RNA, 20 nt, Human adenovirus E
ucagcgacgagcagcuggcc

SEQ ID NO: 3934558 - RNA, 19 nt, Human adenovirus E
ucaggcagaggaggacagc

SEQ ID NO: 3934559 - RNA, 16 nt, Human adenovirus E
ucaggcagaggaggag

SEQ ID NO: 3934560 - RNA, 13 nt, Human adenovirus E
ucaggcagcaccg

SEQ ID NO: 3934561 - RNA, 18 nt, Human adenovirus E
ucaggccccgcagcaguc

SEQ ID NO: 3934562 - RNA, 13 nt, Human adenovirus E
ucaggcgccagcg

SEQ ID NO: 3934563 - RNA, 13 nt, Human adenovirus E
ucaggcuccucug

SEQ ID NO: 3934564 - RNA, 23 nt, Human adenovirus E
ucaggcugggcucgagcaugacg

SEQ ID NO: 3934565 - RNA, 19 nt, Human adenovirus E
ucagucucaaguccagcaa

SEQ ID NO: 3934566 - RNA, 20 nt, Human adenovirus E
ucauaccagcagccgccgcc

SEQ ID NO: 3934567 - RNA, 22 nt, Human adenovirus E
ucauccaugaugauggcgaugg

SEQ ID NO: 3934568 - RNA, 19 nt, Human adenovirus E
ucauccucgaacgcuccgg

SEQ ID NO: 3934569 - RNA, 14 nt, Human adenovirus E
ucaucugggccugg

SEQ ID NO: 3934570 - RNA, 14 nt, Human adenovirus E
ucauguacagcaac

SEQ ID NO: 3934571 - RNA, 22 nt, Human adenovirus E
ucauuuguuggcauuaccccua

SEQ ID NO: 3934572 - RNA, 16 nt, Human adenovirus E
uccaagacaguucauu

SEQ ID NO: 3934573 - RNA, 18 nt, Human adenovirus E
uccaagauauucugcucc

SEQ ID NO: 3934574 - RNA, 18 nt, Human adenovirus E
uccaccaacgccaccguc

SEQ ID NO: 3934575 - RNA, 13 nt, Human adenovirus E
uccacccaccaca

SEQ ID NO: 3934576 - RNA, 15 nt, Human adenovirus E
uccaccuuuuccagg

SEQ ID NO: 3934577 - RNA, 16 nt, Human adenovirus E
uccaccuuuuccaggg

SEQ ID NO: 3934578 - RNA, 15 nt, Human adenovirus E
uccacgagccaggug

SEQ ID NO: 3934579 - RNA, 17 nt, Human adenovirus E
uccacgcgcacauccag

SEQ ID NO: 3934580 - RNA, 19 nt, Human adenovirus E
uccacgcggggcgggagcu

SEQ ID NO: 3934581 - RNA, 19 nt, Human adenovirus E
uccacgguggcuuccagca

SEQ ID NO: 3934582 - RNA, 16 nt, Human adenovirus E
uccacguuccacacag

SEQ ID NO: 3934583 - RNA, 17 nt, Human adenovirus E
uccacuaacaucucuuc

SEQ ID NO: 3934584 - RNA, 18 nt, Human adenovirus E
uccagaaaaagccacaga

SEQ ID NO: 3934585 - RNA, 20 nt, Human adenovirus E
uccagauaacuggacagaaa

SEQ ID NO: 3934586 - RNA, 11 nt, Human adenovirus E
uccaggccagc

SEQ ID NO: 3934587 - RNA, 17 nt, Human adenovirus E
uccaucauccccacgcc

SEQ ID NO: 3934588 - RNA, 19 nt, Human adenovirus E
ucccagcggcgaggaggau

SEQ ID NO: 3934589 - RNA, 15 nt, Human adenovirus E
ucccauacuccaccu

SEQ ID NO: 3934590 - RNA, 16 nt, Human adenovirus E
uccccgcgcuccugga

SEQ ID NO: 3934591 - RNA, 16 nt, Human adenovirus E
uccccgucuccugccg

SEQ ID NO: 3934592 - RNA, 15 nt, Human adenovirus E
uccccgugccagcga

SEQ ID NO: 3934593 - RNA, 15 nt, Human adenovirus E
uccccuccugcacag

SEQ ID NO: 3934594 - RNA, 14 nt, Human adenovirus E
ucccgcaucugcac

SEQ ID NO: 3934595 - RNA, 18 nt, Human adenovirus E
ucccgccccaguacgcgc

SEQ ID NO: 3934596 - RNA, 17 nt, Human adenovirus E
ucccggcgcccgccuac

SEQ ID NO: 3934597 - RNA, 17 nt, Human adenovirus E
ucccggcggcgcucuga

SEQ ID NO: 3934598 - RNA, 13 nt, Human adenovirus E
uccgaggacgagg

SEQ ID NO: 3934599 - RNA, 21 nt, Human adenovirus E
uccgaggacgagggcaugcaa

SEQ ID NO: 3934600 - RNA, 15 nt, Human adenovirus E
uccgaggccacgcgg

SEQ ID NO: 3934601 - RNA, 18 nt, Human adenovirus E
uccgccgacgacagcagc

SEQ ID NO: 3934602 - RNA, 19 nt, Human adenovirus E
uccgcgacacggcacgcgg

SEQ ID NO: 3934603 - RNA, 21 nt, Human adenovirus E
uccgcguaauuggcccgccgc

SEQ ID NO: 3934604 - RNA, 22 nt, Human adenovirus E
uccgcguaauuggcccgccgcc

SEQ ID NO: 3934605 - RNA, 15 nt, Human adenovirus E
uccggcaccgcuucc

SEQ ID NO: 3934606 - RNA, 20 nt, Human adenovirus E
uccggggcagaagcacacag

SEQ ID NO: 3934607 - RNA, 14 nt, Human adenovirus E
uccgguccuuccag

SEQ ID NO: 3934608 - RNA, 13 nt, Human adenovirus E
uccucccucagca

SEQ ID NO: 3934609 - RNA, 18 nt, Human adenovirus E
uccucucgagccgcaccu

SEQ ID NO: 3934610 - RNA, 13 nt, Human adenovirus E
uccucuucuuggu

SEQ ID NO: 3934611 - RNA, 14 nt, Human adenovirus E
uccugcccgccacc

SEQ ID NO: 3934612 - RNA, 21 nt, Human adenovirus E
uccuggcugacguccugcagg

SEQ ID NO: 3934613 - RNA, 18 nt, Human adenovirus E
uccugguucaccugcagc

SEQ ID NO: 3934614 - RNA, 15 nt, Human adenovirus E
ucgacgagcgcacca

SEQ ID NO: 3934615 - RNA, 22 nt, Human adenovirus E
ucgacuccguggccuggaggcu

SEQ ID NO: 3934616 - RNA, 20 nt, Human adenovirus E
ucgagagccacaccacagcu

SEQ ID NO: 3934617 - RNA, 23 nt, Human adenovirus E
ucgagcaguuauuuuuccuccac

SEQ ID NO: 3934618 - RNA, 17 nt, Human adenovirus E
ucgagcugacccauuuc

SEQ ID NO: 3934619 - RNA, 17 nt, Human adenovirus E
ucgagggucuccuggau

SEQ ID NO: 3934620 - RNA, 17 nt, Human adenovirus E
ucgcaaucaggcagcac

SEQ ID NO: 3934621 - RNA, 18 nt, Human adenovirus E
ucgcagaaaaugaugcaa

SEQ ID NO: 3934622 - RNA, 20 nt, Human adenovirus E
ucgcagccccgcucgggugg

SEQ ID NO: 3934623 - RNA, 22 nt, Human adenovirus E
ucgcaucaggccccgcagcagu

SEQ ID NO: 3934624 - RNA, 17 nt, Human adenovirus E
ucgccagggcuugcaga

SEQ ID NO: 3934625 - RNA, 20 nt, Human adenovirus E
ucgcccggcggcaccggagc

SEQ ID NO: 3934626 - RNA, 17 nt, Human adenovirus E
ucgcccuagccgccucc

SEQ ID NO: 3934627 - RNA, 19 nt, Human adenovirus E
ucgccgcgcgugcccccca

SEQ ID NO: 3934628 - RNA, 20 nt, Human adenovirus E
ucgcgcaccaguuccgccag

SEQ ID NO: 3934629 - RNA, 20 nt, Human adenovirus E
ucgcgcuccaaccccacgca

SEQ ID NO: 3934630 - RNA, 19 nt, Human adenovirus E
ucgcggcgaacgagccggc

SEQ ID NO: 3934631 - RNA, 15 nt, Human adenovirus E
ucgcgguccuuccag

SEQ ID NO: 3934632 - RNA, 17 nt, Human adenovirus E
ucgcuauucgccccaga

SEQ ID NO: 3934633 - RNA, 21 nt, Human adenovirus E
ucgcuuacgcacgucuucaac

SEQ ID NO: 3934634 - RNA, 18 nt, Human adenovirus E
ucggacuucgugccgcug

SEQ ID NO: 3934635 - RNA, 17 nt, Human adenovirus E
ucgggucggucagggag

SEQ ID NO: 3934636 - RNA, 19 nt, Human adenovirus E
ucgucaaggaugcgcugcu

SEQ ID NO: 3934637 - RNA, 12 nt, Human adenovirus E
ucgucaggccgu

SEQ ID NO: 3934638 - RNA, 13 nt, Human adenovirus E
ucguccagggcag

SEQ ID NO: 3934639 - RNA, 16 nt, Human adenovirus E
ucguucucuccagcac

SEQ ID NO: 3934640 - RNA, 15 nt, Human adenovirus E
ucguuguuggccagc

SEQ ID NO: 3934641 - RNA, 14 nt, Human adenovirus E
ucuaccucugccac

SEQ ID NO: 3934642 - RNA, 20 nt, Human adenovirus E
ucuaccucugccacaccugg

SEQ ID NO: 3934643 - RNA, 13 nt, Human adenovirus E
ucuacgaggacca

SEQ ID NO: 3934644 - RNA, 17 nt, Human adenovirus E
ucucagccaaucagcgc

SEQ ID NO: 3934645 - RNA, 20 nt, Human adenovirus E
ucucagccaaucagcgcccc

SEQ ID NO: 3934646 - RNA, 16 nt, Human adenovirus E
ucucaucaaguuucaa

SEQ ID NO: 3934647 - RNA, 19 nt, Human adenovirus E
ucuccaucgcuuacagccu

SEQ ID NO: 3934648 - RNA, 13 nt, Human adenovirus E
ucuccccccgcac

SEQ ID NO: 3934649 - RNA, 14 nt, Human adenovirus E
ucuccgcuccgggu

SEQ ID NO: 3934650 - RNA, 13 nt, Human adenovirus E
ucucuccagcacc

SEQ ID NO: 3934651 - RNA, 21 nt, Human adenovirus E
uggugaagaugccgggcagga

SEQ ID NO: 3934652 - RNA, 15 nt, Human adenovirus E
uggugaaggaggaaa

SEQ ID NO: 3934653 - RNA, 15 nt, Human adenovirus E
uggugcccaagcgcc

SEQ ID NO: 3934654 - RNA, 20 nt, Human adenovirus E
ugguguacuaugccuucugc

SEQ ID NO: 3934655 - RNA, 14 nt, Human adenovirus E
ugucaguguaucua

SEQ ID NO: 3934656 - RNA, 20 nt, Human adenovirus E
ugucccaugguggcgcagcu

SEQ ID NO: 3934657 - RNA, 21 nt, Human adenovirus E
ugucccuuuuguuuccacagc

SEQ ID NO: 3934658 - RNA, 15 nt, Human adenovirus E
ugucgagccugcuga

SEQ ID NO: 3934659 - RNA, 21 nt, Human adenovirus E
ugucuuucguccucgcugucc

SEQ ID NO: 3934660 - RNA, 13 nt, Human adenovirus E
uguggacagcagc

SEQ ID NO: 3934661 - RNA, 15 nt, Human adenovirus E
ugugggaccugcugg

SEQ ID NO: 3934662 - RNA, 19 nt, Human adenovirus E
uguggggcgugcaggcccc

SEQ ID NO: 3934663 - RNA, 18 nt, Human adenovirus E
ugugguagucaaauacug

SEQ ID NO: 3934664 - RNA, 18 nt, Human adenovirus E
uguucagagacaggagcg

SEQ ID NO: 3934665 - RNA, 17 nt, Human adenovirus E
uguuccugguggugcag

SEQ ID NO: 3934666 - RNA, 16 nt, Human adenovirus E
uuaccgagcagcagca

SEQ ID NO: 3934667 - RNA, 22 nt, Human adenovirus E
  misc_feature (7)..(7): n is a, c, g or u
uuagaancggcggcgaagacgc

SEQ ID NO: 3934668 - RNA, 19 nt, Human adenovirus E
uuagcuuugacaguacagg

SEQ ID NO: 3934669 - RNA, 22 nt, Human adenovirus E
uuagggcaagccacaguacaga

SEQ ID NO: 3934670 - RNA, 21 nt, Human adenovirus E
uucacuccccucuucccagcu

SEQ ID NO: 3934671 - RNA, 16 nt, Human adenovirus E
uucaugaccagcauga

SEQ ID NO: 3934672 - RNA, 15 nt, Human adenovirus E
uucauggaaugagua

SEQ ID NO: 3934673 - RNA, 22 nt, Human adenovirus E
uuccaccugaucccgaauacca

SEQ ID NO: 3934674 - RNA, 13 nt, Human adenovirus E
uuccagcaaagcc

SEQ ID NO: 3934675 - RNA, 13 nt, Human adenovirus E
uucccacuccccu

SEQ ID NO: 3934676 - RNA, 22 nt, Human adenovirus E
uucgcccuagccgccuccaccc

SEQ ID NO: 3934677 - RNA, 18 nt, Human adenovirus E
uucguccucgcagccccg

SEQ ID NO: 3934678 - RNA, 16 nt, Human adenovirus E
uucgugagguaaaucc

SEQ ID NO: 3934679 - RNA, 21 nt, Human adenovirus E
uucuacacuaaaaaaauacug

SEQ ID NO: 3934680 - RNA, 16 nt, Human adenovirus E
uucuacuuccuccuca

SEQ ID NO: 3934681 - RNA, 18 nt, Human adenovirus E
uucuagaaacgaggagga

SEQ ID NO: 3934682 - RNA, 19 nt, Human adenovirus E
uucuaucauuaccucugcu

SEQ ID NO: 3934683 - RNA, 16 nt, Human adenovirus E
uucuccuagggaggaa

SEQ ID NO: 3934684 - RNA, 19 nt, Human adenovirus E
uucugggugaucuuggccc

SEQ ID NO: 3934685 - RNA, 15 nt, Human adenovirus E
uugaauuuuaauuuu

SEQ ID NO: 3934686 - RNA, 23 nt, Human adenovirus E
uugacggccuuguaggcgcagca

SEQ ID NO: 3934687 - RNA, 19 nt, Human adenovirus E
uugagcugcccgaggagca

SEQ ID NO: 3934688 - RNA, 16 nt, Human adenovirus E
uugccgaaggacccca

SEQ ID NO: 3934689 - RNA, 18 nt, Human adenovirus E
uugcgcagggccaggcgc

SEQ ID NO: 3934690 - RNA, 19 nt, Human adenovirus E
uuggaagcaguaguacaga

SEQ ID NO: 3934691 - RNA, 17 nt, Human adenovirus E
uuggacccaggccaugc

SEQ ID NO: 3934692 - RNA, 22 nt, Human adenovirus E
uuggcgauguuaccgcccagau

SEQ ID NO: 3934693 - RNA, 12 nt, Human adenovirus E
uuucccacccuc

SEQ ID NO: 3934694 - RNA, 17 nt, Human adenovirus E
uuugccuucaccaccug

SEQ ID NO: 3934695 - RNA, 15 nt, Human adenovirus E
uuuggaggaagacug

SEQ ID NO: 3934696 - RNA, 23 nt, Human adenovirus E
uuuuaaugaaucagauguaucua

SEQ ID NO: 3934697 - RNA, 11 nt, Human adenovirus E
uuuugaugcaa

SEQ ID NO: 3934698 - RNA, 21 nt, Human adenovirus E
cgggcacgauucugaccugcc

SEQ ID NO: 3934699 - RNA, 19 nt, Human adenovirus E
cgggcacucccgcaucugc

SEQ ID NO: 3934700 - RNA, 21 nt, Human adenovirus E
cgggcacuuccgcgcucccug

SEQ ID NO: 3934701 - RNA, 22 nt, Human adenovirus E
cgggcccugaccggggccggga

SEQ ID NO: 3934702 - RNA, 13 nt, Human adenovirus E
cgggcgcagcagc

SEQ ID NO: 3934703 - RNA, 13 nt, Human adenovirus E
cgggcggcgcugc

SEQ ID NO: 3934704 - RNA, 19 nt, Human adenovirus E
cgggcggcgcugcagagcc

SEQ ID NO: 3934705 - RNA, 22 nt, Human adenovirus E
  misc_feature (6)..(6): n is a, c, g or u
cgggcnugggcgugcagaccgu

SEQ ID NO: 3934706 - RNA, 14 nt, Human adenovirus E
cgggcuaccgcggc

SEQ ID NO: 3934707 - RNA, 13 nt, Human adenovirus E
cggggaucagccc

SEQ ID NO: 3934708 - RNA, 12 nt, Human adenovirus E
cggggcagaagc

SEQ ID NO: 3934709 - RNA, 15 nt, Human adenovirus E
cggggcgggagcugc

SEQ ID NO: 3934710 - RNA, 18 nt, Human adenovirus E
cgggggagaugagcuggg

SEQ ID NO: 3934711 - RNA, 23 nt, Human adenovirus E
cgggggugcgcucccggcggcgc

SEQ ID NO: 3934712 - RNA, 16 nt, Human adenovirus E
cggggguucaagcgcg

SEQ ID NO: 3934713 - RNA, 13 nt, Human adenovirus E
cgggguugcagca

SEQ ID NO: 3934714 - RNA, 17 nt, Human adenovirus E
cgggguuucuucuuggg

SEQ ID NO: 3934715 - RNA, 19 nt, Human adenovirus E
cgggugauccuccaccaga

SEQ ID NO: 3934716 - RNA, 17 nt, Human adenovirus E
cggucaacuccuccucc

SEQ ID NO: 3934717 - RNA, 16 nt, Human adenovirus E
cggucauaccagcagc

SEQ ID NO: 3934718 - RNA, 15 nt, Human adenovirus E
cggucguccccggag

SEQ ID NO: 3934719 - RNA, 19 nt, Human adenovirus E
cggugagcgccagcaggcg

SEQ ID NO: 3934720 - RNA, 21 nt, Human adenovirus E
cggugagcgccagcaggcggc

SEQ ID NO: 3934721 - RNA, 15 nt, Human adenovirus E
cggugccgcccagga

SEQ ID NO: 3934722 - RNA, 18 nt, Human adenovirus E
cggugccgcccaggacua

SEQ ID NO: 3934723 - RNA, 16 nt, Human adenovirus E
cgguggcuuccagcaa

SEQ ID NO: 3934724 - RNA, 21 nt, Human adenovirus E
cgguggggccguagaugaccc

SEQ ID NO: 3934725 - RNA, 13 nt, Human adenovirus E
cgguggggcggcc

SEQ ID NO: 3934726 - RNA, 18 nt, Human adenovirus E
cggugucgagccugcuga

SEQ ID NO: 3934727 - RNA, 22 nt, Human adenovirus E
cguagaccgacuuuaugggccg

SEQ ID NO: 3934728 - RNA, 23 nt, Human adenovirus E
cguaugcgcaggagcacagggac

SEQ ID NO: 3934729 - RNA, 17 nt, Human adenovirus E
cgucaaggaugcgcugc

SEQ ID NO: 3934730 - RNA, 13 nt, Human adenovirus E
cgucccgggggug

SEQ ID NO: 3934731 - RNA, 19 nt, Human adenovirus E
cguccucgcuguccuggcu

SEQ ID NO: 3934732 - RNA, 15 nt, Human adenovirus E
cgucgugcacgcagc

SEQ ID NO: 3934733 - RNA, 19 nt, Human adenovirus E
cgucucgagauccacggga

SEQ ID NO: 3934734 - RNA, 18 nt, Human adenovirus E
cgugaacgcgcuggugga

SEQ ID NO: 3934735 - RNA, 16 nt, Human adenovirus E
cgugaccuugcagcag

SEQ ID NO: 3934736 - RNA, 20 nt, Human adenovirus E
cgugaccuugcagcaggugc

SEQ ID NO: 3934737 - RNA, 16 nt, Human adenovirus E
cgugagccgcgcccug

SEQ ID NO: 3934738 - RNA, 17 nt, Human adenovirus E
cgugcaacacagaacca

SEQ ID NO: 3934739 - RNA, 13 nt, Human adenovirus E
cgugcgcgaggcc

SEQ ID NO: 3934740 - RNA, 20 nt, Human adenovirus E
cgugcgcgaggccguggccc

SEQ ID NO: 3934741 - RNA, 13 nt, Human adenovirus E
cgugcggugagcg

SEQ ID NO: 3934742 - RNA, 20 nt, Human adenovirus E
cgugcggugagcgccagcag

SEQ ID NO: 3934743 - RNA, 12 nt, Human adenovirus E
cguggagcugga

SEQ ID NO: 3934744 - RNA, 20 nt, Human adenovirus E
cgugggcggcggccugggca

SEQ ID NO: 3934745 - RNA, 14 nt, Human adenovirus E
cguucucuccagca

SEQ ID NO: 3934746 - RNA, 17 nt, Human adenovirus E
cguucucuccagcacca

SEQ ID NO: 3934747 - RNA, 17 nt, Human adenovirus E
cguugcggugugccccg

SEQ ID NO: 3934748 - RNA, 12 nt, Human adenovirus E
cuacaagacccc

SEQ ID NO: 3934749 - RNA, 12 nt, Human adenovirus E
cuaccacccaca

SEQ ID NO: 3934750 - RNA, 14 nt, Human adenovirus E
cuaccagccccaga

SEQ ID NO: 3934751 - RNA, 16 nt, Human adenovirus E
cuaccucgacccccag

SEQ ID NO: 3934752 - RNA, 14 nt, Human adenovirus E
cuaccucugccaca

SEQ ID NO: 3934753 - RNA, 22 nt, Human adenovirus E
cuacggcaucucgauccagcag

SEQ ID NO: 3934754 - RNA, 20 nt, Human adenovirus E
cuacuacuuccaagaagagg

SEQ ID NO: 3934755 - RNA, 18 nt, Human adenovirus E
cuagcagccgcggccagg

SEQ ID NO: 3934756 - RNA, 21 nt, Human adenovirus E
cuagcauguagaacugguuga

SEQ ID NO: 3934757 - RNA, 14 nt, Human adenovirus E
cuagccgccuccac

SEQ ID NO: 3934758 - RNA, 15 nt, Human adenovirus E
cuaggacguccagag

SEQ ID NO: 3934759 - RNA, 22 nt, Human adenovirus E
cuaggacguccagagcgcagua

SEQ ID NO: 3934760 - RNA, 16 nt, Human adenovirus E
cucagcaaccugcugg

SEQ ID NO: 3934761 - RNA, 19 nt, Human adenovirus E
cucagccaucgccaaccuc

SEQ ID NO: 3934762 - RNA, 15 nt, Human adenovirus E
cucagccgcgccuac

SEQ ID NO: 3934763 - RNA, 16 nt, Human adenovirus E
cucagguguccagcug

SEQ ID NO: 3934764 - RNA, 17 nt, Human adenovirus E
cucagguguccagcugg

SEQ ID NO: 3934765 - RNA, 20 nt, Human adenovirus E
cucaucaagcaucuggcccg

SEQ ID NO: 3934766 - RNA, 15 nt, Human adenovirus E
cucaucaaguuucaa

SEQ ID NO: 3934767 - RNA, 20 nt, Human adenovirus E
  misc_feature (8)..(8): n is a, c, g or u
cucauuanuccagcagaggc

SEQ ID NO: 3934768 - RNA, 18 nt, Human adenovirus E
cuccaacguggagcugac

SEQ ID NO: 3934769 - RNA, 21 nt, Human adenovirus E
cuccaagucugugccacccuc

SEQ ID NO: 3934770 - RNA, 14 nt, Human adenovirus E
cuccaccaacgcca

SEQ ID NO: 3934771 - RNA, 16 nt, Human adenovirus E
cuccaccuccacccac

SEQ ID NO: 3934772 - RNA, 18 nt, Human adenovirus E
  misc_feature (9)..(9): n is a, c, g or u
cuccagcunuuccaaccc

SEQ ID NO: 3934773 - RNA, 18 nt, Human adenovirus E
cuccaguucguggaggag

SEQ ID NO: 3934774 - RNA, 17 nt, Human adenovirus E
cuccaucgcuuacagcc

SEQ ID NO: 3934775 - RNA, 22 nt, Human adenovirus E
cucccgguaccacaucacccuc

SEQ ID NO: 3934776 - RNA, 12 nt, Human adenovirus E
cucccucgguga

SEQ ID NO: 3934777 - RNA, 15 nt, Human adenovirus E
cucccucguacgaga

SEQ ID NO: 3934778 - RNA, 14 nt, Human adenovirus E
cucccuggggcgcc

SEQ ID NO: 3934779 - RNA, 20 nt, Human adenovirus E
cuccgacgcggccgucccag

SEQ ID NO: 3934780 - RNA, 19 nt, Human adenovirus E
cuccgcgacacggcacgcg

SEQ ID NO: 3934781 - RNA, 19 nt, Human adenovirus E
cuccgcuugccguccuucu

SEQ ID NO: 3934782 - RNA, 23 nt, Human adenovirus E
cuccggcaccgcuuccaagcgcu

SEQ ID NO: 3934783 - RNA, 17 nt, Human adenovirus E
cuccguggccuggaggc

SEQ ID NO: 3934784 - RNA, 21 nt, Human adenovirus E
cuccuagaacagucagcgcuc

SEQ ID NO: 3934785 - RNA, 13 nt, Human adenovirus E
cuccucccucagc

SEQ ID NO: 3934786 - RNA, 19 nt, Human adenovirus E
cuccugccgcgccaaccgc

SEQ ID NO: 3934787 - RNA, 19 nt, Human adenovirus E
cuccugcuugcaggccugc

SEQ ID NO: 3934788 - RNA, 17 nt, Human adenovirus E
cuccuggaccuggugaa

SEQ ID NO: 3934789 - RNA, 17 nt, Human adenovirus E
cuccuucagcgcgcgcu

SEQ ID NO: 3934790 - RNA, 16 nt, Human adenovirus E
cucgagugccacugcc

SEQ ID NO: 3934791 - RNA, 15 nt, Human adenovirus E
cucgcacuccacgag

SEQ ID NO: 3934792 - RNA, 14 nt, Human adenovirus E
cucgcagcagcugc

SEQ ID NO: 3934793 - RNA, 14 nt, Human adenovirus E
cucgccgcucgccg

SEQ ID NO: 3934794 - RNA, 20 nt, Human adenovirus E
cucgcgaggcauacgugccc

SEQ ID NO: 3934795 - RNA, 23 nt, Human adenovirus E
cucgcgccugcugcugcugcugg

SEQ ID NO: 3934796 - RNA, 23 nt, Human adenovirus E
cucgcgguggggcggccagcuga

SEQ ID NO: 3934797 - RNA, 17 nt, Human adenovirus E
cucgcguccguguggca

SEQ ID NO: 3934798 - RNA, 14 nt, Human adenovirus E
cucgcucugguggc

SEQ ID NO: 3934799 - RNA, 20 nt, Human adenovirus E
cucggacgauuggacccagg

SEQ ID NO: 3934800 - RNA, 22 nt, Human adenovirus E
cucggacgauuggacccaggcc

SEQ ID NO: 3934801 - RNA, 20 nt, Human adenovirus E
cucggccauccuggaggccg

SEQ ID NO: 3934802 - RNA, 17 nt, Human adenovirus E
cucggcgaugguggcgc

SEQ ID NO: 3934803 - RNA, 16 nt, Human adenovirus E
cucgggaucgcgggcg

SEQ ID NO: 3934804 - RNA, 21 nt, Human adenovirus E
cucgggucggucagggagaug

SEQ ID NO: 3934805 - RNA, 19 nt, Human adenovirus E
cucguaaaaguccacggcg

SEQ ID NO: 3934806 - RNA, 15 nt, Human adenovirus E
cucguaccugggcua

SEQ ID NO: 3934807 - RNA, 21 nt, Human adenovirus E
cucgucugccguagucuggag

SEQ ID NO: 3934808 - RNA, 13 nt, Human adenovirus E
cucucgaggacgc

SEQ ID NO: 3934809 - RNA, 15 nt, Human adenovirus E
cucugacgcuccugg

SEQ ID NO: 3934810 - RNA, 22 nt, Human adenovirus E
cucugcacgccgcaccgcuccc

SEQ ID NO: 3934811 - RNA, 21 nt, Human adenovirus E
cucugggugaaggccacggga

SEQ ID NO: 3934812 - RNA, 18 nt, Human adenovirus E
cucugguacugcaggccc

SEQ ID NO: 3934813 - RNA, 17 nt, Human adenovirus E
cucuucagcacucucaa

SEQ ID NO: 3934814 - RNA, 12 nt, Human adenovirus E
gauacgggugau

SEQ ID NO: 3934815 - RNA, 14 nt, Human adenovirus E
gauaggagcuccug

SEQ ID NO: 3934816 - RNA, 16 nt, Human adenovirus E
gauaggagcuccugga

SEQ ID NO: 3934817 - RNA, 15 nt, Human adenovirus E
gaucaccagcuggcc

SEQ ID NO: 3934818 - RNA, 20 nt, Human adenovirus E
gaucagcaucaucugggccu

SEQ ID NO: 3934819 - RNA, 14 nt, Human adenovirus E
gauccacggccagg

SEQ ID NO: 3934820 - RNA, 16 nt, Human adenovirus E
gauccacgggaucuga

SEQ ID NO: 3934821 - RNA, 18 nt, Human adenovirus E
gauccagcagaccuccuc

SEQ ID NO: 3934822 - RNA, 17 nt, Human adenovirus E
gaucccgccccaguacg

SEQ ID NO: 3934823 - RNA, 17 nt, Human adenovirus E
gaucgaccagguggugg

SEQ ID NO: 3934824 - RNA, 20 nt, Human adenovirus E
gaucgaggacgucagcggcg

SEQ ID NO: 3934825 - RNA, 20 nt, Human adenovirus E
gaucggguuggucauccugg

SEQ ID NO: 3934826 - RNA, 14 nt, Human adenovirus E
gaucucgcucaggu

SEQ ID NO: 3934827 - RNA, 16 nt, Human adenovirus E
gaucugacacuacaga

SEQ ID NO: 3934828 - RNA, 15 nt, Human adenovirus E
gaugcaccuguggga

SEQ ID NO: 3934829 - RNA, 13 nt, Human adenovirus E
gaugcagcaggcg

SEQ ID NO: 3934830 - RNA, 12 nt, Human adenovirus E
gaugcaggggcg

SEQ ID NO: 3934831 - RNA, 17 nt, Human adenovirus E
gaugcccacggcccuca

SEQ ID NO: 3934832 - RNA, 14 nt, Human adenovirus E
gaugccgggcagga

SEQ ID NO: 3934833 - RNA, 23 nt, Human adenovirus E
gaugcgcugcucgaccgcaccga

SEQ ID NO: 3934834 - RNA, 22 nt, Human adenovirus E
gaugcggcccaugagcugcgag

SEQ ID NO: 3934835 - RNA, 14 nt, Human adenovirus E
gauggccacgggca

SEQ ID NO: 3934836 - RNA, 20 nt, Human adenovirus E
gauggugaagaugccgggca

SEQ ID NO: 3934837 - RNA, 20 nt, Human adenovirus E
gauuccaagagaagccccug

SEQ ID NO: 3934838 - RNA, 23 nt, Human adenovirus E
gauucccgaaccccaccacccag

SEQ ID NO: 3934839 - RNA, 23 nt, Human adenovirus E
gauuucgaggcggacgagcugac

SEQ ID NO: 3934840 - RNA, 15 nt, Human adenovirus E
gcaacaacagccccc

SEQ ID NO: 3934841 - RNA, 15 nt, Human adenovirus E
gcaaccaccccugcc

SEQ ID NO: 3934842 - RNA, 13 nt, Human adenovirus E
gcaaccugcuggg

SEQ ID NO: 3934843 - RNA, 14 nt, Human adenovirus E
gcaacgcugcacgg

SEQ ID NO: 3934844 - RNA, 15 nt, Human adenovirus E
gcaacuuccugacca

SEQ ID NO: 3934845 - RNA, 17 nt, Human adenovirus E
gcaagacagucuggagg

SEQ ID NO: 3934846 - RNA, 18 nt, Human adenovirus E
gcaagaccaccacucgcc

SEQ ID NO: 3934847 - RNA, 15 nt, Human adenovirus E
gcaagcgccgcagca

SEQ ID NO: 3934848 - RNA, 13 nt, Human adenovirus E
gcaagcuccugca

SEQ ID NO: 3934849 - RNA, 20 nt, Human adenovirus E
gcaaggaggaugcagcagcu

SEQ ID NO: 3934850 - RNA, 16 nt, Human adenovirus E
gcacaaaauucucagg

SEQ ID NO: 3934851 - RNA, 11 nt, Human adenovirus E
gcacaggcagc

SEQ ID NO: 3934852 - RNA, 21 nt, Human adenovirus E
gcaccauggaggugcagacgg

SEQ ID NO: 3934853 - RNA, 13 nt, Human adenovirus E
gcacccgcccccc

SEQ ID NO: 3934854 - RNA, 19 nt, Human adenovirus E
gcacccggugcacucccag

SEQ ID NO: 3934855 - RNA, 23 nt, Human adenovirus E
gcaccucggcccgguuguugaug

SEQ ID NO: 3934856 - RNA, 21 nt, Human adenovirus E
gcaccugugggaccugcugga

SEQ ID NO: 3934857 - RNA, 15 nt, Human adenovirus E
gcacgaagcccugca

SEQ ID NO: 3934858 - RNA, 16 nt, Human adenovirus E
gcacgaagcccugcag

SEQ ID NO: 3934859 - RNA, 16 nt, Human adenovirus E
gcacgacaggcagcgg

SEQ ID NO: 3934860 - RNA, 12 nt, Human adenovirus E
gcacggccagcg

SEQ ID NO: 3934861 - RNA, 17 nt, Human adenovirus E
gcacguggacgagcaga

SEQ ID NO: 3934862 - RNA, 24 nt, Human adenovirus E
gcacguggacgagcagaccuacca

SEQ ID NO: 3934863 - RNA, 14 nt, Human adenovirus E
gcagaacagggcaa

SEQ ID NO: 3934864 - RNA, 17 nt, Human adenovirus E
gcagaccaaccuggacc

SEQ ID NO: 3934865 - RNA, 18 nt, Human adenovirus E
gcagagcaucguggugca

SEQ ID NO: 3934866 - RNA, 14 nt, Human adenovirus E
gcagcacuggaaca

SEQ ID NO: 3934867 - RNA, 20 nt, Human adenovirus E
gcagcagaaaaagaccagca

SEQ ID NO: 3934868 - RNA, 22 nt, Human adenovirus E
gcagcagaggaggcagcaaagu

SEQ ID NO: 3934869 - RNA, 14 nt, Human adenovirus E
gcagccccaggcca

SEQ ID NO: 3934870 - RNA, 16 nt, Human adenovirus E
gcagccccggaugauc

SEQ ID NO: 3934871 - RNA, 13 nt, Human adenovirus E
gcagcgggcccug

SEQ ID NO: 3934872 - RNA, 18 nt, Human adenovirus E
gcagcugaagcaacugca

SEQ ID NO: 3934873 - RNA, 14 nt, Human adenovirus E
gcagcugggacuug

SEQ ID NO: 3934874 - RNA, 17 nt, Human adenovirus E
gcaggaccaccagcacg

SEQ ID NO: 3934875 - RNA, 18 nt, Human adenovirus E
gcagggccaggcgcacgg

SEQ ID NO: 3934876 - RNA, 14 nt, Human adenovirus E
gcagggccuguggg

SEQ ID NO: 3934877 - RNA, 16 nt, Human adenovirus E
gcagggccuguggggc

SEQ ID NO: 3934878 - RNA, 14 nt, Human adenovirus E
gcagggcgcccagc

SEQ ID NO: 3934879 - RNA, 12 nt, Human adenovirus E
gcaggggcgcag

SEQ ID NO: 3934880 - RNA, 16 nt, Human adenovirus E
gcaggggcgcagggca

SEQ ID NO: 3934881 - RNA, 16 nt, Human adenovirus E
gcaggggguccagcau

SEQ ID NO: 3934882 - RNA, 20 nt, Human adenovirus E
gcagguccagaccucggcgc

SEQ ID NO: 3934883 - RNA, 23 nt, Human adenovirus E
gcagguccagaccucggcgcgag

SEQ ID NO: 3934884 - RNA, 18 nt, Human adenovirus E
gcagucauaaucaucugc

SEQ ID NO: 3934885 - RNA, 14 nt, Human adenovirus E
gcagugggcgcaga

SEQ ID NO: 3934886 - RNA, 21 nt, Human adenovirus E
gcaguuauuuuuccuccaccc

SEQ ID NO: 3934887 - RNA, 16 nt, Human adenovirus E
gcauagucugccugcu

SEQ ID NO: 3934888 - RNA, 13 nt, Human adenovirus E
gcaucagcuggaa

SEQ ID NO: 3934889 - RNA, 17 nt, Human adenovirus E
gcaucaucugggccugg

SEQ ID NO: 3934890 - RNA, 14 nt, Human adenovirus E
gcaucccagcugga

SEQ ID NO: 3934891 - RNA, 22 nt, Human adenovirus E
  misc_feature (8)..(8): n is a, c, g or u
gcaucgcnuaccugcgccacca

SEQ ID NO: 3934892 - RNA, 19 nt, Human adenovirus E
gcaucguggugcaggagcg

SEQ ID NO: 3934893 - RNA, 18 nt, Human adenovirus E
gcaucucgauccagcaga

SEQ ID NO: 3934894 - RNA, 13 nt, Human adenovirus E
gcaucugcugcug

SEQ ID NO: 3934895 - RNA, 14 nt, Human adenovirus E
gcaucugcugcugu

SEQ ID NO: 3934896 - RNA, 20 nt, Human adenovirus E
gcaugaauuggcucagcgcc

SEQ ID NO: 3934897 - RNA, 21 nt, Human adenovirus E
gcaugcggaucucgcucaggu

SEQ ID NO: 3934898 - RNA, 14 nt, Human adenovirus E
gcaugcggggggag

SEQ ID NO: 3934899 - RNA, 17 nt, Human adenovirus E
gcaugcuggcuagaccc

SEQ ID NO: 3934900 - RNA, 21 nt, Human adenovirus E
gcaugucccgcccgcggcgag

SEQ ID NO: 3934901 - RNA, 18 nt, Human adenovirus E
gcauguucauuuuugcuu

SEQ ID NO: 3934902 - RNA, 21 nt, Human adenovirus E
gcauguugaucaucgccuugu

SEQ ID NO: 3934903 - RNA, 18 nt, Human adenovirus E
gcauucuuaagcacaccc

SEQ ID NO: 3934904 - RNA, 19 nt, Human adenovirus E
gccaaccggcucucggcca

SEQ ID NO: 3934905 - RNA, 16 nt, Human adenovirus E
gccaacgccaguccag

SEQ ID NO: 3934906 - RNA, 20 nt, Human adenovirus E
gccaacgugccccggggcca

SEQ ID NO: 3934907 - RNA, 13 nt, Human adenovirus E
gccacaccacagc

SEQ ID NO: 3934908 - RNA, 16 nt, Human adenovirus E
gccacaccuggcagac

SEQ ID NO: 3934909 - RNA, 14 nt, Human adenovirus E
gccacucucucaga

SEQ ID NO: 3934910 - RNA, 16 nt, Human adenovirus E
gccagacccagccaga

SEQ ID NO: 3934911 - RNA, 20 nt, Human adenovirus E
gccagagcaggaagcagaga

SEQ ID NO: 3934912 - RNA, 12 nt, Human adenovirus E
gccagaugaugc

SEQ ID NO: 3934913 - RNA, 14 nt, Human adenovirus E
gccagaugaugcaa

SEQ ID NO: 3934914 - RNA, 17 nt, Human adenovirus E
gccagcacccagaccau

SEQ ID NO: 3934915 - RNA, 18 nt, Human adenovirus E
gccagcuccuccucggcc

SEQ ID NO: 3934916 - RNA, 21 nt, Human adenovirus E
gccagcugaguuuucagcccg

SEQ ID NO: 3934917 - RNA, 15 nt, Human adenovirus E
gccaggccugcaaga

SEQ ID NO: 3934918 - RNA, 12 nt, Human adenovirus E
gccaggcgcacg

SEQ ID NO: 3934919 - RNA, 21 nt, Human adenovirus E
gccaggcgcacgggacgcagg

SEQ ID NO: 3934920 - RNA, 16 nt, Human adenovirus E
gccaggguccgguccu

SEQ ID NO: 3934921 - RNA, 22 nt, Human adenovirus E
gccaucacaccuuccaccugau

SEQ ID NO: 3934922 - RNA, 18 nt, Human adenovirus E
gccauguucagggcggcc

SEQ ID NO: 3934923 - RNA, 17 nt, Human adenovirus E
gcccacggcccucagca

SEQ ID NO: 3934924 - RNA, 15 nt, Human adenovirus E
gcccacuccgagacg

SEQ ID NO: 3934925 - RNA, 21 nt, Human adenovirus E
gcccacuuagcauuaccacac

SEQ ID NO: 3934926 - RNA, 22 nt, Human adenovirus E
gcccagcaagauguacggaggc

SEQ ID NO: 3934927 - RNA, 20 nt, Human adenovirus E
gcccagcacacgcccagaaa

SEQ ID NO: 3934928 - RNA, 14 nt, Human adenovirus E
gcccagcaccagca

SEQ ID NO: 3934929 - RNA, 20 nt, Human adenovirus E
gcccagccccgccaccuccg

SEQ ID NO: 3934930 - RNA, 19 nt, Human adenovirus E
gcccaugagcugcgagaag

SEQ ID NO: 3934931 - RNA, 17 nt, Human adenovirus E
gucauggaccaggugcu

SEQ ID NO: 3934932 - RNA, 20 nt, Human adenovirus E
guccacacugguggccaccu

SEQ ID NO: 3934933 - RNA, 20 nt, Human adenovirus E
guccaccuuuuccaggguau

SEQ ID NO: 3934934 - RNA, 20 nt, Human adenovirus E
guccagagauccacggccag

SEQ ID NO: 3934935 - RNA, 16 nt, Human adenovirus E
guccagcuggcgggcg

SEQ ID NO: 3934936 - RNA, 20 nt, Human adenovirus E
guccccagaguuuggaagag

SEQ ID NO: 3934937 - RNA, 17 nt, Human adenovirus E
gucccccacccaguccc

SEQ ID NO: 3934938 - RNA, 19 nt, Human adenovirus E
gucccccgaguuguccugg

SEQ ID NO: 3934939 - RNA, 18 nt, Human adenovirus E
guccggguggaugaugac

SEQ ID NO: 3934940 - RNA, 22 nt, Human adenovirus E
guccgguccuuccagggucgca

SEQ ID NO: 3934941 - RNA, 14 nt, Human adenovirus E
guccucgcggggcc

SEQ ID NO: 3934942 - RNA, 17 nt, Human adenovirus E
guccuggcgggggcaca

SEQ ID NO: 3934943 - RNA, 23 nt, Human adenovirus E
gucgagggucuccuggaugaugu

SEQ ID NO: 3934944 - RNA, 16 nt, Human adenovirus E
gucgaugggcucgccu

SEQ ID NO: 3934945 - RNA, 12 nt, Human adenovirus E
gucgccagggcu

SEQ ID NO: 3934946 - RNA, 13 nt, Human adenovirus E
gucgcccagcgcc

SEQ ID NO: 3934947 - RNA, 15 nt, Human adenovirus E
gucggccaugggcau

SEQ ID NO: 3934948 - RNA, 12 nt, Human adenovirus E
gucgggggcagg

SEQ ID NO: 3934949 - RNA, 15 nt, Human adenovirus E
gucguccccggagag

SEQ ID NO: 3934950 - RNA, 12 nt, Human adenovirus E
gucuaccucuac

SEQ ID NO: 3934951 - RNA, 20 nt, Human adenovirus E
gucuaccucuaccucugcca

SEQ ID NO: 3934952 - RNA, 18 nt, Human adenovirus E
gucuccacguuccacaca

SEQ ID NO: 3934953 - RNA, 19 nt, Human adenovirus E
gucucggugacggcgcgcc

SEQ ID NO: 3934954 - RNA, 14 nt, Human adenovirus E
gucucuucagaugg

SEQ ID NO: 3934955 - RNA, 23 nt, Human adenovirus E
gucugcccgcaggcgggacagag

SEQ ID NO: 3934956 - RNA, 14 nt, Human adenovirus E
gucugccugcuuau

SEQ ID NO: 3934957 - RNA, 17 nt, Human adenovirus E
gucugcgaccugacgga

SEQ ID NO: 3934958 - RNA, 21 nt, Human adenovirus E
gugaacgaguucauguacagc

SEQ ID NO: 3934959 - RNA, 14 nt, Human adenovirus E
gugaagaugccggg

SEQ ID NO: 3934960 - RNA, 20 nt, Human adenovirus E
gugaaggggugcgcgccggg

SEQ ID NO: 3934961 - RNA, 16 nt, Human adenovirus E
gugacccugggccuga

SEQ ID NO: 3934962 - RNA, 16 nt, Human adenovirus E
gugaccgaggugcccc

SEQ ID NO: 3934963 - RNA, 18 nt, Human adenovirus E
gugaccguggagcuggag

SEQ ID NO: 3934964 - RNA, 17 nt, Human adenovirus E
gugagcucgucgggguc

SEQ ID NO: 3934965 - RNA, 13 nt, Human adenovirus E
gugaucgaggacg

SEQ ID NO: 3934966 - RNA, 23 nt, Human adenovirus E
gugcaaccggugcugagacccgg

SEQ ID NO: 3934967 - RNA, 20 nt, Human adenovirus E
gugcagcagaagcgugggcc

SEQ ID NO: 3934968 - RNA, 21 nt, Human adenovirus E
gugcaggcaccgcagcuugcc

SEQ ID NO: 3934969 - RNA, 13 nt, Human adenovirus E
gugcauggacagg

SEQ ID NO: 3934970 - RNA, 14 nt, Human adenovirus E
gugcccgaggccgc

SEQ ID NO: 3934971 - RNA, 18 nt, Human adenovirus E
gugcccgugcgcacccgc

SEQ ID NO: 3934972 - RNA, 24 nt, Human adenovirus E
gugcggcgggcgcagcagcgcaug

SEQ ID NO: 3934973 - RNA, 15 nt, Human adenovirus E
gugcugacccugagc

SEQ ID NO: 3934974 - RNA, 17 nt, Human adenovirus E
gugcugcacaccacccu

SEQ ID NO: 3934975 - RNA, 18 nt, Human adenovirus E
gugcugcacaccacccug

SEQ ID NO: 3934976 - RNA, 19 nt, Human adenovirus E
guggaccucgauuccucgg

SEQ ID NO: 3934977 - RNA, 11 nt, Human adenovirus E
guggacgccgu

SEQ ID NO: 3934978 - RNA, 14 nt, Human adenovirus E
guggagcuggagug

SEQ ID NO: 3934979 - RNA, 21 nt, Human adenovirus E
guggcacgacaggcagcgggg

SEQ ID NO: 3934980 - RNA, 19 nt, Human adenovirus E
guggccagaucguccaggg

SEQ ID NO: 3934981 - RNA, 14 nt, Human adenovirus E
guggcggugcaggc

SEQ ID NO: 3934982 - RNA, 18 nt, Human adenovirus E
gugucgagccugcugacg

SEQ ID NO: 3934983 - RNA, 11 nt, Human adenovirus E
guguugaaauu

SEQ ID NO: 3934984 - RNA, 20 nt, Human adenovirus E
guguugcacaauaucuuuga

SEQ ID NO: 3934985 - RNA, 21 nt, Human adenovirus E
guuacugacgccagacgccgc

SEQ ID NO: 3934986 - RNA, 18 nt, Human adenovirus E
guuauuuuuccuccaccc

SEQ ID NO: 3934987 - RNA, 14 nt, Human adenovirus E
guucagggaggcgc

SEQ ID NO: 3934988 - RNA, 20 nt, Human adenovirus E
guucagggaggcgcugcuga

SEQ ID NO: 3934989 - RNA, 21 nt, Human adenovirus E
guucaucaauaaacugaugga

SEQ ID NO: 3934990 - RNA, 13 nt, Human adenovirus E
guucauuuuugcu

SEQ ID NO: 3934991 - RNA, 20 nt, Human adenovirus E
guucauuuuugcuugcugcu

SEQ ID NO: 3934992 - RNA, 16 nt, Human adenovirus E
guuccggagcagcugg

SEQ ID NO: 3934993 - RNA, 16 nt, Human adenovirus E
guuccugaugcaggag

SEQ ID NO: 3934994 - RNA, 23 nt, Human adenovirus E
guuccugugggacgauguggaca

SEQ ID NO: 3934995 - RNA, 14 nt, Human adenovirus E
guucuacgaggacc

SEQ ID NO: 3934996 - RNA, 19 nt, Human adenovirus E
guucuuuuaacagaacauu

SEQ ID NO: 3934997 - RNA, 21 nt, Human adenovirus E
guugagggagagacagcugcc

SEQ ID NO: 3934998 - RNA, 20 nt, Human adenovirus E
guugaugaccugggcggcga

SEQ ID NO: 3934999 - RNA, 19 nt, Human adenovirus E
guugauuuuaacacagagu

SEQ ID NO: 3935000 - RNA, 18 nt, Human adenovirus E
guugcagggcgcccagca

SEQ ID NO: 3935001 - RNA, 19 nt, Human adenovirus E
guuggacuugggugggagu

SEQ ID NO: 3935002 - RNA, 23 nt, Human adenovirus E
guuggguuucggugacggcgggg

SEQ ID NO: 3935003 - RNA, 18 nt, Human adenovirus E
guugucgagcuugguggc

SEQ ID NO: 3935004 - RNA, 12 nt, Human adenovirus E
guuguuggccag

SEQ ID NO: 3935005 - RNA, 17 nt, Human adenovirus E
uaaacuuucgccagcuu

SEQ ID NO: 3935006 - RNA, 16 nt, Human adenovirus E
uaaccgccccgccgcc

SEQ ID NO: 3935007 - RNA, 21 nt, Human adenovirus E
uaaccgccccgccgcccagcc

SEQ ID NO: 3935008 - RNA, 22 nt, Human adenovirus E
uaaccggcggagaugacugacc

SEQ ID NO: 3935009 - RNA, 17 nt, Human adenovirus E
uaaccuguccacccgcu

SEQ ID NO: 3935010 - RNA, 21 nt, Human adenovirus E
uacacauacaaagccucagcg

SEQ ID NO: 3935011 - RNA, 16 nt, Human adenovirus E
uacacaugaucagcgg

SEQ ID NO: 3935012 - RNA, 13 nt, Human adenovirus E
uacaccaacuuca

SEQ ID NO: 3935013 - RNA, 18 nt, Human adenovirus E
uacacccccggaacauug

SEQ ID NO: 3935014 - RNA, 13 nt, Human adenovirus E
uacaccuguuacc

SEQ ID NO: 3935015 - RNA, 18 nt, Human adenovirus E
uaccacaucacccucugg

SEQ ID NO: 3935016 - RNA, 22 nt, Human adenovirus E
uaccagauccucagguaaauca

SEQ ID NO: 3935017 - RNA, 22 nt, Human adenovirus E
uaccgcggucauaccagcagcc

SEQ ID NO: 3935018 - RNA, 11 nt, Human adenovirus E
uaccuccaccu

SEQ ID NO: 3935019 - RNA, 17 nt, Human adenovirus E
uaccucugccacaccug

SEQ ID NO: 3935020 - RNA, 21 nt, Human adenovirus E
uaccucugccacaccuggcag

SEQ ID NO: 3935021 - RNA, 15 nt, Human adenovirus E
uaccugcgccaccac

SEQ ID NO: 3935022 - RNA, 20 nt, Human adenovirus E
uaccugcugcgccuggccaa

SEQ ID NO: 3935023 - RNA, 20 nt, Human adenovirus E
uaccuggcgccuacggaggg

SEQ ID NO: 3935024 - RNA, 23 nt, Human adenovirus E
uacgcacgucuucaaccgcuucc

SEQ ID NO: 3935025 - RNA, 21 nt, Human adenovirus E
uacucacaccacacacacaga

SEQ ID NO: 3935026 - RNA, 14 nt, Human adenovirus E
uacugaucugauac

SEQ ID NO: 3935027 - RNA, 15 nt, Human adenovirus E
uacugaucugauacu

SEQ ID NO: 3935028 - RNA, 22 nt, Human adenovirus E
uacuggccacugugucagucuu

SEQ ID NO: 3935029 - RNA, 16 nt, Human adenovirus E
uacuucuuccagacca

SEQ ID NO: 3935030 - RNA, 20 nt, Human adenovirus E
uacuugcuguagcagaaccu

SEQ ID NO: 3935031 - RNA, 16 nt, Human adenovirus E
uagagcuugggggcga

SEQ ID NO: 3935032 - RNA, 17 nt, Human adenovirus E
uagcaagaacaggagcu

SEQ ID NO: 3935033 - RNA, 16 nt, Human adenovirus E
uagcauguagaacugg

SEQ ID NO: 3935034 - RNA, 16 nt, Human adenovirus E
uagcauuaccacacag

SEQ ID NO: 3935035 - RNA, 17 nt, Human adenovirus E
uagcauuaccacacaga

SEQ ID NO: 3935036 - RNA, 21 nt, Human adenovirus E
uagccgccuccacccaucauc

SEQ ID NO: 3935037 - RNA, 14 nt, Human adenovirus E
uagcuaccgccucu

SEQ ID NO: 3935038 - RNA, 19 nt, Human adenovirus E
uagcucggcuucgacaccu

SEQ ID NO: 3935039 - RNA, 16 nt, Human adenovirus E
uagcugaagcccacgg

SEQ ID NO: 3935040 - RNA, 20 nt, Human adenovirus E
uagcuuuauuaaagauguga

SEQ ID NO: 3935041 - RNA, 14 nt, Human adenovirus E
uagucauacagcuc

SEQ ID NO: 3935042 - RNA, 19 nt, Human adenovirus E
uaucaugcaacuuggaagg

SEQ ID NO: 3935043 - RNA, 15 nt, Human adenovirus E
uaucuuugaggagga

SEQ ID NO: 3935044 - RNA, 19 nt, Human adenovirus E
uaugaggccgagccacagc

SEQ ID NO: 3935045 - RNA, 22 nt, Human adenovirus E
uaugccaucuuccagcagaguc

SEQ ID NO: 3935046 - RNA, 14 nt, Human adenovirus E
uaugcgcaggagca

SEQ ID NO: 3935047 - RNA, 24 nt, Human adenovirus E
gacggccuuguaggcgcagcagcc

SEQ ID NO: 3935048 - RNA, 14 nt, Human adenovirus E
gacggcgacuaccu

SEQ ID NO: 3935049 - RNA, 12 nt, Human adenovirus E
gacggcggccug

SEQ ID NO: 3935050 - RNA, 19 nt, Human adenovirus E
gacgggcucucgccgccgc

SEQ ID NO: 3935051 - RNA, 16 nt, Human adenovirus E
gacggguuccuguggg

SEQ ID NO: 3935052 - RNA, 19 nt, Human adenovirus E
gacguaugcgcaggagcac

SEQ ID NO: 3935053 - RNA, 14 nt, Human adenovirus E
gacguccagagcgc

SEQ ID NO: 3935054 - RNA, 14 nt, Human adenovirus E
gacuaccuccaccu

SEQ ID NO: 3935055 - RNA, 13 nt, Human adenovirus E
gacucccaccugc

SEQ ID NO: 3935056 - RNA, 20 nt, Human adenovirus E
gacuccgcgcaaggaccuga

SEQ ID NO: 3935057 - RNA, 13 nt, Human adenovirus E
gacugggcggugc

SEQ ID NO: 3935058 - RNA, 12 nt, Human adenovirus E
gagaaaagcaag

SEQ ID NO: 3935059 - RNA, 22 nt, Human adenovirus E
gagaaccgccuggggcagaacg

SEQ ID NO: 3935060 - RNA, 15 nt, Human adenovirus E
gagaccgagcuccag

SEQ ID NO: 3935061 - RNA, 13 nt, Human adenovirus E
gagacgaugggca

SEQ ID NO: 3935062 - RNA, 14 nt, Human adenovirus E
gagacgaugggcag

SEQ ID NO: 3935063 - RNA, 20 nt, Human adenovirus E
gagaguuucaugaccagcau

SEQ ID NO: 3935064 - RNA, 13 nt, Human adenovirus E
gagauccacggcc

SEQ ID NO: 3935065 - RNA, 19 nt, Human adenovirus E
gagaugcggcccaugagcu

SEQ ID NO: 3935066 - RNA, 13 nt, Human adenovirus E
gagauggaggaag

SEQ ID NO: 3935067 - RNA, 14 nt, Human adenovirus E
gagcacgaggagga

SEQ ID NO: 3935068 - RNA, 19 nt, Human adenovirus E
gagcagaccuaccaggaga

SEQ ID NO: 3935069 - RNA, 20 nt, Human adenovirus E
gagcaugacggcgacuaccu

SEQ ID NO: 3935070 - RNA, 18 nt, Human adenovirus E
gagcaugagcaccacagc

SEQ ID NO: 3935071 - RNA, 20 nt, Human adenovirus E
gagcauuacucucaucaagu

SEQ ID NO: 3935072 - RNA, 15 nt, Human adenovirus E
gagccacaccacagc

SEQ ID NO: 3935073 - RNA, 15 nt, Human adenovirus E
gagccacugcuaccu

SEQ ID NO: 3935074 - RNA, 13 nt, Human adenovirus E
gagcccgagggcc

SEQ ID NO: 3935075 - RNA, 18 nt, Human adenovirus E
gagccgcgcccugggcca

SEQ ID NO: 3935076 - RNA, 23 nt, Human adenovirus E
gagccggcgcaaacccgggagcu

SEQ ID NO: 3935077 - RNA, 17 nt, Human adenovirus E
gagccggucguccccgg

SEQ ID NO: 3935078 - RNA, 13 nt, Human adenovirus E
gagcgcauccugc

SEQ ID NO: 3935079 - RNA, 15 nt, Human adenovirus E
gagcgccagcaggcg

SEQ ID NO: 3935080 - RNA, 15 nt, Human adenovirus E
gagcgcgagcaagga

SEQ ID NO: 3935081 - RNA, 19 nt, Human adenovirus E
gagcucggagggggggauc

SEQ ID NO: 3935082 - RNA, 22 nt, Human adenovirus E
gagcucuaaccuguccacccgc

SEQ ID NO: 3935083 - RNA, 17 nt, Human adenovirus E
gagcucugcaagcuccu

SEQ ID NO: 3935084 - RNA, 16 nt, Human adenovirus E
gagcugcggcgcggcc

SEQ ID NO: 3935085 - RNA, 24 nt, Human adenovirus E
gagcuugggggcgaggaagacgga

SEQ ID NO: 3935086 - RNA, 16 nt, Human adenovirus E
gaggaagacugggaca

SEQ ID NO: 3935087 - RNA, 13 nt, Human adenovirus E
gaggacccaccgc

SEQ ID NO: 3935088 - RNA, 21 nt, Human adenovirus E
gaggacuacaccaacuucauc

SEQ ID NO: 3935089 - RNA, 19 nt, Human adenovirus E
gaggagacugauggccacg

SEQ ID NO: 3935090 - RNA, 13 nt, Human adenovirus E
gaggagcccgagg

SEQ ID NO: 3935091 - RNA, 22 nt, Human adenovirus E
gaggagcucaaccccggcuucc

SEQ ID NO: 3935092 - RNA, 23 nt, Human adenovirus E
gaggagcucagccgcgccuacga

SEQ ID NO: 3935093 - RNA, 16 nt, Human adenovirus E
gaggagcuggcagugc

SEQ ID NO: 3935094 - RNA, 12 nt, Human adenovirus E
gaggaggagcug

SEQ ID NO: 3935095 - RNA, 17 nt, Human adenovirus E
gaggaggaggcagagga

SEQ ID NO: 3935096 - RNA, 16 nt, Human adenovirus E
gaggaggggggccacc

SEQ ID NO: 3935097 - RNA, 20 nt, Human adenovirus E
gaggaucgcggcgaacgagc

SEQ ID NO: 3935098 - RNA, 16 nt, Human adenovirus E
gaggcagguccagacc

SEQ ID NO: 3935099 - RNA, 12 nt, Human adenovirus E
gaggccagcacc

SEQ ID NO: 3935100 - RNA, 16 nt, Human adenovirus E
gaggccagcacccaga

SEQ ID NO: 3935101 - RNA, 15 nt, Human adenovirus E
gaggccaucggccag

SEQ ID NO: 3935102 - RNA, 16 nt, Human adenovirus E
gaggccaucgugcaga

SEQ ID NO: 3935103 - RNA, 14 nt, Human adenovirus E
gaggccgagccaca

SEQ ID NO: 3935104 - RNA, 19 nt, Human adenovirus E
gaggcguacaugccgcaga

SEQ ID NO: 3935105 - RNA, 15 nt, Human adenovirus E
gaggguucagccgcc

SEQ ID NO: 3935106 - RNA, 18 nt, Human adenovirus E
gagguacaugggcaugag

SEQ ID NO: 3935107 - RNA, 13 nt, Human adenovirus E
gaguaccuggaag

SEQ ID NO: 3935108 - RNA, 14 nt, Human adenovirus E
gaguauggcaccag

SEQ ID NO: 3935109 - RNA, 13 nt, Human adenovirus E
gaguccagcgcgu

SEQ ID NO: 3935110 - RNA, 19 nt, Human adenovirus E
gagucgcggaugaaguggg

SEQ ID NO: 3935111 - RNA, 13 nt, Human adenovirus E
gagucgggggcag

SEQ ID NO: 3935112 - RNA, 16 nt, Human adenovirus E
gaguuggaggagaugg

SEQ ID NO: 3935113 - RNA, 23 nt, Human adenovirus E
gauaccacccgguuguaccuggu

SEQ ID NO: 3935114 - RNA, 15 nt, Human adenovirus E
gauauucuggagcag

SEQ ID NO: 3935115 - RNA, 20 nt, Human adenovirus E
gaucaucgccuugugcaugg

SEQ ID NO: 3935116 - RNA, 12 nt, Human adenovirus E
gauccagcggcg

SEQ ID NO: 3935117 - RNA, 17 nt, Human adenovirus E
gccgccgcgcaucucca

SEQ ID NO: 3935118 - RNA, 19 nt, Human adenovirus E
gccgccgcgcaucuccagg

SEQ ID NO: 3935119 - RNA, 13 nt, Human adenovirus E
gccgccuccaccc

SEQ ID NO: 3935120 - RNA, 20 nt, Human adenovirus E
gccgcgcccugggccaggac

SEQ ID NO: 3935121 - RNA, 16 nt, Human adenovirus E
gccgcggccaaccugg

SEQ ID NO: 3935122 - RNA, 13 nt, Human adenovirus E
gccgcggccgccg

SEQ ID NO: 3935123 - RNA, 12 nt, Human adenovirus E
gccgcggugcuc

SEQ ID NO: 3935124 - RNA, 23 nt, Human adenovirus E
gccgcuccgucaagcugcugcuc

SEQ ID NO: 3935125 - RNA, 13 nt, Human adenovirus E
gccgcuggcuccu

SEQ ID NO: 3935126 - RNA, 16 nt, Human adenovirus E
gccgcuggcuccugga

SEQ ID NO: 3935127 - RNA, 20 nt, Human adenovirus E
gccgcuggcuccuggaccug

SEQ ID NO: 3935128 - RNA, 15 nt, Human adenovirus E
gccgcuuccgcugcu

SEQ ID NO: 3935129 - RNA, 23 nt, Human adenovirus E
gccggacuacuucuuccagacca

SEQ ID NO: 3935130 - RNA, 17 nt, Human adenovirus E
gccggagcggcacccgc

SEQ ID NO: 3935131 - RNA, 14 nt, Human adenovirus E
gccggcgcuucugc

SEQ ID NO: 3935132 - RNA, 20 nt, Human adenovirus E
gccggcgcuucugcccccgc

SEQ ID NO: 3935133 - RNA, 18 nt, Human adenovirus E
gccggcgucgcauggucu

SEQ ID NO: 3935134 - RNA, 18 nt, Human adenovirus E
gccguccucccggaggag

SEQ ID NO: 3935135 - RNA, 13 nt, Human adenovirus E
gccguggcccagc

SEQ ID NO: 3935136 - RNA, 18 nt, Human adenovirus E
gccucaggagugaugaag

SEQ ID NO: 3935137 - RNA, 20 nt, Human adenovirus E
gccucaggagugaugaagau

SEQ ID NO: 3935138 - RNA, 19 nt, Human adenovirus E
gccucaggcugacgcugcg

SEQ ID NO: 3935139 - RNA, 16 nt, Human adenovirus E
gccuccuuggaagagg

SEQ ID NO: 3935140 - RNA, 15 nt, Human adenovirus E
gccucggaccuggcc

SEQ ID NO: 3935141 - RNA, 17 nt, Human adenovirus E
gccucgugcucgggggu

SEQ ID NO: 3935142 - RNA, 19 nt, Human adenovirus E
gccucugggugaaggccac

SEQ ID NO: 3935143 - RNA, 22 nt, Human adenovirus E
gccucuguuaaauuuuugcuuu

SEQ ID NO: 3935144 - RNA, 22 nt, Human adenovirus E
gccugcaagacagucuggagga

SEQ ID NO: 3935145 - RNA, 19 nt, Human adenovirus E
gccugcugacgccgaacuc

SEQ ID NO: 3935146 - RNA, 18 nt, Human adenovirus E
gccugcugggccuuggcu

SEQ ID NO: 3935147 - RNA, 23 nt, Human adenovirus E
gccuggaccgaaagagggugcug

SEQ ID NO: 3935148 - RNA, 14 nt, Human adenovirus E
gccuggcccucuuc

SEQ ID NO: 3935149 - RNA, 20 nt, Human adenovirus E
gccuggccgccggugccgcc

SEQ ID NO: 3935150 - RNA, 23 nt, Human adenovirus E
gccugguggacaagaugagccgc

SEQ ID NO: 3935151 - RNA, 19 nt, Human adenovirus E
gccuguuccugaugcagga

SEQ ID NO: 3935152 - RNA, 22 nt, Human adenovirus E
gccuuagcuuugacaguacagg

SEQ ID NO: 3935153 - RNA, 20 nt, Human adenovirus E
gccuucaccaccugcaucug

SEQ ID NO: 3935154 - RNA, 16 nt, Human adenovirus E
gccuuggcaguacagu

SEQ ID NO: 3935155 - RNA, 19 nt, Human adenovirus E
gccuuguaggcgcagcagc

SEQ ID NO: 3935156 - RNA, 19 nt, Human adenovirus E
gccuuugugcccgcccagg

SEQ ID NO: 3935157 - RNA, 14 nt, Human adenovirus E
gcgaacgcucugca

SEQ ID NO: 3935158 - RNA, 15 nt, Human adenovirus E
gcgaacuccauggcu

SEQ ID NO: 3935159 - RNA, 13 nt, Human adenovirus E
gcgagacgcccag

SEQ ID NO: 3935160 - RNA, 15 nt, Human adenovirus E
gcgagcaaggacaga

SEQ ID NO: 3935161 - RNA, 19 nt, Human adenovirus E
gcgagcagaaggggggcag

SEQ ID NO: 3935162 - RNA, 21 nt, Human adenovirus E
gcgagcugagcgaccaggagc

SEQ ID NO: 3935163 - RNA, 22 nt, Human adenovirus E
gcgaggccaucggccaggcgca

SEQ ID NO: 3935164 - RNA, 13 nt, Human adenovirus E
gcgagggggcgag

SEQ ID NO: 3935165 - RNA, 13 nt, Human adenovirus E
gcgagggugcgcu

SEQ ID NO: 3935166 - RNA, 15 nt, Human adenovirus E
gcgagggugcugccg

SEQ ID NO: 3935167 - RNA, 14 nt, Human adenovirus E
gcgaguaccuggaa

SEQ ID NO: 3935168 - RNA, 16 nt, Human adenovirus E
gcgaugcgggcggcgc

SEQ ID NO: 3935169 - RNA, 17 nt, Human adenovirus E
gcgaugcgggcggcgcu

SEQ ID NO: 3935170 - RNA, 16 nt, Human adenovirus E
gcgauggcggcggcgg

SEQ ID NO: 3935171 - RNA, 22 nt, Human adenovirus E
gcgaugggcccgugggcggcgg

SEQ ID NO: 3935172 - RNA, 19 nt, Human adenovirus E
gcgauguugagcugcacgu

SEQ ID NO: 3935173 - RNA, 23 nt, Human adenovirus E
gcgcaaacccgggagcugaggaa

SEQ ID NO: 3935174 - RNA, 15 nt, Human adenovirus E
gcgccaucagcaagc

SEQ ID NO: 3935175 - RNA, 16 nt, Human adenovirus E
gcgcccgccuaccuga

SEQ ID NO: 3935176 - RNA, 23 nt, Human adenovirus E
gcgccgcagcaguggcagcggcc

SEQ ID NO: 3935177 - RNA, 19 nt, Human adenovirus E
gcgccgcagugggcgcaga

SEQ ID NO: 3935178 - RNA, 14 nt, Human adenovirus E
ggauacggaggcgg

SEQ ID NO: 3935179 - RNA, 19 nt, Human adenovirus E
ggaucagcaguuugggcag

SEQ ID NO: 3935180 - RNA, 15 nt, Human adenovirus E
ggaucagcaucaucu

SEQ ID NO: 3935181 - RNA, 18 nt, Human adenovirus E
ggaucagcaucaucuggg

SEQ ID NO: 3935182 - RNA, 12 nt, Human adenovirus E
ggaucagccccg

SEQ ID NO: 3935183 - RNA, 18 nt, Human adenovirus E
ggaucugaaaaccgcuga

SEQ ID NO: 3935184 - RNA, 11 nt, Human adenovirus E
ggaugagcucg

SEQ ID NO: 3935185 - RNA, 21 nt, Human adenovirus E
ggaugaugauauucuggagca

SEQ ID NO: 3935186 - RNA, 24 nt, Human adenovirus E
ggaugcaugcggggggagaugagg

SEQ ID NO: 3935187 - RNA, 13 nt, Human adenovirus E
ggauggcuggcag

SEQ ID NO: 3935188 - RNA, 17 nt, Human adenovirus E
ggauggcuggcagagcc

SEQ ID NO: 3935189 - RNA, 17 nt, Human adenovirus E
ggaugucaaauuccucc

SEQ ID NO: 3935190 - RNA, 19 nt, Human adenovirus E
ggcaauccucgcacagaac

SEQ ID NO: 3935191 - RNA, 19 nt, Human adenovirus E
ggcaccggagcacccccgc

SEQ ID NO: 3935192 - RNA, 14 nt, Human adenovirus E
ggcacgacaggcag

SEQ ID NO: 3935193 - RNA, 23 nt, Human adenovirus E
ggcacggggaacucuugcaggac

SEQ ID NO: 3935194 - RNA, 17 nt, Human adenovirus E
ggcagaacgugcugcac

SEQ ID NO: 3935195 - RNA, 20 nt, Human adenovirus E
ggcagaggaggacagccugc

SEQ ID NO: 3935196 - RNA, 17 nt, Human adenovirus E
ggcagaggaggaggaga

SEQ ID NO: 3935197 - RNA, 19 nt, Human adenovirus E
ggcagcagugucuggagga

SEQ ID NO: 3935198 - RNA, 22 nt, Human adenovirus E
ggcagcagugucuggaggagca

SEQ ID NO: 3935199 - RNA, 21 nt, Human adenovirus E
ggcagggauacaaguccuggc

SEQ ID NO: 3935200 - RNA, 23 nt, Human adenovirus E
ggcagggauacaaguccuggcgg

SEQ ID NO: 3935201 - RNA, 19 nt, Human adenovirus E
ggcagugguggcgggggag

SEQ ID NO: 3935202 - RNA, 23 nt, Human adenovirus E
ggcauacgugcccaagcagaacc

SEQ ID NO: 3935203 - RNA, 22 nt, Human adenovirus E
ggcauucuuaagcacacccuca

SEQ ID NO: 3935204 - RNA, 18 nt, Human adenovirus E
ggcauugucggugugcuu

SEQ ID NO: 3935205 - RNA, 16 nt, Human adenovirus E
ggcauuguuuuuugca

SEQ ID NO: 3935206 - RNA, 22 nt, Human adenovirus E
ggccaccucgccgcgcaggggc

SEQ ID NO: 3935207 - RNA, 20 nt, Human adenovirus E
ggccacgagccggggcagcg

SEQ ID NO: 3935208 - RNA, 21 nt, Human adenovirus E
ggccagaucguccagggcagc

SEQ ID NO: 3935209 - RNA, 22 nt, Human adenovirus E
ggccagaucguccagggcagcu

SEQ ID NO: 3935210 - RNA, 15 nt, Human adenovirus E
ggccagcugcaccac

SEQ ID NO: 3935211 - RNA, 19 nt, Human adenovirus E
ggccaggacgacccgggca

SEQ ID NO: 3935212 - RNA, 13 nt, Human adenovirus E
ggccauccuggag

SEQ ID NO: 3935213 - RNA, 23 nt, Human adenovirus E
ggccccgcagcagucgcugccgc

SEQ ID NO: 3935214 - RNA, 20 nt, Human adenovirus E
ggcccgcuacaacagcacca

SEQ ID NO: 3935215 - RNA, 22 nt, Human adenovirus E
ggcccggaugcaggggcggcag

SEQ ID NO: 3935216 - RNA, 15 nt, Human adenovirus E
ggcccggcaggccac

SEQ ID NO: 3935217 - RNA, 20 nt, Human adenovirus E
ggccgaccccgucaccacca

SEQ ID NO: 3935218 - RNA, 13 nt, Human adenovirus E
ggccgaccucauu

SEQ ID NO: 3935219 - RNA, 19 nt, Human adenovirus E
ggccgagcugucggccugc

SEQ ID NO: 3935220 - RNA, 16 nt, Human adenovirus E
ggccgccagcuccucc

SEQ ID NO: 3935221 - RNA, 15 nt, Human adenovirus E
ggccgccggugccgc

SEQ ID NO: 3935222 - RNA, 19 nt, Human adenovirus E
ggccgccgugagcggggcu

SEQ ID NO: 3935223 - RNA, 18 nt, Human adenovirus E
ggccgcuggcuccuggac

SEQ ID NO: 3935224 - RNA, 17 nt, Human adenovirus E
ggccggagcuguccagg

SEQ ID NO: 3935225 - RNA, 21 nt, Human adenovirus E
ggccugaugcaccugugggac

SEQ ID NO: 3935226 - RNA, 15 nt, Human adenovirus E
ggccugcaaccccca

SEQ ID NO: 3935227 - RNA, 17 nt, Human adenovirus E
ggccugcaacccccagc

SEQ ID NO: 3935228 - RNA, 18 nt, Human adenovirus E
ggccugcgcgcgcccagc

SEQ ID NO: 3935229 - RNA, 21 nt, Human adenovirus E
ggccugcgcgcgcccagcaag

SEQ ID NO: 3935230 - RNA, 21 nt, Human adenovirus E
ggccugcgucgccggcggcgc

SEQ ID NO: 3935231 - RNA, 23 nt, Human adenovirus E
ggccuguuccugaugcaggaggg

SEQ ID NO: 3935232 - RNA, 19 nt, Human adenovirus E
ggccuuggaggcggcggca

SEQ ID NO: 3935233 - RNA, 17 nt, Human adenovirus E
ggcgaagacgcgcgccg

SEQ ID NO: 3935234 - RNA, 20 nt, Human adenovirus E
ggcgagaucgagggcgagcu

SEQ ID NO: 3935235 - RNA, 13 nt, Human adenovirus E
ggcgagggccugc

SEQ ID NO: 3935236 - RNA, 17 nt, Human adenovirus E
ggcgaguaccuggaaga

SEQ ID NO: 3935237 - RNA, 14 nt, Human adenovirus E
ggcgauccccggca

SEQ ID NO: 3935238 - RNA, 22 nt, Human adenovirus E
ggcgcaaguacggcgcggccag

SEQ ID NO: 3935239 - RNA, 20 nt, Human adenovirus E
ggcgcacgggacgcagggcc

SEQ ID NO: 3935240 - RNA, 22 nt, Human adenovirus E
ggcgcccugcgcgucggccagg

SEQ ID NO: 3935241 - RNA, 21 nt, Human adenovirus E
ggcgcgacuacauccgcgacu

SEQ ID NO: 3935242 - RNA, 15 nt, Human adenovirus E
ggcgcggaggaagga

SEQ ID NO: 3935243 - RNA, 17 nt, Human adenovirus E
ggcgcugcagagccagc

SEQ ID NO: 3935244 - RNA, 22 nt, Human adenovirus E
ggcggcagaacggggugcugga

SEQ ID NO: 3935245 - RNA, 20 nt, Human adenovirus E
ggcggccuugcgcagggagg

SEQ ID NO: 3935246 - RNA, 17 nt, Human adenovirus E
ggcggcgauguugagcu

SEQ ID NO: 3935247 - RNA, 17 nt, Human adenovirus E
ggcgggggagaugagcu

SEQ ID NO: 3935248 - RNA, 22 nt, Human adenovirus E
ggcgggggagaugagcugggcc

SEQ ID NO: 3935249 - RNA, 19 nt, Human adenovirus E
ggcgugcgcuccuggacgc

SEQ ID NO: 3935250 - RNA, 17 nt, Human adenovirus E
ggcuaccgcggcacgcg

SEQ ID NO: 3935251 - RNA, 21 nt, Human adenovirus E
ggcuccgcgacacggcacgcg

SEQ ID NO: 3935252 - RNA, 15 nt, Human adenovirus E
ggcuccuggaccugg

SEQ ID NO: 3935253 - RNA, 23 nt, Human adenovirus E
ggcucgucugccguagucuggag

SEQ ID NO: 3935254 - RNA, 17 nt, Human adenovirus E
ggcucugaaccugcccc

SEQ ID NO: 3935255 - RNA, 13 nt, Human adenovirus E
ggcuggagccgca

SEQ ID NO: 3935256 - RNA, 15 nt, Human adenovirus E
ggcuggggcgacggg

SEQ ID NO: 3935257 - RNA, 21 nt, Human adenovirus E
ggcuggucgaaaaccgcuccc

SEQ ID NO: 3935258 - RNA, 16 nt, Human adenovirus E
gggacucccucagcau

SEQ ID NO: 3935259 - RNA, 20 nt, Human adenovirus E
gggagcugcggcgcggccug

SEQ ID NO: 3935260 - RNA, 10 nt, Human adenovirus E
gggaggaaca

SEQ ID NO: 3935261 - RNA, 16 nt, Human adenovirus E
gggauagaaagccugg

SEQ ID NO: 3935262 - RNA, 19 nt, Human adenovirus E
gggauccaugguggcgcug

SEQ ID NO: 3935263 - RNA, 22 nt, Human adenovirus E
gggcagacggucgaugaagcgc

SEQ ID NO: 3935264 - RNA, 15 nt, Human adenovirus E
gggcaggaggucggg

SEQ ID NO: 3935265 - RNA, 22 nt, Human adenovirus E
gggcauaaaguugcgagugaug

SEQ ID NO: 3935266 - RNA, 22 nt, Human adenovirus E
gggcaugggcguguggcagcag

SEQ ID NO: 3935267 - RNA, 12 nt, Human adenovirus E
gggccaccccca

SEQ ID NO: 3935268 - RNA, 16 nt, Human adenovirus E
gggccacgagccgggg

SEQ ID NO: 3935269 - RNA, 17 nt, Human adenovirus E
gggccagacccagccag

SEQ ID NO: 3935270 - RNA, 18 nt, Human adenovirus E
gggccagacccagccaga

SEQ ID NO: 3935271 - RNA, 15 nt, Human adenovirus E
gggccauguucaggg

SEQ ID NO: 3935272 - RNA, 16 nt, Human adenovirus E
gggccucgugcucggg

SEQ ID NO: 3935273 - RNA, 12 nt, Human adenovirus E
gggccugugggg

SEQ ID NO: 3935274 - RNA, 13 nt, Human adenovirus E
gggcgcagggcau

SEQ ID NO: 3935275 - RNA, 14 nt, Human adenovirus E
gggcgcccagcagg

SEQ ID NO: 3935276 - RNA, 13 nt, Human adenovirus E
gggcgcggaccug

SEQ ID NO: 3935277 - RNA, 20 nt, Human adenovirus E
gggcggcgcugcagagccag

SEQ ID NO: 3935278 - RNA, 15 nt, Human adenovirus E
gggcguagagcuugg

SEQ ID NO: 3935279 - RNA, 16 nt, Human adenovirus E
gggcguagagcuuggg

SEQ ID NO: 3935280 - RNA, 20 nt, Human adenovirus E
gggcguccagcgcagccagg

SEQ ID NO: 3935281 - RNA, 21 nt, Human adenovirus E
gggcguccagcgcagccaggg

SEQ ID NO: 3935282 - RNA, 14 nt, Human adenovirus E
gggcgucgucgccg

SEQ ID NO: 3935283 - RNA, 17 nt, Human adenovirus E
gggcgucgucgccggag

SEQ ID NO: 3935284 - RNA, 16 nt, Human adenovirus E
gggcgugccccagggc

SEQ ID NO: 3935285 - RNA, 14 nt, Human adenovirus E
gggcuaacucuuau

SEQ ID NO: 3935286 - RNA, 19 nt, Human adenovirus E
gggcucucgccgccgcgac

SEQ ID NO: 3935287 - RNA, 16 nt, Human adenovirus E
gggcuggcgcgccugg

SEQ ID NO: 3935288 - RNA, 14 nt, Human adenovirus E
ggggaacccguccu

SEQ ID NO: 3935289 - RNA, 22 nt, Human adenovirus E
ggggaacccguccugaucugca

SEQ ID NO: 3935290 - RNA, 15 nt, Human adenovirus E
ggggacgagcugcuu

SEQ ID NO: 3935291 - RNA, 20 nt, Human adenovirus E
ggggcaguuucuugagcucc

SEQ ID NO: 3935292 - RNA, 23 nt, Human adenovirus E
ggggccacgagccggggcagcgc

SEQ ID NO: 3935293 - RNA, 23 nt, Human adenovirus E
cccagucauagcaggggcgcagg

SEQ ID NO: 3935294 - RNA, 14 nt, Human adenovirus E
cccauagccagccg

SEQ ID NO: 3935295 - RNA, 19 nt, Human adenovirus E
cccaugaucaagcccagca

SEQ ID NO: 3935296 - RNA, 20 nt, Human adenovirus E
cccaugaucaagcccagcac

SEQ ID NO: 3935297 - RNA, 19 nt, Human adenovirus E
cccaugguggcgcagcuga

SEQ ID NO: 3935298 - RNA, 23 nt, Human adenovirus E
cccauggugggcacgcacccggg

SEQ ID NO: 3935299 - RNA, 17 nt, Human adenovirus E
ccccaccaugcagcuga

SEQ ID NO: 3935300 - RNA, 16 nt, Human adenovirus E
ccccaggaugccccga

SEQ ID NO: 3935301 - RNA, 23 nt, Human adenovirus E
ccccagggauaggagcuccugga

SEQ ID NO: 3935302 - RNA, 20 nt, Human adenovirus E
cccccaaagucaugagcgcg

SEQ ID NO: 3935303 - RNA, 17 nt, Human adenovirus E
cccccagcgguucuggg

SEQ ID NO: 3935304 - RNA, 12 nt, Human adenovirus E
cccccggaacau

SEQ ID NO: 3935305 - RNA, 18 nt, Human adenovirus E
cccccgggaguuccucca

SEQ ID NO: 3935306 - RNA, 13 nt, Human adenovirus E
ccccgcuggaggc

SEQ ID NO: 3935307 - RNA, 18 nt, Human adenovirus E
  misc_feature (6)..(6): n is a, c, g or u
ccccgnuacuaacaacca

SEQ ID NO: 3935308 - RNA, 21 nt, Human adenovirus E
ccccuccagaacacgcugccc

SEQ ID NO: 3935309 - RNA, 13 nt, Human adenovirus E
cccgaggaagcaa

SEQ ID NO: 3935310 - RNA, 13 nt, Human adenovirus E
cccgagggccgcu

SEQ ID NO: 3935311 - RNA, 15 nt, Human adenovirus E
cccgagggccgcugg

SEQ ID NO: 3935312 - RNA, 22 nt, Human adenovirus E
cccgaugaccggcugcaggugg

SEQ ID NO: 3935313 - RNA, 23 nt, Human adenovirus E
cccgcaucugcaccucacagcuc

SEQ ID NO: 3935314 - RNA, 17 nt, Human adenovirus E
cccgccaacgugccccg

SEQ ID NO: 3935315 - RNA, 23 nt, Human adenovirus E
cccgccaacgugccccggggcca

SEQ ID NO: 3935316 - RNA, 19 nt, Human adenovirus E
cccgccccaguacgcgcuc

SEQ ID NO: 3935317 - RNA, 22 nt, Human adenovirus E
cccgccgcuguggagccacugc

SEQ ID NO: 3935318 - RNA, 20 nt, Human adenovirus E
cccgccucguuccagacgcg

SEQ ID NO: 3935319 - RNA, 14 nt, Human adenovirus E
cccgcgcuccugga

SEQ ID NO: 3935320 - RNA, 18 nt, Human adenovirus E
cccgcgcugauccccauc

SEQ ID NO: 3935321 - RNA, 16 nt, Human adenovirus E
cccgcgcuugcugggc

SEQ ID NO: 3935322 - RNA, 15 nt, Human adenovirus E
cccgcuggaccacgg

SEQ ID NO: 3935323 - RNA, 13 nt, Human adenovirus E
cccggaugcaggg

SEQ ID NO: 3935324 - RNA, 15 nt, Human adenovirus E
cccggcaggccacca

SEQ ID NO: 3935325 - RNA, 17 nt, Human adenovirus E
cccggcggcaccggagc

SEQ ID NO: 3935326 - RNA, 12 nt, Human adenovirus E
cccggcggcgcg

SEQ ID NO: 3935327 - RNA, 23 nt, Human adenovirus E
cccgggaguuccuccacuuccuc

SEQ ID NO: 3935328 - RNA, 19 nt, Human adenovirus E
  misc_feature (8)..(8): n is a, c, g or u
cccgggcnugggcgugcag

SEQ ID NO: 3935329 - RNA, 16 nt, Human adenovirus E
cccguccucgcggggc

SEQ ID NO: 3935330 - RNA, 22 nt, Human adenovirus E
cccguccucuucccacuccccu

SEQ ID NO: 3935331 - RNA, 14 nt, Human adenovirus E
cccucaaaggccgc

SEQ ID NO: 3935332 - RNA, 20 nt, Human adenovirus E
cccucagcguggaggagcuc

SEQ ID NO: 3935333 - RNA, 20 nt, Human adenovirus E
cccucggacuucgugccgcu

SEQ ID NO: 3935334 - RNA, 17 nt, Human adenovirus E
cccucuaugccaucuuc

SEQ ID NO: 3935335 - RNA, 17 nt, Human adenovirus E
cccucuucccagcucug

SEQ ID NO: 3935336 - RNA, 16 nt, Human adenovirus E
cccugaaagugcugac

SEQ ID NO: 3935337 - RNA, 22 nt, Human adenovirus E
cccugaaagugcugacccugag

SEQ ID NO: 3935338 - RNA, 12 nt, Human adenovirus E
cccuggccugca

SEQ ID NO: 3935339 - RNA, 18 nt, Human adenovirus E
cccugugucgucaccgcc

SEQ ID NO: 3935340 - RNA, 23 nt, Human adenovirus E
ccgaaggcaacuucucggugacc

SEQ ID NO: 3935341 - RNA, 17 nt, Human adenovirus E
ccgaccgggugcuaacg

SEQ ID NO: 3935342 - RNA, 15 nt, Human adenovirus E
ccgacgacagcagcg

SEQ ID NO: 3935343 - RNA, 18 nt, Human adenovirus E
ccgacgagaagcagcagc

SEQ ID NO: 3935344 - RNA, 14 nt, Human adenovirus E
ccgacggcgcgccg

SEQ ID NO: 3935345 - RNA, 15 nt, Human adenovirus E
ccgagaagcuggcgg

SEQ ID NO: 3935346 - RNA, 16 nt, Human adenovirus E
ccgagcagcagcacac

SEQ ID NO: 3935347 - RNA, 13 nt, Human adenovirus E
ccgagcuccagcu

SEQ ID NO: 3935348 - RNA, 13 nt, Human adenovirus E
ccgaggagggcaa

SEQ ID NO: 3935349 - RNA, 14 nt, Human adenovirus E
ccgaggagggcaag

SEQ ID NO: 3935350 - RNA, 16 nt, Human adenovirus E
ccgaggcccuggccac

SEQ ID NO: 3935351 - RNA, 13 nt, Human adenovirus E
ccgaggugcccca

SEQ ID NO: 3935352 - RNA, 13 nt, Human adenovirus E
ccgaggugccccu

SEQ ID NO: 3935353 - RNA, 17 nt, Human adenovirus E
ccgauguagguggggua

SEQ ID NO: 3935354 - RNA, 13 nt, Human adenovirus E
ccgcaacgacagg

SEQ ID NO: 3935355 - RNA, 17 nt, Human adenovirus E
ccgcaagaccaccacuc

SEQ ID NO: 3935356 - RNA, 15 nt, Human adenovirus E
ccgcaccgccgcugc

SEQ ID NO: 3935357 - RNA, 19 nt, Human adenovirus E
ccgcagcaguggcagcggc

SEQ ID NO: 3935358 - RNA, 17 nt, Human adenovirus E
ccgcagcuugcccucgg

SEQ ID NO: 3935359 - RNA, 22 nt, Human adenovirus E
ccgcaguugucuguaucacaag

SEQ ID NO: 3935360 - RNA, 17 nt, Human adenovirus E
  misc_feature (6)..(6): n is a, c, g or u
ccgcancgugaagacgc

SEQ ID NO: 3935361 - RNA, 17 nt, Human adenovirus E
ccgcaucugcaccucac

SEQ ID NO: 3935362 - RNA, 12 nt, Human adenovirus E
ccgccaccugcu

SEQ ID NO: 3935363 - RNA, 13 nt, Human adenovirus E
ccgcccgcccgcg

SEQ ID NO: 3935364 - RNA, 13 nt, Human adenovirus E
ccgccgcaagacc

SEQ ID NO: 3935365 - RNA, 14 nt, Human adenovirus E
ccgccgcccagccc

SEQ ID NO: 3935366 - RNA, 14 nt, Human adenovirus E
ccgccgcggccgcc

SEQ ID NO: 3935367 - RNA, 11 nt, Human adenovirus E
ccgccgcggcg

SEQ ID NO: 3935368 - RNA, 21 nt, Human adenovirus E
ccgccgcuguggagccacugc

SEQ ID NO: 3935369 - RNA, 19 nt, Human adenovirus E
ccgccggugccgcccagga

SEQ ID NO: 3935370 - RNA, 22 nt, Human adenovirus E
ccgccuaccugauaucgccucc

SEQ ID NO: 3935371 - RNA, 18 nt, Human adenovirus E
ccgccucggaccuggccg

SEQ ID NO: 3935372 - RNA, 21 nt, Human adenovirus E
ccgccuggggcagaacgugcu

SEQ ID NO: 3935373 - RNA, 14 nt, Human adenovirus E
ccgccuucgcguuc

SEQ ID NO: 3935374 - RNA, 15 nt, Human adenovirus E
ccgcgaguccaaccu

SEQ ID NO: 3935375 - RNA, 13 nt, Human adenovirus E
ccgcgcccaccga

SEQ ID NO: 3935376 - RNA, 19 nt, Human adenovirus E
ccgcgcccugggccaggac

SEQ ID NO: 3935377 - RNA, 17 nt, Human adenovirus E
ccgcgccuacgaguuga

SEQ ID NO: 3935378 - RNA, 14 nt, Human adenovirus E
ccgcgcgugccccc

SEQ ID NO: 3935379 - RNA, 17 nt, Human adenovirus E
ccgcgcuugcugggcga

SEQ ID NO: 3935380 - RNA, 19 nt, Human adenovirus E
ccgcggagcacgaggagga

SEQ ID NO: 3935381 - RNA, 22 nt, Human adenovirus E
ccgcggccggcgcgcuccacgg

SEQ ID NO: 3935382 - RNA, 17 nt, Human adenovirus E
ccgcgguaccuggcgcc

SEQ ID NO: 3935383 - RNA, 14 nt, Human adenovirus E
ccgcggugcuccuc

SEQ ID NO: 3935384 - RNA, 12 nt, Human adenovirus E
ccggagcagcug

SEQ ID NO: 3935385 - RNA, 13 nt, Human adenovirus E
ccggagcugucca

SEQ ID NO: 3935386 - RNA, 19 nt, Human adenovirus E
ccggaucuuucccacccuc

SEQ ID NO: 3935387 - RNA, 19 nt, Human adenovirus E
ccggcauugcuuccguggc

SEQ ID NO: 3935388 - RNA, 22 nt, Human adenovirus E
ccggcgcaaacccgggagcuga

SEQ ID NO: 3935389 - RNA, 17 nt, Human adenovirus E
ccggcggcgcucugacu

SEQ ID NO: 3935390 - RNA, 16 nt, Human adenovirus E
ccggcucccccggcca

SEQ ID NO: 3935391 - RNA, 18 nt, Human adenovirus E
ccggcucccccggccacu

SEQ ID NO: 3935392 - RNA, 20 nt, Human adenovirus E
ccgggccuuggaggcggcgg

SEQ ID NO: 3935393 - RNA, 12 nt, Human adenovirus E
cucccaggacau

SEQ ID NO: 3935394 - RNA, 22 nt, Human adenovirus E
cucccaggacauggaauacacc

SEQ ID NO: 3935395 - RNA, 13 nt, Human adenovirus E
cuccccccaggga

SEQ ID NO: 3935396 - RNA, 17 nt, Human adenovirus E
cuccccgggaccuauca

SEQ ID NO: 3935397 - RNA, 21 nt, Human adenovirus E
cuccccucuucccagcucugg

SEQ ID NO: 3935398 - RNA, 23 nt, Human adenovirus E
cucccgccugaaccugacacacc

SEQ ID NO: 3935399 - RNA, 12 nt, Human adenovirus E
cucccucagcau

SEQ ID NO: 3935400 - RNA, 13 nt, Human adenovirus E
cucccuggccugc

SEQ ID NO: 3935401 - RNA, 14 nt, Human adenovirus E
cuccggcaccgcuu

SEQ ID NO: 3935402 - RNA, 17 nt, Human adenovirus E
cuccgucaagcugcugc

SEQ ID NO: 3935403 - RNA, 20 nt, Human adenovirus E
cuccucaggcggcaguggug

SEQ ID NO: 3935404 - RNA, 13 nt, Human adenovirus E
cuccuccucggcc

SEQ ID NO: 3935405 - RNA, 16 nt, Human adenovirus E
cuccugcacaggcagc

SEQ ID NO: 3935406 - RNA, 22 nt, Human adenovirus E
cuccugccgcgccaaccgcacc

SEQ ID NO: 3935407 - RNA, 21 nt, Human adenovirus E
cuccuucagcgcgcgcugccc

SEQ ID NO: 3935408 - RNA, 20 nt, Human adenovirus E
cucgaccgcaccgaggugcc

SEQ ID NO: 3935409 - RNA, 16 nt, Human adenovirus E
cucgacucccaccugc

SEQ ID NO: 3935410 - RNA, 18 nt, Human adenovirus E
cucgacuccguggccugg

SEQ ID NO: 3935411 - RNA, 20 nt, Human adenovirus E
cucgcacuccacgagccagg

SEQ ID NO: 3935412 - RNA, 15 nt, Human adenovirus E
cucgcgccugcugcu

SEQ ID NO: 3935413 - RNA, 17 nt, Human adenovirus E
cucgcgguggggcggcc

SEQ ID NO: 3935414 - RNA, 16 nt, Human adenovirus E
cucggacgucaccugc

SEQ ID NO: 3935415 - RNA, 17 nt, Human adenovirus E
cucggacuucgugccgc

SEQ ID NO: 3935416 - RNA, 17 nt, Human adenovirus E
cucggcauggcccgcgg

SEQ ID NO: 3935417 - RNA, 23 nt, Human adenovirus E
cucggccauccuggaggccgugg

SEQ ID NO: 3935418 - RNA, 15 nt, Human adenovirus E
cucgggaucucgccg

SEQ ID NO: 3935419 - RNA, 21 nt, Human adenovirus E
cucgggccgcgaacgcucugc

SEQ ID NO: 3935420 - RNA, 22 nt, Human adenovirus E
cucguacgagagcgugaugcag

SEQ ID NO: 3935421 - RNA, 20 nt, Human adenovirus E
cucgugcgagggggcgagga

SEQ ID NO: 3935422 - RNA, 15 nt, Human adenovirus E
cucuacggcaucucg

SEQ ID NO: 3935423 - RNA, 16 nt, Human adenovirus E
cucuauguuuaauuuu

SEQ ID NO: 3935424 - RNA, 20 nt, Human adenovirus E
cucucagaccgugcagcaga

SEQ ID NO: 3935425 - RNA, 17 nt, Human adenovirus E
cucucagcgccacugag

SEQ ID NO: 3935426 - RNA, 12 nt, Human adenovirus E
cucucgccgccg

SEQ ID NO: 3935427 - RNA, 13 nt, Human adenovirus E
cucugccacaccu

SEQ ID NO: 3935428 - RNA, 18 nt, Human adenovirus E
cucugccacaccuggcag

SEQ ID NO: 3935429 - RNA, 19 nt, Human adenovirus E
cucuguggaaacaauaaca

SEQ ID NO: 3935430 - RNA, 18 nt, Human adenovirus E
cucuucgggggcagaggc

SEQ ID NO: 3935431 - RNA, 16 nt, Human adenovirus E
cucuucugccucgaug

SEQ ID NO: 3935432 - RNA, 17 nt, Human adenovirus E
cucuucuuccuccucca

SEQ ID NO: 3935433 - RNA, 19 nt, Human adenovirus E
cucuuugccuucaccaccu

SEQ ID NO: 3935434 - RNA, 21 nt, Human adenovirus E
cucuuugccuucaccaccugc

SEQ ID NO: 3935435 - RNA, 15 nt, Human adenovirus E
cugaaaguggagcug

SEQ ID NO: 3935436 - RNA, 16 nt, Human adenovirus E
cugaaccugacacacc

SEQ ID NO: 3935437 - RNA, 15 nt, Human adenovirus E
cugaaccugcccccc

SEQ ID NO: 3935438 - RNA, 21 nt, Human adenovirus E
cugaaccugccccccaaaguc

SEQ ID NO: 3935439 - RNA, 14 nt, Human adenovirus E
cugaacgaaggcuu

SEQ ID NO: 3935440 - RNA, 19 nt, Human adenovirus E
cugaauaucaccgagcccg

SEQ ID NO: 3935441 - RNA, 18 nt, Human adenovirus E
cugaaucuaauacuacca

SEQ ID NO: 3935442 - RNA, 17 nt, Human adenovirus E
cugaccaccguggugca

SEQ ID NO: 3935443 - RNA, 13 nt, Human adenovirus E
cugacgcuccugg

SEQ ID NO: 3935444 - RNA, 22 nt, Human adenovirus E
cugaggggcgugccccagggca

SEQ ID NO: 3935445 - RNA, 20 nt, Human adenovirus E
cugaucugauacuccucaau

SEQ ID NO: 3935446 - RNA, 16 nt, Human adenovirus E
cugcaaacuuccucca

SEQ ID NO: 3935447 - RNA, 22 nt, Human adenovirus E
cugcaagacagucuggaggaag

SEQ ID NO: 3935448 - RNA, 21 nt, Human adenovirus E
cugcaaggagaaggaggagag

SEQ ID NO: 3935449 - RNA, 15 nt, Human adenovirus E
cugcacaccacccug

SEQ ID NO: 3935450 - RNA, 15 nt, Human adenovirus E
cugcacaggcagcaa

SEQ ID NO: 3935451 - RNA, 18 nt, Human adenovirus E
cugcacuaccucuucagg

SEQ ID NO: 3935452 - RNA, 14 nt, Human adenovirus E
cugcacuggcagcc

SEQ ID NO: 3935453 - RNA, 16 nt, Human adenovirus E
cugcacuggcagccca

SEQ ID NO: 3935454 - RNA, 18 nt, Human adenovirus E
cugcacuggcagcccagc

SEQ ID NO: 3935455 - RNA, 20 nt, Human adenovirus E
cugcacuggcagcccagccg

SEQ ID NO: 3935456 - RNA, 21 nt, Human adenovirus E
cugcaggccccggcgggcugc

SEQ ID NO: 3935457 - RNA, 22 nt, Human adenovirus E
cugcaggugguaguugagggag

SEQ ID NO: 3935458 - RNA, 16 nt, Human adenovirus E
cugccacaccuggcag

SEQ ID NO: 3935459 - RNA, 14 nt, Human adenovirus E
cugcccgccaccug

SEQ ID NO: 3935460 - RNA, 19 nt, Human adenovirus E
cugccgcugcgcagcagua

SEQ ID NO: 3935461 - RNA, 17 nt, Human adenovirus E
cugcgacuggccgaccc

SEQ ID NO: 3935462 - RNA, 20 nt, Human adenovirus E
cugcgagcccaacccgcgcc

SEQ ID NO: 3935463 - RNA, 16 nt, Human adenovirus E
cugcgcaacggccugc

SEQ ID NO: 3935464 - RNA, 16 nt, Human adenovirus E
cugcgcgucggccagg

SEQ ID NO: 3935465 - RNA, 18 nt, Human adenovirus E
cugcguuacgugcagcag

SEQ ID NO: 3935466 - RNA, 22 nt, Human adenovirus E
cugcuaccugcugcgccuggcc

SEQ ID NO: 3935467 - RNA, 18 nt, Human adenovirus E
cugcucgaucuccuccuc

SEQ ID NO: 3935468 - RNA, 17 nt, Human adenovirus E
cugcucgggcaucagcu

SEQ ID NO: 3935469 - RNA, 22 nt, Human adenovirus E
cugcugaauaucaccgagcccg

SEQ ID NO: 3935470 - RNA, 14 nt, Human adenovirus E
cugcugcugcuggu

SEQ ID NO: 3935471 - RNA, 22 nt, Human adenovirus E
cugcugcugguggcccccuuca

SEQ ID NO: 3935472 - RNA, 16 nt, Human adenovirus E
cugcuggaggccaucg

SEQ ID NO: 3935473 - RNA, 13 nt, Human adenovirus E
cugcugguggccc

SEQ ID NO: 3935474 - RNA, 19 nt, Human adenovirus E
cugcuguuagugcuccccc

SEQ ID NO: 3935475 - RNA, 14 nt, Human adenovirus E
cugcuugcauuuca

SEQ ID NO: 3935476 - RNA, 11 nt, Human adenovirus E
cuggacagaaa

SEQ ID NO: 3935477 - RNA, 17 nt, Human adenovirus E
cuggaccacugccgccg

SEQ ID NO: 3935478 - RNA, 20 nt, Human adenovirus E
cuggagaagaaucgccaggg

SEQ ID NO: 3935479 - RNA, 15 nt, Human adenovirus E
cuggagcgacaucgg

SEQ ID NO: 3935480 - RNA, 22 nt, Human adenovirus E
cuggagcgacaucggcaccagc

SEQ ID NO: 3935481 - RNA, 19 nt, Human adenovirus E
cuggagcgcguggcccgcu

SEQ ID NO: 3935482 - RNA, 15 nt, Human adenovirus E
cuggaggagcagaac

SEQ ID NO: 3935483 - RNA, 14 nt, Human adenovirus E
cuggccaccuacca

SEQ ID NO: 3935484 - RNA, 23 nt, Human adenovirus E
cuggccgaccccgucaccaccaa

SEQ ID NO: 3935485 - RNA, 16 nt, Human adenovirus E
cuggccguguugcucu

SEQ ID NO: 3935486 - RNA, 21 nt, Human adenovirus E
cuggcgggcggcgccacccug

SEQ ID NO: 3935487 - RNA, 17 nt, Human adenovirus E
cuggcugacguccugca

SEQ ID NO: 3935488 - RNA, 20 nt, Human adenovirus E
cuggcugacguccugcagga

SEQ ID NO: 3935489 - RNA, 18 nt, Human adenovirus E
cugggacagcacucaggc

SEQ ID NO: 3935490 - RNA, 19 nt, Human adenovirus E
cugggauccaugguggcgc

SEQ ID NO: 3935491 - RNA, 16 nt, Human adenovirus E
cugggcauucgcaaga

SEQ ID NO: 3935492 - RNA, 19 nt, Human adenovirus E
cugggcgagguugagcucc

SEQ ID NO: 3935493 - RNA, 20 nt, Human adenovirus E
cuggggguguugucccugcg

SEQ ID NO: 3935494 - RNA, 20 nt, Human adenovirus E
cugggugacaaagagcuguc

SEQ ID NO: 3935495 - RNA, 14 nt, Human adenovirus E
cugguacugcgccc

SEQ ID NO: 3935496 - RNA, 23 nt, Human adenovirus E
cuggugcggcgggcgcagcagcg

SEQ ID NO: 3935497 - RNA, 19 nt, Human adenovirus E
cugguugguggcgcacccg

SEQ ID NO: 3935498 - RNA, 16 nt, Human adenovirus E
cuguaguggugugcau

SEQ ID NO: 3935499 - RNA, 15 nt, Human adenovirus E
cuguaucccacccug

SEQ ID NO: 3935500 - RNA, 18 nt, Human adenovirus E
cuguaucccacccugcau

SEQ ID NO: 3935501 - RNA, 13 nt, Human adenovirus E
cugucggccugcg

SEQ ID NO: 3935502 - RNA, 16 nt, Human adenovirus E
cugugucgucaccgcc

SEQ ID NO: 3935503 - RNA, 18 nt, Human adenovirus E
cuguuccugaugcaggag

SEQ ID NO: 3935504 - RNA, 17 nt, Human adenovirus E
cuuaccgagcagcagca

SEQ ID NO: 3935505 - RNA, 20 nt, Human adenovirus E
cuuagcauuaccacacagac

SEQ ID NO: 3935506 - RNA, 21 nt, Human adenovirus E
cuuaguggugcuguguugcug

SEQ ID NO: 3935507 - RNA, 14 nt, Human adenovirus E
cuucacccccacgg

SEQ ID NO: 3935508 - RNA, 16 nt, Human adenovirus E
cuucagcgcgcgcugc

SEQ ID NO: 3935509 - RNA, 19 nt, Human adenovirus E
cccgucuccugccgcgcca

SEQ ID NO: 3935510 - RNA, 21 nt, Human adenovirus E
cccgugcgcgugcgcgggcac

SEQ ID NO: 3935511 - RNA, 15 nt, Human adenovirus E
cccucagggcccggc

SEQ ID NO: 3935512 - RNA, 16 nt, Human adenovirus E
cccucuccccccgcac

SEQ ID NO: 3935513 - RNA, 21 nt, Human adenovirus E
cccugcgguggugaaggagga

SEQ ID NO: 3935514 - RNA, 15 nt, Human adenovirus E
cccugcucccagagc

SEQ ID NO: 3935515 - RNA, 13 nt, Human adenovirus E
cccugggccagga

SEQ ID NO: 3935516 - RNA, 21 nt, Human adenovirus E
cccugggccaggacgacccgg

SEQ ID NO: 3935517 - RNA, 19 nt, Human adenovirus E
ccgaacucgcgccugcugc

SEQ ID NO: 3935518 - RNA, 19 nt, Human adenovirus E
ccgaaggaagaggcggugu

SEQ ID NO: 3935519 - RNA, 22 nt, Human adenovirus E
ccgaagggggucaucuugcagg

SEQ ID NO: 3935520 - RNA, 23 nt, Human adenovirus E
ccgacaaaaaucagacccacugc

SEQ ID NO: 3935521 - RNA, 20 nt, Human adenovirus E
ccgagcuccagcuccagugu

SEQ ID NO: 3935522 - RNA, 21 nt, Human adenovirus E
ccgaggaagaaaaccgcgccg

SEQ ID NO: 3935523 - RNA, 17 nt, Human adenovirus E
ccgcacccgcgccgacg

SEQ ID NO: 3935524 - RNA, 15 nt, Human adenovirus E
ccgcaccgaggugcc

SEQ ID NO: 3935525 - RNA, 16 nt, Human adenovirus E
ccgcagaacagggcaa

SEQ ID NO: 3935526 - RNA, 21 nt, Human adenovirus E
ccgcagaagcaagcuccagcu

SEQ ID NO: 3935527 - RNA, 16 nt, Human adenovirus E
ccgcagcaguggcagc

SEQ ID NO: 3935528 - RNA, 23 nt, Human adenovirus E
ccgcagcuugcccucggccucgg

SEQ ID NO: 3935529 - RNA, 22 nt, Human adenovirus E
ccgcauccccaaauucaaacac

SEQ ID NO: 3935530 - RNA, 21 nt, Human adenovirus E
ccgcaucugcaccucacagcu

SEQ ID NO: 3935531 - RNA, 16 nt, Human adenovirus E
ccgccaacgugccccg

SEQ ID NO: 3935532 - RNA, 18 nt, Human adenovirus E
ccgccaugaacucugacu

SEQ ID NO: 3935533 - RNA, 16 nt, Human adenovirus E
ccgcccaaggccgagc

SEQ ID NO: 3935534 - RNA, 12 nt, Human adenovirus E
ccgccuccaccc

SEQ ID NO: 3935535 - RNA, 16 nt, Human adenovirus E
ccgcgagggugcugcc

SEQ ID NO: 3935536 - RNA, 14 nt, Human adenovirus E
ccgcgagugccccc

SEQ ID NO: 3935537 - RNA, 20 nt, Human adenovirus E
ccgcgaucccugagcuccuc

SEQ ID NO: 3935538 - RNA, 15 nt, Human adenovirus E
ccgcgcgcgcgcuac

SEQ ID NO: 3935539 - RNA, 13 nt, Human adenovirus E
ccgcgcuccugga

SEQ ID NO: 3935540 - RNA, 16 nt, Human adenovirus E
ccgcggcacgcgcuuc

SEQ ID NO: 3935541 - RNA, 16 nt, Human adenovirus E
ccgcggcgccgcgccg

SEQ ID NO: 3935542 - RNA, 22 nt, Human adenovirus E
ccgcguaauuggcccgccgccc

SEQ ID NO: 3935543 - RNA, 14 nt, Human adenovirus E
ccgcgucagggugg

SEQ ID NO: 3935544 - RNA, 14 nt, Human adenovirus E
acugaauuuuuguc

SEQ ID NO: 3935545 - RNA, 13 nt, Human adenovirus E
acugaugacagca

SEQ ID NO: 3935546 - RNA, 16 nt, Human adenovirus E
acgcaguagaaggugc

SEQ ID NO: 3935547 - RNA, 18 nt, Human adenovirus E
acgccaucgucuccugcu

SEQ ID NO: 3935548 - RNA, 15 nt, Human adenovirus E
acgcccgcgccaaga

SEQ ID NO: 3935549 - RNA, 20 nt, Human adenovirus E
acgcccuuuucaaccugggu

SEQ ID NO: 3935550 - RNA, 21 nt, Human adenovirus E
acgcccuuuucaaccuggguc

SEQ ID NO: 3935551 - RNA, 23 nt, Human adenovirus E
acgccgcaccgcucccuggccug

SEQ ID NO: 3935552 - RNA, 19 nt, Human adenovirus E
acgccuuacauguggagcu

SEQ ID NO: 3935553 - RNA, 23 nt, Human adenovirus E
acgccuuacauguggagcuacca

SEQ ID NO: 3935554 - RNA, 16 nt, Human adenovirus E
acgcgcacuuccucaa

SEQ ID NO: 3935555 - RNA, 22 nt, Human adenovirus E
acgcgcccgcgcuugcugggcg

SEQ ID NO: 3935556 - RNA, 21 nt, Human adenovirus E
acgcgcucagcaccgaggagg

SEQ ID NO: 3935557 - RNA, 14 nt, Human adenovirus E
acgcgcucaucaag

SEQ ID NO: 3935558 - RNA, 14 nt, Human adenovirus E
acgcgcugcuggag

SEQ ID NO: 3935559 - RNA, 18 nt, Human adenovirus E
acgcuccugguccuguga

SEQ ID NO: 3935560 - RNA, 14 nt, Human adenovirus E
acggcuccccgcgc

SEQ ID NO: 3935561 - RNA, 15 nt, Human adenovirus E
acgggacgcagggcc

SEQ ID NO: 3935562 - RNA, 16 nt, Human adenovirus E
acgggacgcagggcca

SEQ ID NO: 3935563 - RNA, 21 nt, Human adenovirus E
acgggauagaaagccuggugg

SEQ ID NO: 3935564 - RNA, 20 nt, Human adenovirus E
acgggaugcacgugcugcac

SEQ ID NO: 3935565 - RNA, 22 nt, Human adenovirus E
  misc_feature (8)..(8): n is a, c, g or u
acgggganggcguaggccuggg

SEQ ID NO: 3935566 - RNA, 22 nt, Human adenovirus E
acgggugaaugacauccgcgcc

SEQ ID NO: 3935567 - RNA, 22 nt, Human adenovirus E
acggguucgugcgccaggccug

SEQ ID NO: 3935568 - RNA, 14 nt, Human adenovirus E
acggucauguggau

SEQ ID NO: 3935569 - RNA, 15 nt, Human adenovirus E
acggucgagcugacc

SEQ ID NO: 3935570 - RNA, 22 nt, Human adenovirus E
acgucaccugcggcguggagca

SEQ ID NO: 3935571 - RNA, 12 nt, Human adenovirus E
acguccugcagg

SEQ ID NO: 3935572 - RNA, 21 nt, Human adenovirus E
acgugcccauagacaaggagg

SEQ ID NO: 3935573 - RNA, 22 nt, Human adenovirus E
acguggagcugaccaaccuggu

SEQ ID NO: 3935574 - RNA, 15 nt, Human adenovirus E
acuacagccuaggcc

SEQ ID NO: 3935575 - RNA, 17 nt, Human adenovirus E
acuaccucuucaggcac

SEQ ID NO: 3935576 - RNA, 13 nt, Human adenovirus E
acuaccuggccua

SEQ ID NO: 3935577 - RNA, 20 nt, Human adenovirus E
acuaggaacuucaggcuggg

SEQ ID NO: 3935578 - RNA, 12 nt, Human adenovirus E
acuaugccuucu

SEQ ID NO: 3935579 - RNA, 15 nt, Human adenovirus E
acucaccccggggcu

SEQ ID NO: 3935580 - RNA, 16 nt, Human adenovirus E
acucaggcagaggagg

SEQ ID NO: 3935581 - RNA, 16 nt, Human adenovirus E
acucagguguccagcu

SEQ ID NO: 3935582 - RNA, 21 nt, Human adenovirus E
acuccccucuucccagcucug

SEQ ID NO: 3935583 - RNA, 23 nt, Human adenovirus E
acuccccucuucccagcucuggu

SEQ ID NO: 3935584 - RNA, 15 nt, Human adenovirus E
acucgcagcagcugc

SEQ ID NO: 3935585 - RNA, 20 nt, Human adenovirus E
acugacguaaaggccaaagu

SEQ ID NO: 3935586 - RNA, 19 nt, Human adenovirus E
acugacuuccuccgcggcc

SEQ ID NO: 3935587 - RNA, 23 nt, Human adenovirus E
acugaggggcgugccccagggca

SEQ ID NO: 3935588 - RNA, 21 nt, Human adenovirus E
acugccgcugcaaccucugca

SEQ ID NO: 3935589 - RNA, 15 nt, Human adenovirus E
acuggaucuuugugc

SEQ ID NO: 3935590 - RNA, 22 nt, Human adenovirus E
acuggcagcccagccgccgggc

SEQ ID NO: 3935591 - RNA, 20 nt, Human adenovirus E
acugggcuuuucggcgcggu

SEQ ID NO: 3935592 - RNA, 13 nt, Human adenovirus E
acuucaaaaugaa

SEQ ID NO: 3935593 - RNA, 18 nt, Human adenovirus E
acuuccucaaacgcccaa

SEQ ID NO: 3935594 - RNA, 20 nt, Human adenovirus E
acuuccuccgcggccggcca

SEQ ID NO: 3935595 - RNA, 20 nt, Human adenovirus E
acuucucgcgcuucugcugu

SEQ ID NO: 3935596 - RNA, 13 nt, Human adenovirus E
acuugccgcagcc

SEQ ID NO: 3935597 - RNA, 16 nt, Human adenovirus E
acuuggccagccacuu

SEQ ID NO: 3935598 - RNA, 19 nt, Human adenovirus E
agaacagcagucaggcaga

SEQ ID NO: 3935599 - RNA, 18 nt, Human adenovirus E
agaacaggagcuacaacg

SEQ ID NO: 3935600 - RNA, 15 nt, Human adenovirus E
agaagcaagcuccag

SEQ ID NO: 3935601 - RNA, 14 nt, Human adenovirus E
agaagcgugggccu

SEQ ID NO: 3935602 - RNA, 14 nt, Human adenovirus E
agacaguucauuug

SEQ ID NO: 3935603 - RNA, 19 nt, Human adenovirus E
agacaugcaucccagcugg

SEQ ID NO: 3935604 - RNA, 16 nt, Human adenovirus E
agaccgugaaggagga

SEQ ID NO: 3935605 - RNA, 20 nt, Human adenovirus E
agacgaggaggaggcagagg

SEQ ID NO: 3935606 - RNA, 15 nt, Human adenovirus E
agacgaugggcaggc

SEQ ID NO: 3935607 - RNA, 15 nt, Human adenovirus E
agacuccgaggaggg

SEQ ID NO: 3935608 - RNA, 16 nt, Human adenovirus E
agacucgggccgcgaa

SEQ ID NO: 3935609 - RNA, 16 nt, Human adenovirus E
agacugauggccacgg

SEQ ID NO: 3935610 - RNA, 15 nt, Human adenovirus E
agagcaugagcacca

SEQ ID NO: 3935611 - RNA, 19 nt, Human adenovirus E
agagcgugaugcagcaggc

SEQ ID NO: 3935612 - RNA, 18 nt, Human adenovirus E
agagcuguccgugucccc

SEQ ID NO: 3935613 - RNA, 19 nt, Human adenovirus E
agaucaaaccgcagcagag

SEQ ID NO: 3935614 - RNA, 18 nt, Human adenovirus E
agaucuagggccucagga

SEQ ID NO: 3935615 - RNA, 14 nt, Human adenovirus E
agaucuucgagggu

SEQ ID NO: 3935616 - RNA, 21 nt, Human adenovirus E
agaugcaauugaaagcaacau

SEQ ID NO: 3935617 - RNA, 17 nt, Human adenovirus E
agauggcgagggggagc

SEQ ID NO: 3935618 - RNA, 18 nt, Human adenovirus E
agauggugggccuuugga

SEQ ID NO: 3935619 - RNA, 15 nt, Human adenovirus E
agcaaagcccccgau

SEQ ID NO: 3935620 - RNA, 23 nt, Human adenovirus E
agcaacaaguucaaggcgcgggu

SEQ ID NO: 3935621 - RNA, 11 nt, Human adenovirus E
agcaagcagca

SEQ ID NO: 3935622 - RNA, 15 nt, Human adenovirus E
agcaccacagggcag

SEQ ID NO: 3935623 - RNA, 13 nt, Human adenovirus E
agcaccaggcagg

SEQ ID NO: 3935624 - RNA, 23 nt, Human adenovirus E
  misc_feature (9)..(9): n is a, c, g or u
agcacgaangaggccacguggga

SEQ ID NO: 3935625 - RNA, 16 nt, Human adenovirus E
agcacucaacccaccc

SEQ ID NO: 3935626 - RNA, 12 nt, Human adenovirus E
agcagaaggggg

SEQ ID NO: 3935627 - RNA, 21 nt, Human adenovirus E
agcagaccgugaaggaggaga

SEQ ID NO: 3935628 - RNA, 21 nt, Human adenovirus E
agcagcagagguugccagcuc

SEQ ID NO: 3935629 - RNA, 14 nt, Human adenovirus E
agcagccccaggcc

SEQ ID NO: 3935630 - RNA, 16 nt, Human adenovirus E
agcagcgagcugggca

SEQ ID NO: 3935631 - RNA, 21 nt, Human adenovirus E
agcagguggacugaggaucgc

SEQ ID NO: 3935632 - RNA, 14 nt, Human adenovirus E
agcagugcucaggu

SEQ ID NO: 3935633 - RNA, 13 nt, Human adenovirus E
agcaugaagggga

SEQ ID NO: 3935634 - RNA, 13 nt, Human adenovirus E
agcaugagcacca

SEQ ID NO: 3935635 - RNA, 14 nt, Human adenovirus E
agcauuaccacaca

SEQ ID NO: 3935636 - RNA, 20 nt, Human adenovirus E
agccacagcgacccaugcuc

SEQ ID NO: 3935637 - RNA, 19 nt, Human adenovirus E
agccacgaccgccgcggcc

SEQ ID NO: 3935638 - RNA, 17 nt, Human adenovirus E
agccacugcuaccugcu

SEQ ID NO: 3935639 - RNA, 15 nt, Human adenovirus E
agccagagcaggaag

SEQ ID NO: 3935640 - RNA, 18 nt, Human adenovirus E
agccauagcaaccaacau

SEQ ID NO: 3935641 - RNA, 16 nt, Human adenovirus E
agcccaacccgcgccu

SEQ ID NO: 3935642 - RNA, 15 nt, Human adenovirus E
agcccacggccgcca

SEQ ID NO: 3935643 - RNA, 22 nt, Human adenovirus E
agcccacggccgccagcuccuc

SEQ ID NO: 3935644 - RNA, 15 nt, Human adenovirus E
agcccagcaccagca

SEQ ID NO: 3935645 - RNA, 15 nt, Human adenovirus E
agccccgggcccagg

SEQ ID NO: 3935646 - RNA, 21 nt, Human adenovirus E
agccccguccucuucccacuc

SEQ ID NO: 3935647 - RNA, 12 nt, Human adenovirus E
agcccgaggaga

SEQ ID NO: 3935648 - RNA, 22 nt, Human adenovirus E
agcccgcgcgggaggcaggucc

SEQ ID NO: 3935649 - RNA, 21 nt, Human adenovirus E
agcccgugaccuugcagcagg

SEQ ID NO: 3935650 - RNA, 15 nt, Human adenovirus E
agcccugcaggaagc

SEQ ID NO: 3935651 - RNA, 16 nt, Human adenovirus E
agccgccuggacccgg

SEQ ID NO: 3935652 - RNA, 21 nt, Human adenovirus E
agccgcgcccugggccaggac

SEQ ID NO: 3935653 - RNA, 17 nt, Human adenovirus E
agccgcugacggcgcag

SEQ ID NO: 3935654 - RNA, 22 nt, Human adenovirus E
agccggcgcaaacccgggagcu

SEQ ID NO: 3935655 - RNA, 20 nt, Human adenovirus E
agcgacaucggcaccagcca

SEQ ID NO: 3935656 - RNA, 19 nt, Human adenovirus E
agcgaccaggagcugaugc

SEQ ID NO: 3935657 - RNA, 18 nt, Human adenovirus E
agcgacgaucugggggug

SEQ ID NO: 3935658 - RNA, 15 nt, Human adenovirus E
agcgcaccaccgccu

SEQ ID NO: 3935659 - RNA, 22 nt, Human adenovirus E
agcgcaugcggaucucgcucag

SEQ ID NO: 3935660 - RNA, 15 nt, Human adenovirus E
agcgcauggucuggu

SEQ ID NO: 3935661 - RNA, 18 nt, Human adenovirus E
agcgcccagucggcgaga

SEQ ID NO: 3935662 - RNA, 16 nt, Human adenovirus E
agcgccgcagcagugg

SEQ ID NO: 3935663 - RNA, 13 nt, Human adenovirus E
agcgccggcagga

SEQ ID NO: 3935664 - RNA, 19 nt, Human adenovirus E
agcgccggcaggacccgga

SEQ ID NO: 3935665 - RNA, 14 nt, Human adenovirus E
agcgcgcgcugccc

SEQ ID NO: 3935666 - RNA, 13 nt, Human adenovirus E
agcgcguggcccg

SEQ ID NO: 3935667 - RNA, 17 nt, Human adenovirus E
agcgcuagcagccgcgg

SEQ ID NO: 3935668 - RNA, 21 nt, Human adenovirus E
agcggccgaccgcgauggcuc

SEQ ID NO: 3935669 - RNA, 17 nt, Human adenovirus E
agcggugugccgcgguc

SEQ ID NO: 3935670 - RNA, 23 nt, Human adenovirus E
agcggugugccgcgguccuccuc

SEQ ID NO: 3935671 - RNA, 19 nt, Human adenovirus E
agcuagaaaauccacagcg

SEQ ID NO: 3935672 - RNA, 14 nt, Human adenovirus E
agcuccucccucag

SEQ ID NO: 3935673 - RNA, 15 nt, Human adenovirus E
agcucgacgagccgg

SEQ ID NO: 3935674 - RNA, 17 nt, Human adenovirus E
agcucgcgguugagaag

SEQ ID NO: 3935675 - RNA, 17 nt, Human adenovirus E
agcugaaaguggagcug

SEQ ID NO: 3935676 - RNA, 18 nt, Human adenovirus E
agcugaaguaugaauggg

SEQ ID NO: 3935677 - RNA, 14 nt, Human adenovirus E
agcugaccaaccug

SEQ ID NO: 3935678 - RNA, 22 nt, Human adenovirus E
agcugccguccucccggaggag

SEQ ID NO: 3935679 - RNA, 15 nt, Human adenovirus E
agcugucggccugcg

SEQ ID NO: 3935680 - RNA, 21 nt, Human adenovirus E
agcuuaccgagcagcagcaca

SEQ ID NO: 3935681 - RNA, 22 nt, Human adenovirus E
agcuugcccuucucgcugaaca

SEQ ID NO: 3935682 - RNA, 22 nt, Human adenovirus E
agcuugggggcgaggaagacgg

SEQ ID NO: 3935683 - RNA, 16 nt, Human adenovirus E
aggaacuggugcuuga

SEQ ID NO: 3935684 - RNA, 22 nt, Human adenovirus E
aggaagacugggagaacagcag

SEQ ID NO: 3935685 - RNA, 12 nt, Human adenovirus E
aggaaggcagcg

SEQ ID NO: 3935686 - RNA, 15 nt, Human adenovirus E
aggacaaaaaggaag

SEQ ID NO: 3935687 - RNA, 16 nt, Human adenovirus E
aggacaaaaaggaaga

SEQ ID NO: 3935688 - RNA, 14 nt, Human adenovirus E
aggacagccugcaa

SEQ ID NO: 3935689 - RNA, 15 nt, Human adenovirus E
aggacccggagacgc

SEQ ID NO: 3935690 - RNA, 14 nt, Human adenovirus E
aggacgccgaggcu

SEQ ID NO: 3935691 - RNA, 20 nt, Human adenovirus E
aggacuccgccgacgacagc

SEQ ID NO: 3935692 - RNA, 12 nt, Human adenovirus E
gaggcagcagca

SEQ ID NO: 3935693 - RNA, 17 nt, Human adenovirus E
gaggcagcagcagcaga

SEQ ID NO: 3935694 - RNA, 19 nt, Human adenovirus E
gaggcagcagcagcagaaa

SEQ ID NO: 3935695 - RNA, 14 nt, Human adenovirus E
gaggcccggcgcga

SEQ ID NO: 3935696 - RNA, 13 nt, Human adenovirus E
gaggcccuggcca

SEQ ID NO: 3935697 - RNA, 13 nt, Human adenovirus E
gaggcgcugcuga

SEQ ID NO: 3935698 - RNA, 17 nt, Human adenovirus E
gagggccgcuggcuccu

SEQ ID NO: 3935699 - RNA, 21 nt, Human adenovirus E
gagggcgagaucgagggcgag

SEQ ID NO: 3935700 - RNA, 16 nt, Human adenovirus E
gagggcgaguaccugg

SEQ ID NO: 3935701 - RNA, 17 nt, Human adenovirus E
gagggucugggcagcga

SEQ ID NO: 3935702 - RNA, 22 nt, Human adenovirus E
gagggugcugaaaacaccaccu

SEQ ID NO: 3935703 - RNA, 19 nt, Human adenovirus E
gagggugcugagggacgag

SEQ ID NO: 3935704 - RNA, 22 nt, Human adenovirus E
gagggugcugccgcggcggugc

SEQ ID NO: 3935705 - RNA, 21 nt, Human adenovirus E
gagguacaugggcaugagccc

SEQ ID NO: 3935706 - RNA, 23 nt, Human adenovirus E
gagguaguugagcgugguggcga

SEQ ID NO: 3935707 - RNA, 18 nt, Human adenovirus E
gaggugacccugggccug

SEQ ID NO: 3935708 - RNA, 12 nt, Human adenovirus E
gagucagagaaa

SEQ ID NO: 3935709 - RNA, 15 nt, Human adenovirus E
gagucugaaucuuua

SEQ ID NO: 3935710 - RNA, 12 nt, Human adenovirus E
gagugaugaaga

SEQ ID NO: 3935711 - RNA, 14 nt, Human adenovirus E
gaguuuggaagcag

SEQ ID NO: 3935712 - RNA, 19 nt, Human adenovirus E
gaucaaauuauacacugaa

SEQ ID NO: 3935713 - RNA, 14 nt, Human adenovirus E
gaucagccccgcgc

SEQ ID NO: 3935714 - RNA, 23 nt, Human adenovirus E
gaucagccccgcgcgcgcgcacg

SEQ ID NO: 3935715 - RNA, 17 nt, Human adenovirus E
gaucccauacuccaccu

SEQ ID NO: 3935716 - RNA, 19 nt, Human adenovirus E
gaucccauacuccaccucc

SEQ ID NO: 3935717 - RNA, 19 nt, Human adenovirus E
gaucccauuugagcuggag

SEQ ID NO: 3935718 - RNA, 22 nt, Human adenovirus E
gauccccgucuccugccgcgcc

SEQ ID NO: 3935719 - RNA, 18 nt, Human adenovirus E
gaucccgcgaugcgggcg

SEQ ID NO: 3935720 - RNA, 13 nt, Human adenovirus E
gaucccuccaggu

SEQ ID NO: 3935721 - RNA, 17 nt, Human adenovirus E
gaucccugagcuccucc

SEQ ID NO: 3935722 - RNA, 15 nt, Human adenovirus E
gaucccugcuugcau

SEQ ID NO: 3935723 - RNA, 22 nt, Human adenovirus E
gaucgcggcgaacgagccggcg

SEQ ID NO: 3935724 - RNA, 15 nt, Human adenovirus E
gaucuccaccgcgcc

SEQ ID NO: 3935725 - RNA, 16 nt, Human adenovirus E
gaucucuugcacgucc

SEQ ID NO: 3935726 - RNA, 13 nt, Human adenovirus E
gaugaagugggcg

SEQ ID NO: 3935727 - RNA, 14 nt, Human adenovirus E
gaugaccugggcgg

SEQ ID NO: 3935728 - RNA, 23 nt, Human adenovirus E
gaugaugauauucuggagcaggc

SEQ ID NO: 3935729 - RNA, 22 nt, Human adenovirus E
gaugcauagucugcagcgggcc

SEQ ID NO: 3935730 - RNA, 17 nt, Human adenovirus E
gauggccacgggcagcc

SEQ ID NO: 3935731 - RNA, 14 nt, Human adenovirus E
gauggugaagaugc

SEQ ID NO: 3935732 - RNA, 23 nt, Human adenovirus E
gauggugaagaugccgggcagga

SEQ ID NO: 3935733 - RNA, 10 nt, Human adenovirus E
gauggugguc

SEQ ID NO: 3935734 - RNA, 19 nt, Human adenovirus E
gauguacagguggcagaug

SEQ ID NO: 3935735 - RNA, 14 nt, Human adenovirus E
gaugugcucgguga

SEQ ID NO: 3935736 - RNA, 16 nt, Human adenovirus E
gauguggacagcagcg

SEQ ID NO: 3935737 - RNA, 21 nt, Human adenovirus E
gauuccucgggaaaacucauc

SEQ ID NO: 3935738 - RNA, 22 nt, Human adenovirus E
gcaaaacuaacacuuugcuuga

SEQ ID NO: 3935739 - RNA, 18 nt, Human adenovirus E
gcaaacccgggagcugag

SEQ ID NO: 3935740 - RNA, 23 nt, Human adenovirus E
gcaaagcccccgaucccuccagg

SEQ ID NO: 3935741 - RNA, 16 nt, Human adenovirus E
gcaacaacagcccccu

SEQ ID NO: 3935742 - RNA, 15 nt, Human adenovirus E
gcaacauccccgcgc

SEQ ID NO: 3935743 - RNA, 18 nt, Human adenovirus E
gcaaccaacauuggaaau

SEQ ID NO: 3935744 - RNA, 15 nt, Human adenovirus E
gcaacggccugcccg

SEQ ID NO: 3935745 - RNA, 14 nt, Human adenovirus E
gcaagaccaccacu

SEQ ID NO: 3935746 - RNA, 13 nt, Human adenovirus E
aaaaauacccgcc

SEQ ID NO: 3935747 - RNA, 20 nt, Human adenovirus E
aaaagcgcccgaggaagcaa

SEQ ID NO: 3935748 - RNA, 13 nt, Human adenovirus E
aaaauuugaagau

SEQ ID NO: 3935749 - RNA, 13 nt, Human adenovirus E
aaacacgacuuuc

SEQ ID NO: 3935750 - RNA, 17 nt, Human adenovirus E
aaacagguguugaugau

SEQ ID NO: 3935751 - RNA, 20 nt, Human adenovirus E
aaacccuccgggcacucccg

SEQ ID NO: 3935752 - RNA, 16 nt, Human adenovirus E
aaagcuccgcuugccg

SEQ ID NO: 3935753 - RNA, 14 nt, Human adenovirus E
aaagguuggggcac

SEQ ID NO: 3935754 - RNA, 15 nt, Human adenovirus E
aaaucagacccacug

SEQ ID NO: 3935755 - RNA, 23 nt, Human adenovirus E
aacaagucuauguuggcacagca

SEQ ID NO: 3935756 - RNA, 19 nt, Human adenovirus E
aacauucuggccugcaccc

SEQ ID NO: 3935757 - RNA, 15 nt, Human adenovirus E
aaccaucacagagag

SEQ ID NO: 3935758 - RNA, 14 nt, Human adenovirus E
aacccaccacgccu

SEQ ID NO: 3935759 - RNA, 19 nt, Human adenovirus E
aaccggugcugagacccgg

SEQ ID NO: 3935760 - RNA, 17 nt, Human adenovirus E
aaccuauggcagcaagg

SEQ ID NO: 3935761 - RNA, 21 nt, Human adenovirus E
aaccugacacaccaccacagc

SEQ ID NO: 3935762 - RNA, 23 nt, Human adenovirus E
aaccugggauccaugguggcgcu

SEQ ID NO: 3935763 - RNA, 16 nt, Human adenovirus E
aacgccugcugggccu

SEQ ID NO: 3935764 - RNA, 13 nt, Human adenovirus E
aacgcgcuggugg

SEQ ID NO: 3935765 - RNA, 21 nt, Human adenovirus E
aacgcuccggaauccugcccg

SEQ ID NO: 3935766 - RNA, 13 nt, Human adenovirus E
aacggccugcccg

SEQ ID NO: 3935767 - RNA, 20 nt, Human adenovirus E
aacucuuauaccuucucaua

SEQ ID NO: 3935768 - RNA, 15 nt, Human adenovirus E
aacuuuuaauccaaa

SEQ ID NO: 3935769 - RNA, 20 nt, Human adenovirus E
aagaagcugaaaguggagcu

SEQ ID NO: 3935770 - RNA, 17 nt, Human adenovirus E
aagagucagagaaaggc

SEQ ID NO: 3935771 - RNA, 15 nt, Human adenovirus E
aagcaaguuccggag

SEQ ID NO: 3935772 - RNA, 22 nt, Human adenovirus E
aagcagccgccgccagaccguc

SEQ ID NO: 3935773 - RNA, 19 nt, Human adenovirus E
aagccuuuagacagcagcc

SEQ ID NO: 3935774 - RNA, 17 nt, Human adenovirus E
aagcgcggaaagcggcc

SEQ ID NO: 3935775 - RNA, 14 nt, Human adenovirus E
aagcgugggccugu

SEQ ID NO: 3935776 - RNA, 23 nt, Human adenovirus E
aagcugaaaguggagcugccgcc

SEQ ID NO: 3935777 - RNA, 13 nt, Human adenovirus E
aaggaggugaaga

SEQ ID NO: 3935778 - RNA, 22 nt, Human adenovirus E
aaggccauggcgaccagcgugc

SEQ ID NO: 3935779 - RNA, 13 nt, Human adenovirus E
aaguccuccccag

SEQ ID NO: 3935780 - RNA, 13 nt, Human adenovirus E
aauaacagccagg

SEQ ID NO: 3935781 - RNA, 21 nt, Human adenovirus E
aauacaccacccucucccccc

SEQ ID NO: 3935782 - RNA, 12 nt, Human adenovirus E
aauaccacagcg

SEQ ID NO: 3935783 - RNA, 21 nt, Human adenovirus E
aaucguucucuccagcaccag

SEQ ID NO: 3935784 - RNA, 18 nt, Human adenovirus E
aaugccgcggugcuccuc

SEQ ID NO: 3935785 - RNA, 20 nt, Human adenovirus E
aaugugguagucaaauacug

SEQ ID NO: 3935786 - RNA, 21 nt, Human adenovirus E
aauuccgucgaccguuaaaaa

SEQ ID NO: 3935787 - RNA, 20 nt, Human adenovirus E
acaaaaaggaagaagaaagu

SEQ ID NO: 3935788 - RNA, 14 nt, Human adenovirus E
acaaaaaugaacau

SEQ ID NO: 3935789 - RNA, 15 nt, Human adenovirus E
acaaaugccagcuga

SEQ ID NO: 3935790 - RNA, 16 nt, Human adenovirus E
acaaggcccugggcau

SEQ ID NO: 3935791 - RNA, 21 nt, Human adenovirus E
acaagucggcggacaucgccu

SEQ ID NO: 3935792 - RNA, 23 nt, Human adenovirus E
acaagucuauguuggcacagcac

SEQ ID NO: 3935793 - RNA, 17 nt, Human adenovirus E
acacaccaccacagcaa

SEQ ID NO: 3935794 - RNA, 11 nt, Human adenovirus E
acaccacccuc

SEQ ID NO: 3935795 - RNA, 12 nt, Human adenovirus E
acaccuggacca

SEQ ID NO: 3935796 - RNA, 15 nt, Human adenovirus E
acacgcccagaaacc

SEQ ID NO: 3935797 - RNA, 16 nt, Human adenovirus E
acagcaccacagggca

SEQ ID NO: 3935798 - RNA, 18 nt, Human adenovirus E
acagcacucaggcagagg

SEQ ID NO: 3935799 - RNA, 19 nt, Human adenovirus E
acagcacucaggcagagga

SEQ ID NO: 3935800 - RNA, 11 nt, Human adenovirus E
acagcagcccc

SEQ ID NO: 3935801 - RNA, 12 nt, Human adenovirus E
acagccacucuc

SEQ ID NO: 3935802 - RNA, 23 nt, Human adenovirus E
acagccgccuggacccggugccg

SEQ ID NO: 3935803 - RNA, 16 nt, Human adenovirus E
acagcugaggauuguc

SEQ ID NO: 3935804 - RNA, 21 nt, Human adenovirus E
acagggcaauccucgcacaga

SEQ ID NO: 3935805 - RNA, 17 nt, Human adenovirus E
acagucuggaggaagac

SEQ ID NO: 3935806 - RNA, 18 nt, Human adenovirus E
acagucuggaggaagacg

SEQ ID NO: 3935807 - RNA, 18 nt, Human adenovirus E
acauccccgcgcuccugg

SEQ ID NO: 3935808 - RNA, 23 nt, Human adenovirus E
acaugcagccccggaugauccug

SEQ ID NO: 3935809 - RNA, 17 nt, Human adenovirus E
accacaaaaacuacacc

SEQ ID NO: 3935810 - RNA, 19 nt, Human adenovirus E
accacagggccagcaccgc

SEQ ID NO: 3935811 - RNA, 15 nt, Human adenovirus E
accacccagaccggu

SEQ ID NO: 3935812 - RNA, 22 nt, Human adenovirus E
accacccgguuguaccuggugg

SEQ ID NO: 3935813 - RNA, 21 nt, Human adenovirus E
accacccucuccccccgcaca

SEQ ID NO: 3935814 - RNA, 14 nt, Human adenovirus E
accaccgccucgga

SEQ ID NO: 3935815 - RNA, 21 nt, Human adenovirus E
accaccggucucgaucauuga

SEQ ID NO: 3935816 - RNA, 21 nt, Human adenovirus E
accaccuggacaaaauaccac

SEQ ID NO: 3935817 - RNA, 20 nt, Human adenovirus E
accagcagaaaaccagcagc

SEQ ID NO: 3935818 - RNA, 23 nt, Human adenovirus E
accaucaucuuagcgcuagcagc

SEQ ID NO: 3935819 - RNA, 17 nt, Human adenovirus E
accauugucaaugccac

SEQ ID NO: 3935820 - RNA, 15 nt, Human adenovirus E
acccacugcugaacc

SEQ ID NO: 3935821 - RNA, 11 nt, Human adenovirus E
acccagccaga

SEQ ID NO: 3935822 - RNA, 15 nt, Human adenovirus E
accccaccacccaga

SEQ ID NO: 3935823 - RNA, 15 nt, Human adenovirus E
accccauagccagcc

SEQ ID NO: 3935824 - RNA, 22 nt, Human adenovirus E
accccauccagguguagguuuc

SEQ ID NO: 3935825 - RNA, 23 nt, Human adenovirus E
  misc_feature (12)..(12): n is a, c, g or u
acccccagcugnugagcgagacc

SEQ ID NO: 3935826 - RNA, 17 nt, Human adenovirus E
acccgugcagccacagc

SEQ ID NO: 3935827 - RNA, 18 nt, Human adenovirus E
acccgugcagccacagcg

SEQ ID NO: 3935828 - RNA, 13 nt, Human adenovirus E
acccucgcucugg

SEQ ID NO: 3935829 - RNA, 21 nt, Human adenovirus E
accgcaacucguaccugggcu

SEQ ID NO: 3935830 - RNA, 15 nt, Human adenovirus E
accgccgcggccgcc

SEQ ID NO: 3935831 - RNA, 17 nt, Human adenovirus E
accgccucggaccuggc

SEQ ID NO: 3935832 - RNA, 13 nt, Human adenovirus E
accgcgaggccau

SEQ ID NO: 3935833 - RNA, 14 nt, Human adenovirus E
accgcggcgccgcg

SEQ ID NO: 3935834 - RNA, 20 nt, Human adenovirus E
accgcggucauaccagcagc

SEQ ID NO: 3935835 - RNA, 15 nt, Human adenovirus E
accgcucccuggccu

SEQ ID NO: 3935836 - RNA, 19 nt, Human adenovirus E
accgcucccuggccugcaa

SEQ ID NO: 3935837 - RNA, 15 nt, Human adenovirus E
accggcucucggcca

SEQ ID NO: 3935838 - RNA, 19 nt, Human adenovirus E
accgggugcuaacgagcgc

SEQ ID NO: 3935839 - RNA, 18 nt, Human adenovirus E
accggguucgacgagcgc

SEQ ID NO: 3935840 - RNA, 22 nt, Human adenovirus E
accguggagcuggagugccugc

SEQ ID NO: 3935841 - RNA, 16 nt, Human adenovirus E
accguggugcagaaca

SEQ ID NO: 3935842 - RNA, 16 nt, Human adenovirus E
accgugucaugaugca

SEQ ID NO: 3935843 - RNA, 20 nt, Human adenovirus E
  misc_feature (4)..(4): n is a, c, g or u
accnuacuuuuuccacccgc

SEQ ID NO: 3935844 - RNA, 19 nt, Human adenovirus E
accucaauccgcguaauug

SEQ ID NO: 3935845 - RNA, 17 nt, Human adenovirus E
accucaggcacacgcac

SEQ ID NO: 3935846 - RNA, 15 nt, Human adenovirus E
accuccaccugagcg

SEQ ID NO: 3935847 - RNA, 20 nt, Human adenovirus E
accucgacccccagaccggu

SEQ ID NO: 3935848 - RNA, 13 nt, Human adenovirus E
accucgcccugcu

SEQ ID NO: 3935849 - RNA, 18 nt, Human adenovirus E
accugauaucgccuccuu

SEQ ID NO: 3935850 - RNA, 13 nt, Human adenovirus E
accugcugggcau

SEQ ID NO: 3935851 - RNA, 17 nt, Human adenovirus E
accuggcuguuccaggg

SEQ ID NO: 3935852 - RNA, 22 nt, Human adenovirus E
accuggucucguacaugggcau

SEQ ID NO: 3935853 - RNA, 21 nt, Human adenovirus E
accuugcagcaggugcugccg

SEQ ID NO: 3935854 - RNA, 15 nt, Human adenovirus E
acgaagcccugcagg

SEQ ID NO: 3935855 - RNA, 18 nt, Human adenovirus E
acgaagcccugcaggaag

SEQ ID NO: 3935856 - RNA, 16 nt, Human adenovirus E
acgaggccggccuggu

SEQ ID NO: 3935857 - RNA, 18 nt, Human adenovirus E
acgauuggacccaggcca

SEQ ID NO: 3935858 - RNA, 13 nt, Human adenovirus E
acgcacccgggcu

SEQ ID NO: 3935859 - RNA, 20 nt, Human adenovirus E
gcaagacccccaauggggug

SEQ ID NO: 3935860 - RNA, 15 nt, Human adenovirus E
gcaagacccggucac

SEQ ID NO: 3935861 - RNA, 13 nt, Human adenovirus E
gcaagagauggag

SEQ ID NO: 3935862 - RNA, 23 nt, Human adenovirus E
gcaagaucuccaacguggagcug

SEQ ID NO: 3935863 - RNA, 14 nt, Human adenovirus E
gcaagccacaguac

SEQ ID NO: 3935864 - RNA, 21 nt, Human adenovirus E
gcaagcccguggucagcgacg

SEQ ID NO: 3935865 - RNA, 18 nt, Human adenovirus E
gcaagcgguuggggggag

SEQ ID NO: 3935866 - RNA, 15 nt, Human adenovirus E
gcaaggaccugagcg

SEQ ID NO: 3935867 - RNA, 19 nt, Human adenovirus E
gcaaggaggaugcagcagc

SEQ ID NO: 3935868 - RNA, 22 nt, Human adenovirus E
gcaaguacggcgcggccagccu

SEQ ID NO: 3935869 - RNA, 21 nt, Human adenovirus E
gcaaguuccggagcagcuggg

SEQ ID NO: 3935870 - RNA, 20 nt, Human adenovirus E
gcaaucaggcagcaccgggu

SEQ ID NO: 3935871 - RNA, 23 nt, Human adenovirus E
gcacagacugaacgacaagcugg

SEQ ID NO: 3935872 - RNA, 20 nt, Human adenovirus E
gcacagggacgauccccggg

SEQ ID NO: 3935873 - RNA, 20 nt, Human adenovirus E
gcaccaguuccgccaggagg

SEQ ID NO: 3935874 - RNA, 14 nt, Human adenovirus E
gcaccgccgcugca

SEQ ID NO: 3935875 - RNA, 14 nt, Human adenovirus E
gcaccucggcccgg

SEQ ID NO: 3935876 - RNA, 14 nt, Human adenovirus E
gcaccugugggacc

SEQ ID NO: 3935877 - RNA, 20 nt, Human adenovirus E
gcacgagaagguccuggcca

SEQ ID NO: 3935878 - RNA, 23 nt, Human adenovirus E
gcacgcggccguucaugggcacc

SEQ ID NO: 3935879 - RNA, 16 nt, Human adenovirus E
gcacguggacgagcag

SEQ ID NO: 3935880 - RNA, 23 nt, Human adenovirus E
gcacguggccgcggccaaccugg

SEQ ID NO: 3935881 - RNA, 15 nt, Human adenovirus E
gcacucaacccaccc

SEQ ID NO: 3935882 - RNA, 12 nt, Human adenovirus E
gcacucaggcag

SEQ ID NO: 3935883 - RNA, 20 nt, Human adenovirus E
gcacuuccgcgcucccuggg

SEQ ID NO: 3935884 - RNA, 15 nt, Human adenovirus E
gcagaaaaaggcggg

SEQ ID NO: 3935885 - RNA, 20 nt, Human adenovirus E
gcagaccuaccaggagauca

SEQ ID NO: 3935886 - RNA, 17 nt, Human adenovirus E
gcagaggcguccgcccu

SEQ ID NO: 3935887 - RNA, 15 nt, Human adenovirus E
gcagagucaggcugg

SEQ ID NO: 3935888 - RNA, 21 nt, Human adenovirus E
gcagaucuagggccucaggag

SEQ ID NO: 3935889 - RNA, 18 nt, Human adenovirus E
gcagcagcacacaacagg

SEQ ID NO: 3935890 - RNA, 14 nt, Human adenovirus E
gcagcagcagcaga

SEQ ID NO: 3935891 - RNA, 16 nt, Human adenovirus E
gcagcagcgagcuggg

SEQ ID NO: 3935892 - RNA, 16 nt, Human adenovirus E
gcagccccccugcucc

SEQ ID NO: 3935893 - RNA, 24 nt, Human adenovirus E
gcagccccccugcucccagagcug

SEQ ID NO: 3935894 - RNA, 13 nt, Human adenovirus E
gcagcccccgcug

SEQ ID NO: 3935895 - RNA, 16 nt, Human adenovirus E
gcagcccccgcuggag

SEQ ID NO: 3935896 - RNA, 20 nt, Human adenovirus E
  misc_feature (7)..(7): n is a, c, g or u
gcagccnuucuccacgggga

SEQ ID NO: 3935897 - RNA, 19 nt, Human adenovirus E
gcagcgacgagacucgggc

SEQ ID NO: 3935898 - RNA, 20 nt, Human adenovirus E
gcagcggggacagauguggg

SEQ ID NO: 3935899 - RNA, 20 nt, Human adenovirus E
gcagcucacuaccaauaaca

SEQ ID NO: 3935900 - RNA, 16 nt, Human adenovirus E
gcaggaccaccagcac

SEQ ID NO: 3935901 - RNA, 14 nt, Human adenovirus E
gcaggagggggcca

SEQ ID NO: 3935902 - RNA, 18 nt, Human adenovirus E
gcaggccugcgggggcaa

SEQ ID NO: 3935903 - RNA, 14 nt, Human adenovirus E
gcaggcggcgcgag

SEQ ID NO: 3935904 - RNA, 18 nt, Human adenovirus E
gcagggagagggcgcuga

SEQ ID NO: 3935905 - RNA, 19 nt, Human adenovirus E
gcaggggcggcaggggcac

SEQ ID NO: 3935906 - RNA, 20 nt, Human adenovirus E
gcaggggcggcucggggccc

SEQ ID NO: 3935907 - RNA, 22 nt, Human adenovirus E
gcagggugaugagguccacacu

SEQ ID NO: 3935908 - RNA, 13 nt, Human adenovirus E
gcaguaguacaga

SEQ ID NO: 3935909 - RNA, 17 nt, Human adenovirus E
gcagucccacugcuagu

SEQ ID NO: 3935910 - RNA, 13 nt, Human adenovirus E
gcaguggcagcgg

SEQ ID NO: 3935911 - RNA, 14 nt, Human adenovirus E
gcaucagcuggaag

SEQ ID NO: 3935912 - RNA, 12 nt, Human adenovirus E
gcaucccagcug

SEQ ID NO: 3935913 - RNA, 23 nt, Human adenovirus E
gcaucccagcuggaucaugauca

SEQ ID NO: 3935914 - RNA, 17 nt, Human adenovirus E
gcaucuccagguggccg

SEQ ID NO: 3935915 - RNA, 17 nt, Human adenovirus E
gcaucucuucagcacuc

SEQ ID NO: 3935916 - RNA, 12 nt, Human adenovirus E
gcaucuggcccg

SEQ ID NO: 3935917 - RNA, 19 nt, Human adenovirus E
gcaucuggcccggcaggcc

SEQ ID NO: 3935918 - RNA, 20 nt, Human adenovirus E
gcaugaaggggacgagcugc

SEQ ID NO: 3935919 - RNA, 23 nt, Human adenovirus E
gcaugcaauggcagaucacccug

SEQ ID NO: 3935920 - RNA, 20 nt, Human adenovirus E
gcauggucucggugacggcg

SEQ ID NO: 3935921 - RNA, 16 nt, Human adenovirus E
gcaugucccgcccgcg

SEQ ID NO: 3935922 - RNA, 19 nt, Human adenovirus E
gcauucguuacucggagcu

SEQ ID NO: 3935923 - RNA, 17 nt, Human adenovirus E
gcauucuuaagcacacc

SEQ ID NO: 3935924 - RNA, 16 nt, Human adenovirus E
gccaaggggggucuga

SEQ ID NO: 3935925 - RNA, 15 nt, Human adenovirus E
gccacaccacagcua

SEQ ID NO: 3935926 - RNA, 22 nt, Human adenovirus E
gccacaccacagcuaccuccag

SEQ ID NO: 3935927 - RNA, 18 nt, Human adenovirus E
gccacccccagcgccgcg

SEQ ID NO: 3935928 - RNA, 14 nt, Human adenovirus E
gccaccucagcuca

SEQ ID NO: 3935929 - RNA, 21 nt, Human adenovirus E
gccacggcggcggcagcggcc

SEQ ID NO: 3935930 - RNA, 23 nt, Human adenovirus E
gccacggcggcggcagcggccau

SEQ ID NO: 3935931 - RNA, 18 nt, Human adenovirus E
gccacuacccggacgagu

SEQ ID NO: 3935932 - RNA, 17 nt, Human adenovirus E
gccagaucguccagggc

SEQ ID NO: 3935933 - RNA, 15 nt, Human adenovirus E
gccagcacccagacc

SEQ ID NO: 3935934 - RNA, 21 nt, Human adenovirus E
gccagccccgauuaugcaggg

SEQ ID NO: 3935935 - RNA, 13 nt, Human adenovirus E
gccagcuccuccu

SEQ ID NO: 3935936 - RNA, 18 nt, Human adenovirus E
gccagcugcaccacgcug

SEQ ID NO: 3935937 - RNA, 15 nt, Human adenovirus E
gccaggaggacuaca

SEQ ID NO: 3935938 - RNA, 18 nt, Human adenovirus E
gccaguccagacuguauu

SEQ ID NO: 3935939 - RNA, 17 nt, Human adenovirus E
gccauaggaccaccagg

SEQ ID NO: 3935940 - RNA, 20 nt, Human adenovirus E
gccaugcggaugaagcacaa

SEQ ID NO: 3935941 - RNA, 20 nt, Human adenovirus E
gccauggcgaccagcgugcg

SEQ ID NO: 3935942 - RNA, 15 nt, Human adenovirus E
gcccacggcccucag

SEQ ID NO: 3935943 - RNA, 22 nt, Human adenovirus E
gcccagccccgccaccuccgac

SEQ ID NO: 3935944 - RNA, 20 nt, Human adenovirus E
gcccaucauguacgccagca

SEQ ID NO: 3935945 - RNA, 20 nt, Human adenovirus E
gccccaguacgcgcucagca

SEQ ID NO: 3935946 - RNA, 23 nt, Human adenovirus E
gccccccggcggcgcgugcagug

SEQ ID NO: 3935947 - RNA, 19 nt, Human adenovirus E
gccccccugcucccagagc

SEQ ID NO: 3935948 - RNA, 17 nt, Human adenovirus E
gcccccgaucccuccag

SEQ ID NO: 3935949 - RNA, 13 nt, Human adenovirus E
gcccccgcuggag

SEQ ID NO: 3935950 - RNA, 18 nt, Human adenovirus E
gcccccgcuggaggcucc

SEQ ID NO: 3935951 - RNA, 19 nt, Human adenovirus E
gcccccgcuggaggcuccu

SEQ ID NO: 3935952 - RNA, 14 nt, Human adenovirus E
gccccgccaccucc

SEQ ID NO: 3935953 - RNA, 16 nt, Human adenovirus E
gccccgccgcccagcc

SEQ ID NO: 3935954 - RNA, 14 nt, Human adenovirus E
gccccgggcccagg

SEQ ID NO: 3935955 - RNA, 18 nt, Human adenovirus E
gccccggggccaggagga

SEQ ID NO: 3935956 - RNA, 19 nt, Human adenovirus E
gccccgguucgaggccggc

SEQ ID NO: 3935957 - RNA, 22 nt, Human adenovirus E
gcccgacaugaugcaagacccg

SEQ ID NO: 3935958 - RNA, 13 nt, Human adenovirus E
gcccgaggccgcc

SEQ ID NO: 3935959 - RNA, 13 nt, Human adenovirus E
gcccgccaccugc

SEQ ID NO: 3935960 - RNA, 15 nt, Human adenovirus E
gcccgcgcuugcugg

SEQ ID NO: 3935961 - RNA, 15 nt, Human adenovirus E
gcccgcggagcacga

SEQ ID NO: 3935962 - RNA, 23 nt, Human adenovirus E
gcccggaugcaggggcggcaggg

SEQ ID NO: 3935963 - RNA, 16 nt, Human adenovirus E
gcccggcgagcgcucc

SEQ ID NO: 3935964 - RNA, 15 nt, Human adenovirus E
gcccggguccaggcc

SEQ ID NO: 3935965 - RNA, 19 nt, Human adenovirus E
gcccgugaccuugcagcag

SEQ ID NO: 3935966 - RNA, 16 nt, Human adenovirus E
gcccgugaggcgcgcg

SEQ ID NO: 3935967 - RNA, 21 nt, Human adenovirus E
gcccgugggcggcggccuggg

SEQ ID NO: 3935968 - RNA, 21 nt, Human adenovirus E
gcccuggccaccuaccacauc

SEQ ID NO: 3935969 - RNA, 14 nt, Human adenovirus E
gcccugggccagga

SEQ ID NO: 3935970 - RNA, 16 nt, Human adenovirus E
gcccugggccaggacg

SEQ ID NO: 3935971 - RNA, 15 nt, Human adenovirus E
gcccuuuucaaccug

SEQ ID NO: 3935972 - RNA, 20 nt, Human adenovirus E
gccgaacucgcgccugcugc

SEQ ID NO: 3935973 - RNA, 19 nt, Human adenovirus E
gccgaccgcgauggcucgu

SEQ ID NO: 3935974 - RNA, 16 nt, Human adenovirus E
gccgaccgcggcgccg

SEQ ID NO: 3935975 - RNA, 14 nt, Human adenovirus E
gccgcaccgcuccc

SEQ ID NO: 3935976 - RNA, 13 nt, Human adenovirus E
gccgccagcuccu

SEQ ID NO: 3935977 - RNA, 12 nt, Human adenovirus E
gccgcccaggac

SEQ ID NO: 3935978 - RNA, 16 nt, Human adenovirus E
gccgccgcaagaccac

SEQ ID NO: 3935979 - RNA, 15 nt, Human adenovirus E
gccgccggugccgcc

SEQ ID NO: 3935980 - RNA, 22 nt, Human adenovirus E
gccgcgaacgcucugcaaggag

SEQ ID NO: 3935981 - RNA, 19 nt, Human adenovirus E
gccgcgcucgacaugaccg

SEQ ID NO: 3935982 - RNA, 20 nt, Human adenovirus E
gccgcugaccuuccgcgagu

SEQ ID NO: 3935983 - RNA, 22 nt, Human adenovirus E
gccggacuacuucuuccagacc

SEQ ID NO: 3935984 - RNA, 21 nt, Human adenovirus E
gccggaucggggagaucuucc

SEQ ID NO: 3935985 - RNA, 20 nt, Human adenovirus E
gccggcgcaaacccgggagc

SEQ ID NO: 3935986 - RNA, 15 nt, Human adenovirus E
gccgguccucgagcg

SEQ ID NO: 3935987 - RNA, 21 nt, Human adenovirus E
gccguccggcauuaacuccuc

SEQ ID NO: 3935988 - RNA, 16 nt, Human adenovirus E
gccgucgccgcaccgc

SEQ ID NO: 3935989 - RNA, 23 nt, Human adenovirus E
gccgucuacucgcagcagcugcg

SEQ ID NO: 3935990 - RNA, 22 nt, Human adenovirus E
gccuacgaguugaaccucuucu

SEQ ID NO: 3935991 - RNA, 22 nt, Human adenovirus E
gccuacuuugagcugcccgagg

SEQ ID NO: 3935992 - RNA, 19 nt, Human adenovirus E
gccuccacgcgcacaucca

SEQ ID NO: 3935993 - RNA, 22 nt, Human adenovirus E
gccucgcugaacuaccagaacg

SEQ ID NO: 3935994 - RNA, 16 nt, Human adenovirus E
gccucggaccuggccg

SEQ ID NO: 3935995 - RNA, 19 nt, Human adenovirus E
gccucuaccgaggucaggg

SEQ ID NO: 3935996 - RNA, 23 nt, Human adenovirus E
gccugaugcaccugugggaccug

SEQ ID NO: 3935997 - RNA, 23 nt, Human adenovirus E
gccugcaagacagucuggaggaa

SEQ ID NO: 3935998 - RNA, 15 nt, Human adenovirus E
gccugcaucucgugc

SEQ ID NO: 3935999 - RNA, 21 nt, Human adenovirus E
gccugggguucauguugugca

SEQ ID NO: 3936000 - RNA, 21 nt, Human adenovirus E
gccuuggaggcggcggcagga

SEQ ID NO: 3936001 - RNA, 20 nt, Human adenovirus E
gcgaccaggagcugaugcau

SEQ ID NO: 3936002 - RNA, 16 nt, Human adenovirus E
gcgagacgcccaggcc

SEQ ID NO: 3936003 - RNA, 17 nt, Human adenovirus E
gcgaguccaaccuggga

SEQ ID NO: 3936004 - RNA, 19 nt, Human adenovirus E
gcgaucccauuugagcugg

SEQ ID NO: 3936005 - RNA, 23 nt, Human adenovirus E
gcgaucccugagcuccucccuca

SEQ ID NO: 3936006 - RNA, 12 nt, Human adenovirus E
gcgaugcagccc

SEQ ID NO: 3936007 - RNA, 24 nt, Human adenovirus E
gcgaugggcccgugggcggcggcc

SEQ ID NO: 3936008 - RNA, 14 nt, Human adenovirus E
gcgcaacggccugc

SEQ ID NO: 3936009 - RNA, 18 nt, Human adenovirus E
gcgcacggccagcgcgcg

SEQ ID NO: 3936010 - RNA, 16 nt, Human adenovirus E
gcgcaucgcccggcgg

SEQ ID NO: 3936011 - RNA, 13 nt, Human adenovirus E
gcgcaucuccagg

SEQ ID NO: 3936012 - RNA, 21 nt, Human adenovirus E
gcgcaucuccagguggccggg

SEQ ID NO: 3936013 - RNA, 22 nt, Human adenovirus E
gcgccagcccaauggcaccugc

SEQ ID NO: 3936014 - RNA, 13 nt, Human adenovirus E
gcgcccagcaaga

SEQ ID NO: 3936015 - RNA, 15 nt, Human adenovirus E
gcgcccucaaaggcc

SEQ ID NO: 3936016 - RNA, 16 nt, Human adenovirus E
gcgccgggcccgcgau

SEQ ID NO: 3936017 - RNA, 21 nt, Human adenovirus E
gcgcgaggaggugacccuggg

SEQ ID NO: 3936018 - RNA, 19 nt, Human adenovirus E
gcgcgaguucgccccccgg

SEQ ID NO: 3936019 - RNA, 20 nt, Human adenovirus E
  misc_feature (9)..(9): n is a, c, g or u
gcgcgcaanuacacccccgc

SEQ ID NO: 3936020 - RNA, 22 nt, Human adenovirus E
  misc_feature (9)..(9): n is a, c, g or u
gcgcgcaanuacacccccgccg

SEQ ID NO: 3936021 - RNA, 12 nt, Human adenovirus E
gcgcgcccagca

SEQ ID NO: 3936022 - RNA, 19 nt, Human adenovirus E
gcgcgccgggcggcagggg

SEQ ID NO: 3936023 - RNA, 20 nt, Human adenovirus E
gcgcgccgggcggcaggggc

SEQ ID NO: 3936024 - RNA, 14 nt, Human adenovirus E
gcgcgcgcugcccg

SEQ ID NO: 3936025 - RNA, 20 nt, Human adenovirus E
gcgcgggaggcagguccaga

SEQ ID NO: 3936026 - RNA, 14 nt, Human adenovirus E
gcgcgucggccagg

SEQ ID NO: 3936027 - RNA, 13 nt, Human adenovirus E
gcgcuaccugcuc

SEQ ID NO: 3936028 - RNA, 22 nt, Human adenovirus E
gcgcucgccaacgcuccacgca

SEQ ID NO: 3936029 - RNA, 22 nt, Human adenovirus E
gcgcugaacgccuuccucagca

SEQ ID NO: 3936030 - RNA, 21 nt, Human adenovirus E
gcgcugcccguucucgcucgc

SEQ ID NO: 3936031 - RNA, 22 nt, Human adenovirus E
gcgcugguggagaacaaggcca

SEQ ID NO: 3936032 - RNA, 23 nt, Human adenovirus E
gcggaauaucaaaaucucugccg

SEQ ID NO: 3936033 - RNA, 23 nt, Human adenovirus E
gcggcacccgcgcgugcagauga

SEQ ID NO: 3936034 - RNA, 23 nt, Human adenovirus E
gcggccacggcggcggcagcggc

SEQ ID NO: 3936035 - RNA, 17 nt, Human adenovirus E
gcggcgacgaggccggc

SEQ ID NO: 3936036 - RNA, 17 nt, Human adenovirus E
gcggcgaucggggcgau

SEQ ID NO: 3936037 - RNA, 17 nt, Human adenovirus E
gcggcgauguugagcug

SEQ ID NO: 3936038 - RNA, 20 nt, Human adenovirus E
gcggcgauguugagcugcac

SEQ ID NO: 3936039 - RNA, 13 nt, Human adenovirus E
gcggcgcggagcc

SEQ ID NO: 3936040 - RNA, 20 nt, Human adenovirus E
gcgggagaagaacuucccca

SEQ ID NO: 3936041 - RNA, 14 nt, Human adenovirus E
gcgggcgcagcagc

SEQ ID NO: 3936042 - RNA, 13 nt, Human adenovirus E
gcggucccagagc

SEQ ID NO: 3936043 - RNA, 13 nt, Human adenovirus E
gcguaggccuggg

SEQ ID NO: 3936044 - RNA, 18 nt, Human adenovirus E
gcguccagcgcagccagg

SEQ ID NO: 3936045 - RNA, 16 nt, Human adenovirus E
gcgucgccggcggcgc

SEQ ID NO: 3936046 - RNA, 21 nt, Human adenovirus E
gcgugcacgaagcccugcagg

SEQ ID NO: 3936047 - RNA, 15 nt, Human adenovirus E
gcgugcaggccccgg

SEQ ID NO: 3936048 - RNA, 23 nt, Human adenovirus E
gcgugcaggccccggucggggac

SEQ ID NO: 3936049 - RNA, 15 nt, Human adenovirus E
gcgugccccagggca

SEQ ID NO: 3936050 - RNA, 22 nt, Human adenovirus E
gcguggcccgcuacaacagcac

SEQ ID NO: 3936051 - RNA, 14 nt, Human adenovirus E
gcguguggcagcag

SEQ ID NO: 3936052 - RNA, 17 nt, Human adenovirus E
gcuaguaccaaugagca

SEQ ID NO: 3936053 - RNA, 23 nt, Human adenovirus E
gcucaccacuacuaucucuuccu

SEQ ID NO: 3936054 - RNA, 12 nt, Human adenovirus E
gcucacccgcag

SEQ ID NO: 3936055 - RNA, 18 nt, Human adenovirus E
gcucagcaccgaggagga

SEQ ID NO: 3936056 - RNA, 16 nt, Human adenovirus E
gcuccagcuccagugu

SEQ ID NO: 3936057 - RNA, 20 nt, Human adenovirus E
gcucccggcggcgcucugac

SEQ ID NO: 3936058 - RNA, 13 nt, Human adenovirus E
gcuccgcgcugcc

SEQ ID NO: 3936059 - RNA, 21 nt, Human adenovirus E
gcuccggaauccugcccgcca

SEQ ID NO: 3936060 - RNA, 18 nt, Human adenovirus E
gcuccuagucgaagaccc

SEQ ID NO: 3936061 - RNA, 13 nt, Human adenovirus E
gcuccucccucag

SEQ ID NO: 3936062 - RNA, 12 nt, Human adenovirus E
gcucgccacauc

SEQ ID NO: 3936063 - RNA, 18 nt, Human adenovirus E
gcucgcgguggggcggcc

SEQ ID NO: 3936064 - RNA, 22 nt, Human adenovirus E
gcucgcgguggggcggccagcu

SEQ ID NO: 3936065 - RNA, 12 nt, Human adenovirus E
gcucuccacguc

SEQ ID NO: 3936066 - RNA, 22 nt, Human adenovirus E
gcugaacgccuuccucagcacc

SEQ ID NO: 3936067 - RNA, 16 nt, Human adenovirus E
gcugcaaccucugcac

SEQ ID NO: 3936068 - RNA, 17 nt, Human adenovirus E
gcugcaaccucugcacg

SEQ ID NO: 3936069 - RNA, 14 nt, Human adenovirus E
gcugcagagccagc

SEQ ID NO: 3936070 - RNA, 20 nt, Human adenovirus E
gcugcgcaacggccugcccg

SEQ ID NO: 3936071 - RNA, 20 nt, Human adenovirus E
gcugcggcgcggccuggacc

SEQ ID NO: 3936072 - RNA, 14 nt, Human adenovirus E
gcugcugcucaggg

SEQ ID NO: 3936073 - RNA, 14 nt, Human adenovirus E
gcugcugcugcugg

SEQ ID NO: 3936074 - RNA, 23 nt, Human adenovirus E
gcuggaagacguaugcgcaggag

SEQ ID NO: 3936075 - RNA, 18 nt, Human adenovirus E
gcuggaccacggcaaccc

SEQ ID NO: 3936076 - RNA, 16 nt, Human adenovirus E
gcuggcagagccccuu

SEQ ID NO: 3936077 - RNA, 17 nt, Human adenovirus E
gcuggcagagccccuuc

SEQ ID NO: 3936078 - RNA, 18 nt, Human adenovirus E
gcuggcuccuggaccugg

SEQ ID NO: 3936079 - RNA, 15 nt, Human adenovirus E
gcugggucugcgacc

SEQ ID NO: 3936080 - RNA, 14 nt, Human adenovirus E
gcuguagcagaacc

SEQ ID NO: 3936081 - RNA, 20 nt, Human adenovirus E
gcuguagcauagucugccug

SEQ ID NO: 3936082 - RNA, 13 nt, Human adenovirus E
gcuguccacgagc

SEQ ID NO: 3936083 - RNA, 21 nt, Human adenovirus E
gcuuaaaaccuauggcagcaa

SEQ ID NO: 3936084 - RNA, 14 nt, Human adenovirus E
gcuucacgcucgcc

SEQ ID NO: 3936085 - RNA, 16 nt, Human adenovirus E
gcuuccguggcggugc

SEQ ID NO: 3936086 - RNA, 13 nt, Human adenovirus E
gcuugcaggccug

SEQ ID NO: 3936087 - RNA, 22 nt, Human adenovirus E
gcuuggcgacgagcucggcggu

SEQ ID NO: 3936088 - RNA, 14 nt, Human adenovirus E
gcuuucggacauuu

SEQ ID NO: 3936089 - RNA, 15 nt, Human adenovirus E
ggaacuacagcaggc

SEQ ID NO: 3936090 - RNA, 16 nt, Human adenovirus E
ggaagaacaggaagaa

SEQ ID NO: 3936091 - RNA, 14 nt, Human adenovirus E
ggaaggugauuggc

SEQ ID NO: 3936092 - RNA, 18 nt, Human adenovirus E
ggaaugccgcggugcucc

SEQ ID NO: 3936093 - RNA, 15 nt, Human adenovirus E
ggacagcacucaggc

SEQ ID NO: 3936094 - RNA, 18 nt, Human adenovirus E
ggacaggguaucgcaauc

SEQ ID NO: 3936095 - RNA, 15 nt, Human adenovirus E
ugcccuucucgcuga

SEQ ID NO: 3936096 - RNA, 19 nt, Human adenovirus E
ugcccuucucgcugaacag

SEQ ID NO: 3936097 - RNA, 18 nt, Human adenovirus E
ugccgaccgcggcgccgc

SEQ ID NO: 3936098 - RNA, 19 nt, Human adenovirus E
ugccgaccgcggcgccgcg

SEQ ID NO: 3936099 - RNA, 18 nt, Human adenovirus E
ugccgcagccgguggggc

SEQ ID NO: 3936100 - RNA, 16 nt, Human adenovirus E
ugccgccgccgcuccg

SEQ ID NO: 3936101 - RNA, 16 nt, Human adenovirus E
ugccgcgguccuccuc

SEQ ID NO: 3936102 - RNA, 17 nt, Human adenovirus E
ugccgcgguccuccucg

SEQ ID NO: 3936103 - RNA, 18 nt, Human adenovirus E
ugccugaacgccugcugg

SEQ ID NO: 3936104 - RNA, 22 nt, Human adenovirus E
ugccuucaccaccugcaucugc

SEQ ID NO: 3936105 - RNA, 19 nt, Human adenovirus E
ugccuuggcaguacaguua

SEQ ID NO: 3936106 - RNA, 21 nt, Human adenovirus E
ugcgaccugacggagucuucc

SEQ ID NO: 3936107 - RNA, 15 nt, Human adenovirus E
ugcgaguuggaggag

SEQ ID NO: 3936108 - RNA, 22 nt, Human adenovirus E
ugcgaucucggucaugaacugc

SEQ ID NO: 3936109 - RNA, 12 nt, Human adenovirus E
ugcgcagggcca

SEQ ID NO: 3936110 - RNA, 15 nt, Human adenovirus E
ugcgcagggccaggc

SEQ ID NO: 3936111 - RNA, 15 nt, Human adenovirus E
ugcgcgucggccagg

SEQ ID NO: 3936112 - RNA, 12 nt, Human adenovirus E
ugcgcuccugga

SEQ ID NO: 3936113 - RNA, 19 nt, Human adenovirus E
ugcggcgggcgcagcagcg

SEQ ID NO: 3936114 - RNA, 21 nt, Human adenovirus E
ugcgggcggcgcugcagagcc

SEQ ID NO: 3936115 - RNA, 13 nt, Human adenovirus E
ugcguacaaaaug

SEQ ID NO: 3936116 - RNA, 16 nt, Human adenovirus E
ugcgucaucacccagg

SEQ ID NO: 3936117 - RNA, 22 nt, Human adenovirus E
ugcgucaucacccagggggcga

SEQ ID NO: 3936118 - RNA, 17 nt, Human adenovirus E
ugcuaacgagcgccccu

SEQ ID NO: 3936119 - RNA, 13 nt, Human adenovirus E
ugcuagucagcgg

SEQ ID NO: 3936120 - RNA, 15 nt, Human adenovirus E
ugcucuuugccuuca

SEQ ID NO: 3936121 - RNA, 22 nt, Human adenovirus E
ugcucuuugccuucaccaccug

SEQ ID NO: 3936122 - RNA, 23 nt, Human adenovirus E
ugcugaaaaagggccgcgggguc

SEQ ID NO: 3936123 - RNA, 17 nt, Human adenovirus E
ugcugcccgacggccau

SEQ ID NO: 3936124 - RNA, 17 nt, Human adenovirus E
ugcugcucgagcgccca

SEQ ID NO: 3936125 - RNA, 21 nt, Human adenovirus E
ugcugggcauucgcaagaggc

SEQ ID NO: 3936126 - RNA, 23 nt, Human adenovirus E
ugcuguaguggugugcauguuga

SEQ ID NO: 3936127 - RNA, 20 nt, Human adenovirus E
ugcuuucgugguauugcuau

SEQ ID NO: 3936128 - RNA, 16 nt, Human adenovirus E
uggaacaaacucugaa

SEQ ID NO: 3936129 - RNA, 22 nt, Human adenovirus E
uggaagacguaugcgcaggagc

SEQ ID NO: 3936130 - RNA, 15 nt, Human adenovirus E
uggaagagggcgagg

SEQ ID NO: 3936131 - RNA, 12 nt, Human adenovirus E
uggaccucggcc

SEQ ID NO: 3936132 - RNA, 20 nt, Human adenovirus E
uggacuucaccgagagccgc

SEQ ID NO: 3936133 - RNA, 17 nt, Human adenovirus E
uggagaacaaggccauc

SEQ ID NO: 3936134 - RNA, 13 nt, Human adenovirus E
uggagccauagca

SEQ ID NO: 3936135 - RNA, 17 nt, Human adenovirus E
uggagcgcguggcccgc

SEQ ID NO: 3936136 - RNA, 17 nt, Human adenovirus E
uggaggagcucagccgc

SEQ ID NO: 3936137 - RNA, 17 nt, Human adenovirus E
uggaucagguuuaggac

SEQ ID NO: 3936138 - RNA, 21 nt, Human adenovirus E
uggcaauggaggacccaccgc

SEQ ID NO: 3936139 - RNA, 19 nt, Human adenovirus E
uggcaccucucgcccccgc

SEQ ID NO: 3936140 - RNA, 15 nt, Human adenovirus E
uggcacgacaggcag

SEQ ID NO: 3936141 - RNA, 16 nt, Human adenovirus E
uggcacgacaggcagc

SEQ ID NO: 3936142 - RNA, 16 nt, Human adenovirus E
uggcagacgggcaugg

SEQ ID NO: 3936143 - RNA, 15 nt, Human adenovirus E
uggcagcccagccgc

SEQ ID NO: 3936144 - RNA, 19 nt, Human adenovirus E
uggcauuguuuuuugcaau

SEQ ID NO: 3936145 - RNA, 20 nt, Human adenovirus E
uggcauuuuugaugugggcc

SEQ ID NO: 3936146 - RNA, 15 nt, Human adenovirus E
uggccaacuaccugg

SEQ ID NO: 3936147 - RNA, 23 nt, Human adenovirus E
uggccaccucgccgcgcaggggc

SEQ ID NO: 3936148 - RNA, 15 nt, Human adenovirus E
uggccagcugcacca

SEQ ID NO: 3936149 - RNA, 21 nt, Human adenovirus E
uggccaucgugaacgcgcugg

SEQ ID NO: 3936150 - RNA, 20 nt, Human adenovirus E
uggccugcaacccccagcug

SEQ ID NO: 3936151 - RNA, 18 nt, Human adenovirus E
uggcgauggagcgcaugg

SEQ ID NO: 3936152 - RNA, 15 nt, Human adenovirus E
uggcgcgugaagacc

SEQ ID NO: 3936153 - RNA, 12 nt, Human adenovirus E
uggcuggcagag

SEQ ID NO: 3936154 - RNA, 20 nt, Human adenovirus E
ugggcacgcacccgggcuug

SEQ ID NO: 3936155 - RNA, 13 nt, Human adenovirus E
ugggcaugagccc

SEQ ID NO: 3936156 - RNA, 21 nt, Human adenovirus E
ugggcauucgcaagaggcagc

SEQ ID NO: 3936157 - RNA, 15 nt, Human adenovirus E
ugggcccuucgccuc

SEQ ID NO: 3936158 - RNA, 16 nt, Human adenovirus E
ugggccgguccucgag

SEQ ID NO: 3936159 - RNA, 14 nt, Human adenovirus E
ugggccugaugcac

SEQ ID NO: 3936160 - RNA, 16 nt, Human adenovirus E
ugggcguguggcagca

SEQ ID NO: 3936161 - RNA, 21 nt, Human adenovirus E
uggggcgcccucaaaggccgc

SEQ ID NO: 3936162 - RNA, 21 nt, Human adenovirus E
uggggcgugcaggccccgguc

SEQ ID NO: 3936163 - RNA, 15 nt, Human adenovirus E
ugggguagcagcgcc

SEQ ID NO: 3936164 - RNA, 15 nt, Human adenovirus E
ugguaguugagggag

SEQ ID NO: 3936165 - RNA, 13 nt, Human adenovirus E
uggugcaggagcg

SEQ ID NO: 3936166 - RNA, 15 nt, Human adenovirus E
ugguggccaccucgc

SEQ ID NO: 3936167 - RNA, 21 nt, Human adenovirus E
ugguggucaugcugacgagcc

SEQ ID NO: 3936168 - RNA, 23 nt, Human adenovirus E
ugguggucccgugcaggcaccgc

SEQ ID NO: 3936169 - RNA, 17 nt, Human adenovirus E
ugguucaccugcagcag

SEQ ID NO: 3936170 - RNA, 13 nt, Human adenovirus E
uguacagcaacaa

SEQ ID NO: 3936171 - RNA, 14 nt, Human adenovirus E
uguaucccacccug

SEQ ID NO: 3936172 - RNA, 14 nt, Human adenovirus E
ugucaaccacugcg

SEQ ID NO: 3936173 - RNA, 13 nt, Human adenovirus E
ugucaugaugcag

SEQ ID NO: 3936174 - RNA, 22 nt, Human adenovirus E
uguccacccgcucucugcucaa

SEQ ID NO: 3936175 - RNA, 18 nt, Human adenovirus E
uguccagcuggcgggcgg

SEQ ID NO: 3936176 - RNA, 15 nt, Human adenovirus E
uguggaccucggccu

SEQ ID NO: 3936177 - RNA, 15 nt, Human adenovirus E
ugugggacgaugagg

SEQ ID NO: 3936178 - RNA, 20 nt, Human adenovirus E
uguuccacgguggcuuccag

SEQ ID NO: 3936179 - RNA, 18 nt, Human adenovirus E
uuacaaguuucuccacca

SEQ ID NO: 3936180 - RNA, 17 nt, Human adenovirus E
uuaccacuaugcagcuc

SEQ ID NO: 3936181 - RNA, 13 nt, Human adenovirus E
uuaccgagcagca

SEQ ID NO: 3936182 - RNA, 13 nt, Human adenovirus E
uuauuguugcugu

SEQ ID NO: 3936183 - RNA, 21 nt, Human adenovirus E
uucacccccacggaggccagc

SEQ ID NO: 3936184 - RNA, 19 nt, Human adenovirus E
uucagggaggcgcugcuga

SEQ ID NO: 3936185 - RNA, 19 nt, Human adenovirus E
uuccacgguggcuuccagc

SEQ ID NO: 3936186 - RNA, 13 nt, Human adenovirus E
uuccucaaaugcu

SEQ ID NO: 3936187 - RNA, 18 nt, Human adenovirus E
uuccucgggaaaacucau

SEQ ID NO: 3936188 - RNA, 12 nt, Human adenovirus E
uucgaccccguc

SEQ ID NO: 3936189 - RNA, 23 nt, Human adenovirus E
uucgccuccuacgugcucuuugc

SEQ ID NO: 3936190 - RNA, 13 nt, Human adenovirus E
uucuccggcuccc

SEQ ID NO: 3936191 - RNA, 13 nt, Human adenovirus E
uucugcuguuagu

SEQ ID NO: 3936192 - RNA, 21 nt, Human adenovirus E
uucuggccugcacccucaucu

SEQ ID NO: 3936193 - RNA, 15 nt, Human adenovirus E
uucuuccuccuccac

SEQ ID NO: 3936194 - RNA, 13 nt, Human adenovirus E
uugcuugcugcua

SEQ ID NO: 3936195 - RNA, 20 nt, Human adenovirus E
uugucaaugccaccucagcu

SEQ ID NO: 3936196 - RNA, 16 nt, Human adenovirus E
uuuaaugaaucagaug

SEQ ID NO: 3936197 - RNA, 21 nt, Human adenovirus E
uuuccuccacccucccaggac

SEQ ID NO: 3936198 - RNA, 23 nt, Human adenovirus E
uuucgcggguugggacggcugcg

SEQ ID NO: 3936199 - RNA, 19 nt, Human adenovirus E
uuucuagaaacgaggagga

SEQ ID NO: 3936200 - RNA, 11 nt, Human adenovirus E
ggaccacugcc

SEQ ID NO: 3936201 - RNA, 18 nt, Human adenovirus E
ggacccggacgugcagcc

SEQ ID NO: 3936202 - RNA, 19 nt, Human adenovirus E
ggacccgguagaggugggc

SEQ ID NO: 3936203 - RNA, 23 nt, Human adenovirus E
ggacccuacguagaagaggugga

SEQ ID NO: 3936204 - RNA, 21 nt, Human adenovirus E
ggaccgaaagagggugcugag

SEQ ID NO: 3936205 - RNA, 13 nt, Human adenovirus E
ggaccgaggggga

SEQ ID NO: 3936206 - RNA, 19 nt, Human adenovirus E
ggaccuggccaaccaggcc

SEQ ID NO: 3936207 - RNA, 13 nt, Human adenovirus E
ggacgaggagggc

SEQ ID NO: 3936208 - RNA, 21 nt, Human adenovirus E
ggacggcugcgggaguauggc

SEQ ID NO: 3936209 - RNA, 13 nt, Human adenovirus E
ggacguccagagc

SEQ ID NO: 3936210 - RNA, 13 nt, Human adenovirus E
ggacuugccgcag

SEQ ID NO: 3936211 - RNA, 13 nt, Human adenovirus E
ggagacgcgcggc

SEQ ID NO: 3936212 - RNA, 19 nt, Human adenovirus E
ggagccuuguugcgcaggg

SEQ ID NO: 3936213 - RNA, 17 nt, Human adenovirus E
ggagcggcgaggagccc

SEQ ID NO: 3936214 - RNA, 14 nt, Human adenovirus E
ggagcuccuggagc

SEQ ID NO: 3936215 - RNA, 18 nt, Human adenovirus E
ggagcugaccaaccuggu

SEQ ID NO: 3936216 - RNA, 14 nt, Human adenovirus E
ggagcuguccaggg

SEQ ID NO: 3936217 - RNA, 14 nt, Human adenovirus E
ggaggaagacuggg

SEQ ID NO: 3936218 - RNA, 14 nt, Human adenovirus E
ggaggaugcagcag

SEQ ID NO: 3936219 - RNA, 17 nt, Human adenovirus E
ggaggaugcagcagcug

SEQ ID NO: 3936220 - RNA, 18 nt, Human adenovirus E
ggaggauguccaagcgca

SEQ ID NO: 3936221 - RNA, 18 nt, Human adenovirus E
ggaggauuuggaggaaga

SEQ ID NO: 3936222 - RNA, 12 nt, Human adenovirus E
ggaggcagagga

SEQ ID NO: 3936223 - RNA, 15 nt, Human adenovirus E
ggaggccagcaccca

SEQ ID NO: 3936224 - RNA, 14 nt, Human adenovirus E
ggaggggcggaaca

SEQ ID NO: 3936225 - RNA, 20 nt, Human adenovirus E
ggaguacuucaaaaugaaga

SEQ ID NO: 3936226 - RNA, 14 nt, Human adenovirus E
ggagugaugaagau

SEQ ID NO: 3936227 - RNA, 13 nt, Human adenovirus E
ggaguuccuccac

SEQ ID NO: 3936228 - RNA, 21 nt, Human adenovirus E
ggaucgcuguccacgagcgcc

SEQ ID NO: 3936229 - RNA, 12 nt, Human adenovirus E
ggaucuggaggg

SEQ ID NO: 3936230 - RNA, 16 nt, Human adenovirus E
ggauggcuggcagagc

SEQ ID NO: 3936231 - RNA, 23 nt, Human adenovirus E
ggauuccgcggcuaacgagggcg

SEQ ID NO: 3936232 - RNA, 18 nt, Human adenovirus E
ggcaccucucgcccccgc

SEQ ID NO: 3936233 - RNA, 14 nt, Human adenovirus E
ggcaccugcgagcc

SEQ ID NO: 3936234 - RNA, 13 nt, Human adenovirus E
ggcaccuggagcg

SEQ ID NO: 3936235 - RNA, 17 nt, Human adenovirus E
ggcacgacaggcagcgg

SEQ ID NO: 3936236 - RNA, 12 nt, Human adenovirus E
ggcagaggagga

SEQ ID NO: 3936237 - RNA, 20 nt, Human adenovirus E
ggcagcagugucuggaggag

SEQ ID NO: 3936238 - RNA, 24 nt, Human adenovirus E
ggcagcagugucuggaggagcaga

SEQ ID NO: 3936239 - RNA, 12 nt, Human adenovirus E
ggcagcgccgcc

SEQ ID NO: 3936240 - RNA, 14 nt, Human adenovirus E
ggcagcggggacag

SEQ ID NO: 3936241 - RNA, 19 nt, Human adenovirus E
ggcagguccagaccucggc

SEQ ID NO: 3936242 - RNA, 16 nt, Human adenovirus E
ggcaucuugcacgaga

SEQ ID NO: 3936243 - RNA, 18 nt, Human adenovirus E
ggccaaagucuaaaaaua

SEQ ID NO: 3936244 - RNA, 16 nt, Human adenovirus E
ggccaacgccagucca

SEQ ID NO: 3936245 - RNA, 15 nt, Human adenovirus E
ggccaacuaccuggc

SEQ ID NO: 3936246 - RNA, 19 nt, Human adenovirus E
ggccacccccagcgccgcg

SEQ ID NO: 3936247 - RNA, 13 nt, Human adenovirus E
ggccaccucgccg

SEQ ID NO: 3936248 - RNA, 18 nt, Human adenovirus E
ggccagcacccagaccau

SEQ ID NO: 3936249 - RNA, 22 nt, Human adenovirus E
ggccagcugcaccacgcugcgc

SEQ ID NO: 3936250 - RNA, 20 nt, Human adenovirus E
ggccaggcgcacguggacga

SEQ ID NO: 3936251 - RNA, 16 nt, Human adenovirus E
ggccauccuggaggcc

SEQ ID NO: 3936252 - RNA, 16 nt, Human adenovirus E
ggcccugcggugguga

SEQ ID NO: 3936253 - RNA, 17 nt, Human adenovirus E
ggccgaaguccagcuga

SEQ ID NO: 3936254 - RNA, 15 nt, Human adenovirus E
ggccgaucccugcuu

SEQ ID NO: 3936255 - RNA, 22 nt, Human adenovirus E
ggccgcgaacgcucugcaagga

SEQ ID NO: 3936256 - RNA, 17 nt, Human adenovirus E
ggccgcgagggugcugc

SEQ ID NO: 3936257 - RNA, 14 nt, Human adenovirus E
ggccgcggccaacc

SEQ ID NO: 3936258 - RNA, 14 nt, Human adenovirus E
ggccggccggauuc

SEQ ID NO: 3936259 - RNA, 19 nt, Human adenovirus E
ggccgucuacucgcagcag

SEQ ID NO: 3936260 - RNA, 14 nt, Human adenovirus E
ggccguggcccagc

SEQ ID NO: 3936261 - RNA, 20 nt, Human adenovirus E
ggccuaguugcgggugggcu

SEQ ID NO: 3936262 - RNA, 20 nt, Human adenovirus E
ggccucgacucccaccugcu

SEQ ID NO: 3936263 - RNA, 16 nt, Human adenovirus E
ggccugcaacccccag

SEQ ID NO: 3936264 - RNA, 11 nt, Human adenovirus E
ggccugcaaga

SEQ ID NO: 3936265 - RNA, 16 nt, Human adenovirus E
ggcgacgagcucggcg

SEQ ID NO: 3936266 - RNA, 16 nt, Human adenovirus E
ggcgacgaggccggcc

SEQ ID NO: 3936267 - RNA, 19 nt, Human adenovirus E
ggcgacgaggccggccugg

SEQ ID NO: 3936268 - RNA, 17 nt, Human adenovirus E
ggcgacgggcucucgcc

SEQ ID NO: 3936269 - RNA, 15 nt, Human adenovirus E
ggcgacuaccuccac

SEQ ID NO: 3936270 - RNA, 19 nt, Human adenovirus E
ggcgagaucgagggcgagc

SEQ ID NO: 3936271 - RNA, 20 nt, Human adenovirus E
ggcgagcgcuccggcaccgc

SEQ ID NO: 3936272 - RNA, 13 nt, Human adenovirus E
ggcgagcucgacg

SEQ ID NO: 3936273 - RNA, 18 nt, Human adenovirus E
ggcgaggggcuggcgcgc

SEQ ID NO: 3936274 - RNA, 22 nt, Human adenovirus E
ggcgaggggcuggcgcgccugg

SEQ ID NO: 3936275 - RNA, 15 nt, Human adenovirus E
ggcgagggggagcgc

SEQ ID NO: 3936276 - RNA, 14 nt, Human adenovirus E
ggcgagguugagcu

SEQ ID NO: 3936277 - RNA, 14 nt, Human adenovirus E
ggcgaguaccugga

SEQ ID NO: 3936278 - RNA, 15 nt, Human adenovirus E
ggcgaugcagccccc

SEQ ID NO: 3936279 - RNA, 17 nt, Human adenovirus E
ggcgauguugagcugca

SEQ ID NO: 3936280 - RNA, 19 nt, Human adenovirus E
ggcgauguugagcugcacg

SEQ ID NO: 3936281 - RNA, 22 nt, Human adenovirus E
ggcgcacguggacgagcagacc

SEQ ID NO: 3936282 - RNA, 14 nt, Human adenovirus E
ggcgcagggcaugg

SEQ ID NO: 3936283 - RNA, 20 nt, Human adenovirus E
ggcgcagggcaugguguugc

SEQ ID NO: 3936284 - RNA, 23 nt, Human adenovirus E
ggcgcccugcgcgucggccaggu

SEQ ID NO: 3936285 - RNA, 16 nt, Human adenovirus E
ggcgcgagcugagcga

SEQ ID NO: 3936286 - RNA, 16 nt, Human adenovirus E
ggcgcggaggaaggaa

SEQ ID NO: 3936287 - RNA, 14 nt, Human adenovirus E
ggcgcggccuggac

SEQ ID NO: 3936288 - RNA, 19 nt, Human adenovirus E
ggcgcucuccccccaggga

SEQ ID NO: 3936289 - RNA, 19 nt, Human adenovirus E
ggcggauggcuggcagagc

SEQ ID NO: 3936290 - RNA, 17 nt, Human adenovirus E
ggcggcgcacgggcaga

SEQ ID NO: 3936291 - RNA, 18 nt, Human adenovirus E
ggcggcgcugcagagcca

SEQ ID NO: 3936292 - RNA, 21 nt, Human adenovirus E
ggcggcgcugcagagccagcc

SEQ ID NO: 3936293 - RNA, 13 nt, Human adenovirus E
ggcggcggcagcg

SEQ ID NO: 3936294 - RNA, 12 nt, Human adenovirus E
ggcggcggccug

SEQ ID NO: 3936295 - RNA, 11 nt, Human adenovirus E
ggcggcggcgc

SEQ ID NO: 3936296 - RNA, 13 nt, Human adenovirus E
ggcggcggcgcgc

SEQ ID NO: 3936297 - RNA, 13 nt, Human adenovirus E
ggcggcuggggcg

SEQ ID NO: 3936298 - RNA, 14 nt, Human adenovirus E
ggcggcuggggcga

SEQ ID NO: 3936299 - RNA, 16 nt, Human adenovirus E
ggcgggcgcagcagcg

SEQ ID NO: 3936300 - RNA, 13 nt, Human adenovirus E
ggcggugcaggcc

SEQ ID NO: 3936301 - RNA, 18 nt, Human adenovirus E
ggcggugcccgaggccgc

SEQ ID NO: 3936302 - RNA, 21 nt, Human adenovirus E
ggcguccgcgccgcagugggc

SEQ ID NO: 3936303 - RNA, 16 nt, Human adenovirus E
ggcgucgucgccggag

SEQ ID NO: 3936304 - RNA, 20 nt, Human adenovirus E
ggcgugccccagggcauggg

SEQ ID NO: 3936305 - RNA, 15 nt, Human adenovirus E
ggcguguggcagcag

SEQ ID NO: 3936306 - RNA, 19 nt, Human adenovirus E
ggcuccuagucgaagaccc

SEQ ID NO: 3936307 - RNA, 22 nt, Human adenovirus E
ggcucgacuccguggccuggag

SEQ ID NO: 3936308 - RNA, 14 nt, Human adenovirus E
ggcuggucgggguc

SEQ ID NO: 3936309 - RNA, 19 nt, Human adenovirus E
ggcuucaggcgccagcgcc

SEQ ID NO: 3936310 - RNA, 15 nt, Human adenovirus E
ggcuucccccaggau

SEQ ID NO: 3936311 - RNA, 23 nt, Human adenovirus E
ggcuucccccaggaugccccgag

SEQ ID NO: 3936312 - RNA, 19 nt, Human adenovirus E
ggcuucgacaccuggacca

SEQ ID NO: 3936313 - RNA, 12 nt, Human adenovirus E
ggcuugcagacc

SEQ ID NO: 3936314 - RNA, 13 nt, Human adenovirus E
ggcuugcagaccg

SEQ ID NO: 3936315 - RNA, 13 nt, Human adenovirus E
gggacagaggagg

SEQ ID NO: 3936316 - RNA, 22 nt, Human adenovirus E
gggcaacaucuccuucacccgg

SEQ ID NO: 3936317 - RNA, 18 nt, Human adenovirus E
gggcaauccucgcacaga

SEQ ID NO: 3936318 - RNA, 12 nt, Human adenovirus E
gggcaggcgcug

SEQ ID NO: 3936319 - RNA, 15 nt, Human adenovirus E
gggcagggagagggc

SEQ ID NO: 3936320 - RNA, 22 nt, Human adenovirus E
gggcaugaccucggcacucagg

SEQ ID NO: 3936321 - RNA, 21 nt, Human adenovirus E
gggccauguucagggcggcca

SEQ ID NO: 3936322 - RNA, 22 nt, Human adenovirus E
gggccauguucagggcggccag

SEQ ID NO: 3936323 - RNA, 18 nt, Human adenovirus E
gggcccagguuggugcga

SEQ ID NO: 3936324 - RNA, 20 nt, Human adenovirus E
gggccgcuggcuccuggacc

SEQ ID NO: 3936325 - RNA, 22 nt, Human adenovirus E
gggccugcucgagugccacugc

SEQ ID NO: 3936326 - RNA, 13 nt, Human adenovirus E
gggccuggccgcc

SEQ ID NO: 3936327 - RNA, 14 nt, Human adenovirus E
gggccuggccgccg

SEQ ID NO: 3936328 - RNA, 20 nt, Human adenovirus E
gggcgccgagcuccugcccg

SEQ ID NO: 3936329 - RNA, 13 nt, Human adenovirus E
gggcggcaggggc

SEQ ID NO: 3936330 - RNA, 20 nt, Human adenovirus E
gggcgugcagaccguggaca

SEQ ID NO: 3936331 - RNA, 14 nt, Human adenovirus E
gggcgugccccagg

SEQ ID NO: 3936332 - RNA, 17 nt, Human adenovirus E
gggcgugcgcuccugga

SEQ ID NO: 3936333 - RNA, 18 nt, Human adenovirus E
gggcuaccgaggaagaaa

SEQ ID NO: 3936334 - RNA, 18 nt, Human adenovirus E
gggcugcuagucagcggc

SEQ ID NO: 3936335 - RNA, 21 nt, Human adenovirus E
ggggccacgagccggggcagc

SEQ ID NO: 3936336 - RNA, 12 nt, Human adenovirus E
ggggccaggagg

SEQ ID NO: 3936337 - RNA, 17 nt, Human adenovirus E
ggggcccggaugcaggg

SEQ ID NO: 3936338 - RNA, 23 nt, Human adenovirus E
ggggccgggaccgagggggagag

SEQ ID NO: 3936339 - RNA, 12 nt, Human adenovirus E
ggggcgggggag

SEQ ID NO: 3936340 - RNA, 20 nt, Human adenovirus E
gggggccacgagccggggca

SEQ ID NO: 3936341 - RNA, 16 nt, Human adenovirus E
gggggcguaguucccc

SEQ ID NO: 3936342 - RNA, 15 nt, Human adenovirus E
ggguccaggccagca

SEQ ID NO: 3936343 - RNA, 13 nt, Human adenovirus E
gggucccggccgg

SEQ ID NO: 3936344 - RNA, 15 nt, Human adenovirus E
gggugcgcgacgccg

SEQ ID NO: 3936345 - RNA, 23 nt, Human adenovirus E
ggguggucuccgucacggugaag

SEQ ID NO: 3936346 - RNA, 17 nt, Human adenovirus E
gguaaauccaagccagc

SEQ ID NO: 3936347 - RNA, 23 nt, Human adenovirus E
gguagcuccauugcagggccucg

SEQ ID NO: 3936348 - RNA, 22 nt, Human adenovirus E
ggucagaaaagacgaucuuuuu

SEQ ID NO: 3936349 - RNA, 22 nt, Human adenovirus E
ggucagcgacgagcagcuggcc

SEQ ID NO: 3936350 - RNA, 16 nt, Human adenovirus E
gguccaggccagcacg

SEQ ID NO: 3936351 - RNA, 14 nt, Human adenovirus E
ggucccggccgggg

SEQ ID NO: 3936352 - RNA, 14 nt, Human adenovirus E
gguccgcaaaugca

SEQ ID NO: 3936353 - RNA, 13 nt, Human adenovirus E
gguccgguccuuc

SEQ ID NO: 3936354 - RNA, 18 nt, Human adenovirus E
gguccucgagcggugugc

SEQ ID NO: 3936355 - RNA, 23 nt, Human adenovirus E
ggucgagcgcgagcaaggacaga

SEQ ID NO: 3936356 - RNA, 21 nt, Human adenovirus E
ggucgaguuggaaggcgacaa

SEQ ID NO: 3936357 - RNA, 23 nt, Human adenovirus E
ggucucgcacuccacgagccagg

SEQ ID NO: 3936358 - RNA, 18 nt, Human adenovirus E
ggugaccguggagcugga

SEQ ID NO: 3936359 - RNA, 21 nt, Human adenovirus E
ggugauacgguucucgagaug

SEQ ID NO: 3936360 - RNA, 15 nt, Human adenovirus E
ggugauccuccacca

SEQ ID NO: 3936361 - RNA, 19 nt, Human adenovirus E
ccaccgcgaguccaaccug

SEQ ID NO: 3936362 - RNA, 20 nt, Human adenovirus E
ccaccgcgaguccaaccugg

SEQ ID NO: 3936363 - RNA, 20 nt, Human adenovirus E
ccacgagccggggcagcgcc

SEQ ID NO: 3936364 - RNA, 19 nt, Human adenovirus E
ccacgccuuacauguggag

SEQ ID NO: 3936365 - RNA, 17 nt, Human adenovirus E
ccacgcgcacauccaga

SEQ ID NO: 3936366 - RNA, 20 nt, Human adenovirus E
ccacgcggggcgggagcugc

SEQ ID NO: 3936367 - RNA, 23 nt, Human adenovirus E
ccacgcggggcgggagcugcggc

SEQ ID NO: 3936368 - RNA, 15 nt, Human adenovirus E
ccacggaggccagca

SEQ ID NO: 3936369 - RNA, 17 nt, Human adenovirus E
ccacggaggccagcacc

SEQ ID NO: 3936370 - RNA, 13 nt, Human adenovirus E
ccacggccagggc

SEQ ID NO: 3936371 - RNA, 19 nt, Human adenovirus E
ccacggcccucagcaucag

SEQ ID NO: 3936372 - RNA, 22 nt, Human adenovirus E
ccacguacaugaucuccuuggg

SEQ ID NO: 3936373 - RNA, 15 nt, Human adenovirus E
ccacuacagcagcag

SEQ ID NO: 3936374 - RNA, 15 nt, Human adenovirus E
ccacuacuaucucuu

SEQ ID NO: 3936375 - RNA, 14 nt, Human adenovirus E
ccacucucucagac

SEQ ID NO: 3936376 - RNA, 14 nt, Human adenovirus E
ccacuggcucccgc

SEQ ID NO: 3936377 - RNA, 14 nt, Human adenovirus E
ccagaacgaccaca

SEQ ID NO: 3936378 - RNA, 18 nt, Human adenovirus E
ccagaacgaccacagcaa

SEQ ID NO: 3936379 - RNA, 16 nt, Human adenovirus E
ccagacgcgcggcuuc

SEQ ID NO: 3936380 - RNA, 21 nt, Human adenovirus E
ccagauccucagguaaaucaa

SEQ ID NO: 3936381 - RNA, 20 nt, Human adenovirus E
ccagcaaagccuccacgcgc

SEQ ID NO: 3936382 - RNA, 20 nt, Human adenovirus E
ccagcaccauggaggugcag

SEQ ID NO: 3936383 - RNA, 15 nt, Human adenovirus E
ccagcacccagacca

SEQ ID NO: 3936384 - RNA, 19 nt, Human adenovirus E
ccagcagaaaaccagcagc

SEQ ID NO: 3936385 - RNA, 17 nt, Human adenovirus E
ccagccccgccaccucc

SEQ ID NO: 3936386 - RNA, 20 nt, Human adenovirus E
ccagcgaaggguaugcuuuc

SEQ ID NO: 3936387 - RNA, 17 nt, Human adenovirus E
ccagcgccggcaggacc

SEQ ID NO: 3936388 - RNA, 19 nt, Human adenovirus E
ccagcggcgaggaggaugu

SEQ ID NO: 3936389 - RNA, 18 nt, Human adenovirus E
ccagcugaaaaccaucau

SEQ ID NO: 3936390 - RNA, 13 nt, Human adenovirus E
ccagcuggccuug

SEQ ID NO: 3936391 - RNA, 17 nt, Human adenovirus E
ccaggacuacuccaccc

SEQ ID NO: 3936392 - RNA, 19 nt, Human adenovirus E
ccaggccgaaguccagcug

SEQ ID NO: 3936393 - RNA, 17 nt, Human adenovirus E
ccaggcggucccagagc

SEQ ID NO: 3936394 - RNA, 12 nt, Human adenovirus E
ccagggcauggg

SEQ ID NO: 3936395 - RNA, 12 nt, Human adenovirus E
ccaggugguggc

SEQ ID NO: 3936396 - RNA, 15 nt, Human adenovirus E
ccauacuccaccucc

SEQ ID NO: 3936397 - RNA, 17 nt, Human adenovirus E
ccauagcuuaccgagca

SEQ ID NO: 3936398 - RNA, 22 nt, Human adenovirus E
ccauaguucaacacgcuccagc

SEQ ID NO: 3936399 - RNA, 21 nt, Human adenovirus E
ccaucgugcagaaccccacca

SEQ ID NO: 3936400 - RNA, 15 nt, Human adenovirus E
ccaucuccgcuccgg

SEQ ID NO: 3936401 - RNA, 14 nt, Human adenovirus E
ccauggaggugcag

SEQ ID NO: 3936402 - RNA, 19 nt, Human adenovirus E
ccaugguggcgcagcugac

SEQ ID NO: 3936403 - RNA, 20 nt, Human adenovirus E
ccaugguggcgcagcugacc

SEQ ID NO: 3936404 - RNA, 20 nt, Human adenovirus E
ccauggugggcacgcacccg

SEQ ID NO: 3936405 - RNA, 20 nt, Human adenovirus E
ccauguuuucugccaacacc

SEQ ID NO: 3936406 - RNA, 16 nt, Human adenovirus E
cccaacuacgcgcugc

SEQ ID NO: 3936407 - RNA, 16 nt, Human adenovirus E
cccaauggcaccugcg

SEQ ID NO: 3936408 - RNA, 15 nt, Human adenovirus E
cccaauugcaagcca

SEQ ID NO: 3936409 - RNA, 16 nt, Human adenovirus E
cccacauuacacagac

SEQ ID NO: 3936410 - RNA, 13 nt, Human adenovirus E
cccacgcuacguc

SEQ ID NO: 3936411 - RNA, 13 nt, Human adenovirus E
cccacggccgcca

SEQ ID NO: 3936412 - RNA, 20 nt, Human adenovirus E
cccagaccggugaggagcuc

SEQ ID NO: 3936413 - RNA, 17 nt, Human adenovirus E
cccagaucaucggcacc

SEQ ID NO: 3936414 - RNA, 22 nt, Human adenovirus E
cccagcaagauguacggaggcg

SEQ ID NO: 3936415 - RNA, 16 nt, Human adenovirus E
cccagccccgccaccu

SEQ ID NO: 3936416 - RNA, 18 nt, Human adenovirus E
cccagccccgccaccucc

SEQ ID NO: 3936417 - RNA, 12 nt, Human adenovirus E
cccaggacaugg

SEQ ID NO: 3936418 - RNA, 21 nt, Human adenovirus E
cccagguuggugcgacugggc

SEQ ID NO: 3936419 - RNA, 16 nt, Human adenovirus E
cccaucaucgccgcgg

SEQ ID NO: 3936420 - RNA, 21 nt, Human adenovirus E
  misc_feature (6)..(6): n is a, c, g or u
cccaunuagcagucccacugc

SEQ ID NO: 3936421 - RNA, 18 nt, Human adenovirus E
ccccacggaggccagcac

SEQ ID NO: 3936422 - RNA, 13 nt, Human adenovirus E
ccccauagccagc

SEQ ID NO: 3936423 - RNA, 18 nt, Human adenovirus E
  misc_feature (7)..(7): n is a, c, g or u
ccccaunuagcaguccca

SEQ ID NO: 3936424 - RNA, 18 nt, Human adenovirus E
ccccgcagcagucgcugc

SEQ ID NO: 3936425 - RNA, 18 nt, Human adenovirus E
ccccggcggcgcgugcag

SEQ ID NO: 3936426 - RNA, 20 nt, Human adenovirus E
  misc_feature (9)..(9): n is a, c, g or u
ccccgggcnugggcgugcag

SEQ ID NO: 3936427 - RNA, 16 nt, Human adenovirus E
ccccggggccaggagg

SEQ ID NO: 3936428 - RNA, 12 nt, Human adenovirus E
ccccgugccagc

SEQ ID NO: 3936429 - RNA, 14 nt, Human adenovirus E
ccccucagcgugga

SEQ ID NO: 3936430 - RNA, 19 nt, Human adenovirus E
ccccucagcguggaggagc

SEQ ID NO: 3936431 - RNA, 13 nt, Human adenovirus E
ccccuccacagcc

SEQ ID NO: 3936432 - RNA, 15 nt, Human adenovirus E
ccccuucacggacag

SEQ ID NO: 3936433 - RNA, 16 nt, Human adenovirus E
cccgaggcccuggcca

SEQ ID NO: 3936434 - RNA, 23 nt, Human adenovirus E
cccgauuaugcagggugaugagg

SEQ ID NO: 3936435 - RNA, 22 nt, Human adenovirus E
cccgcagaagcaagcuccagcu

SEQ ID NO: 3936436 - RNA, 22 nt, Human adenovirus E
cccgccucguuccagacgcggc

SEQ ID NO: 3936437 - RNA, 20 nt, Human adenovirus E
cccgcgaugcgggcggcgcu

SEQ ID NO: 3936438 - RNA, 18 nt, Human adenovirus E
cccgcgccgacgcccuuu

SEQ ID NO: 3936439 - RNA, 12 nt, Human adenovirus E
cccgcgcggggc

SEQ ID NO: 3936440 - RNA, 17 nt, Human adenovirus E
cccgcguucugcgcgcg

SEQ ID NO: 3936441 - RNA, 23 nt, Human adenovirus E
cccgcuguguugguggaaaauaa

SEQ ID NO: 3936442 - RNA, 21 nt, Human adenovirus E
cccggucccccacccaguccc

SEQ ID NO: 3936443 - RNA, 19 nt, Human adenovirus E
cccggugcugacggcuccc

SEQ ID NO: 3936444 - RNA, 16 nt, Human adenovirus E
cagccccaggccaacc

SEQ ID NO: 3936445 - RNA, 17 nt, Human adenovirus E
cagcccccgcuggaggc

SEQ ID NO: 3936446 - RNA, 16 nt, Human adenovirus E
cagcccccuccacagc

SEQ ID NO: 3936447 - RNA, 19 nt, Human adenovirus E
cagccccgauuaugcaggg

SEQ ID NO: 3936448 - RNA, 14 nt, Human adenovirus E
cagcccuuccagga

SEQ ID NO: 3936449 - RNA, 16 nt, Human adenovirus E
cagccgaaacucaucg

SEQ ID NO: 3936450 - RNA, 13 nt, Human adenovirus E
cagccugcaagac

SEQ ID NO: 3936451 - RNA, 21 nt, Human adenovirus E
cagccugcaagacagucugga

SEQ ID NO: 3936452 - RNA, 16 nt, Human adenovirus E
cagccugcugaugccc

SEQ ID NO: 3936453 - RNA, 20 nt, Human adenovirus E
cagcgaguggcgcggcugcu

SEQ ID NO: 3936454 - RNA, 14 nt, Human adenovirus E
cagcgccccgcauc

SEQ ID NO: 3936455 - RNA, 19 nt, Human adenovirus E
cagcgcgcacccggugcac

SEQ ID NO: 3936456 - RNA, 15 nt, Human adenovirus E
cagcgcgcgcugccc

SEQ ID NO: 3936457 - RNA, 21 nt, Human adenovirus E
cagcggcggagcggcaucucg

SEQ ID NO: 3936458 - RNA, 14 nt, Human adenovirus E
cagcggcggcagca

SEQ ID NO: 3936459 - RNA, 15 nt, Human adenovirus E
cagcgggcccugacc

SEQ ID NO: 3936460 - RNA, 20 nt, Human adenovirus E
cagcgguguccggggcugcu

SEQ ID NO: 3936461 - RNA, 15 nt, Human adenovirus E
cagcguggaggagcu

SEQ ID NO: 3936462 - RNA, 23 nt, Human adenovirus E
cagcugaggauuguccucggugg

SEQ ID NO: 3936463 - RNA, 14 nt, Human adenovirus E
cagcugauggugcc

SEQ ID NO: 3936464 - RNA, 15 nt, Human adenovirus E
cagcugcaccacgcu

SEQ ID NO: 3936465 - RNA, 15 nt, Human adenovirus E
cagcuggcgggcggc

SEQ ID NO: 3936466 - RNA, 21 nt, Human adenovirus E
cagcugggacuugccgcagcc

SEQ ID NO: 3936467 - RNA, 23 nt, Human adenovirus E
cagcuguuccugguggugcagca

SEQ ID NO: 3936468 - RNA, 20 nt, Human adenovirus E
cagcuuggcgacgagcucgg

SEQ ID NO: 3936469 - RNA, 16 nt, Human adenovirus E
caggaaauuccccagc

SEQ ID NO: 3936470 - RNA, 20 nt, Human adenovirus E
caggaaggugauuggcuugu

SEQ ID NO: 3936471 - RNA, 20 nt, Human adenovirus E
caggacagcgaaccccgcag

SEQ ID NO: 3936472 - RNA, 22 nt, Human adenovirus E
caggacauggaauacaccaccc

SEQ ID NO: 3936473 - RNA, 22 nt, Human adenovirus E
caggacccggagacgcgcggcc

SEQ ID NO: 3936474 - RNA, 22 nt, Human adenovirus E
caggacccuacguagaagaggu

SEQ ID NO: 3936475 - RNA, 20 nt, Human adenovirus E
caggacgacccgggcaaccu

SEQ ID NO: 3936476 - RNA, 22 nt, Human adenovirus E
caggagaugcaauugaaagcaa

SEQ ID NO: 3936477 - RNA, 21 nt, Human adenovirus E
caggaggcgcucuccccccag

SEQ ID NO: 3936478 - RNA, 16 nt, Human adenovirus E
caggagggggccaccc

SEQ ID NO: 3936479 - RNA, 13 nt, Human adenovirus E
caggaggucgggg

SEQ ID NO: 3936480 - RNA, 13 nt, Human adenovirus E
caggaugagcuga

SEQ ID NO: 3936481 - RNA, 21 nt, Human adenovirus E
caggaugcaccgugcggugag

SEQ ID NO: 3936482 - RNA, 22 nt, Human adenovirus E
caggccgagacgaugggcaggc

SEQ ID NO: 3936483 - RNA, 23 nt, Human adenovirus E
caggccgucuacucgcagcagcu

SEQ ID NO: 3936484 - RNA, 16 nt, Human adenovirus E
caggcgccagcgccgg

SEQ ID NO: 3936485 - RNA, 17 nt, Human adenovirus E
caggcgccagcgccggc

SEQ ID NO: 3936486 - RNA, 16 nt, Human adenovirus E
caggcgggacagagga

SEQ ID NO: 3936487 - RNA, 18 nt, Human adenovirus E
caggcggucccagagcuc

SEQ ID NO: 3936488 - RNA, 14 nt, Human adenovirus E
cagggacucccuca

SEQ ID NO: 3936489 - RNA, 22 nt, Human adenovirus E
cagggccagcaccgccccgccc

SEQ ID NO: 3936490 - RNA, 16 nt, Human adenovirus E
cagggccaggcgcacg

SEQ ID NO: 3936491 - RNA, 12 nt, Human adenovirus E
cagggcccggcc

SEQ ID NO: 3936492 - RNA, 13 nt, Human adenovirus E
cagggccuguggg

SEQ ID NO: 3936493 - RNA, 21 nt, Human adenovirus E
cagggccuguggggcgugcag

SEQ ID NO: 3936494 - RNA, 14 nt, Human adenovirus E
caggggcggcaggg

SEQ ID NO: 3936495 - RNA, 17 nt, Human adenovirus E
cagggggaucagcauca

SEQ ID NO: 3936496 - RNA, 22 nt, Human adenovirus E
caggguaucgcaaucaggcagc

SEQ ID NO: 3936497 - RNA, 15 nt, Human adenovirus E
cagguguccagcugg

SEQ ID NO: 3936498 - RNA, 18 nt, Human adenovirus E
cagucucaaguccagcaa

SEQ ID NO: 3936499 - RNA, 14 nt, Human adenovirus E
cagucucuggagcg

SEQ ID NO: 3936500 - RNA, 23 nt, Human adenovirus E
cagugcgcuuuucacaagaagag

SEQ ID NO: 3936501 - RNA, 19 nt, Human adenovirus E
caguggcagcggccgaggc

SEQ ID NO: 3936502 - RNA, 20 nt, Human adenovirus E
cauacgugcccaagcagaac

SEQ ID NO: 3936503 - RNA, 14 nt, Human adenovirus E
cauaggaccaccag

SEQ ID NO: 3936504 - RNA, 20 nt, Human adenovirus E
caucaagcagguggccccgg

SEQ ID NO: 3936505 - RNA, 19 nt, Human adenovirus E
caucaauuuuucgucccug

SEQ ID NO: 3936506 - RNA, 12 nt, Human adenovirus E
caucacaccuuc

SEQ ID NO: 3936507 - RNA, 20 nt, Human adenovirus E
caucaggccccgcagcaguc

SEQ ID NO: 3936508 - RNA, 14 nt, Human adenovirus E
caucaucugggccu

SEQ ID NO: 3936509 - RNA, 18 nt, Human adenovirus E
caucaucugggccugguc

SEQ ID NO: 3936510 - RNA, 19 nt, Human adenovirus E
caucaugguggucaggguc

SEQ ID NO: 3936511 - RNA, 17 nt, Human adenovirus E
cauccccgcgcuccugg

SEQ ID NO: 3936512 - RNA, 18 nt, Human adenovirus E
caucccguacugcggcag

SEQ ID NO: 3936513 - RNA, 15 nt, Human adenovirus E
cauccgcgcccaccg

SEQ ID NO: 3936514 - RNA, 21 nt, Human adenovirus E
cauccgcggcgacgaggccgg

SEQ ID NO: 3936515 - RNA, 17 nt, Human adenovirus E
cauccucgaacgcuccg

SEQ ID NO: 3936516 - RNA, 19 nt, Human adenovirus E
cauccugcguuacgugcag

SEQ ID NO: 3936517 - RNA, 18 nt, Human adenovirus E
caucgacagcgugguggc

SEQ ID NO: 3936518 - RNA, 17 nt, Human adenovirus E
caucgauggugaagaug

SEQ ID NO: 3936519 - RNA, 19 nt, Human adenovirus E
caucgcuauucgccccaga

SEQ ID NO: 3936520 - RNA, 15 nt, Human adenovirus E
caucgcuuacagccu

SEQ ID NO: 3936521 - RNA, 14 nt, Human adenovirus E
caucggcaccagcc

SEQ ID NO: 3936522 - RNA, 15 nt, Human adenovirus E
caucgucaaggaugc

SEQ ID NO: 3936523 - RNA, 22 nt, Human adenovirus E
caucgucaaggaugcgcugcuc

SEQ ID NO: 3936524 - RNA, 14 nt, Human adenovirus E
caucgucuccugcu

SEQ ID NO: 3936525 - RNA, 14 nt, Human adenovirus E
caucguugaagagg

SEQ ID NO: 3936526 - RNA, 13 nt, Human adenovirus E
caucuccgaggac

SEQ ID NO: 3936527 - RNA, 19 nt, Human adenovirus E
caucucuucagcacucuca

SEQ ID NO: 3936528 - RNA, 14 nt, Human adenovirus E
caucuggcccggca

SEQ ID NO: 3936529 - RNA, 18 nt, Human adenovirus E
caugaauuggcucagcgc

SEQ ID NO: 3936530 - RNA, 20 nt, Human adenovirus E
caugaccaucgaccugauga

SEQ ID NO: 3936531 - RNA, 19 nt, Human adenovirus E
caugacggcgacuaccucc

SEQ ID NO: 3936532 - RNA, 18 nt, Human adenovirus E
caugagcucgugucuccg

SEQ ID NO: 3936533 - RNA, 16 nt, Human adenovirus E
caugauccagcggcgg

SEQ ID NO: 3936534 - RNA, 14 nt, Human adenovirus E
caugcaucccagcu

SEQ ID NO: 3936535 - RNA, 21 nt, Human adenovirus E
cauggaccaggugcucaucaa

SEQ ID NO: 3936536 - RNA, 15 nt, Human adenovirus E
cauggcgaccagcgu

SEQ ID NO: 3936537 - RNA, 13 nt, Human adenovirus E
cauggcgcugacg

SEQ ID NO: 3936538 - RNA, 23 nt, Human adenovirus E
caugguguacuaugccuucugcu

SEQ ID NO: 3936539 - RNA, 20 nt, Human adenovirus E
cauguggcgguucaccaccu

SEQ ID NO: 3936540 - RNA, 24 nt, Human adenovirus E
  misc_feature (13)..(13): n is a, c, g or u
cauguuacacucnugcaccauccc

SEQ ID NO: 3936541 - RNA, 15 nt, Human adenovirus E
cauuaccacacagac

SEQ ID NO: 3936542 - RNA, 23 nt, Human adenovirus E
cauucuacacuaaaaaaauacug

SEQ ID NO: 3936543 - RNA, 16 nt, Human adenovirus E
cauucuuaagcacacc

SEQ ID NO: 3936544 - RNA, 15 nt, Human adenovirus E
cauugucaaugccac

SEQ ID NO: 3936545 - RNA, 14 nt, Human adenovirus E
cauuuuugccaugc

SEQ ID NO: 3936546 - RNA, 17 nt, Human adenovirus E
ccaaacuaaccuccacc

SEQ ID NO: 3936547 - RNA, 13 nt, Human adenovirus E
ccaaauccaugau

SEQ ID NO: 3936548 - RNA, 18 nt, Human adenovirus E
ccaacaaaugccagcuga

SEQ ID NO: 3936549 - RNA, 22 nt, Human adenovirus E
ccaaccaggccgugcagcggca

SEQ ID NO: 3936550 - RNA, 21 nt, Human adenovirus E
  misc_feature (7)..(7): n is a, c, g or u
ccaaccnuacuuuuuccaccc

SEQ ID NO: 3936551 - RNA, 13 nt, Human adenovirus E
ccaagaaugaaca

SEQ ID NO: 3936552 - RNA, 17 nt, Human adenovirus E
ccaagaccccauagcca

SEQ ID NO: 3936553 - RNA, 14 nt, Human adenovirus E
ccaagcgccagccc

SEQ ID NO: 3936554 - RNA, 14 nt, Human adenovirus E
ccacacacacagau

SEQ ID NO: 3936555 - RNA, 13 nt, Human adenovirus E
ccacaccacagcu

SEQ ID NO: 3936556 - RNA, 16 nt, Human adenovirus E
ccacagccggcgcuuc

SEQ ID NO: 3936557 - RNA, 16 nt, Human adenovirus E
ccacagcgacccaugc

SEQ ID NO: 3936558 - RNA, 15 nt, Human adenovirus E
ccacauuacacagac

SEQ ID NO: 3936559 - RNA, 16 nt, Human adenovirus E
ccaccacccccaguac

SEQ ID NO: 3936560 - RNA, 18 nt, Human adenovirus E
ccaccaugcagcugaugg

SEQ ID NO: 3936561 - RNA, 12 nt, Human adenovirus E
ccacccagaccg

SEQ ID NO: 3936562 - RNA, 20 nt, Human adenovirus E
ccacccccagcgccgcgcuc

SEQ ID NO: 3936563 - RNA, 17 nt, Human adenovirus E
agcuuugacaguacagg

SEQ ID NO: 3936564 - RNA, 20 nt, Human adenovirus E
aggacccggagacgcgcggc

SEQ ID NO: 3936565 - RNA, 23 nt, Human adenovirus E
aggacgacccgggcaaccuggaa

SEQ ID NO: 3936566 - RNA, 23 nt, Human adenovirus E
aggacgcgcucaucaagcaucug

SEQ ID NO: 3936567 - RNA, 16 nt, Human adenovirus E
aggacguccagagcgc

SEQ ID NO: 3936568 - RNA, 23 nt, Human adenovirus E
aggacuacuccacccgcaugaau

SEQ ID NO: 3936569 - RNA, 22 nt, Human adenovirus E
aggacuccgccgacgacagcag

SEQ ID NO: 3936570 - RNA, 13 nt, Human adenovirus E
aggagaaggagga

SEQ ID NO: 3936571 - RNA, 13 nt, Human adenovirus E
aggagauggagga

SEQ ID NO: 3936572 - RNA, 12 nt, Human adenovirus E
aggagcgcgggc

SEQ ID NO: 3936573 - RNA, 14 nt, Human adenovirus E
aggagcuccuggag

SEQ ID NO: 3936574 - RNA, 17 nt, Human adenovirus E
aggagcuuggcgaugga

SEQ ID NO: 3936575 - RNA, 14 nt, Human adenovirus E
aggaggagcuggca

SEQ ID NO: 3936576 - RNA, 13 nt, Human adenovirus E
aggaggaugcagc

SEQ ID NO: 3936577 - RNA, 14 nt, Human adenovirus E
aggagggcaagccc

SEQ ID NO: 3936578 - RNA, 13 nt, Human adenovirus E
aggaucuggaggg

SEQ ID NO: 3936579 - RNA, 15 nt, Human adenovirus E
aggaugcagcagcug

SEQ ID NO: 3936580 - RNA, 13 nt, Human adenovirus E
aggcagaggagga

SEQ ID NO: 3936581 - RNA, 19 nt, Human adenovirus E
aggcagaggaggacagccu

SEQ ID NO: 3936582 - RNA, 13 nt, Human adenovirus E
aggccgaucccug

SEQ ID NO: 3936583 - RNA, 16 nt, Human adenovirus E
aggccggagcugucca

SEQ ID NO: 3936584 - RNA, 15 nt, Human adenovirus E
aggccggccuggugu

SEQ ID NO: 3936585 - RNA, 14 nt, Human adenovirus E
aggccguggcccag

SEQ ID NO: 3936586 - RNA, 16 nt, Human adenovirus E
aggccucucagcgcca

SEQ ID NO: 3936587 - RNA, 15 nt, Human adenovirus E
aggcgcugguagagg

SEQ ID NO: 3936588 - RNA, 16 nt, Human adenovirus E
aggcggcggcaggacc

SEQ ID NO: 3936589 - RNA, 18 nt, Human adenovirus E
aggcgggacagaggaggg

SEQ ID NO: 3936590 - RNA, 20 nt, Human adenovirus E
aggcguccgcgccgcagugg

SEQ ID NO: 3936591 - RNA, 18 nt, Human adenovirus E
aggcuccuuacgugcccc

SEQ ID NO: 3936592 - RNA, 19 nt, Human adenovirus E
aggcuccuuacgugccccc

SEQ ID NO: 3936593 - RNA, 15 nt, Human adenovirus E
aggcugggcucgagc

SEQ ID NO: 3936594 - RNA, 20 nt, Human adenovirus E
agggaacguguacugggugc

SEQ ID NO: 3936595 - RNA, 16 nt, Human adenovirus E
agggcaggcgcugagg

SEQ ID NO: 3936596 - RNA, 13 nt, Human adenovirus E
agggccgcuggcu

SEQ ID NO: 3936597 - RNA, 17 nt, Human adenovirus E
agggcgaaagugucccu

SEQ ID NO: 3936598 - RNA, 21 nt, Human adenovirus E
agggcgagaucgagggcgagc

SEQ ID NO: 3936599 - RNA, 16 nt, Human adenovirus E
agggcgaggggcuggc

SEQ ID NO: 3936600 - RNA, 20 nt, Human adenovirus E
agggcguuggagaggagcuu

SEQ ID NO: 3936601 - RNA, 22 nt, Human adenovirus E
agggggcgaggagccccgggcc

SEQ ID NO: 3936602 - RNA, 15 nt, Human adenovirus E
aggguauaaagcggc

SEQ ID NO: 3936603 - RNA, 21 nt, Human adenovirus E
agggucccgugccccuggggu

SEQ ID NO: 3936604 - RNA, 19 nt, Human adenovirus E
agggugccggacuggggga

SEQ ID NO: 3936605 - RNA, 15 nt, Human adenovirus E
aggucaaccaaccuc

SEQ ID NO: 3936606 - RNA, 17 nt, Human adenovirus E
aggugacccugggccug

SEQ ID NO: 3936607 - RNA, 21 nt, Human adenovirus E
aggugacccugggccugaugc

SEQ ID NO: 3936608 - RNA, 21 nt, Human adenovirus E
aggugcaaccggugcugagac

SEQ ID NO: 3936609 - RNA, 14 nt, Human adenovirus E
agguggacgaggag

SEQ ID NO: 3936610 - RNA, 16 nt, Human adenovirus E
agguguccagcuggcg

SEQ ID NO: 3936611 - RNA, 21 nt, Human adenovirus E
aguacaggagccauaauggcu

SEQ ID NO: 3936612 - RNA, 17 nt, Human adenovirus E
aguacggcgcggccagc

SEQ ID NO: 3936613 - RNA, 15 nt, Human adenovirus E
agucauagcaggggc

SEQ ID NO: 3936614 - RNA, 17 nt, Human adenovirus E
agucucaaguccagcaa

SEQ ID NO: 3936615 - RNA, 13 nt, Human adenovirus E
agucucuggagcg

SEQ ID NO: 3936616 - RNA, 19 nt, Human adenovirus E
agugcgucucgggacccug

SEQ ID NO: 3936617 - RNA, 16 nt, Human adenovirus E
agugucuggaggagca

SEQ ID NO: 3936618 - RNA, 21 nt, Human adenovirus E
aguuagcugaucuguagaaaa

SEQ ID NO: 3936619 - RNA, 18 nt, Human adenovirus E
aguuccuccacuuccucu

SEQ ID NO: 3936620 - RNA, 20 nt, Human adenovirus E
aguucguaguugagcgccuc

SEQ ID NO: 3936621 - RNA, 17 nt, Human adenovirus E
aguugcaagggcccagc

SEQ ID NO: 3936622 - RNA, 21 nt, Human adenovirus E
aguugcagggcgcccagcagg

SEQ ID NO: 3936623 - RNA, 17 nt, Human adenovirus E
aguuucuugagcuccuc

SEQ ID NO: 3936624 - RNA, 16 nt, Human adenovirus E
auaacaaaaaaaauga

SEQ ID NO: 3936625 - RNA, 21 nt, Human adenovirus E
auaacaagacucggaacaaua

SEQ ID NO: 3936626 - RNA, 17 nt, Human adenovirus E
auaacagccaggucaaa

SEQ ID NO: 3936627 - RNA, 21 nt, Human adenovirus E
auaauuuucauuuuuccagcc

SEQ ID NO: 3936628 - RNA, 15 nt, Human adenovirus E
aucacacacgcccag

SEQ ID NO: 3936629 - RNA, 20 nt, Human adenovirus E
aucacccuagugagcugcgg

SEQ ID NO: 3936630 - RNA, 13 nt, Human adenovirus E
aucaucugggccu

SEQ ID NO: 3936631 - RNA, 13 nt, Human adenovirus E
auccacagcggcg

SEQ ID NO: 3936632 - RNA, 16 nt, Human adenovirus E
auccacggccagggcg

SEQ ID NO: 3936633 - RNA, 22 nt, Human adenovirus E
aucccaacaaaugccagcugag

SEQ ID NO: 3936634 - RNA, 15 nt, Human adenovirus E
aucccagcuggauca

SEQ ID NO: 3936635 - RNA, 23 nt, Human adenovirus E
aucccgauauugucuugcugccc

SEQ ID NO: 3936636 - RNA, 22 nt, Human adenovirus E
auccugcccgccaccugcuccg

SEQ ID NO: 3936637 - RNA, 21 nt, Human adenovirus E
aucgcaaucaggcagcaccgg

SEQ ID NO: 3936638 - RNA, 12 nt, Human adenovirus E
aucgcagugcag

SEQ ID NO: 3936639 - RNA, 11 nt, Human adenovirus E
aucggccaggc

SEQ ID NO: 3936640 - RNA, 16 nt, Human adenovirus E
aucguggugcaggagc

SEQ ID NO: 3936641 - RNA, 18 nt, Human adenovirus E
aucguggugcaggagcgc

SEQ ID NO: 3936642 - RNA, 15 nt, Human adenovirus E
aucuaguaugaugag

SEQ ID NO: 3936643 - RNA, 16 nt, Human adenovirus E
aucucccgccugaacc

SEQ ID NO: 3936644 - RNA, 18 nt, Human adenovirus E
aucucgaaucaggcugga

SEQ ID NO: 3936645 - RNA, 14 nt, Human adenovirus E
aucugcaccucaca

SEQ ID NO: 3936646 - RNA, 18 nt, Human adenovirus E
augaauacacccccggaa

SEQ ID NO: 3936647 - RNA, 12 nt, Human adenovirus E
augaccugggcg

SEQ ID NO: 3936648 - RNA, 14 nt, Human adenovirus E
augagcaccacagc

SEQ ID NO: 3936649 - RNA, 23 nt, Human adenovirus E
augagguccacacugguggccac

SEQ ID NO: 3936650 - RNA, 14 nt, Human adenovirus E
augaugcccacggc

SEQ ID NO: 3936651 - RNA, 14 nt, Human adenovirus E
augauuccuagaca

SEQ ID NO: 3936652 - RNA, 13 nt, Human adenovirus E
augcaagacccgg

SEQ ID NO: 3936653 - RNA, 18 nt, Human adenovirus E
augcaagagauggaggaa

SEQ ID NO: 3936654 - RNA, 18 nt, Human adenovirus E
augcaauucugacaauga

SEQ ID NO: 3936655 - RNA, 22 nt, Human adenovirus E
augcaccugugggaccugcugg

SEQ ID NO: 3936656 - RNA, 14 nt, Human adenovirus E
augcacgugcugca

SEQ ID NO: 3936657 - RNA, 19 nt, Human adenovirus E
augcaggggcggcaggggc

SEQ ID NO: 3936658 - RNA, 18 nt, Human adenovirus E
augccaacccuucccacc

SEQ ID NO: 3936659 - RNA, 23 nt, Human adenovirus E
augcuccaggucaucgcgccuga

SEQ ID NO: 3936660 - RNA, 13 nt, Human adenovirus E
auggaggugcaga

SEQ ID NO: 3936661 - RNA, 13 nt, Human adenovirus E
auggcaccucucg

SEQ ID NO: 3936662 - RNA, 19 nt, Human adenovirus E
auggcaccucucgcccccg

SEQ ID NO: 3936663 - RNA, 18 nt, Human adenovirus E
auggcgagggggagcgcg

SEQ ID NO: 3936664 - RNA, 22 nt, Human adenovirus E
auggcggcggcggcgaugcagc

SEQ ID NO: 3936665 - RNA, 16 nt, Human adenovirus E
augguggcgcagcuga

SEQ ID NO: 3936666 - RNA, 21 nt, Human adenovirus E
augucauacuugagcuguccc

SEQ ID NO: 3936667 - RNA, 20 nt, Human adenovirus E
augucucuucgggggcagag

SEQ ID NO: 3936668 - RNA, 21 nt, Human adenovirus E
augugacgcccgcggagcacg

SEQ ID NO: 3936669 - RNA, 15 nt, Human adenovirus E
auguucagggcggcc

SEQ ID NO: 3936670 - RNA, 14 nt, Human adenovirus E
auuacacagacaac

SEQ ID NO: 3936671 - RNA, 15 nt, Human adenovirus E
auuaccucugcucua

SEQ ID NO: 3936672 - RNA, 23 nt, Human adenovirus E
auuagggcaagccacaguacaga

SEQ ID NO: 3936673 - RNA, 15 nt, Human adenovirus E
auucccacggagccc

SEQ ID NO: 3936674 - RNA, 15 nt, Human adenovirus E
auucggggaagacgu

SEQ ID NO: 3936675 - RNA, 20 nt, Human adenovirus E
auuguaaaacagccacucuc

SEQ ID NO: 3936676 - RNA, 14 nt, Human adenovirus E
caaaaccauauccc

SEQ ID NO: 3936677 - RNA, 20 nt, Human adenovirus E
caaaaccauaucccagggca

SEQ ID NO: 3936678 - RNA, 14 nt, Human adenovirus E
caaacuuccuccac

SEQ ID NO: 3936679 - RNA, 22 nt, Human adenovirus E
caacaaaagaaaaauccuccag

SEQ ID NO: 3936680 - RNA, 13 nt, Human adenovirus E
caacaaaugccag

SEQ ID NO: 3936681 - RNA, 19 nt, Human adenovirus E
caacaugguagcccaucau

SEQ ID NO: 3936682 - RNA, 16 nt, Human adenovirus E
caaccaaacuaaccuc

SEQ ID NO: 3936683 - RNA, 16 nt, Human adenovirus E
caaccacgugcgcacc

SEQ ID NO: 3936684 - RNA, 22 nt, Human adenovirus E
caaccacgugcgcacccugauc

SEQ ID NO: 3936685 - RNA, 15 nt, Human adenovirus E
caacccuucccaccc

SEQ ID NO: 3936686 - RNA, 13 nt, Human adenovirus E
caacccuuccucc

SEQ ID NO: 3936687 - RNA, 15 nt, Human adenovirus E
caaccucaggcacac

SEQ ID NO: 3936688 - RNA, 18 nt, Human adenovirus E
caaccucgccaucugccc

SEQ ID NO: 3936689 - RNA, 12 nt, Human adenovirus E
caacgccauccu

SEQ ID NO: 3936690 - RNA, 23 nt, Human adenovirus E
caacgcgcggcuggcggugcuca

SEQ ID NO: 3936691 - RNA, 19 nt, Human adenovirus E
caacgcgcugcuggagcgc

SEQ ID NO: 3936692 - RNA, 24 nt, Human adenovirus E
caacgugcagaccaaccuggaccg

SEQ ID NO: 3936693 - RNA, 17 nt, Human adenovirus E
caacuccuccuccagaa

SEQ ID NO: 3936694 - RNA, 14 nt, Human adenovirus E
caacuucucggugc

SEQ ID NO: 3936695 - RNA, 14 nt, Human adenovirus E
caagaacagccaga

SEQ ID NO: 3936696 - RNA, 18 nt, Human adenovirus E
caagaacagccagagcag

SEQ ID NO: 3936697 - RNA, 18 nt, Human adenovirus E
caagaaguaccucaccug

SEQ ID NO: 3936698 - RNA, 21 nt, Human adenovirus E
caagaaugaacacuguauccc

SEQ ID NO: 3936699 - RNA, 16 nt, Human adenovirus E
caagagauggaggaau

SEQ ID NO: 3936700 - RNA, 19 nt, Human adenovirus E
caagagucagagaaaggcu

SEQ ID NO: 3936701 - RNA, 20 nt, Human adenovirus E
caagaguuccaggcgguccc

SEQ ID NO: 3936702 - RNA, 16 nt, Human adenovirus E
caagccacaguacaga

SEQ ID NO: 3936703 - RNA, 14 nt, Human adenovirus E
caagcccaucauug

SEQ ID NO: 3936704 - RNA, 14 nt, Human adenovirus E
caagcgccgcagca

SEQ ID NO: 3936705 - RNA, 20 nt, Human adenovirus E
caaggacagacccuucugac

SEQ ID NO: 3936706 - RNA, 15 nt, Human adenovirus E
caaguuucuccacca

SEQ ID NO: 3936707 - RNA, 20 nt, Human adenovirus E
caauaucacgaaaucauaug

SEQ ID NO: 3936708 - RNA, 19 nt, Human adenovirus E
caaugccaccucagcucaa

SEQ ID NO: 3936709 - RNA, 20 nt, Human adenovirus E
caauggaggacccaccgcuc

SEQ ID NO: 3936710 - RNA, 16 nt, Human adenovirus E
caaugguacugaucug

SEQ ID NO: 3936711 - RNA, 12 nt, Human adenovirus E
cacaagaagaga

SEQ ID NO: 3936712 - RNA, 13 nt, Human adenovirus E
cacacacacagau

SEQ ID NO: 3936713 - RNA, 17 nt, Human adenovirus E
cacacagacaacccaca

SEQ ID NO: 3936714 - RNA, 21 nt, Human adenovirus E
cacaccaacaugcccaacgug

SEQ ID NO: 3936715 - RNA, 15 nt, Human adenovirus E
cacaccaccacagca

SEQ ID NO: 3936716 - RNA, 16 nt, Human adenovirus E
cacaccuuccaccuga

SEQ ID NO: 3936717 - RNA, 13 nt, Human adenovirus E
cacacgcccagca

SEQ ID NO: 3936718 - RNA, 16 nt, Human adenovirus E
cacagaaccaccaggu

SEQ ID NO: 3936719 - RNA, 13 nt, Human adenovirus E
cacagcacaggca

SEQ ID NO: 3936720 - RNA, 23 nt, Human adenovirus E
cacagccuugaacaucugaaugc

SEQ ID NO: 3936721 - RNA, 16 nt, Human adenovirus E
cacagcggcggcagca

SEQ ID NO: 3936722 - RNA, 12 nt, Human adenovirus E
cacaggcagcaa

SEQ ID NO: 3936723 - RNA, 14 nt, Human adenovirus E
cacaggcagcaaag

SEQ ID NO: 3936724 - RNA, 14 nt, Human adenovirus E
cacaugucccccuc

SEQ ID NO: 3936725 - RNA, 22 nt, Human adenovirus E
caccaacgugcagaccaaccug

SEQ ID NO: 3936726 - RNA, 16 nt, Human adenovirus E
caccaacuucaucagc

SEQ ID NO: 3936727 - RNA, 16 nt, Human adenovirus E
caccaagaacagccag

SEQ ID NO: 3936728 - RNA, 21 nt, Human adenovirus E
caccacagcgcccuggucgag

SEQ ID NO: 3936729 - RNA, 13 nt, Human adenovirus E
caccaccacagca

SEQ ID NO: 3936730 - RNA, 13 nt, Human adenovirus E
caccaccgccucg

SEQ ID NO: 3936731 - RNA, 13 nt, Human adenovirus E
caccacuacagcc

SEQ ID NO: 3936732 - RNA, 14 nt, Human adenovirus E
caccacucgccgcu

SEQ ID NO: 3936733 - RNA, 16 nt, Human adenovirus E
cacccagaccaucaac

SEQ ID NO: 3936734 - RNA, 15 nt, Human adenovirus E
cacccgcgcgugcag

SEQ ID NO: 3936735 - RNA, 22 nt, Human adenovirus E
caccgcaacaacagcccccucc

SEQ ID NO: 3936736 - RNA, 23 nt, Human adenovirus E
caccgccccgcccgccaugcagc

SEQ ID NO: 3936737 - RNA, 20 nt, Human adenovirus E
caccgccgacgagaagcagc

SEQ ID NO: 3936738 - RNA, 17 nt, Human adenovirus E
caccgcucccuggccug

SEQ ID NO: 3936739 - RNA, 13 nt, Human adenovirus E
caccguggugcag

SEQ ID NO: 3936740 - RNA, 12 nt, Human adenovirus E
caccucacagcu

SEQ ID NO: 3936741 - RNA, 17 nt, Human adenovirus E
caccucugacccugccg

SEQ ID NO: 3936742 - RNA, 19 nt, Human adenovirus E
caccuggacaaaauaccac

SEQ ID NO: 3936743 - RNA, 20 nt, Human adenovirus E
cacgaagcccugcaggaagc

SEQ ID NO: 3936744 - RNA, 21 nt, Human adenovirus E
cacgagaaccgccuggggcag

SEQ ID NO: 3936745 - RNA, 13 nt, Human adenovirus E
cacgagccggggc

SEQ ID NO: 3936746 - RNA, 19 nt, Human adenovirus E
cacgaggaggagcuggcag

SEQ ID NO: 3936747 - RNA, 15 nt, Human adenovirus E
cacgcccagcacacg

SEQ ID NO: 3936748 - RNA, 22 nt, Human adenovirus E
cacgccucgucaggccguccug

SEQ ID NO: 3936749 - RNA, 12 nt, Human adenovirus E
cacgcgcccgcg

SEQ ID NO: 3936750 - RNA, 12 nt, Human adenovirus E
cacgcuccagcc

SEQ ID NO: 3936751 - RNA, 17 nt, Human adenovirus E
cacgcucgccagcaccg

SEQ ID NO: 3936752 - RNA, 16 nt, Human adenovirus E
cacgcugcgcccccag

SEQ ID NO: 3936753 - RNA, 17 nt, Human adenovirus E
cacggcguacgagcaga

SEQ ID NO: 3936754 - RNA, 18 nt, Human adenovirus E
cacgggacgcagggccau

SEQ ID NO: 3936755 - RNA, 23 nt, Human adenovirus E
cacggguucgugcgccaggccug

SEQ ID NO: 3936756 - RNA, 21 nt, Human adenovirus E
cacgugagccgcgcccugggc

SEQ ID NO: 3936757 - RNA, 22 nt, Human adenovirus E
cacucaggcagaggaggacagc

SEQ ID NO: 3936758 - RNA, 24 nt, Human adenovirus E
cacucuuaaagaguagcccgcgcc

SEQ ID NO: 3936759 - RNA, 16 nt, Human adenovirus E
cacugacguaaaggcc

SEQ ID NO: 3936760 - RNA, 16 nt, Human adenovirus E
cacugccgccgcuucc

SEQ ID NO: 3936761 - RNA, 18 nt, Human adenovirus E
cacugucgagagccacac

SEQ ID NO: 3936762 - RNA, 21 nt, Human adenovirus E
cacuuacuaaguguugaauuu

SEQ ID NO: 3936763 - RNA, 14 nt, Human adenovirus E
cagaaagcacagac

SEQ ID NO: 3936764 - RNA, 14 nt, Human adenovirus E
cagaaaucccgcca

SEQ ID NO: 3936765 - RNA, 23 nt, Human adenovirus E
cagaacaaugacuucacccccac

SEQ ID NO: 3936766 - RNA, 14 nt, Human adenovirus E
cagaaccugaaaga

SEQ ID NO: 3936767 - RNA, 19 nt, Human adenovirus E
cagaacggggugcuggaga

SEQ ID NO: 3936768 - RNA, 11 nt, Human adenovirus E
cagaaguuuca

SEQ ID NO: 3936769 - RNA, 13 nt, Human adenovirus E
cagaaguuucaug

SEQ ID NO: 3936770 - RNA, 23 nt, Human adenovirus E
cagacaacccacauuacacagac

SEQ ID NO: 3936771 - RNA, 13 nt, Human adenovirus E
cagacccacugcu

SEQ ID NO: 3936772 - RNA, 23 nt, Human adenovirus E
cagacccacugcugaaccucuau

SEQ ID NO: 3936773 - RNA, 17 nt, Human adenovirus E
cagacccagccagauga

SEQ ID NO: 3936774 - RNA, 22 nt, Human adenovirus E
cagaccgguaagaaggagcggc

SEQ ID NO: 3936775 - RNA, 18 nt, Human adenovirus E
cagaccggugaggagcuc

SEQ ID NO: 3936776 - RNA, 17 nt, Human adenovirus E
cagaccgugaaggagga

SEQ ID NO: 3936777 - RNA, 23 nt, Human adenovirus E
cagacgcgcggcuucaggcgcca

SEQ ID NO: 3936778 - RNA, 17 nt, Human adenovirus E
cagagacaggagcggcg

SEQ ID NO: 3936779 - RNA, 22 nt, Human adenovirus E
cagagcaucguggugcaggagc

SEQ ID NO: 3936780 - RNA, 17 nt, Human adenovirus E
cagagcgcccuccaccg

SEQ ID NO: 3936781 - RNA, 19 nt, Human adenovirus E
cagagcgcccuccaccggc

SEQ ID NO: 3936782 - RNA, 22 nt, Human adenovirus E
cagagcuggaaguccgugcgcu

SEQ ID NO: 3936783 - RNA, 16 nt, Human adenovirus E
cagaggaggacagccu

SEQ ID NO: 3936784 - RNA, 16 nt, Human adenovirus E
cagaggaggaggugga

SEQ ID NO: 3936785 - RNA, 21 nt, Human adenovirus E
cagagucgggggcaggagcag

SEQ ID NO: 3936786 - RNA, 16 nt, Human adenovirus E
cagaucccgccugggg

SEQ ID NO: 3936787 - RNA, 15 nt, Human adenovirus E
cagauccucguccgc

SEQ ID NO: 3936788 - RNA, 22 nt, Human adenovirus E
cagaugcgcccccaccacccuc

SEQ ID NO: 3936789 - RNA, 15 nt, Human adenovirus E
cagcaaagcccccga

SEQ ID NO: 3936790 - RNA, 20 nt, Human adenovirus E
cagcaaagccuccacgcgca

SEQ ID NO: 3936791 - RNA, 14 nt, Human adenovirus E
cagcaagccgcuga

SEQ ID NO: 3936792 - RNA, 16 nt, Human adenovirus E
cagcaagcgguugggg

SEQ ID NO: 3936793 - RNA, 21 nt, Human adenovirus E
cagcaaggcguggaacagcac

SEQ ID NO: 3936794 - RNA, 14 nt, Human adenovirus E
cagcaauaacugua

SEQ ID NO: 3936795 - RNA, 18 nt, Human adenovirus E
cagcaccacagggcaggc

SEQ ID NO: 3936796 - RNA, 20 nt, Human adenovirus E
  misc_feature (10)..(10): n is a, c, g or u
cagcacgaangaggccacgu

SEQ ID NO: 3936797 - RNA, 12 nt, Human adenovirus E
cagcacucucaa

SEQ ID NO: 3936798 - RNA, 21 nt, Human adenovirus E
cagcacuggaacaccaucagg

SEQ ID NO: 3936799 - RNA, 16 nt, Human adenovirus E
cagcagaagcgugggc

SEQ ID NO: 3936800 - RNA, 20 nt, Human adenovirus E
cagcagagguugccagcucg

SEQ ID NO: 3936801 - RNA, 20 nt, Human adenovirus E
cagcagcacacaacaggcgc

SEQ ID NO: 3936802 - RNA, 15 nt, Human adenovirus E
cagcagccccaggcc

SEQ ID NO: 3936803 - RNA, 14 nt, Human adenovirus E
cagcagcgagcugg

SEQ ID NO: 3936804 - RNA, 13 nt, Human adenovirus E
cagcagcugaagc

SEQ ID NO: 3936805 - RNA, 14 nt, Human adenovirus E
cagcaggcggcgcg

SEQ ID NO: 3936806 - RNA, 14 nt, Human adenovirus E
cagcaggugcugcc

SEQ ID NO: 3936807 - RNA, 15 nt, Human adenovirus E
cagcaggugcugccg

SEQ ID NO: 3936808 - RNA, 15 nt, Human adenovirus E
cagcagucaggcaga

SEQ ID NO: 3936809 - RNA, 16 nt, Human adenovirus E
cagcagucaggcagag

SEQ ID NO: 3936810 - RNA, 20 nt, Human adenovirus E
cagcagucaggcagaggagg

SEQ ID NO: 3936811 - RNA, 21 nt, Human adenovirus E
cagcaguuugggcagcggggu

SEQ ID NO: 3936812 - RNA, 23 nt, Human adenovirus E
cagcaugaaggggacgagcugcu

SEQ ID NO: 3936813 - RNA, 19 nt, Human adenovirus E
cagcaugaugcccacggcc

SEQ ID NO: 3936814 - RNA, 17 nt, Human adenovirus E
cagccacucucucagac

SEQ ID NO: 3936815 - RNA, 15 nt, Human adenovirus E
cagccagagcaggaa

SEQ ID NO: 3936816 - RNA, 15 nt, Human adenovirus E
cagccccaggccaac

SEQ ID NO: 3936817 - RNA, 22 nt, Human adenovirus E
cacugccgcugcaaccucugca

SEQ ID NO: 3936818 - RNA, 13 nt, Human adenovirus E
cacuuccucuucu

SEQ ID NO: 3936819 - RNA, 15 nt, Human adenovirus E
cagaacacgcugccc

SEQ ID NO: 3936820 - RNA, 16 nt, Human adenovirus E
cagaccagucgccagg

SEQ ID NO: 3936821 - RNA, 18 nt, Human adenovirus E
cagaccgguaagaaggag

SEQ ID NO: 3936822 - RNA, 18 nt, Human adenovirus E
cagaccgugaaccugagc

SEQ ID NO: 3936823 - RNA, 23 nt, Human adenovirus E
cagaccgugaaccugagccaggc

SEQ ID NO: 3936824 - RNA, 21 nt, Human adenovirus E
cagaccgugaaggaggagagc

SEQ ID NO: 3936825 - RNA, 18 nt, Human adenovirus E
cagaccgugcagcagauc

SEQ ID NO: 3936826 - RNA, 15 nt, Human adenovirus E
cagagaaugagcaga

SEQ ID NO: 3936827 - RNA, 19 nt, Human adenovirus E
cagagcucggugaugugcu

SEQ ID NO: 3936828 - RNA, 21 nt, Human adenovirus E
cagagcucggugaugugcucu

SEQ ID NO: 3936829 - RNA, 11 nt, Human adenovirus E
cagaggaggag

SEQ ID NO: 3936830 - RNA, 17 nt, Human adenovirus E
cagagucaggcugggcu

SEQ ID NO: 3936831 - RNA, 19 nt, Human adenovirus E
cagagucgggggcaggagc

SEQ ID NO: 3936832 - RNA, 16 nt, Human adenovirus E
cagaguuuggaagagc

SEQ ID NO: 3936833 - RNA, 17 nt, Human adenovirus E
cagaucuagggccucag

SEQ ID NO: 3936834 - RNA, 16 nt, Human adenovirus E
cagcaaagccuccacg

SEQ ID NO: 3936835 - RNA, 21 nt, Human adenovirus E
cagcaagccgcugacggcgca

SEQ ID NO: 3936836 - RNA, 16 nt, Human adenovirus E
cagcaccaacgugcag

SEQ ID NO: 3936837 - RNA, 14 nt, Human adenovirus E
cagcaccaggcagg

SEQ ID NO: 3936838 - RNA, 14 nt, Human adenovirus E
cagcacccagacca

SEQ ID NO: 3936839 - RNA, 16 nt, Human adenovirus E
cagcacucaggcagag

SEQ ID NO: 3936840 - RNA, 21 nt, Human adenovirus E
cagcacucucaacuccucggg

SEQ ID NO: 3936841 - RNA, 18 nt, Human adenovirus E
cagcagaaaaagaccagc

SEQ ID NO: 3936842 - RNA, 19 nt, Human adenovirus E
cagcagaaaaccagcagcu

SEQ ID NO: 3936843 - RNA, 21 nt, Human adenovirus E
cagcagcagaaaaagaccagc

SEQ ID NO: 3936844 - RNA, 14 nt, Human adenovirus E
cagcagcagcagaa

SEQ ID NO: 3936845 - RNA, 14 nt, Human adenovirus E
cagcagccccaggc

SEQ ID NO: 3936846 - RNA, 21 nt, Human adenovirus E
  misc_feature (9)..(9): n is a, c, g or u
cagcagccnuucuccacgggg

SEQ ID NO: 3936847 - RNA, 18 nt, Human adenovirus E
cagcagcgagcugggcag

SEQ ID NO: 3936848 - RNA, 21 nt, Human adenovirus E
cagcaggcggcgcgagcugag

SEQ ID NO: 3936849 - RNA, 22 nt, Human adenovirus E
cagcaggugcugccgaccgcgg

SEQ ID NO: 3936850 - RNA, 17 nt, Human adenovirus E
cagcagguggacugagg

SEQ ID NO: 3936851 - RNA, 23 nt, Human adenovirus E
cagcaguauccggggaguccagc

SEQ ID NO: 3936852 - RNA, 15 nt, Human adenovirus E
cagcaucaaccgcaa

SEQ ID NO: 3936853 - RNA, 12 nt, Human adenovirus E
cagcaucaucug

SEQ ID NO: 3936854 - RNA, 19 nt, Human adenovirus E
cagcaucaucugggccugg

SEQ ID NO: 3936855 - RNA, 21 nt, Human adenovirus E
cagcaucaucugggccugguc

SEQ ID NO: 3936856 - RNA, 21 nt, Human adenovirus E
cagccacuugaacucggggau

SEQ ID NO: 3936857 - RNA, 22 nt, Human adenovirus E
cagccagagcaggaagcagaga

SEQ ID NO: 3936858 - RNA, 20 nt, Human adenovirus E
cagcccaauggcaccugcga

SEQ ID NO: 3936859 - RNA, 21 nt, Human adenovirus E
cagccccgauuaugcagggug

SEQ ID NO: 3936860 - RNA, 14 nt, Human adenovirus E
cagccgcggccagg

SEQ ID NO: 3936861 - RNA, 22 nt, Human adenovirus E
cagccggcgcuucugcccccgc

SEQ ID NO: 3936862 - RNA, 18 nt, Human adenovirus E
cagcgaaccccgcagaac

SEQ ID NO: 3936863 - RNA, 21 nt, Human adenovirus E
cagcgacgagacucgggccgc

SEQ ID NO: 3936864 - RNA, 14 nt, Human adenovirus E
cagcgcagccaggg

SEQ ID NO: 3936865 - RNA, 23 nt, Human adenovirus E
cagcgccccgcauccccaaauuc

SEQ ID NO: 3936866 - RNA, 17 nt, Human adenovirus E
cagcgcccugcgccuga

SEQ ID NO: 3936867 - RNA, 12 nt, Human adenovirus E
cagcgccgggcc

SEQ ID NO: 3936868 - RNA, 23 nt, Human adenovirus E
cagcgcgcgucguuguuggccag

SEQ ID NO: 3936869 - RNA, 21 nt, Human adenovirus E
cagcggcauugucggugugcu

SEQ ID NO: 3936870 - RNA, 19 nt, Human adenovirus E
cagcggccaucgccagcau

SEQ ID NO: 3936871 - RNA, 18 nt, Human adenovirus E
cagcggcgagggccugcu

SEQ ID NO: 3936872 - RNA, 15 nt, Human adenovirus E
cagcggcggcagcag

SEQ ID NO: 3936873 - RNA, 17 nt, Human adenovirus E
cagcggcggcagcaggu

SEQ ID NO: 3936874 - RNA, 21 nt, Human adenovirus E
cagcgggcccugaccggggcc

SEQ ID NO: 3936875 - RNA, 19 nt, Human adenovirus E
cagcguccgauccuggucg

SEQ ID NO: 3936876 - RNA, 21 nt, Human adenovirus E
cagcguccgauccuggucgag

SEQ ID NO: 3936877 - RNA, 20 nt, Human adenovirus E
cagcguggaggagcucagcc

SEQ ID NO: 3936878 - RNA, 21 nt, Human adenovirus E
cagcguguucuccccccgacc

SEQ ID NO: 3936879 - RNA, 18 nt, Human adenovirus E
cagcuaccuccagugccu

SEQ ID NO: 3936880 - RNA, 23 nt, Human adenovirus E
cagcucaacgacgaaguggugag

SEQ ID NO: 3936881 - RNA, 18 nt, Human adenovirus E
cagcuccuccucggccug

SEQ ID NO: 3936882 - RNA, 15 nt, Human adenovirus E
cagcugauggugccc

SEQ ID NO: 3936883 - RNA, 22 nt, Human adenovirus E
cagcugcgcgccuucaccucgc

SEQ ID NO: 3936884 - RNA, 18 nt, Human adenovirus E
caggaaauuccccagccc

SEQ ID NO: 3936885 - RNA, 19 nt, Human adenovirus E
caggaaauuccccagccca

SEQ ID NO: 3936886 - RNA, 21 nt, Human adenovirus E
caggacccuacguagaagagg

SEQ ID NO: 3936887 - RNA, 19 nt, Human adenovirus E
caggacgacccgggcaacc

SEQ ID NO: 3936888 - RNA, 14 nt, Human adenovirus E
caggagcacaggga

SEQ ID NO: 3936889 - RNA, 16 nt, Human adenovirus E
caggagcacagggacg

SEQ ID NO: 3936890 - RNA, 21 nt, Human adenovirus E
caggagcgcgggcugccgcug

SEQ ID NO: 3936891 - RNA, 15 nt, Human adenovirus E
caggagcugaugcau

SEQ ID NO: 3936892 - RNA, 21 nt, Human adenovirus E
caggagggggccacccccagc

SEQ ID NO: 3936893 - RNA, 20 nt, Human adenovirus E
caggaugcaccgugcgguga

SEQ ID NO: 3936894 - RNA, 22 nt, Human adenovirus E
caggcacacgcacuaccaccac

SEQ ID NO: 3936895 - RNA, 22 nt, Human adenovirus E
caggcacggguucgugcgccag

SEQ ID NO: 3936896 - RNA, 12 nt, Human adenovirus E
caggcagcgggg

SEQ ID NO: 3936897 - RNA, 12 nt, Human adenovirus E
caggccagcacg

SEQ ID NO: 3936898 - RNA, 18 nt, Human adenovirus E
caggccaugcaacgcauc

SEQ ID NO: 3936899 - RNA, 18 nt, Human adenovirus E
caggccccggucggggac

SEQ ID NO: 3936900 - RNA, 17 nt, Human adenovirus E
caggccgaaguccagcu

SEQ ID NO: 3936901 - RNA, 22 nt, Human adenovirus E
caggccgucuacucgcagcagc

SEQ ID NO: 3936902 - RNA, 15 nt, Human adenovirus E
caggccgugcagcgg

SEQ ID NO: 3936903 - RNA, 22 nt, Human adenovirus E
caggcgauggcggcggcggcga

SEQ ID NO: 3936904 - RNA, 22 nt, Human adenovirus E
caggcgcacgggacgcagggcc

SEQ ID NO: 3936905 - RNA, 14 nt, Human adenovirus E
caggcggcaguggu

SEQ ID NO: 3936906 - RNA, 22 nt, Human adenovirus E
caggcuggagccgcagcuaacg

SEQ ID NO: 3936907 - RNA, 18 nt, Human adenovirus E
cagggacgauccccgggc

SEQ ID NO: 3936908 - RNA, 15 nt, Human adenovirus E
cagggacucccucag

SEQ ID NO: 3936909 - RNA, 17 nt, Human adenovirus E
cagggaggcgcugcuga

SEQ ID NO: 3936910 - RNA, 19 nt, Human adenovirus E
cagggauacaaguccuggc

SEQ ID NO: 3936911 - RNA, 14 nt, Human adenovirus E
cagggccagcaccg

SEQ ID NO: 3936912 - RNA, 15 nt, Human adenovirus E
caggggcgcagggca

SEQ ID NO: 3936913 - RNA, 15 nt, Human adenovirus E
caggggcggcagggg

SEQ ID NO: 3936914 - RNA, 18 nt, Human adenovirus E
cagggggccacgagccgg

SEQ ID NO: 3936915 - RNA, 19 nt, Human adenovirus E
caggggguccagcaugacc

SEQ ID NO: 3936916 - RNA, 20 nt, Human adenovirus E
cagggucucaaagcuccgcu

SEQ ID NO: 3936917 - RNA, 14 nt, Human adenovirus E
cagggugaugaggu

SEQ ID NO: 3936918 - RNA, 20 nt, Human adenovirus E
cagguacacauacaaagccu

SEQ ID NO: 3936919 - RNA, 19 nt, Human adenovirus E
caggucaucgcgccugaga

SEQ ID NO: 3936920 - RNA, 14 nt, Human adenovirus E
cagguggcagaugc

SEQ ID NO: 3936921 - RNA, 22 nt, Human adenovirus E
cagguggcagaugcggcgguac

SEQ ID NO: 3936922 - RNA, 16 nt, Human adenovirus E
caguacgugcaacaca

SEQ ID NO: 3936923 - RNA, 15 nt, Human adenovirus E
caguauccgcagcag

SEQ ID NO: 3936924 - RNA, 16 nt, Human adenovirus E
caguauccgcagcagc

SEQ ID NO: 3936925 - RNA, 17 nt, Human adenovirus E
caguauccgcagcagcg

SEQ ID NO: 3936926 - RNA, 20 nt, Human adenovirus E
cagucauagcaggggcgcag

SEQ ID NO: 3936927 - RNA, 21 nt, Human adenovirus E
caguccauaguucaacacgcu

SEQ ID NO: 3936928 - RNA, 13 nt, Human adenovirus E
cagucccacugcu

SEQ ID NO: 3936929 - RNA, 14 nt, Human adenovirus E
cagucccccgagga

SEQ ID NO: 3936930 - RNA, 20 nt, Human adenovirus E
cagucgccagggcuugcaga

SEQ ID NO: 3936931 - RNA, 16 nt, Human adenovirus E
cagucucaaguccagc

SEQ ID NO: 3936932 - RNA, 22 nt, Human adenovirus E
cagucucaaguccagcaaagcg

SEQ ID NO: 3936933 - RNA, 12 nt, Human adenovirus E
cagucuggagga

SEQ ID NO: 3936934 - RNA, 19 nt, Human adenovirus E
cguggaggagcucagccgc

SEQ ID NO: 3936935 - RNA, 14 nt, Human adenovirus E
cguggccuggaggc

SEQ ID NO: 3936936 - RNA, 15 nt, Human adenovirus E
cgugguccuggugac

SEQ ID NO: 3936937 - RNA, 20 nt, Human adenovirus E
cgugguggcggacgcgcgcc

SEQ ID NO: 3936938 - RNA, 14 nt, Human adenovirus E
cguguucucccccc

SEQ ID NO: 3936939 - RNA, 19 nt, Human adenovirus E
cguuacgugcagcagaagc

SEQ ID NO: 3936940 - RNA, 16 nt, Human adenovirus E
cguuacucggagcugg

SEQ ID NO: 3936941 - RNA, 17 nt, Human adenovirus E
cguuacucggagcuggc

SEQ ID NO: 3936942 - RNA, 21 nt, Human adenovirus E
cguuacugucguugucggauc

SEQ ID NO: 3936943 - RNA, 12 nt, Human adenovirus E
cguucucuccag

SEQ ID NO: 3936944 - RNA, 12 nt, Human adenovirus E
cguugggcaggg

SEQ ID NO: 3936945 - RNA, 12 nt, Human adenovirus E
cuaacacuuugc

SEQ ID NO: 3936946 - RNA, 13 nt, Human adenovirus E
cuaccgcagcugg

SEQ ID NO: 3936947 - RNA, 20 nt, Human adenovirus E
cuaccgucaccuccacagcc

SEQ ID NO: 3936948 - RNA, 17 nt, Human adenovirus E
cuaccugauaucgccuc

SEQ ID NO: 3936949 - RNA, 14 nt, Human adenovirus E
cuacgucguggugg

SEQ ID NO: 3936950 - RNA, 21 nt, Human adenovirus E
cuacgucuacaaggcccuggg

SEQ ID NO: 3936951 - RNA, 15 nt, Human adenovirus E
cuacuggucgcugcc

SEQ ID NO: 3936952 - RNA, 23 nt, Human adenovirus E
cuacuuccaagaagaggcagcag

SEQ ID NO: 3936953 - RNA, 13 nt, Human adenovirus E
cuacuuccuccuc

SEQ ID NO: 3936954 - RNA, 14 nt, Human adenovirus E
cuagaacagucagc

SEQ ID NO: 3936955 - RNA, 16 nt, Human adenovirus E
cuagccgccuccaccc

SEQ ID NO: 3936956 - RNA, 18 nt, Human adenovirus E
cuaggacguccagagcgc

SEQ ID NO: 3936957 - RNA, 23 nt, Human adenovirus E
cuaguugcgggugggcuuuuggu

SEQ ID NO: 3936958 - RNA, 16 nt, Human adenovirus E
cuaucauuaccucugc

SEQ ID NO: 3936959 - RNA, 21 nt, Human adenovirus E
cuaugaggccgagccacagcg

SEQ ID NO: 3936960 - RNA, 21 nt, Human adenovirus E
cuaugccaucuuccagcagag

SEQ ID NO: 3936961 - RNA, 22 nt, Human adenovirus E
cuaugugacgcccgcggagcac

SEQ ID NO: 3936962 - RNA, 16 nt, Human adenovirus E
cuauguuggcacagca

SEQ ID NO: 3936963 - RNA, 17 nt, Human adenovirus E
cuauguuggcacagcac

SEQ ID NO: 3936964 - RNA, 19 nt, Human adenovirus E
cuauguuggcacagcacag

SEQ ID NO: 3936965 - RNA, 20 nt, Human adenovirus E
cuauguuggcacagcacagg

SEQ ID NO: 3936966 - RNA, 19 nt, Human adenovirus E
cucaacccaccccacccag

SEQ ID NO: 3936967 - RNA, 21 nt, Human adenovirus E
cucaaccccggcuucccccag

SEQ ID NO: 3936968 - RNA, 16 nt, Human adenovirus E
cucaaguccagcaaag

SEQ ID NO: 3936969 - RNA, 15 nt, Human adenovirus E
cucacagaucugcau

SEQ ID NO: 3936970 - RNA, 20 nt, Human adenovirus E
cucacaugaccgccuucgcg

SEQ ID NO: 3936971 - RNA, 15 nt, Human adenovirus E
cucaccaaggccaug

SEQ ID NO: 3936972 - RNA, 16 nt, Human adenovirus E
cucaccaaggccaugg

SEQ ID NO: 3936973 - RNA, 13 nt, Human adenovirus E
cucaccgccacgc

SEQ ID NO: 3936974 - RNA, 19 nt, Human adenovirus E
cucagcaaccugcugggca

SEQ ID NO: 3936975 - RNA, 19 nt, Human adenovirus E
cucagcacccagcccgcca

SEQ ID NO: 3936976 - RNA, 13 nt, Human adenovirus E
cucagcaccgagg

SEQ ID NO: 3936977 - RNA, 23 nt, Human adenovirus E
cucagcguggaggagcucagccg

SEQ ID NO: 3936978 - RNA, 20 nt, Human adenovirus E
cucaggcacacgcacuacca

SEQ ID NO: 3936979 - RNA, 18 nt, Human adenovirus E
cucaggcugacgcugcgc

SEQ ID NO: 3936980 - RNA, 23 nt, Human adenovirus E
cucaggggguccggguccaggga

SEQ ID NO: 3936981 - RNA, 23 nt, Human adenovirus E
cucaucaagcaucuggcccggca

SEQ ID NO: 3936982 - RNA, 20 nt, Human adenovirus E
cuccaagucugugccacccu

SEQ ID NO: 3936983 - RNA, 15 nt, Human adenovirus E
cuccacccucccagg

SEQ ID NO: 3936984 - RNA, 11 nt, Human adenovirus E
cuccagcacca

SEQ ID NO: 3936985 - RNA, 17 nt, Human adenovirus E
cuccaguucguggagga

SEQ ID NO: 3936986 - RNA, 13 nt, Human adenovirus E
cucccagagcugg

SEQ ID NO: 3936987 - RNA, 23 nt, Human adenovirus E
cucccggaggaggggggccaccu

SEQ ID NO: 3936988 - RNA, 16 nt, Human adenovirus E
cucccucggugaagaa

SEQ ID NO: 3936989 - RNA, 20 nt, Human adenovirus E
cuccgaggucaaccaaccuc

SEQ ID NO: 3936990 - RNA, 22 nt, Human adenovirus E
cuccgccgacgacagcagcgug

SEQ ID NO: 3936991 - RNA, 17 nt, Human adenovirus E
cuccgcggccggccauu

SEQ ID NO: 3936992 - RNA, 13 nt, Human adenovirus E
cuccgcuggguga

SEQ ID NO: 3936993 - RNA, 14 nt, Human adenovirus E
cuccggaauccugc

SEQ ID NO: 3936994 - RNA, 17 nt, Human adenovirus E
cuccggaauccugcccg

SEQ ID NO: 3936995 - RNA, 15 nt, Human adenovirus E
cuccuagggaggaac

SEQ ID NO: 3936996 - RNA, 17 nt, Human adenovirus E
cuccuccaagucugugc

SEQ ID NO: 3936997 - RNA, 15 nt, Human adenovirus E
cuccucccucagcaa

SEQ ID NO: 3936998 - RNA, 12 nt, Human adenovirus E
cuccuccuccag

SEQ ID NO: 3936999 - RNA, 20 nt, Human adenovirus E
cuccuucagcgcgcgcugcc

SEQ ID NO: 3937000 - RNA, 15 nt, Human adenovirus E
cucgaaggcgggcau

SEQ ID NO: 3937001 - RNA, 20 nt, Human adenovirus E
cucgaaucaggcuggagccg

SEQ ID NO: 3937002 - RNA, 14 nt, Human adenovirus E
cucgagcgcccagu

SEQ ID NO: 3937003 - RNA, 16 nt, Human adenovirus E
cucgaucuccuccucu

SEQ ID NO: 3937004 - RNA, 19 nt, Human adenovirus E
cucgcaacgcugcacggga

SEQ ID NO: 3937005 - RNA, 17 nt, Human adenovirus E
cucgcagcagcugcgcg

SEQ ID NO: 3937006 - RNA, 21 nt, Human adenovirus E
cucgccaucugcccccaccgc

SEQ ID NO: 3937007 - RNA, 19 nt, Human adenovirus E
cucgcugaacuaccagaac

SEQ ID NO: 3937008 - RNA, 21 nt, Human adenovirus E
cucggacuucgugccgcugac

SEQ ID NO: 3937009 - RNA, 12 nt, Human adenovirus E
cucggagcuggc

SEQ ID NO: 3937010 - RNA, 14 nt, Human adenovirus E
cucggccauccugg

SEQ ID NO: 3937011 - RNA, 15 nt, Human adenovirus E
cucggccauccugga

SEQ ID NO: 3937012 - RNA, 16 nt, Human adenovirus E
cucggccauccuggag

SEQ ID NO: 3937013 - RNA, 18 nt, Human adenovirus E
cucguccacauccaggaa

SEQ ID NO: 3937014 - RNA, 22 nt, Human adenovirus E
cucugcucaauauauagcccag

SEQ ID NO: 3937015 - RNA, 15 nt, Human adenovirus E
cucuguccccggugc

SEQ ID NO: 3937016 - RNA, 13 nt, Human adenovirus E
cucuuccucuucu

SEQ ID NO: 3937017 - RNA, 17 nt, Human adenovirus E
cucuucgggggcagagg

SEQ ID NO: 3937018 - RNA, 15 nt, Human adenovirus E
cucuucuacuuccuc

SEQ ID NO: 3937019 - RNA, 18 nt, Human adenovirus E
cucuucuacuuccuccuc

SEQ ID NO: 3937020 - RNA, 15 nt, Human adenovirus E
cucuucuuccuccuc

SEQ ID NO: 3937021 - RNA, 14 nt, Human adenovirus E
cucuugcaggacag

SEQ ID NO: 3937022 - RNA, 20 nt, Human adenovirus E
cucuuugccuucaccaccug

SEQ ID NO: 3937023 - RNA, 13 nt, Human adenovirus E
cugaaaacaccac

SEQ ID NO: 3937024 - RNA, 13 nt, Human adenovirus E
cugaaacacaaaa

SEQ ID NO: 3937025 - RNA, 16 nt, Human adenovirus E
cugaaaguggagcugc

SEQ ID NO: 3937026 - RNA, 20 nt, Human adenovirus E
cugaacaguauccgcagcag

SEQ ID NO: 3937027 - RNA, 21 nt, Human adenovirus E
cugaagcccacggccgccagc

SEQ ID NO: 3937028 - RNA, 23 nt, Human adenovirus E
cugaaucuaauacuaccacccac

SEQ ID NO: 3937029 - RNA, 22 nt, Human adenovirus E
cugaccaccguggugcagaaca

SEQ ID NO: 3937030 - RNA, 21 nt, Human adenovirus E
cugacuaacucagguguccag

SEQ ID NO: 3937031 - RNA, 20 nt, Human adenovirus E
cugagcauucacaugcucau

SEQ ID NO: 3937032 - RNA, 15 nt, Human adenovirus E
cugagcgaccaggag

SEQ ID NO: 3937033 - RNA, 18 nt, Human adenovirus E
cugagcgggggggaggac

SEQ ID NO: 3937034 - RNA, 13 nt, Human adenovirus E
cugagggacgagg

SEQ ID NO: 3937035 - RNA, 14 nt, Human adenovirus E
cugaguuugggcaa

SEQ ID NO: 3937036 - RNA, 15 nt, Human adenovirus E
cugaucacaucgacc

SEQ ID NO: 3937037 - RNA, 15 nt, Human adenovirus E
cugauggccacgggc

SEQ ID NO: 3937038 - RNA, 17 nt, Human adenovirus E
cugcaaccaccccugcc

SEQ ID NO: 3937039 - RNA, 13 nt, Human adenovirus E
cugcaacccccag

SEQ ID NO: 3937040 - RNA, 13 nt, Human adenovirus E
cugcaagcuccug

SEQ ID NO: 3937041 - RNA, 14 nt, Human adenovirus E
cugcacaccacccu

SEQ ID NO: 3937042 - RNA, 14 nt, Human adenovirus E
cugcacaggcagca

SEQ ID NO: 3937043 - RNA, 22 nt, Human adenovirus E
cugcaccacgcugcgcccccag

SEQ ID NO: 3937044 - RNA, 14 nt, Human adenovirus E
cugcagagccagcc

SEQ ID NO: 3937045 - RNA, 16 nt, Human adenovirus E
cugcagcgggcccuga

SEQ ID NO: 3937046 - RNA, 15 nt, Human adenovirus E
cugccacaccuggca

SEQ ID NO: 3937047 - RNA, 20 nt, Human adenovirus E
cugccaccaauuggaggaau

SEQ ID NO: 3937048 - RNA, 20 nt, Human adenovirus E
cugcccccgccccagcagca

SEQ ID NO: 3937049 - RNA, 21 nt, Human adenovirus E
cugcccccgccccagcagcaa

SEQ ID NO: 3937050 - RNA, 13 nt, Human adenovirus E
cugccgcccgugg

SEQ ID NO: 3937051 - RNA, 14 nt, Human adenovirus E
cugccgcccgugga

SEQ ID NO: 3937052 - RNA, 16 nt, Human adenovirus E
cugccgcccuggugcg

SEQ ID NO: 3937053 - RNA, 22 nt, Human adenovirus E
uacuggggguauaggcagggag

SEQ ID NO: 3937054 - RNA, 12 nt, Human adenovirus E
uacuuccuccuc

SEQ ID NO: 3937055 - RNA, 15 nt, Human adenovirus E
uagaaugaccacaac

SEQ ID NO: 3937056 - RNA, 17 nt, Human adenovirus E
uagaaugaccacaacca

SEQ ID NO: 3937057 - RNA, 17 nt, Human adenovirus E
uagacagauggaagaca

SEQ ID NO: 3937058 - RNA, 14 nt, Human adenovirus E
uagagccucgggaa

SEQ ID NO: 3937059 - RNA, 16 nt, Human adenovirus E
uagaguuuggaagcag

SEQ ID NO: 3937060 - RNA, 17 nt, Human adenovirus E
uagcacucaacccaccc

SEQ ID NO: 3937061 - RNA, 22 nt, Human adenovirus E
uagccccguccucuucccacuc

SEQ ID NO: 3937062 - RNA, 20 nt, Human adenovirus E
uagcuuaccgagcagcagca

SEQ ID NO: 3937063 - RNA, 15 nt, Human adenovirus E
uaggaccaccaggaa

SEQ ID NO: 3937064 - RNA, 13 nt, Human adenovirus E
uagucaaauacug

SEQ ID NO: 3937065 - RNA, 15 nt, Human adenovirus E
uaguggugugcaugu

SEQ ID NO: 3937066 - RNA, 21 nt, Human adenovirus E
uaguucaacacgcuccagccg

SEQ ID NO: 3937067 - RNA, 16 nt, Human adenovirus E
uaguuuauacauguga

SEQ ID NO: 3937068 - RNA, 21 nt, Human adenovirus E
uaugauugaaaaccaucacag

SEQ ID NO: 3937069 - RNA, 13 nt, Human adenovirus E
uauuuuuccucca

SEQ ID NO: 3937070 - RNA, 16 nt, Human adenovirus E
uauuuuuccuccaccc

SEQ ID NO: 3937071 - RNA, 12 nt, Human adenovirus E
ucaaaaucucug

SEQ ID NO: 3937072 - RNA, 20 nt, Human adenovirus E
ucaaauacucgcagaaaaug

SEQ ID NO: 3937073 - RNA, 21 nt, Human adenovirus E
ucaacaauagcacucaaccca

SEQ ID NO: 3937074 - RNA, 15 nt, Human adenovirus E
ucaacagccgccugg

SEQ ID NO: 3937075 - RNA, 14 nt, Human adenovirus E
ucaacuccuccucc

SEQ ID NO: 3937076 - RNA, 13 nt, Human adenovirus E
ucaacuccucggg

SEQ ID NO: 3937077 - RNA, 15 nt, Human adenovirus E
ucaagcaucuggccc

SEQ ID NO: 3937078 - RNA, 14 nt, Human adenovirus E
ucaaggacaaagug

SEQ ID NO: 3937079 - RNA, 20 nt, Human adenovirus E
ucaaggaugcgcugcucgac

SEQ ID NO: 3937080 - RNA, 17 nt, Human adenovirus E
ucaaguggugcccccuc

SEQ ID NO: 3937081 - RNA, 20 nt, Human adenovirus E
ucaaguggugcccccuccag

SEQ ID NO: 3937082 - RNA, 22 nt, Human adenovirus E
ucaaguuucugugucugaaccc

SEQ ID NO: 3937083 - RNA, 19 nt, Human adenovirus E
ucacaugcucaucgcuauu

SEQ ID NO: 3937084 - RNA, 15 nt, Human adenovirus E
ucaccaccucccggu

SEQ ID NO: 3937085 - RNA, 19 nt, Human adenovirus E
ucaccaccugcaucugcug

SEQ ID NO: 3937086 - RNA, 17 nt, Human adenovirus E
ucaccgagagccgccuc

SEQ ID NO: 3937087 - RNA, 16 nt, Human adenovirus E
ucaccgccccgcucag

SEQ ID NO: 3937088 - RNA, 15 nt, Human adenovirus E
ucacggcguacgagc

SEQ ID NO: 3937089 - RNA, 19 nt, Human adenovirus E
ucagacccacugcugaacc

SEQ ID NO: 3937090 - RNA, 22 nt, Human adenovirus E
ucagcacucucaacuccucggg

SEQ ID NO: 3937091 - RNA, 19 nt, Human adenovirus E
ucagcaucaucugggccug

SEQ ID NO: 3937092 - RNA, 19 nt, Human adenovirus E
ucagcaugaugcccacggc

SEQ ID NO: 3937093 - RNA, 15 nt, Human adenovirus E
ucagccagcguccga

SEQ ID NO: 3937094 - RNA, 16 nt, Human adenovirus E
ucagcgcacucucgag

SEQ ID NO: 3937095 - RNA, 16 nt, Human adenovirus E
ucagcgccccgcaucc

SEQ ID NO: 3937096 - RNA, 12 nt, Human adenovirus E
ucaggcugggcu

SEQ ID NO: 3937097 - RNA, 18 nt, Human adenovirus E
ucagggaggcgcugcuga

SEQ ID NO: 3937098 - RNA, 15 nt, Human adenovirus E
ucagguguccagcug

SEQ ID NO: 3937099 - RNA, 16 nt, Human adenovirus E
ucaguuuuuccaacaa

SEQ ID NO: 3937100 - RNA, 19 nt, Human adenovirus E
ucaucaaguuucaaugugg

SEQ ID NO: 3937101 - RNA, 17 nt, Human adenovirus E
ucauccucgaacgcucc

SEQ ID NO: 3937102 - RNA, 14 nt, Human adenovirus E
ucaugaccagcaug

SEQ ID NO: 3937103 - RNA, 11 nt, Human adenovirus E
ucaugaugcag

SEQ ID NO: 3937104 - RNA, 13 nt, Human adenovirus E
ucaugcccgccuc

SEQ ID NO: 3937105 - RNA, 17 nt, Human adenovirus E
ucauguacgccagcaac

SEQ ID NO: 3937106 - RNA, 16 nt, Human adenovirus E
  misc_feature (7)..(7): n is a, c, g or u
ucauuanuccagcaga

SEQ ID NO: 3937107 - RNA, 20 nt, Human adenovirus E
ucauugccgucauucaugga

SEQ ID NO: 3937108 - RNA, 21 nt, Human adenovirus E
ucauuuccggguucccacgcu

SEQ ID NO: 3937109 - RNA, 14 nt, Human adenovirus E
ucauuuuuccagcc

SEQ ID NO: 3937110 - RNA, 16 nt, Human adenovirus E
uccaagaccccauagc

SEQ ID NO: 3937111 - RNA, 17 nt, Human adenovirus E
uccacgagcgccagcug

SEQ ID NO: 3937112 - RNA, 22 nt, Human adenovirus E
uccacgguggcuuccagcaaag

SEQ ID NO: 3937113 - RNA, 20 nt, Human adenovirus E
uccacugucgagagccacac

SEQ ID NO: 3937114 - RNA, 16 nt, Human adenovirus E
uccagaaaaagccaca

SEQ ID NO: 3937115 - RNA, 15 nt, Human adenovirus E
uccagcaccaggcag

SEQ ID NO: 3937116 - RNA, 23 nt, Human adenovirus E
uccagcggcggagcggcaucucg

SEQ ID NO: 3937117 - RNA, 18 nt, Human adenovirus E
uccagggacucccucagc

SEQ ID NO: 3937118 - RNA, 17 nt, Human adenovirus E
uccaucgcuuacagccu

SEQ ID NO: 3937119 - RNA, 16 nt, Human adenovirus E
ucccaagaucuucgag

SEQ ID NO: 3937120 - RNA, 23 nt, Human adenovirus E
ucccaagaucuucgagggucugg

SEQ ID NO: 3937121 - RNA, 11 nt, Human adenovirus E
ucccacugcua

SEQ ID NO: 3937122 - RNA, 21 nt, Human adenovirus E
uccccaaauucaaacaccuca

SEQ ID NO: 3937123 - RNA, 20 nt, Human adenovirus E
  misc_feature (7)..(7): n is a, c, g or u
uccccgnuacuaacaaccaa

SEQ ID NO: 3937124 - RNA, 17 nt, Human adenovirus E
uccccucuucccagcuc

SEQ ID NO: 3937125 - RNA, 23 nt, Human adenovirus E
ucccggaggaggggggccaccuc

SEQ ID NO: 3937126 - RNA, 18 nt, Human adenovirus E
ucccgguaccacaucacc

SEQ ID NO: 3937127 - RNA, 17 nt, Human adenovirus E
ucccucguacgagagcg

SEQ ID NO: 3937128 - RNA, 21 nt, Human adenovirus E
ucccugagcuccucccucagc

SEQ ID NO: 3937129 - RNA, 18 nt, Human adenovirus E
ucccuggccugcaacccc

SEQ ID NO: 3937130 - RNA, 20 nt, Human adenovirus E
uccgcugggugacaaagagc

SEQ ID NO: 3937131 - RNA, 23 nt, Human adenovirus E
uccggaauccugcccgccaccug

SEQ ID NO: 3937132 - RNA, 16 nt, Human adenovirus E
uccggcaccgcuucca

SEQ ID NO: 3937133 - RNA, 14 nt, Human adenovirus E
uccggccgcgaggg

SEQ ID NO: 3937134 - RNA, 15 nt, Human adenovirus E
uccgggccggacuac

SEQ ID NO: 3937135 - RNA, 15 nt, Human adenovirus E
uccgggucucggcau

SEQ ID NO: 3937136 - RNA, 20 nt, Human adenovirus E
uccgucaagcugcugcucag

SEQ ID NO: 3937137 - RNA, 16 nt, Human adenovirus E
uccguggcggugcagg

SEQ ID NO: 3937138 - RNA, 19 nt, Human adenovirus E
uccuaggccuuuuaauuuu

SEQ ID NO: 3937139 - RNA, 14 nt, Human adenovirus E
uccuccacccuccc

SEQ ID NO: 3937140 - RNA, 16 nt, Human adenovirus E
uccucccucagcaaua

SEQ ID NO: 3937141 - RNA, 11 nt, Human adenovirus E
uccuccuccac

SEQ ID NO: 3937142 - RNA, 17 nt, Human adenovirus E
uccuccucguagaggaa

SEQ ID NO: 3937143 - RNA, 16 nt, Human adenovirus E
uccugaauccccacug

SEQ ID NO: 3937144 - RNA, 14 nt, Human adenovirus E
uccugcacaggcag

SEQ ID NO: 3937145 - RNA, 16 nt, Human adenovirus E
uccugcacaggcagca

SEQ ID NO: 3937146 - RNA, 17 nt, Human adenovirus E
uccugcacaggcagcaa

SEQ ID NO: 3937147 - RNA, 21 nt, Human adenovirus E
uccugcccgcgcugaucccca

SEQ ID NO: 3937148 - RNA, 16 nt, Human adenovirus E
ucgaaggcgggcauga

SEQ ID NO: 3937149 - RNA, 18 nt, Human adenovirus E
ucgacgccaucagcgagu

SEQ ID NO: 3937150 - RNA, 21 nt, Human adenovirus E
ucgagcuugguggcgaaggag

SEQ ID NO: 3937151 - RNA, 19 nt, Human adenovirus E
ucgaggagaaccugcacua

SEQ ID NO: 3937152 - RNA, 22 nt, Human adenovirus E
ucgagggggaacccguccugau

SEQ ID NO: 3937153 - RNA, 17 nt, Human adenovirus E
ucgauggugaagaugcc

SEQ ID NO: 3937154 - RNA, 19 nt, Human adenovirus E
ucgcacuccacgagccagg

SEQ ID NO: 3937155 - RNA, 16 nt, Human adenovirus E
ucgcagaaaaugaugc

SEQ ID NO: 3937156 - RNA, 17 nt, Human adenovirus E
ucgcaucaggccccgca

SEQ ID NO: 3937157 - RNA, 20 nt, Human adenovirus E
ucgccaaccucgccaucugc

SEQ ID NO: 3937158 - RNA, 23 nt, Human adenovirus E
ucgccgcaccgccgcugcaacca

SEQ ID NO: 3937159 - RNA, 12 nt, Human adenovirus E
ucgcgcaccacc

SEQ ID NO: 3937160 - RNA, 16 nt, Human adenovirus E
ucgcgcacggccagcg

SEQ ID NO: 3937161 - RNA, 17 nt, Human adenovirus E
ucgcgguggggcggcca

SEQ ID NO: 3937162 - RNA, 21 nt, Human adenovirus E
ucgcgguggggcggccagcug

SEQ ID NO: 3937163 - RNA, 15 nt, Human adenovirus E
ucgcuguccacgagc

SEQ ID NO: 3937164 - RNA, 19 nt, Human adenovirus E
ucgcuguccacgagcgcca

SEQ ID NO: 3937165 - RNA, 17 nt, Human adenovirus E
ucggcaccagccaacug

SEQ ID NO: 3937166 - RNA, 13 nt, Human adenovirus E
ucggcgggggaga

SEQ ID NO: 3937167 - RNA, 14 nt, Human adenovirus E
ucggcguuggccau

SEQ ID NO: 3937168 - RNA, 19 nt, Human adenovirus E
ucgugcagaaccccaccag

SEQ ID NO: 3937169 - RNA, 18 nt, Human adenovirus E
ucguucucuccagcacca

SEQ ID NO: 3937170 - RNA, 17 nt, Human adenovirus E
ucguuguuggccagcug

SEQ ID NO: 3937171 - RNA, 16 nt, Human adenovirus E
ucuaaccuguccaccc

SEQ ID NO: 3937172 - RNA, 14 nt, Human adenovirus E
cgcggcgacgaggc

SEQ ID NO: 3937173 - RNA, 13 nt, Human adenovirus E
cgcggcggugccc

SEQ ID NO: 3937174 - RNA, 13 nt, Human adenovirus E
cgcgguaccuggc

SEQ ID NO: 3937175 - RNA, 15 nt, Human adenovirus E
cgcgucgcccaucuc

SEQ ID NO: 3937176 - RNA, 19 nt, Human adenovirus E
cgcgugcacgaagcccugc

SEQ ID NO: 3937177 - RNA, 16 nt, Human adenovirus E
cgcuacaacagcacca

SEQ ID NO: 3937178 - RNA, 16 nt, Human adenovirus E
cgcucagcaccgagga

SEQ ID NO: 3937179 - RNA, 16 nt, Human adenovirus E
cgcucccuggccugca

SEQ ID NO: 3937180 - RNA, 14 nt, Human adenovirus E
cgcucccuggggcg

SEQ ID NO: 3937181 - RNA, 18 nt, Human adenovirus E
cgcuccggaauccugccc

SEQ ID NO: 3937182 - RNA, 22 nt, Human adenovirus E
cgcucgcgguggggcggccagc

SEQ ID NO: 3937183 - RNA, 23 nt, Human adenovirus E
cgcucgcgguggggcggccagcu

SEQ ID NO: 3937184 - RNA, 17 nt, Human adenovirus E
cgcucguagggacugag

SEQ ID NO: 3937185 - RNA, 13 nt, Human adenovirus E
cgcugcagagcca

SEQ ID NO: 3937186 - RNA, 20 nt, Human adenovirus E
cgcugcgcaacggccugccc

SEQ ID NO: 3937187 - RNA, 13 nt, Human adenovirus E
cgcuguccacgag

SEQ ID NO: 3937188 - RNA, 13 nt, Human adenovirus E
cgcuguccuggcu

SEQ ID NO: 3937189 - RNA, 23 nt, Human adenovirus E
cggaauccugcccgccaccugcu

SEQ ID NO: 3937190 - RNA, 13 nt, Human adenovirus E
cggacgagcugac

SEQ ID NO: 3937191 - RNA, 20 nt, Human adenovirus E
cggacgauuggacccaggcc

SEQ ID NO: 3937192 - RNA, 21 nt, Human adenovirus E
cggacgauuggacccaggcca

SEQ ID NO: 3937193 - RNA, 13 nt, Human adenovirus E
cggacgugcagcc

SEQ ID NO: 3937194 - RNA, 13 nt, Human adenovirus E
cggacuuccgugu

SEQ ID NO: 3937195 - RNA, 13 nt, Human adenovirus E
cggagacccugcg

SEQ ID NO: 3937196 - RNA, 22 nt, Human adenovirus E
cggagaguguaccgccgcggcc

SEQ ID NO: 3937197 - RNA, 22 nt, Human adenovirus E
cggagaugccuuucaagagccc

SEQ ID NO: 3937198 - RNA, 15 nt, Human adenovirus E
cggagauguuggaga

SEQ ID NO: 3937199 - RNA, 21 nt, Human adenovirus E
cggagauguuggagauggcga

SEQ ID NO: 3937200 - RNA, 12 nt, Human adenovirus E
cggagcacgagg

SEQ ID NO: 3937201 - RNA, 22 nt, Human adenovirus E
cggagcacgaggaggagcuggc

SEQ ID NO: 3937202 - RNA, 15 nt, Human adenovirus E
cggaggccagcaccc

SEQ ID NO: 3937203 - RNA, 21 nt, Human adenovirus E
cggaggccagcacccagacca

SEQ ID NO: 3937204 - RNA, 17 nt, Human adenovirus E
cggaucucgcucagguc

SEQ ID NO: 3937205 - RNA, 14 nt, Human adenovirus E
cggauggcuggcag

SEQ ID NO: 3937206 - RNA, 13 nt, Human adenovirus E
cggcacucagguu

SEQ ID NO: 3937207 - RNA, 15 nt, Human adenovirus E
cggcaggccaccauc

SEQ ID NO: 3937208 - RNA, 12 nt, Human adenovirus E
cggcccucagca

SEQ ID NO: 3937209 - RNA, 12 nt, Human adenovirus E
cggccgccguga

SEQ ID NO: 3937210 - RNA, 23 nt, Human adenovirus E
cggccgccgugagcggggcugga

SEQ ID NO: 3937211 - RNA, 18 nt, Human adenovirus E
cggccggauuccgcggcu

SEQ ID NO: 3937212 - RNA, 22 nt, Human adenovirus E
cggccggauuccgcggcuaacg

SEQ ID NO: 3937213 - RNA, 14 nt, Human adenovirus E
cggccucggugcac

SEQ ID NO: 3937214 - RNA, 22 nt, Human adenovirus E
cggccugcgucaucacccaggg

SEQ ID NO: 3937215 - RNA, 22 nt, Human adenovirus E
cggcgaaguugaaaaacuggga

SEQ ID NO: 3937216 - RNA, 13 nt, Human adenovirus E
cggcgacgaggcc

SEQ ID NO: 3937217 - RNA, 13 nt, Human adenovirus E
cggcgaggagccc

SEQ ID NO: 3937218 - RNA, 16 nt, Human adenovirus E
cggcgcaaacccggga

SEQ ID NO: 3937219 - RNA, 21 nt, Human adenovirus E
cggcgcaaacccgggagcuga

SEQ ID NO: 3937220 - RNA, 22 nt, Human adenovirus E
cggcgcagcuguuccugguggu

SEQ ID NO: 3937221 - RNA, 14 nt, Human adenovirus E
cggcgcccgccuac

SEQ ID NO: 3937222 - RNA, 19 nt, Human adenovirus E
cggcgcgccaucagcaagc

SEQ ID NO: 3937223 - RNA, 20 nt, Human adenovirus E
cggcgcgcuccacgguggcc

SEQ ID NO: 3937224 - RNA, 13 nt, Human adenovirus E
cggcgcggccagc

SEQ ID NO: 3937225 - RNA, 12 nt, Human adenovirus E
cggcggcagcag

SEQ ID NO: 3937226 - RNA, 16 nt, Human adenovirus E
cggcgggcgcagcagc

SEQ ID NO: 3937227 - RNA, 17 nt, Human adenovirus E
cggcggugcccgaggcc

SEQ ID NO: 3937228 - RNA, 22 nt, Human adenovirus E
cggcuggugauccggggcagaa

SEQ ID NO: 3937229 - RNA, 13 nt, Human adenovirus E
cgggagcugagga

SEQ ID NO: 3937230 - RNA, 16 nt, Human adenovirus E
cgggagcugcggcgcg

SEQ ID NO: 3937231 - RNA, 13 nt, Human adenovirus E
cgggcacucccgc

SEQ ID NO: 3937232 - RNA, 16 nt, Human adenovirus E
cgggcacucccgcauc

SEQ ID NO: 3937233 - RNA, 13 nt, Human adenovirus E
cgggcacuuccgc

SEQ ID NO: 3937234 - RNA, 22 nt, Human adenovirus E
cgggcaugggcguguggcagca

SEQ ID NO: 3937235 - RNA, 20 nt, Human adenovirus E
cgggccgcgaacgcucugca

SEQ ID NO: 3937236 - RNA, 13 nt, Human adenovirus E
cgggcggcagggg

SEQ ID NO: 3937237 - RNA, 17 nt, Human adenovirus E
  misc_feature (6)..(6): n is a, c, g or u
cgggcnugggcgugcag

SEQ ID NO: 3937238 - RNA, 17 nt, Human adenovirus E
cggggccgggaccgagg

SEQ ID NO: 3937239 - RNA, 20 nt, Human adenovirus E
cggggcuguggaccucggcc

SEQ ID NO: 3937240 - RNA, 22 nt, Human adenovirus E
cgggggcguaggcguccgcgcc

SEQ ID NO: 3937241 - RNA, 18 nt, Human adenovirus E
cggggugucggggaagga

SEQ ID NO: 3937242 - RNA, 20 nt, Human adenovirus E
cggguccaccuuuuccaggg

SEQ ID NO: 3937243 - RNA, 21 nt, Human adenovirus E
cgggugaaugacauccgcgcc

SEQ ID NO: 3937244 - RNA, 18 nt, Human adenovirus E
cgggugauggucucccgc

SEQ ID NO: 3937245 - RNA, 18 nt, Human adenovirus E
cggguucgugcgccaggc

SEQ ID NO: 3937246 - RNA, 23 nt, Human adenovirus E
cggguucgugcgccaggccugca

SEQ ID NO: 3937247 - RNA, 16 nt, Human adenovirus E
cggucaacuccuccuc

SEQ ID NO: 3937248 - RNA, 12 nt, Human adenovirus E
cggucagggaga

SEQ ID NO: 3937249 - RNA, 15 nt, Human adenovirus E
cggucagggagauga

SEQ ID NO: 3937250 - RNA, 13 nt, Human adenovirus E
cggucccccaccc

SEQ ID NO: 3937251 - RNA, 12 nt, Human adenovirus E
cgguccuccucg

SEQ ID NO: 3937252 - RNA, 14 nt, Human adenovirus E
cggucggggaccgc

SEQ ID NO: 3937253 - RNA, 18 nt, Human adenovirus E
cggucguuguccaccagc

SEQ ID NO: 3937254 - RNA, 18 nt, Human adenovirus E
cggugcacccgugcagcc

SEQ ID NO: 3937255 - RNA, 15 nt, Human adenovirus E
cggugcgcugguggc

SEQ ID NO: 3937256 - RNA, 20 nt, Human adenovirus E
cggugcgcugguggcggugu

SEQ ID NO: 3937257 - RNA, 16 nt, Human adenovirus E
cgguggggcggccagc

SEQ ID NO: 3937258 - RNA, 23 nt, Human adenovirus E
cggugugcgcgugcccgugcgca

SEQ ID NO: 3937259 - RNA, 16 nt, Human adenovirus E
cgguuguaccuggugg

SEQ ID NO: 3937260 - RNA, 19 nt, Human adenovirus E
cguaccagauccucaggua

SEQ ID NO: 3937261 - RNA, 23 nt, Human adenovirus E
cguacgagagcgugaugcagcag

SEQ ID NO: 3937262 - RNA, 17 nt, Human adenovirus E
cguacugcggcagaugc

SEQ ID NO: 3937263 - RNA, 19 nt, Human adenovirus E
cguacuugcuguagcagaa

SEQ ID NO: 3937264 - RNA, 14 nt, Human adenovirus E
cguaggccugggcg

SEQ ID NO: 3937265 - RNA, 12 nt, Human adenovirus E
cguaggugagcu

SEQ ID NO: 3937266 - RNA, 19 nt, Human adenovirus E
cguaugcgcaggagcacag

SEQ ID NO: 3937267 - RNA, 15 nt, Human adenovirus E
cgucaucgacagcgu

SEQ ID NO: 3937268 - RNA, 21 nt, Human adenovirus E
cguccgcccuugcgcgagcag

SEQ ID NO: 3937269 - RNA, 14 nt, Human adenovirus E
cguccgcgccgcag

SEQ ID NO: 3937270 - RNA, 19 nt, Human adenovirus E
cgucgccggcggcgcacgg

SEQ ID NO: 3937271 - RNA, 15 nt, Human adenovirus E
cgucggccaugggca

SEQ ID NO: 3937272 - RNA, 19 nt, Human adenovirus E
cgucuaccucuaccucugc

SEQ ID NO: 3937273 - RNA, 22 nt, Human adenovirus E
cgucuccugcuugcaggccugc

SEQ ID NO: 3937274 - RNA, 23 nt, Human adenovirus E
cgucuggugcggcgggcgcagca

SEQ ID NO: 3937275 - RNA, 23 nt, Human adenovirus E
cgugagccgcgcccugggccagg

SEQ ID NO: 3937276 - RNA, 17 nt, Human adenovirus E
cgugagcggggcuggac

SEQ ID NO: 3937277 - RNA, 16 nt, Human adenovirus E
cgugaggcgcgcgcag

SEQ ID NO: 3937278 - RNA, 15 nt, Human adenovirus E
cgugcacgcagcagc

SEQ ID NO: 3937279 - RNA, 19 nt, Human adenovirus E
cgugcagaccaaccuggac

SEQ ID NO: 3937280 - RNA, 15 nt, Human adenovirus E
cgugcagcagaucua

SEQ ID NO: 3937281 - RNA, 17 nt, Human adenovirus E
cgugcagcggcagauca

SEQ ID NO: 3937282 - RNA, 21 nt, Human adenovirus E
cgugcaggcaccgcagcuugc

SEQ ID NO: 3937283 - RNA, 15 nt, Human adenovirus E
cgugcccaagcagaa

SEQ ID NO: 3937284 - RNA, 21 nt, Human adenovirus E
cgugccccccaagcgccagcc

SEQ ID NO: 3937285 - RNA, 16 nt, Human adenovirus E
cgugccccggggccag

SEQ ID NO: 3937286 - RNA, 14 nt, Human adenovirus E
cgugcgcuccugga

SEQ ID NO: 3937287 - RNA, 14 nt, Human adenovirus E
cgugcguacccgga

SEQ ID NO: 3937288 - RNA, 14 nt, Human adenovirus E
cgugcucgggggug

SEQ ID NO: 3937289 - RNA, 20 nt, Human adenovirus E
cgugcucuuugccuucacca

SEQ ID NO: 3937290 - RNA, 17 nt, Human adenovirus E
cguggaggagcucagcc

SEQ ID NO: 3937291 - RNA, 15 nt, Human adenovirus E
guccagaaaaagcca

SEQ ID NO: 3937292 - RNA, 17 nt, Human adenovirus E
guccagcgcagccaggg

SEQ ID NO: 3937293 - RNA, 11 nt, Human adenovirus E
guccaggccag

SEQ ID NO: 3937294 - RNA, 12 nt, Human adenovirus E
guccaggccagc

SEQ ID NO: 3937295 - RNA, 12 nt, Human adenovirus E
gucccacugcua

SEQ ID NO: 3937296 - RNA, 14 nt, Human adenovirus E
gucccccacccagu

SEQ ID NO: 3937297 - RNA, 16 nt, Human adenovirus E
gucccugcucguccuc

SEQ ID NO: 3937298 - RNA, 13 nt, Human adenovirus E
gucccuggcuccg

SEQ ID NO: 3937299 - RNA, 18 nt, Human adenovirus E
guccgcccgcccgcgccc

SEQ ID NO: 3937300 - RNA, 17 nt, Human adenovirus E
guccggguccagggacu

SEQ ID NO: 3937301 - RNA, 20 nt, Human adenovirus E
gucgagcgcgagcaaggaca

SEQ ID NO: 3937302 - RNA, 14 nt, Human adenovirus E
gucgcagggggcca

SEQ ID NO: 3937303 - RNA, 17 nt, Human adenovirus E
gucgcagggggccacga

SEQ ID NO: 3937304 - RNA, 14 nt, Human adenovirus E
gucgccgcaccgcc

SEQ ID NO: 3937305 - RNA, 16 nt, Human adenovirus E
gucgggggggucggca

SEQ ID NO: 3937306 - RNA, 12 nt, Human adenovirus E
gucuccaugagc

SEQ ID NO: 3937307 - RNA, 16 nt, Human adenovirus E
gucucgccgcgccggc

SEQ ID NO: 3937308 - RNA, 20 nt, Human adenovirus E
gucucuucgggggcagaggc

SEQ ID NO: 3937309 - RNA, 22 nt, Human adenovirus E
gucuggaggaagacgaggagga

SEQ ID NO: 3937310 - RNA, 15 nt, Human adenovirus E
gucuggaggagcaga

SEQ ID NO: 3937311 - RNA, 19 nt, Human adenovirus E
gucuggcccgugaggcgcg

SEQ ID NO: 3937312 - RNA, 16 nt, Human adenovirus E
gucuggugcggcgggc

SEQ ID NO: 3937313 - RNA, 15 nt, Human adenovirus E
gucugugccacccuc

SEQ ID NO: 3937314 - RNA, 18 nt, Human adenovirus E
gugaagaccgcguaguug

SEQ ID NO: 3937315 - RNA, 18 nt, Human adenovirus E
gugaccuugcagcaggug

SEQ ID NO: 3937316 - RNA, 22 nt, Human adenovirus E
gugacgcaguagaaggugcggg

SEQ ID NO: 3937317 - RNA, 19 nt, Human adenovirus E
gugagcggggcuggacaga

SEQ ID NO: 3937318 - RNA, 18 nt, Human adenovirus E
gugauccggggcagaagc

SEQ ID NO: 3937319 - RNA, 21 nt, Human adenovirus E
gugcaaccggugcugagaccc

SEQ ID NO: 3937320 - RNA, 22 nt, Human adenovirus E
gugcacgaagcccugcaggaag

SEQ ID NO: 3937321 - RNA, 18 nt, Human adenovirus E
gugcagcagaagcguggg

SEQ ID NO: 3937322 - RNA, 16 nt, Human adenovirus E
gugcagccacagcgcg

SEQ ID NO: 3937323 - RNA, 13 nt, Human adenovirus E
gugccccagggca

SEQ ID NO: 3937324 - RNA, 14 nt, Human adenovirus E
gugccccagggcau

SEQ ID NO: 3937325 - RNA, 20 nt, Human adenovirus E
gugcccccgcgguaccuggc

SEQ ID NO: 3937326 - RNA, 16 nt, Human adenovirus E
gugccccggggccagg

SEQ ID NO: 3937327 - RNA, 17 nt, Human adenovirus E
gugccucuuccaugguu

SEQ ID NO: 3937328 - RNA, 14 nt, Human adenovirus E
gugcgagggggcga

SEQ ID NO: 3937329 - RNA, 15 nt, Human adenovirus E
gugcgcgccgggcug

SEQ ID NO: 3937330 - RNA, 17 nt, Human adenovirus E
gugcgcuucaggcucau

SEQ ID NO: 3937331 - RNA, 19 nt, Human adenovirus E
gugcucgcaacgcugcacg

SEQ ID NO: 3937332 - RNA, 17 nt, Human adenovirus E
gugcucggggguggugu

SEQ ID NO: 3937333 - RNA, 17 nt, Human adenovirus E
gugcuguguugcugguu

SEQ ID NO: 3937334 - RNA, 14 nt, Human adenovirus E
guggaccucggccu

SEQ ID NO: 3937335 - RNA, 23 nt, Human adenovirus E
guggaccuggccaaccaggccgu

SEQ ID NO: 3937336 - RNA, 14 nt, Human adenovirus E
guggagcuaccagc

SEQ ID NO: 3937337 - RNA, 15 nt, Human adenovirus E
guggagcuaccagcc

SEQ ID NO: 3937338 - RNA, 17 nt, Human adenovirus E
guggcacgacaggcagc

SEQ ID NO: 3937339 - RNA, 22 nt, Human adenovirus E
guggcagcggccgaggcggcug

SEQ ID NO: 3937340 - RNA, 21 nt, Human adenovirus E
guggccagaucguccagggca

SEQ ID NO: 3937341 - RNA, 12 nt, Human adenovirus E
guggccuggagg

SEQ ID NO: 3937342 - RNA, 13 nt, Human adenovirus E
guggcgcagcuga

SEQ ID NO: 3937343 - RNA, 18 nt, Human adenovirus E
guggcggugcaggccucu

SEQ ID NO: 3937344 - RNA, 23 nt, Human adenovirus E
guggcucugccuuggcaguacag

SEQ ID NO: 3937345 - RNA, 21 nt, Human adenovirus E
gugggcuuggauguugaggua

SEQ ID NO: 3937346 - RNA, 20 nt, Human adenovirus E
guggucagcgacgagcagcu

SEQ ID NO: 3937347 - RNA, 21 nt, Human adenovirus E
guggucagcgacgagcagcug

SEQ ID NO: 3937348 - RNA, 17 nt, Human adenovirus E
guggucagcucgucggg

SEQ ID NO: 3937349 - RNA, 23 nt, Human adenovirus E
gugguccuggugaccguggagcu

SEQ ID NO: 3937350 - RNA, 15 nt, Human adenovirus E
guggucggccuggcc

SEQ ID NO: 3937351 - RNA, 18 nt, Human adenovirus E
guggugcccccuccagaa

SEQ ID NO: 3937352 - RNA, 21 nt, Human adenovirus E
gugguggcgggggagggggcc

SEQ ID NO: 3937353 - RNA, 20 nt, Human adenovirus E
  misc_feature (6)..(6): n is a, c, g or u
guguangccacgugaccggg

SEQ ID NO: 3937354 - RNA, 17 nt, Human adenovirus E
gugucccagcggcgagg

SEQ ID NO: 3937355 - RNA, 17 nt, Human adenovirus E
gugucccugaccaugac

SEQ ID NO: 3937356 - RNA, 18 nt, Human adenovirus E
guguccggggcugcuagu

SEQ ID NO: 3937357 - RNA, 19 nt, Human adenovirus E
gugugccgcgguccuccuc

SEQ ID NO: 3937358 - RNA, 13 nt, Human adenovirus E
guguugaugaugc

SEQ ID NO: 3937359 - RNA, 22 nt, Human adenovirus E
guuacaccugcccuggagauga

SEQ ID NO: 3937360 - RNA, 14 nt, Human adenovirus E
guuacgugcagcag

SEQ ID NO: 3937361 - RNA, 13 nt, Human adenovirus E
guucaacagucca

SEQ ID NO: 3937362 - RNA, 21 nt, Human adenovirus E
guuccacgguggcuuccagca

SEQ ID NO: 3937363 - RNA, 14 nt, Human adenovirus E
guuccggagcagcu

SEQ ID NO: 3937364 - RNA, 17 nt, Human adenovirus E
guucgugcccgaggacu

SEQ ID NO: 3937365 - RNA, 19 nt, Human adenovirus E
guugaaaaacugggaguug

SEQ ID NO: 3937366 - RNA, 17 nt, Human adenovirus E
guugcaagggcccagcg

SEQ ID NO: 3937367 - RNA, 14 nt, Human adenovirus E
guuggccagcugca

SEQ ID NO: 3937368 - RNA, 14 nt, Human adenovirus E
guugugguccuggg

SEQ ID NO: 3937369 - RNA, 15 nt, Human adenovirus E
guuucaauguggauc

SEQ ID NO: 3937370 - RNA, 14 nt, Human adenovirus E
guuuccacagcucg

SEQ ID NO: 3937371 - RNA, 21 nt, Human adenovirus E
guuuccacaucguaggugagg

SEQ ID NO: 3937372 - RNA, 15 nt, Human adenovirus E
uaaaauuaacaauua

SEQ ID NO: 3937373 - RNA, 21 nt, Human adenovirus E
uaaagauggaaaauuauccuu

SEQ ID NO: 3937374 - RNA, 19 nt, Human adenovirus E
  misc_feature (10)..(10): n is a, c, g or u
uaaaucagcnuaccaccac

SEQ ID NO: 3937375 - RNA, 21 nt, Human adenovirus E
  misc_feature (10)..(10): n is a, c, g or u
uaaaucagcnuaccaccacua

SEQ ID NO: 3937376 - RNA, 14 nt, Human adenovirus E
uaaauuuuugcuuu

SEQ ID NO: 3937377 - RNA, 15 nt, Human adenovirus E
uaacauuuuugccau

SEQ ID NO: 3937378 - RNA, 12 nt, Human adenovirus E
uaacuggacaga

SEQ ID NO: 3937379 - RNA, 18 nt, Human adenovirus E
uaagaaaaucaacaaaag

SEQ ID NO: 3937380 - RNA, 14 nt, Human adenovirus E
uaaguguugaauuu

SEQ ID NO: 3937381 - RNA, 14 nt, Human adenovirus E
uaaucacacacgcc

SEQ ID NO: 3937382 - RNA, 20 nt, Human adenovirus E
uaaucuuaccauugucaaug

SEQ ID NO: 3937383 - RNA, 15 nt, Human adenovirus E
uacacagacaaccac

SEQ ID NO: 3937384 - RNA, 23 nt, Human adenovirus E
uacaccaacuucaucagcgcccu

SEQ ID NO: 3937385 - RNA, 12 nt, Human adenovirus E
uacaccacccuc

SEQ ID NO: 3937386 - RNA, 17 nt, Human adenovirus E
uacagaaagcacagacu

SEQ ID NO: 3937387 - RNA, 17 nt, Human adenovirus E
uaccaccacuacagccu

SEQ ID NO: 3937388 - RNA, 22 nt, Human adenovirus E
uaccaccacuacagccuaggcc

SEQ ID NO: 3937389 - RNA, 12 nt, Human adenovirus E
uaccacccacac

SEQ ID NO: 3937390 - RNA, 19 nt, Human adenovirus E
uaccaggaaauuccccagc

SEQ ID NO: 3937391 - RNA, 16 nt, Human adenovirus E
uaccaguccgggccgg

SEQ ID NO: 3937392 - RNA, 17 nt, Human adenovirus E
uaccccaccaugcagcu

SEQ ID NO: 3937393 - RNA, 18 nt, Human adenovirus E
uaccccuacacaugauca

SEQ ID NO: 3937394 - RNA, 16 nt, Human adenovirus E
uaccccuacgaugcag

SEQ ID NO: 3937395 - RNA, 16 nt, Human adenovirus E
uacccggaggguccuc

SEQ ID NO: 3937396 - RNA, 14 nt, Human adenovirus E
uacccguggaucau

SEQ ID NO: 3937397 - RNA, 16 nt, Human adenovirus E
uacccuucucccaggc

SEQ ID NO: 3937398 - RNA, 20 nt, Human adenovirus E
uaccgcccagaucccgccug

SEQ ID NO: 3937399 - RNA, 16 nt, Human adenovirus E
uaccuagccuacaacu

SEQ ID NO: 3937400 - RNA, 18 nt, Human adenovirus E
uaccuccagugccuucuc

SEQ ID NO: 3937401 - RNA, 12 nt, Human adenovirus E
uaccucuucagg

SEQ ID NO: 3937402 - RNA, 18 nt, Human adenovirus E
uacgauaccacccgguug

SEQ ID NO: 3937403 - RNA, 22 nt, Human adenovirus E
uacgauauguggccccccacga

SEQ ID NO: 3937404 - RNA, 19 nt, Human adenovirus E
uacgcccgcgccaagagcc

SEQ ID NO: 3937405 - RNA, 19 nt, Human adenovirus E
uacgcgcugcauccuucca

SEQ ID NO: 3937406 - RNA, 17 nt, Human adenovirus E
uacuaaaaauaauauag

SEQ ID NO: 3937407 - RNA, 16 nt, Human adenovirus E
uacucacaccacacac

SEQ ID NO: 3937408 - RNA, 21 nt, Human adenovirus E
uacucgcagaaaaugaugcaa

SEQ ID NO: 3937409 - RNA, 19 nt, Human adenovirus E
uacucuuucauauccucuc

SEQ ID NO: 3937410 - RNA, 17 nt, Human adenovirus E
ucuacguuuugaugcaa

SEQ ID NO: 3937411 - RNA, 15 nt, Human adenovirus E
ucuacuuccuccuca

SEQ ID NO: 3937412 - RNA, 16 nt, Human adenovirus E
ucuaugcaauucugac

SEQ ID NO: 3937413 - RNA, 22 nt, Human adenovirus E
ucuaugccaucuuccagcagag

SEQ ID NO: 3937414 - RNA, 18 nt, Human adenovirus E
ucucagaccgugcagcag

SEQ ID NO: 3937415 - RNA, 18 nt, Human adenovirus E
ucuccggcucccccggcc

SEQ ID NO: 3937416 - RNA, 23 nt, Human adenovirus E
ucuccugccaccaauuggaggaa

SEQ ID NO: 3937417 - RNA, 13 nt, Human adenovirus E
ucucgauccagca

SEQ ID NO: 3937418 - RNA, 15 nt, Human adenovirus E
ucucgauccagcaga

SEQ ID NO: 3937419 - RNA, 12 nt, Human adenovirus E
ucucgccgccgc

SEQ ID NO: 3937420 - RNA, 17 nt, Human adenovirus E
ucugaaccugcccccca

SEQ ID NO: 3937421 - RNA, 18 nt, Human adenovirus E
ucugcaagcuccugcaga

SEQ ID NO: 3937422 - RNA, 14 nt, Human adenovirus E
ucugcccccgcccc

SEQ ID NO: 3937423 - RNA, 20 nt, Human adenovirus E
ucugcccccgccccagcagc

SEQ ID NO: 3937424 - RNA, 12 nt, Human adenovirus E
ucuggaggagca

SEQ ID NO: 3937425 - RNA, 12 nt, Human adenovirus E
ucugugccaccc

SEQ ID NO: 3937426 - RNA, 13 nt, Human adenovirus E
ucuguugagcugg

SEQ ID NO: 3937427 - RNA, 12 nt, Human adenovirus E
ucuuccagacca

SEQ ID NO: 3937428 - RNA, 15 nt, Human adenovirus E
ucuucuuccuccucc

SEQ ID NO: 3937429 - RNA, 22 nt, Human adenovirus E
ucuugcgggguuucuucuuggg

SEQ ID NO: 3937430 - RNA, 17 nt, Human adenovirus E
ucuuucauauccucucc

SEQ ID NO: 3937431 - RNA, 16 nt, Human adenovirus E
ugaaaacaccaccugg

SEQ ID NO: 3937432 - RNA, 13 nt, Human adenovirus E
ugaaacccuccgg

SEQ ID NO: 3937433 - RNA, 19 nt, Human adenovirus E
ugaacacuguaucccaccc

SEQ ID NO: 3937434 - RNA, 20 nt, Human adenovirus E
ugaacaguauccgcagcagc

SEQ ID NO: 3937435 - RNA, 21 nt, Human adenovirus E
ugaacgccugcugggccuugg

SEQ ID NO: 3937436 - RNA, 20 nt, Human adenovirus E
ugaacucggggaucagcagu

SEQ ID NO: 3937437 - RNA, 21 nt, Human adenovirus E
ugaagcacaaaauucucaggu

SEQ ID NO: 3937438 - RNA, 17 nt, Human adenovirus E
ugaaggggacgagcugc

SEQ ID NO: 3937439 - RNA, 17 nt, Human adenovirus E
ugaccaccguggugcag

SEQ ID NO: 3937440 - RNA, 19 nt, Human adenovirus E
ugaccccgaugaccggcug

SEQ ID NO: 3937441 - RNA, 13 nt, Human adenovirus E
ugaccggcugcag

SEQ ID NO: 3937442 - RNA, 16 nt, Human adenovirus E
ugaccuugcagcaggu

SEQ ID NO: 3937443 - RNA, 19 nt, Human adenovirus E
ugacgccgaacucgcgccu

SEQ ID NO: 3937444 - RNA, 15 nt, Human adenovirus E
ugacguccugcagga

SEQ ID NO: 3937445 - RNA, 18 nt, Human adenovirus E
ugagaaaagcaaggagga

SEQ ID NO: 3937446 - RNA, 17 nt, Human adenovirus E
ugagacccggcaccacc

SEQ ID NO: 3937447 - RNA, 20 nt, Human adenovirus E
cugccgcgccaaccgcaccc

SEQ ID NO: 3937448 - RNA, 17 nt, Human adenovirus E
cugccguccucccggag

SEQ ID NO: 3937449 - RNA, 12 nt, Human adenovirus E
cugcgcccggag

SEQ ID NO: 3937450 - RNA, 15 nt, Human adenovirus E
cugcggcguggagca

SEQ ID NO: 3937451 - RNA, 23 nt, Human adenovirus E
cugcgggguggacuucaccgaga

SEQ ID NO: 3937452 - RNA, 13 nt, Human adenovirus E
cugcucaggcucc

SEQ ID NO: 3937453 - RNA, 18 nt, Human adenovirus E
cugcucgagugccacugc

SEQ ID NO: 3937454 - RNA, 16 nt, Human adenovirus E
cugcugcugcuggugg

SEQ ID NO: 3937455 - RNA, 17 nt, Human adenovirus E
cugcugcugcugguggc

SEQ ID NO: 3937456 - RNA, 23 nt, Human adenovirus E
cugcuggaggccaucgugcagaa

SEQ ID NO: 3937457 - RNA, 20 nt, Human adenovirus E
cugcuguuagugcucccccg

SEQ ID NO: 3937458 - RNA, 17 nt, Human adenovirus E
cuggaagaagcagaaga

SEQ ID NO: 3937459 - RNA, 15 nt, Human adenovirus E
cuggacgcugcucac

SEQ ID NO: 3937460 - RNA, 16 nt, Human adenovirus E
cuggaggccguggugc

SEQ ID NO: 3937461 - RNA, 14 nt, Human adenovirus E
cuggaucugacgcc

SEQ ID NO: 3937462 - RNA, 14 nt, Human adenovirus E
cuggcagcccagcc

SEQ ID NO: 3937463 - RNA, 14 nt, Human adenovirus E
cuggccaaccaggc

SEQ ID NO: 3937464 - RNA, 16 nt, Human adenovirus E
cuggcccggcaggcca

SEQ ID NO: 3937465 - RNA, 14 nt, Human adenovirus E
cuggcgugagcgac

SEQ ID NO: 3937466 - RNA, 23 nt, Human adenovirus E
cuggcuguuccagggcuccccga

SEQ ID NO: 3937467 - RNA, 16 nt, Human adenovirus E
cugggaccccgugacc

SEQ ID NO: 3937468 - RNA, 16 nt, Human adenovirus E
cugggaguugcgcgcc

SEQ ID NO: 3937469 - RNA, 19 nt, Human adenovirus E
cugggucccggcgcccgcc

SEQ ID NO: 3937470 - RNA, 14 nt, Human adenovirus E
cugguacuuggcca

SEQ ID NO: 3937471 - RNA, 17 nt, Human adenovirus E
cugguacuuggccagcc

SEQ ID NO: 3937472 - RNA, 20 nt, Human adenovirus E
cuggugaacauucugcagag

SEQ ID NO: 3937473 - RNA, 17 nt, Human adenovirus E
cugguggacaagaugag

SEQ ID NO: 3937474 - RNA, 18 nt, Human adenovirus E
cugguggcgguguugcuu

SEQ ID NO: 3937475 - RNA, 13 nt, Human adenovirus E
cuguaccgcgagg

SEQ ID NO: 3937476 - RNA, 23 nt, Human adenovirus E
cuguccgagaagcuggcggccau

SEQ ID NO: 3937477 - RNA, 16 nt, Human adenovirus E
cugucgagagccacac

SEQ ID NO: 3937478 - RNA, 21 nt, Human adenovirus E
cugugccacccucgcucuggu

SEQ ID NO: 3937479 - RNA, 22 nt, Human adenovirus E
cuguuccugguggugcagcaua

SEQ ID NO: 3937480 - RNA, 15 nt, Human adenovirus E
cuguugaugugaugg

SEQ ID NO: 3937481 - RNA, 22 nt, Human adenovirus E
cuuaaaaccuauggcagcaagg

SEQ ID NO: 3937482 - RNA, 20 nt, Human adenovirus E
cuuagcuuugacaguacagg

SEQ ID NO: 3937483 - RNA, 16 nt, Human adenovirus E
cuucaacaaguacugc

SEQ ID NO: 3937484 - RNA, 14 nt, Human adenovirus E
cuucaauuggagca

SEQ ID NO: 3937485 - RNA, 22 nt, Human adenovirus E
cuucacccccacggaggccagc

SEQ ID NO: 3937486 - RNA, 23 nt, Human adenovirus E
cuucacccccacggaggccagca

SEQ ID NO: 3937487 - RNA, 23 nt, Human adenovirus E
cuucacggacagcggcagcauca

SEQ ID NO: 3937488 - RNA, 23 nt, Human adenovirus E
cuucaggcgccagcgccggcagg

SEQ ID NO: 3937489 - RNA, 17 nt, Human adenovirus E
cuucccaccccacucug

SEQ ID NO: 3937490 - RNA, 17 nt, Human adenovirus E
cuucuacuuccuccuca

SEQ ID NO: 3937491 - RNA, 23 nt, Human adenovirus E
cuucugcccccgccccagcagca

SEQ ID NO: 3937492 - RNA, 21 nt, Human adenovirus E
cuugaacucggggaucagcag

SEQ ID NO: 3937493 - RNA, 14 nt, Human adenovirus E
cuugcaggccugcg

SEQ ID NO: 3937494 - RNA, 13 nt, Human adenovirus E
cuugcauuucaau

SEQ ID NO: 3937495 - RNA, 20 nt, Human adenovirus E
cuugcccuucucgcugaaca

SEQ ID NO: 3937496 - RNA, 11 nt, Human adenovirus E
cuugcugcuau

SEQ ID NO: 3937497 - RNA, 16 nt, Human adenovirus E
cuugcuguagcagaac

SEQ ID NO: 3937498 - RNA, 19 nt, Human adenovirus E
cuuggaggcggcggcagga

SEQ ID NO: 3937499 - RNA, 16 nt, Human adenovirus E
cuugggcggcagcggc

SEQ ID NO: 3937500 - RNA, 21 nt, Human adenovirus E
cuuucauguuacacaugcauc

SEQ ID NO: 3937501 - RNA, 14 nt, Human adenovirus E
cuuugaggaggaga

SEQ ID NO: 3937502 - RNA, 22 nt, Human adenovirus E
cuuuuggucuccacguuccaca

SEQ ID NO: 3937503 - RNA, 13 nt, Human adenovirus E
gaaaaucgcccag

SEQ ID NO: 3937504 - RNA, 23 nt, Human adenovirus E
gaaagcaaguuccggagcagcug

SEQ ID NO: 3937505 - RNA, 20 nt, Human adenovirus E
gaaagccccgcaaaaucaag

SEQ ID NO: 3937506 - RNA, 13 nt, Human adenovirus E
gaaaguggagcug

SEQ ID NO: 3937507 - RNA, 18 nt, Human adenovirus E
gaacacgcugcccacgua

SEQ ID NO: 3937508 - RNA, 17 nt, Human adenovirus E
gaacagcagucaggcag

SEQ ID NO: 3937509 - RNA, 13 nt, Human adenovirus E
gaacagccagagc

SEQ ID NO: 3937510 - RNA, 22 nt, Human adenovirus E
gaacccguccugaucugcacgg

SEQ ID NO: 3937511 - RNA, 16 nt, Human adenovirus E
gaaccugagccaggcu

SEQ ID NO: 3937512 - RNA, 16 nt, Human adenovirus E
gaacgagccggcgcaa

SEQ ID NO: 3937513 - RNA, 18 nt, Human adenovirus E
gaacgccugcugggccuu

SEQ ID NO: 3937514 - RNA, 16 nt, Human adenovirus E
gaacugguugacggcc

SEQ ID NO: 3937515 - RNA, 16 nt, Human adenovirus E
gaacuuuuugcugacc

SEQ ID NO: 3937516 - RNA, 21 nt, Human adenovirus E
gaagacgaaggcgcgcaggcc

SEQ ID NO: 3937517 - RNA, 16 nt, Human adenovirus E
gaagaugccgggcagg

SEQ ID NO: 3937518 - RNA, 17 nt, Human adenovirus E
gaagaugccgggcagga

SEQ ID NO: 3937519 - RNA, 18 nt, Human adenovirus E
gaagcaguaguacagaaa

SEQ ID NO: 3937520 - RNA, 12 nt, Human adenovirus E
ggggcggccagc

SEQ ID NO: 3937521 - RNA, 17 nt, Human adenovirus E
ggggcggcucggggccc

SEQ ID NO: 3937522 - RNA, 14 nt, Human adenovirus E
ggggcgugcaggcc

SEQ ID NO: 3937523 - RNA, 23 nt, Human adenovirus E
gggggacaaagguacccucgauc

SEQ ID NO: 3937524 - RNA, 21 nt, Human adenovirus E
gggggccacccccagcgccgc

SEQ ID NO: 3937525 - RNA, 23 nt, Human adenovirus E
gggggccacgagccggggcagcg

SEQ ID NO: 3937526 - RNA, 22 nt, Human adenovirus E
gggggugcgcucccggcggcgc

SEQ ID NO: 3937527 - RNA, 22 nt, Human adenovirus E
gggucgcugagcccgugcugcu

SEQ ID NO: 3937528 - RNA, 14 nt, Human adenovirus E
gggugacgcaguag

SEQ ID NO: 3937529 - RNA, 14 nt, Human adenovirus E
gggugaugaggucc

SEQ ID NO: 3937530 - RNA, 23 nt, Human adenovirus E
gguaaaucguucucuccagcacc

SEQ ID NO: 3937531 - RNA, 21 nt, Human adenovirus E
gguagcuccauugcagggccu

SEQ ID NO: 3937532 - RNA, 12 nt, Human adenovirus E
ggucgaggagaa

SEQ ID NO: 3937533 - RNA, 18 nt, Human adenovirus E
ggucgcccgucucucagc

SEQ ID NO: 3937534 - RNA, 19 nt, Human adenovirus E
ggucuaaggaaucuucucu

SEQ ID NO: 3937535 - RNA, 21 nt, Human adenovirus E
ggucucaaagcuccgcuugcc

SEQ ID NO: 3937536 - RNA, 18 nt, Human adenovirus E
ggucucccgcaagacccc

SEQ ID NO: 3937537 - RNA, 19 nt, Human adenovirus E
ggucucgaucauugagcac

SEQ ID NO: 3937538 - RNA, 13 nt, Human adenovirus E
ggucugccuuccc

SEQ ID NO: 3937539 - RNA, 16 nt, Human adenovirus E
ggugacccugggccug

SEQ ID NO: 3937540 - RNA, 19 nt, Human adenovirus E
ggugaccguggagcuggag

SEQ ID NO: 3937541 - RNA, 14 nt, Human adenovirus E
ggugaggaagagcc

SEQ ID NO: 3937542 - RNA, 17 nt, Human adenovirus E
ggugauggucucccgca

SEQ ID NO: 3937543 - RNA, 16 nt, Human adenovirus E
ggugcacuuggggaau

SEQ ID NO: 3937544 - RNA, 23 nt, Human adenovirus E
ggugcagacggaucccuggaugc

SEQ ID NO: 3937545 - RNA, 22 nt, Human adenovirus E
ggugcaggagcgcgggcugccg

SEQ ID NO: 3937546 - RNA, 15 nt, Human adenovirus E
ggugcgacugggcuu

SEQ ID NO: 3937547 - RNA, 18 nt, Human adenovirus E
ggugcgaggaugcgagcc

SEQ ID NO: 3937548 - RNA, 17 nt, Human adenovirus E
gguggaauuugagcugc

SEQ ID NO: 3937549 - RNA, 20 nt, Human adenovirus E
gguggacuucaccgagagcc

SEQ ID NO: 3937550 - RNA, 13 nt, Human adenovirus E
gguggugcagcau

SEQ ID NO: 3937551 - RNA, 18 nt, Human adenovirus E
gguucauguugugcagga

SEQ ID NO: 3937552 - RNA, 23 nt, Human adenovirus E
gguuccaccgcgaguccaaccug

SEQ ID NO: 3937553 - RNA, 17 nt, Human adenovirus E
gguucucuaauuccuca

SEQ ID NO: 3937554 - RNA, 18 nt, Human adenovirus E
guaaacgccgguggcacg

SEQ ID NO: 3937555 - RNA, 16 nt, Human adenovirus E
guaagcagugcucagg

SEQ ID NO: 3937556 - RNA, 12 nt, Human adenovirus E
guaagccccaca

SEQ ID NO: 3937557 - RNA, 21 nt, Human adenovirus E
guacaacgcgcugcuggagcg

SEQ ID NO: 3937558 - RNA, 17 nt, Human adenovirus E
guaccaguccgggccgg

SEQ ID NO: 3937559 - RNA, 19 nt, Human adenovirus E
guaccccaccaugcagcug

SEQ ID NO: 3937560 - RNA, 17 nt, Human adenovirus E
guacccucgaucccggg

SEQ ID NO: 3937561 - RNA, 22 nt, Human adenovirus E
guacgagagcgugaugcagcag

SEQ ID NO: 3937562 - RNA, 14 nt, Human adenovirus E
guacgagcagaccg

SEQ ID NO: 3937563 - RNA, 22 nt, Human adenovirus E
guacucuuucauauccucuccg

SEQ ID NO: 3937564 - RNA, 20 nt, Human adenovirus E
guacugcggcagaugcgccc

SEQ ID NO: 3937565 - RNA, 21 nt, Human adenovirus E
guacugcggcagaugcgcccc

SEQ ID NO: 3937566 - RNA, 17 nt, Human adenovirus E
guacuuaguggugcugu

SEQ ID NO: 3937567 - RNA, 19 nt, Human adenovirus E
guacuugaucuccaccgcg

SEQ ID NO: 3937568 - RNA, 13 nt, Human adenovirus E
guacuuggccagc

SEQ ID NO: 3937569 - RNA, 14 nt, Human adenovirus E
guaggccugggcgg

SEQ ID NO: 3937570 - RNA, 14 nt, Human adenovirus E
guauccggugcacu

SEQ ID NO: 3937571 - RNA, 18 nt, Human adenovirus E
guaucguugacggcggcc

SEQ ID NO: 3937572 - RNA, 16 nt, Human adenovirus E
guaugcgaucucgguc

SEQ ID NO: 3937573 - RNA, 15 nt, Human adenovirus E
guaugcgcaggagca

SEQ ID NO: 3937574 - RNA, 23 nt, Human adenovirus E
guauggcaccagacgaugggcgu

SEQ ID NO: 3937575 - RNA, 18 nt, Human adenovirus E
guauugcuauuuuggauc

SEQ ID NO: 3937576 - RNA, 15 nt, Human adenovirus E
gucacccgccccgcc

SEQ ID NO: 3937577 - RNA, 16 nt, Human adenovirus E
gucacccgccccgccc

SEQ ID NO: 3937578 - RNA, 18 nt, Human adenovirus E
gucaccuccacagccccu

SEQ ID NO: 3937579 - RNA, 16 nt, Human adenovirus E
guccaccugcggggcg

SEQ ID NO: 3937580 - RNA, 17 nt, Human adenovirus E
guccacgagcgccagcu

SEQ ID NO: 3937581 - RNA, 18 nt, Human adenovirus E
uaucgccuccuuggaaga

SEQ ID NO: 3937582 - RNA, 22 nt, Human adenovirus E
uaugauugaaaaccaucacaga

SEQ ID NO: 3937583 - RNA, 18 nt, Human adenovirus E
uaugcagggugaugaggu

SEQ ID NO: 3937584 - RNA, 12 nt, Human adenovirus E
uauucuggagca

SEQ ID NO: 3937585 - RNA, 20 nt, Human adenovirus E
uauuuuuccuccacccuccc

SEQ ID NO: 3937586 - RNA, 14 nt, Human adenovirus E
ucaaacgcccaaaa

SEQ ID NO: 3937587 - RNA, 13 nt, Human adenovirus E
ucaaauuccuccu

SEQ ID NO: 3937588 - RNA, 23 nt, Human adenovirus E
ucaacaaaagaaaaauccuccag

SEQ ID NO: 3937589 - RNA, 19 nt, Human adenovirus E
ucaacaauagcacucaacc

SEQ ID NO: 3937590 - RNA, 17 nt, Human adenovirus E
ucaacacgcuccagccg

SEQ ID NO: 3937591 - RNA, 16 nt, Human adenovirus E
ucaacuccuccuccag

SEQ ID NO: 3937592 - RNA, 19 nt, Human adenovirus E
ucaacuucucggugcugag

SEQ ID NO: 3937593 - RNA, 22 nt, Human adenovirus E
ucaagcgcgcgucgcccaucuc

SEQ ID NO: 3937594 - RNA, 16 nt, Human adenovirus E
ucaagggucuguggac

SEQ ID NO: 3937595 - RNA, 13 nt, Human adenovirus E
ucaaugccaccuc

SEQ ID NO: 3937596 - RNA, 17 nt, Human adenovirus E
ucacacacgcccagcac

SEQ ID NO: 3937597 - RNA, 15 nt, Human adenovirus E
ucacaccacacacac

SEQ ID NO: 3937598 - RNA, 23 nt, Human adenovirus E
ucacagaucugcaucucccaggc

SEQ ID NO: 3937599 - RNA, 19 nt, Human adenovirus E
ucacagcucaacagcugag

SEQ ID NO: 3937600 - RNA, 16 nt, Human adenovirus E
ucacaugaccgccuuc

SEQ ID NO: 3937601 - RNA, 14 nt, Human adenovirus E
ucaccaaggccaug

SEQ ID NO: 3937602 - RNA, 14 nt, Human adenovirus E
ucaccaccucccgg

SEQ ID NO: 3937603 - RNA, 19 nt, Human adenovirus E
ucaccccggggcuguggac

SEQ ID NO: 3937604 - RNA, 13 nt, Human adenovirus E
ucacccugcucau

SEQ ID NO: 3937605 - RNA, 23 nt, Human adenovirus E
ucaccgagcccgagggccgcugg

SEQ ID NO: 3937606 - RNA, 17 nt, Human adenovirus E
ucaccuccacagccccu

SEQ ID NO: 3937607 - RNA, 17 nt, Human adenovirus E
ucacgggacccugccgc

SEQ ID NO: 3937608 - RNA, 15 nt, Human adenovirus E
ucacggugaaggggu

SEQ ID NO: 3937609 - RNA, 19 nt, Human adenovirus E
ucagacaugcaucccagcu

SEQ ID NO: 3937610 - RNA, 19 nt, Human adenovirus E
ucagagcgagccagucucg

SEQ ID NO: 3937611 - RNA, 13 nt, Human adenovirus E
ucagcacccagcc

SEQ ID NO: 3937612 - RNA, 15 nt, Human adenovirus E
ucagcaucaucuggg

SEQ ID NO: 3937613 - RNA, 17 nt, Human adenovirus E
ucagccaaucagcgccc

SEQ ID NO: 3937614 - RNA, 18 nt, Human adenovirus E
ucagccaucgccaaccuc

SEQ ID NO: 3937615 - RNA, 14 nt, Human adenovirus E
ucagcgccccgcau

SEQ ID NO: 3937616 - RNA, 15 nt, Human adenovirus E
ucagcgccccgcauc

SEQ ID NO: 3937617 - RNA, 21 nt, Human adenovirus E
ucagcggcucgacuccguggc

SEQ ID NO: 3937618 - RNA, 14 nt, Human adenovirus E
ucaggaugagcuga

SEQ ID NO: 3937619 - RNA, 17 nt, Human adenovirus E
ucaggcagaggaggagg

SEQ ID NO: 3937620 - RNA, 12 nt, Human adenovirus E
ucaggcagcacc

SEQ ID NO: 3937621 - RNA, 22 nt, Human adenovirus E
ucaggcgccagcgccggcagga

SEQ ID NO: 3937622 - RNA, 11 nt, Human adenovirus E
ucaguugcagg

SEQ ID NO: 3937623 - RNA, 22 nt, Human adenovirus E
ucauaguugugguccuggguga

SEQ ID NO: 3937624 - RNA, 19 nt, Human adenovirus E
gaaagagggugcugaggga

SEQ ID NO: 3937625 - RNA, 18 nt, Human adenovirus E
gaacacuguaucccaccc

SEQ ID NO: 3937626 - RNA, 13 nt, Human adenovirus E
gaacaggaagaac

SEQ ID NO: 3937627 - RNA, 17 nt, Human adenovirus E
gaacaugcagccccgga

SEQ ID NO: 3937628 - RNA, 13 nt, Human adenovirus E
gaaccccaccagc

SEQ ID NO: 3937629 - RNA, 17 nt, Human adenovirus E
gaaccgccuggggcaga

SEQ ID NO: 3937630 - RNA, 17 nt, Human adenovirus E
gaacgaccacagcaacu

SEQ ID NO: 3937631 - RNA, 21 nt, Human adenovirus E
gaacgccuuccucagcaccca

SEQ ID NO: 3937632 - RNA, 22 nt, Human adenovirus E
gaacgcuccggaauccugcccg

SEQ ID NO: 3937633 - RNA, 20 nt, Human adenovirus E
gaacucaagggucuguggac

SEQ ID NO: 3937634 - RNA, 18 nt, Human adenovirus E
gaacugguugacggccuu

SEQ ID NO: 3937635 - RNA, 17 nt, Human adenovirus E
gaacuugcagggccugu

SEQ ID NO: 3937636 - RNA, 21 nt, Human adenovirus E
gaagaacucaagggucugugg

SEQ ID NO: 3937637 - RNA, 18 nt, Human adenovirus E
gaagaccccggcgcaagu

SEQ ID NO: 3937638 - RNA, 18 nt, Human adenovirus E
gaagacgaaggcgcgcag

SEQ ID NO: 3937639 - RNA, 17 nt, Human adenovirus E
gaagacguaugcgcagg

SEQ ID NO: 3937640 - RNA, 13 nt, Human adenovirus E
gaagaggcagcag

SEQ ID NO: 3937641 - RNA, 17 nt, Human adenovirus E
gaagaucgcggagaugg

SEQ ID NO: 3937642 - RNA, 22 nt, Human adenovirus E
gaagcccacggccgccagcucc

SEQ ID NO: 3937643 - RNA, 20 nt, Human adenovirus E
gaagccuuuagacagcagcc

SEQ ID NO: 3937644 - RNA, 16 nt, Human adenovirus E
gaaggaaggcagcgac

SEQ ID NO: 3937645 - RNA, 16 nt, Human adenovirus E
gaaguaccucaccugg

SEQ ID NO: 3937646 - RNA, 16 nt, Human adenovirus E
gaagucugcccgcagg

SEQ ID NO: 3937647 - RNA, 21 nt, Human adenovirus E
gaagugggcguggggcagucc

SEQ ID NO: 3937648 - RNA, 15 nt, Human adenovirus E
gaauacaccacccuc

SEQ ID NO: 3937649 - RNA, 12 nt, Human adenovirus E
gaauacaccccc

SEQ ID NO: 3937650 - RNA, 15 nt, Human adenovirus E
gaauacacccccgga

SEQ ID NO: 3937651 - RNA, 20 nt, Human adenovirus E
gaauaucaaaaucucugccg

SEQ ID NO: 3937652 - RNA, 19 nt, Human adenovirus E
gaauaucaccgagcccgag

SEQ ID NO: 3937653 - RNA, 18 nt, Human adenovirus E
gaauccccacuggcuccc

SEQ ID NO: 3937654 - RNA, 19 nt, Human adenovirus E
gaaucuuuauuugauuuuu

SEQ ID NO: 3937655 - RNA, 20 nt, Human adenovirus E
gacaaaaaucagacccacug

SEQ ID NO: 3937656 - RNA, 15 nt, Human adenovirus E
gacacaccaccacag

SEQ ID NO: 3937657 - RNA, 21 nt, Human adenovirus E
gacacuaggaacuucaggcug

SEQ ID NO: 3937658 - RNA, 22 nt, Human adenovirus E
gacagcagcguguucucccccc

SEQ ID NO: 3937659 - RNA, 17 nt, Human adenovirus E
gaccaccguggugcaga

SEQ ID NO: 3937660 - RNA, 20 nt, Human adenovirus E
gaccaccguggugcagaaca

SEQ ID NO: 3937661 - RNA, 18 nt, Human adenovirus E
gaccagcaugaaggggac

SEQ ID NO: 3937662 - RNA, 21 nt, Human adenovirus E
gacccagaucaucggcaccuu

SEQ ID NO: 3937663 - RNA, 20 nt, Human adenovirus E
gacccagccagaugaugcaa

SEQ ID NO: 3937664 - RNA, 18 nt, Human adenovirus E
gacccggacgugcagccc

SEQ ID NO: 3937665 - RNA, 19 nt, Human adenovirus E
gacccggagacgcgcggcc

SEQ ID NO: 3937666 - RNA, 14 nt, Human adenovirus E
gacccugcgcaagg

SEQ ID NO: 3937667 - RNA, 23 nt, Human adenovirus E
gaccgacgcccguccucggcgcu

SEQ ID NO: 3937668 - RNA, 16 nt, Human adenovirus E
gaccgagcuccagcuc

SEQ ID NO: 3937669 - RNA, 13 nt, Human adenovirus E
gaccgugcagcag

SEQ ID NO: 3937670 - RNA, 13 nt, Human adenovirus E
gacgacagcagcg

SEQ ID NO: 3937671 - RNA, 22 nt, Human adenovirus E
gacgacccgggcaaccuggaag

SEQ ID NO: 3937672 - RNA, 14 nt, Human adenovirus E
gacgagcgcucgcg

SEQ ID NO: 3937673 - RNA, 16 nt, Human adenovirus E
gacgagcugcuugccg

SEQ ID NO: 3937674 - RNA, 22 nt, Human adenovirus E
gacgaggauuucgaggcggacg

SEQ ID NO: 3937675 - RNA, 12 nt, Human adenovirus E
gacgcagggcca

SEQ ID NO: 3937676 - RNA, 22 nt, Human adenovirus E
gacgcaguagaaggugcggggg

SEQ ID NO: 3937677 - RNA, 22 nt, Human adenovirus E
gacgcccaggccgaaguccagc

SEQ ID NO: 3937678 - RNA, 22 nt, Human adenovirus E
gacgcccucgggaucgcgggcg

SEQ ID NO: 3937679 - RNA, 14 nt, Human adenovirus E
gacgcgcggccacg

SEQ ID NO: 3937680 - RNA, 12 nt, Human adenovirus E
gacgcuccuggu

SEQ ID NO: 3937681 - RNA, 22 nt, Human adenovirus E
gacgcugcgcaacggccugccc

SEQ ID NO: 3937682 - RNA, 21 nt, Human adenovirus E
gacggcccuugacguggggca

SEQ ID NO: 3937683 - RNA, 20 nt, Human adenovirus E
gacggccuuguaggcgcagc

SEQ ID NO: 3937684 - RNA, 19 nt, Human adenovirus E
gacggcgcagcuguuccug

SEQ ID NO: 3937685 - RNA, 20 nt, Human adenovirus E
gacggcgcgcccguccucgc

SEQ ID NO: 3937686 - RNA, 18 nt, Human adenovirus E
gacggucaacuccuccuc

SEQ ID NO: 3937687 - RNA, 14 nt, Human adenovirus E
gacguccugcagga

SEQ ID NO: 3937688 - RNA, 15 nt, Human adenovirus E
gacguuacugucguu

SEQ ID NO: 3937689 - RNA, 20 nt, Human adenovirus E
gacuacuucuuccagaccag

SEQ ID NO: 3937690 - RNA, 12 nt, Human adenovirus E
gacucccaccug

SEQ ID NO: 3937691 - RNA, 14 nt, Human adenovirus E
gacucccucagcau

SEQ ID NO: 3937692 - RNA, 16 nt, Human adenovirus E
gagaacagcagucagg

SEQ ID NO: 3937693 - RNA, 24 nt, Human adenovirus E
gagaaggaacucuucgcgguccuu

SEQ ID NO: 3937694 - RNA, 16 nt, Human adenovirus E
gagacacacuuggaaa

SEQ ID NO: 3937695 - RNA, 23 nt, Human adenovirus E
gagacgcgcggccacggcggcgg

SEQ ID NO: 3937696 - RNA, 23 nt, Human adenovirus E
gagacugauggccacgggcagcc

SEQ ID NO: 3937697 - RNA, 18 nt, Human adenovirus E
uggaauuugagcugcccg

SEQ ID NO: 3937698 - RNA, 14 nt, Human adenovirus E
uggacaaaauacca

SEQ ID NO: 3937699 - RNA, 17 nt, Human adenovirus E
uggacaagaugagccgc

SEQ ID NO: 3937700 - RNA, 23 nt, Human adenovirus E
  misc_feature (9)..(9): n is a, c, g or u
uggacaucnagauucccacggag

SEQ ID NO: 3937701 - RNA, 14 nt, Human adenovirus E
uggacccaggccau

SEQ ID NO: 3937702 - RNA, 15 nt, Human adenovirus E
uggacccaggccaug

SEQ ID NO: 3937703 - RNA, 20 nt, Human adenovirus E
uggaccuggugaacauucug

SEQ ID NO: 3937704 - RNA, 19 nt, Human adenovirus E
uggacucugacgcuccugg

SEQ ID NO: 3937705 - RNA, 20 nt, Human adenovirus E
uggacucugacgcuccuggu

SEQ ID NO: 3937706 - RNA, 22 nt, Human adenovirus E
uggagcagucucuggagcgggc

SEQ ID NO: 3937707 - RNA, 19 nt, Human adenovirus E
uggagcgacaucggcacca

SEQ ID NO: 3937708 - RNA, 22 nt, Human adenovirus E
uggagcuaccagccccagaugg

SEQ ID NO: 3937709 - RNA, 15 nt, Human adenovirus E
uggaggaagacgagg

SEQ ID NO: 3937710 - RNA, 13 nt, Human adenovirus E
uggaggaagacug

SEQ ID NO: 3937711 - RNA, 15 nt, Human adenovirus E
uggaggaagacuggg

SEQ ID NO: 3937712 - RNA, 20 nt, Human adenovirus E
uggaggaagacugggacagc

SEQ ID NO: 3937713 - RNA, 14 nt, Human adenovirus E
uggaggagcucagc

SEQ ID NO: 3937714 - RNA, 19 nt, Human adenovirus E
uggaggaguucacucccuc

SEQ ID NO: 3937715 - RNA, 17 nt, Human adenovirus E
uggaggcggcggcagga

SEQ ID NO: 3937716 - RNA, 23 nt, Human adenovirus E
uggaggcuaagcgaacggguugg

SEQ ID NO: 3937717 - RNA, 18 nt, Human adenovirus E
uggaggcuccuuacgugc

SEQ ID NO: 3937718 - RNA, 17 nt, Human adenovirus E
uggagugccugcgccgc

SEQ ID NO: 3937719 - RNA, 19 nt, Human adenovirus E
uggcaccagacgaugggcg

SEQ ID NO: 3937720 - RNA, 14 nt, Human adenovirus E
uggcacgacaggca

SEQ ID NO: 3937721 - RNA, 15 nt, Human adenovirus E
uggcagaucacccug

SEQ ID NO: 3937722 - RNA, 21 nt, Human adenovirus E
uggcagcagugucuggaggag

SEQ ID NO: 3937723 - RNA, 20 nt, Human adenovirus E
uggcaguuacaccugcccug

SEQ ID NO: 3937724 - RNA, 19 nt, Human adenovirus E
uggcaugcgaguuggagga

SEQ ID NO: 3937725 - RNA, 14 nt, Human adenovirus E
uggccaaccaggcc

SEQ ID NO: 3937726 - RNA, 18 nt, Human adenovirus E
uggccagaucguccaggg

SEQ ID NO: 3937727 - RNA, 15 nt, Human adenovirus E
uggcccgcgggcagg

SEQ ID NO: 3937728 - RNA, 19 nt, Human adenovirus E
uggcccgguggcugggucc

SEQ ID NO: 3937729 - RNA, 17 nt, Human adenovirus E
uggccgugguccuggug

SEQ ID NO: 3937730 - RNA, 13 nt, Human adenovirus E
cucuugcaggaca

SEQ ID NO: 3937731 - RNA, 15 nt, Human adenovirus E
cugaaaacaccaccu

SEQ ID NO: 3937732 - RNA, 17 nt, Human adenovirus E
cugaaaacaccaccugg

SEQ ID NO: 3937733 - RNA, 17 nt, Human adenovirus E
cugaaacacaaaauaaa

SEQ ID NO: 3937734 - RNA, 17 nt, Human adenovirus E
cugaaaguggagcugcc

SEQ ID NO: 3937735 - RNA, 21 nt, Human adenovirus E
cugaacaguauccgcagcagc

SEQ ID NO: 3937736 - RNA, 22 nt, Human adenovirus E
cugaacgccuuccucagcaccc

SEQ ID NO: 3937737 - RNA, 15 nt, Human adenovirus E
cugaacgggggcgcc

SEQ ID NO: 3937738 - RNA, 16 nt, Human adenovirus E
cugaauaucaccgagc

SEQ ID NO: 3937739 - RNA, 12 nt, Human adenovirus E
cugacccugagc

SEQ ID NO: 3937740 - RNA, 13 nt, Human adenovirus E
cugacccugagcg

SEQ ID NO: 3937741 - RNA, 16 nt, Human adenovirus E
cugaccggggccggga

SEQ ID NO: 3937742 - RNA, 19 nt, Human adenovirus E
cugacgccagacgccgcac

SEQ ID NO: 3937743 - RNA, 14 nt, Human adenovirus E
cugacgcuccuggu

SEQ ID NO: 3937744 - RNA, 16 nt, Human adenovirus E
cugacgcuccuggucc

SEQ ID NO: 3937745 - RNA, 23 nt, Human adenovirus E
cugacgcugcgcaacggccugcc

SEQ ID NO: 3937746 - RNA, 20 nt, Human adenovirus E
cugacggagucuuccaacuc

SEQ ID NO: 3937747 - RNA, 15 nt, Human adenovirus E
cugacggcgcagcug

SEQ ID NO: 3937748 - RNA, 20 nt, Human adenovirus E
cugacguaaaggccaaaguc

SEQ ID NO: 3937749 - RNA, 19 nt, Human adenovirus E
cugagacccggcaccaccg

SEQ ID NO: 3937750 - RNA, 22 nt, Human adenovirus E
cugagcauucacaugcucaucg

SEQ ID NO: 3937751 - RNA, 16 nt, Human adenovirus E
cugagcgaccaggagc

SEQ ID NO: 3937752 - RNA, 17 nt, Human adenovirus E
cugagcgggggggagga

SEQ ID NO: 3937753 - RNA, 16 nt, Human adenovirus E
cugaucuguagaaaaa

SEQ ID NO: 3937754 - RNA, 16 nt, Human adenovirus E
cugaugcaccuguggg

SEQ ID NO: 3937755 - RNA, 16 nt, Human adenovirus E
cugauggccacgggca

SEQ ID NO: 3937756 - RNA, 16 nt, Human adenovirus E
cugauggugaccgagg

SEQ ID NO: 3937757 - RNA, 15 nt, Human adenovirus E
cugcaacccccagcu

SEQ ID NO: 3937758 - RNA, 20 nt, Human adenovirus E
cugcaagacagucuggagga

SEQ ID NO: 3937759 - RNA, 16 nt, Human adenovirus E
cugcaaggagaaggag

SEQ ID NO: 3937760 - RNA, 19 nt, Human adenovirus E
cugcacaccacccugcgcg

SEQ ID NO: 3937761 - RNA, 13 nt, Human adenovirus E
cugcaccucacag

SEQ ID NO: 3937762 - RNA, 14 nt, Human adenovirus E
cugcacgccgcacc

SEQ ID NO: 3937763 - RNA, 17 nt, Human adenovirus E
cugcacgccgcaccgcu

SEQ ID NO: 3937764 - RNA, 17 nt, Human adenovirus E
cugcacuggcagcccag

SEQ ID NO: 3937765 - RNA, 13 nt, Human adenovirus E
cugcagagccagc

SEQ ID NO: 3937766 - RNA, 20 nt, Human adenovirus E
cugcaguacgugcaacacag

SEQ ID NO: 3937767 - RNA, 23 nt, Human adenovirus E
cugcaguacgugcaacacagaac

SEQ ID NO: 3937768 - RNA, 18 nt, Human adenovirus E
cugccaucacaccuucca

SEQ ID NO: 3937769 - RNA, 14 nt, Human adenovirus E
cugcccgacggcca

SEQ ID NO: 3937770 - RNA, 15 nt, Human adenovirus E
cugcccgcaggcggg

SEQ ID NO: 3937771 - RNA, 16 nt, Human adenovirus E
cugcccgccaccugcu

SEQ ID NO: 3937772 - RNA, 16 nt, Human adenovirus E
cugcccggcugcgggg

SEQ ID NO: 3937773 - RNA, 12 nt, Human adenovirus E
cugcccuggaga

SEQ ID NO: 3937774 - RNA, 22 nt, Human adenovirus E
cugccgcaagaucucuugcacg

SEQ ID NO: 3937775 - RNA, 17 nt, Human adenovirus E
cugccgcugcgcagcag

SEQ ID NO: 3937776 - RNA, 16 nt, Human adenovirus E
cugccuuggcaguaca

SEQ ID NO: 3937777 - RNA, 15 nt, Human adenovirus E
cugcgcaacggccug

SEQ ID NO: 3937778 - RNA, 22 nt, Human adenovirus E
cugcgccgcuucuucgccgacg

SEQ ID NO: 3937779 - RNA, 13 nt, Human adenovirus E
cugcgccugaugg

SEQ ID NO: 3937780 - RNA, 19 nt, Human adenovirus E
cugcgcgcgcccagcaaga

SEQ ID NO: 3937781 - RNA, 15 nt, Human adenovirus E
cugcgcggggaggcc

SEQ ID NO: 3937782 - RNA, 13 nt, Human adenovirus E
cugcggcgcggcc

SEQ ID NO: 3937783 - RNA, 22 nt, Human adenovirus E
cugcucaauauauagcccagau

SEQ ID NO: 3937784 - RNA, 13 nt, Human adenovirus E
cugcucccagagc

SEQ ID NO: 3937785 - RNA, 16 nt, Human adenovirus E
cugcuccgcgcugccc

SEQ ID NO: 3937786 - RNA, 21 nt, Human adenovirus E
cugcuccgcgcugcccucgga

SEQ ID NO: 3937787 - RNA, 22 nt, Human adenovirus E
cugcucgggcaucagcuggaag

SEQ ID NO: 3937788 - RNA, 11 nt, Human adenovirus E
cugcugaaccu

SEQ ID NO: 3937789 - RNA, 14 nt, Human adenovirus E
cugcuggaggccau

SEQ ID NO: 3937790 - RNA, 14 nt, Human adenovirus E
cugcugguggcccc

SEQ ID NO: 3937791 - RNA, 22 nt, Human adenovirus E
cugcuucggaucuucagccagc

SEQ ID NO: 3937792 - RNA, 21 nt, Human adenovirus E
cuggaagacguaugcgcagga

SEQ ID NO: 3937793 - RNA, 19 nt, Human adenovirus E
cuggacaaaauaccaccuc

SEQ ID NO: 3937794 - RNA, 13 nt, Human adenovirus E
cuggaccugguga

SEQ ID NO: 3937795 - RNA, 20 nt, Human adenovirus E
cuggacgcugcucaccaccu

SEQ ID NO: 3937796 - RNA, 21 nt, Human adenovirus E
cuggaggccaucgugcagaac

SEQ ID NO: 3937797 - RNA, 17 nt, Human adenovirus E
cuggaggccguggugcc

SEQ ID NO: 3937798 - RNA, 17 nt, Human adenovirus E
cuggagugccugcgccg

SEQ ID NO: 3937799 - RNA, 17 nt, Human adenovirus E
cuggaucuuugugcgca

SEQ ID NO: 3937800 - RNA, 16 nt, Human adenovirus E
cuggccaucgugaacg

SEQ ID NO: 3937801 - RNA, 19 nt, Human adenovirus E
cuggccguguugcucuacu

SEQ ID NO: 3937802 - RNA, 20 nt, Human adenovirus E
cuggccugcacccucaucuc

SEQ ID NO: 3937803 - RNA, 22 nt, Human adenovirus E
cuggcgccuacggaggggcgga

SEQ ID NO: 3937804 - RNA, 15 nt, Human adenovirus E
cugggacagcacuca

SEQ ID NO: 3937805 - RNA, 22 nt, Human adenovirus E
cugggacagcacucaggcagag

SEQ ID NO: 3937806 - RNA, 23 nt, Human adenovirus E
cugggcauucgcaagaggcagcc

SEQ ID NO: 3937807 - RNA, 11 nt, Human adenovirus E
cugggccagga

SEQ ID NO: 3937808 - RNA, 22 nt, Human adenovirus E
cugggccaggacgacccgggca

SEQ ID NO: 3937809 - RNA, 18 nt, Human adenovirus E
cugguacugcaggccccg

SEQ ID NO: 3937810 - RNA, 16 nt, Human adenovirus E
cugguacuuggccagc

SEQ ID NO: 3937811 - RNA, 22 nt, Human adenovirus E
cuggugaacauucugcagagca

SEQ ID NO: 3937812 - RNA, 23 nt, Human adenovirus E
cugguguacaacgcgcugcugga

SEQ ID NO: 3937813 - RNA, 17 nt, Human adenovirus E
cuguaccgcgaggccau

SEQ ID NO: 3937814 - RNA, 18 nt, Human adenovirus E
cugucaaauacucgcaga

SEQ ID NO: 3937815 - RNA, 17 nt, Human adenovirus E
cugugggaccugcugga

SEQ ID NO: 3937816 - RNA, 18 nt, Human adenovirus E
cugugggaccugcuggag

SEQ ID NO: 3937817 - RNA, 12 nt, Human adenovirus E
cuuaccuuuggu

SEQ ID NO: 3937818 - RNA, 15 nt, Human adenovirus E
cuuacggcaagcgca

SEQ ID NO: 3937819 - RNA, 18 nt, Human adenovirus E
cuuagcuuugacaguaca

SEQ ID NO: 3937820 - RNA, 16 nt, Human adenovirus E
cuucaaaaugaagauc

SEQ ID NO: 3937821 - RNA, 14 nt, Human adenovirus E
cuuccagcaaagcc

SEQ ID NO: 3937822 - RNA, 16 nt, Human adenovirus E
cuuccaucauccccac

SEQ ID NO: 3937823 - RNA, 16 nt, Human adenovirus E
cuucccaccccacucu

SEQ ID NO: 3937824 - RNA, 18 nt, Human adenovirus E
cuucccagcucugguacu

SEQ ID NO: 3937825 - RNA, 15 nt, Human adenovirus E
cuucccauggugggc

SEQ ID NO: 3937826 - RNA, 22 nt, Human adenovirus E
cuuccgcgucaguugcagggcg

SEQ ID NO: 3937827 - RNA, 17 nt, Human adenovirus E
cuuccucagcacccagc

SEQ ID NO: 3937828 - RNA, 17 nt, Human adenovirus E
cuucucgcgcuucugcu

SEQ ID NO: 3937829 - RNA, 14 nt, Human adenovirus E
cuugcagguccaag

SEQ ID NO: 3937830 - RNA, 23 nt, Human adenovirus E
cuugcgcaaguucgugcccgagg

SEQ ID NO: 3937831 - RNA, 12 nt, Human adenovirus E
cuugggcggcug

SEQ ID NO: 3937832 - RNA, 15 nt, Human adenovirus E
cuuuagacagcagcc

SEQ ID NO: 3937833 - RNA, 19 nt, Human adenovirus E
cuuucauuuuugcgcacau

SEQ ID NO: 3937834 - RNA, 18 nt, Human adenovirus E
cuuugugcccgcccaggu

SEQ ID NO: 3937835 - RNA, 13 nt, Human adenovirus E
gaaaaagccacag

SEQ ID NO: 3937836 - RNA, 12 nt, Human adenovirus E
gaaaauggcaug

SEQ ID NO: 3937837 - RNA, 13 nt, Human adenovirus E
gaaagccuggugg

SEQ ID NO: 3937838 - RNA, 15 nt, Human adenovirus E
gaaaucgcaguuggg

SEQ ID NO: 3937839 - RNA, 17 nt, Human adenovirus E
gaaauuguaaaacagcc

SEQ ID NO: 3937840 - RNA, 18 nt, Human adenovirus E
gaacaccaucagggccgg

SEQ ID NO: 3937841 - RNA, 15 nt, Human adenovirus E
gaacacgcugcccac

SEQ ID NO: 3937842 - RNA, 19 nt, Human adenovirus E
gaacagccagagcaggaag

SEQ ID NO: 3937843 - RNA, 13 nt, Human adenovirus E
gaaccccaccacc

SEQ ID NO: 3937844 - RNA, 15 nt, Human adenovirus E
gaaccccaccaccca

SEQ ID NO: 3937845 - RNA, 20 nt, Human adenovirus E
gaaccccgcagaacagggca

SEQ ID NO: 3937846 - RNA, 22 nt, Human adenovirus E
gaaccugaaagagcucugcaag

SEQ ID NO: 3937847 - RNA, 13 nt, Human adenovirus E
gccccaggccaac

SEQ ID NO: 3937848 - RNA, 13 nt, Human adenovirus E
gcccccaccgccg

SEQ ID NO: 3937849 - RNA, 22 nt, Human adenovirus E
gcccccgaucccuccagguaca

SEQ ID NO: 3937850 - RNA, 15 nt, Human adenovirus E
gcccccgccccagca

SEQ ID NO: 3937851 - RNA, 16 nt, Human adenovirus E
gcccccgccccagcag

SEQ ID NO: 3937852 - RNA, 22 nt, Human adenovirus E
gcccccgcgguaccuggcgccu

SEQ ID NO: 3937853 - RNA, 15 nt, Human adenovirus E
gcccccgcuggaggc

SEQ ID NO: 3937854 - RNA, 17 nt, Human adenovirus E
gccccggggccaggagg

SEQ ID NO: 3937855 - RNA, 20 nt, Human adenovirus E
gccccucagcguggaggagc

SEQ ID NO: 3937856 - RNA, 22 nt, Human adenovirus E
gccccucagcguggaggagcuc

SEQ ID NO: 3937857 - RNA, 22 nt, Human adenovirus E
gcccgaggagaugcgcgcggcc

SEQ ID NO: 3937858 - RNA, 16 nt, Human adenovirus E
gcccgagggccgcugg

SEQ ID NO: 3937859 - RNA, 19 nt, Human adenovirus E
gcccgcgcuugcugggcga

SEQ ID NO: 3937860 - RNA, 15 nt, Human adenovirus E
gcccggcaggccacc

SEQ ID NO: 3937861 - RNA, 16 nt, Human adenovirus E
gcccggcaggccacca

SEQ ID NO: 3937862 - RNA, 12 nt, Human adenovirus E
gcccggcugcgg

SEQ ID NO: 3937863 - RNA, 15 nt, Human adenovirus E
gcccgguggcugggu

SEQ ID NO: 3937864 - RNA, 16 nt, Human adenovirus E
gcccgguuccacgcgg

SEQ ID NO: 3937865 - RNA, 19 nt, Human adenovirus E
gcccgguuccacgcggggc

SEQ ID NO: 3937866 - RNA, 11 nt, Human adenovirus E
gcccugcagga

SEQ ID NO: 3937867 - RNA, 13 nt, Human adenovirus E
gcccuggccaccu

SEQ ID NO: 3937868 - RNA, 23 nt, Human adenovirus E
gcccugggcauagucgcgccgcg

SEQ ID NO: 3937869 - RNA, 15 nt, Human adenovirus E
gcccuugcgcgagca

SEQ ID NO: 3937870 - RNA, 18 nt, Human adenovirus E
gcccuuuucaaccugggu

SEQ ID NO: 3937871 - RNA, 19 nt, Human adenovirus E
gccgaacucgcgccugcug

SEQ ID NO: 3937872 - RNA, 22 nt, Human adenovirus E
gccgcaagaccaccacucgccg

SEQ ID NO: 3937873 - RNA, 22 nt, Human adenovirus E
gccgcaccgcucccuggccugc

SEQ ID NO: 3937874 - RNA, 14 nt, Human adenovirus E
gccgcccagccccg

SEQ ID NO: 3937875 - RNA, 14 nt, Human adenovirus E
gccgccccucucag

SEQ ID NO: 3937876 - RNA, 15 nt, Human adenovirus E
gccgccccucucagu

SEQ ID NO: 3937877 - RNA, 16 nt, Human adenovirus E
gccgccgggccuugga

SEQ ID NO: 3937878 - RNA, 19 nt, Human adenovirus E
gccgccggugccgcccagg

SEQ ID NO: 3937879 - RNA, 16 nt, Human adenovirus E
gccgcgcccugggcca

SEQ ID NO: 3937880 - RNA, 21 nt, Human adenovirus E
gccgcgugcggucgcgcacca

SEQ ID NO: 3937881 - RNA, 21 nt, Human adenovirus E
gccgcuccgucaagcugcugc

SEQ ID NO: 3937882 - RNA, 17 nt, Human adenovirus E
gccgcugcaaccacccc

SEQ ID NO: 3937883 - RNA, 18 nt, Human adenovirus E
gccggcggcggcgcaucg

SEQ ID NO: 3937884 - RNA, 18 nt, Human adenovirus E
gccgggaccgagggggag

SEQ ID NO: 3937885 - RNA, 19 nt, Human adenovirus E
gccgggccuuggaggcggc

SEQ ID NO: 3937886 - RNA, 14 nt, Human adenovirus E
gccguccucccgga

SEQ ID NO: 3937887 - RNA, 15 nt, Human adenovirus E
gccguuccgcaccga

SEQ ID NO: 3937888 - RNA, 23 nt, Human adenovirus E
gccguugauguuguggcccacga

SEQ ID NO: 3937889 - RNA, 17 nt, Human adenovirus E
gccuaggccacaauaca

SEQ ID NO: 3937890 - RNA, 21 nt, Human adenovirus E
gccucggugcacccgugcagc

SEQ ID NO: 3937891 - RNA, 20 nt, Human adenovirus E
gccucuguuaaauuuuugcu

SEQ ID NO: 3937892 - RNA, 14 nt, Human adenovirus E
gccugauggcucug

SEQ ID NO: 3937893 - RNA, 22 nt, Human adenovirus E
gccugcaagaucuccaacgugg

SEQ ID NO: 3937894 - RNA, 22 nt, Human adenovirus E
gccugcucgagugccacugccg

SEQ ID NO: 3937895 - RNA, 17 nt, Human adenovirus E
gccuucaauuggagcag

SEQ ID NO: 3937896 - RNA, 15 nt, Human adenovirus E
gccuucaccaccugc

SEQ ID NO: 3937897 - RNA, 15 nt, Human adenovirus E
gccuuggaggcggcg

SEQ ID NO: 3937898 - RNA, 20 nt, Human adenovirus E
gccuuguaggcgcagcagcc

SEQ ID NO: 3937899 - RNA, 15 nt, Human adenovirus E
gccuuucaagagccc

SEQ ID NO: 3937900 - RNA, 20 nt, Human adenovirus E
gcgacacggucauguggaug

SEQ ID NO: 3937901 - RNA, 16 nt, Human adenovirus E
gcgaccagcgugcguu

SEQ ID NO: 3937902 - RNA, 18 nt, Human adenovirus E
gcgacuaccuccaccuga

SEQ ID NO: 3937903 - RNA, 21 nt, Human adenovirus E
gcgagcagaaggggggcaggg

SEQ ID NO: 3937904 - RNA, 15 nt, Human adenovirus E
gcgagggccugcucg

SEQ ID NO: 3937905 - RNA, 16 nt, Human adenovirus E
gcgagggggagcgcga

SEQ ID NO: 3937906 - RNA, 14 nt, Human adenovirus E
gcgagggggcgagg

SEQ ID NO: 3937907 - RNA, 21 nt, Human adenovirus E
gcgaucccauuugagcuggag

SEQ ID NO: 3937908 - RNA, 13 nt, Human adenovirus E
gcgcacggccagc

SEQ ID NO: 3937909 - RNA, 20 nt, Human adenovirus E
gcgcagagcgcccuccaccg

SEQ ID NO: 3937910 - RNA, 17 nt, Human adenovirus E
gcgccacccugugucgu

SEQ ID NO: 3937911 - RNA, 16 nt, Human adenovirus E
gcgccagcgccggcag

SEQ ID NO: 3937912 - RNA, 22 nt, Human adenovirus E
gcgcccaccauuaccaccguca

SEQ ID NO: 3937913 - RNA, 13 nt, Human adenovirus E
gcgcccggagaaa

SEQ ID NO: 3937914 - RNA, 13 nt, Human adenovirus E
gcgcccuccaccg

SEQ ID NO: 3937915 - RNA, 14 nt, Human adenovirus E
gcgccgggcggcag

SEQ ID NO: 3937916 - RNA, 18 nt, Human adenovirus E
gcgccgggcggcaggggc

SEQ ID NO: 3937917 - RNA, 12 nt, Human adenovirus E
gcgccucaggcu

SEQ ID NO: 3937918 - RNA, 22 nt, Human adenovirus E
gcgcgagcagaaggggggcagg

SEQ ID NO: 3937919 - RNA, 14 nt, Human adenovirus E
gcgcgccaucagca

SEQ ID NO: 3937920 - RNA, 18 nt, Human adenovirus E
gcgcgccgggcggcaggg

SEQ ID NO: 3937921 - RNA, 12 nt, Human adenovirus E
gcgcgcugcccg

SEQ ID NO: 3937922 - RNA, 17 nt, Human adenovirus E
gcgcggaccugcacugg

SEQ ID NO: 3937923 - RNA, 20 nt, Human adenovirus E
gcgcggccacggcggcggca

SEQ ID NO: 3937924 - RNA, 17 nt, Human adenovirus E
gcgcgguaggcccugga

SEQ ID NO: 3937925 - RNA, 12 nt, Human adenovirus E
gcgcgugccccc

SEQ ID NO: 3937926 - RNA, 13 nt, Human adenovirus E
gcgcuaccacccg

SEQ ID NO: 3937927 - RNA, 14 nt, Human adenovirus E
gcgcuccuggaugu

SEQ ID NO: 3937928 - RNA, 16 nt, Human adenovirus E
gcgcucgcucacccgc

SEQ ID NO: 3937929 - RNA, 22 nt, Human adenovirus E
gcgcuucugcccccgccccagc

SEQ ID NO: 3937930 - RNA, 12 nt, Human adenovirus E
gcgcuucugcug

SEQ ID NO: 3937931 - RNA, 23 nt, Human adenovirus E
gcggaacugguacuuggccagcc

SEQ ID NO: 3937932 - RNA, 15 nt, Human adenovirus E
gcggacgcgcgccgg

SEQ ID NO: 3937933 - RNA, 17 nt, Human adenovirus E
gcggaucucgcucaggu

SEQ ID NO: 3937934 - RNA, 16 nt, Human adenovirus E
gcggaugcuggcgcgc

SEQ ID NO: 3937935 - RNA, 16 nt, Human adenovirus E
gcggauggcuggcaga

SEQ ID NO: 3937936 - RNA, 23 nt, Human adenovirus E
gcggcagcggccaucgccagcau

SEQ ID NO: 3937937 - RNA, 20 nt, Human adenovirus E
gcggccggcgcgcuccacgg

SEQ ID NO: 3937938 - RNA, 23 nt, Human adenovirus E
gcggccguucaugggcaccugga

SEQ ID NO: 3937939 - RNA, 14 nt, Human adenovirus E
gcggccuggaccga

SEQ ID NO: 3937940 - RNA, 16 nt, Human adenovirus E
gcggccuugcgcaggg

SEQ ID NO: 3937941 - RNA, 21 nt, Human adenovirus E
gcggcgaacgagccggcgcaa

SEQ ID NO: 3937942 - RNA, 17 nt, Human adenovirus E
gcggcggagcggcaucu

SEQ ID NO: 3937943 - RNA, 15 nt, Human adenovirus E
gcggcugcucaggcu

SEQ ID NO: 3937944 - RNA, 13 nt, Human adenovirus E
gcgggaggcaggu

SEQ ID NO: 3937945 - RNA, 18 nt, Human adenovirus E
gcgggguuucuucuuggg

SEQ ID NO: 3937946 - RNA, 14 nt, Human adenovirus E
gcggugccucuucc

SEQ ID NO: 3937947 - RNA, 17 nt, Human adenovirus E
gcggugcguuccagcau

SEQ ID NO: 3937948 - RNA, 21 nt, Human adenovirus E
gcguagagcuugggggcgagg

SEQ ID NO: 3937949 - RNA, 20 nt, Human adenovirus E
gcguaggagucuugcagcuu

SEQ ID NO: 3937950 - RNA, 21 nt, Human adenovirus E
gcgucgcagggggccacgagc

SEQ ID NO: 3937951 - RNA, 19 nt, Human adenovirus E
gcgucucgagauccacggg

SEQ ID NO: 3937952 - RNA, 20 nt, Human adenovirus E
gcgucucgggacccugccau

SEQ ID NO: 3937953 - RNA, 14 nt, Human adenovirus E
gcgugaugcagcag

SEQ ID NO: 3937954 - RNA, 18 nt, Human adenovirus E
gcgugcacgaagcccugc

SEQ ID NO: 3937955 - RNA, 21 nt, Human adenovirus E
gcgugccccccaagcgccagc

SEQ ID NO: 3937956 - RNA, 22 nt, Human adenovirus E
gcgugccccccaagcgccagcc

SEQ ID NO: 3937957 - RNA, 15 nt, Human adenovirus E
gcgugcgcuccugga

SEQ ID NO: 3937958 - RNA, 22 nt, Human adenovirus E
gcuaagcgaacggguugggcug

SEQ ID NO: 3937959 - RNA, 12 nt, Human adenovirus E
gcuaccagcccc

SEQ ID NO: 3937960 - RNA, 20 nt, Human adenovirus E
gcuaccgccaaaaaucagac

SEQ ID NO: 3937961 - RNA, 21 nt, Human adenovirus E
gcuaccugcugcgccuggcca

SEQ ID NO: 3937962 - RNA, 23 nt, Human adenovirus E
gcucaaccccggcuucccccagg

SEQ ID NO: 3937963 - RNA, 17 nt, Human adenovirus E
cgucgcagggggccacg

SEQ ID NO: 3937964 - RNA, 16 nt, Human adenovirus E
cgucgccgcaccgccg

SEQ ID NO: 3937965 - RNA, 20 nt, Human adenovirus E
cgucuaccccuacgaugcag

SEQ ID NO: 3937966 - RNA, 15 nt, Human adenovirus E
cgugaaccugagcca

SEQ ID NO: 3937967 - RNA, 15 nt, Human adenovirus E
cgugaccgagcuggu

SEQ ID NO: 3937968 - RNA, 20 nt, Human adenovirus E
cgugagguaaauccaagcca

SEQ ID NO: 3937969 - RNA, 19 nt, Human adenovirus E
cgugaucgaggacgucagc

SEQ ID NO: 3937970 - RNA, 17 nt, Human adenovirus E
cgugcagaaccccacca

SEQ ID NO: 3937971 - RNA, 19 nt, Human adenovirus E
cgugcagaaccccaccagc

SEQ ID NO: 3937972 - RNA, 19 nt, Human adenovirus E
cgugcagcagaagcguggg

SEQ ID NO: 3937973 - RNA, 14 nt, Human adenovirus E
cgugcagccacagc

SEQ ID NO: 3937974 - RNA, 22 nt, Human adenovirus E
cgugcauguucucgcgcaccag

SEQ ID NO: 3937975 - RNA, 13 nt, Human adenovirus E
cgugccccagggc

SEQ ID NO: 3937976 - RNA, 19 nt, Human adenovirus E
cgugccccagggcauggga

SEQ ID NO: 3937977 - RNA, 23 nt, Human adenovirus E
cguggaacagcaccacagggcag

SEQ ID NO: 3937978 - RNA, 17 nt, Human adenovirus E
cguggaggauuuggagg

SEQ ID NO: 3937979 - RNA, 23 nt, Human adenovirus E
cguggcccgcuacaacagcacca

SEQ ID NO: 3937980 - RNA, 15 nt, Human adenovirus E
cguggccgcggccaa

SEQ ID NO: 3937981 - RNA, 21 nt, Human adenovirus E
cguggcucugccuuggcagua

SEQ ID NO: 3937982 - RNA, 13 nt, Human adenovirus E
cguggucagcgac

SEQ ID NO: 3937983 - RNA, 15 nt, Human adenovirus E
cguggucuucuccau

SEQ ID NO: 3937984 - RNA, 15 nt, Human adenovirus E
cguggugcaggagcg

SEQ ID NO: 3937985 - RNA, 19 nt, Human adenovirus E
cgugucaugaugcaguugc

SEQ ID NO: 3937986 - RNA, 13 nt, Human adenovirus E
cguguggcagcag

SEQ ID NO: 3937987 - RNA, 14 nt, Human adenovirus E
cguguggcagcagu

SEQ ID NO: 3937988 - RNA, 18 nt, Human adenovirus E
cguucagggaggcgcugc

SEQ ID NO: 3937989 - RNA, 20 nt, Human adenovirus E
cguucucuccagcaccaggc

SEQ ID NO: 3937990 - RNA, 15 nt, Human adenovirus E
cguugcggugugccc

SEQ ID NO: 3937991 - RNA, 13 nt, Human adenovirus E
cguugggcaggga

SEQ ID NO: 3937992 - RNA, 20 nt, Human adenovirus E
cuaaaccccauuacuggcac

SEQ ID NO: 3937993 - RNA, 22 nt, Human adenovirus E
cuaacaaccaaacuaaccucca

SEQ ID NO: 3937994 - RNA, 17 nt, Human adenovirus E
cuacaaggcccugggca

SEQ ID NO: 3937995 - RNA, 18 nt, Human adenovirus E
cuacagccuaggccacaa

SEQ ID NO: 3937996 - RNA, 20 nt, Human adenovirus E
cuaccaauaacauuuuugcc

SEQ ID NO: 3937997 - RNA, 19 nt, Human adenovirus E
cuaccagccccagaugggc

SEQ ID NO: 3937998 - RNA, 18 nt, Human adenovirus E
cuaccgucaccuccacag

SEQ ID NO: 3937999 - RNA, 15 nt, Human adenovirus E
cuaccuauaccuccc

SEQ ID NO: 3938000 - RNA, 17 nt, Human adenovirus E
cuaccucgacccccaga

SEQ ID NO: 3938001 - RNA, 13 nt, Human adenovirus E
cuaccucugccac

SEQ ID NO: 3938002 - RNA, 16 nt, Human adenovirus E
cuaccuggccuaccac

SEQ ID NO: 3938003 - RNA, 13 nt, Human adenovirus E
cuacucgcagcag

SEQ ID NO: 3938004 - RNA, 21 nt, Human adenovirus E
cuacugaauuuuuguccacug

SEQ ID NO: 3938005 - RNA, 12 nt, Human adenovirus E
cuacuuccuccu

SEQ ID NO: 3938006 - RNA, 23 nt, Human adenovirus E
cuagaacagucagcgcucaccgc

SEQ ID NO: 3938007 - RNA, 12 nt, Human adenovirus E
cuaguccccaga

SEQ ID NO: 3938008 - RNA, 19 nt, Human adenovirus E
cuaguugcgggugggcuuu

SEQ ID NO: 3938009 - RNA, 20 nt, Human adenovirus E
cuauaccucccuugcuguuc

SEQ ID NO: 3938010 - RNA, 22 nt, Human adenovirus E
cuaugagaaaagcaaggaggau

SEQ ID NO: 3938011 - RNA, 20 nt, Human adenovirus E
cuaugaggccgagccacagc

SEQ ID NO: 3938012 - RNA, 13 nt, Human adenovirus E
cuaugcagcucac

SEQ ID NO: 3938013 - RNA, 14 nt, Human adenovirus E
cuaugccuucugcu

SEQ ID NO: 3938014 - RNA, 16 nt, Human adenovirus E
cuaugccuucugcuac

SEQ ID NO: 3938015 - RNA, 20 nt, Human adenovirus E
cucaaugguacugaugacag

SEQ ID NO: 3938016 - RNA, 19 nt, Human adenovirus E
cucagcgccgggcccgcga

SEQ ID NO: 3938017 - RNA, 17 nt, Human adenovirus E
cucagcguggaggagcu

SEQ ID NO: 3938018 - RNA, 15 nt, Human adenovirus E
cucagcucaaaaugg

SEQ ID NO: 3938019 - RNA, 15 nt, Human adenovirus E
cucaggcagaggagg

SEQ ID NO: 3938020 - RNA, 16 nt, Human adenovirus E
cucaggcagaggagga

SEQ ID NO: 3938021 - RNA, 14 nt, Human adenovirus E
cucagggcccggcc

SEQ ID NO: 3938022 - RNA, 18 nt, Human adenovirus E
cucagguguccagcuggc

SEQ ID NO: 3938023 - RNA, 19 nt, Human adenovirus E
cucagucucaaguccagca

SEQ ID NO: 3938024 - RNA, 19 nt, Human adenovirus E
cucaucuccuuugugauuu

SEQ ID NO: 3938025 - RNA, 22 nt, Human adenovirus E
cuccaauugccugaacgccugc

SEQ ID NO: 3938026 - RNA, 15 nt, Human adenovirus E
cuccacagccccuac

SEQ ID NO: 3938027 - RNA, 13 nt, Human adenovirus E
cuccacgcgcaca

SEQ ID NO: 3938028 - RNA, 17 nt, Human adenovirus E
cuccacgucgagguccu

SEQ ID NO: 3938029 - RNA, 17 nt, Human adenovirus E
cuccagaagacggauga

SEQ ID NO: 3938030 - RNA, 14 nt, Human adenovirus E
cuccagcaccaggc

SEQ ID NO: 3938031 - RNA, 15 nt, Human adenovirus E
cuccagcuccagugu

SEQ ID NO: 3938032 - RNA, 15 nt, Human adenovirus E
cuccaguguaagccc

SEQ ID NO: 3938033 - RNA, 21 nt, Human adenovirus E
ggugauccuccaccagagaag

SEQ ID NO: 3938034 - RNA, 16 nt, Human adenovirus E
ggugcccgaggccgcc

SEQ ID NO: 3938035 - RNA, 19 nt, Human adenovirus E
ggugcccgaggccgccagu

SEQ ID NO: 3938036 - RNA, 15 nt, Human adenovirus E
ggugccgcccaggac

SEQ ID NO: 3938037 - RNA, 17 nt, Human adenovirus E
gguggggcggccagcug

SEQ ID NO: 3938038 - RNA, 14 nt, Human adenovirus E
gguggucaugcuga

SEQ ID NO: 3938039 - RNA, 13 nt, Human adenovirus E
gguguccagcugg

SEQ ID NO: 3938040 - RNA, 15 nt, Human adenovirus E
ggugucggggaagga

SEQ ID NO: 3938041 - RNA, 13 nt, Human adenovirus E
gguguugcuuucg

SEQ ID NO: 3938042 - RNA, 22 nt, Human adenovirus E
gguguugcuuucgauuguggga

SEQ ID NO: 3938043 - RNA, 19 nt, Human adenovirus E
gguuagaguuuggaagcag

SEQ ID NO: 3938044 - RNA, 18 nt, Human adenovirus E
gguuguugaugaccuggg

SEQ ID NO: 3938045 - RNA, 16 nt, Human adenovirus E
guaacuguuguugauc

SEQ ID NO: 3938046 - RNA, 20 nt, Human adenovirus E
guaauuggcccgccgcccug

SEQ ID NO: 3938047 - RNA, 22 nt, Human adenovirus E
guacacauacaaagccucagcg

SEQ ID NO: 3938048 - RNA, 19 nt, Human adenovirus E
guacaggagccauaauggc

SEQ ID NO: 3938049 - RNA, 18 nt, Human adenovirus E
guacagguggcagaugcg

SEQ ID NO: 3938050 - RNA, 24 nt, Human adenovirus E
guacccucgaucccgggggcguag

SEQ ID NO: 3938051 - RNA, 18 nt, Human adenovirus E
guacuaugccuucugcua

SEQ ID NO: 3938052 - RNA, 24 nt, Human adenovirus E
guacucgcgcgccacgcacuucca

SEQ ID NO: 3938053 - RNA, 14 nt, Human adenovirus E
guacugcggcagau

SEQ ID NO: 3938054 - RNA, 16 nt, Human adenovirus E
guagaagagguggacg

SEQ ID NO: 3938055 - RNA, 21 nt, Human adenovirus E
guagaccacgacgcccucggg

SEQ ID NO: 3938056 - RNA, 13 nt, Human adenovirus E
guagagguaguug

SEQ ID NO: 3938057 - RNA, 16 nt, Human adenovirus E
guagcaauugaccaug

SEQ ID NO: 3938058 - RNA, 19 nt, Human adenovirus E
guagggacugaggggcgug

SEQ ID NO: 3938059 - RNA, 17 nt, Human adenovirus E
guagguauucccucucg

SEQ ID NO: 3938060 - RNA, 13 nt, Human adenovirus E
guaucccacccug

SEQ ID NO: 3938061 - RNA, 21 nt, Human adenovirus E
guauccgcagcagcgagcugg

SEQ ID NO: 3938062 - RNA, 13 nt, Human adenovirus E
gucaacaauagca

SEQ ID NO: 3938063 - RNA, 13 nt, Human adenovirus E
gucaaccacugcg

SEQ ID NO: 3938064 - RNA, 15 nt, Human adenovirus E
gucaccaccaagaac

SEQ ID NO: 3938065 - RNA, 13 nt, Human adenovirus E
gucaggccguccu

SEQ ID NO: 3938066 - RNA, 20 nt, Human adenovirus E
gucauagcaggggcgcaggg

SEQ ID NO: 3938067 - RNA, 23 nt, Human adenovirus E
gucauagcaggggcgcagggcau

SEQ ID NO: 3938068 - RNA, 22 nt, Human adenovirus E
guccagagauccacggccaggg

SEQ ID NO: 3938069 - RNA, 21 nt, Human adenovirus E
guccagcuggcgggcggcgcc

SEQ ID NO: 3938070 - RNA, 13 nt, Human adenovirus E
guccaggccagca

SEQ ID NO: 3938071 - RNA, 22 nt, Human adenovirus E
guccagggacucccucagcaug

SEQ ID NO: 3938072 - RNA, 22 nt, Human adenovirus E
gucccaugguggcgcagcugac

SEQ ID NO: 3938073 - RNA, 24 nt, Human adenovirus E
gucccaugguggcgcagcugaccu

SEQ ID NO: 3938074 - RNA, 21 nt, Human adenovirus E
gucccccguugggcagggaga

SEQ ID NO: 3938075 - RNA, 13 nt, Human adenovirus E
guccgggcgcugc

SEQ ID NO: 3938076 - RNA, 17 nt, Human adenovirus E
guccggguggaugauga

SEQ ID NO: 3938077 - RNA, 14 nt, Human adenovirus E
guccguguccccgu

SEQ ID NO: 3938078 - RNA, 16 nt, Human adenovirus E
guccucgcuguccugg

SEQ ID NO: 3938079 - RNA, 14 nt, Human adenovirus E
guccuggcgggggc

SEQ ID NO: 3938080 - RNA, 12 nt, Human adenovirus E
guccuuccaggg

SEQ ID NO: 3938081 - RNA, 17 nt, Human adenovirus E
gucgagggucuccugga

SEQ ID NO: 3938082 - RNA, 19 nt, Human adenovirus E
gucgcagggggccacgagc

SEQ ID NO: 3938083 - RNA, 17 nt, Human adenovirus E
gucgcccagcgccucca

SEQ ID NO: 3938084 - RNA, 20 nt, Human adenovirus E
gucgcccaucuccgaggacg

SEQ ID NO: 3938085 - RNA, 23 nt, Human adenovirus E
gucguuggagaugcggcccauga

SEQ ID NO: 3938086 - RNA, 19 nt, Human adenovirus E
gucuaccucuaccucugcc

SEQ ID NO: 3938087 - RNA, 21 nt, Human adenovirus E
gucuauguuggcacagcacag

SEQ ID NO: 3938088 - RNA, 15 nt, Human adenovirus E
gucuccaugagcucg

SEQ ID NO: 3938089 - RNA, 18 nt, Human adenovirus E
gucucgcacuccacgagc

SEQ ID NO: 3938090 - RNA, 17 nt, Human adenovirus E
gucucuucgggggcaga

SEQ ID NO: 3938091 - RNA, 14 nt, Human adenovirus E
gucugcagcgggcc

SEQ ID NO: 3938092 - RNA, 22 nt, Human adenovirus E
gucugcccgcaggcgggacaga

SEQ ID NO: 3938093 - RNA, 19 nt, Human adenovirus E
gucuucgcggugcccgagg

SEQ ID NO: 3938094 - RNA, 19 nt, Human adenovirus E
gugaagaagaccccgcagg

SEQ ID NO: 3938095 - RNA, 20 nt, Human adenovirus E
gugacacacucaaaaaaaua

SEQ ID NO: 3938096 - RNA, 12 nt, Human adenovirus E
gugacccugggc

SEQ ID NO: 3938097 - RNA, 17 nt, Human adenovirus E
gugaccgagcuggucau

SEQ ID NO: 3938098 - RNA, 22 nt, Human adenovirus E
gugagccgcgcccugggccagg

SEQ ID NO: 3938099 - RNA, 14 nt, Human adenovirus E
gugagcggggcugg

SEQ ID NO: 3938100 - RNA, 20 nt, Human adenovirus E
gugaggucaucauaggccau

SEQ ID NO: 3938101 - RNA, 16 nt, Human adenovirus E
gugcacccgugcagcc

SEQ ID NO: 3938102 - RNA, 11 nt, Human adenovirus E
gugcagaccaa

SEQ ID NO: 3938103 - RNA, 15 nt, Human adenovirus E
gugcagaccaaccug

SEQ ID NO: 3938104 - RNA, 22 nt, Human adenovirus E
gugcagcagaagcgugggccug

SEQ ID NO: 3938105 - RNA, 13 nt, Human adenovirus E
gugcagcccgagg

SEQ ID NO: 3938106 - RNA, 17 nt, Human adenovirus E
gugcaguggcgcgggcg

SEQ ID NO: 3938107 - RNA, 13 nt, Human adenovirus E
gugcauguugauc

SEQ ID NO: 3938108 - RNA, 12 nt, Human adenovirus E
gugccccagagc

SEQ ID NO: 3938109 - RNA, 21 nt, Human adenovirus E
gugccccgguucgaggccggc

SEQ ID NO: 3938110 - RNA, 12 nt, Human adenovirus E
guugcgcagggc

SEQ ID NO: 3938111 - RNA, 16 nt, Human adenovirus E
guugcgcagggccagg

SEQ ID NO: 3938112 - RNA, 17 nt, Human adenovirus E
guugcgcagggccaggc

SEQ ID NO: 3938113 - RNA, 12 nt, Human adenovirus E
guugggcaggga

SEQ ID NO: 3938114 - RNA, 12 nt, Human adenovirus E
guuguaccuggu

SEQ ID NO: 3938115 - RNA, 13 nt, Human adenovirus E
guuguugauuuua

SEQ ID NO: 3938116 - RNA, 19 nt, Human adenovirus E
guuguuggccagcugcacc

SEQ ID NO: 3938117 - RNA, 14 nt, Human adenovirus E
uaaacucacuuugu

SEQ ID NO: 3938118 - RNA, 12 nt, Human adenovirus E
uaaaggccaaag

SEQ ID NO: 3938119 - RNA, 21 nt, Human adenovirus E
uaacauuuuugccaugcguca

SEQ ID NO: 3938120 - RNA, 23 nt, Human adenovirus E
uaaccgccccgccgcccagcccc

SEQ ID NO: 3938121 - RNA, 12 nt, Human adenovirus E
uaaccuccacca

SEQ ID NO: 3938122 - RNA, 20 nt, Human adenovirus E
uaacucagguguccagcugg

SEQ ID NO: 3938123 - RNA, 16 nt, Human adenovirus E
uacaacgcgcugcugg

SEQ ID NO: 3938124 - RNA, 15 nt, Human adenovirus E
uacaccacccucucc

SEQ ID NO: 3938125 - RNA, 14 nt, Human adenovirus E
uacagcaacaaguu

SEQ ID NO: 3938126 - RNA, 14 nt, Human adenovirus E
uacaggagccauaa

SEQ ID NO: 3938127 - RNA, 15 nt, Human adenovirus E
uacagguggcagaug

SEQ ID NO: 3938128 - RNA, 14 nt, Human adenovirus E
uacauuaaaucagc

SEQ ID NO: 3938129 - RNA, 12 nt, Human adenovirus E
uaccaaugagca

SEQ ID NO: 3938130 - RNA, 17 nt, Human adenovirus E
uaccacaucacccucug

SEQ ID NO: 3938131 - RNA, 18 nt, Human adenovirus E
uaccagaacgaccacagc

SEQ ID NO: 3938132 - RNA, 21 nt, Human adenovirus E
uaccaggagaucacccacgug

SEQ ID NO: 3938133 - RNA, 21 nt, Human adenovirus E
uaccauugucaaugccaccuc

SEQ ID NO: 3938134 - RNA, 13 nt, Human adenovirus E
uacccgguggugg

SEQ ID NO: 3938135 - RNA, 15 nt, Human adenovirus E
uacccuucucccagg

SEQ ID NO: 3938136 - RNA, 15 nt, Human adenovirus E
uaccgagcagcagca

SEQ ID NO: 3938137 - RNA, 22 nt, Human adenovirus E
uaccggacaagauaaacaccgc

SEQ ID NO: 3938138 - RNA, 18 nt, Human adenovirus E
uaccgucaccuccacagc

SEQ ID NO: 3938139 - RNA, 13 nt, Human adenovirus E
uaccuccaccuga

SEQ ID NO: 3938140 - RNA, 18 nt, Human adenovirus E
uaccucgacccccagacc

SEQ ID NO: 3938141 - RNA, 21 nt, Human adenovirus E
uaccucugcucuaugcaauuc

SEQ ID NO: 3938142 - RNA, 13 nt, Human adenovirus E
uaccuuuggaagu

SEQ ID NO: 3938143 - RNA, 18 nt, Human adenovirus E
uacgaguugaaccucuuc

SEQ ID NO: 3938144 - RNA, 18 nt, Human adenovirus E
uacgcgcacuuccucaaa

SEQ ID NO: 3938145 - RNA, 15 nt, Human adenovirus E
uacgugcaacacaga

SEQ ID NO: 3938146 - RNA, 18 nt, Human adenovirus E
uacuaacaaccaaacuaa

SEQ ID NO: 3938147 - RNA, 14 nt, Human adenovirus E
uacucgcagcagcu

SEQ ID NO: 3938148 - RNA, 16 nt, Human adenovirus E
uacucgcagcagcugc

SEQ ID NO: 3938149 - RNA, 15 nt, Human adenovirus E
uacuucaaaaugaag

SEQ ID NO: 3938150 - RNA, 22 nt, Human adenovirus E
uacuuccaagaagaggcagcag

SEQ ID NO: 3938151 - RNA, 22 nt, Human adenovirus E
uacuuccgcgagacgcccaggc

SEQ ID NO: 3938152 - RNA, 12 nt, Human adenovirus E
uagacagcagcc

SEQ ID NO: 3938153 - RNA, 14 nt, Human adenovirus E
uagcccagaucuac

SEQ ID NO: 3938154 - RNA, 15 nt, Human adenovirus E
uagcgguccaucagc

SEQ ID NO: 3938155 - RNA, 14 nt, Human adenovirus E
uaggagcuccugga

SEQ ID NO: 3938156 - RNA, 23 nt, Human adenovirus E
uaggagcuccuggagcgaggcga

SEQ ID NO: 3938157 - RNA, 21 nt, Human adenovirus E
uaguugugguccugggugagg

SEQ ID NO: 3938158 - RNA, 14 nt, Human adenovirus E
uauccgcagcagcg

SEQ ID NO: 3938159 - RNA, 22 nt, Human adenovirus E
uaugcaauucugacaaugagga

SEQ ID NO: 3938160 - RNA, 20 nt, Human adenovirus E
ucaaccacugcgacaacgac

SEQ ID NO: 3938161 - RNA, 21 nt, Human adenovirus E
ucaaccccggcuucccccagg

SEQ ID NO: 3938162 - RNA, 18 nt, Human adenovirus E
ucaagcccagcaccagca

SEQ ID NO: 3938163 - RNA, 20 nt, Human adenovirus E
ucaaugucauuuucauacac

SEQ ID NO: 3938164 - RNA, 15 nt, Human adenovirus E
ucacaccuuccaccu

SEQ ID NO: 3938165 - RNA, 17 nt, Human adenovirus E
ucacaccuuccaccuga

SEQ ID NO: 3938166 - RNA, 21 nt, Human adenovirus E
ucaccaaacugucaaauacuc

SEQ ID NO: 3938167 - RNA, 17 nt, Human adenovirus E
ucaccagcuggccuugg

SEQ ID NO: 3938168 - RNA, 16 nt, Human adenovirus E
ucaccuccacagcccc

SEQ ID NO: 3938169 - RNA, 15 nt, Human adenovirus E
ucaccugcagcagau

SEQ ID NO: 3938170 - RNA, 14 nt, Human adenovirus E
ucaccuuccgcucc

SEQ ID NO: 3938171 - RNA, 19 nt, Human adenovirus E
ucacuuuguggacaacacc

SEQ ID NO: 3938172 - RNA, 20 nt, Human adenovirus E
ucacuuuguggacaacaccu

SEQ ID NO: 3938173 - RNA, 15 nt, Human adenovirus E
ucagacccacugcug

SEQ ID NO: 3938174 - RNA, 16 nt, Human adenovirus E
ucagcaucagucgucu

SEQ ID NO: 3938175 - RNA, 18 nt, Human adenovirus E
ucagcaucaucugggccu

SEQ ID NO: 3938176 - RNA, 22 nt, Human adenovirus E
ucagcgacgagcagcuggcccg

SEQ ID NO: 3938177 - RNA, 18 nt, Human adenovirus E
ucagcggcgagggccugc

SEQ ID NO: 3938178 - RNA, 12 nt, Human adenovirus E
ucagcuggaagu

SEQ ID NO: 3938179 - RNA, 15 nt, Human adenovirus E
ucagggccgggugcu

SEQ ID NO: 3938180 - RNA, 20 nt, Human adenovirus E
ucaggucggucuccacgcgg

SEQ ID NO: 3938181 - RNA, 17 nt, Human adenovirus E
ucaucaugagcaaagag

SEQ ID NO: 3938182 - RNA, 23 nt, Human adenovirus E
ucaucuuagcgcuagcagccgcg

SEQ ID NO: 3938183 - RNA, 20 nt, Human adenovirus E
ucaugaacugcucgaucucc

SEQ ID NO: 3938184 - RNA, 23 nt, Human adenovirus E
ucaugagcgcggucauggaccag

SEQ ID NO: 3938185 - RNA, 12 nt, Human adenovirus E
uccaacguggag

SEQ ID NO: 3938186 - RNA, 17 nt, Human adenovirus E
uccaagaagaggcagca

SEQ ID NO: 3938187 - RNA, 21 nt, Human adenovirus E
uccaagaagaggcagcagcag

SEQ ID NO: 3938188 - RNA, 18 nt, Human adenovirus E
uccaagucugugccaccc

SEQ ID NO: 3938189 - RNA, 23 nt, Human adenovirus E
uccaccagcggguccaccuuuuc

SEQ ID NO: 3938190 - RNA, 13 nt, Human adenovirus E
uccacgagccagg

SEQ ID NO: 3938191 - RNA, 15 nt, Human adenovirus E
uccacggccagggcg

SEQ ID NO: 3938192 - RNA, 14 nt, Human adenovirus E
uccacuuccucuuc

SEQ ID NO: 3938193 - RNA, 19 nt, Human adenovirus E
uccagagauccacggccag

SEQ ID NO: 3938194 - RNA, 20 nt, Human adenovirus E
uccagagauccacggccagg

SEQ ID NO: 3938195 - RNA, 16 nt, Human adenovirus E
uccagccgaaacucau

SEQ ID NO: 3938196 - RNA, 15 nt, Human adenovirus E
cgacaugcccgaccc

SEQ ID NO: 3938197 - RNA, 12 nt, Human adenovirus E
cgaccacagcaa

SEQ ID NO: 3938198 - RNA, 14 nt, Human adenovirus E
cgaccacagcaacu

SEQ ID NO: 3938199 - RNA, 13 nt, Human adenovirus E
cgacccgcaaccc

SEQ ID NO: 3938200 - RNA, 23 nt, Human adenovirus E
cgaccgccgcggccgccgugagc

SEQ ID NO: 3938201 - RNA, 17 nt, Human adenovirus E
cgacgagaagcagcagc

SEQ ID NO: 3938202 - RNA, 15 nt, Human adenovirus E
cgacuaccuccaccu

SEQ ID NO: 3938203 - RNA, 19 nt, Human adenovirus E
cgacuccguggccuggagg

SEQ ID NO: 3938204 - RNA, 20 nt, Human adenovirus E
cgacugcgucuaccucuacc

SEQ ID NO: 3938205 - RNA, 15 nt, Human adenovirus E
cgagacgcccaggcc

SEQ ID NO: 3938206 - RNA, 15 nt, Human adenovirus E
cgagagccgccucag

SEQ ID NO: 3938207 - RNA, 20 nt, Human adenovirus E
cgagcagaaggggggcaggg

SEQ ID NO: 3938208 - RNA, 19 nt, Human adenovirus E
cgagcagaccuaccaggag

SEQ ID NO: 3938209 - RNA, 13 nt, Human adenovirus E
cgagccaggugag

SEQ ID NO: 3938210 - RNA, 18 nt, Human adenovirus E
cgagcccgagggccgcug

SEQ ID NO: 3938211 - RNA, 24 nt, Human adenovirus E
cgagcgccccuuguggaagaagga

SEQ ID NO: 3938212 - RNA, 18 nt, Human adenovirus E
cgagcgcuccggcaccgc

SEQ ID NO: 3938213 - RNA, 21 nt, Human adenovirus E
cgaggagccccgggcccaggu

SEQ ID NO: 3938214 - RNA, 18 nt, Human adenovirus E
cgaggaggagcuggcagu

SEQ ID NO: 3938215 - RNA, 20 nt, Human adenovirus E
cgaggaggagcuggcagugc

SEQ ID NO: 3938216 - RNA, 15 nt, Human adenovirus E
cgaggaggaggcaga

SEQ ID NO: 3938217 - RNA, 15 nt, Human adenovirus E
cgaggccggccuggu

SEQ ID NO: 3938218 - RNA, 17 nt, Human adenovirus E
cgaggccggccuggugu

SEQ ID NO: 3938219 - RNA, 15 nt, Human adenovirus E
cgaggccguggccca

SEQ ID NO: 3938220 - RNA, 17 nt, Human adenovirus E
cgaggcggacgagcuga

SEQ ID NO: 3938221 - RNA, 16 nt, Human adenovirus E
cgagggcguggcugcc

SEQ ID NO: 3938222 - RNA, 17 nt, Human adenovirus E
cgagggggcgaggagcc

SEQ ID NO: 3938223 - RNA, 17 nt, Human adenovirus E
cgaggguucagccgcca

SEQ ID NO: 3938224 - RNA, 13 nt, Human adenovirus E
cgaggugccccuc

SEQ ID NO: 3938225 - RNA, 15 nt, Human adenovirus E
cgaggugccccucag

SEQ ID NO: 3938226 - RNA, 23 nt, Human adenovirus E
cgagguguaccaguccgggccgg

SEQ ID NO: 3938227 - RNA, 21 nt, Human adenovirus E
cgaguugcaagggcccagcga

SEQ ID NO: 3938228 - RNA, 20 nt, Human adenovirus E
cgaguuugcuuacggcaagc

SEQ ID NO: 3938229 - RNA, 17 nt, Human adenovirus E
cgauaaacucacuuugu

SEQ ID NO: 3938230 - RNA, 18 nt, Human adenovirus E
cgauuaugcagggugaug

SEQ ID NO: 3938231 - RNA, 19 nt, Human adenovirus E
cgauucccgaaccccacca

SEQ ID NO: 3938232 - RNA, 15 nt, Human adenovirus E
cgauuggacccaggc

SEQ ID NO: 3938233 - RNA, 22 nt, Human adenovirus E
cgcaagccgguauacaagccca

SEQ ID NO: 3938234 - RNA, 14 nt, Human adenovirus E
cgcaccugccccua

SEQ ID NO: 3938235 - RNA, 14 nt, Human adenovirus E
cgcagaacagggca

SEQ ID NO: 3938236 - RNA, 12 nt, Human adenovirus E
cgcagcagcgca

SEQ ID NO: 3938237 - RNA, 15 nt, Human adenovirus E
cgcagcagcgcaugc

SEQ ID NO: 3938238 - RNA, 15 nt, Human adenovirus E
cgcagccccccugcu

SEQ ID NO: 3938239 - RNA, 23 nt, Human adenovirus E
cgcagcuugcccucggccucggu

SEQ ID NO: 3938240 - RNA, 14 nt, Human adenovirus E
cgcagggaggugug

SEQ ID NO: 3938241 - RNA, 13 nt, Human adenovirus E
cgcagggccaggc

SEQ ID NO: 3938242 - RNA, 19 nt, Human adenovirus E
cgcaugaccaccugggcga

SEQ ID NO: 3938243 - RNA, 19 nt, Human adenovirus E
cgccaaccucgccaucugc

SEQ ID NO: 3938244 - RNA, 23 nt, Human adenovirus E
cgccaacgugccccggggccagg

SEQ ID NO: 3938245 - RNA, 11 nt, Human adenovirus E
cgccaccacca

SEQ ID NO: 3938246 - RNA, 21 nt, Human adenovirus E
cgccaccugcuccgcgcugcc

SEQ ID NO: 3938247 - RNA, 17 nt, Human adenovirus E
cgccagacgccgcaccu

SEQ ID NO: 3938248 - RNA, 14 nt, Human adenovirus E
cgccagcuccuccu

SEQ ID NO: 3938249 - RNA, 13 nt, Human adenovirus E
cgccaggccugca

SEQ ID NO: 3938250 - RNA, 15 nt, Human adenovirus E
cgcccaaggccgagc

SEQ ID NO: 3938251 - RNA, 19 nt, Human adenovirus E
cgcccagccccgccaccuc

SEQ ID NO: 3938252 - RNA, 22 nt, Human adenovirus E
cgcccugcgcgucggccaggua

SEQ ID NO: 3938253 - RNA, 15 nt, Human adenovirus E
cgcccugggccagga

SEQ ID NO: 3938254 - RNA, 20 nt, Human adenovirus E
cgccgacgagaagcagcagc

SEQ ID NO: 3938255 - RNA, 24 nt, Human adenovirus E
cgccgacgcggagacccugcgcaa

SEQ ID NO: 3938256 - RNA, 22 nt, Human adenovirus E
cgccgaggcucucuucaacaag

SEQ ID NO: 3938257 - RNA, 20 nt, Human adenovirus E
cgccgcaccgcucccuggcc

SEQ ID NO: 3938258 - RNA, 14 nt, Human adenovirus E
cgccgcccagcccc

SEQ ID NO: 3938259 - RNA, 22 nt, Human adenovirus E
cgccguagaaggcuggcgggga

SEQ ID NO: 3938260 - RNA, 12 nt, Human adenovirus E
cgccucaggcug

SEQ ID NO: 3938261 - RNA, 19 nt, Human adenovirus E
cgcgagacgcccaggccga

SEQ ID NO: 3938262 - RNA, 18 nt, Human adenovirus E
cgcgagcgguuccaccgc

SEQ ID NO: 3938263 - RNA, 21 nt, Human adenovirus E
cgcgagcugagcgaccaggag

SEQ ID NO: 3938264 - RNA, 22 nt, Human adenovirus E
cgcgaggaggugacccugggcc

SEQ ID NO: 3938265 - RNA, 17 nt, Human adenovirus E
cgcgagugccccccgcc

SEQ ID NO: 3938266 - RNA, 12 nt, Human adenovirus E
cgcgcaccaccg

SEQ ID NO: 3938267 - RNA, 22 nt, Human adenovirus E
cgcgcaccaguuccgccaggag

SEQ ID NO: 3938268 - RNA, 20 nt, Human adenovirus E
cgcgcaucuccagguggccg

SEQ ID NO: 3938269 - RNA, 13 nt, Human adenovirus E
cgcgcccugggcc

SEQ ID NO: 3938270 - RNA, 22 nt, Human adenovirus E
cgcgcgccgggcggcaggggcg

SEQ ID NO: 3938271 - RNA, 17 nt, Human adenovirus E
cgcgcggcuggcggugc

SEQ ID NO: 3938272 - RNA, 12 nt, Human adenovirus E
cgcgcucaucaa

SEQ ID NO: 3938273 - RNA, 16 nt, Human adenovirus E
cgcggagcacgaggag

SEQ ID NO: 3938274 - RNA, 15 nt, Human adenovirus E
cgcggaggaaggaag

SEQ ID NO: 3938275 - RNA, 24 nt, Human adenovirus E
cgcggccagggggucgcucucguc

SEQ ID NO: 3938276 - RNA, 21 nt, Human adenovirus E
cgcggccgccgugagcggggc

SEQ ID NO: 3938277 - RNA, 20 nt, Human adenovirus E
cgcggccguucaugggcacc

SEQ ID NO: 3938278 - RNA, 16 nt, Human adenovirus E
cgcgguaccuggcgcc

SEQ ID NO: 3938279 - RNA, 17 nt, Human adenovirus E
cgcgguggggcggccag

SEQ ID NO: 3938280 - RNA, 18 nt, Human adenovirus E
cgcucccuggggcgcccu

SEQ ID NO: 3938281 - RNA, 21 nt, Human adenovirus E
cgcuccgucaagcugcugcuc

SEQ ID NO: 3938282 - RNA, 14 nt, Human adenovirus E
cgcucgccacaucc

SEQ ID NO: 3938283 - RNA, 15 nt, Human adenovirus E
cgcugcccucggacu

SEQ ID NO: 3938284 - RNA, 22 nt, Human adenovirus E
cgcuggcuccuggaccugguga

SEQ ID NO: 3938285 - RNA, 15 nt, Human adenovirus E
cgcugguggcggugu

SEQ ID NO: 3938286 - RNA, 21 nt, Human adenovirus E
cgcuguccacgagcgccagcu

SEQ ID NO: 3938287 - RNA, 13 nt, Human adenovirus E
cgcuuacagccug

SEQ ID NO: 3938288 - RNA, 17 nt, Human adenovirus E
cggaaccacagggccag

SEQ ID NO: 3938289 - RNA, 23 nt, Human adenovirus E
cggaauaucaaaaucucugccgc

SEQ ID NO: 3938290 - RNA, 17 nt, Human adenovirus E
cggacgauuggacccag

SEQ ID NO: 3938291 - RNA, 18 nt, Human adenovirus E
cggagaaaacuggcguga

SEQ ID NO: 3938292 - RNA, 16 nt, Human adenovirus E
cggagcacgaggagga

SEQ ID NO: 3938293 - RNA, 21 nt, Human adenovirus E
cggaggcgacgggcucucgcc

SEQ ID NO: 3938294 - RNA, 12 nt, Human adenovirus E
cggaggugagcu

SEQ ID NO: 3938295 - RNA, 12 nt, Human adenovirus E
cggaugaagcac

SEQ ID NO: 3938296 - RNA, 13 nt, Human adenovirus E
cggcacucuccag

SEQ ID NO: 3938297 - RNA, 18 nt, Human adenovirus E
cggcagaucaacagccgc

SEQ ID NO: 3938298 - RNA, 14 nt, Human adenovirus E
cggcagaugcgccc

SEQ ID NO: 3938299 - RNA, 20 nt, Human adenovirus E
cggcauggcccgcgggcagg

SEQ ID NO: 3938300 - RNA, 15 nt, Human adenovirus E
cggccagccugcuga

SEQ ID NO: 3938301 - RNA, 23 nt, Human adenovirus E
cggccagcugaaaaccaucaugc

SEQ ID NO: 3938302 - RNA, 15 nt, Human adenovirus E
cggccauccuggagg

SEQ ID NO: 3938303 - RNA, 18 nt, Human adenovirus E
  misc_feature (8)..(8): n is a, c, g or u
cggccgancgccugggcg

SEQ ID NO: 3938304 - RNA, 13 nt, Human adenovirus E
cggccgcgcaccu

SEQ ID NO: 3938305 - RNA, 17 nt, Human adenovirus E
cggccggcgcgcuccac

SEQ ID NO: 3938306 - RNA, 20 nt, Human adenovirus E
cggccgucccagacaugcaa

SEQ ID NO: 3938307 - RNA, 16 nt, Human adenovirus E
cggccuugcgcaggga

SEQ ID NO: 3938308 - RNA, 13 nt, Human adenovirus E
cggcgacuaccuc

SEQ ID NO: 3938309 - RNA, 15 nt, Human adenovirus E
cggcgaugcagcccc

SEQ ID NO: 3938310 - RNA, 13 nt, Human adenovirus E
cggcgcgagcuga

SEQ ID NO: 3938311 - RNA, 14 nt, Human adenovirus E
cggcgcgagcugag

SEQ ID NO: 3938312 - RNA, 14 nt, Human adenovirus E
cggcgcggccagcc

SEQ ID NO: 3938313 - RNA, 14 nt, Human adenovirus E
ucgacucccaccug

SEQ ID NO: 3938314 - RNA, 17 nt, Human adenovirus E
ucgagagccacaccaca

SEQ ID NO: 3938315 - RNA, 21 nt, Human adenovirus E
ucgagggucugggcagcgacg

SEQ ID NO: 3938316 - RNA, 21 nt, Human adenovirus E
ucgcaagaggcagcccuucca

SEQ ID NO: 3938317 - RNA, 18 nt, Human adenovirus E
ucgcaucaggccccgcag

SEQ ID NO: 3938318 - RNA, 15 nt, Human adenovirus E
ucgccgcgcaggggc

SEQ ID NO: 3938319 - RNA, 15 nt, Human adenovirus E
ucgccuugugcaugg

SEQ ID NO: 3938320 - RNA, 15 nt, Human adenovirus E
ucgcgcacggccagc

SEQ ID NO: 3938321 - RNA, 13 nt, Human adenovirus E
ucgcgccugcugc

SEQ ID NO: 3938322 - RNA, 12 nt, Human adenovirus E
ucgcgcuucugc

SEQ ID NO: 3938323 - RNA, 14 nt, Human adenovirus E
ucgcugccgccgcc

SEQ ID NO: 3938324 - RNA, 17 nt, Human adenovirus E
ucggagagcgaagacga

SEQ ID NO: 3938325 - RNA, 14 nt, Human adenovirus E
ucggcgcgagcggg

SEQ ID NO: 3938326 - RNA, 14 nt, Human adenovirus E
ucguaggugagcuc

SEQ ID NO: 3938327 - RNA, 15 nt, Human adenovirus E
ucguccagggcagcu

SEQ ID NO: 3938328 - RNA, 12 nt, Human adenovirus E
ucgugcgagggg

SEQ ID NO: 3938329 - RNA, 17 nt, Human adenovirus E
ucgugcgccaggccugc

SEQ ID NO: 3938330 - RNA, 19 nt, Human adenovirus E
ucguggcgccugcaucucg

SEQ ID NO: 3938331 - RNA, 16 nt, Human adenovirus E
ucgugguauugcuauu

SEQ ID NO: 3938332 - RNA, 17 nt, Human adenovirus E
ucuaauacuaccaccca

SEQ ID NO: 3938333 - RNA, 18 nt, Human adenovirus E
ucuacaaggcccugggca

SEQ ID NO: 3938334 - RNA, 14 nt, Human adenovirus E
ucuacuucaacccc

SEQ ID NO: 3938335 - RNA, 19 nt, Human adenovirus E
ucuacuucaaccccuucuc

SEQ ID NO: 3938336 - RNA, 23 nt, Human adenovirus E
ucuaucucccgccugaaccugac

SEQ ID NO: 3938337 - RNA, 21 nt, Human adenovirus E
ucucaguuuuuccaacaacac

SEQ ID NO: 3938338 - RNA, 15 nt, Human adenovirus E
ucucaucaaguuuca

SEQ ID NO: 3938339 - RNA, 21 nt, Human adenovirus E
ucuccaccauuaaauauacug

SEQ ID NO: 3938340 - RNA, 12 nt, Human adenovirus E
ucuccgaaauuu

SEQ ID NO: 3938341 - RNA, 15 nt, Human adenovirus E
ucucuaauuccucaa

SEQ ID NO: 3938342 - RNA, 18 nt, Human adenovirus E
ucugacgccucuggguga

SEQ ID NO: 3938343 - RNA, 14 nt, Human adenovirus E
ucugcaaggagaag

SEQ ID NO: 3938344 - RNA, 20 nt, Human adenovirus E
ucugcaaggagaaggaggag

SEQ ID NO: 3938345 - RNA, 18 nt, Human adenovirus E
ucugccacaccuggcaga

SEQ ID NO: 3938346 - RNA, 15 nt, Human adenovirus E
ucuggagcaggcggc

SEQ ID NO: 3938347 - RNA, 23 nt, Human adenovirus E
ucuggaggaagacgaggaggagg

SEQ ID NO: 3938348 - RNA, 14 nt, Human adenovirus E
ucugggugaaggcc

SEQ ID NO: 3938349 - RNA, 13 nt, Human adenovirus E
ucuucccacuccc

SEQ ID NO: 3938350 - RNA, 11 nt, Human adenovirus E
ucuuccuccuc

SEQ ID NO: 3938351 - RNA, 16 nt, Human adenovirus E
ucuuccucuucuuggu

SEQ ID NO: 3938352 - RNA, 19 nt, Human adenovirus E
ucuucgagggucugggcag

SEQ ID NO: 3938353 - RNA, 18 nt, Human adenovirus E
ucuucuacuuccuccuca

SEQ ID NO: 3938354 - RNA, 15 nt, Human adenovirus E
ugaaacccuccgggc

SEQ ID NO: 3938355 - RNA, 21 nt, Human adenovirus E
ugaacaguauccgcagcagcg

SEQ ID NO: 3938356 - RNA, 15 nt, Human adenovirus E
ugaagauggagccau

SEQ ID NO: 3938357 - RNA, 21 nt, Human adenovirus E
ugaaggaggagagcaacuucc

SEQ ID NO: 3938358 - RNA, 17 nt, Human adenovirus E
ugaccggggccgggacc

SEQ ID NO: 3938359 - RNA, 13 nt, Human adenovirus E
ugaccucgucggg

SEQ ID NO: 3938360 - RNA, 12 nt, Human adenovirus E
ugaccugggcua

SEQ ID NO: 3938361 - RNA, 14 nt, Human adenovirus E
ugaccuugcagcag

SEQ ID NO: 3938362 - RNA, 23 nt, Human adenovirus E
ugacggccuuguaggcgcagcag

SEQ ID NO: 3938363 - RNA, 15 nt, Human adenovirus E
ugacggcggccugcc

SEQ ID NO: 3938364 - RNA, 18 nt, Human adenovirus E
ugagacgcugcggaguca

SEQ ID NO: 3938365 - RNA, 22 nt, Human adenovirus E
ugagcaaagagauucccacgcc

SEQ ID NO: 3938366 - RNA, 11 nt, Human adenovirus E
ugagcaccaca

SEQ ID NO: 3938367 - RNA, 15 nt, Human adenovirus E
ugagccgcuggaaga

SEQ ID NO: 3938368 - RNA, 16 nt, Human adenovirus E
ugagcgaccaggagcu

SEQ ID NO: 3938369 - RNA, 18 nt, Human adenovirus E
ugagcggcccugccaacc

SEQ ID NO: 3938370 - RNA, 17 nt, Human adenovirus E
ugagcuccucccucagc

SEQ ID NO: 3938371 - RNA, 15 nt, Human adenovirus E
ugagcugcgagaagg

SEQ ID NO: 3938372 - RNA, 22 nt, Human adenovirus E
ugaggacuccgccgacgacagc

SEQ ID NO: 3938373 - RNA, 23 nt, Human adenovirus E
ugagggcgaaagugucccugacc

SEQ ID NO: 3938374 - RNA, 13 nt, Human adenovirus E
ugagguggacgag

SEQ ID NO: 3938375 - RNA, 17 nt, Human adenovirus E
ugaguccgucggccaug

SEQ ID NO: 3938376 - RNA, 16 nt, Human adenovirus E
ugauaucuuccagaua

SEQ ID NO: 3938377 - RNA, 23 nt, Human adenovirus E
ugaucacuauucuuaucugccuc

SEQ ID NO: 3938378 - RNA, 19 nt, Human adenovirus E
ugaucgaggacgucagcgg

SEQ ID NO: 3938379 - RNA, 15 nt, Human adenovirus E
ugaugacagcaacag

SEQ ID NO: 3938380 - RNA, 13 nt, Human adenovirus E
ugaugcagcaggc

SEQ ID NO: 3938381 - RNA, 15 nt, Human adenovirus E
ugaugcccacggccc

SEQ ID NO: 3938382 - RNA, 13 nt, Human adenovirus E
ugauucaacaguu

SEQ ID NO: 3938383 - RNA, 16 nt, Human adenovirus E
ugcaaacuuccuccac

SEQ ID NO: 3938384 - RNA, 17 nt, Human adenovirus E
ugcaagacuccgaggag

SEQ ID NO: 3938385 - RNA, 16 nt, Human adenovirus E
ugcaagaguuccaggc

SEQ ID NO: 3938386 - RNA, 20 nt, Human adenovirus E
ugcaagcgccgcagcagugg

SEQ ID NO: 3938387 - RNA, 17 nt, Human adenovirus E
ugcacgagaaccgccug

SEQ ID NO: 3938388 - RNA, 22 nt, Human adenovirus E
ugcacgccgcaccgcucccugg

SEQ ID NO: 3938389 - RNA, 19 nt, Human adenovirus E
ugcacgguaagagccuagc

SEQ ID NO: 3938390 - RNA, 15 nt, Human adenovirus E
ugcacgugcugcacg

SEQ ID NO: 3938391 - RNA, 21 nt, Human adenovirus E
ugcagaacaaugacuucaccc

SEQ ID NO: 3938392 - RNA, 19 nt, Human adenovirus E
ugcagaaccccaccagcaa

SEQ ID NO: 3938393 - RNA, 15 nt, Human adenovirus E
ugcagcacuggaaca

SEQ ID NO: 3938394 - RNA, 19 nt, Human adenovirus E
ugcaggaccacaugcuugg

SEQ ID NO: 3938395 - RNA, 14 nt, Human adenovirus E
ugcaggagggggcc

SEQ ID NO: 3938396 - RNA, 17 nt, Human adenovirus E
ugcaggccugcgggggc

SEQ ID NO: 3938397 - RNA, 13 nt, Human adenovirus E
ugcaggucugccu

SEQ ID NO: 3938398 - RNA, 14 nt, Human adenovirus E
ugcaucccagcugg

SEQ ID NO: 3938399 - RNA, 17 nt, Human adenovirus E
ugcaucucuucagcacu

SEQ ID NO: 3938400 - RNA, 17 nt, Human adenovirus E
ugcaugccaacccuucc

SEQ ID NO: 3938401 - RNA, 19 nt, Human adenovirus E
ugcauguucauuuuugcuu

SEQ ID NO: 3938402 - RNA, 23 nt, Human adenovirus E
ugcccauauuagacuaugaggcc

SEQ ID NO: 3938403 - RNA, 15 nt, Human adenovirus E
ugccccagggcaugg

SEQ ID NO: 3938404 - RNA, 14 nt, Human adenovirus E
ugccccccgccgcu

SEQ ID NO: 3938405 - RNA, 13 nt, Human adenovirus E
ugcccccuccaga

SEQ ID NO: 3938406 - RNA, 16 nt, Human adenovirus E
ugccccggggccagga

SEQ ID NO: 3938407 - RNA, 14 nt, Human adenovirus E
ccaugcgcgcggcg

SEQ ID NO: 3938408 - RNA, 21 nt, Human adenovirus E
ccauguucagggcggccagac

SEQ ID NO: 3938409 - RNA, 12 nt, Human adenovirus E
ccauuacuggca

SEQ ID NO: 3938410 - RNA, 17 nt, Human adenovirus E
cccaacccgcgccucaa

SEQ ID NO: 3938411 - RNA, 17 nt, Human adenovirus E
cccacauuacacagaca

SEQ ID NO: 3938412 - RNA, 14 nt, Human adenovirus E
cccacccugcaugc

SEQ ID NO: 3938413 - RNA, 16 nt, Human adenovirus E
cccacggagcccaugg

SEQ ID NO: 3938414 - RNA, 17 nt, Human adenovirus E
cccacggaggccagcac

SEQ ID NO: 3938415 - RNA, 20 nt, Human adenovirus E
cccacggcccucagcaucag

SEQ ID NO: 3938416 - RNA, 22 nt, Human adenovirus E
cccagaaaccggugacacacuc

SEQ ID NO: 3938417 - RNA, 23 nt, Human adenovirus E
cccagagcgagguguaccagucc

SEQ ID NO: 3938418 - RNA, 21 nt, Human adenovirus E
cccagcagcaacuuccagcca

SEQ ID NO: 3938419 - RNA, 17 nt, Human adenovirus E
cccagccccgccaccuc

SEQ ID NO: 3938420 - RNA, 17 nt, Human adenovirus E
cccaggacuacuccacc

SEQ ID NO: 3938421 - RNA, 21 nt, Human adenovirus E
cccaggccgaaguccagcuga

SEQ ID NO: 3938422 - RNA, 16 nt, Human adenovirus E
gaagcccugcaggaag

SEQ ID NO: 3938423 - RNA, 14 nt, Human adenovirus E
gaagcgugggccug

SEQ ID NO: 3938424 - RNA, 17 nt, Human adenovirus E
gaaggauagcaagaaca

SEQ ID NO: 3938425 - RNA, 15 nt, Human adenovirus E
gaaggugcggggguc

SEQ ID NO: 3938426 - RNA, 14 nt, Human adenovirus E
gaagguggacccgg

SEQ ID NO: 3938427 - RNA, 21 nt, Human adenovirus E
gaagucguuggagaugcggcc

SEQ ID NO: 3938428 - RNA, 17 nt, Human adenovirus E
gaaucaggcuggagccg

SEQ ID NO: 3938429 - RNA, 18 nt, Human adenovirus E
gaaucgaguacaauaaca

SEQ ID NO: 3938430 - RNA, 16 nt, Human adenovirus E
gaaugagcagagucag

SEQ ID NO: 3938431 - RNA, 15 nt, Human adenovirus E
gacagcacucaggca

SEQ ID NO: 3938432 - RNA, 19 nt, Human adenovirus E
gacagcacucaggcagagg

SEQ ID NO: 3938433 - RNA, 20 nt, Human adenovirus E
gacagcacucaggcagagga

SEQ ID NO: 3938434 - RNA, 19 nt, Human adenovirus E
gacagcgaaccccgcagaa

SEQ ID NO: 3938435 - RNA, 19 nt, Human adenovirus E
gacagcgugguggcggacg

SEQ ID NO: 3938436 - RNA, 19 nt, Human adenovirus E
gacagcugccguccucccg

SEQ ID NO: 3938437 - RNA, 19 nt, Human adenovirus E
gacaggagcggcgaggagc

SEQ ID NO: 3938438 - RNA, 15 nt, Human adenovirus E
gacaucggcgugaag

SEQ ID NO: 3938439 - RNA, 20 nt, Human adenovirus E
  misc_feature (7)..(7): n is a, c, g or u
gacaucnagauucccacgga

SEQ ID NO: 3938440 - RNA, 18 nt, Human adenovirus E
gacaugcaucccagcugg

SEQ ID NO: 3938441 - RNA, 16 nt, Human adenovirus E
gaccacagcaacuucc

SEQ ID NO: 3938442 - RNA, 16 nt, Human adenovirus E
gaccagucgccagggc

SEQ ID NO: 3938443 - RNA, 12 nt, Human adenovirus E
gacccacugcug

SEQ ID NO: 3938444 - RNA, 12 nt, Human adenovirus E
gacccaggccau

SEQ ID NO: 3938445 - RNA, 21 nt, Human adenovirus E
gacccggacgugcagcccgag

SEQ ID NO: 3938446 - RNA, 13 nt, Human adenovirus E
gacccugggccug

SEQ ID NO: 3938447 - RNA, 17 nt, Human adenovirus E
gaccgacgugcgcgagg

SEQ ID NO: 3938448 - RNA, 13 nt, Human adenovirus E
gaccgagcuccag

SEQ ID NO: 3938449 - RNA, 17 nt, Human adenovirus E
gaccgagggggagagcu

SEQ ID NO: 3938450 - RNA, 15 nt, Human adenovirus E
gaccgaggugcccca

SEQ ID NO: 3938451 - RNA, 20 nt, Human adenovirus E
gaccgaggugccccagagcg

SEQ ID NO: 3938452 - RNA, 19 nt, Human adenovirus E
gaccgcggcgccgcgccgg

SEQ ID NO: 3938453 - RNA, 16 nt, Human adenovirus E
gaccgggggucccggc

SEQ ID NO: 3938454 - RNA, 20 nt, Human adenovirus E
gaccgggugcuaacgagcgc

SEQ ID NO: 3938455 - RNA, 16 nt, Human adenovirus E
gaccggugaggagcuc

SEQ ID NO: 3938456 - RNA, 13 nt, Human adenovirus E
gaccguggagcug

SEQ ID NO: 3938457 - RNA, 14 nt, Human adenovirus E
gaccugcacuggca

SEQ ID NO: 3938458 - RNA, 14 nt, Human adenovirus E
gaccugcuggaggc

SEQ ID NO: 3938459 - RNA, 15 nt, Human adenovirus E
gacgagcccgcgcgg

SEQ ID NO: 3938460 - RNA, 23 nt, Human adenovirus E
gacgauccccgggcgucgcaggg

SEQ ID NO: 3938461 - RNA, 15 nt, Human adenovirus E
gacgccaucagcgag

SEQ ID NO: 3938462 - RNA, 19 nt, Human adenovirus E
gacgccgccaccggugugc

SEQ ID NO: 3938463 - RNA, 22 nt, Human adenovirus E
gacgccuuugugcccgcccagg

SEQ ID NO: 3938464 - RNA, 13 nt, Human adenovirus E
gacgcucgcgagg

SEQ ID NO: 3938465 - RNA, 19 nt, Human adenovirus E
gacgcugcgcaacggccug

SEQ ID NO: 3938466 - RNA, 15 nt, Human adenovirus E
gacgcugcucaccac

SEQ ID NO: 3938467 - RNA, 19 nt, Human adenovirus E
gacggccuuguaggcgcag

SEQ ID NO: 3938468 - RNA, 16 nt, Human adenovirus E
gcauucacaugcucau

SEQ ID NO: 3938469 - RNA, 21 nt, Human adenovirus E
gcauucgcaagaggcagcccu

SEQ ID NO: 3938470 - RNA, 19 nt, Human adenovirus E
gccaaccucgccaucugcc

SEQ ID NO: 3938471 - RNA, 20 nt, Human adenovirus E
gccaacuaccuggccuacca

SEQ ID NO: 3938472 - RNA, 20 nt, Human adenovirus E
gccaacugaacgggggcgcc

SEQ ID NO: 3938473 - RNA, 18 nt, Human adenovirus E
gccacaauacaugcccau

SEQ ID NO: 3938474 - RNA, 14 nt, Human adenovirus E
gccacaccacagcu

SEQ ID NO: 3938475 - RNA, 16 nt, Human adenovirus E
gccacagaaguuucau

SEQ ID NO: 3938476 - RNA, 18 nt, Human adenovirus E
gccacagcgacccaugcu

SEQ ID NO: 3938477 - RNA, 13 nt, Human adenovirus E
gccacaguacaga

SEQ ID NO: 3938478 - RNA, 21 nt, Human adenovirus E
gccaccuccugaucccgcgau

SEQ ID NO: 3938479 - RNA, 18 nt, Human adenovirus E
gccaccucgccgcgcagg

SEQ ID NO: 3938480 - RNA, 16 nt, Human adenovirus E
gccacgaccgccgcgg

SEQ ID NO: 3938481 - RNA, 18 nt, Human adenovirus E
gccagaucguccagggca

SEQ ID NO: 3938482 - RNA, 16 nt, Human adenovirus E
gccagcacccagacca

SEQ ID NO: 3938483 - RNA, 21 nt, Human adenovirus E
gccagcaugucccgcccgcgg

SEQ ID NO: 3938484 - RNA, 21 nt, Human adenovirus E
gccagcgccggcaggacccgg

SEQ ID NO: 3938485 - RNA, 23 nt, Human adenovirus E
gccagcugaguuuucagcccgau

SEQ ID NO: 3938486 - RNA, 10 nt, Human adenovirus E
gccaggcgca

SEQ ID NO: 3938487 - RNA, 14 nt, Human adenovirus E
gccagggcuugcag

SEQ ID NO: 3938488 - RNA, 14 nt, Human adenovirus E
gccaggugaggucg

SEQ ID NO: 3938489 - RNA, 20 nt, Human adenovirus E
gccaggugaggucgggcugg

SEQ ID NO: 3938490 - RNA, 13 nt, Human adenovirus E
gccauccuggagg

SEQ ID NO: 3938491 - RNA, 13 nt, Human adenovirus E
gccaucggcuccu

SEQ ID NO: 3938492 - RNA, 16 nt, Human adenovirus E
gccaucgugcagaacc

SEQ ID NO: 3938493 - RNA, 19 nt, Human adenovirus E
gccaucuuccagcagaguc

SEQ ID NO: 3938494 - RNA, 20 nt, Human adenovirus E
gccauuggugauggacaugc

SEQ ID NO: 3938495 - RNA, 20 nt, Human adenovirus E
gcccaacccgcgccucaacu

SEQ ID NO: 3938496 - RNA, 22 nt, Human adenovirus E
gcccaacuacgcgcugcauccu

SEQ ID NO: 3938497 - RNA, 15 nt, Human adenovirus E
gcccagcaccagcac

SEQ ID NO: 3938498 - RNA, 18 nt, Human adenovirus E
gcccagccccgccaccuc

SEQ ID NO: 3938499 - RNA, 21 nt, Human adenovirus E
gcccaggccgaaguccagcug

SEQ ID NO: 3938500 - RNA, 18 nt, Human adenovirus E
gcccagguuuuccaugca

SEQ ID NO: 3938501 - RNA, 22 nt, Human adenovirus E
gcccaugaucaagcccagcacc

SEQ ID NO: 3938502 - RNA, 23 nt, Human adenovirus E
gccccgcagcagucgcugccgcc

SEQ ID NO: 3938503 - RNA, 13 nt, Human adenovirus E
gccccuuguggaa

SEQ ID NO: 3938504 - RNA, 14 nt, Human adenovirus E
gcccgcaggcggga

SEQ ID NO: 3938505 - RNA, 20 nt, Human adenovirus E
gcccgccaacgugccccggg

SEQ ID NO: 3938506 - RNA, 18 nt, Human adenovirus E
gcccgcgcuugcugggcg

SEQ ID NO: 3938507 - RNA, 13 nt, Human adenovirus E
gcccggcgagcgc

SEQ ID NO: 3938508 - RNA, 16 nt, Human adenovirus E
gcccggcgcgacuaca

SEQ ID NO: 3938509 - RNA, 15 nt, Human adenovirus E
gcccggcggcaccgg

SEQ ID NO: 3938510 - RNA, 16 nt, Human adenovirus E
gcccggguccaggcca

SEQ ID NO: 3938511 - RNA, 20 nt, Human adenovirus E
gcccgguuccacgcggggcg

SEQ ID NO: 3938512 - RNA, 17 nt, Human adenovirus E
gcccguggucagcgacg

SEQ ID NO: 3938513 - RNA, 20 nt, Human adenovirus E
gcccugcgcgucggccaggu

SEQ ID NO: 3938514 - RNA, 23 nt, Human adenovirus E
gcccugcgcgucggccagguagc

SEQ ID NO: 3938515 - RNA, 22 nt, Human adenovirus E
gcccuucgcccuagccgccucc

SEQ ID NO: 3938516 - RNA, 18 nt, Human adenovirus E
gccgagacgaugggcagg

SEQ ID NO: 3938517 - RNA, 19 nt, Human adenovirus E
gccgagacgaugggcaggc

SEQ ID NO: 3938518 - RNA, 23 nt, Human adenovirus E
gccgagacggucaacuccuccuc

SEQ ID NO: 3938519 - RNA, 22 nt, Human adenovirus E
gccgcagcaguggcagcggccg

SEQ ID NO: 3938520 - RNA, 18 nt, Human adenovirus E
gccgccgcaagaccacca

SEQ ID NO: 3938521 - RNA, 13 nt, Human adenovirus E
ugagcaccacagc

SEQ ID NO: 3938522 - RNA, 16 nt, Human adenovirus E
ugagcaccacagcgcc

SEQ ID NO: 3938523 - RNA, 12 nt, Human adenovirus E
ugagcgccagca

SEQ ID NO: 3938524 - RNA, 16 nt, Human adenovirus E
ugagcuccucccucag

SEQ ID NO: 3938525 - RNA, 12 nt, Human adenovirus E
ugagcucuucgc

SEQ ID NO: 3938526 - RNA, 12 nt, Human adenovirus E
ugagggacgagg

SEQ ID NO: 3938527 - RNA, 14 nt, Human adenovirus E
ugauauucuggagc

SEQ ID NO: 3938528 - RNA, 17 nt, Human adenovirus E
ugaucaccagcuggccu

SEQ ID NO: 3938529 - RNA, 18 nt, Human adenovirus E
ugauccccaucaucgccg

SEQ ID NO: 3938530 - RNA, 17 nt, Human adenovirus E
ugaucccgcgaugcggg

SEQ ID NO: 3938531 - RNA, 13 nt, Human adenovirus E
ugauccuccacca

SEQ ID NO: 3938532 - RNA, 13 nt, Human adenovirus E
ugaugcaggaggg

SEQ ID NO: 3938533 - RNA, 23 nt, Human adenovirus E
ugauggccgugguccuggugacc

SEQ ID NO: 3938534 - RNA, 14 nt, Human adenovirus E
ugauggcgggacgc

SEQ ID NO: 3938535 - RNA, 14 nt, Human adenovirus E
ugcaagacuccgag

SEQ ID NO: 3938536 - RNA, 17 nt, Human adenovirus E
ugcaagaguuccaggcg

SEQ ID NO: 3938537 - RNA, 21 nt, Human adenovirus E
ugcaagcggugcguuccagca

SEQ ID NO: 3938538 - RNA, 22 nt, Human adenovirus E
ugcaagcggugcguuccagcau

SEQ ID NO: 3938539 - RNA, 23 nt, Human adenovirus E
ugcaccgugcggugagcgccagc

SEQ ID NO: 3938540 - RNA, 12 nt, Human adenovirus E
ugcaccuguggg

SEQ ID NO: 3938541 - RNA, 20 nt, Human adenovirus E
ugcacgagaaccgccugggg

SEQ ID NO: 3938542 - RNA, 14 nt, Human adenovirus E
ugcacuggcagccc

SEQ ID NO: 3938543 - RNA, 18 nt, Human adenovirus E
ugcagaccaaccuggacc

SEQ ID NO: 3938544 - RNA, 21 nt, Human adenovirus E
ugcagacggaucccuggaugc

SEQ ID NO: 3938545 - RNA, 16 nt, Human adenovirus E
ugcagaggcgcuggua

SEQ ID NO: 3938546 - RNA, 12 nt, Human adenovirus E
ugcagcagcuga

SEQ ID NO: 3938547 - RNA, 19 nt, Human adenovirus E
ugcagcccccgcuggaggc

SEQ ID NO: 3938548 - RNA, 21 nt, Human adenovirus E
ugcagcgaagagaccccgggu

SEQ ID NO: 3938549 - RNA, 21 nt, Human adenovirus E
ugcagcggcagaucaacagcc

SEQ ID NO: 3938550 - RNA, 24 nt, Human adenovirus E
ugcagcugauggugcccaagcgcc

SEQ ID NO: 3938551 - RNA, 21 nt, Human adenovirus E
ugcaggccccggucggggacc

SEQ ID NO: 3938552 - RNA, 21 nt, Human adenovirus E
ugcaggccugcgggggcaaca

SEQ ID NO: 3938553 - RNA, 20 nt, Human adenovirus E
ugcagggccucgugcucggg

SEQ ID NO: 3938554 - RNA, 12 nt, Human adenovirus E
ugcagggccugu

SEQ ID NO: 3938555 - RNA, 15 nt, Human adenovirus E
ugcagggugaugagg

SEQ ID NO: 3938556 - RNA, 18 nt, Human adenovirus E
ugcaucgggcggccgcca

SEQ ID NO: 3938557 - RNA, 14 nt, Human adenovirus E
ugcaucucuucagc

SEQ ID NO: 3938558 - RNA, 24 nt, Human adenovirus E
ugcauguucauuuuugcuugcugc

SEQ ID NO: 3938559 - RNA, 23 nt, Human adenovirus E
  misc_feature (9)..(9): n is a, c, g or u
ugccaaccnuacuuuuuccaccc

SEQ ID NO: 3938560 - RNA, 18 nt, Human adenovirus E
ugccacaccuggcagacg

SEQ ID NO: 3938561 - RNA, 17 nt, Human adenovirus E
ugcccacggcccucagc

SEQ ID NO: 3938562 - RNA, 14 nt, Human adenovirus E
ugcccgccaccugc

SEQ ID NO: 3938563 - RNA, 12 nt, Human adenovirus E
ugcccucggccu

SEQ ID NO: 3938564 - RNA, 13 nt, Human adenovirus E
ugccgcccaggac

SEQ ID NO: 3938565 - RNA, 21 nt, Human adenovirus E
ugccgcccaggacuacuccac

SEQ ID NO: 3938566 - RNA, 15 nt, Human adenovirus E
ugccgcugcaaccuc

SEQ ID NO: 3938567 - RNA, 17 nt, Human adenovirus E
ugccgggcaggaggucg

SEQ ID NO: 3938568 - RNA, 15 nt, Human adenovirus E
ugcgcgccgagacgg

SEQ ID NO: 3938569 - RNA, 15 nt, Human adenovirus E
ugcgcgccgggcugg

SEQ ID NO: 3938570 - RNA, 18 nt, Human adenovirus E
ugcggaaccacagggcca

SEQ ID NO: 3938571 - RNA, 19 nt, Human adenovirus E
ugcggaacugguacuuggc

SEQ ID NO: 3938572 - RNA, 22 nt, Human adenovirus E
ugcggaacugguacuuggccag

SEQ ID NO: 3938573 - RNA, 16 nt, Human adenovirus E
ugcggcgcggccugga

SEQ ID NO: 3938574 - RNA, 16 nt, Human adenovirus E
ugcggcgggcgcagca

SEQ ID NO: 3938575 - RNA, 22 nt, Human adenovirus E
ugcgggcggcgcugcagagcca

SEQ ID NO: 3938576 - RNA, 18 nt, Human adenovirus E
ugcggugugccccgguuc

SEQ ID NO: 3938577 - RNA, 13 nt, Human adenovirus E
ugcguacccggag

SEQ ID NO: 3938578 - RNA, 23 nt, Human adenovirus E
ugcuaacgagcgccccuugugga

SEQ ID NO: 3938579 - RNA, 22 nt, Human adenovirus E
ugcuaccugcugcgccuggcca

SEQ ID NO: 3938580 - RNA, 19 nt, Human adenovirus E
ugcuagugaaggucagcgg

SEQ ID NO: 3938581 - RNA, 18 nt, Human adenovirus E
ugcuauuuuggaucugac

SEQ ID NO: 3938582 - RNA, 21 nt, Human adenovirus E
ugcucagucucaaguccagca

SEQ ID NO: 3938583 - RNA, 15 nt, Human adenovirus E
ugcucaugcaucucu

SEQ ID NO: 3938584 - RNA, 19 nt, Human adenovirus E
ugcuccugguucaccugca

SEQ ID NO: 3938585 - RNA, 21 nt, Human adenovirus E
ugcucgagugccacugccgcu

SEQ ID NO: 3938586 - RNA, 17 nt, Human adenovirus E
ugcucgaucuccuccuc

SEQ ID NO: 3938587 - RNA, 17 nt, Human adenovirus E
ugcucgcaacgcugcac

SEQ ID NO: 3938588 - RNA, 20 nt, Human adenovirus E
ugcucuacuacaucuucugc

SEQ ID NO: 3938589 - RNA, 19 nt, Human adenovirus E
ugcugaaaacaccaccugg

SEQ ID NO: 3938590 - RNA, 23 nt, Human adenovirus E
ugcuguagcauagucugccugcu

SEQ ID NO: 3938591 - RNA, 22 nt, Human adenovirus E
ugcuugcauuucaaucccaaca

SEQ ID NO: 3938592 - RNA, 12 nt, Human adenovirus E
ugcuugcugcua

SEQ ID NO: 3938593 - RNA, 15 nt, Human adenovirus E
uggaaacgcagaccg

SEQ ID NO: 3938594 - RNA, 16 nt, Human adenovirus E
uggaagaagcagccgc

SEQ ID NO: 3938595 - RNA, 17 nt, Human adenovirus E
uggaagaagcagccgcc

SEQ ID NO: 3938596 - RNA, 13 nt, Human adenovirus E
uggaagagcggcg

SEQ ID NO: 3938597 - RNA, 22 nt, Human adenovirus E
uggaaggcgacaacgcgcggcu

SEQ ID NO: 3938598 - RNA, 20 nt, Human adenovirus E
uggaauuuuaucaaguuucu

SEQ ID NO: 3938599 - RNA, 18 nt, Human adenovirus E
uggacaaaauaccaccuc

SEQ ID NO: 3938600 - RNA, 15 nt, Human adenovirus E
uggacaacaccugau

SEQ ID NO: 3938601 - RNA, 18 nt, Human adenovirus E
uggacaagaugagccgcu

SEQ ID NO: 3938602 - RNA, 22 nt, Human adenovirus E
uggacagaaaaucgcccaggca

SEQ ID NO: 3938603 - RNA, 18 nt, Human adenovirus E
uggaccacugccgccgcu

SEQ ID NO: 3938604 - RNA, 20 nt, Human adenovirus E
uggacccggacgugcagccc

SEQ ID NO: 3938605 - RNA, 17 nt, Human adenovirus E
uggaccucgauuccucg

SEQ ID NO: 3938606 - RNA, 22 nt, Human adenovirus E
uggaccuggccaaccaggccgu

SEQ ID NO: 3938607 - RNA, 19 nt, Human adenovirus E
uggaugcucuauacgggca

SEQ ID NO: 3938608 - RNA, 21 nt, Human adenovirus E
uggcacgacaggcagcgggga

SEQ ID NO: 3938609 - RNA, 20 nt, Human adenovirus E
uggcacuaaucacacauuga

SEQ ID NO: 3938610 - RNA, 18 nt, Human adenovirus E
uggcagaucacccugcuc

SEQ ID NO: 3938611 - RNA, 19 nt, Human adenovirus E
uggcaucggcacucuccag

SEQ ID NO: 3938612 - RNA, 22 nt, Human adenovirus E
uggccagaucguccagggcagc

SEQ ID NO: 3938613 - RNA, 17 nt, Human adenovirus E
uggcccgugaggcgcgc

SEQ ID NO: 3938614 - RNA, 22 nt, Human adenovirus E
uggcgauguuaccgcccagauc

SEQ ID NO: 3938615 - RNA, 19 nt, Human adenovirus E
uggcgcggcugcucaggcu

SEQ ID NO: 3938616 - RNA, 18 nt, Human adenovirus E
uggcggccaucaacuucu

SEQ ID NO: 3938617 - RNA, 20 nt, Human adenovirus E
uggcggcgauguugagcugc

SEQ ID NO: 3938618 - RNA, 16 nt, Human adenovirus E
uggcgggcggcgccac

SEQ ID NO: 3938619 - RNA, 21 nt, Human adenovirus E
ugggaaugcgcgugcacgaag

SEQ ID NO: 3938620 - RNA, 22 nt, Human adenovirus E
ugggacgauguggacagcagcg

SEQ ID NO: 3938621 - RNA, 14 nt, Human adenovirus E
ugggcagggagagg

SEQ ID NO: 3938622 - RNA, 15 nt, Human adenovirus E
ugggcguguggcagc

SEQ ID NO: 3938623 - RNA, 20 nt, Human adenovirus E
uggggcaguuucuugagcuc

SEQ ID NO: 3938624 - RNA, 16 nt, Human adenovirus E
uggggcgugcaggccc

SEQ ID NO: 3938625 - RNA, 16 nt, Human adenovirus E
ugggucugcgaccuga

SEQ ID NO: 3938626 - RNA, 21 nt, Human adenovirus E
uggucagcgacgagcagcugg

SEQ ID NO: 3938627 - RNA, 22 nt, Human adenovirus E
uggucagggucuuguugcuagu

SEQ ID NO: 3938628 - RNA, 19 nt, Human adenovirus E
ugguccuggugaccgugga

SEQ ID NO: 3938629 - RNA, 22 nt, Human adenovirus E
uggucuccacguuccacacagu

SEQ ID NO: 3938630 - RNA, 18 nt, Human adenovirus E
ugguggcgcgcaccucgc

SEQ ID NO: 3938631 - RNA, 13 nt, Human adenovirus E
uggugggcgccga

SEQ ID NO: 3938632 - RNA, 14 nt, Human adenovirus E
uguaaaacagccac

SEQ ID NO: 3938633 - RNA, 21 nt, Human adenovirus E
uguaccccaccaugcagcuga

SEQ ID NO: 3938634 - RNA, 15 nt, Human adenovirus E
uguaggcgcagcagc

SEQ ID NO: 3938635 - RNA, 17 nt, Human adenovirus E
ugucauacuugagcugu

SEQ ID NO: 3938636 - RNA, 22 nt, Human adenovirus E
uguccaaaaagcgcguccgggu

SEQ ID NO: 3938637 - RNA, 15 nt, Human adenovirus E
ugucgcaucaggccc

SEQ ID NO: 3938638 - RNA, 14 nt, Human adenovirus E
ugucuugcugcccg

SEQ ID NO: 3938639 - RNA, 14 nt, Human adenovirus E
uguggacagcagcg

SEQ ID NO: 3938640 - RNA, 19 nt, Human adenovirus E
ugugggaccugcuggaggc

SEQ ID NO: 3938641 - RNA, 12 nt, Human adenovirus E
uguucaacaguc

SEQ ID NO: 3938642 - RNA, 23 nt, Human adenovirus E
uguuccacgguggcuuccagcaa

SEQ ID NO: 3938643 - RNA, 14 nt, Human adenovirus E
uguuccugaugcag

SEQ ID NO: 3938644 - RNA, 14 nt, Human adenovirus E
uguuggccagcugc

SEQ ID NO: 3938645 - RNA, 15 nt, Human adenovirus E
uuaacgcgcacaaaa

SEQ ID NO: 3938646 - RNA, 19 nt, Human adenovirus E
uuacaaaguaacuguuguu

SEQ ID NO: 3938647 - RNA, 15 nt, Human adenovirus E
uuacuccccuccugc

SEQ ID NO: 3938648 - RNA, 17 nt, Human adenovirus E
uuagcgcucuaguuuuu

SEQ ID NO: 3938649 - RNA, 23 nt, Human adenovirus E
uucaccaccugcaucugcugcug

SEQ ID NO: 3938650 - RNA, 19 nt, Human adenovirus E
uucacccggcgcuaccugc

SEQ ID NO: 3938651 - RNA, 15 nt, Human adenovirus E
uucaccugcagcaga

SEQ ID NO: 3938652 - RNA, 14 nt, Human adenovirus E
uucagagacaggag

SEQ ID NO: 3938653 - RNA, 21 nt, Human adenovirus E
uucagcgcacucucgaggacg

SEQ ID NO: 3938654 - RNA, 21 nt, Human adenovirus E
uucauauccucuccgaaauuu

SEQ ID NO: 3938655 - RNA, 20 nt, Human adenovirus E
uuccacgguggcuuccagca

SEQ ID NO: 3938656 - RNA, 19 nt, Human adenovirus E
uuccagggcgcgcgggagg

SEQ ID NO: 3938657 - RNA, 23 nt, Human adenovirus E
uucgugcgccaggccugcaagau

SEQ ID NO: 3938658 - RNA, 20 nt, Human adenovirus E
uucuuaucugccuccuccaa

SEQ ID NO: 3938659 - RNA, 13 nt, Human adenovirus E
uugaacaugcagc

SEQ ID NO: 3938660 - RNA, 11 nt, Human adenovirus E
uugcaagcgcc

SEQ ID NO: 3938661 - RNA, 23 nt, Human adenovirus E
uugccugaacgccugcugggccu

SEQ ID NO: 3938662 - RNA, 14 nt, Human adenovirus E
uugcgcacaugugc

SEQ ID NO: 3938663 - RNA, 16 nt, Human adenovirus E
uuggcgauggagcgca

SEQ ID NO: 3938664 - RNA, 15 nt, Human adenovirus E
uugucggaucaaauu

SEQ ID NO: 3938665 - RNA, 23 nt, Human adenovirus E
uuuccagggcgcgcgggaggucc

SEQ ID NO: 3938666 - RNA, 18 nt, Human adenovirus E
uuugauacugauggaaac

SEQ ID NO: 3938667 - RNA, 23 nt, Human adenovirus E
uuuuacaguauggugauugaacu

SEQ ID NO: 3938668 - RNA, 17 nt, Human adenovirus E
uuuucauuuuuccagcc

SEQ ID NO: 3938669 - RNA, 12 nt, Human adenovirus E
uuuuuccuccac

SEQ ID NO: 3938670 - RNA, 20 nt, Human adenovirus E
aaccgccccgccgcccagcc

SEQ ID NO: 3938671 - RNA, 13 nt, Human adenovirus E
aacgccauccuga

SEQ ID NO: 3938672 - RNA, 12 nt, Human adenovirus E
aacgcccaaaac

SEQ ID NO: 3938673 - RNA, 14 nt, Human adenovirus E
aacgcgcacaaaaa

SEQ ID NO: 3938674 - RNA, 18 nt, Human adenovirus E
aacgcucgguguugaaau

SEQ ID NO: 3938675 - RNA, 19 nt, Human adenovirus E
aacgugcagaccaaccugg

SEQ ID NO: 3938676 - RNA, 20 nt, Human adenovirus E
aacgugccccggggccagga

SEQ ID NO: 3938677 - RNA, 19 nt, Human adenovirus E
aacucagguguccagcugg

SEQ ID NO: 3938678 - RNA, 14 nt, Human adenovirus E
aacucguaccuggg

SEQ ID NO: 3938679 - RNA, 17 nt, Human adenovirus E
aacuggugcuugaaguc

SEQ ID NO: 3938680 - RNA, 15 nt, Human adenovirus E
aacugucaaauacuc

SEQ ID NO: 3938681 - RNA, 16 nt, Human adenovirus E
aacuugcagggccugu

SEQ ID NO: 3938682 - RNA, 11 nt, Human adenovirus E
aagaagcagcc

SEQ ID NO: 3938683 - RNA, 13 nt, Human adenovirus E
aagacgaggagga

SEQ ID NO: 3938684 - RNA, 14 nt, Human adenovirus E
aagacgugcuggag

SEQ ID NO: 3938685 - RNA, 21 nt, Human adenovirus E
aagagaaggccgaucccugcu

SEQ ID NO: 3938686 - RNA, 21 nt, Human adenovirus E
aagagcagaacuuccagcaga

SEQ ID NO: 3938687 - RNA, 18 nt, Human adenovirus E
aagagccuuucggugcga

SEQ ID NO: 3938688 - RNA, 18 nt, Human adenovirus E
aagaugccgggcaggagg

SEQ ID NO: 3938689 - RNA, 13 nt, Human adenovirus E
aagauggagccau

SEQ ID NO: 3938690 - RNA, 21 nt, Human adenovirus E
aagauggagccauagcaacca

SEQ ID NO: 3938691 - RNA, 14 nt, Human adenovirus E
aagauguugaagug

SEQ ID NO: 3938692 - RNA, 23 nt, Human adenovirus E
aagcccacggccgccagcuccuc

SEQ ID NO: 3938693 - RNA, 18 nt, Human adenovirus E
aagcgcccgaggaagcaa

SEQ ID NO: 3938694 - RNA, 21 nt, Human adenovirus E
aagguccagaaaaagccacag

SEQ ID NO: 3938695 - RNA, 22 nt, Human adenovirus E
aaguagcugauggaaguggcca

SEQ ID NO: 3938696 - RNA, 14 nt, Human adenovirus E
aaguccagcaaagc

SEQ ID NO: 3938697 - RNA, 15 nt, Human adenovirus E
aaguccagcaaagcg

SEQ ID NO: 3938698 - RNA, 21 nt, Human adenovirus E
aaguggaaaccuaaaccccau

SEQ ID NO: 3938699 - RNA, 20 nt, Human adenovirus E
aauaauacuuucauuuuugc

SEQ ID NO: 3938700 - RNA, 14 nt, Human adenovirus E
aaucaggcagcacc

SEQ ID NO: 3938701 - RNA, 15 nt, Human adenovirus E
aaucaucauguuaca

SEQ ID NO: 3938702 - RNA, 12 nt, Human adenovirus E
aauccuccaggu

SEQ ID NO: 3938703 - RNA, 19 nt, Human adenovirus E
aaugagcagagucaggcug

SEQ ID NO: 3938704 - RNA, 16 nt, Human adenovirus E
aaugauucgacaagau

SEQ ID NO: 3938705 - RNA, 17 nt, Human adenovirus E
aaugcaaauuccaagaa

SEQ ID NO: 3938706 - RNA, 16 nt, Human adenovirus E
aaugcuaccgccaaaa

SEQ ID NO: 3938707 - RNA, 15 nt, Human adenovirus E
aaugucauuuucaua

SEQ ID NO: 3938708 - RNA, 13 nt, Human adenovirus E
aauucaaggaaga

SEQ ID NO: 3938709 - RNA, 21 nt, Human adenovirus E
aauugucgcuaugauugaaaa

SEQ ID NO: 3938710 - RNA, 14 nt, Human adenovirus E
aauuuuuagccaua

SEQ ID NO: 3938711 - RNA, 15 nt, Human adenovirus E
acaaagccucagcgu

SEQ ID NO: 3938712 - RNA, 17 nt, Human adenovirus E
acaagaugagccgcugg

SEQ ID NO: 3938713 - RNA, 14 nt, Human adenovirus E
acacaacaggcgca

SEQ ID NO: 3938714 - RNA, 18 nt, Human adenovirus E
acaccuggaccacugccg

SEQ ID NO: 3938715 - RNA, 13 nt, Human adenovirus E
acaccuuccaccu

SEQ ID NO: 3938716 - RNA, 20 nt, Human adenovirus E
acacgggguugcagcacugg

SEQ ID NO: 3938717 - RNA, 12 nt, Human adenovirus E
acacugguggcc

SEQ ID NO: 3938718 - RNA, 16 nt, Human adenovirus E
acacugguggccaccu

SEQ ID NO: 3938719 - RNA, 18 nt, Human adenovirus E
acacuguaucccacccug

SEQ ID NO: 3938720 - RNA, 22 nt, Human adenovirus E
acagaguuaugaucaccagcug

SEQ ID NO: 3938721 - RNA, 18 nt, Human adenovirus E
acagcaccaacgugcaga

SEQ ID NO: 3938722 - RNA, 20 nt, Human adenovirus E
acagcaccaacgugcagacc

SEQ ID NO: 3938723 - RNA, 20 nt, Human adenovirus E
acagcacucaggcagaggag

SEQ ID NO: 3938724 - RNA, 17 nt, Human adenovirus E
acagcagcagagguugc

SEQ ID NO: 3938725 - RNA, 21 nt, Human adenovirus E
acagcagucaggcagaggagg

SEQ ID NO: 3938726 - RNA, 16 nt, Human adenovirus E
acagccacucucucag

SEQ ID NO: 3938727 - RNA, 19 nt, Human adenovirus E
acagcgaaccccgcagaac

SEQ ID NO: 3938728 - RNA, 22 nt, Human adenovirus E
acagcugccguccucccggagg

SEQ ID NO: 3938729 - RNA, 14 nt, Human adenovirus E
acaggcagcaaagc

SEQ ID NO: 3938730 - RNA, 15 nt, Human adenovirus E
acagggcaauccucg

SEQ ID NO: 3938731 - RNA, 12 nt, Human adenovirus E
acaguacagaua

SEQ ID NO: 3938732 - RNA, 22 nt, Human adenovirus E
acaucacccucugguugaacau

SEQ ID NO: 3938733 - RNA, 12 nt, Human adenovirus E
acaugcagcccc

SEQ ID NO: 3938734 - RNA, 23 nt, Human adenovirus E
acauggaauacaccacccucucc

SEQ ID NO: 3938735 - RNA, 23 nt, Human adenovirus E
acauucuacacuaaaaaaauacu

SEQ ID NO: 3938736 - RNA, 20 nt, Human adenovirus E
accaacgccauccugaaucc

SEQ ID NO: 3938737 - RNA, 19 nt, Human adenovirus E
accacagcaaccucaggca

SEQ ID NO: 3938738 - RNA, 18 nt, Human adenovirus E
accacagcaacuuccuga

SEQ ID NO: 3938739 - RNA, 17 nt, Human adenovirus E
accacagggccagcacc

SEQ ID NO: 3938740 - RNA, 16 nt, Human adenovirus E
accaccacuacagccu

SEQ ID NO: 3938741 - RNA, 18 nt, Human adenovirus E
accacccucuccccccgc

SEQ ID NO: 3938742 - RNA, 21 nt, Human adenovirus E
accaccucccgguaccacauc

SEQ ID NO: 3938743 - RNA, 20 nt, Human adenovirus E
accaccugcaucugcugcug

SEQ ID NO: 3938744 - RNA, 18 nt, Human adenovirus E
accacgugcgcacccuga

SEQ ID NO: 3938745 - RNA, 13 nt, Human adenovirus E
accacuacagccu

SEQ ID NO: 3938746 - RNA, 22 nt, Human adenovirus E
accagccccagaugggccuggc

SEQ ID NO: 3938747 - RNA, 22 nt, Human adenovirus E
accaggaaauuccccagcccac

SEQ ID NO: 3938748 - RNA, 15 nt, Human adenovirus E
accaguccgggccgg

SEQ ID NO: 3938749 - RNA, 16 nt, Human adenovirus E
accaugcagcugaugg

SEQ ID NO: 3938750 - RNA, 13 nt, Human adenovirus E
accaugcuagccu

SEQ ID NO: 3938751 - RNA, 14 nt, Human adenovirus E
accaugcuagccug

SEQ ID NO: 3938752 - RNA, 16 nt, Human adenovirus E
accauggaggugcaga

SEQ ID NO: 3938753 - RNA, 16 nt, Human adenovirus E
acccaacauacuuuua

SEQ ID NO: 3938754 - RNA, 21 nt, Human adenovirus E
acccagaccgguaagaaggag

SEQ ID NO: 3938755 - RNA, 22 nt, Human adenovirus E
acccagcccgccaacgugcccc

SEQ ID NO: 3938756 - RNA, 17 nt, Human adenovirus E
accccaccacccagacc

SEQ ID NO: 3938757 - RNA, 16 nt, Human adenovirus E
accccaccaugcagcu

SEQ ID NO: 3938758 - RNA, 17 nt, Human adenovirus E
acccccgccgcggcgcc

SEQ ID NO: 3938759 - RNA, 21 nt, Human adenovirus E
acccgcagaagcaagcuccag

SEQ ID NO: 3938760 - RNA, 24 nt, Human adenovirus E
acccgcguucugcgcgcgggaguu

SEQ ID NO: 3938761 - RNA, 15 nt, Human adenovirus E
acccggacgugcagc

SEQ ID NO: 3938762 - RNA, 15 nt, Human adenovirus E
acccggcucugaacc

SEQ ID NO: 3938763 - RNA, 20 nt, Human adenovirus E
acccggugauaucuuccaga

SEQ ID NO: 3938764 - RNA, 22 nt, Human adenovirus E
acccgguggaucuuuuccagga

SEQ ID NO: 3938765 - RNA, 22 nt, Human adenovirus E
acccucuccccccgcacagccu

SEQ ID NO: 3938766 - RNA, 18 nt, Human adenovirus E
acccugggccugaugcac

SEQ ID NO: 3938767 - RNA, 20 nt, Human adenovirus E
acccugugucgucaccgccc

SEQ ID NO: 3938768 - RNA, 12 nt, Human adenovirus E
accgagcuccag

SEQ ID NO: 3938769 - RNA, 16 nt, Human adenovirus E
accgcacccgcgccga

SEQ ID NO: 3938770 - RNA, 18 nt, Human adenovirus E
accgccgacgagaagcag

SEQ ID NO: 3938771 - RNA, 18 nt, Human adenovirus E
accgccuaccgcagcugg

SEQ ID NO: 3938772 - RNA, 18 nt, Human adenovirus E
accgcgccauugguggcg

SEQ ID NO: 3938773 - RNA, 21 nt, Human adenovirus E
accgcucccuggccugcaacc

SEQ ID NO: 3938774 - RNA, 21 nt, Human adenovirus E
accggcucucggccauccugg

SEQ ID NO: 3938775 - RNA, 19 nt, Human adenovirus E
accgggugauccuccacca

SEQ ID NO: 3938776 - RNA, 15 nt, Human adenovirus E
accggugaggagcuc

SEQ ID NO: 3938777 - RNA, 23 nt, Human adenovirus E
accgugcggugagcgccagcagg

SEQ ID NO: 3938778 - RNA, 11 nt, Human adenovirus E
accguggagcu

SEQ ID NO: 3938779 - RNA, 14 nt, Human adenovirus E
accguggugcagaa

SEQ ID NO: 3938780 - RNA, 21 nt, Human adenovirus E
accucaggcacacgcacuacc

SEQ ID NO: 3938781 - RNA, 18 nt, Human adenovirus E
accucccgguaccacauc

SEQ ID NO: 3938782 - RNA, 17 nt, Human adenovirus E
accucgauuccucggga

SEQ ID NO: 3938783 - RNA, 17 nt, Human adenovirus E
accugaaagagcucugc

SEQ ID NO: 3938784 - RNA, 15 nt, Human adenovirus E
accugacacaccacc

SEQ ID NO: 3938785 - RNA, 20 nt, Human adenovirus E
accugcagcagauugacaag

SEQ ID NO: 3938786 - RNA, 14 nt, Human adenovirus E
ccacuacagccuag

SEQ ID NO: 3938787 - RNA, 19 nt, Human adenovirus E
ccacugccgcugcaaccuc

SEQ ID NO: 3938788 - RNA, 23 nt, Human adenovirus E
ccacuuagcauuaccacacagac

SEQ ID NO: 3938789 - RNA, 17 nt, Human adenovirus E
ccacuugaacucgggga

SEQ ID NO: 3938790 - RNA, 16 nt, Human adenovirus E
ccagaaaaagccacag

SEQ ID NO: 3938791 - RNA, 17 nt, Human adenovirus E
ccagaacacgcugccca

SEQ ID NO: 3938792 - RNA, 22 nt, Human adenovirus E
ccagacaugcaagagauggagg

SEQ ID NO: 3938793 - RNA, 21 nt, Human adenovirus E
ccagaguuuggaagagcggcg

SEQ ID NO: 3938794 - RNA, 12 nt, Human adenovirus E
ccagauccucag

SEQ ID NO: 3938795 - RNA, 15 nt, Human adenovirus E
ccagaugggccuggc

SEQ ID NO: 3938796 - RNA, 23 nt, Human adenovirus E
ccagcaccaggcaggccacgggg

SEQ ID NO: 3938797 - RNA, 23 nt, Human adenovirus E
ccagcagcuagaaaauccacagc

SEQ ID NO: 3938798 - RNA, 20 nt, Human adenovirus E
ccagcaugucccgcccgcgg

SEQ ID NO: 3938799 - RNA, 20 nt, Human adenovirus E
ccagccccgauuaugcaggg

SEQ ID NO: 3938800 - RNA, 19 nt, Human adenovirus E
ccagccccgccaccuccga

SEQ ID NO: 3938801 - RNA, 21 nt, Human adenovirus E
ccagcccgccaacgugccccg

SEQ ID NO: 3938802 - RNA, 13 nt, Human adenovirus E
ccagcgcgugacc

SEQ ID NO: 3938803 - RNA, 20 nt, Human adenovirus E
ccagcugacuaacucaggug

SEQ ID NO: 3938804 - RNA, 12 nt, Human adenovirus E
ccagcugcacca

SEQ ID NO: 3938805 - RNA, 19 nt, Human adenovirus E
ccagcugcaccacgcugcg

SEQ ID NO: 3938806 - RNA, 22 nt, Human adenovirus E
ccagcugcaccacgcugcgccc

SEQ ID NO: 3938807 - RNA, 20 nt, Human adenovirus E
ccaggaaauuccccagccca

SEQ ID NO: 3938808 - RNA, 21 nt, Human adenovirus E
ccaggccgaaguccagcugac

SEQ ID NO: 3938809 - RNA, 14 nt, Human adenovirus E
ccaggcggucccag

SEQ ID NO: 3938810 - RNA, 20 nt, Human adenovirus E
ccagggacucccucagcaug

SEQ ID NO: 3938811 - RNA, 15 nt, Human adenovirus E
ccagucucauugccg

SEQ ID NO: 3938812 - RNA, 22 nt, Human adenovirus E
ccagugagcauugccaaaugca

SEQ ID NO: 3938813 - RNA, 20 nt, Human adenovirus E
ccaguucauugacuggaucu

SEQ ID NO: 3938814 - RNA, 15 nt, Human adenovirus E
ccauagccagccgac

SEQ ID NO: 3938815 - RNA, 14 nt, Human adenovirus E
ccauaucccagggc

SEQ ID NO: 3938816 - RNA, 12 nt, Human adenovirus E
ccaucacagaga

SEQ ID NO: 3938817 - RNA, 18 nt, Human adenovirus E
ccauccgcggcgacgagg

SEQ ID NO: 3938818 - RNA, 20 nt, Human adenovirus E
ccaucgagauugaccugggc

SEQ ID NO: 3938819 - RNA, 17 nt, Human adenovirus E
ccaucugcccccaccgc

SEQ ID NO: 3938820 - RNA, 15 nt, Human adenovirus E
ccauggcuugcaggg

SEQ ID NO: 3938821 - RNA, 20 nt, Human adenovirus E
cccaagcagaaccuguucag

SEQ ID NO: 3938822 - RNA, 20 nt, Human adenovirus E
  misc_feature (8)..(8): n is a, c, g or u
cccaagcnugcaccaacccu

SEQ ID NO: 3938823 - RNA, 17 nt, Human adenovirus E
cccaauuuaaaagcuua

SEQ ID NO: 3938824 - RNA, 23 nt, Human adenovirus E
cccaccacaauuacucacaccac

SEQ ID NO: 3938825 - RNA, 16 nt, Human adenovirus E
cccacggaggccagca

SEQ ID NO: 3938826 - RNA, 18 nt, Human adenovirus E
cccagaguuuggaagagc

SEQ ID NO: 3938827 - RNA, 19 nt, Human adenovirus E
cccagcagcaacuuccagc

SEQ ID NO: 3938828 - RNA, 12 nt, Human adenovirus E
cccagcccacga

SEQ ID NO: 3938829 - RNA, 11 nt, Human adenovirus E
cccagcggcga

SEQ ID NO: 3938830 - RNA, 17 nt, Human adenovirus E
cccagcggcgaggagga

SEQ ID NO: 3938831 - RNA, 21 nt, Human adenovirus E
cccagcucugguacugcaggc

SEQ ID NO: 3938832 - RNA, 23 nt, Human adenovirus E
cccaggacauggaauacaccacc

SEQ ID NO: 3938833 - RNA, 23 nt, Human adenovirus E
cccaggccgaaguccagcugacu

SEQ ID NO: 3938834 - RNA, 19 nt, Human adenovirus E
cccaguacgcgcucagcac

SEQ ID NO: 3938835 - RNA, 14 nt, Human adenovirus E
cccauacuccaccu

SEQ ID NO: 3938836 - RNA, 15 nt, Human adenovirus E
cccauacuccaccuc

SEQ ID NO: 3938837 - RNA, 13 nt, Human adenovirus E
cccauagccagcc

SEQ ID NO: 3938838 - RNA, 19 nt, Human adenovirus E
cccaucauguacgccagca

SEQ ID NO: 3938839 - RNA, 22 nt, Human adenovirus E
cccauggaaacgcagaccgagc

SEQ ID NO: 3938840 - RNA, 14 nt, Human adenovirus E
ccccaagcgccagc

SEQ ID NO: 3938841 - RNA, 14 nt, Human adenovirus E
ccccaccaugcagc

SEQ ID NO: 3938842 - RNA, 13 nt, Human adenovirus E
ccccacccaguga

SEQ ID NO: 3938843 - RNA, 16 nt, Human adenovirus E
ccccacggaggccagc

SEQ ID NO: 3938844 - RNA, 22 nt, Human adenovirus E
  misc_feature (7)..(7): n is a, c, g or u
ccccaunuagcagucccacugc

SEQ ID NO: 3938845 - RNA, 19 nt, Human adenovirus E
cccccggcggcgcgugcag

SEQ ID NO: 3938846 - RNA, 19 nt, Human adenovirus E
cccccgggaguuccuccac

SEQ ID NO: 3938847 - RNA, 17 nt, Human adenovirus E
ccccgaucccuccaggu

SEQ ID NO: 3938848 - RNA, 16 nt, Human adenovirus E
ccccgccaugcgcgcg

SEQ ID NO: 3938849 - RNA, 13 nt, Human adenovirus E
ccccgcgcgcgcg

SEQ ID NO: 3938850 - RNA, 23 nt, Human adenovirus E
ccccggagaguuucaugaccagc

SEQ ID NO: 3938851 - RNA, 22 nt, Human adenovirus E
ccccuggggugugaccaccguc

SEQ ID NO: 3938852 - RNA, 12 nt, Human adenovirus E
cccgcagcaguc

SEQ ID NO: 3938853 - RNA, 18 nt, Human adenovirus E
cccgccaaauaaucacac

SEQ ID NO: 3938854 - RNA, 22 nt, Human adenovirus E
cccgccaaauaaucacacacgc

SEQ ID NO: 3938855 - RNA, 13 nt, Human adenovirus E
cccgccaccugcu

SEQ ID NO: 3938856 - RNA, 15 nt, Human adenovirus E
cccgcgaugcgggcg

SEQ ID NO: 3938857 - RNA, 13 nt, Human adenovirus E
cccgcgcgugcag

SEQ ID NO: 3938858 - RNA, 20 nt, Human adenovirus E
cccggaugcaggggcggcag

SEQ ID NO: 3938859 - RNA, 16 nt, Human adenovirus E
cccggcgcuaccugcu

SEQ ID NO: 3938860 - RNA, 17 nt, Human adenovirus E
cccggcggcgcgugcag

SEQ ID NO: 3938861 - RNA, 20 nt, Human adenovirus E
cccggcggcgcgugcagugg

SEQ ID NO: 3938862 - RNA, 24 nt, Human adenovirus E
cccggcgucgugcacgcagcagcg

SEQ ID NO: 3938863 - RNA, 14 nt, Human adenovirus E
cccgggcaaccugg

SEQ ID NO: 3938864 - RNA, 20 nt, Human adenovirus E
cccgggcaaccuggaagcca

SEQ ID NO: 3938865 - RNA, 15 nt, Human adenovirus E
cccggggcuguggac

SEQ ID NO: 3938866 - RNA, 16 nt, Human adenovirus E
cccgguaccacaucac

SEQ ID NO: 3938867 - RNA, 20 nt, Human adenovirus E
cccgguggugggcgccgagc

SEQ ID NO: 3938868 - RNA, 14 nt, Human adenovirus E
cccguaucgggcgc

SEQ ID NO: 3938869 - RNA, 20 nt, Human adenovirus E
cccguccucuucccacuccc

SEQ ID NO: 3938870 - RNA, 12 nt, Human adenovirus E
cccgugcagcca

SEQ ID NO: 3938871 - RNA, 13 nt, Human adenovirus E
cccgugcaggcac

SEQ ID NO: 3938872 - RNA, 17 nt, Human adenovirus E
cccguucucgcucgcca

SEQ ID NO: 3938873 - RNA, 19 nt, Human adenovirus E
cccugagcgacgaucuggg

SEQ ID NO: 3938874 - RNA, 15 nt, Human adenovirus E
cccugccgcccuggu

SEQ ID NO: 3938875 - RNA, 14 nt, Human adenovirus E
cccugcgccugaug

SEQ ID NO: 3938876 - RNA, 21 nt, Human adenovirus E
cccugcgcggggaggcccggc

SEQ ID NO: 3938877 - RNA, 16 nt, Human adenovirus E
cccuucucccaggccg

SEQ ID NO: 3938878 - RNA, 22 nt, Human adenovirus E
cccuucuccggcucccccggcc

SEQ ID NO: 3938879 - RNA, 18 nt, Human adenovirus E
ccgaaagagggugcugag

SEQ ID NO: 3938880 - RNA, 14 nt, Human adenovirus E
ccgaauaccacagc

SEQ ID NO: 3938881 - RNA, 18 nt, Human adenovirus E
ccgaccccgucaccacca

SEQ ID NO: 3938882 - RNA, 17 nt, Human adenovirus E
ccgagacgaugggcagg

SEQ ID NO: 3938883 - RNA, 12 nt, Human adenovirus E
ccgagcagcagc

SEQ ID NO: 3938884 - RNA, 16 nt, Human adenovirus E
ccgaggacgagggcau

SEQ ID NO: 3938885 - RNA, 20 nt, Human adenovirus E
ccgaggagaugcgcgcggcc

SEQ ID NO: 3938886 - RNA, 21 nt, Human adenovirus E
ccgaggagggcaagcccgugg

SEQ ID NO: 3938887 - RNA, 17 nt, Human adenovirus E
ccgagucgcggaugaag

SEQ ID NO: 3938888 - RNA, 17 nt, Human adenovirus E
ccgcaacaacagccccc

SEQ ID NO: 3938889 - RNA, 14 nt, Human adenovirus E
ccgcagcagcgagc

SEQ ID NO: 3938890 - RNA, 19 nt, Human adenovirus E
ccgcagcagcgagcugggc

SEQ ID NO: 3938891 - RNA, 21 nt, Human adenovirus E
ccgcagcagcgagcugggcag

SEQ ID NO: 3938892 - RNA, 21 nt, Human adenovirus E
ccgcagcaguggcagcggccg

SEQ ID NO: 3938893 - RNA, 12 nt, Human adenovirus E
cgagcgccucag

SEQ ID NO: 3938894 - RNA, 14 nt, Human adenovirus E
cgagcgggagaaga

SEQ ID NO: 3938895 - RNA, 15 nt, Human adenovirus E
cgagcuccagcucca

SEQ ID NO: 3938896 - RNA, 16 nt, Human adenovirus E
cgagcuccagcuccag

SEQ ID NO: 3938897 - RNA, 18 nt, Human adenovirus E
cgagcugagcgaccagga

SEQ ID NO: 3938898 - RNA, 20 nt, Human adenovirus E
cgagcuugguggcgaaggag

SEQ ID NO: 3938899 - RNA, 18 nt, Human adenovirus E
cgaggaagaaaaccgcgc

SEQ ID NO: 3938900 - RNA, 19 nt, Human adenovirus E
cgaggacgagggcaugcaa

SEQ ID NO: 3938901 - RNA, 14 nt, Human adenovirus E
cgaggaggaggcag

SEQ ID NO: 3938902 - RNA, 19 nt, Human adenovirus E
cgaggaggaggcagaggag

SEQ ID NO: 3938903 - RNA, 23 nt, Human adenovirus E
cgaggaucuguaccccaccaugc

SEQ ID NO: 3938904 - RNA, 16 nt, Human adenovirus E
cgaggccacgcggcgg

SEQ ID NO: 3938905 - RNA, 12 nt, Human adenovirus E
cgagggccgcug

SEQ ID NO: 3938906 - RNA, 21 nt, Human adenovirus E
cgagggccgcuggcuccugga

SEQ ID NO: 3938907 - RNA, 12 nt, Human adenovirus E
cgagggccugcu

SEQ ID NO: 3938908 - RNA, 22 nt, Human adenovirus E
cgagggccugcucgagugccac

SEQ ID NO: 3938909 - RNA, 18 nt, Human adenovirus E
cgagggucugggcagcga

SEQ ID NO: 3938910 - RNA, 15 nt, Human adenovirus E
cgagggugcugccgc

SEQ ID NO: 3938911 - RNA, 19 nt, Human adenovirus E
cgagggugcugccgcggcg

SEQ ID NO: 3938912 - RNA, 14 nt, Human adenovirus E
cgaguacaauaaca

SEQ ID NO: 3938913 - RNA, 19 nt, Human adenovirus E
cgagugccacugccgcugc

SEQ ID NO: 3938914 - RNA, 23 nt, Human adenovirus E
cgaguugaaccucuucucgccgc

SEQ ID NO: 3938915 - RNA, 18 nt, Human adenovirus E
agaucguccagggcagcu

SEQ ID NO: 3938916 - RNA, 17 nt, Human adenovirus E
agaucucuugcacgucc

SEQ ID NO: 3938917 - RNA, 17 nt, Human adenovirus E
agaugagccgcuggaag

SEQ ID NO: 3938918 - RNA, 19 nt, Human adenovirus E
agaugagccgcuggaagac

SEQ ID NO: 3938919 - RNA, 15 nt, Human adenovirus E
agaugcaauugaaag

SEQ ID NO: 3938920 - RNA, 22 nt, Human adenovirus E
agaugccuuucaagagccccuc

SEQ ID NO: 3938921 - RNA, 22 nt, Human adenovirus E
agauggggguuggcgcggagga

SEQ ID NO: 3938922 - RNA, 20 nt, Human adenovirus E
agcaacuacccggugguggg

SEQ ID NO: 3938923 - RNA, 21 nt, Human adenovirus E
agcaaggaggaugcagcagcu

SEQ ID NO: 3938924 - RNA, 15 nt, Human adenovirus E
agcacacagcucaac

SEQ ID NO: 3938925 - RNA, 14 nt, Human adenovirus E
agcaccacagcgcc

SEQ ID NO: 3938926 - RNA, 16 nt, Human adenovirus E
agcacccagcccgcca

SEQ ID NO: 3938927 - RNA, 23 nt, Human adenovirus E
agcacccccgccaugcgcgcggc

SEQ ID NO: 3938928 - RNA, 13 nt, Human adenovirus E
agcaccgccccgc

SEQ ID NO: 3938929 - RNA, 17 nt, Human adenovirus E
cgaguuggaggagaugg

SEQ ID NO: 3938930 - RNA, 15 nt, Human adenovirus E
cgauacgggugaugg

SEQ ID NO: 3938931 - RNA, 14 nt, Human adenovirus E
cgaucccugagcuc

SEQ ID NO: 3938932 - RNA, 20 nt, Human adenovirus E
cgauguaggugggguagcag

SEQ ID NO: 3938933 - RNA, 15 nt, Human adenovirus E
cgauguggacagcag

SEQ ID NO: 3938934 - RNA, 20 nt, Human adenovirus E
cgcaacucguaccugggcua

SEQ ID NO: 3938935 - RNA, 13 nt, Human adenovirus E
cgcaaucaccuca

SEQ ID NO: 3938936 - RNA, 15 nt, Human adenovirus E
cgcacguggacgagc

SEQ ID NO: 3938937 - RNA, 21 nt, Human adenovirus E
cgcagagcgcccuccaccggc

SEQ ID NO: 3938938 - RNA, 16 nt, Human adenovirus E
cgcagcagcgagcugg

SEQ ID NO: 3938939 - RNA, 18 nt, Human adenovirus E
cgcagccccgcucgggug

SEQ ID NO: 3938940 - RNA, 17 nt, Human adenovirus E
cgcaggccggagcuguc

SEQ ID NO: 3938941 - RNA, 23 nt, Human adenovirus E
cgcaugcggaucucgcucagguc

SEQ ID NO: 3938942 - RNA, 16 nt, Human adenovirus E
cgcauggucucgguga

SEQ ID NO: 3938943 - RNA, 14 nt, Human adenovirus E
cgccaccugcuccg

SEQ ID NO: 3938944 - RNA, 18 nt, Human adenovirus E
cgccagcuccuccucggc

SEQ ID NO: 3938945 - RNA, 14 nt, Human adenovirus E
cgccagcuuugcag

SEQ ID NO: 3938946 - RNA, 13 nt, Human adenovirus E
cgccaguccagac

SEQ ID NO: 3938947 - RNA, 15 nt, Human adenovirus E
cgccaguccagacug

SEQ ID NO: 3938948 - RNA, 14 nt, Human adenovirus E
cgcccaagaaugaa

SEQ ID NO: 3938949 - RNA, 12 nt, Human adenovirus E
cgcccagcaaga

SEQ ID NO: 3938950 - RNA, 14 nt, Human adenovirus E
cgcccugcgccuga

SEQ ID NO: 3938951 - RNA, 15 nt, Human adenovirus E
cgccgcaccgcuccc

SEQ ID NO: 3938952 - RNA, 17 nt, Human adenovirus E
cgccgggccuuggaggc

SEQ ID NO: 3938953 - RNA, 19 nt, Human adenovirus E
cgccguugucaaccacugc

SEQ ID NO: 3938954 - RNA, 18 nt, Human adenovirus E
cgccuccuuggaagaggu

SEQ ID NO: 3938955 - RNA, 17 nt, Human adenovirus E
cgccugcaucucgugcu

SEQ ID NO: 3938956 - RNA, 19 nt, Human adenovirus E
cgccugcugggccuuggcu

SEQ ID NO: 3938957 - RNA, 16 nt, Human adenovirus E
cgcgacggugucgagc

SEQ ID NO: 3938958 - RNA, 19 nt, Human adenovirus E
cgcgacggugucgagccug

SEQ ID NO: 3938959 - RNA, 22 nt, Human adenovirus E
cgcgacuuggcggauggcuggc

SEQ ID NO: 3938960 - RNA, 17 nt, Human adenovirus E
cgcgagacgcccaggcc

SEQ ID NO: 3938961 - RNA, 13 nt, Human adenovirus E
cgcgagcaaggac

SEQ ID NO: 3938962 - RNA, 18 nt, Human adenovirus E
cgcgaggaggugacccug

SEQ ID NO: 3938963 - RNA, 19 nt, Human adenovirus E
cgcgaggccaucggccagg

SEQ ID NO: 3938964 - RNA, 23 nt, Human adenovirus E
cgcgaggccaucggccaggcgca

SEQ ID NO: 3938965 - RNA, 12 nt, Human adenovirus E
cgcgccaucagc

SEQ ID NO: 3938966 - RNA, 17 nt, Human adenovirus E
cgcgcccgcccagucgc

SEQ ID NO: 3938967 - RNA, 15 nt, Human adenovirus E
cgcgcccugggccag

SEQ ID NO: 3938968 - RNA, 19 nt, Human adenovirus E
cgcgccgcagugggcgcag

SEQ ID NO: 3938969 - RNA, 23 nt, Human adenovirus E
cgcgccugcugcugcugcuggug

SEQ ID NO: 3938970 - RNA, 11 nt, Human adenovirus E
cgcgccugggg

SEQ ID NO: 3938971 - RNA, 14 nt, Human adenovirus E
cgcgcgcacguggc

SEQ ID NO: 3938972 - RNA, 15 nt, Human adenovirus E
cgcgcggccacggcg

SEQ ID NO: 3938973 - RNA, 13 nt, Human adenovirus E
cgcgcggcccggu

SEQ ID NO: 3938974 - RNA, 23 nt, Human adenovirus E
cgcgcugguggagaacaaggcca

SEQ ID NO: 3938975 - RNA, 16 nt, Human adenovirus E
cgcgcuugcugggcga

SEQ ID NO: 3938976 - RNA, 22 nt, Human adenovirus E
cgcgcuugcugggcgaagagga

SEQ ID NO: 3938977 - RNA, 22 nt, Human adenovirus E
cgcggcgaacgagccggcgcaa

SEQ ID NO: 3938978 - RNA, 20 nt, Human adenovirus E
cgcggcuguagaccacgacg

SEQ ID NO: 3938979 - RNA, 14 nt, Human adenovirus E
cgcgguccuccucg

SEQ ID NO: 3938980 - RNA, 18 nt, Human adenovirus E
cgcgguggggcggccagc

SEQ ID NO: 3938981 - RNA, 17 nt, Human adenovirus E
cgcguaguugcagaggc

SEQ ID NO: 3938982 - RNA, 21 nt, Human adenovirus E
cgcgucggugaugcucuccac

SEQ ID NO: 3938983 - RNA, 18 nt, Human adenovirus E
cgcgucguuguuggccag

SEQ ID NO: 3938984 - RNA, 15 nt, Human adenovirus E
cgcgugaagaccgcg

SEQ ID NO: 3938985 - RNA, 12 nt, Human adenovirus E
cgcucagcaccg

SEQ ID NO: 3938986 - RNA, 19 nt, Human adenovirus E
cgcucaucaagcaucuggc

SEQ ID NO: 3938987 - RNA, 13 nt, Human adenovirus E
cgcucccuggccu

SEQ ID NO: 3938988 - RNA, 12 nt, Human adenovirus E
cgcucccugggg

SEQ ID NO: 3938989 - RNA, 15 nt, Human adenovirus E
cgcuccggcaccgcu

SEQ ID NO: 3938990 - RNA, 22 nt, Human adenovirus E
cgcucugguggccaacgccagu

SEQ ID NO: 3938991 - RNA, 18 nt, Human adenovirus E
cgcugagcccgugcugcu

SEQ ID NO: 3938992 - RNA, 17 nt, Human adenovirus E
cgcugcagagccagccg

SEQ ID NO: 3938993 - RNA, 15 nt, Human adenovirus E
cgcugcgcccccagc

SEQ ID NO: 3938994 - RNA, 17 nt, Human adenovirus E
cgcugcgcccccagcgg

SEQ ID NO: 3938995 - RNA, 17 nt, Human adenovirus E
cgcugcucgaccgcacc

SEQ ID NO: 3938996 - RNA, 16 nt, Human adenovirus E
cgcuggcuccuggacc

SEQ ID NO: 3938997 - RNA, 14 nt, Human adenovirus E
cgcuguccggccgc

SEQ ID NO: 3938998 - RNA, 17 nt, Human adenovirus E
cgcuguggagccacugc

SEQ ID NO: 3938999 - RNA, 20 nt, Human adenovirus E
cgcuguugagacccgagcgg

SEQ ID NO: 3939000 - RNA, 14 nt, Human adenovirus E
cggaaagguugggg

SEQ ID NO: 3939001 - RNA, 17 nt, Human adenovirus E
cggaacaauacucucgc

SEQ ID NO: 3939002 - RNA, 23 nt, Human adenovirus E
cggaacugguacuuggccagcca

SEQ ID NO: 3939003 - RNA, 12 nt, Human adenovirus E
cggaaggugcaa

SEQ ID NO: 3939004 - RNA, 19 nt, Human adenovirus E
cggagauggcaccucucgc

SEQ ID NO: 3939005 - RNA, 22 nt, Human adenovirus E
cggagcacccccgccaugcgcg

SEQ ID NO: 3939006 - RNA, 17 nt, Human adenovirus E
cggagcacgaggaggag

SEQ ID NO: 3939007 - RNA, 20 nt, Human adenovirus E
cggagcacgaggaggagcug

SEQ ID NO: 3939008 - RNA, 22 nt, Human adenovirus E
cggagccuuguugcgcagggcc

SEQ ID NO: 3939009 - RNA, 18 nt, Human adenovirus E
cggagcuguccagggucc

SEQ ID NO: 3939010 - RNA, 13 nt, Human adenovirus E
cggaggccagcac

SEQ ID NO: 3939011 - RNA, 16 nt, Human adenovirus E
cggaucuucagccagc

SEQ ID NO: 3939012 - RNA, 12 nt, Human adenovirus E
cggaugaagugg

SEQ ID NO: 3939013 - RNA, 13 nt, Human adenovirus E
cggcaccaccgug

SEQ ID NO: 3939014 - RNA, 22 nt, Human adenovirus E
cggcagaacggggugcuggaga

SEQ ID NO: 3939015 - RNA, 20 nt, Human adenovirus E
cggcagaugcgcccccacca

SEQ ID NO: 3939016 - RNA, 21 nt, Human adenovirus E
cggcagaugcgcccccaccac

SEQ ID NO: 3939017 - RNA, 13 nt, Human adenovirus E
cggcaggccacca

SEQ ID NO: 3939018 - RNA, 13 nt, Human adenovirus F
aaaaaaagaauua

SEQ ID NO: 3939019 - RNA, 17 nt, Human adenovirus F
aaaaacuuacaaucauu

SEQ ID NO: 3939020 - RNA, 21 nt, Human adenovirus F
aaaaaucuaccacagaaaugu

SEQ ID NO: 3939021 - RNA, 17 nt, Human adenovirus F
aaaacaaaacaaacucc

SEQ ID NO: 3939022 - RNA, 12 nt, Human adenovirus F
aaaaccaaauca

SEQ ID NO: 3939023 - RNA, 13 nt, Human adenovirus F
aaaaccgccacau

SEQ ID NO: 3939024 - RNA, 21 nt, Human adenovirus F
aaaacguaccaaccggagccu

SEQ ID NO: 3939025 - RNA, 18 nt, Human adenovirus F
aaaacuuggcagcaacau

SEQ ID NO: 3939026 - RNA, 20 nt, Human adenovirus F
aaaagcucgcgcacagcuuc

SEQ ID NO: 3939027 - RNA, 22 nt, Human adenovirus F
aaaaucacuguuuuuaacuauu

SEQ ID NO: 3939028 - RNA, 24 nt, Human adenovirus F
aaaaucguagguuuaaauuacacu

SEQ ID NO: 3939029 - RNA, 14 nt, Human adenovirus F
aaacaacaaaauca

SEQ ID NO: 3939030 - RNA, 13 nt, Human adenovirus F
aaacacaaacaua

SEQ ID NO: 3939031 - RNA, 14 nt, Human adenovirus F
aaacagugccacau

SEQ ID NO: 3939032 - RNA, 19 nt, Human adenovirus F
aaaccccgaucccgaaucu

SEQ ID NO: 3939033 - RNA, 12 nt, Human adenovirus F
aaaccgccacau

SEQ ID NO: 3939034 - RNA, 22 nt, Human adenovirus F
aaaccgccgacccaggcaacau

SEQ ID NO: 3939035 - RNA, 13 nt, Human adenovirus F
aaaccuguucuaa

SEQ ID NO: 3939036 - RNA, 14 nt, Human adenovirus F
aaagacacaauugg

SEQ ID NO: 3939037 - RNA, 14 nt, Human adenovirus F
aaagacagcaagga

SEQ ID NO: 3939038 - RNA, 15 nt, Human adenovirus F
aaagacagcaaggaa

SEQ ID NO: 3939039 - RNA, 18 nt, Human adenovirus F
aaagacccauuuccaagc

SEQ ID NO: 3939040 - RNA, 16 nt, Human adenovirus F
aaagagcguguuccca

SEQ ID NO: 3939041 - RNA, 21 nt, Human adenovirus F
aaagcagugggacgaggagga

SEQ ID NO: 3939042 - RNA, 14 nt, Human adenovirus F
aaagccaacuccaa

SEQ ID NO: 3939043 - RNA, 15 nt, Human adenovirus F
aaagcgggggcgucc

SEQ ID NO: 3939044 - RNA, 21 nt, Human adenovirus F
aaagcugugagcgccagccgc

SEQ ID NO: 3939045 - RNA, 20 nt, Human adenovirus F
aaaguagcucuuccaagcug

SEQ ID NO: 3939046 - RNA, 12 nt, Human adenovirus F
aaaguccuggcc

SEQ ID NO: 3939047 - RNA, 19 nt, Human adenovirus F
aaaguccuggccaacugcc

SEQ ID NO: 3939048 - RNA, 17 nt, Human adenovirus F
aaauacagucaagcucu

SEQ ID NO: 3939049 - RNA, 23 nt, Human adenovirus F
aaaucgugcccguggaaaaagac

SEQ ID NO: 3939050 - RNA, 15 nt, Human adenovirus F
aaaucuucaaacauu

SEQ ID NO: 3939051 - RNA, 19 nt, Human adenovirus F
aaaucuuccucccaaagua

SEQ ID NO: 3939052 - RNA, 14 nt, Human adenovirus F
aaaugccuaccucu

SEQ ID NO: 3939053 - RNA, 18 nt, Human adenovirus F
aaauuacagccaagucaa

SEQ ID NO: 3939054 - RNA, 21 nt, Human adenovirus F
aaauucaugcaugcagacuuu

SEQ ID NO: 3939055 - RNA, 13 nt, Human adenovirus F
aacaaggccugga

SEQ ID NO: 3939056 - RNA, 12 nt, Human adenovirus F
aacacaaacaua

SEQ ID NO: 3939057 - RNA, 21 nt, Human adenovirus F
aacacaauauuuauacacucc

SEQ ID NO: 3939058 - RNA, 14 nt, Human adenovirus F
aacagccccagcug

SEQ ID NO: 3939059 - RNA, 15 nt, Human adenovirus F
aacagcuccucagcc

SEQ ID NO: 3939060 - RNA, 22 nt, Human adenovirus F
aacagggacacgagcugucaua

SEQ ID NO: 3939061 - RNA, 17 nt, Human adenovirus F
aacaguaacaacuccuu

SEQ ID NO: 3939062 - RNA, 22 nt, Human adenovirus F
aacauagcaaaagcauuuuccu

SEQ ID NO: 3939063 - RNA, 20 nt, Human adenovirus F
aaccacgcccaugcagccau

SEQ ID NO: 3939064 - RNA, 22 nt, Human adenovirus F
aacccaugagccgccagguggu

SEQ ID NO: 3939065 - RNA, 18 nt, Human adenovirus F
aaccccuuugugcccucc

SEQ ID NO: 3939066 - RNA, 18 nt, Human adenovirus F
aacccugaggaggaggcc

SEQ ID NO: 3939067 - RNA, 13 nt, Human adenovirus F
aaccuugaggaau

SEQ ID NO: 3939068 - RNA, 22 nt, Human adenovirus F
aacgagaucggcaccagccagc

SEQ ID NO: 3939069 - RNA, 16 nt, Human adenovirus F
cccccggcggcgggug

SEQ ID NO: 3939070 - RNA, 18 nt, Human adenovirus F
ccccgcgacgucagcuga

SEQ ID NO: 3939071 - RNA, 18 nt, Human adenovirus F
ccccggcggcgggugcag

SEQ ID NO: 3939072 - RNA, 23 nt, Human adenovirus F
ccccggcggcgggugcaguggcg

SEQ ID NO: 3939073 - RNA, 24 nt, Human adenovirus F
ccccgggaguuuuagcacucaagu

SEQ ID NO: 3939074 - RNA, 13 nt, Human adenovirus F
ccccuaccagccg

SEQ ID NO: 3939075 - RNA, 20 nt, Human adenovirus F
ccccuuacaaacaguaacaa

SEQ ID NO: 3939076 - RNA, 14 nt, Human adenovirus F
cccgacagaggccg

SEQ ID NO: 3939077 - RNA, 15 nt, Human adenovirus F
cccgcaacggcgcag

SEQ ID NO: 3939078 - RNA, 22 nt, Human adenovirus F
cccgcaaucccgaagccuucag

SEQ ID NO: 3939079 - RNA, 16 nt, Human adenovirus F
cccggguccuacaccu

SEQ ID NO: 3939080 - RNA, 15 nt, Human adenovirus F
cccgucacucuccgc

SEQ ID NO: 3939081 - RNA, 10 nt, Human adenovirus F
cccuaccacc

SEQ ID NO: 3939082 - RNA, 19 nt, Human adenovirus F
cccuauucgggcacugcau

SEQ ID NO: 3939083 - RNA, 17 nt, Human adenovirus F
cccucagacgacugggc

SEQ ID NO: 3939084 - RNA, 13 nt, Human adenovirus F
cccucagagcugc

SEQ ID NO: 3939085 - RNA, 22 nt, Human adenovirus F
cccucuccgugcaaaacaauuc

SEQ ID NO: 3939086 - RNA, 18 nt, Human adenovirus F
cccugaccgaccuggggc

SEQ ID NO: 3939087 - RNA, 16 nt, Human adenovirus F
cccuggaauuuuugcu

SEQ ID NO: 3939088 - RNA, 18 nt, Human adenovirus F
cccugucguugccagccg

SEQ ID NO: 3939089 - RNA, 21 nt, Human adenovirus F
cccuuacgaacacuacaaucc

SEQ ID NO: 3939090 - RNA, 22 nt, Human adenovirus F
cccuuggaaauuugcugacagc

SEQ ID NO: 3939091 - RNA, 15 nt, Human adenovirus F
cccuuuuccagcaac

SEQ ID NO: 3939092 - RNA, 21 nt, Human adenovirus F
ccgaagccuucaggcagcagc

SEQ ID NO: 3939093 - RNA, 13 nt, Human adenovirus F
ccgacaacaaaaa

SEQ ID NO: 3939094 - RNA, 23 nt, Human adenovirus F
ccgacagaggccgguacccagac

SEQ ID NO: 3939095 - RNA, 22 nt, Human adenovirus F
ccgacauguuugucuuuaaaaa

SEQ ID NO: 3939096 - RNA, 16 nt, Human adenovirus F
ccgagcagcugcguac

SEQ ID NO: 3939097 - RNA, 16 nt, Human adenovirus F
ccgaggcacuguucaa

SEQ ID NO: 3939098 - RNA, 21 nt, Human adenovirus F
ccgagugacacgucaccgcca

SEQ ID NO: 3939099 - RNA, 16 nt, Human adenovirus F
ccgcacuggaugccac

SEQ ID NO: 3939100 - RNA, 15 nt, Human adenovirus F
ccgcagucucccacc

SEQ ID NO: 3939101 - RNA, 19 nt, Human adenovirus F
ccgccacaugaacacuucc

SEQ ID NO: 3939102 - RNA, 23 nt, Human adenovirus F
ccgccaugacugccgcucgggcg

SEQ ID NO: 3939103 - RNA, 15 nt, Human adenovirus F
ccgccccugccaccg

SEQ ID NO: 3939104 - RNA, 12 nt, Human adenovirus F
ccgcccgccucu

SEQ ID NO: 3939105 - RNA, 14 nt, Human adenovirus F
ccgcccgcuccgac

SEQ ID NO: 3939106 - RNA, 19 nt, Human adenovirus F
ccgccgucgucgcucuguc

SEQ ID NO: 3939107 - RNA, 12 nt, Human adenovirus F
ccgcgaaugccc

SEQ ID NO: 3939108 - RNA, 17 nt, Human adenovirus F
ccgcggacgucaagccc

SEQ ID NO: 3939109 - RNA, 21 nt, Human adenovirus F
ccgcggcggcuauugccagca

SEQ ID NO: 3939110 - RNA, 20 nt, Human adenovirus F
ccgcggucaacagcuggaac

SEQ ID NO: 3939111 - RNA, 14 nt, Human adenovirus F
ccgcgucugcugcu

SEQ ID NO: 3939112 - RNA, 20 nt, Human adenovirus F
ccgcgucugcugcugccucu

SEQ ID NO: 3939113 - RNA, 21 nt, Human adenovirus F
ccgcugucguuaguggaggca

SEQ ID NO: 3939114 - RNA, 17 nt, Human adenovirus F
ccgcuuggaggagcugu

SEQ ID NO: 3939115 - RNA, 21 nt, Human adenovirus F
ccgcuugggggcgccaucccc

SEQ ID NO: 3939116 - RNA, 18 nt, Human adenovirus F
ccggagaggggaggaagu

SEQ ID NO: 3939117 - RNA, 16 nt, Human adenovirus F
ccggagccggcggugg

SEQ ID NO: 3939118 - RNA, 22 nt, Human adenovirus F
ccggaggcagugguggaugggg

SEQ ID NO: 3939119 - RNA, 14 nt, Human adenovirus F
ccggcacugaugcc

SEQ ID NO: 3939120 - RNA, 20 nt, Human adenovirus F
ccggcggcgggugcaguggc

SEQ ID NO: 3939121 - RNA, 22 nt, Human adenovirus F
ccggcggcgggugcaguggcgg

SEQ ID NO: 3939122 - RNA, 17 nt, Human adenovirus F
ccggcuucggugacaaa

SEQ ID NO: 3939123 - RNA, 21 nt, Human adenovirus F
ccggugcuauuaaaauggaac

SEQ ID NO: 3939124 - RNA, 22 nt, Human adenovirus F
ccguccccagcgcccuggauac

SEQ ID NO: 3939125 - RNA, 17 nt, Human adenovirus F
ccgucggaccugccccu

SEQ ID NO: 3939126 - RNA, 21 nt, Human adenovirus F
ccgucuagccaacuauuuggc

SEQ ID NO: 3939127 - RNA, 14 nt, Human adenovirus F
ccgucuccaucgcc

SEQ ID NO: 3939128 - RNA, 22 nt, Human adenovirus F
ccgugcaaaacaauucucucuc

SEQ ID NO: 3939129 - RNA, 19 nt, Human adenovirus F
ccguucggagccaaccucc

SEQ ID NO: 3939130 - RNA, 13 nt, Human adenovirus F
ccuacucuuacaa

SEQ ID NO: 3939131 - RNA, 21 nt, Human adenovirus F
ccuaggaucccaaguggcccu

SEQ ID NO: 3939132 - RNA, 21 nt, Human adenovirus F
ccuaucacuaaaaccaacaaa

SEQ ID NO: 3939133 - RNA, 15 nt, Human adenovirus F
ccucaaggaaugcac

SEQ ID NO: 3939134 - RNA, 15 nt, Human adenovirus F
ccuccagcacugccg

SEQ ID NO: 3939135 - RNA, 12 nt, Human adenovirus F
ccuccgacccca

SEQ ID NO: 3939136 - RNA, 21 nt, Human adenovirus F
ccuccgacgcuugcuggaguu

SEQ ID NO: 3939137 - RNA, 22 nt, Human adenovirus F
ccuccucgcugucuggaaccac

SEQ ID NO: 3939138 - RNA, 19 nt, Human adenovirus F
ccucguuguuuuccucuga

SEQ ID NO: 3939139 - RNA, 11 nt, Human adenovirus F
ccucugacggg

SEQ ID NO: 3939140 - RNA, 19 nt, Human adenovirus F
ccucuucuccugcuugucu

SEQ ID NO: 3939141 - RNA, 22 nt, Human adenovirus F
ccugagaucguuucuuuagaag

SEQ ID NO: 3939142 - RNA, 17 nt, Human adenovirus F
ccugaucccgaagaggg

SEQ ID NO: 3939143 - RNA, 16 nt, Human adenovirus F
ccugcaaagccaaccu

SEQ ID NO: 3939144 - RNA, 14 nt, Human adenovirus F
ccugcaagaucucc

SEQ ID NO: 3939145 - RNA, 17 nt, Human adenovirus F
ccugcaauggcagccca

SEQ ID NO: 3939146 - RNA, 16 nt, Human adenovirus F
ccugcacgcucuugcu

SEQ ID NO: 3939147 - RNA, 19 nt, Human adenovirus F
ccugccgcugcgcagcagu

SEQ ID NO: 3939148 - RNA, 19 nt, Human adenovirus F
ccugcggauuaagaaccac

SEQ ID NO: 3939149 - RNA, 17 nt, Human adenovirus F
ccugcuccugcccgggu

SEQ ID NO: 3939150 - RNA, 22 nt, Human adenovirus F
ccuggcaacaucggcaccccuc

SEQ ID NO: 3939151 - RNA, 13 nt, Human adenovirus F
ccuggcagcugga

SEQ ID NO: 3939152 - RNA, 14 nt, Human adenovirus F
ccuggccaacugcc

SEQ ID NO: 3939153 - RNA, 18 nt, Human adenovirus F
ccugggaugcagguagga

SEQ ID NO: 3939154 - RNA, 14 nt, Human adenovirus F
ccugggcuggaugc

SEQ ID NO: 3939155 - RNA, 22 nt, Human adenovirus F
ccugggguagggugucugccag

SEQ ID NO: 3939156 - RNA, 23 nt, Human adenovirus F
ccugggguagggugucugccaga

SEQ ID NO: 3939157 - RNA, 19 nt, Human adenovirus F
ccuguaccaccgcaaacaa

SEQ ID NO: 3939158 - RNA, 19 nt, Human adenovirus F
ccugucgccccugccaacu

SEQ ID NO: 3939159 - RNA, 13 nt, Human adenovirus F
ccuuacaaacagu

SEQ ID NO: 3939160 - RNA, 20 nt, Human adenovirus F
ccuuagaacuaccuccaccc

SEQ ID NO: 3939161 - RNA, 16 nt, Human adenovirus F
ccuucaggcagcagcc

SEQ ID NO: 3939162 - RNA, 11 nt, Human adenovirus F
ccuuccacuuu

SEQ ID NO: 3939163 - RNA, 16 nt, Human adenovirus F
ccuugcaaaaccaaau

SEQ ID NO: 3939164 - RNA, 22 nt, Human adenovirus F
ccuuggccaccacgggaguugc

SEQ ID NO: 3939165 - RNA, 14 nt, Human adenovirus F
ccuuuugcaucuca

SEQ ID NO: 3939166 - RNA, 19 nt, Human adenovirus F
ccuuuugcaucucaaagcu

SEQ ID NO: 3939167 - RNA, 18 nt, Human adenovirus F
cgaaccaaugcguucccg

SEQ ID NO: 3939168 - RNA, 15 nt, Human adenovirus F
cgaacuuucucucuu

SEQ ID NO: 3939169 - RNA, 18 nt, Human adenovirus F
cgaagccuucaggcagca

SEQ ID NO: 3939170 - RNA, 20 nt, Human adenovirus F
cgaauucguggccccuacca

SEQ ID NO: 3939171 - RNA, 20 nt, Human adenovirus F
cgacgacgcggcgguugagg

SEQ ID NO: 3939172 - RNA, 22 nt, Human adenovirus F
cgacgcuguaugcuauuuucca

SEQ ID NO: 3939173 - RNA, 12 nt, Human adenovirus F
cgagcgccucaa

SEQ ID NO: 3939174 - RNA, 20 nt, Human adenovirus F
cgaggcuuuccgcgaggcca

SEQ ID NO: 3939175 - RNA, 18 nt, Human adenovirus F
cgaggggcuggcccgcuu

SEQ ID NO: 3939176 - RNA, 13 nt, Human adenovirus F
cgauaacauuacu

SEQ ID NO: 3939177 - RNA, 12 nt, Human adenovirus F
cgauggagccag

SEQ ID NO: 3939178 - RNA, 17 nt, Human adenovirus F
cgcacuucaagaaacac

SEQ ID NO: 3939179 - RNA, 16 nt, Human adenovirus F
cgcagaaacaugccac

SEQ ID NO: 3939180 - RNA, 16 nt, Human adenovirus F
cgcagccugagcugcc

SEQ ID NO: 3939181 - RNA, 14 nt, Human adenovirus F
cgcagcgggcagga

SEQ ID NO: 3939182 - RNA, 22 nt, Human adenovirus F
cgcagcugcuuguaucacagaa

SEQ ID NO: 3939183 - RNA, 16 nt, Human adenovirus F
cgcaggagcucagaaa

SEQ ID NO: 3939184 - RNA, 22 nt, Human adenovirus F
cgcagguuuuacgcggggcagg

SEQ ID NO: 3939185 - RNA, 16 nt, Human adenovirus F
cgcauaacccuggaau

SEQ ID NO: 3939186 - RNA, 13 nt, Human adenovirus F
cgcaugccuccag

SEQ ID NO: 3939187 - RNA, 16 nt, Human adenovirus F
cgccaacuccgcccac

SEQ ID NO: 3939188 - RNA, 20 nt, Human adenovirus F
cgccaauuuuucggggguca

SEQ ID NO: 3939189 - RNA, 16 nt, Human adenovirus F
cgccagccuccggugg

SEQ ID NO: 3939190 - RNA, 14 nt, Human adenovirus F
cgccagcuggcaaa

SEQ ID NO: 3939191 - RNA, 21 nt, Human adenovirus F
cgccauugccacccgccagga

SEQ ID NO: 3939192 - RNA, 13 nt, Human adenovirus F
cgccccugugagu

SEQ ID NO: 3939193 - RNA, 19 nt, Human adenovirus F
cagacuuugucagccaaag

SEQ ID NO: 3939194 - RNA, 17 nt, Human adenovirus F
cagauggaaacugucag

SEQ ID NO: 3939195 - RNA, 17 nt, Human adenovirus F
cagauggagagcuggga

SEQ ID NO: 3939196 - RNA, 21 nt, Human adenovirus F
cagcaacuacccuguaguggg

SEQ ID NO: 3939197 - RNA, 15 nt, Human adenovirus F
cagcagcagcagcgg

SEQ ID NO: 3939198 - RNA, 23 nt, Human adenovirus F
cagcagguuaaagccaacuccaa

SEQ ID NO: 3939199 - RNA, 15 nt, Human adenovirus F
cagccaagucaaaaa

SEQ ID NO: 3939200 - RNA, 16 nt, Human adenovirus F
cagccaaugggcucca

SEQ ID NO: 3939201 - RNA, 17 nt, Human adenovirus F
cagccaaugggcuccag

SEQ ID NO: 3939202 - RNA, 17 nt, Human adenovirus F
cagcccaacaccaccau

SEQ ID NO: 3939203 - RNA, 17 nt, Human adenovirus F
cagccccaggccaaccg

SEQ ID NO: 3939204 - RNA, 16 nt, Human adenovirus F
cagccgcaccgcggcg

SEQ ID NO: 3939205 - RNA, 19 nt, Human adenovirus F
cagccgccgucgcgagcuu

SEQ ID NO: 3939206 - RNA, 20 nt, Human adenovirus F
cagccguccacgcucccgga

SEQ ID NO: 3939207 - RNA, 16 nt, Human adenovirus F
cagccuagacgaggag

SEQ ID NO: 3939208 - RNA, 21 nt, Human adenovirus F
cagccugagcugccagaggcc

SEQ ID NO: 3939209 - RNA, 19 nt, Human adenovirus F
cagccugcgucgggcucua

SEQ ID NO: 3939210 - RNA, 23 nt, Human adenovirus F
cagcgaguacuucaccaaugcca

SEQ ID NO: 3939211 - RNA, 20 nt, Human adenovirus F
cagcgcccgggcccuggagg

SEQ ID NO: 3939212 - RNA, 19 nt, Human adenovirus F
cagcgggaagagaggcagc

SEQ ID NO: 3939213 - RNA, 22 nt, Human adenovirus F
cagcgggaagagaggcagcccc

SEQ ID NO: 3939214 - RNA, 22 nt, Human adenovirus F
cagcgucagguuugacagcauu

SEQ ID NO: 3939215 - RNA, 17 nt, Human adenovirus F
cagcucaacgcaguggu

SEQ ID NO: 3939216 - RNA, 14 nt, Human adenovirus F
cagcuccucagccc

SEQ ID NO: 3939217 - RNA, 14 nt, Human adenovirus F
cagcugaagacaca

SEQ ID NO: 3939218 - RNA, 13 nt, Human adenovirus F
caggaagcagcuc

SEQ ID NO: 3939219 - RNA, 21 nt, Human adenovirus F
caggagcagcgggaagagagg

SEQ ID NO: 3939220 - RNA, 16 nt, Human adenovirus F
caggagcccgaagaga

SEQ ID NO: 3939221 - RNA, 21 nt, Human adenovirus F
caggagcccgaagagaugagg

SEQ ID NO: 3939222 - RNA, 15 nt, Human adenovirus F
caggagcugcgggcc

SEQ ID NO: 3939223 - RNA, 21 nt, Human adenovirus F
caggaucccucagagcugcaa

SEQ ID NO: 3939224 - RNA, 13 nt, Human adenovirus F
caggcacaccuuc

SEQ ID NO: 3939225 - RNA, 18 nt, Human adenovirus F
caggcagcagccccaggc

SEQ ID NO: 3939226 - RNA, 21 nt, Human adenovirus F
caggccgcccuaaccucuacc

SEQ ID NO: 3939227 - RNA, 12 nt, Human adenovirus F
caggccgcggcg

SEQ ID NO: 3939228 - RNA, 21 nt, Human adenovirus F
caggcguuuaaaaacuugcaa

SEQ ID NO: 3939229 - RNA, 14 nt, Human adenovirus F
caggcuacugggga

SEQ ID NO: 3939230 - RNA, 11 nt, Human adenovirus F
cagggcacagu

SEQ ID NO: 3939231 - RNA, 22 nt, Human adenovirus F
caggguuuuugagcaugaaacu

SEQ ID NO: 3939232 - RNA, 15 nt, Human adenovirus F
cagguauaaguauua

SEQ ID NO: 3939233 - RNA, 16 nt, Human adenovirus F
cagguccagaccucaa

SEQ ID NO: 3939234 - RNA, 18 nt, Human adenovirus F
cagguuaaagccaacucc

SEQ ID NO: 3939235 - RNA, 15 nt, Human adenovirus F
cagguuugacagcau

SEQ ID NO: 3939236 - RNA, 16 nt, Human adenovirus F
caguccuucugccacg

SEQ ID NO: 3939237 - RNA, 22 nt, Human adenovirus F
cagucggugggcguccagugga

SEQ ID NO: 3939238 - RNA, 15 nt, Human adenovirus F
cagucugccaacacu

SEQ ID NO: 3939239 - RNA, 13 nt, Human adenovirus F
caguggccgcacu

SEQ ID NO: 3939240 - RNA, 17 nt, Human adenovirus F
caguggccgcacucagc

SEQ ID NO: 3939241 - RNA, 13 nt, Human adenovirus F
cagugggacgagg

SEQ ID NO: 3939242 - RNA, 16 nt, Human adenovirus F
cagugguggacuuaca

SEQ ID NO: 3939243 - RNA, 22 nt, Human adenovirus F
caguguauccccgaaacaaaac

SEQ ID NO: 3939244 - RNA, 14 nt, Human adenovirus F
caguuaccaaggcg

SEQ ID NO: 3939245 - RNA, 16 nt, Human adenovirus F
cauaaccuugaggaau

SEQ ID NO: 3939246 - RNA, 13 nt, Human adenovirus F
cauagcuggaggg

SEQ ID NO: 3939247 - RNA, 17 nt, Human adenovirus F
cauaguugcucccaaag

SEQ ID NO: 3939248 - RNA, 14 nt, Human adenovirus F
cauccgccuccacc

SEQ ID NO: 3939249 - RNA, 15 nt, Human adenovirus F
caucuaucuuuuccu

SEQ ID NO: 3939250 - RNA, 19 nt, Human adenovirus F
caucucaaagcuggagcuc

SEQ ID NO: 3939251 - RNA, 22 nt, Human adenovirus F
caucuucaccucuguuugcugc

SEQ ID NO: 3939252 - RNA, 14 nt, Human adenovirus F
caugcaacuuggaa

SEQ ID NO: 3939253 - RNA, 18 nt, Human adenovirus F
caugcgccgagcggcugc

SEQ ID NO: 3939254 - RNA, 16 nt, Human adenovirus F
caugcgcuccaacacu

SEQ ID NO: 3939255 - RNA, 18 nt, Human adenovirus F
caugcgcuccaacacuau

SEQ ID NO: 3939256 - RNA, 15 nt, Human adenovirus F
caugcuuagccucgg

SEQ ID NO: 3939257 - RNA, 16 nt, Human adenovirus F
cauggcgggcaguggc

SEQ ID NO: 3939258 - RNA, 17 nt, Human adenovirus F
cauggcgggcaguggcc

SEQ ID NO: 3939259 - RNA, 13 nt, Human adenovirus F
cauggcucagccc

SEQ ID NO: 3939260 - RNA, 21 nt, Human adenovirus F
cauggugguagaaggucaggc

SEQ ID NO: 3939261 - RNA, 17 nt, Human adenovirus F
cauguucacugaaagcc

SEQ ID NO: 3939262 - RNA, 20 nt, Human adenovirus F
cauuaagucauuugguaaca

SEQ ID NO: 3939263 - RNA, 22 nt, Human adenovirus F
cauuacuuuacccgacaacaaa

SEQ ID NO: 3939264 - RNA, 12 nt, Human adenovirus F
cauuauugcacu

SEQ ID NO: 3939265 - RNA, 21 nt, Human adenovirus F
cauuccauuuauuacaccccc

SEQ ID NO: 3939266 - RNA, 13 nt, Human adenovirus F
cauuggcuggagg

SEQ ID NO: 3939267 - RNA, 15 nt, Human adenovirus F
cauugggcugaugca

SEQ ID NO: 3939268 - RNA, 19 nt, Human adenovirus F
cauugggcugaugcauuug

SEQ ID NO: 3939269 - RNA, 21 nt, Human adenovirus F
cauuguguccugcaacaaaaa

SEQ ID NO: 3939270 - RNA, 22 nt, Human adenovirus F
cauuugguaacaaggccuggaa

SEQ ID NO: 3939271 - RNA, 14 nt, Human adenovirus F
ccaaaacuuucaac

SEQ ID NO: 3939272 - RNA, 16 nt, Human adenovirus F
ccaaaauggcucugcu

SEQ ID NO: 3939273 - RNA, 23 nt, Human adenovirus F
ccaaacggcguucuagccaacac

SEQ ID NO: 3939274 - RNA, 20 nt, Human adenovirus F
ccaaagagcuugaacauaac

SEQ ID NO: 3939275 - RNA, 23 nt, Human adenovirus F
ccaaagagcuugaacauaacacc

SEQ ID NO: 3939276 - RNA, 18 nt, Human adenovirus F
ccaaaucaaucagcggcu

SEQ ID NO: 3939277 - RNA, 20 nt, Human adenovirus F
ccaaauuacgucauugacau

SEQ ID NO: 3939278 - RNA, 18 nt, Human adenovirus F
ccaacagccccagcuggu

SEQ ID NO: 3939279 - RNA, 17 nt, Human adenovirus F
ccaaccaagaaauacaa

SEQ ID NO: 3939280 - RNA, 17 nt, Human adenovirus F
ccaacggcuugcaagaa

SEQ ID NO: 3939281 - RNA, 13 nt, Human adenovirus F
ccaacuauuuggg

SEQ ID NO: 3939282 - RNA, 17 nt, Human adenovirus F
ccaagaaauacaaaggc

SEQ ID NO: 3939283 - RNA, 21 nt, Human adenovirus F
ccaagccucauugagcgaguc

SEQ ID NO: 3939284 - RNA, 22 nt, Human adenovirus F
ccaagccuuaauuucugagggg

SEQ ID NO: 3939285 - RNA, 20 nt, Human adenovirus F
ccaaggcguaaagacugaca

SEQ ID NO: 3939286 - RNA, 16 nt, Human adenovirus F
ccaagugccccagaaa

SEQ ID NO: 3939287 - RNA, 14 nt, Human adenovirus F
ccaauaccagcaaa

SEQ ID NO: 3939288 - RNA, 20 nt, Human adenovirus F
ccacauaagaagccagccaa

SEQ ID NO: 3939289 - RNA, 14 nt, Human adenovirus F
ccaccaaauuaaau

SEQ ID NO: 3939290 - RNA, 16 nt, Human adenovirus F
ccaccaagcuccucau

SEQ ID NO: 3939291 - RNA, 21 nt, Human adenovirus F
ccaccagccggaggagugggc

SEQ ID NO: 3939292 - RNA, 16 nt, Human adenovirus F
ggaagaugaguuuaaa

SEQ ID NO: 3939293 - RNA, 21 nt, Human adenovirus F
ggaaucccgcgagccccccuc

SEQ ID NO: 3939294 - RNA, 18 nt, Human adenovirus F
ggacagcuaugacccaga

SEQ ID NO: 3939295 - RNA, 20 nt, Human adenovirus F
ggaccuuacuuucugggcac

SEQ ID NO: 3939296 - RNA, 15 nt, Human adenovirus F
ggacguggaggaaga

SEQ ID NO: 3939297 - RNA, 13 nt, Human adenovirus F
ggacuuggcagaa

SEQ ID NO: 3939298 - RNA, 15 nt, Human adenovirus F
ggagcagauggagag

SEQ ID NO: 3939299 - RNA, 21 nt, Human adenovirus F
ggaggagauggugggccgcug

SEQ ID NO: 3939300 - RNA, 15 nt, Human adenovirus F
ggaggaggaggagaa

SEQ ID NO: 3939301 - RNA, 13 nt, Human adenovirus F
ggaggcagcagag

SEQ ID NO: 3939302 - RNA, 13 nt, Human adenovirus F
ggaggccauccug

SEQ ID NO: 3939303 - RNA, 23 nt, Human adenovirus F
ggaggccauccuggaccuggaag

SEQ ID NO: 3939304 - RNA, 11 nt, Human adenovirus F
ggagucacugc

SEQ ID NO: 3939305 - RNA, 14 nt, Human adenovirus F
ggagugccgccggu

SEQ ID NO: 3939306 - RNA, 13 nt, Human adenovirus F
ggaguuggaggag

SEQ ID NO: 3939307 - RNA, 15 nt, Human adenovirus F
ggauccauagagggc

SEQ ID NO: 3939308 - RNA, 23 nt, Human adenovirus F
ggaucccagcguugagccggaag

SEQ ID NO: 3939309 - RNA, 13 nt, Human adenovirus F
ggaucuggaggaa

SEQ ID NO: 3939310 - RNA, 16 nt, Human adenovirus F
ggaucuuaagcugcag

SEQ ID NO: 3939311 - RNA, 18 nt, Human adenovirus F
ggaugcaugcgaggggaa

SEQ ID NO: 3939312 - RNA, 12 nt, Human adenovirus F
ggaugguggcaa

SEQ ID NO: 3939313 - RNA, 21 nt, Human adenovirus F
ggauucuaagggaggcagcag

SEQ ID NO: 3939314 - RNA, 23 nt, Human adenovirus F
ggcaauguugccaccgagaucac

SEQ ID NO: 3939315 - RNA, 17 nt, Human adenovirus F
ggcacagaauccucaga

SEQ ID NO: 3939316 - RNA, 22 nt, Human adenovirus F
ggcaccuuuuaccugaaccaca

SEQ ID NO: 3939317 - RNA, 21 nt, Human adenovirus F
ggcagaacguucuucacugca

SEQ ID NO: 3939318 - RNA, 19 nt, Human adenovirus F
ggcaggaaagccacgcucg

SEQ ID NO: 3939319 - RNA, 15 nt, Human adenovirus F
ggcaguggccgccga

SEQ ID NO: 3939320 - RNA, 22 nt, Human adenovirus F
ggcauuaaaaacuuuggguccu

SEQ ID NO: 3939321 - RNA, 22 nt, Human adenovirus F
ggcauuaaugggcaaaggggga

SEQ ID NO: 3939322 - RNA, 21 nt, Human adenovirus F
ggccaacugccaccuccaccg

SEQ ID NO: 3939323 - RNA, 18 nt, Human adenovirus F
ggccauccuggaccugga

SEQ ID NO: 3939324 - RNA, 18 nt, Human adenovirus F
ggccaucggccaugguca

SEQ ID NO: 3939325 - RNA, 14 nt, Human adenovirus F
ggcccugccgcgga

SEQ ID NO: 3939326 - RNA, 13 nt, Human adenovirus F
ggccuguuuuuga

SEQ ID NO: 3939327 - RNA, 18 nt, Human adenovirus F
ggccuugggaugcagccu

SEQ ID NO: 3939328 - RNA, 13 nt, Human adenovirus F
ggcgaauaaaagg

SEQ ID NO: 3939329 - RNA, 15 nt, Human adenovirus F
ggcgcauucccuuuu

SEQ ID NO: 3939330 - RNA, 13 nt, Human adenovirus F
ggcgccggacggg

SEQ ID NO: 3939331 - RNA, 17 nt, Human adenovirus F
ggcgcuugccaggguuc

SEQ ID NO: 3939332 - RNA, 16 nt, Human adenovirus F
ggcggaugguggcaag

SEQ ID NO: 3939333 - RNA, 22 nt, Human adenovirus F
ggcggccauggaucgcauccug

SEQ ID NO: 3939334 - RNA, 13 nt, Human adenovirus F
ggcggcccugcaa

SEQ ID NO: 3939335 - RNA, 13 nt, Human adenovirus F
ggcgguugagguc

SEQ ID NO: 3939336 - RNA, 20 nt, Human adenovirus F
ggcguggccuccguggccuu

SEQ ID NO: 3939337 - RNA, 20 nt, Human adenovirus F
ggcgugggaguuggaggaga

SEQ ID NO: 3939338 - RNA, 23 nt, Human adenovirus F
ggcguguacaccaacgaggccuu

SEQ ID NO: 3939339 - RNA, 14 nt, Human adenovirus F
ggcuacccccgccc

SEQ ID NO: 3939340 - RNA, 17 nt, Human adenovirus F
ggcuacccccgcccgcc

SEQ ID NO: 3939341 - RNA, 15 nt, Human adenovirus F
ggcugcuucugccag

SEQ ID NO: 3939342 - RNA, 16 nt, Human adenovirus F
ggcugcuucugccagu

SEQ ID NO: 3939343 - RNA, 13 nt, Human adenovirus F
ggcuucugccaga

SEQ ID NO: 3939344 - RNA, 17 nt, Human adenovirus F
ggcuugcauaaaagcuu

SEQ ID NO: 3939345 - RNA, 13 nt, Human adenovirus F
gggaauggagcug

SEQ ID NO: 3939346 - RNA, 12 nt, Human adenovirus F
gggaccagcugu

SEQ ID NO: 3939347 - RNA, 13 nt, Human adenovirus F
gggauggguaagu

SEQ ID NO: 3939348 - RNA, 22 nt, Human adenovirus F
gggauucuaagggaggcagcag

SEQ ID NO: 3939349 - RNA, 16 nt, Human adenovirus F
gggcaggaggacuaug

SEQ ID NO: 3939350 - RNA, 23 nt, Human adenovirus F
gggcauuaaugggcaaaggggga

SEQ ID NO: 3939351 - RNA, 19 nt, Human adenovirus F
gggcccugaccgaccuggg

SEQ ID NO: 3939352 - RNA, 13 nt, Human adenovirus F
gggccuggugcag

SEQ ID NO: 3939353 - RNA, 12 nt, Human adenovirus F
gggcgcgguggu

SEQ ID NO: 3939354 - RNA, 16 nt, Human adenovirus F
gggcggcgguaacaag

SEQ ID NO: 3939355 - RNA, 18 nt, Human adenovirus F
gggcucauugguccagca

SEQ ID NO: 3939356 - RNA, 15 nt, Human adenovirus F
ggggcggaccugcaa

SEQ ID NO: 3939357 - RNA, 22 nt, Human adenovirus F
ggguaacuuuuaugaaugugag

SEQ ID NO: 3939358 - RNA, 14 nt, Human adenovirus F
cgcccgccucccaa

SEQ ID NO: 3939359 - RNA, 12 nt, Human adenovirus F
cgcccugaaagu

SEQ ID NO: 3939360 - RNA, 18 nt, Human adenovirus F
cgccgcaccgcgcccguc

SEQ ID NO: 3939361 - RNA, 12 nt, Human adenovirus F
cgccgccccugg

SEQ ID NO: 3939362 - RNA, 17 nt, Human adenovirus F
cgccgccccuggccugu

SEQ ID NO: 3939363 - RNA, 22 nt, Human adenovirus F
cgccguggcuggcgggcaaagc

SEQ ID NO: 3939364 - RNA, 13 nt, Human adenovirus F
cgccuccaacaca

SEQ ID NO: 3939365 - RNA, 22 nt, Human adenovirus F
cgccuccaacacagccgccgcu

SEQ ID NO: 3939366 - RNA, 14 nt, Human adenovirus F
cgcgcccguccucc

SEQ ID NO: 3939367 - RNA, 12 nt, Human adenovirus F
cgcgcgggcagg

SEQ ID NO: 3939368 - RNA, 22 nt, Human adenovirus F
cgcggaagaagaugaggaggac

SEQ ID NO: 3939369 - RNA, 18 nt, Human adenovirus F
cgcggcggcuauugccag

SEQ ID NO: 3939370 - RNA, 23 nt, Human adenovirus F
cgcggggcaggagcugcgggccg

SEQ ID NO: 3939371 - RNA, 14 nt, Human adenovirus F
cgcggucggcacgc

SEQ ID NO: 3939372 - RNA, 18 nt, Human adenovirus F
cgcgugcuuagacccggc

SEQ ID NO: 3939373 - RNA, 15 nt, Human adenovirus F
cgcuagaccaacaaa

SEQ ID NO: 3939374 - RNA, 15 nt, Human adenovirus F
cgcuaucaggaagca

SEQ ID NO: 3939375 - RNA, 17 nt, Human adenovirus F
cgcuaucaggaagcagc

SEQ ID NO: 3939376 - RNA, 16 nt, Human adenovirus F
cgcuccagguggggcg

SEQ ID NO: 3939377 - RNA, 20 nt, Human adenovirus F
cgcuggcuuuuggaccuggu

SEQ ID NO: 3939378 - RNA, 14 nt, Human adenovirus F
cgcuguacugugca

SEQ ID NO: 3939379 - RNA, 21 nt, Human adenovirus F
cgcugugaguuuugagggugg

SEQ ID NO: 3939380 - RNA, 20 nt, Human adenovirus F
cgcuguggacgacagccagc

SEQ ID NO: 3939381 - RNA, 22 nt, Human adenovirus F
cgcuuucaguuggagcagccug

SEQ ID NO: 3939382 - RNA, 22 nt, Human adenovirus F
cggaacaaccuucaaacccagc

SEQ ID NO: 3939383 - RNA, 18 nt, Human adenovirus F
cggaagccgaaguccaaa

SEQ ID NO: 3939384 - RNA, 21 nt, Human adenovirus F
cggaaguuaaagugcgcccca

SEQ ID NO: 3939385 - RNA, 15 nt, Human adenovirus F
cggaccuuuuacugu

SEQ ID NO: 3939386 - RNA, 21 nt, Human adenovirus F
cggacgugagagaggcggugg

SEQ ID NO: 3939387 - RNA, 20 nt, Human adenovirus F
cggacucggaaccugaaaga

SEQ ID NO: 3939388 - RNA, 17 nt, Human adenovirus F
cggacuuggcgugcaga

SEQ ID NO: 3939389 - RNA, 16 nt, Human adenovirus F
cggaguaccugagccc

SEQ ID NO: 3939390 - RNA, 19 nt, Human adenovirus F
cggcaaaugcucugcaaaa

SEQ ID NO: 3939391 - RNA, 15 nt, Human adenovirus F
cggcaccagccagcu

SEQ ID NO: 3939392 - RNA, 12 nt, Human adenovirus F
cggcggccauga

SEQ ID NO: 3939393 - RNA, 14 nt, Human adenovirus F
cggcgggaagagga

SEQ ID NO: 3939394 - RNA, 24 nt, Human adenovirus F
cggcguaguugcguagacgcugga

SEQ ID NO: 3939395 - RNA, 19 nt, Human adenovirus F
cggcguucuagccaacacc

SEQ ID NO: 3939396 - RNA, 20 nt, Human adenovirus F
cggcuccugugcagcgcgcu

SEQ ID NO: 3939397 - RNA, 17 nt, Human adenovirus F
cggcuggggcagaacgu

SEQ ID NO: 3939398 - RNA, 24 nt, Human adenovirus F
cgggaagcaaccgcacaugccagc

SEQ ID NO: 3939399 - RNA, 22 nt, Human adenovirus F
cgggcacugcauacaacucccu

SEQ ID NO: 3939400 - RNA, 14 nt, Human adenovirus F
cgggcagccgguca

SEQ ID NO: 3939401 - RNA, 23 nt, Human adenovirus F
cgggcccgucgucaggccgcccg

SEQ ID NO: 3939402 - RNA, 12 nt, Human adenovirus F
cgggccuggugc

SEQ ID NO: 3939403 - RNA, 16 nt, Human adenovirus F
cggguuuaccuggugg

SEQ ID NO: 3939404 - RNA, 21 nt, Human adenovirus F
cggguuuuggacauggccagc

SEQ ID NO: 3939405 - RNA, 22 nt, Human adenovirus F
cgguacaagauuugacgaaaga

SEQ ID NO: 3939406 - RNA, 21 nt, Human adenovirus F
cgguauagccggugcacuugg

SEQ ID NO: 3939407 - RNA, 16 nt, Human adenovirus F
cgguugugcaguguua

SEQ ID NO: 3939408 - RNA, 16 nt, Human adenovirus F
cguaccaagccugacu

SEQ ID NO: 3939409 - RNA, 16 nt, Human adenovirus F
cguagcacucccucuu

SEQ ID NO: 3939410 - RNA, 14 nt, Human adenovirus F
cgucaacuccucuu

SEQ ID NO: 3939411 - RNA, 16 nt, Human adenovirus F
cgucacuuccgccgca

SEQ ID NO: 3939412 - RNA, 21 nt, Human adenovirus F
cgucacuuccgccgcaccgcg

SEQ ID NO: 3939413 - RNA, 17 nt, Human adenovirus F
cgucaugcucuggggug

SEQ ID NO: 3939414 - RNA, 18 nt, Human adenovirus F
cgucggcucuggacauga

SEQ ID NO: 3939415 - RNA, 13 nt, Human adenovirus F
cgugaccgagcag

SEQ ID NO: 3939416 - RNA, 20 nt, Human adenovirus F
cgugagagaggcgguggcgc

SEQ ID NO: 3939417 - RNA, 16 nt, Human adenovirus F
cguggcauggcagcag

SEQ ID NO: 3939418 - RNA, 22 nt, Human adenovirus F
cguggccuugcaagcagcucgc

SEQ ID NO: 3939419 - RNA, 16 nt, Human adenovirus F
cguggcucaauguaac

SEQ ID NO: 3939420 - RNA, 21 nt, Human adenovirus F
cguguagccuuuaacugcgca

SEQ ID NO: 3939421 - RNA, 19 nt, Human adenovirus F
cguuaguggaggcagcuuc

SEQ ID NO: 3939422 - RNA, 16 nt, Human adenovirus F
cguucgacggcggugg

SEQ ID NO: 3939423 - RNA, 20 nt, Human adenovirus F
cguucucuccccacagccgu

SEQ ID NO: 3939424 - RNA, 19 nt, Human adenovirus F
cguugcacgcucugcaucu

SEQ ID NO: 3939425 - RNA, 18 nt, Human adenovirus F
cguuuccucgauuuccau

SEQ ID NO: 3939426 - RNA, 19 nt, Human adenovirus F
cuaaaaaaacuccacccaa

SEQ ID NO: 3939427 - RNA, 13 nt, Human adenovirus F
cuaaaacaaacca

SEQ ID NO: 3939428 - RNA, 20 nt, Human adenovirus F
cuaagggaggcagcagagga

SEQ ID NO: 3939429 - RNA, 16 nt, Human adenovirus F
cuaaugcacagccugc

SEQ ID NO: 3939430 - RNA, 18 nt, Human adenovirus F
cuacaauuccacuggcaa

SEQ ID NO: 3939431 - RNA, 15 nt, Human adenovirus F
cuacggaggaagagg

SEQ ID NO: 3939432 - RNA, 16 nt, Human adenovirus F
cuacguccgcgacugc

SEQ ID NO: 3939433 - RNA, 22 nt, Human adenovirus F
cuacgugcacaaagcucugggc

SEQ ID NO: 3939434 - RNA, 19 nt, Human adenovirus F
cuagaccaacaaacgaaaa

SEQ ID NO: 3939435 - RNA, 15 nt, Human adenovirus F
cuagacgaggaggac

SEQ ID NO: 3939436 - RNA, 16 nt, Human adenovirus F
cuagccaacacccugu

SEQ ID NO: 3939437 - RNA, 24 nt, Human adenovirus F
cuagccaacuauuuggcccaccac

SEQ ID NO: 3939438 - RNA, 20 nt, Human adenovirus F
cuagggugugaaggcaaagg

SEQ ID NO: 3939439 - RNA, 17 nt, Human adenovirus F
cuauauaggacaaaaaa

SEQ ID NO: 3939440 - RNA, 19 nt, Human adenovirus F
cuaucccgccccugccacc

SEQ ID NO: 3939441 - RNA, 20 nt, Human adenovirus F
cuaucccgccccugccaccg

SEQ ID NO: 3939442 - RNA, 17 nt, Human adenovirus F
cuaugacaccuccucaa

SEQ ID NO: 3939443 - RNA, 16 nt, Human adenovirus F
cuauuaaugcaaacaa

SEQ ID NO: 3939444 - RNA, 14 nt, Human adenovirus F
cucaaacaacaaaa

SEQ ID NO: 3939445 - RNA, 12 nt, Human adenovirus F
cucaagcggguu

SEQ ID NO: 3939446 - RNA, 13 nt, Human adenovirus F
cucaccuggcaaa

SEQ ID NO: 3939447 - RNA, 20 nt, Human adenovirus F
cucagccugaaauacacuga

SEQ ID NO: 3939448 - RNA, 18 nt, Human adenovirus F
cucagggucgauggagcc

SEQ ID NO: 3939449 - RNA, 19 nt, Human adenovirus F
cucaucuucaccucuguuu

SEQ ID NO: 3939450 - RNA, 16 nt, Human adenovirus F
cucaugagcugggaga

SEQ ID NO: 3939451 - RNA, 15 nt, Human adenovirus F
cucauucgcacggcg

SEQ ID NO: 3939452 - RNA, 17 nt, Human adenovirus F
cucauuuucuuauguaa

SEQ ID NO: 3939453 - RNA, 18 nt, Human adenovirus F
cuccaaaggucagaaaaa

SEQ ID NO: 3939454 - RNA, 17 nt, Human adenovirus F
cucccaacaaccuaccc

SEQ ID NO: 3939455 - RNA, 15 nt, Human adenovirus F
ccuuacgucagcuac

SEQ ID NO: 3939456 - RNA, 19 nt, Human adenovirus F
ccuucacuccucgccaggc

SEQ ID NO: 3939457 - RNA, 18 nt, Human adenovirus F
ccuucaggcagcagcccc

SEQ ID NO: 3939458 - RNA, 17 nt, Human adenovirus F
ccuucgccgcagucucc

SEQ ID NO: 3939459 - RNA, 16 nt, Human adenovirus F
ccuugcaagcagcucg

SEQ ID NO: 3939460 - RNA, 23 nt, Human adenovirus F
ccuuugacaaucagggaaauuua

SEQ ID NO: 3939461 - RNA, 21 nt, Human adenovirus F
ccuuuucacccacccaccgcu

SEQ ID NO: 3939462 - RNA, 20 nt, Human adenovirus F
cgaaaaaugaugauggcagc

SEQ ID NO: 3939463 - RNA, 23 nt, Human adenovirus F
cgaaacuuccaacccaugagccg

SEQ ID NO: 3939464 - RNA, 22 nt, Human adenovirus F
cgaacacgcugccaacaaaugu

SEQ ID NO: 3939465 - RNA, 20 nt, Human adenovirus F
cgaagccuucaggcagcagc

SEQ ID NO: 3939466 - RNA, 19 nt, Human adenovirus F
cgaagcuagcauaaaagaa

SEQ ID NO: 3939467 - RNA, 13 nt, Human adenovirus F
cgaaugcccccca

SEQ ID NO: 3939468 - RNA, 16 nt, Human adenovirus F
cgaaugcccuuucaaa

SEQ ID NO: 3939469 - RNA, 21 nt, Human adenovirus F
cgaauugcagcccaccaugca

SEQ ID NO: 3939470 - RNA, 15 nt, Human adenovirus F
cgacagccaggcaga

SEQ ID NO: 3939471 - RNA, 15 nt, Human adenovirus F
cgaccucccaaaguc

SEQ ID NO: 3939472 - RNA, 15 nt, Human adenovirus F
cgaccugaaaaccau

SEQ ID NO: 3939473 - RNA, 16 nt, Human adenovirus F
cgacgcuuggcaccgc

SEQ ID NO: 3939474 - RNA, 18 nt, Human adenovirus F
cgacugggcggcggccau

SEQ ID NO: 3939475 - RNA, 18 nt, Human adenovirus F
cgagccaccaucuccagc

SEQ ID NO: 3939476 - RNA, 14 nt, Human adenovirus F
cgagcgccaucccc

SEQ ID NO: 3939477 - RNA, 22 nt, Human adenovirus F
cgaggacggcaaggaaccagug

SEQ ID NO: 3939478 - RNA, 23 nt, Human adenovirus F
cgaggagguagaaguggaggaaa

SEQ ID NO: 3939479 - RNA, 22 nt, Human adenovirus F
cgaggccaaacccccguuccca

SEQ ID NO: 3939480 - RNA, 19 nt, Human adenovirus F
cgaggccuuucacccagac

SEQ ID NO: 3939481 - RNA, 23 nt, Human adenovirus F
cgaggcuuuccgcgaggccaugc

SEQ ID NO: 3939482 - RNA, 13 nt, Human adenovirus F
cgcaacacaucca

SEQ ID NO: 3939483 - RNA, 13 nt, Human adenovirus F
cgcacccuggugg

SEQ ID NO: 3939484 - RNA, 15 nt, Human adenovirus F
cgcacuggaugccac

SEQ ID NO: 3939485 - RNA, 18 nt, Human adenovirus F
cgcagcagauccuucccg

SEQ ID NO: 3939486 - RNA, 18 nt, Human adenovirus F
cgcagccugagcugccag

SEQ ID NO: 3939487 - RNA, 14 nt, Human adenovirus F
cgcagcgacugacg

SEQ ID NO: 3939488 - RNA, 13 nt, Human adenovirus F
cgcagcuguuuuu

SEQ ID NO: 3939489 - RNA, 16 nt, Human adenovirus F
cgcaugccuccagcac

SEQ ID NO: 3939490 - RNA, 18 nt, Human adenovirus F
cgcaugccuccagcacug

SEQ ID NO: 3939491 - RNA, 17 nt, Human adenovirus F
cgcauuaccauuaguaa

SEQ ID NO: 3939492 - RNA, 15 nt, Human adenovirus F
cgccaguccaccgcg

SEQ ID NO: 3939493 - RNA, 13 nt, Human adenovirus F
cgccauagcugga

SEQ ID NO: 3939494 - RNA, 13 nt, Human adenovirus F
cgccauaggcgca

SEQ ID NO: 3939495 - RNA, 15 nt, Human adenovirus F
cgccaucaugagucu

SEQ ID NO: 3939496 - RNA, 16 nt, Human adenovirus F
cgccguaggagaggca

SEQ ID NO: 3939497 - RNA, 16 nt, Human adenovirus F
cgccucaugagcuggg

SEQ ID NO: 3939498 - RNA, 11 nt, Human adenovirus F
cgccuccacca

SEQ ID NO: 3939499 - RNA, 13 nt, Human adenovirus F
cgccuccaccacc

SEQ ID NO: 3939500 - RNA, 13 nt, Human adenovirus F
cgccuccuggugg

SEQ ID NO: 3939501 - RNA, 10 nt, Human adenovirus F
cgccuggaga

SEQ ID NO: 3939502 - RNA, 18 nt, Human adenovirus F
cgccuuaguugguaccaa

SEQ ID NO: 3939503 - RNA, 14 nt, Human adenovirus F
cgcgacagagcacc

SEQ ID NO: 3939504 - RNA, 14 nt, Human adenovirus F
cgcgcaaccagugg

SEQ ID NO: 3939505 - RNA, 23 nt, Human adenovirus F
cgcgcaacggcaaucccagcaga

SEQ ID NO: 3939506 - RNA, 14 nt, Human adenovirus F
cgcgcaccucuugu

SEQ ID NO: 3939507 - RNA, 15 nt, Human adenovirus F
cgcgcacgacgggga

SEQ ID NO: 3939508 - RNA, 18 nt, Human adenovirus F
cgcggacauuaccgcgcc

SEQ ID NO: 3939509 - RNA, 13 nt, Human adenovirus F
cgcgucugcugcu

SEQ ID NO: 3939510 - RNA, 15 nt, Human adenovirus F
cgcgucugcugcugc

SEQ ID NO: 3939511 - RNA, 16 nt, Human adenovirus F
cgcuaugugcagcagu

SEQ ID NO: 3939512 - RNA, 18 nt, Human adenovirus F
cgcucaccgcccagggaa

SEQ ID NO: 3939513 - RNA, 16 nt, Human adenovirus F
cgcugaccagcagcag

SEQ ID NO: 3939514 - RNA, 21 nt, Human adenovirus F
cgcugagugacgaucuggggg

SEQ ID NO: 3939515 - RNA, 17 nt, Human adenovirus F
cgcugccuuugcaauau

SEQ ID NO: 3939516 - RNA, 12 nt, Human adenovirus F
cgcuggcuccgc

SEQ ID NO: 3939517 - RNA, 15 nt, Human adenovirus F
cgcuggcuccgcggc

SEQ ID NO: 3939518 - RNA, 13 nt, Human adenovirus F
cgcugggagaaaa

SEQ ID NO: 3939519 - RNA, 23 nt, Human adenovirus F
cgcugucguuaguggaggcagcu

SEQ ID NO: 3939520 - RNA, 16 nt, Human adenovirus F
cggaaacaaaaaacuu

SEQ ID NO: 3939521 - RNA, 14 nt, Human adenovirus F
cggaaccugaaaga

SEQ ID NO: 3939522 - RNA, 15 nt, Human adenovirus F
cggaaggaaacgcug

SEQ ID NO: 3939523 - RNA, 18 nt, Human adenovirus F
cggaagggcggaacagca

SEQ ID NO: 3939524 - RNA, 13 nt, Human adenovirus F
cggagccaaccuc

SEQ ID NO: 3939525 - RNA, 15 nt, Human adenovirus F
cggagccggcggugg

SEQ ID NO: 3939526 - RNA, 16 nt, Human adenovirus F
cggcacgggcgcacgu

SEQ ID NO: 3939527 - RNA, 20 nt, Human adenovirus F
cggcauuaacggcguggugg

SEQ ID NO: 3939528 - RNA, 23 nt, Human adenovirus F
cggcgaugaaacuugauuuccau

SEQ ID NO: 3939529 - RNA, 14 nt, Human adenovirus F
cggcgccggacggg

SEQ ID NO: 3939530 - RNA, 13 nt, Human adenovirus F
cggcgccuccaac

SEQ ID NO: 3939531 - RNA, 22 nt, Human adenovirus F
cggcgugguggauauagccaac

SEQ ID NO: 3939532 - RNA, 23 nt, Human adenovirus F
cggcucuggacaugacggcacgu

SEQ ID NO: 3939533 - RNA, 22 nt, Human adenovirus F
cggcugcuucugccagugcagg

SEQ ID NO: 3939534 - RNA, 16 nt, Human adenovirus F
cggcuggggcagaacg

SEQ ID NO: 3939535 - RNA, 18 nt, Human adenovirus F
cgggaagaauacuaaaac

SEQ ID NO: 3939536 - RNA, 16 nt, Human adenovirus F
cgggcaguggccgccg

SEQ ID NO: 3939537 - RNA, 15 nt, Human adenovirus F
cggggcaggagcugc

SEQ ID NO: 3939538 - RNA, 12 nt, Human adenovirus F
cggggugggaaa

SEQ ID NO: 3939539 - RNA, 14 nt, Human adenovirus F
cgggucgcagcagg

SEQ ID NO: 3939540 - RNA, 18 nt, Human adenovirus F
cggguuagaaguaaccaa

SEQ ID NO: 3939541 - RNA, 18 nt, Human adenovirus F
cggguuuuauggcaccgc

SEQ ID NO: 3939542 - RNA, 22 nt, Human adenovirus F
cgguacuaaggcgggcacaaag

SEQ ID NO: 3939543 - RNA, 20 nt, Human adenovirus F
cgguggauaccgcugcagcu

SEQ ID NO: 3939544 - RNA, 16 nt, Human adenovirus F
cgguggcaacccugag

SEQ ID NO: 3939545 - RNA, 22 nt, Human adenovirus F
cgguggcaacccugaggaggag

SEQ ID NO: 3939546 - RNA, 16 nt, Human adenovirus F
cgguggcggacggguc

SEQ ID NO: 3939547 - RNA, 21 nt, Human adenovirus F
cgguuguuuuccaccaggggg

SEQ ID NO: 3939548 - RNA, 15 nt, Human adenovirus F
cgguuucaaacaugu

SEQ ID NO: 3939549 - RNA, 16 nt, Human adenovirus F
cguacaaguugcaaag

SEQ ID NO: 3939550 - RNA, 21 nt, Human adenovirus F
cguagacgcuggaagagguag

SEQ ID NO: 3939551 - RNA, 20 nt, Human adenovirus F
cguagagcucagcaaucuga

SEQ ID NO: 3939552 - RNA, 19 nt, Human adenovirus F
cguagaguuugggagccag

SEQ ID NO: 3939553 - RNA, 22 nt, Human adenovirus F
cguagguuuaaauuacacuaag

SEQ ID NO: 3939554 - RNA, 22 nt, Human adenovirus F
cgucaacuccucuugcaggagc

SEQ ID NO: 3939555 - RNA, 21 nt, Human adenovirus F
cgucaggccgcccgucaggcc

SEQ ID NO: 3939556 - RNA, 14 nt, Human adenovirus F
cgucauccgccucc

SEQ ID NO: 3939557 - RNA, 12 nt, Human adenovirus F
cgucccuggagu

SEQ ID NO: 3939558 - RNA, 20 nt, Human adenovirus F
cgucgcgaacucuggacguc

SEQ ID NO: 3939559 - RNA, 18 nt, Human adenovirus F
cgucuacccuuacgaaca

SEQ ID NO: 3939560 - RNA, 19 nt, Human adenovirus F
cgucugagccuuuguuccu

SEQ ID NO: 3939561 - RNA, 17 nt, Human adenovirus F
cgugaccgagcagcugc

SEQ ID NO: 3939562 - RNA, 17 nt, Human adenovirus F
cguggaaaaacuuggaa

SEQ ID NO: 3939563 - RNA, 21 nt, Human adenovirus F
cguggagccgacuucaagccc

SEQ ID NO: 3939564 - RNA, 21 nt, Human adenovirus F
cgugggaaggggccagcaagc

SEQ ID NO: 3939565 - RNA, 13 nt, Human adenovirus F
cgugguaaaaggg

SEQ ID NO: 3939566 - RNA, 14 nt, Human adenovirus F
cguucagccacucc

SEQ ID NO: 3939567 - RNA, 13 nt, Human adenovirus F
cguuguggacuuc

SEQ ID NO: 3939568 - RNA, 22 nt, Human adenovirus F
cguuguggagucacugcuaccu

SEQ ID NO: 3939569 - RNA, 16 nt, Human adenovirus F
cuaaaaacggagcuca

SEQ ID NO: 3939570 - RNA, 13 nt, Human adenovirus F
cuaaccacuacca

SEQ ID NO: 3939571 - RNA, 16 nt, Human adenovirus F
cuaacuggcagagcac

SEQ ID NO: 3939572 - RNA, 21 nt, Human adenovirus F
gcaaggguaaugucuuuccag

SEQ ID NO: 3939573 - RNA, 21 nt, Human adenovirus F
gcaaguuucgcaaaagcuggg

SEQ ID NO: 3939574 - RNA, 13 nt, Human adenovirus F
gcaauggcucugu

SEQ ID NO: 3939575 - RNA, 15 nt, Human adenovirus F
gcaccagccagcuca

SEQ ID NO: 3939576 - RNA, 16 nt, Human adenovirus F
gcaccagccagcucaa

SEQ ID NO: 3939577 - RNA, 18 nt, Human adenovirus F
gcaccauuguacgagaag

SEQ ID NO: 3939578 - RNA, 11 nt, Human adenovirus F
gcaccuucagu

SEQ ID NO: 3939579 - RNA, 13 nt, Human adenovirus F
gcacguuugacaa

SEQ ID NO: 3939580 - RNA, 19 nt, Human adenovirus F
gcacugguaaaccagcaca

SEQ ID NO: 3939581 - RNA, 17 nt, Human adenovirus F
gcagaaacaugccaccc

SEQ ID NO: 3939582 - RNA, 23 nt, Human adenovirus F
gcagagcccauugauccccaaca

SEQ ID NO: 3939583 - RNA, 18 nt, Human adenovirus F
gcagcagccccaggccaa

SEQ ID NO: 3939584 - RNA, 20 nt, Human adenovirus F
gcagccugagcugccagagg

SEQ ID NO: 3939585 - RNA, 16 nt, Human adenovirus F
gcagcgcacgcuggag

SEQ ID NO: 3939586 - RNA, 20 nt, Human adenovirus F
gcagcgccacucgggaaaga

SEQ ID NO: 3939587 - RNA, 20 nt, Human adenovirus F
gcagcgggaagagaggcagc

SEQ ID NO: 3939588 - RNA, 14 nt, Human adenovirus F
gcagcgggcaggag

SEQ ID NO: 3939589 - RNA, 21 nt, Human adenovirus F
gcagcguguccuuuggcgcga

SEQ ID NO: 3939590 - RNA, 19 nt, Human adenovirus F
gcagcucgcaaacaauaaa

SEQ ID NO: 3939591 - RNA, 19 nt, Human adenovirus F
gcagggugcgauugaaaua

SEQ ID NO: 3939592 - RNA, 21 nt, Human adenovirus F
gcagguaggaccacuggaggg

SEQ ID NO: 3939593 - RNA, 15 nt, Human adenovirus F
gcaguaucaguggag

SEQ ID NO: 3939594 - RNA, 13 nt, Human adenovirus F
gcaguccacuuaa

SEQ ID NO: 3939595 - RNA, 22 nt, Human adenovirus F
gcaguccacuuaacagcuccuc

SEQ ID NO: 3939596 - RNA, 15 nt, Human adenovirus F
gcagugguggauggg

SEQ ID NO: 3939597 - RNA, 21 nt, Human adenovirus F
gcagugucaauagcauacaga

SEQ ID NO: 3939598 - RNA, 22 nt, Human adenovirus F
gcaguguuauaagguccacacu

SEQ ID NO: 3939599 - RNA, 19 nt, Human adenovirus F
gcauaaaagaagcacagga

SEQ ID NO: 3939600 - RNA, 23 nt, Human adenovirus F
gcauaaaguugcgggugauuuug

SEQ ID NO: 3939601 - RNA, 23 nt, Human adenovirus F
gcauacguuacucggagcuggcg

SEQ ID NO: 3939602 - RNA, 16 nt, Human adenovirus F
gcauccaccagccgca

SEQ ID NO: 3939603 - RNA, 23 nt, Human adenovirus F
gcauccucccaacaaccuaccca

SEQ ID NO: 3939604 - RNA, 16 nt, Human adenovirus F
gcaugccuccagcacu

SEQ ID NO: 3939605 - RNA, 20 nt, Human adenovirus F
gcaugccuccagcacugccg

SEQ ID NO: 3939606 - RNA, 14 nt, Human adenovirus F
gcauggcucagccc

SEQ ID NO: 3939607 - RNA, 16 nt, Human adenovirus F
gcauguacggcggcgc

SEQ ID NO: 3939608 - RNA, 21 nt, Human adenovirus F
gcauuaggccgucccugggau

SEQ ID NO: 3939609 - RNA, 14 nt, Human adenovirus F
gccaacuauuuggc

SEQ ID NO: 3939610 - RNA, 19 nt, Human adenovirus F
gccaaugggcuccagcgag

SEQ ID NO: 3939611 - RNA, 13 nt, Human adenovirus F
gccagaaaaaacc

SEQ ID NO: 3939612 - RNA, 21 nt, Human adenovirus F
gccagaaaaaacccuuaacaa

SEQ ID NO: 3939613 - RNA, 13 nt, Human adenovirus F
gccagacgcaggu

SEQ ID NO: 3939614 - RNA, 20 nt, Human adenovirus F
gccagcauggcucagccccg

SEQ ID NO: 3939615 - RNA, 18 nt, Human adenovirus F
gccagccuccgguggcuc

SEQ ID NO: 3939616 - RNA, 18 nt, Human adenovirus F
gccauucuuaacccgcac

SEQ ID NO: 3939617 - RNA, 14 nt, Human adenovirus F
gccauuuuggaagc

SEQ ID NO: 3939618 - RNA, 15 nt, Human adenovirus F
gccccccaauccaaa

SEQ ID NO: 3939619 - RNA, 17 nt, Human adenovirus F
gccccgcccacugaccg

SEQ ID NO: 3939620 - RNA, 23 nt, Human adenovirus F
gcccgaccuguauacgggaagga

SEQ ID NO: 3939621 - RNA, 12 nt, Human adenovirus F
gcccgggcacau

SEQ ID NO: 3939622 - RNA, 17 nt, Human adenovirus F
gcccgggcacaucagaa

SEQ ID NO: 3939623 - RNA, 14 nt, Human adenovirus F
gcccgggcccugga

SEQ ID NO: 3939624 - RNA, 19 nt, Human adenovirus F
gcccgggccuggugcaguu

SEQ ID NO: 3939625 - RNA, 23 nt, Human adenovirus F
gcccuccuuugcgcgaacagagu

SEQ ID NO: 3939626 - RNA, 13 nt, Human adenovirus F
gcccuggccugga

SEQ ID NO: 3939627 - RNA, 18 nt, Human adenovirus F
gccgccaggugguagaca

SEQ ID NO: 3939628 - RNA, 23 nt, Human adenovirus F
gccgccaugacugccgcucgggc

SEQ ID NO: 3939629 - RNA, 15 nt, Human adenovirus F
gccgcccgucaggcc

SEQ ID NO: 3939630 - RNA, 18 nt, Human adenovirus F
gccggcaacgcugcaggc

SEQ ID NO: 3939631 - RNA, 17 nt, Human adenovirus F
gccggugauggcguacg

SEQ ID NO: 3939632 - RNA, 14 nt, Human adenovirus F
gccguggacgcacg

SEQ ID NO: 3939633 - RNA, 22 nt, Human adenovirus F
gccuacaacuacggagaugcag

SEQ ID NO: 3939634 - RNA, 17 nt, Human adenovirus F
gccucagggucaacugg

SEQ ID NO: 3939635 - RNA, 15 nt, Human adenovirus F
gccuccaacacagcc

SEQ ID NO: 3939636 - RNA, 21 nt, Human adenovirus F
gccucuacugcucguggcaug

SEQ ID NO: 3939637 - RNA, 17 nt, Human adenovirus F
gccugagcugccagagg

SEQ ID NO: 3939638 - RNA, 20 nt, Human adenovirus F
gccuguggaguggcauuaaa

SEQ ID NO: 3939639 - RNA, 19 nt, Human adenovirus F
gccuugcaaaaccaaauca

SEQ ID NO: 3939640 - RNA, 18 nt, Human adenovirus F
gccuugggaugcagccuu

SEQ ID NO: 3939641 - RNA, 23 nt, Human adenovirus F
gccuuguaugggcagcauccuuu

SEQ ID NO: 3939642 - RNA, 21 nt, Human adenovirus F
gccuuucacccucgucgcccu

SEQ ID NO: 3939643 - RNA, 21 nt, Human adenovirus F
gccuuuugcaucucaaagcug

SEQ ID NO: 3939644 - RNA, 15 nt, Human adenovirus F
gcgaaauugggcugc

SEQ ID NO: 3939645 - RNA, 14 nt, Human adenovirus F
gcgaaugcccccca

SEQ ID NO: 3939646 - RNA, 13 nt, Human adenovirus F
gcgaaugcccuuu

SEQ ID NO: 3939647 - RNA, 13 nt, Human adenovirus F
gcgcaccucuugu

SEQ ID NO: 3939648 - RNA, 15 nt, Human adenovirus F
gcgccucaauuuuua

SEQ ID NO: 3939649 - RNA, 16 nt, Human adenovirus F
gcgcgaacagaguggg

SEQ ID NO: 3939650 - RNA, 21 nt, Human adenovirus F
gcgcgaacagagugggggcaa

SEQ ID NO: 3939651 - RNA, 17 nt, Human adenovirus F
gcgcgacagagcaccau

SEQ ID NO: 3939652 - RNA, 19 nt, Human adenovirus F
gcgcgcucgucgggaagca

SEQ ID NO: 3939653 - RNA, 20 nt, Human adenovirus F
gcgcggaagaagaugaggag

SEQ ID NO: 3939654 - RNA, 14 nt, Human adenovirus F
gcgcuugccagggu

SEQ ID NO: 3939655 - RNA, 14 nt, Human adenovirus F
gcggagccugaggg

SEQ ID NO: 3939656 - RNA, 17 nt, Human adenovirus F
gcggcaaugcuuuugau

SEQ ID NO: 3939657 - RNA, 24 nt, Human adenovirus F
gcgggcaggagcccgaagagauga

SEQ ID NO: 3939658 - RNA, 14 nt, Human adenovirus F
gcggggcaggagcu

SEQ ID NO: 3939659 - RNA, 15 nt, Human adenovirus F
gcggggcaggagcug

SEQ ID NO: 3939660 - RNA, 18 nt, Human adenovirus F
gcggguuaaaaagcgaga

SEQ ID NO: 3939661 - RNA, 22 nt, Human adenovirus F
gcgguugcggccacgcgagaga

SEQ ID NO: 3939662 - RNA, 18 nt, Human adenovirus F
gcguagaguuugggagcc

SEQ ID NO: 3939663 - RNA, 15 nt, Human adenovirus F
gcgucgcuggcuccg

SEQ ID NO: 3939664 - RNA, 16 nt, Human adenovirus F
gcgucggcgccacacu

SEQ ID NO: 3939665 - RNA, 20 nt, Human adenovirus F
gcgugcuuagacccggcacu

SEQ ID NO: 3939666 - RNA, 20 nt, Human adenovirus F
gcguggccuccguggccuug

SEQ ID NO: 3939667 - RNA, 22 nt, Human adenovirus F
gcguuacgcgcaacgcaagaga

SEQ ID NO: 3939668 - RNA, 14 nt, Human adenovirus F
gcuaaccugugcag

SEQ ID NO: 3939669 - RNA, 15 nt, Human adenovirus F
gcuaacuuguggaga

SEQ ID NO: 3939670 - RNA, 14 nt, Human adenovirus F
gcuaauuuuucacc

SEQ ID NO: 3939671 - RNA, 23 nt, Human adenovirus F
gcuacucaacagaaaccucuucc

SEQ ID NO: 3939672 - RNA, 17 nt, Human adenovirus F
gcuagaaugucacugcc

SEQ ID NO: 3939673 - RNA, 22 nt, Human adenovirus F
gcuaucaggaagcagcucaggu

SEQ ID NO: 3939674 - RNA, 16 nt, Human adenovirus F
gcuauugccagcaugg

SEQ ID NO: 3939675 - RNA, 13 nt, Human adenovirus F
gcucauccugcug

SEQ ID NO: 3939676 - RNA, 13 nt, Human adenovirus F
gcuccuggcgagc

SEQ ID NO: 3939677 - RNA, 15 nt, Human adenovirus F
gcucgcuacauccau

SEQ ID NO: 3939678 - RNA, 20 nt, Human adenovirus F
gcucuaacgggcaccggcac

SEQ ID NO: 3939679 - RNA, 22 nt, Human adenovirus F
gcucugaacacuuuugccaaag

SEQ ID NO: 3939680 - RNA, 17 nt, Human adenovirus F
gcucugcaucucuugaa

SEQ ID NO: 3939681 - RNA, 12 nt, Human adenovirus F
gcucugcuuaac

SEQ ID NO: 3939682 - RNA, 21 nt, Human adenovirus F
gcucugguagaaagcaaagcc

SEQ ID NO: 3939683 - RNA, 13 nt, Human adenovirus F
gcucuucuuccuc

SEQ ID NO: 3939684 - RNA, 18 nt, Human adenovirus F
gcugacccuucccaacgc

SEQ ID NO: 3939685 - RNA, 14 nt, Human adenovirus F
gcugacggccggcc

SEQ ID NO: 3939686 - RNA, 18 nt, Human adenovirus F
gcugaugcauuuguggga

SEQ ID NO: 3939687 - RNA, 22 nt, Human adenovirus F
gcugccagaggccguagcccgu

SEQ ID NO: 3939688 - RNA, 12 nt, Human adenovirus F
uagcauaaaaga

SEQ ID NO: 3939689 - RNA, 22 nt, Human adenovirus F
uagcauaaaggggaccagcugu

SEQ ID NO: 3939690 - RNA, 16 nt, Human adenovirus F
uaggcuuuaacaacac

SEQ ID NO: 3939691 - RNA, 19 nt, Human adenovirus F
uagugaaacaugaggagga

SEQ ID NO: 3939692 - RNA, 22 nt, Human adenovirus F
uaucacuaaaaccaacaaaauc

SEQ ID NO: 3939693 - RNA, 18 nt, Human adenovirus F
uaucccgcgcuaaaucuu

SEQ ID NO: 3939694 - RNA, 17 nt, Human adenovirus F
uaugcagacaagacaug

SEQ ID NO: 3939695 - RNA, 14 nt, Human adenovirus F
uaugccaacuuuuu

SEQ ID NO: 3939696 - RNA, 11 nt, Human adenovirus F
uauggaggagg

SEQ ID NO: 3939697 - RNA, 13 nt, Human adenovirus F
uaugucugccaaa

SEQ ID NO: 3939698 - RNA, 15 nt, Human adenovirus F
uauuuuaaaaugguu

SEQ ID NO: 3939699 - RNA, 19 nt, Human adenovirus F
ucaaaaucuucaaacauua

SEQ ID NO: 3939700 - RNA, 16 nt, Human adenovirus F
ucaaacaaccagcgcu

SEQ ID NO: 3939701 - RNA, 18 nt, Human adenovirus F
ucaaagacgccgccuugc

SEQ ID NO: 3939702 - RNA, 16 nt, Human adenovirus F
ucaaccaacuaacacu

SEQ ID NO: 3939703 - RNA, 14 nt, Human adenovirus F
ucaacucagaauug

SEQ ID NO: 3939704 - RNA, 14 nt, Human adenovirus F
ucaacuccucuugc

SEQ ID NO: 3939705 - RNA, 16 nt, Human adenovirus F
ucaagaaacacaaaca

SEQ ID NO: 3939706 - RNA, 19 nt, Human adenovirus F
ucaagaaacacaaacauag

SEQ ID NO: 3939707 - RNA, 20 nt, Human adenovirus F
ucaagggauugacgcagcaa

SEQ ID NO: 3939708 - RNA, 20 nt, Human adenovirus F
ucaauagcauacagaagacc

SEQ ID NO: 3939709 - RNA, 14 nt, Human adenovirus F
ucacccaaagccaa

SEQ ID NO: 3939710 - RNA, 12 nt, Human adenovirus F
ucacccacccac

SEQ ID NO: 3939711 - RNA, 12 nt, Human adenovirus F
ucaccuacaacc

SEQ ID NO: 3939712 - RNA, 18 nt, Human adenovirus F
ucaccuacucuggcuccg

SEQ ID NO: 3939713 - RNA, 18 nt, Human adenovirus F
ucacgcuguaccaggagg

SEQ ID NO: 3939714 - RNA, 14 nt, Human adenovirus F
ucacugaaagccag

SEQ ID NO: 3939715 - RNA, 15 nt, Human adenovirus F
ucacugaaagccagc

SEQ ID NO: 3939716 - RNA, 17 nt, Human adenovirus F
ucacugcuaccuccucc

SEQ ID NO: 3939717 - RNA, 23 nt, Human adenovirus F
ucagaaaccccaccguggcuccc

SEQ ID NO: 3939718 - RNA, 20 nt, Human adenovirus F
ucagacggccguaccaagcc

SEQ ID NO: 3939719 - RNA, 23 nt, Human adenovirus F
ucagacggccguaccaagccuga

SEQ ID NO: 3939720 - RNA, 15 nt, Human adenovirus F
ucagcaugagcaagc

SEQ ID NO: 3939721 - RNA, 16 nt, Human adenovirus F
ucagccacuccugcag

SEQ ID NO: 3939722 - RNA, 18 nt, Human adenovirus F
ucauccaaguuuuuacaa

SEQ ID NO: 3939723 - RNA, 12 nt, Human adenovirus F
ucauccgccucc

SEQ ID NO: 3939724 - RNA, 23 nt, Human adenovirus F
ucauuaucauauuggcucguuuc

SEQ ID NO: 3939725 - RNA, 15 nt, Human adenovirus F
uccaagugccccaga

SEQ ID NO: 3939726 - RNA, 13 nt, Human adenovirus F
uccaccagccgca

SEQ ID NO: 3939727 - RNA, 19 nt, Human adenovirus F
uccacguaccagaaagcua

SEQ ID NO: 3939728 - RNA, 12 nt, Human adenovirus F
uccagccucaaa

SEQ ID NO: 3939729 - RNA, 14 nt, Human adenovirus F
uccauaaugauggc

SEQ ID NO: 3939730 - RNA, 20 nt, Human adenovirus F
uccaugccuuucucccaggc

SEQ ID NO: 3939731 - RNA, 14 nt, Human adenovirus F
ucccaaaaaaagaa

SEQ ID NO: 3939732 - RNA, 14 nt, Human adenovirus F
ucccaacacuuuca

SEQ ID NO: 3939733 - RNA, 15 nt, Human adenovirus F
ucccagcagaaacua

SEQ ID NO: 3939734 - RNA, 14 nt, Human adenovirus F
ucccaggcguggcc

SEQ ID NO: 3939735 - RNA, 18 nt, Human adenovirus F
ucccgccccugccaccgc

SEQ ID NO: 3939736 - RNA, 19 nt, Human adenovirus F
uccgcagacgaacacaaua

SEQ ID NO: 3939737 - RNA, 16 nt, Human adenovirus F
uccgccauugccaccc

SEQ ID NO: 3939738 - RNA, 12 nt, Human adenovirus F
uccgcccgcucc

SEQ ID NO: 3939739 - RNA, 16 nt, Human adenovirus F
uccuaacgccacuuuu

SEQ ID NO: 3939740 - RNA, 14 nt, Human adenovirus F
uccuauuacagccc

SEQ ID NO: 3939741 - RNA, 23 nt, Human adenovirus F
uccucgauuuccauaaacuccuc

SEQ ID NO: 3939742 - RNA, 17 nt, Human adenovirus F
uccuucacaaaguccug

SEQ ID NO: 3939743 - RNA, 15 nt, Human adenovirus F
ucgaaggcugccggc

SEQ ID NO: 3939744 - RNA, 15 nt, Human adenovirus F
ucgauggagccagcg

SEQ ID NO: 3939745 - RNA, 17 nt, Human adenovirus F
ucgcaaacaauaaaaga

SEQ ID NO: 3939746 - RNA, 19 nt, Human adenovirus F
ucgcaagguaagcuaagga

SEQ ID NO: 3939747 - RNA, 15 nt, Human adenovirus F
ucgcauccuggcccu

SEQ ID NO: 3939748 - RNA, 23 nt, Human adenovirus F
ucgccagcgacaaggcaccaucu

SEQ ID NO: 3939749 - RNA, 16 nt, Human adenovirus F
ucgccaguccaccgcg

SEQ ID NO: 3939750 - RNA, 15 nt, Human adenovirus F
ucgccgcgcaggggc

SEQ ID NO: 3939751 - RNA, 15 nt, Human adenovirus F
ucgccuaacaucacc

SEQ ID NO: 3939752 - RNA, 17 nt, Human adenovirus F
ucgcgaaauugggcugc

SEQ ID NO: 3939753 - RNA, 14 nt, Human adenovirus F
ucgcuccagguggg

SEQ ID NO: 3939754 - RNA, 19 nt, Human adenovirus F
ucgcuccagguggggcggc

SEQ ID NO: 3939755 - RNA, 21 nt, Human adenovirus F
ucgggcccgucgucaggccgc

SEQ ID NO: 3939756 - RNA, 17 nt, Human adenovirus F
ucgucgcccucuucugc

SEQ ID NO: 3939757 - RNA, 23 nt, Human adenovirus F
ucgugcccguggaaaaagacagc

SEQ ID NO: 3939758 - RNA, 16 nt, Human adenovirus F
ucuaaugccuuaacau

SEQ ID NO: 3939759 - RNA, 23 nt, Human adenovirus F
ucuagauaauaacuuucuuacac

SEQ ID NO: 3939760 - RNA, 14 nt, Human adenovirus F
ucucaucuucaccu

SEQ ID NO: 3939761 - RNA, 22 nt, Human adenovirus F
ucuccugcacgucgccagaguu

SEQ ID NO: 3939762 - RNA, 19 nt, Human adenovirus F
ucugauaauguguguuuuu

SEQ ID NO: 3939763 - RNA, 15 nt, Human adenovirus F
ucugaucucuuacau

SEQ ID NO: 3939764 - RNA, 20 nt, Human adenovirus F
ucugcaaaaacaaauacagu

SEQ ID NO: 3939765 - RNA, 20 nt, Human adenovirus F
ucugcagcagcgcccgccuc

SEQ ID NO: 3939766 - RNA, 20 nt, Human adenovirus F
ucugccaccagccggaggag

SEQ ID NO: 3939767 - RNA, 20 nt, Human adenovirus F
ucugccaucgcugaccagca

SEQ ID NO: 3939768 - RNA, 23 nt, Human adenovirus F
ucuggaaucagcaucuuaggaag

SEQ ID NO: 3939769 - RNA, 22 nt, Human adenovirus F
ucuguaacaccgagcuucuuag

SEQ ID NO: 3939770 - RNA, 16 nt, Human adenovirus F
ucuuaaguuauacagu

SEQ ID NO: 3939771 - RNA, 17 nt, Human adenovirus F
ucuucgcccugaaaguc

SEQ ID NO: 3939772 - RNA, 12 nt, Human adenovirus F
ucuuucuuacaa

SEQ ID NO: 3939773 - RNA, 13 nt, Human adenovirus F
ucuuugccaccuu

SEQ ID NO: 3939774 - RNA, 21 nt, Human adenovirus F
ugaaaaccauuuugcgcacca

SEQ ID NO: 3939775 - RNA, 18 nt, Human adenovirus F
ugaaaagaaccagaauug

SEQ ID NO: 3939776 - RNA, 18 nt, Human adenovirus F
ugaaaucacaguugggac

SEQ ID NO: 3939777 - RNA, 10 nt, Human adenovirus F
ugaaauuaau

SEQ ID NO: 3939778 - RNA, 12 nt, Human adenovirus F
ugaaccacgcug

SEQ ID NO: 3939779 - RNA, 22 nt, Human adenovirus F
ugaacccgguguacaccaccuc

SEQ ID NO: 3939780 - RNA, 16 nt, Human adenovirus F
ugaaccggaaaaccaa

SEQ ID NO: 3939781 - RNA, 22 nt, Human adenovirus F
ugaacguacucuuuugccacgc

SEQ ID NO: 3939782 - RNA, 11 nt, Human adenovirus F
ugaagaccaau

SEQ ID NO: 3939783 - RNA, 22 nt, Human adenovirus F
ugaagccauucuucucuucggc

SEQ ID NO: 3939784 - RNA, 15 nt, Human adenovirus F
ugaaguuucacacuu

SEQ ID NO: 3939785 - RNA, 16 nt, Human adenovirus F
ugacaacggacgugag

SEQ ID NO: 3939786 - RNA, 19 nt, Human adenovirus F
ugacacgggcacucuucgc

SEQ ID NO: 3939787 - RNA, 20 nt, Human adenovirus F
ugacacgucaccgccaagag

SEQ ID NO: 3939788 - RNA, 15 nt, Human adenovirus F
ugaccaaggacuggu

SEQ ID NO: 3939789 - RNA, 17 nt, Human adenovirus F
ugacgaagacauucuug

SEQ ID NO: 3939790 - RNA, 14 nt, Human adenovirus F
ugacgugccugagg

SEQ ID NO: 3939791 - RNA, 17 nt, Human adenovirus F
ugacgugccugagggcg

SEQ ID NO: 3939792 - RNA, 22 nt, Human adenovirus F
ugagcuuggauuaggaagggca

SEQ ID NO: 3939793 - RNA, 13 nt, Human adenovirus F
ugaggacgagccc

SEQ ID NO: 3939794 - RNA, 14 nt, Human adenovirus F
ugauccacuuacaa

SEQ ID NO: 3939795 - RNA, 14 nt, Human adenovirus F
ugaugcaccucuug

SEQ ID NO: 3939796 - RNA, 15 nt, Human adenovirus F
ugcaaagcucccaaa

SEQ ID NO: 3939797 - RNA, 14 nt, Human adenovirus F
ugcaauggcagccc

SEQ ID NO: 3939798 - RNA, 18 nt, Human adenovirus F
ugcacugccaucugcagc

SEQ ID NO: 3939799 - RNA, 16 nt, Human adenovirus F
ugcacuuaacuguucu

SEQ ID NO: 3939800 - RNA, 23 nt, Human adenovirus F
ugcagcagcgcccgccucccaaa

SEQ ID NO: 3939801 - RNA, 12 nt, Human adenovirus F
ugcagcccacca

SEQ ID NO: 3939802 - RNA, 21 nt, Human adenovirus F
ugcagcccaccaugcaacuca

SEQ ID NO: 3939803 - RNA, 14 nt, Human adenovirus F
ugcagcgguaucug

SEQ ID NO: 3939804 - RNA, 22 nt, Human adenovirus F
ugcaguucgcccgugccaccga

SEQ ID NO: 3939805 - RNA, 13 nt, Human adenovirus F
cccuucccgacau

SEQ ID NO: 3939806 - RNA, 14 nt, Human adenovirus F
ccgaaguccaaaug

SEQ ID NO: 3939807 - RNA, 17 nt, Human adenovirus F
ccgacuacuuacuccca

SEQ ID NO: 3939808 - RNA, 16 nt, Human adenovirus F
gaugucauaaacguaa

SEQ ID NO: 3939809 - RNA, 21 nt, Human adenovirus F
gauguccuuaaggaggaggcu

SEQ ID NO: 3939810 - RNA, 14 nt, Human adenovirus F
gauuuggaagauga

SEQ ID NO: 3939811 - RNA, 18 nt, Human adenovirus F
gauuuuucuucuccuggc

SEQ ID NO: 3939812 - RNA, 22 nt, Human adenovirus F
gcaaaaaaacgaaaccgagaau

SEQ ID NO: 3939813 - RNA, 17 nt, Human adenovirus F
gcaaacaacgaacuuuc

SEQ ID NO: 3939814 - RNA, 15 nt, Human adenovirus F
gcaaacaauaaaaga

SEQ ID NO: 3939815 - RNA, 21 nt, Human adenovirus F
gcaaacgagaggaccacuuaa

SEQ ID NO: 3939816 - RNA, 22 nt, Human adenovirus F
gcaaacggugaacgaggagcgc

SEQ ID NO: 3939817 - RNA, 19 nt, Human adenovirus F
acggcggaugguggcaagg

SEQ ID NO: 3939818 - RNA, 17 nt, Human adenovirus F
acgggcggcaaaugcuc

SEQ ID NO: 3939819 - RNA, 21 nt, Human adenovirus F
acgggcggcaaaugcucugca

SEQ ID NO: 3939820 - RNA, 14 nt, Human adenovirus F
acgggcuggcuucc

SEQ ID NO: 3939821 - RNA, 15 nt, Human adenovirus F
acguacucuuuugcc

SEQ ID NO: 3939822 - RNA, 17 nt, Human adenovirus F
acgucauccgccuccac

SEQ ID NO: 3939823 - RNA, 18 nt, Human adenovirus F
acgucccaucauuuccac

SEQ ID NO: 3939824 - RNA, 19 nt, Human adenovirus F
acgugggacgacagccagg

SEQ ID NO: 3939825 - RNA, 19 nt, Human adenovirus F
acguucgucguuuccccaa

SEQ ID NO: 3939826 - RNA, 22 nt, Human adenovirus F
acuaagccucucgcucugcaaa

SEQ ID NO: 3939827 - RNA, 14 nt, Human adenovirus F
acuaaugcacagcc

SEQ ID NO: 3939828 - RNA, 18 nt, Human adenovirus F
acuaugccuuccgucaug

SEQ ID NO: 3939829 - RNA, 17 nt, Human adenovirus F
acucauccauaaugaug

SEQ ID NO: 3939830 - RNA, 14 nt, Human adenovirus F
acuccucuuccucc

SEQ ID NO: 3939831 - RNA, 12 nt, Human adenovirus F
acuccucuugca

SEQ ID NO: 3939832 - RNA, 18 nt, Human adenovirus F
acucggagcuggcgccuc

SEQ ID NO: 3939833 - RNA, 17 nt, Human adenovirus F
acucuuuauuuuucuga

SEQ ID NO: 3939834 - RNA, 12 nt, Human adenovirus F
acugaccccauu

SEQ ID NO: 3939835 - RNA, 15 nt, Human adenovirus F
acugauccacuuaca

SEQ ID NO: 3939836 - RNA, 21 nt, Human adenovirus F
acugcauacaacucccuggcc

SEQ ID NO: 3939837 - RNA, 15 nt, Human adenovirus F
acugccacugaaacc

SEQ ID NO: 3939838 - RNA, 15 nt, Human adenovirus F
acugcggacuaccua

SEQ ID NO: 3939839 - RNA, 17 nt, Human adenovirus F
acugcuaaagggaacug

SEQ ID NO: 3939840 - RNA, 21 nt, Human adenovirus F
acugcuaaagggaacugccag

SEQ ID NO: 3939841 - RNA, 14 nt, Human adenovirus F
acugcuaccuccuc

SEQ ID NO: 3939842 - RNA, 20 nt, Human adenovirus F
acugcuagaaugucacugcc

SEQ ID NO: 3939843 - RNA, 16 nt, Human adenovirus F
acuggaguaacacaau

SEQ ID NO: 3939844 - RNA, 21 nt, Human adenovirus F
acugggugcgagaugcgucgg

SEQ ID NO: 3939845 - RNA, 13 nt, Human adenovirus F
acugguaaaccag

SEQ ID NO: 3939846 - RNA, 15 nt, Human adenovirus F
acugucaggcucuga

SEQ ID NO: 3939847 - RNA, 21 nt, Human adenovirus F
acuguuaauauacguaaaugu

SEQ ID NO: 3939848 - RNA, 16 nt, Human adenovirus F
acuucaccaaugccau

SEQ ID NO: 3939849 - RNA, 16 nt, Human adenovirus F
acuucauugguuugau

SEQ ID NO: 3939850 - RNA, 15 nt, Human adenovirus F
acuuccagcuguugg

SEQ ID NO: 3939851 - RNA, 17 nt, Human adenovirus F
acuuccagcuguuggag

SEQ ID NO: 3939852 - RNA, 15 nt, Human adenovirus F
acuuggggaauuugu

SEQ ID NO: 3939853 - RNA, 18 nt, Human adenovirus F
acuuuaaacaagcaaaga

SEQ ID NO: 3939854 - RNA, 15 nt, Human adenovirus F
acuuucuccacgucc

SEQ ID NO: 3939855 - RNA, 23 nt, Human adenovirus F
acuuuuuuuguggccauuuucca

SEQ ID NO: 3939856 - RNA, 15 nt, Human adenovirus F
agaaaacgaaaacuu

SEQ ID NO: 3939857 - RNA, 22 nt, Human adenovirus F
agaaaccccaccguggcuccca

SEQ ID NO: 3939858 - RNA, 23 nt, Human adenovirus F
agaaaccccaccguggcucccac

SEQ ID NO: 3939859 - RNA, 19 nt, Human adenovirus F
agaaacuacaaaagcagug

SEQ ID NO: 3939860 - RNA, 19 nt, Human adenovirus F
agaaauuuagauuuuucuu

SEQ ID NO: 3939861 - RNA, 15 nt, Human adenovirus F
agaacaaaacacacu

SEQ ID NO: 3939862 - RNA, 19 nt, Human adenovirus F
agaaccuugcuacggagga

SEQ ID NO: 3939863 - RNA, 20 nt, Human adenovirus F
agaacguguugguagagcug

SEQ ID NO: 3939864 - RNA, 23 nt, Human adenovirus F
agaagaugcccuguccguggugu

SEQ ID NO: 3939865 - RNA, 19 nt, Human adenovirus F
agaaguggaggaaaaacua

SEQ ID NO: 3939866 - RNA, 15 nt, Human adenovirus F
agaauacuaaaacaa

SEQ ID NO: 3939867 - RNA, 18 nt, Human adenovirus F
agaauuuaugccuagcuc

SEQ ID NO: 3939868 - RNA, 13 nt, Human adenovirus F
agacaaaacacua

SEQ ID NO: 3939869 - RNA, 17 nt, Human adenovirus F
agacacauuggcuggag

SEQ ID NO: 3939870 - RNA, 13 nt, Human adenovirus F
agaccaacaaacg

SEQ ID NO: 3939871 - RNA, 14 nt, Human adenovirus F
agacccauuuccaa

SEQ ID NO: 3939872 - RNA, 14 nt, Human adenovirus F
agagcuaaggagga

SEQ ID NO: 3939873 - RNA, 19 nt, Human adenovirus F
agaggaacguauuuugcgc

SEQ ID NO: 3939874 - RNA, 17 nt, Human adenovirus F
agaggcgguggcgcagc

SEQ ID NO: 3939875 - RNA, 23 nt, Human adenovirus F
agagugagguguaccaguccggg

SEQ ID NO: 3939876 - RNA, 13 nt, Human adenovirus F
agaguuugggagc

SEQ ID NO: 3939877 - RNA, 16 nt, Human adenovirus F
agaugcgauuuuccaa

SEQ ID NO: 3939878 - RNA, 23 nt, Human adenovirus F
agaugcgccucaugagcugggag

SEQ ID NO: 3939879 - RNA, 18 nt, Human adenovirus F
agaugcguccgacggcgc

SEQ ID NO: 3939880 - RNA, 23 nt, Human adenovirus F
agauggaaaacgagggggaggac

SEQ ID NO: 3939881 - RNA, 22 nt, Human adenovirus F
agauggcgugggaguuggagga

SEQ ID NO: 3939882 - RNA, 17 nt, Human adenovirus F
agauuuuggacuguaca

SEQ ID NO: 3939883 - RNA, 21 nt, Human adenovirus F
agauuuuucuucuccuggccg

SEQ ID NO: 3939884 - RNA, 19 nt, Human adenovirus F
agcaagccgcugacggcgc

SEQ ID NO: 3939885 - RNA, 19 nt, Human adenovirus F
agcaccaccugcccuuccu

SEQ ID NO: 3939886 - RNA, 14 nt, Human adenovirus F
agcacugcggugga

SEQ ID NO: 3939887 - RNA, 13 nt, Human adenovirus F
agcagagcucugc

SEQ ID NO: 3939888 - RNA, 17 nt, Human adenovirus F
agcagauggagagcugg

SEQ ID NO: 3939889 - RNA, 15 nt, Human adenovirus F
agcaggccgcccaac

SEQ ID NO: 3939890 - RNA, 20 nt, Human adenovirus F
agcagggugcgauugaaaua

SEQ ID NO: 3939891 - RNA, 14 nt, Human adenovirus F
agcauaauaacucu

SEQ ID NO: 3939892 - RNA, 21 nt, Human adenovirus F
agcauugugguacaggagcgc

SEQ ID NO: 3939893 - RNA, 22 nt, Human adenovirus F
agccaaaucgcgcaaccagugg

SEQ ID NO: 3939894 - RNA, 15 nt, Human adenovirus F
agccaacuauuuggc

SEQ ID NO: 3939895 - RNA, 12 nt, Human adenovirus F
agccaaugggcu

SEQ ID NO: 3939896 - RNA, 17 nt, Human adenovirus F
agccacaauaagcagcu

SEQ ID NO: 3939897 - RNA, 13 nt, Human adenovirus F
agccacuccugca

SEQ ID NO: 3939898 - RNA, 17 nt, Human adenovirus F
agccacuccugcagucc

SEQ ID NO: 3939899 - RNA, 21 nt, Human adenovirus F
agccagcucaacgggggcgcu

SEQ ID NO: 3939900 - RNA, 23 nt, Human adenovirus F
agccaguggacaaaccaaaacaa

SEQ ID NO: 3939901 - RNA, 16 nt, Human adenovirus F
agcccauaaaagcaau

SEQ ID NO: 3939902 - RNA, 17 nt, Human adenovirus F
agcccggguccaggcua

SEQ ID NO: 3939903 - RNA, 19 nt, Human adenovirus F
agccgacuucaagcccaau

SEQ ID NO: 3939904 - RNA, 17 nt, Human adenovirus F
agccgaugcccaacgcu

SEQ ID NO: 3939905 - RNA, 12 nt, Human adenovirus F
agccgccagccu

SEQ ID NO: 3939906 - RNA, 16 nt, Human adenovirus F
agccgcugacggcgca

SEQ ID NO: 3939907 - RNA, 16 nt, Human adenovirus F
agccggaggagugggc

SEQ ID NO: 3939908 - RNA, 16 nt, Human adenovirus F
agccucucgcucugca

SEQ ID NO: 3939909 - RNA, 15 nt, Human adenovirus F
agccugaaacgccgc

SEQ ID NO: 3939910 - RNA, 16 nt, Human adenovirus F
agccugaagcccgcaa

SEQ ID NO: 3939911 - RNA, 12 nt, Human adenovirus F
agccuguggagu

SEQ ID NO: 3939912 - RNA, 12 nt, Human adenovirus F
agccuuuaacug

SEQ ID NO: 3939913 - RNA, 18 nt, Human adenovirus F
agcgagcaggaguugguc

SEQ ID NO: 3939914 - RNA, 14 nt, Human adenovirus F
agcgcagcaccgca

SEQ ID NO: 3939915 - RNA, 17 nt, Human adenovirus F
agcggaauaaguccggc

SEQ ID NO: 3939916 - RNA, 19 nt, Human adenovirus F
agcggcacgucggcgugga

SEQ ID NO: 3939917 - RNA, 18 nt, Human adenovirus F
agcgggaacgcuuuaugc

SEQ ID NO: 3939918 - RNA, 19 nt, Human adenovirus F
agcguacgguugcccgcca

SEQ ID NO: 3939919 - RNA, 13 nt, Human adenovirus F
agcguaggagcua

SEQ ID NO: 3939920 - RNA, 12 nt, Human adenovirus F
cagccaguggga

SEQ ID NO: 3939921 - RNA, 18 nt, Human adenovirus F
cagccccaggccaaccgc

SEQ ID NO: 3939922 - RNA, 14 nt, Human adenovirus F
cagccgugaagcca

SEQ ID NO: 3939923 - RNA, 19 nt, Human adenovirus F
cagccgugaagccaaaucg

SEQ ID NO: 3939924 - RNA, 15 nt, Human adenovirus F
cagccuagacgagga

SEQ ID NO: 3939925 - RNA, 18 nt, Human adenovirus F
cagccugagcugccagag

SEQ ID NO: 3939926 - RNA, 16 nt, Human adenovirus F
cagcgacggaacgugg

SEQ ID NO: 3939927 - RNA, 19 nt, Human adenovirus F
cagcgcccgccucccaaag

SEQ ID NO: 3939928 - RNA, 18 nt, Human adenovirus F
cagcgcgugaccaucacu

SEQ ID NO: 3939929 - RNA, 12 nt, Human adenovirus F
cagcgggcacag

SEQ ID NO: 3939930 - RNA, 17 nt, Human adenovirus F
cagcguagcacucccuc

SEQ ID NO: 3939931 - RNA, 17 nt, Human adenovirus F
cagcguugagccggaag

SEQ ID NO: 3939932 - RNA, 22 nt, Human adenovirus F
cagcuaacucucuuacauuggc

SEQ ID NO: 3939933 - RNA, 16 nt, Human adenovirus F
cagcucaacgggggcg

SEQ ID NO: 3939934 - RNA, 20 nt, Human adenovirus F
cagcucacgucuucuacaca

SEQ ID NO: 3939935 - RNA, 22 nt, Human adenovirus F
cagcucgcaaacaauaaaagaa

SEQ ID NO: 3939936 - RNA, 17 nt, Human adenovirus F
cagcugaacccacccuc

SEQ ID NO: 3939937 - RNA, 18 nt, Human adenovirus F
cagcugcuaaccugugca

SEQ ID NO: 3939938 - RNA, 17 nt, Human adenovirus F
cagcuggagcuucucag

SEQ ID NO: 3939939 - RNA, 18 nt, Human adenovirus F
cagcugguaagcagccua

SEQ ID NO: 3939940 - RNA, 21 nt, Human adenovirus F
cagcuucucgaggccaaaccc

SEQ ID NO: 3939941 - RNA, 17 nt, Human adenovirus F
caggagacggguaaggg

SEQ ID NO: 3939942 - RNA, 19 nt, Human adenovirus F
caggagcagcgggaagaga

SEQ ID NO: 3939943 - RNA, 22 nt, Human adenovirus F
caggagcgcagucuaagccugg

SEQ ID NO: 3939944 - RNA, 23 nt, Human adenovirus F
caggaggcuauuggccagacgca

SEQ ID NO: 3939945 - RNA, 15 nt, Human adenovirus F
caggcagcagggugc

SEQ ID NO: 3939946 - RNA, 20 nt, Human adenovirus F
caggccaaccuagaccgacu

SEQ ID NO: 3939947 - RNA, 15 nt, Human adenovirus F
caggcucugagagug

SEQ ID NO: 3939948 - RNA, 19 nt, Human adenovirus F
cagggaucgcagcgggcag

SEQ ID NO: 3939949 - RNA, 21 nt, Human adenovirus F
cagggcgcuaacugugcaucu

SEQ ID NO: 3939950 - RNA, 20 nt, Human adenovirus F
cagguaggaccacuggaggg

SEQ ID NO: 3939951 - RNA, 14 nt, Human adenovirus F
caggucaaaugcuc

SEQ ID NO: 3939952 - RNA, 17 nt, Human adenovirus F
caggucguaaugaggac

SEQ ID NO: 3939953 - RNA, 21 nt, Human adenovirus F
cagguguacuggucccuuccc

SEQ ID NO: 3939954 - RNA, 16 nt, Human adenovirus F
caguaccgcuccauca

SEQ ID NO: 3939955 - RNA, 20 nt, Human adenovirus F
caguaggacgucagaacggc

SEQ ID NO: 3939956 - RNA, 16 nt, Human adenovirus F
cagugcaggaagagga

SEQ ID NO: 3939957 - RNA, 22 nt, Human adenovirus F
cagugcuuggaagagcaaaacc

SEQ ID NO: 3939958 - RNA, 23 nt, Human adenovirus F
caguggaauuggaaugccugcag

SEQ ID NO: 3939959 - RNA, 23 nt, Human adenovirus F
cagugggaccguaaaugacccca

SEQ ID NO: 3939960 - RNA, 15 nt, Human adenovirus F
cagugggacgaggag

SEQ ID NO: 3939961 - RNA, 14 nt, Human adenovirus F
caguucgcccgugc

SEQ ID NO: 3939962 - RNA, 14 nt, Human adenovirus F
caguuggagcagcc

SEQ ID NO: 3939963 - RNA, 21 nt, Human adenovirus F
caguuggagcagccuguggag

SEQ ID NO: 3939964 - RNA, 15 nt, Human adenovirus F
caguuuggcaaugga

SEQ ID NO: 3939965 - RNA, 22 nt, Human adenovirus F
cauaacuaaaaaaacuccaccc

SEQ ID NO: 3939966 - RNA, 15 nt, Human adenovirus F
cauagcugucucacc

SEQ ID NO: 3939967 - RNA, 20 nt, Human adenovirus F
cauauacuuuaaacaagcaa

SEQ ID NO: 3939968 - RNA, 16 nt, Human adenovirus F
caucaggggcucagga

SEQ ID NO: 3939969 - RNA, 18 nt, Human adenovirus F
cauccccgccgccccugg

SEQ ID NO: 3939970 - RNA, 18 nt, Human adenovirus F
cauccgccauugccaccc

SEQ ID NO: 3939971 - RNA, 19 nt, Human adenovirus F
caucugcagcauugccacu

SEQ ID NO: 3939972 - RNA, 17 nt, Human adenovirus F
caucuucuucugcaucc

SEQ ID NO: 3939973 - RNA, 14 nt, Human adenovirus F
caugaacacuuccg

SEQ ID NO: 3939974 - RNA, 23 nt, Human adenovirus F
caugaccaaaccuauugguucca

SEQ ID NO: 3939975 - RNA, 14 nt, Human adenovirus F
caugagcugggaga

SEQ ID NO: 3939976 - RNA, 13 nt, Human adenovirus F
caugaggaggaaa

SEQ ID NO: 3939977 - RNA, 20 nt, Human adenovirus F
caugagucuguuuggugggc

SEQ ID NO: 3939978 - RNA, 21 nt, Human adenovirus F
caugccacccaagggaaacaa

SEQ ID NO: 3939979 - RNA, 20 nt, Human adenovirus F
caugcccgagccggagaggg

SEQ ID NO: 3939980 - RNA, 22 nt, Human adenovirus F
caugcugcuguuuuuacuuugc

SEQ ID NO: 3939981 - RNA, 14 nt, Human adenovirus F
caugcuuagccucg

SEQ ID NO: 3939982 - RNA, 17 nt, Human adenovirus F
cauggcagcagauuuug

SEQ ID NO: 3939983 - RNA, 15 nt, Human adenovirus F
cauguacacuauggu

SEQ ID NO: 3939984 - RNA, 12 nt, Human adenovirus F
cauuaaaaacuu

SEQ ID NO: 3939985 - RNA, 21 nt, Human adenovirus F
cauuaauaguggcacagcaaa

SEQ ID NO: 3939986 - RNA, 22 nt, Human adenovirus F
cauuacuucacguuacuuaggc

SEQ ID NO: 3939987 - RNA, 22 nt, Human adenovirus F
cauucugagacaaaagcccggg

SEQ ID NO: 3939988 - RNA, 18 nt, Human adenovirus F
cauugguccagcaaaggc

SEQ ID NO: 3939989 - RNA, 18 nt, Human adenovirus F
cauuuaugcccaacagua

SEQ ID NO: 3939990 - RNA, 17 nt, Human adenovirus F
ccaaaacuuucaacaaa

SEQ ID NO: 3939991 - RNA, 21 nt, Human adenovirus F
ccaaagcagagcucugcaaaa

SEQ ID NO: 3939992 - RNA, 18 nt, Human adenovirus F
ccaaaguaucuugcaaaa

SEQ ID NO: 3939993 - RNA, 22 nt, Human adenovirus F
ccaaagucccccuuacagccug

SEQ ID NO: 3939994 - RNA, 19 nt, Human adenovirus F
ccaaaucaaucagcggcug

SEQ ID NO: 3939995 - RNA, 21 nt, Human adenovirus F
ccaacgggcggcaaacuuucu

SEQ ID NO: 3939996 - RNA, 18 nt, Human adenovirus F
ccaacgugcaggccaacc

SEQ ID NO: 3939997 - RNA, 18 nt, Human adenovirus F
ccaaucguagcaggguuu

SEQ ID NO: 3939998 - RNA, 13 nt, Human adenovirus F
ccacaacaacaaa

SEQ ID NO: 3939999 - RNA, 17 nt, Human adenovirus F
ccacaccugggaaaacc

SEQ ID NO: 3940000 - RNA, 17 nt, Human adenovirus F
ccacaguccuucugcca

SEQ ID NO: 3940001 - RNA, 18 nt, Human adenovirus F
ccaccgccgcaccacuga

SEQ ID NO: 3940002 - RNA, 19 nt, Human adenovirus F
ccaccuuggaagcaaugcu

SEQ ID NO: 3940003 - RNA, 20 nt, Human adenovirus F
ccacggaugugaccuguggg

SEQ ID NO: 3940004 - RNA, 16 nt, Human adenovirus F
ccacuuaccagagcca

SEQ ID NO: 3940005 - RNA, 18 nt, Human adenovirus F
ccagaguaacuuuugcca

SEQ ID NO: 3940006 - RNA, 16 nt, Human adenovirus F
ccagcauggcucagcc

SEQ ID NO: 3940007 - RNA, 21 nt, Human adenovirus F
ccagccccgguugugcagugu

SEQ ID NO: 3940008 - RNA, 19 nt, Human adenovirus F
ccagccuccgguggcucug

SEQ ID NO: 3940009 - RNA, 15 nt, Human adenovirus F
ccagcgcccgggccc

SEQ ID NO: 3940010 - RNA, 15 nt, Human adenovirus F
ccaguccgggccaga

SEQ ID NO: 3940011 - RNA, 16 nt, Human adenovirus F
ccaguccgggccagac

SEQ ID NO: 3940012 - RNA, 20 nt, Human adenovirus F
ccagucgcaugaauuggcuu

SEQ ID NO: 3940013 - RNA, 17 nt, Human adenovirus F
ccaguggccgcacucag

SEQ ID NO: 3940014 - RNA, 20 nt, Human adenovirus F
ccauauuauuuaaauaaaac

SEQ ID NO: 3940015 - RNA, 20 nt, Human adenovirus F
ccauccaucacgccaacgcc

SEQ ID NO: 3940016 - RNA, 18 nt, Human adenovirus F
ccaugcgccgagcggcug

SEQ ID NO: 3940017 - RNA, 11 nt, Human adenovirus F
ccauggagcua

SEQ ID NO: 3940018 - RNA, 10 nt, Human adenovirus F
ccauuuccaa

SEQ ID NO: 3940019 - RNA, 23 nt, Human adenovirus F
cccaacuauuugggaggggagga

SEQ ID NO: 3940020 - RNA, 23 nt, Human adenovirus F
cccaaguaaucgguaccuuugag

SEQ ID NO: 3940021 - RNA, 21 nt, Human adenovirus F
cccaccgaguuccugcgcugc

SEQ ID NO: 3940022 - RNA, 22 nt, Human adenovirus F
cccaccggcuccugugcagcgc

SEQ ID NO: 3940023 - RNA, 23 nt, Human adenovirus F
cccacgccuuacauguggagcua

SEQ ID NO: 3940024 - RNA, 15 nt, Human adenovirus F
cccagauuuccuggu

SEQ ID NO: 3940025 - RNA, 18 nt, Human adenovirus F
cccagcacuuggauuaca

SEQ ID NO: 3940026 - RNA, 12 nt, Human adenovirus F
cccagccgcacu

SEQ ID NO: 3940027 - RNA, 15 nt, Human adenovirus F
cccagcugguaagca

SEQ ID NO: 3940028 - RNA, 22 nt, Human adenovirus F
cccagcugugguuaaauuuaau

SEQ ID NO: 3940029 - RNA, 17 nt, Human adenovirus F
cccaggaucccucagag

SEQ ID NO: 3940030 - RNA, 19 nt, Human adenovirus F
cccaucaucgccgccgcca

SEQ ID NO: 3940031 - RNA, 14 nt, Human adenovirus F
auuaaguugggagg

SEQ ID NO: 3940032 - RNA, 23 nt, Human adenovirus F
auuaauaaagcuuaccuuaaauu

SEQ ID NO: 3940033 - RNA, 14 nt, Human adenovirus F
auuaauuacagcau

SEQ ID NO: 3940034 - RNA, 17 nt, Human adenovirus F
auuacauggcaauggcu

SEQ ID NO: 3940035 - RNA, 21 nt, Human adenovirus F
auuacuccagucgcaugaauu

SEQ ID NO: 3940036 - RNA, 14 nt, Human adenovirus F
auuaugagcaaaga

SEQ ID NO: 3940037 - RNA, 17 nt, Human adenovirus F
auucccuuuuccagcaa

SEQ ID NO: 3940038 - RNA, 13 nt, Human adenovirus F
auucugaagagga

SEQ ID NO: 3940039 - RNA, 19 nt, Human adenovirus F
auucuucaguugaaccacg

SEQ ID NO: 3940040 - RNA, 11 nt, Human adenovirus F
auugacgccga

SEQ ID NO: 3940041 - RNA, 13 nt, Human adenovirus F
auugccacccgcc

SEQ ID NO: 3940042 - RNA, 15 nt, Human adenovirus F
auuggucaaaaacuc

SEQ ID NO: 3940043 - RNA, 17 nt, Human adenovirus F
auugugguacaggagcg

SEQ ID NO: 3940044 - RNA, 20 nt, Human adenovirus F
auuuaauggcacaguguuug

SEQ ID NO: 3940045 - RNA, 17 nt, Human adenovirus F
auuuaugcccaacagua

SEQ ID NO: 3940046 - RNA, 15 nt, Human adenovirus F
auuuauuucuuuugc

SEQ ID NO: 3940047 - RNA, 16 nt, Human adenovirus F
auuucacgcaaagucg

SEQ ID NO: 3940048 - RNA, 15 nt, Human adenovirus F
auuuggagggcggca

SEQ ID NO: 3940049 - RNA, 20 nt, Human adenovirus F
auuugguaacaaggccugga

SEQ ID NO: 3940050 - RNA, 23 nt, Human adenovirus F
auuugguaacaaggccuggaaca

SEQ ID NO: 3940051 - RNA, 19 nt, Human adenovirus F
auuuggucagaaaauacaa

SEQ ID NO: 3940052 - RNA, 19 nt, Human adenovirus F
auuuuaauuuucaaucuug

SEQ ID NO: 3940053 - RNA, 16 nt, Human adenovirus F
auuuuccaugcacuca

SEQ ID NO: 3940054 - RNA, 17 nt, Human adenovirus F
caaaaacucugugaagu

SEQ ID NO: 3940055 - RNA, 22 nt, Human adenovirus F
caaacauuaaacgucaaugcca

SEQ ID NO: 3940056 - RNA, 18 nt, Human adenovirus F
caaacauuaagcugcaau

SEQ ID NO: 3940057 - RNA, 15 nt, Human adenovirus F
caaacccagccgcac

SEQ ID NO: 3940058 - RNA, 20 nt, Human adenovirus F
caaagcacacagaacaaaac

SEQ ID NO: 3940059 - RNA, 21 nt, Human adenovirus F
caaaucucgccuaacaucacc

SEQ ID NO: 3940060 - RNA, 16 nt, Human adenovirus F
caacaaaaauacauau

SEQ ID NO: 3940061 - RNA, 22 nt, Human adenovirus F
caacaaaaucaggaacuguuca

SEQ ID NO: 3940062 - RNA, 13 nt, Human adenovirus F
caacaaccuaccc

SEQ ID NO: 3940063 - RNA, 14 nt, Human adenovirus F
caacccgaccuaaa

SEQ ID NO: 3940064 - RNA, 23 nt, Human adenovirus F
caacccugaggaggaggccaucc

SEQ ID NO: 3940065 - RNA, 17 nt, Human adenovirus F
caaccgcacaugccagc

SEQ ID NO: 3940066 - RNA, 12 nt, Human adenovirus F
caacgcaguggu

SEQ ID NO: 3940067 - RNA, 16 nt, Human adenovirus F
caacgcagugguggac

SEQ ID NO: 3940068 - RNA, 17 nt, Human adenovirus F
caacuuuugcaccaggg

SEQ ID NO: 3940069 - RNA, 23 nt, Human adenovirus F
caagcccaauccucaagacuugg

SEQ ID NO: 3940070 - RNA, 18 nt, Human adenovirus F
caagcccauucugccagu

SEQ ID NO: 3940071 - RNA, 18 nt, Human adenovirus F
caagcggguuaaaaagcg

SEQ ID NO: 3940072 - RNA, 14 nt, Human adenovirus F
caagcuucucagcu

SEQ ID NO: 3940073 - RNA, 16 nt, Human adenovirus F
caaggaaugcacacag

SEQ ID NO: 3940074 - RNA, 21 nt, Human adenovirus F
caaggaugaggcgggacugau

SEQ ID NO: 3940075 - RNA, 19 nt, Human adenovirus F
caaggcguaaagacugaca

SEQ ID NO: 3940076 - RNA, 22 nt, Human adenovirus F
caaguauacauuugaacagcug

SEQ ID NO: 3940077 - RNA, 19 nt, Human adenovirus F
caagugucccacugcaacu

SEQ ID NO: 3940078 - RNA, 18 nt, Human adenovirus F
caauagcauacagaagac

SEQ ID NO: 3940079 - RNA, 15 nt, Human adenovirus F
caaucccagcagaaa

SEQ ID NO: 3940080 - RNA, 16 nt, Human adenovirus F
caauccuaacaaaaac

SEQ ID NO: 3940081 - RNA, 17 nt, Human adenovirus F
caaucgaccuaauuaca

SEQ ID NO: 3940082 - RNA, 20 nt, Human adenovirus F
caaucucuucguccuggagu

SEQ ID NO: 3940083 - RNA, 18 nt, Human adenovirus F
caauggaacgcaguguuu

SEQ ID NO: 3940084 - RNA, 13 nt, Human adenovirus F
caauggcagccca

SEQ ID NO: 3940085 - RNA, 18 nt, Human adenovirus F
caauggcagcccagcgcc

SEQ ID NO: 3940086 - RNA, 16 nt, Human adenovirus F
caauuccacuggcaac

SEQ ID NO: 3940087 - RNA, 15 nt, Human adenovirus F
caauucucucuccuu

SEQ ID NO: 3940088 - RNA, 13 nt, Human adenovirus F
cacaaaaacucca

SEQ ID NO: 3940089 - RNA, 21 nt, Human adenovirus F
cacaaagcugugagcgccagc

SEQ ID NO: 3940090 - RNA, 16 nt, Human adenovirus F
cacaaaguccuggcca

SEQ ID NO: 3940091 - RNA, 23 nt, Human adenovirus F
cacaaaguccuggccaacugcca

SEQ ID NO: 3940092 - RNA, 13 nt, Human adenovirus F
cacaauaagcagc

SEQ ID NO: 3940093 - RNA, 13 nt, Human adenovirus F
cacacaucacugu

SEQ ID NO: 3940094 - RNA, 13 nt, Human adenovirus F
cacagaucacgga

SEQ ID NO: 3940095 - RNA, 13 nt, Human adenovirus F
cacaggaagaggg

SEQ ID NO: 3940096 - RNA, 18 nt, Human adenovirus F
cacaggagauccguggag

SEQ ID NO: 3940097 - RNA, 20 nt, Human adenovirus F
cacaguguuugcuucuacca

SEQ ID NO: 3940098 - RNA, 18 nt, Human adenovirus F
cacauaagaagccagcca

SEQ ID NO: 3940099 - RNA, 17 nt, Human adenovirus F
cacauaucgucacuucc

SEQ ID NO: 3940100 - RNA, 23 nt, Human adenovirus F
cacauaucgucacuuccgccgca

SEQ ID NO: 3940101 - RNA, 16 nt, Human adenovirus F
cacauccagggcacag

SEQ ID NO: 3940102 - RNA, 18 nt, Human adenovirus F
cacauuggcuggaggcuu

SEQ ID NO: 3940103 - RNA, 22 nt, Human adenovirus F
caccaacgugcaggccaaccua

SEQ ID NO: 3940104 - RNA, 14 nt, Human adenovirus F
caccaacugcucuu

SEQ ID NO: 3940105 - RNA, 18 nt, Human adenovirus F
caccaauaugcccaacau

SEQ ID NO: 3940106 - RNA, 20 nt, Human adenovirus F
caccacauaagaagccagcc

SEQ ID NO: 3940107 - RNA, 13 nt, Human adenovirus F
caccagaugaugu

SEQ ID NO: 3940108 - RNA, 22 nt, Human adenovirus F
caccagcgugagucgggcucuu

SEQ ID NO: 3940109 - RNA, 22 nt, Human adenovirus F
caccaggucguaaugaggacau

SEQ ID NO: 3940110 - RNA, 20 nt, Human adenovirus F
caccaguagcuuggaagcca

SEQ ID NO: 3940111 - RNA, 15 nt, Human adenovirus F
cacccaaagccaaau

SEQ ID NO: 3940112 - RNA, 17 nt, Human adenovirus F
caccccuagucccuccu

SEQ ID NO: 3940113 - RNA, 23 nt, Human adenovirus F
caccccucuccgugcaaaacaau

SEQ ID NO: 3940114 - RNA, 13 nt, Human adenovirus F
cacccgcagcugc

SEQ ID NO: 3940115 - RNA, 19 nt, Human adenovirus F
cacccuauggaccaccgcg

SEQ ID NO: 3940116 - RNA, 22 nt, Human adenovirus F
caccgcaaugcuggucugcgcu

SEQ ID NO: 3940117 - RNA, 19 nt, Human adenovirus F
caccgccaagagcgccgcu

SEQ ID NO: 3940118 - RNA, 21 nt, Human adenovirus F
caccguuccgcccaugccggc

SEQ ID NO: 3940119 - RNA, 14 nt, Human adenovirus F
caccuacucuggcu

SEQ ID NO: 3940120 - RNA, 16 nt, Human adenovirus F
caccuacucuggcucc

SEQ ID NO: 3940121 - RNA, 23 nt, Human adenovirus F
caccuacuuugacauccgcggcg

SEQ ID NO: 3940122 - RNA, 13 nt, Human adenovirus F
caccuccucaacu

SEQ ID NO: 3940123 - RNA, 14 nt, Human adenovirus F
caccucgcucacau

SEQ ID NO: 3940124 - RNA, 16 nt, Human adenovirus F
caccuuacaccacccc

SEQ ID NO: 3940125 - RNA, 20 nt, Human adenovirus F
caccuuguguuuaagccaga

SEQ ID NO: 3940126 - RNA, 16 nt, Human adenovirus F
cacgcugacccuuccc

SEQ ID NO: 3940127 - RNA, 17 nt, Human adenovirus F
cacgcuguaccaggagg

SEQ ID NO: 3940128 - RNA, 17 nt, Human adenovirus F
cacggggucuauuugga

SEQ ID NO: 3940129 - RNA, 16 nt, Human adenovirus F
cacggguucucgccuc

SEQ ID NO: 3940130 - RNA, 22 nt, Human adenovirus F
cacgucauccgccuccacccuu

SEQ ID NO: 3940131 - RNA, 15 nt, Human adenovirus F
cacuccucgccaggc

SEQ ID NO: 3940132 - RNA, 13 nt, Human adenovirus F
cacugauccacuu

SEQ ID NO: 3940133 - RNA, 22 nt, Human adenovirus F
cacugauccacuuacaaccaaa

SEQ ID NO: 3940134 - RNA, 21 nt, Human adenovirus F
cacugccguugcaaccucugc

SEQ ID NO: 3940135 - RNA, 14 nt, Human adenovirus F
cacuuacaaccaaa

SEQ ID NO: 3940136 - RNA, 15 nt, Human adenovirus F
cacuuacaaccaaaa

SEQ ID NO: 3940137 - RNA, 23 nt, Human adenovirus F
cacuuuacuuaaacccacagcua

SEQ ID NO: 3940138 - RNA, 14 nt, Human adenovirus F
cacuuugccagagg

SEQ ID NO: 3940139 - RNA, 19 nt, Human adenovirus F
cagacgaacacaauauuua

SEQ ID NO: 3940140 - RNA, 17 nt, Human adenovirus F
cagacgucucaagcaac

SEQ ID NO: 3940141 - RNA, 18 nt, Human adenovirus F
cagagccauagcaacagc

SEQ ID NO: 3940142 - RNA, 23 nt, Human adenovirus F
cagaggaaguuucagacgaggag

SEQ ID NO: 3940143 - RNA, 19 nt, Human adenovirus F
cagaggccgguacccagac

SEQ ID NO: 3940144 - RNA, 18 nt, Human adenovirus F
cagauccuucccgugaca

SEQ ID NO: 3940145 - RNA, 16 nt, Human adenovirus F
cagcaggccgcuccca

SEQ ID NO: 3940146 - RNA, 17 nt, Human adenovirus F
cagcaguccgucagcuu

SEQ ID NO: 3940147 - RNA, 19 nt, Human adenovirus F
cagcaguccgucagcuugu

SEQ ID NO: 3940148 - RNA, 21 nt, Human adenovirus F
cagcaguuuugguuacagugg

SEQ ID NO: 3940149 - RNA, 15 nt, Human adenovirus F
agcgucagguuugac

SEQ ID NO: 3940150 - RNA, 14 nt, Human adenovirus F
agcgugagucgggc

SEQ ID NO: 3940151 - RNA, 14 nt, Human adenovirus F
agcuaucagccgca

SEQ ID NO: 3940152 - RNA, 18 nt, Human adenovirus F
agcucccuauauaggaca

SEQ ID NO: 3940153 - RNA, 20 nt, Human adenovirus F
agcuccucagcccguggaga

SEQ ID NO: 3940154 - RNA, 17 nt, Human adenovirus F
agcucuucaucccagcc

SEQ ID NO: 3940155 - RNA, 19 nt, Human adenovirus F
agcugcuaaccugugcaga

SEQ ID NO: 3940156 - RNA, 18 nt, Human adenovirus F
agcugggacagcggaggc

SEQ ID NO: 3940157 - RNA, 14 nt, Human adenovirus F
agcuucccaacacu

SEQ ID NO: 3940158 - RNA, 15 nt, Human adenovirus F
agcuugcccuuggaa

SEQ ID NO: 3940159 - RNA, 20 nt, Human adenovirus F
aggagcagauggagagcugg

SEQ ID NO: 3940160 - RNA, 21 nt, Human adenovirus F
aggagcugucucagcaguugc

SEQ ID NO: 3940161 - RNA, 17 nt, Human adenovirus F
aggaggaggagaaccug

SEQ ID NO: 3940162 - RNA, 13 nt, Human adenovirus F
aggaggaggccau

SEQ ID NO: 3940163 - RNA, 13 nt, Human adenovirus F
aggaggcggagga

SEQ ID NO: 3940164 - RNA, 15 nt, Human adenovirus F
aggagguacuccucg

SEQ ID NO: 3940165 - RNA, 16 nt, Human adenovirus F
aggauacaacguggcu

SEQ ID NO: 3940166 - RNA, 16 nt, Human adenovirus F
aggauccauagagggc

SEQ ID NO: 3940167 - RNA, 18 nt, Human adenovirus F
aggaucccucagagcugc

SEQ ID NO: 3940168 - RNA, 19 nt, Human adenovirus F
aggauuuacacaacgauuc

SEQ ID NO: 3940169 - RNA, 12 nt, Human adenovirus F
aggcaaagcaac

SEQ ID NO: 3940170 - RNA, 16 nt, Human adenovirus F
aggcagcagccccagg

SEQ ID NO: 3940171 - RNA, 14 nt, Human adenovirus F
aggccagucggcag

SEQ ID NO: 3940172 - RNA, 17 nt, Human adenovirus F
aggccauccuggaccug

SEQ ID NO: 3940173 - RNA, 19 nt, Human adenovirus F
aggccauccuggaccugga

SEQ ID NO: 3940174 - RNA, 16 nt, Human adenovirus F
aggcgauagucggugc

SEQ ID NO: 3940175 - RNA, 14 nt, Human adenovirus F
aggcggaaaccaag

SEQ ID NO: 3940176 - RNA, 20 nt, Human adenovirus F
aggcguggaaaaacuuggaa

SEQ ID NO: 3940177 - RNA, 14 nt, Human adenovirus F
agggaaggcgugga

SEQ ID NO: 3940178 - RNA, 17 nt, Human adenovirus F
agggaggcagcagagga

SEQ ID NO: 3940179 - RNA, 23 nt, Human adenovirus F
agggaucgcagcgggcaggagcc

SEQ ID NO: 3940180 - RNA, 18 nt, Human adenovirus F
agggcaaaaugggcuugc

SEQ ID NO: 3940181 - RNA, 17 nt, Human adenovirus F
agggcaacguucagcca

SEQ ID NO: 3940182 - RNA, 22 nt, Human adenovirus F
agggcaacguucagccacuccu

SEQ ID NO: 3940183 - RNA, 22 nt, Human adenovirus F
agggggaggacuuuuuaaagga

SEQ ID NO: 3940184 - RNA, 18 nt, Human adenovirus F
agggugcccgacuggggu

SEQ ID NO: 3940185 - RNA, 14 nt, Human adenovirus F
agggugugaaggca

SEQ ID NO: 3940186 - RNA, 18 nt, Human adenovirus F
agggugugaaggcaaagg

SEQ ID NO: 3940187 - RNA, 21 nt, Human adenovirus F
agguacagcccaacaccacca

SEQ ID NO: 3940188 - RNA, 14 nt, Human adenovirus F
agguccacacuggu

SEQ ID NO: 3940189 - RNA, 18 nt, Human adenovirus F
agguccgaccgcuggggu

SEQ ID NO: 3940190 - RNA, 17 nt, Human adenovirus F
aggucguaaugaggaca

SEQ ID NO: 3940191 - RNA, 23 nt, Human adenovirus F
aggugaugcugcugaugaggaaa

SEQ ID NO: 3940192 - RNA, 14 nt, Human adenovirus F
agguggggcggcga

SEQ ID NO: 3940193 - RNA, 19 nt, Human adenovirus F
agguucguugucgccccug

SEQ ID NO: 3940194 - RNA, 15 nt, Human adenovirus F
agguuuccaaaucau

SEQ ID NO: 3940195 - RNA, 19 nt, Human adenovirus F
aguagcucuuccaagcugc

SEQ ID NO: 3940196 - RNA, 15 nt, Human adenovirus F
agucauccaaaucau

SEQ ID NO: 3940197 - RNA, 21 nt, Human adenovirus F
aguccaaagcagagcucugca

SEQ ID NO: 3940198 - RNA, 13 nt, Human adenovirus F
aguccacaaaaac

SEQ ID NO: 3940199 - RNA, 17 nt, Human adenovirus F
agucccccuuacagccu

SEQ ID NO: 3940200 - RNA, 19 nt, Human adenovirus F
aguccuggccaacugccac

SEQ ID NO: 3940201 - RNA, 12 nt, Human adenovirus F
agucgaggaggu

SEQ ID NO: 3940202 - RNA, 14 nt, Human adenovirus F
agucuaagccuggc

SEQ ID NO: 3940203 - RNA, 18 nt, Human adenovirus F
agugacacgucaccgcca

SEQ ID NO: 3940204 - RNA, 14 nt, Human adenovirus F
agugcaggaagagg

SEQ ID NO: 3940205 - RNA, 17 nt, Human adenovirus F
agugccgccggugaugg

SEQ ID NO: 3940206 - RNA, 19 nt, Human adenovirus F
agugcggauuugggaacug

SEQ ID NO: 3940207 - RNA, 15 nt, Human adenovirus F
agugcuggccgggca

SEQ ID NO: 3940208 - RNA, 16 nt, Human adenovirus F
agugucgcgcaccaua

SEQ ID NO: 3940209 - RNA, 18 nt, Human adenovirus F
aguuagcucugaacacuu

SEQ ID NO: 3940210 - RNA, 14 nt, Human adenovirus F
aguuccucuucucu

SEQ ID NO: 3940211 - RNA, 17 nt, Human adenovirus F
aguugagcgugguggca

SEQ ID NO: 3940212 - RNA, 14 nt, Human adenovirus F
aguugguagcagug

SEQ ID NO: 3940213 - RNA, 17 nt, Human adenovirus F
auaaaauauuguuauuu

SEQ ID NO: 3940214 - RNA, 23 nt, Human adenovirus F
auaacgcuuuaucuguaaaacuu

SEQ ID NO: 3940215 - RNA, 21 nt, Human adenovirus F
auaacuuucuuacacuagcca

SEQ ID NO: 3940216 - RNA, 11 nt, Human adenovirus F
auaagcugggu

SEQ ID NO: 3940217 - RNA, 12 nt, Human adenovirus F
auacacucccuu

SEQ ID NO: 3940218 - RNA, 16 nt, Human adenovirus F
auaccgcugcagcugc

SEQ ID NO: 3940219 - RNA, 20 nt, Human adenovirus F
auacuucuccauguggaacc

SEQ ID NO: 3940220 - RNA, 22 nt, Human adenovirus F
auacuuuuucccaaaaaaagaa

SEQ ID NO: 3940221 - RNA, 15 nt, Human adenovirus F
auagccaaccaggcc

SEQ ID NO: 3940222 - RNA, 20 nt, Human adenovirus F
auagccggugcacuugggga

SEQ ID NO: 3940223 - RNA, 21 nt, Human adenovirus F
auaggcauuaggccgucccug

SEQ ID NO: 3940224 - RNA, 15 nt, Human adenovirus F
auauuggcuaccagg

SEQ ID NO: 3940225 - RNA, 18 nt, Human adenovirus F
aucacccaaagccaaauu

SEQ ID NO: 3940226 - RNA, 17 nt, Human adenovirus F
aucacgcccaccaaauu

SEQ ID NO: 3940227 - RNA, 16 nt, Human adenovirus F
aucaggaacuguucaa

SEQ ID NO: 3940228 - RNA, 19 nt, Human adenovirus F
aucauguccaccugagggg

SEQ ID NO: 3940229 - RNA, 17 nt, Human adenovirus F
auccagcaacucugaac

SEQ ID NO: 3940230 - RNA, 18 nt, Human adenovirus F
auccaucacgccaacgcc

SEQ ID NO: 3940231 - RNA, 21 nt, Human adenovirus F
aucccaaguggcccuuaaugc

SEQ ID NO: 3940232 - RNA, 16 nt, Human adenovirus F
auccccgccgccccug

SEQ ID NO: 3940233 - RNA, 23 nt, Human adenovirus F
auccgccuccacccuuucccacc

SEQ ID NO: 3940234 - RNA, 13 nt, Human adenovirus F
auccguggagccg

SEQ ID NO: 3940235 - RNA, 19 nt, Human adenovirus F
auccuccuucacaaagucc

SEQ ID NO: 3940236 - RNA, 23 nt, Human adenovirus F
auccuucccgugacagaaaucaa

SEQ ID NO: 3940237 - RNA, 15 nt, Human adenovirus F
aucgacguucucucc

SEQ ID NO: 3940238 - RNA, 19 nt, Human adenovirus F
aucgaggccgucuaccugc

SEQ ID NO: 3940239 - RNA, 23 nt, Human adenovirus F
aucgcuggacuuuacaaaaagag

SEQ ID NO: 3940240 - RNA, 15 nt, Human adenovirus F
aucggcaccagccag

SEQ ID NO: 3940241 - RNA, 16 nt, Human adenovirus F
aucucauucgcacggc

SEQ ID NO: 3940242 - RNA, 17 nt, Human adenovirus F
aucucauucgcacggcg

SEQ ID NO: 3940243 - RNA, 22 nt, Human adenovirus F
aucuccugcacgucgccagagu

SEQ ID NO: 3940244 - RNA, 23 nt, Human adenovirus F
aucuucaaacauuaagcugcaau

SEQ ID NO: 3940245 - RNA, 19 nt, Human adenovirus F
augagggauucuaagggag

SEQ ID NO: 3940246 - RNA, 19 nt, Human adenovirus F
augcaacuuggaagggaag

SEQ ID NO: 3940247 - RNA, 21 nt, Human adenovirus F
augcagcgcugccuuugcaau

SEQ ID NO: 3940248 - RNA, 14 nt, Human adenovirus F
augccuacaugaac

SEQ ID NO: 3940249 - RNA, 12 nt, Human adenovirus F
augccuagcucu

SEQ ID NO: 3940250 - RNA, 19 nt, Human adenovirus F
augcuacacaacaaaucau

SEQ ID NO: 3940251 - RNA, 15 nt, Human adenovirus F
augcuuuaccccaua

SEQ ID NO: 3940252 - RNA, 14 nt, Human adenovirus F
auggaacuaacugg

SEQ ID NO: 3940253 - RNA, 21 nt, Human adenovirus F
auggcagcccagcgcccgggc

SEQ ID NO: 3940254 - RNA, 15 nt, Human adenovirus F
auggcccgaccugua

SEQ ID NO: 3940255 - RNA, 16 nt, Human adenovirus F
augggcaccuggaacg

SEQ ID NO: 3940256 - RNA, 22 nt, Human adenovirus F
auggggguaccaacuugcaaaa

SEQ ID NO: 3940257 - RNA, 16 nt, Human adenovirus F
auggguuacuuucggc

SEQ ID NO: 3940258 - RNA, 18 nt, Human adenovirus F
augguaaaaaugccaggc

SEQ ID NO: 3940259 - RNA, 23 nt, Human adenovirus F
augguucuuucuccccaucgccg

SEQ ID NO: 3940260 - RNA, 13 nt, Human adenovirus F
auguaaaguucua

SEQ ID NO: 3940261 - RNA, 23 nt, Human adenovirus F
auguaacgccccccgaggacggc

SEQ ID NO: 3940262 - RNA, 17 nt, Human adenovirus F
auguccaccugaggggc

SEQ ID NO: 3940263 - RNA, 23 nt, Human adenovirus F
augugccgcgcgggcaggaggac

SEQ ID NO: 3940264 - RNA, 13 nt, Human adenovirus F
augugcucgcaaa

SEQ ID NO: 3940265 - RNA, 20 nt, Human adenovirus F
augugucuccgcugggagaa

SEQ ID NO: 3940266 - RNA, 20 nt, Human adenovirus F
auguguguuuuuuacugcua

SEQ ID NO: 3940267 - RNA, 14 nt, Human adenovirus F
auguuauugacauu

SEQ ID NO: 3940268 - RNA, 14 nt, Human adenovirus F
guucgccuggagag

SEQ ID NO: 3940269 - RNA, 12 nt, Human adenovirus F
guucggagccaa

SEQ ID NO: 3940270 - RNA, 15 nt, Human adenovirus F
guucguugucgcccc

SEQ ID NO: 3940271 - RNA, 15 nt, Human adenovirus F
guucuccguguccug

SEQ ID NO: 3940272 - RNA, 16 nt, Human adenovirus F
guugcauuauggccau

SEQ ID NO: 3940273 - RNA, 18 nt, Human adenovirus F
guugcccgccagcuggca

SEQ ID NO: 3940274 - RNA, 21 nt, Human adenovirus F
guugcguagacgcuggaagag

SEQ ID NO: 3940275 - RNA, 17 nt, Human adenovirus F
guuggcuucugccagaa

SEQ ID NO: 3940276 - RNA, 13 nt, Human adenovirus F
guugggagggaug

SEQ ID NO: 3940277 - RNA, 16 nt, Human adenovirus F
guuuguggguauauaa

SEQ ID NO: 3940278 - RNA, 14 nt, Human adenovirus F
guuuuaauggaaac

SEQ ID NO: 3940279 - RNA, 18 nt, Human adenovirus F
uaaaaacaaccaacuuca

SEQ ID NO: 3940280 - RNA, 14 nt, Human adenovirus F
uaaaaucaacauua

SEQ ID NO: 3940281 - RNA, 22 nt, Human adenovirus F
uaaacuccucuuccuccacagc

SEQ ID NO: 3940282 - RNA, 22 nt, Human adenovirus F
uaaagcucaaaaaggcacuuua

SEQ ID NO: 3940283 - RNA, 20 nt, Human adenovirus F
uaaagguguuaacgcugagu

SEQ ID NO: 3940284 - RNA, 19 nt, Human adenovirus F
uaacacaggucaaaugcuc

SEQ ID NO: 3940285 - RNA, 14 nt, Human adenovirus F
uaacagcuccucag

SEQ ID NO: 3940286 - RNA, 16 nt, Human adenovirus F
uaaccacuaccacccu

SEQ ID NO: 3940287 - RNA, 14 nt, Human adenovirus F
uaacccgccuuuuc

SEQ ID NO: 3940288 - RNA, 18 nt, Human adenovirus F
uaacccucaaacacugcg

SEQ ID NO: 3940289 - RNA, 18 nt, Human adenovirus F
uaacccuggaauuuuugc

SEQ ID NO: 3940290 - RNA, 12 nt, Human adenovirus F
uaacgccccccg

SEQ ID NO: 3940291 - RNA, 21 nt, Human adenovirus F
uaacggugaagcuucccaaca

SEQ ID NO: 3940292 - RNA, 14 nt, Human adenovirus F
uaacucucuuacau

SEQ ID NO: 3940293 - RNA, 14 nt, Human adenovirus F
uaacuuucuuacac

SEQ ID NO: 3940294 - RNA, 14 nt, Human adenovirus F
uaacuuuugccaca

SEQ ID NO: 3940295 - RNA, 17 nt, Human adenovirus F
uaagcagcuugaagaac

SEQ ID NO: 3940296 - RNA, 13 nt, Human adenovirus F
uaagcugcagcca

SEQ ID NO: 3940297 - RNA, 20 nt, Human adenovirus F
uaauggagcuauuacuuuag

SEQ ID NO: 3940298 - RNA, 18 nt, Human adenovirus F
uaauuccauaacuaaaaa

SEQ ID NO: 3940299 - RNA, 17 nt, Human adenovirus F
uacaaacaguaacaacu

SEQ ID NO: 3940300 - RNA, 19 nt, Human adenovirus F
uacaagcuauucagcaggc

SEQ ID NO: 3940301 - RNA, 14 nt, Human adenovirus F
uacacaacaaauca

SEQ ID NO: 3940302 - RNA, 14 nt, Human adenovirus F
uacacaccaaacuc

SEQ ID NO: 3940303 - RNA, 16 nt, Human adenovirus F
uacagcccccaccgcc

SEQ ID NO: 3940304 - RNA, 16 nt, Human adenovirus F
uaccaaagacaaaauc

SEQ ID NO: 3940305 - RNA, 19 nt, Human adenovirus F
uaccaaagacaaaaucacu

SEQ ID NO: 3940306 - RNA, 21 nt, Human adenovirus F
uaccaaagacaaaaucacugu

SEQ ID NO: 3940307 - RNA, 17 nt, Human adenovirus F
uaccaaucacggcuucc

SEQ ID NO: 3940308 - RNA, 17 nt, Human adenovirus F
uaccacagaaaugucca

SEQ ID NO: 3940309 - RNA, 16 nt, Human adenovirus F
uaccaccccagcacuu

SEQ ID NO: 3940310 - RNA, 18 nt, Human adenovirus F
uaccagaguaacuuuugc

SEQ ID NO: 3940311 - RNA, 23 nt, Human adenovirus F
uaccaggaggcuauuggccagac

SEQ ID NO: 3940312 - RNA, 21 nt, Human adenovirus F
uacgacuccacguaggcucuc

SEQ ID NO: 3940313 - RNA, 14 nt, Human adenovirus F
uacgcccaggagca

SEQ ID NO: 3940314 - RNA, 20 nt, Human adenovirus F
uacgccgaggguccuccucc

SEQ ID NO: 3940315 - RNA, 17 nt, Human adenovirus F
uacgccuccaccaccuu

SEQ ID NO: 3940316 - RNA, 20 nt, Human adenovirus F
uacggcggcgccaaacggcg

SEQ ID NO: 3940317 - RNA, 14 nt, Human adenovirus F
uacguaccgccuca

SEQ ID NO: 3940318 - RNA, 22 nt, Human adenovirus F
uacugggacagcaggccgcucc

SEQ ID NO: 3940319 - RNA, 13 nt, Human adenovirus F
uacuuuaaacaag

SEQ ID NO: 3940320 - RNA, 14 nt, Human adenovirus F
uagccaaccaggcc

SEQ ID NO: 3940321 - RNA, 22 nt, Human adenovirus F
uagccaacuauuuggcccacca

SEQ ID NO: 3940322 - RNA, 22 nt, Human adenovirus F
uagcuacuuucaucuuaacucu

SEQ ID NO: 3940323 - RNA, 23 nt, Human adenovirus F
uagcucuaaauaugucacagccu

SEQ ID NO: 3940324 - RNA, 18 nt, Human adenovirus F
uaggacgucagaacggcg

SEQ ID NO: 3940325 - RNA, 20 nt, Human adenovirus F
uagggcguagaguuugggag

SEQ ID NO: 3940326 - RNA, 17 nt, Human adenovirus F
uaggugacaaagaggcg

SEQ ID NO: 3940327 - RNA, 22 nt, Human adenovirus F
uagguggggccccugaggcagc

SEQ ID NO: 3940328 - RNA, 14 nt, Human adenovirus F
uaguaacuuucaaa

SEQ ID NO: 3940329 - RNA, 20 nt, Human adenovirus F
uaguuuaaggagaugcaacu

SEQ ID NO: 3940330 - RNA, 11 nt, Human adenovirus F
uauaagcaggu

SEQ ID NO: 3940331 - RNA, 21 nt, Human adenovirus F
uauaagcagguagaaugguuu

SEQ ID NO: 3940332 - RNA, 20 nt, Human adenovirus F
uauaaguauuacaaaugccu

SEQ ID NO: 3940333 - RNA, 17 nt, Human adenovirus F
uauacaccucccuuucc

SEQ ID NO: 3940334 - RNA, 20 nt, Human adenovirus F
uauaccauuaagaagacugu

SEQ ID NO: 3940335 - RNA, 15 nt, Human adenovirus F
uaucaggaagcagcu

SEQ ID NO: 3940336 - RNA, 20 nt, Human adenovirus F
uauccauuaaagcucaaaaa

SEQ ID NO: 3940337 - RNA, 23 nt, Human adenovirus F
uaugagcggaguaacacaaacau

SEQ ID NO: 3940338 - RNA, 12 nt, Human adenovirus F
uaugaugaguca

SEQ ID NO: 3940339 - RNA, 14 nt, Human adenovirus F
uaugggcagcaucc

SEQ ID NO: 3940340 - RNA, 16 nt, Human adenovirus F
uauuaaugcccacacc

SEQ ID NO: 3940341 - RNA, 19 nt, Human adenovirus F
uauuacaaaugccucccuu

SEQ ID NO: 3940342 - RNA, 22 nt, Human adenovirus F
uauucggcuugcauaaaagcuu

SEQ ID NO: 3940343 - RNA, 18 nt, Human adenovirus F
uauugcuuuauugccacc

SEQ ID NO: 3940344 - RNA, 21 nt, Human adenovirus F
uauugcuuuauugccaccgca

SEQ ID NO: 3940345 - RNA, 20 nt, Human adenovirus F
uauuuguauaaucuuaaaac

SEQ ID NO: 3940346 - RNA, 14 nt, Human adenovirus F
uauuuucaacuuua

SEQ ID NO: 3940347 - RNA, 18 nt, Human adenovirus F
ucaaaaaggcacuuuacu

SEQ ID NO: 3940348 - RNA, 22 nt, Human adenovirus F
ucaaaaguguuuauuuauuucu

SEQ ID NO: 3940349 - RNA, 22 nt, Human adenovirus F
ucaaaauugcagcgguaucugc

SEQ ID NO: 3940350 - RNA, 22 nt, Human adenovirus F
ucaaccaacuaacacugcgauu

SEQ ID NO: 3940351 - RNA, 21 nt, Human adenovirus F
ucaaccuucaagcccuacacc

SEQ ID NO: 3940352 - RNA, 13 nt, Human adenovirus F
ucaacgcaguggu

SEQ ID NO: 3940353 - RNA, 19 nt, Human adenovirus F
ucaagaaccaacgcauucc

SEQ ID NO: 3940354 - RNA, 22 nt, Human adenovirus F
ucaagcccuacaccaaugcaaa

SEQ ID NO: 3940355 - RNA, 15 nt, Human adenovirus F
ucaaggaaacaacag

SEQ ID NO: 3940356 - RNA, 19 nt, Human adenovirus F
ucaaucagcggcuggaaaa

SEQ ID NO: 3940357 - RNA, 20 nt, Human adenovirus F
ucacaccucuccccaccgcu

SEQ ID NO: 3940358 - RNA, 16 nt, Human adenovirus F
ucacccacccaccgcu

SEQ ID NO: 3940359 - RNA, 18 nt, Human adenovirus F
ucaccuuacaccaccccu

SEQ ID NO: 3940360 - RNA, 14 nt, Human adenovirus F
ucacgaccucccaa

SEQ ID NO: 3940361 - RNA, 15 nt, Human adenovirus F
ucacucucagcugcu

SEQ ID NO: 3940362 - RNA, 11 nt, Human adenovirus F
ucacuguuuuu

SEQ ID NO: 3940363 - RNA, 15 nt, Human adenovirus F
ucacuuugccagagg

SEQ ID NO: 3940364 - RNA, 14 nt, Human adenovirus F
ucagaccacaacaa

SEQ ID NO: 3940365 - RNA, 21 nt, Human adenovirus F
ucagagcucuucaucccagcc

SEQ ID NO: 3940366 - RNA, 15 nt, Human adenovirus F
ucagagcugcaagag

SEQ ID NO: 3940367 - RNA, 18 nt, Human adenovirus F
ucagcgcgcuucgccucc

SEQ ID NO: 3940368 - RNA, 16 nt, Human adenovirus F
ucagcucuaagacugu

SEQ ID NO: 3940369 - RNA, 16 nt, Human adenovirus F
ucagcugaacccaccc

SEQ ID NO: 3940370 - RNA, 18 nt, Human adenovirus F
ucagggucgauggagcca

SEQ ID NO: 3940371 - RNA, 21 nt, Human adenovirus F
ucaggugaugcuacacaacaa

SEQ ID NO: 3940372 - RNA, 22 nt, Human adenovirus F
ucagucuuucaacgacuaccuc

SEQ ID NO: 3940373 - RNA, 16 nt, Human adenovirus F
ucaugcugcuguuuuu

SEQ ID NO: 3940374 - RNA, 14 nt, Human adenovirus F
uccaaaccaaauaa

SEQ ID NO: 3940375 - RNA, 20 nt, Human adenovirus F
uccaaaggucagaaaaaccg

SEQ ID NO: 3940376 - RNA, 23 nt, Human adenovirus F
uccaaaucucgccuaacaucacc

SEQ ID NO: 3940377 - RNA, 20 nt, Human adenovirus F
uccaagacccgguacaggug

SEQ ID NO: 3940378 - RNA, 13 nt, Human adenovirus F
uccaccugagggg

SEQ ID NO: 3940379 - RNA, 15 nt, Human adenovirus F
uccacuuacaaccaa

SEQ ID NO: 3940380 - RNA, 24 nt, Human adenovirus F
uccagcaaaggcgcccuccuuugc

SEQ ID NO: 3940381 - RNA, 16 nt, Human adenovirus F
uccagggaguccagga

SEQ ID NO: 3940382 - RNA, 23 nt, Human adenovirus F
uccagguggggcggcgaccugaa

SEQ ID NO: 3940383 - RNA, 22 nt, Human adenovirus F
uccagugcaggaagaggaggag

SEQ ID NO: 3940384 - RNA, 13 nt, Human adenovirus F
uccaguggagcaa

SEQ ID NO: 3940385 - RNA, 13 nt, Human adenovirus F
uccauaacuaaaa

SEQ ID NO: 3940386 - RNA, 18 nt, Human adenovirus F
ggcccaguugagggaagc

SEQ ID NO: 3940387 - RNA, 16 nt, Human adenovirus F
ggccccugaggcagcg

SEQ ID NO: 3940388 - RNA, 12 nt, Human adenovirus F
ggcccuggaggc

SEQ ID NO: 3940389 - RNA, 15 nt, Human adenovirus F
ggcccuggccuggaa

SEQ ID NO: 3940390 - RNA, 23 nt, Human adenovirus F
ggccgcgaccggaucuggaggaa

SEQ ID NO: 3940391 - RNA, 18 nt, Human adenovirus F
ggccgcuacgugccuuuu

SEQ ID NO: 3940392 - RNA, 12 nt, Human adenovirus F
ggccgguaacgc

SEQ ID NO: 3940393 - RNA, 22 nt, Human adenovirus F
ggccguuuaugggcaccuggaa

SEQ ID NO: 3940394 - RNA, 11 nt, Human adenovirus F
ggccugcaaga

SEQ ID NO: 3940395 - RNA, 15 nt, Human adenovirus F
ggccuggcagcugga

SEQ ID NO: 3940396 - RNA, 19 nt, Human adenovirus F
ggccuuguaugggcagcau

SEQ ID NO: 3940397 - RNA, 24 nt, Human adenovirus F
ggcgaaaaaugaugauggcagcag

SEQ ID NO: 3940398 - RNA, 18 nt, Human adenovirus F
ggcgauggggccuuggga

SEQ ID NO: 3940399 - RNA, 18 nt, Human adenovirus F
ggcgcaaucccaggcgug

SEQ ID NO: 3940400 - RNA, 15 nt, Human adenovirus F
ggcgcacggccccca

SEQ ID NO: 3940401 - RNA, 17 nt, Human adenovirus F
ggcgccggcgggaagag

SEQ ID NO: 3940402 - RNA, 16 nt, Human adenovirus F
ggcgcuugccaggguu

SEQ ID NO: 3940403 - RNA, 20 nt, Human adenovirus F
ggcgcuuucaguuggagcag

SEQ ID NO: 3940404 - RNA, 23 nt, Human adenovirus F
ggcggaggagcagauggagagcu

SEQ ID NO: 3940405 - RNA, 16 nt, Human adenovirus F
ggcggcgggugcagug

SEQ ID NO: 3940406 - RNA, 21 nt, Human adenovirus F
ggcgggcguccggaggcagug

SEQ ID NO: 3940407 - RNA, 18 nt, Human adenovirus F
ggcgucaugcucuggggu

SEQ ID NO: 3940408 - RNA, 23 nt, Human adenovirus F
ggcguugauaugaugaaaguaga

SEQ ID NO: 3940409 - RNA, 13 nt, Human adenovirus F
ggcuaauggccag

SEQ ID NO: 3940410 - RNA, 19 nt, Human adenovirus F
ggcuccgacgcuuggcacc

SEQ ID NO: 3940411 - RNA, 13 nt, Human adenovirus F
ggcucuggacaug

SEQ ID NO: 3940412 - RNA, 13 nt, Human adenovirus F
ggcucuuggucag

SEQ ID NO: 3940413 - RNA, 14 nt, Human adenovirus F
ggcuuauuggcaug

SEQ ID NO: 3940414 - RNA, 16 nt, Human adenovirus F
ggcuuuuggaccuggu

SEQ ID NO: 3940415 - RNA, 19 nt, Human adenovirus F
gggaacuguccagggaguc

SEQ ID NO: 3940416 - RNA, 11 nt, Human adenovirus F
gggagccagga

SEQ ID NO: 3940417 - RNA, 23 nt, Human adenovirus F
gggagccaggaagacggacucug

SEQ ID NO: 3940418 - RNA, 22 nt, Human adenovirus F
gggaugcagguaggaccacugg

SEQ ID NO: 3940419 - RNA, 11 nt, Human adenovirus F
gggcaaaacau

SEQ ID NO: 3940420 - RNA, 19 nt, Human adenovirus F
gggcaacguucagccacuc

SEQ ID NO: 3940421 - RNA, 22 nt, Human adenovirus F
gggccagacuacuuuuuccaaa

SEQ ID NO: 3940422 - RNA, 12 nt, Human adenovirus F
gggccggccugg

SEQ ID NO: 3940423 - RNA, 23 nt, Human adenovirus F
gggcguagaguuugggagccagg

SEQ ID NO: 3940424 - RNA, 17 nt, Human adenovirus F
gggcuuauuggcaugag

SEQ ID NO: 3940425 - RNA, 17 nt, Human adenovirus F
ggggcccguucuggacu

SEQ ID NO: 3940426 - RNA, 18 nt, Human adenovirus F
gggggcauuaaugggcaa

SEQ ID NO: 3940427 - RNA, 19 nt, Human adenovirus F
gggucuauuuggaccccca

SEQ ID NO: 3940428 - RNA, 20 nt, Human adenovirus F
ggguguacguuuguugcaug

SEQ ID NO: 3940429 - RNA, 19 nt, Human adenovirus F
gguaaaaaugccaggcagc

SEQ ID NO: 3940430 - RNA, 21 nt, Human adenovirus F
gguaaaaaugccaggcagcag

SEQ ID NO: 3940431 - RNA, 22 nt, Human adenovirus F
gguacucucgaaacuuuuugcc

SEQ ID NO: 3940432 - RNA, 17 nt, Human adenovirus F
ggucacucucagcugcu

SEQ ID NO: 3940433 - RNA, 13 nt, Human adenovirus F
ggucauugggcuu

SEQ ID NO: 3940434 - RNA, 16 nt, Human adenovirus F
ggugaaaugaauuugu

SEQ ID NO: 3940435 - RNA, 17 nt, Human adenovirus F
ggugacgguaaaggggc

SEQ ID NO: 3940436 - RNA, 18 nt, Human adenovirus F
ggugauaucauuaaaaag

SEQ ID NO: 3940437 - RNA, 23 nt, Human adenovirus F
gguggaccccauggaugagccca

SEQ ID NO: 3940438 - RNA, 13 nt, Human adenovirus F
ggugugaaggcaa

SEQ ID NO: 3940439 - RNA, 11 nt, Human adenovirus F
gguuaaacaag

SEQ ID NO: 3940440 - RNA, 16 nt, Human adenovirus F
gguuaauaagcugggu

SEQ ID NO: 3940441 - RNA, 21 nt, Human adenovirus F
gguucgaguucacuuugccag

SEQ ID NO: 3940442 - RNA, 17 nt, Human adenovirus F
gguugcccgccagcugg

SEQ ID NO: 3940443 - RNA, 13 nt, Human adenovirus F
gguuuaaacuuuu

SEQ ID NO: 3940444 - RNA, 14 nt, Human adenovirus F
guaaacugauuuga

SEQ ID NO: 3940445 - RNA, 15 nt, Human adenovirus F
guaaagcgagccaaa

SEQ ID NO: 3940446 - RNA, 19 nt, Human adenovirus F
guaacacaggucaaaugcu

SEQ ID NO: 3940447 - RNA, 16 nt, Human adenovirus F
guaacagaacaauaaa

SEQ ID NO: 3940448 - RNA, 14 nt, Human adenovirus F
guaacugagccuga

SEQ ID NO: 3940449 - RNA, 11 nt, Human adenovirus F
guacacuggcu

SEQ ID NO: 3940450 - RNA, 18 nt, Human adenovirus F
guacgagaaaucggagag

SEQ ID NO: 3940451 - RNA, 16 nt, Human adenovirus F
guagggauugaguggg

SEQ ID NO: 3940452 - RNA, 19 nt, Human adenovirus F
guaguuuugcuccagggua

SEQ ID NO: 3940453 - RNA, 14 nt, Human adenovirus F
gucacucuccgccg

SEQ ID NO: 3940454 - RNA, 20 nt, Human adenovirus F
gucagcaagacaccaguagc

SEQ ID NO: 3940455 - RNA, 20 nt, Human adenovirus F
gucagcuaacucucuuacau

SEQ ID NO: 3940456 - RNA, 14 nt, Human adenovirus F
gucagguuugacag

SEQ ID NO: 3940457 - RNA, 22 nt, Human adenovirus F
gucauacauuucgugggaaggg

SEQ ID NO: 3940458 - RNA, 19 nt, Human adenovirus F
gucauccgccuccacccuu

SEQ ID NO: 3940459 - RNA, 16 nt, Human adenovirus F
guccaggaaggccucg

SEQ ID NO: 3940460 - RNA, 17 nt, Human adenovirus F
gucccuggaguuugggg

SEQ ID NO: 3940461 - RNA, 16 nt, Human adenovirus F
guccgacggcgccucc

SEQ ID NO: 3940462 - RNA, 16 nt, Human adenovirus F
gucgcauaacccugga

SEQ ID NO: 3940463 - RNA, 23 nt, Human adenovirus F
gucgccccugugaguguggagcu

SEQ ID NO: 3940464 - RNA, 17 nt, Human adenovirus F
gucgcgaacucuggacg

SEQ ID NO: 3940465 - RNA, 20 nt, Human adenovirus F
gucgcguaacccgccgugga

SEQ ID NO: 3940466 - RNA, 15 nt, Human adenovirus F
gucgcuggcuccgcg

SEQ ID NO: 3940467 - RNA, 13 nt, Human adenovirus F
gucguaacaaaua

SEQ ID NO: 3940468 - RNA, 17 nt, Human adenovirus F
gucguuaguggaggcag

SEQ ID NO: 3940469 - RNA, 16 nt, Human adenovirus F
gucucagcaguugcaa

SEQ ID NO: 3940470 - RNA, 12 nt, Human adenovirus F
gucucccaccuu

SEQ ID NO: 3940471 - RNA, 15 nt, Human adenovirus F
gucugccagagggug

SEQ ID NO: 3940472 - RNA, 13 nt, Human adenovirus F
gucugcguacuga

SEQ ID NO: 3940473 - RNA, 14 nt, Human adenovirus F
gucugguuaaacaa

SEQ ID NO: 3940474 - RNA, 19 nt, Human adenovirus F
gucuuacauaucgcuugcc

SEQ ID NO: 3940475 - RNA, 20 nt, Human adenovirus F
gucuuccuucacuccucgcc

SEQ ID NO: 3940476 - RNA, 15 nt, Human adenovirus F
gugaccgagcagcug

SEQ ID NO: 3940477 - RNA, 17 nt, Human adenovirus F
gugaccgagcagcugcg

SEQ ID NO: 3940478 - RNA, 21 nt, Human adenovirus F
gugaccugugggucgcagcag

SEQ ID NO: 3940479 - RNA, 14 nt, Human adenovirus F
gugagguaugauga

SEQ ID NO: 3940480 - RNA, 17 nt, Human adenovirus F
gugaguugguagcagug

SEQ ID NO: 3940481 - RNA, 18 nt, Human adenovirus F
gugauaucauuaaaaagg

SEQ ID NO: 3940482 - RNA, 13 nt, Human adenovirus F
gugcaacacagcc

SEQ ID NO: 3940483 - RNA, 13 nt, Human adenovirus F
gugcaggaagagg

SEQ ID NO: 3940484 - RNA, 17 nt, Human adenovirus F
gugcauuggcacaggaa

SEQ ID NO: 3940485 - RNA, 20 nt, Human adenovirus F
gugcccauagacaaggaggu

SEQ ID NO: 3940486 - RNA, 16 nt, Human adenovirus F
guggaaagcaaguuuc

SEQ ID NO: 3940487 - RNA, 18 nt, Human adenovirus F
guggacgacagccagcug

SEQ ID NO: 3940488 - RNA, 14 nt, Human adenovirus F
guggagaaccuugc

SEQ ID NO: 3940489 - RNA, 18 nt, Human adenovirus F
guggauaccgcugcagcu

SEQ ID NO: 3940490 - RNA, 19 nt, Human adenovirus F
guggauaccgcugcagcug

SEQ ID NO: 3940491 - RNA, 15 nt, Human adenovirus F
guggauggggaagga

SEQ ID NO: 3940492 - RNA, 15 nt, Human adenovirus F
guggcggaggugccc

SEQ ID NO: 3940493 - RNA, 16 nt, Human adenovirus F
guggcucugcagcagc

SEQ ID NO: 3940494 - RNA, 19 nt, Human adenovirus F
guggcucugcagcagcgcc

SEQ ID NO: 3940495 - RNA, 14 nt, Human adenovirus F
guggcugcaagguc

SEQ ID NO: 3940496 - RNA, 16 nt, Human adenovirus F
guguaccgcaacgacc

SEQ ID NO: 3940497 - RNA, 16 nt, Human adenovirus F
guguaccugucgccca

SEQ ID NO: 3940498 - RNA, 21 nt, Human adenovirus F
guguuaucacccaaagccaaa

SEQ ID NO: 3940499 - RNA, 23 nt, Human adenovirus F
guuaaagugcgccccauuaaaga

SEQ ID NO: 3940500 - RNA, 21 nt, Human adenovirus F
guuacaguggaauuggaaugc

SEQ ID NO: 3940501 - RNA, 20 nt, Human adenovirus F
guucacugaaagccagccgu

SEQ ID NO: 3940502 - RNA, 18 nt, Human adenovirus F
guuccucauacaaaugcu

SEQ ID NO: 3940503 - RNA, 18 nt, Human adenovirus F
guuccucuucucugucuu

SEQ ID NO: 3940504 - RNA, 15 nt, Human adenovirus F
guuccuuccgagaaa

SEQ ID NO: 3940505 - RNA, 15 nt, Human adenovirus F
gacaguggcgcgcuc

SEQ ID NO: 3940506 - RNA, 21 nt, Human adenovirus F
gacaugggggcggaccugcaa

SEQ ID NO: 3940507 - RNA, 20 nt, Human adenovirus F
gaccacgucgccaacagugu

SEQ ID NO: 3940508 - RNA, 21 nt, Human adenovirus F
gaccauuaccaccgucaguga

SEQ ID NO: 3940509 - RNA, 15 nt, Human adenovirus F
gaccccauggacaac

SEQ ID NO: 3940510 - RNA, 21 nt, Human adenovirus F
gaccgacuacuuacucccaac

SEQ ID NO: 3940511 - RNA, 20 nt, Human adenovirus F
gaccugcaauggcagcccag

SEQ ID NO: 3940512 - RNA, 14 nt, Human adenovirus F
gaccuggaagaggg

SEQ ID NO: 3940513 - RNA, 20 nt, Human adenovirus F
gaccugugggucgcagcagg

SEQ ID NO: 3940514 - RNA, 18 nt, Human adenovirus F
gacgacagccaggcagag

SEQ ID NO: 3940515 - RNA, 17 nt, Human adenovirus F
gacggcgguggcggacg

SEQ ID NO: 3940516 - RNA, 13 nt, Human adenovirus F
gacgugcgguggg

SEQ ID NO: 3940517 - RNA, 14 nt, Human adenovirus F
gacguuaaccuagg

SEQ ID NO: 3940518 - RNA, 14 nt, Human adenovirus F
gacuaaacacccgc

SEQ ID NO: 3940519 - RNA, 16 nt, Human adenovirus F
gacuaugucagcuuua

SEQ ID NO: 3940520 - RNA, 22 nt, Human adenovirus F
gacuccgcugacgguggaggaa

SEQ ID NO: 3940521 - RNA, 13 nt, Human adenovirus F
gacucuggugaau

SEQ ID NO: 3940522 - RNA, 19 nt, Human adenovirus F
gacuugccgguuucgcauu

SEQ ID NO: 3940523 - RNA, 12 nt, Human adenovirus F
gagacaaaagcc

SEQ ID NO: 3940524 - RNA, 12 nt, Human adenovirus F
gagagccgagug

SEQ ID NO: 3940525 - RNA, 14 nt, Human adenovirus F
gagcagccugugga

SEQ ID NO: 3940526 - RNA, 17 nt, Human adenovirus F
gagcaguuuggcaaugg

SEQ ID NO: 3940527 - RNA, 22 nt, Human adenovirus F
gagcaguuuggcaauggaacgc

SEQ ID NO: 3940528 - RNA, 17 nt, Human adenovirus F
gagcaugaaacuggaag

SEQ ID NO: 3940529 - RNA, 20 nt, Human adenovirus F
gagcauugugguacaggagc

SEQ ID NO: 3940530 - RNA, 17 nt, Human adenovirus F
gagcccugaucagccag

SEQ ID NO: 3940531 - RNA, 18 nt, Human adenovirus F
gagcgcaauuagcgggcg

SEQ ID NO: 3940532 - RNA, 12 nt, Human adenovirus F
gagcgccauccc

SEQ ID NO: 3940533 - RNA, 23 nt, Human adenovirus F
gagcgguccgucacgcgggccuu

SEQ ID NO: 3940534 - RNA, 13 nt, Human adenovirus F
gagcuaaggagga

SEQ ID NO: 3940535 - RNA, 13 nt, Human adenovirus F
gagcuauuacuuu

SEQ ID NO: 3940536 - RNA, 22 nt, Human adenovirus F
gagcuauuacuuuagcacuaga

SEQ ID NO: 3940537 - RNA, 19 nt, Human adenovirus F
gagcuauuuaaagugguga

SEQ ID NO: 3940538 - RNA, 13 nt, Human adenovirus F
gagcugggacagc

SEQ ID NO: 3940539 - RNA, 22 nt, Human adenovirus F
gagcuuggauuaggaagggcaa

SEQ ID NO: 3940540 - RNA, 14 nt, Human adenovirus F
gaggacgagcccug

SEQ ID NO: 3940541 - RNA, 17 nt, Human adenovirus F
gaggagaaccugagggc

SEQ ID NO: 3940542 - RNA, 18 nt, Human adenovirus F
gaggagcgcaacuuucag

SEQ ID NO: 3940543 - RNA, 21 nt, Human adenovirus F
gaggagcugucucagcaguug

SEQ ID NO: 3940544 - RNA, 14 nt, Human adenovirus F
gaggaggagaaccu

SEQ ID NO: 3940545 - RNA, 22 nt, Human adenovirus F
gaggaucuuaagcugcagccag

SEQ ID NO: 3940546 - RNA, 13 nt, Human adenovirus F
gaggccauccugg

SEQ ID NO: 3940547 - RNA, 13 nt, Human adenovirus F
gaggcgggacuga

SEQ ID NO: 3940548 - RNA, 18 nt, Human adenovirus F
gagggaaaacaaagacga

SEQ ID NO: 3940549 - RNA, 18 nt, Human adenovirus F
gaguguggagcuaaucau

SEQ ID NO: 3940550 - RNA, 17 nt, Human adenovirus F
gaguuggcuucugccag

SEQ ID NO: 3940551 - RNA, 15 nt, Human adenovirus F
gauaccgcugcagcu

SEQ ID NO: 3940552 - RNA, 20 nt, Human adenovirus F
gauauagccaaccaggccuu

SEQ ID NO: 3940553 - RNA, 12 nt, Human adenovirus F
gaucagaaauuu

SEQ ID NO: 3940554 - RNA, 15 nt, Human adenovirus F
gaucauguccaccug

SEQ ID NO: 3940555 - RNA, 17 nt, Human adenovirus F
gauccagugcaggaaga

SEQ ID NO: 3940556 - RNA, 20 nt, Human adenovirus F
gaucccucagagcugcaaga

SEQ ID NO: 3940557 - RNA, 14 nt, Human adenovirus F
gaugauggcagcag

SEQ ID NO: 3940558 - RNA, 13 nt, Human adenovirus F
gauguuuuccaag

SEQ ID NO: 3940559 - RNA, 21 nt, Human adenovirus F
gauucgccauaaugcgggcuc

SEQ ID NO: 3940560 - RNA, 19 nt, Human adenovirus F
gauucuucugugacaaaau

SEQ ID NO: 3940561 - RNA, 23 nt, Human adenovirus F
gauuugccggcaacgcugcaggc

SEQ ID NO: 3940562 - RNA, 18 nt, Human adenovirus F
gauuuguaguggagggau

SEQ ID NO: 3940563 - RNA, 18 nt, Human adenovirus F
gauuuucuuugccaccuu

SEQ ID NO: 3940564 - RNA, 16 nt, Human adenovirus F
gcaaacaauaaaagaa

SEQ ID NO: 3940565 - RNA, 13 nt, Human adenovirus F
gcaaagccauccg

SEQ ID NO: 3940566 - RNA, 21 nt, Human adenovirus F
gcaacaucggcaccccucucc

SEQ ID NO: 3940567 - RNA, 16 nt, Human adenovirus F
gcaaccagugggcucc

SEQ ID NO: 3940568 - RNA, 18 nt, Human adenovirus F
gcaaccauguucacugaa

SEQ ID NO: 3940569 - RNA, 18 nt, Human adenovirus F
gcaacgcugcaggcgcuc

SEQ ID NO: 3940570 - RNA, 14 nt, Human adenovirus F
gcaacguucagcca

SEQ ID NO: 3940571 - RNA, 16 nt, Human adenovirus F
gcaacucgcaggccag

SEQ ID NO: 3940572 - RNA, 16 nt, Human adenovirus F
gcaaguucaaagaaga

SEQ ID NO: 3940573 - RNA, 18 nt, Human adenovirus F
gcaaguuucgcaaaagcu

SEQ ID NO: 3940574 - RNA, 16 nt, Human adenovirus F
gcaaucugaucucuua

SEQ ID NO: 3940575 - RNA, 15 nt, Human adenovirus F
gcacacagaacaaaa

SEQ ID NO: 3940576 - RNA, 18 nt, Human adenovirus F
gcacaggagauccgugga

SEQ ID NO: 3940577 - RNA, 21 nt, Human adenovirus F
gcacaguaaucaaggguuuca

SEQ ID NO: 3940578 - RNA, 16 nt, Human adenovirus F
gcaccgcgcccguccu

SEQ ID NO: 3940579 - RNA, 16 nt, Human adenovirus F
gcaccgcgcggcggcc

SEQ ID NO: 3940580 - RNA, 16 nt, Human adenovirus F
gcacgugucggcggcc

SEQ ID NO: 3940581 - RNA, 20 nt, Human adenovirus F
gcacugcgguggaggccaug

SEQ ID NO: 3940582 - RNA, 19 nt, Human adenovirus F
gcacuuagagugucaguuu

SEQ ID NO: 3940583 - RNA, 19 nt, Human adenovirus F
gcacuucaagaaacacaaa

SEQ ID NO: 3940584 - RNA, 22 nt, Human adenovirus F
gcacuucaagaaacacaaacau

SEQ ID NO: 3940585 - RNA, 17 nt, Human adenovirus F
gcagaacguucuucacu

SEQ ID NO: 3940586 - RNA, 21 nt, Human adenovirus F
gcagagcucugcaaaaacaaa

SEQ ID NO: 3940587 - RNA, 21 nt, Human adenovirus F
gcagagcuugggcccugggcu

SEQ ID NO: 3940588 - RNA, 18 nt, Human adenovirus F
gcagccgugaagccaaau

SEQ ID NO: 3940589 - RNA, 21 nt, Human adenovirus F
gcagccguugcucucuccgga

SEQ ID NO: 3940590 - RNA, 19 nt, Human adenovirus F
gcagccugagcugccagag

SEQ ID NO: 3940591 - RNA, 21 nt, Human adenovirus F
gcagcgcccgccucccaaagu

SEQ ID NO: 3940592 - RNA, 16 nt, Human adenovirus F
gcaggccgcucccaau

SEQ ID NO: 3940593 - RNA, 23 nt, Human adenovirus F
gcagguaggaccacuggagggcg

SEQ ID NO: 3940594 - RNA, 17 nt, Human adenovirus F
gcagucuaagccuggcc

SEQ ID NO: 3940595 - RNA, 16 nt, Human adenovirus F
gcagucucgguaacga

SEQ ID NO: 3940596 - RNA, 14 nt, Human adenovirus F
gcagugggacgagg

SEQ ID NO: 3940597 - RNA, 16 nt, Human adenovirus F
gcaguguuauaagguc

SEQ ID NO: 3940598 - RNA, 18 nt, Human adenovirus F
gcauacguuacucggagc

SEQ ID NO: 3940599 - RNA, 19 nt, Human adenovirus F
gcauaguugcucccaaagu

SEQ ID NO: 3940600 - RNA, 13 nt, Human adenovirus F
gcaucucaaagcu

SEQ ID NO: 3940601 - RNA, 17 nt, Human adenovirus F
gcaucucaaagcuggag

SEQ ID NO: 3940602 - RNA, 19 nt, Human adenovirus F
gcaucucuugaaugaggug

SEQ ID NO: 3940603 - RNA, 18 nt, Human adenovirus F
gcauggcgcuaaaggugu

SEQ ID NO: 3940604 - RNA, 12 nt, Human adenovirus F
gccaaagugcaa

SEQ ID NO: 3940605 - RNA, 18 nt, Human adenovirus F
gccaacagccccagcugg

SEQ ID NO: 3940606 - RNA, 14 nt, Human adenovirus F
gccacaauuuacaa

SEQ ID NO: 3940607 - RNA, 23 nt, Human adenovirus F
gccacacugugcacacacgguuu

SEQ ID NO: 3940608 - RNA, 15 nt, Human adenovirus F
gccacgcaggagcuc

SEQ ID NO: 3940609 - RNA, 17 nt, Human adenovirus F
gccacguccaccgugga

SEQ ID NO: 3940610 - RNA, 22 nt, Human adenovirus F
gccagacuacuuuuuccaaacu

SEQ ID NO: 3940611 - RNA, 22 nt, Human adenovirus F
gccagacuuugucagccaaagu

SEQ ID NO: 3940612 - RNA, 17 nt, Human adenovirus F
gccagcauggcucagcc

SEQ ID NO: 3940613 - RNA, 19 nt, Human adenovirus F
gccagcauggcucagcccc

SEQ ID NO: 3940614 - RNA, 21 nt, Human adenovirus F
gccagccguaggugggacacc

SEQ ID NO: 3940615 - RNA, 19 nt, Human adenovirus F
gccagcgacaaggcaccau

SEQ ID NO: 3940616 - RNA, 21 nt, Human adenovirus F
gccagcuaaugugccgcgcgg

SEQ ID NO: 3940617 - RNA, 13 nt, Human adenovirus F
gccagcuggcaaa

SEQ ID NO: 3940618 - RNA, 15 nt, Human adenovirus F
gccaggcggcgauga

SEQ ID NO: 3940619 - RNA, 11 nt, Human adenovirus F
gccagugcagg

SEQ ID NO: 3940620 - RNA, 14 nt, Human adenovirus F
gccaucugcagcau

SEQ ID NO: 3940621 - RNA, 19 nt, Human adenovirus F
gccauggaaacgcagccug

SEQ ID NO: 3940622 - RNA, 20 nt, Human adenovirus F
gccauggugguagaagguca

SEQ ID NO: 3940623 - RNA, 13 nt, Human adenovirus F
gccauugccaccc

SEQ ID NO: 3940624 - RNA, 15 nt, Human adenovirus F
gcccaccaaauuaaa

SEQ ID NO: 3940625 - RNA, 15 nt, Human adenovirus F
gcccaccacucugau

SEQ ID NO: 3940626 - RNA, 16 nt, Human adenovirus F
gcccauaucugacaac

SEQ ID NO: 3940627 - RNA, 22 nt, Human adenovirus F
gccccuuggugaagguauuaac

SEQ ID NO: 3940628 - RNA, 13 nt, Human adenovirus F
gcccgccagcugg

SEQ ID NO: 3940629 - RNA, 19 nt, Human adenovirus F
gcccgcuugggggcgccau

SEQ ID NO: 3940630 - RNA, 19 nt, Human adenovirus F
gcccggacuuggcgugcag

SEQ ID NO: 3940631 - RNA, 21 nt, Human adenovirus F
gcccgugcgguugcggccacg

SEQ ID NO: 3940632 - RNA, 15 nt, Human adenovirus F
gcccugaucagccag

SEQ ID NO: 3940633 - RNA, 16 nt, Human adenovirus F
gcccuggaggcggcug

SEQ ID NO: 3940634 - RNA, 17 nt, Human adenovirus F
gccgcacucgcuccacc

SEQ ID NO: 3940635 - RNA, 15 nt, Human adenovirus F
gccgccgcucaaggc

SEQ ID NO: 3940636 - RNA, 23 nt, Human adenovirus F
gccgcggacgucaagcccgacau

SEQ ID NO: 3940637 - RNA, 13 nt, Human adenovirus F
gccgcggcggcua

SEQ ID NO: 3940638 - RNA, 20 nt, Human adenovirus F
gccggcucuaggcauaaagu

SEQ ID NO: 3940639 - RNA, 17 nt, Human adenovirus F
gccgggacaacgaggcu

SEQ ID NO: 3940640 - RNA, 15 nt, Human adenovirus F
gccguccacgcuccc

SEQ ID NO: 3940641 - RNA, 23 nt, Human adenovirus F
gccguggcuggcgggcaaagcua

SEQ ID NO: 3940642 - RNA, 18 nt, Human adenovirus F
gccguugcucucuccgga

SEQ ID NO: 3940643 - RNA, 15 nt, Human adenovirus F
gccuccagcacugcc

SEQ ID NO: 3940644 - RNA, 13 nt, Human adenovirus F
gccucccuuugcc

SEQ ID NO: 3940645 - RNA, 15 nt, Human adenovirus F
gccuccgguggcucu

SEQ ID NO: 3940646 - RNA, 24 nt, Human adenovirus F
gccuccuguguuacgccagagagc

SEQ ID NO: 3940647 - RNA, 17 nt, Human adenovirus F
gccucgcgugcucaagc

SEQ ID NO: 3940648 - RNA, 15 nt, Human adenovirus F
gccugacucuuacaa

SEQ ID NO: 3940649 - RNA, 14 nt, Human adenovirus F
gccuucaggcagca

SEQ ID NO: 3940650 - RNA, 17 nt, Human adenovirus F
gccuuguaugggcagca

SEQ ID NO: 3940651 - RNA, 18 nt, Human adenovirus F
gccuuguaugggcagcau

SEQ ID NO: 3940652 - RNA, 19 nt, Human adenovirus F
gccuuguaugggcagcauc

SEQ ID NO: 3940653 - RNA, 14 nt, Human adenovirus F
gcgagcagagccca

SEQ ID NO: 3940654 - RNA, 15 nt, Human adenovirus F
gcgagcuuagcgacc

SEQ ID NO: 3940655 - RNA, 15 nt, Human adenovirus F
gcgcaacgcaagaga

SEQ ID NO: 3940656 - RNA, 24 nt, Human adenovirus F
gcgcaacggcaaucccagcagaaa

SEQ ID NO: 3940657 - RNA, 18 nt, Human adenovirus F
gcgcacgugucggcggcc

SEQ ID NO: 3940658 - RNA, 19 nt, Human adenovirus F
gcgcacugguaaaccagca

SEQ ID NO: 3940659 - RNA, 19 nt, Human adenovirus F
gcgcagcaccgcacagaaa

SEQ ID NO: 3940660 - RNA, 14 nt, Human adenovirus F
gcgcgaacugggcu

SEQ ID NO: 3940661 - RNA, 17 nt, Human adenovirus F
gcgcuucgccuccuggu

SEQ ID NO: 3940662 - RNA, 15 nt, Human adenovirus F
gcgcuuugcgcaggc

SEQ ID NO: 3940663 - RNA, 22 nt, Human adenovirus F
gcggaaaccaagggcucugccu

SEQ ID NO: 3940664 - RNA, 19 nt, Human adenovirus F
gcggaagaagaugaggagg

SEQ ID NO: 3940665 - RNA, 13 nt, Human adenovirus F
gcggcggccauga

SEQ ID NO: 3940666 - RNA, 18 nt, Human adenovirus F
gcgggaagagaggcagcc

SEQ ID NO: 3940667 - RNA, 20 nt, Human adenovirus F
gcgggaagagaggcagcccc

SEQ ID NO: 3940668 - RNA, 20 nt, Human adenovirus F
gcgguggcaacccugaggag

SEQ ID NO: 3940669 - RNA, 17 nt, Human adenovirus F
gcgguggucacucucag

SEQ ID NO: 3940670 - RNA, 21 nt, Human adenovirus F
gcguagcaccccaauguaagu

SEQ ID NO: 3940671 - RNA, 17 nt, Human adenovirus F
gcgucaugcucuggggu

SEQ ID NO: 3940672 - RNA, 18 nt, Human adenovirus F
gcgucgcguaacccgccg

SEQ ID NO: 3940673 - RNA, 17 nt, Human adenovirus F
gcgucgcuggcuccgcg

SEQ ID NO: 3940674 - RNA, 22 nt, Human adenovirus F
gcguggccuccguggccuugca

SEQ ID NO: 3940675 - RNA, 20 nt, Human adenovirus F
gcuaaacaugagcuuacuuu

SEQ ID NO: 3940676 - RNA, 20 nt, Human adenovirus F
gcuaaaggaccaaaacuuuc

SEQ ID NO: 3940677 - RNA, 14 nt, Human adenovirus F
gcuaaaucuuccuc

SEQ ID NO: 3940678 - RNA, 20 nt, Human adenovirus F
gcuaaccugugcagauggaa

SEQ ID NO: 3940679 - RNA, 17 nt, Human adenovirus F
gcuaaggacgguggcau

SEQ ID NO: 3940680 - RNA, 18 nt, Human adenovirus F
gcuaaggacgguggcaug

SEQ ID NO: 3940681 - RNA, 16 nt, Human adenovirus F
gcuacacgcggcccgu

SEQ ID NO: 3940682 - RNA, 19 nt, Human adenovirus F
gcuaccguucuaugcuccu

SEQ ID NO: 3940683 - RNA, 17 nt, Human adenovirus F
gcuacuacuuuaacucu

SEQ ID NO: 3940684 - RNA, 20 nt, Human adenovirus F
gcuacuuaucacaucuuuuu

SEQ ID NO: 3940685 - RNA, 22 nt, Human adenovirus F
gcuagaaaaccgcgccauagcu

SEQ ID NO: 3940686 - RNA, 18 nt, Human adenovirus F
gcuagaaugucacugccg

SEQ ID NO: 3940687 - RNA, 16 nt, Human adenovirus F
gcuagaccaacaaacg

SEQ ID NO: 3940688 - RNA, 14 nt, Human adenovirus F
gcuagcauaaaaga

SEQ ID NO: 3940689 - RNA, 21 nt, Human adenovirus F
gcuaggcucuucuuccucguu

SEQ ID NO: 3940690 - RNA, 14 nt, Human adenovirus F
gcuaugugcagcag

SEQ ID NO: 3940691 - RNA, 20 nt, Human adenovirus F
gcucauccaaguuuuuacaa

SEQ ID NO: 3940692 - RNA, 16 nt, Human adenovirus F
gcucaucugcggccuc

SEQ ID NO: 3940693 - RNA, 19 nt, Human adenovirus F
gcucaucugcggccucagg

SEQ ID NO: 3940694 - RNA, 22 nt, Human adenovirus F
gcuccuuuaacgcccgcugagc

SEQ ID NO: 3940695 - RNA, 19 nt, Human adenovirus F
gcucgcaaacaauaaaaga

SEQ ID NO: 3940696 - RNA, 15 nt, Human adenovirus F
gcucgucgggaagca

SEQ ID NO: 3940697 - RNA, 20 nt, Human adenovirus F
gcucugcagcagcgcccgcc

SEQ ID NO: 3940698 - RNA, 14 nt, Human adenovirus F
gcucugccugcgga

SEQ ID NO: 3940699 - RNA, 15 nt, Human adenovirus F
gcucuguccgccgcc

SEQ ID NO: 3940700 - RNA, 14 nt, Human adenovirus F
gcucuuccaagcug

SEQ ID NO: 3940701 - RNA, 20 nt, Human adenovirus F
gcugagugacgaucuggggg

SEQ ID NO: 3940702 - RNA, 14 nt, Human adenovirus F
gcugcagccagacu

SEQ ID NO: 3940703 - RNA, 12 nt, Human adenovirus F
gcugcagcugcu

SEQ ID NO: 3940704 - RNA, 14 nt, Human adenovirus F
gcugcaggcgcucc

SEQ ID NO: 3940705 - RNA, 14 nt, Human adenovirus F
gcugccaacaaaug

SEQ ID NO: 3940706 - RNA, 21 nt, Human adenovirus F
gcugcguucgacggcgguggc

SEQ ID NO: 3940707 - RNA, 20 nt, Human adenovirus F
gcugcugccucuacugcucg

SEQ ID NO: 3940708 - RNA, 18 nt, Human adenovirus F
gcuggaacucaaaguaaa

SEQ ID NO: 3940709 - RNA, 14 nt, Human adenovirus F
gcuggaggcccuug

SEQ ID NO: 3940710 - RNA, 22 nt, Human adenovirus F
gcuggagggcaaaaugggcuug

SEQ ID NO: 3940711 - RNA, 17 nt, Human adenovirus F
gcuggcccuggccugga

SEQ ID NO: 3940712 - RNA, 16 nt, Human adenovirus F
gcuggcgggcaaagcu

SEQ ID NO: 3940713 - RNA, 21 nt, Human adenovirus F
gcuggggaauggagcuguggu

SEQ ID NO: 3940714 - RNA, 13 nt, Human adenovirus F
gcuguaccaggag

SEQ ID NO: 3940715 - RNA, 15 nt, Human adenovirus F
gcuguaccaggaggc

SEQ ID NO: 3940716 - RNA, 14 nt, Human adenovirus F
gcuguacugugcau

SEQ ID NO: 3940717 - RNA, 23 nt, Human adenovirus F
gcuguacugugcauuugggagcu

SEQ ID NO: 3940718 - RNA, 16 nt, Human adenovirus F
gcuuaguauuaacacu

SEQ ID NO: 3940719 - RNA, 15 nt, Human adenovirus F
gcuucgccuccuggu

SEQ ID NO: 3940720 - RNA, 21 nt, Human adenovirus F
ggaaaaccuacgcccaggagc

SEQ ID NO: 3940721 - RNA, 12 nt, Human adenovirus F
ggaacuguucaa

SEQ ID NO: 3940722 - RNA, 21 nt, Human adenovirus F
ggaagaauacuaaaacaaacc

SEQ ID NO: 3940723 - RNA, 16 nt, Human adenovirus F
ggaagacgagcucccc

SEQ ID NO: 3940724 - RNA, 20 nt, Human adenovirus F
ggacaaagagaaagauggaa

SEQ ID NO: 3940725 - RNA, 13 nt, Human adenovirus F
ggacaagcucccu

SEQ ID NO: 3940726 - RNA, 14 nt, Human adenovirus F
ggacauggccagca

SEQ ID NO: 3940727 - RNA, 14 nt, Human adenovirus F
ggaccacuggaggg

SEQ ID NO: 3940728 - RNA, 15 nt, Human adenovirus F
ggaccacuggagggc

SEQ ID NO: 3940729 - RNA, 16 nt, Human adenovirus F
ggaccacuggagggcg

SEQ ID NO: 3940730 - RNA, 22 nt, Human adenovirus F
ggaccuagaggacguggaggaa

SEQ ID NO: 3940731 - RNA, 14 nt, Human adenovirus F
ggacgggaucagag

SEQ ID NO: 3940732 - RNA, 12 nt, Human adenovirus F
ggacgggcagcc

SEQ ID NO: 3940733 - RNA, 13 nt, Human adenovirus F
ggacgguggcaug

SEQ ID NO: 3940734 - RNA, 18 nt, Human adenovirus F
ggacucgucuccugcaag

SEQ ID NO: 3940735 - RNA, 15 nt, Human adenovirus F
ggagauccguggagc

SEQ ID NO: 3940736 - RNA, 20 nt, Human adenovirus F
ggagcagauggagagcuggg

SEQ ID NO: 3940737 - RNA, 15 nt, Human adenovirus F
ggagccggcgguggc

SEQ ID NO: 3940738 - RNA, 19 nt, Human adenovirus F
ggagccucaaguggggcag

SEQ ID NO: 3940739 - RNA, 23 nt, Human adenovirus F
ggagggacaagcuuaccccgcca

SEQ ID NO: 3940740 - RNA, 18 nt, Human adenovirus F
ggaguaccugagcccggg

SEQ ID NO: 3940741 - RNA, 12 nt, Human adenovirus F
ggagucacugcu

SEQ ID NO: 3940742 - RNA, 13 nt, Human adenovirus F
ggagucccugcac

SEQ ID NO: 3940743 - RNA, 22 nt, Human adenovirus F
ggauaaacugagcguaggauuc

SEQ ID NO: 3940744 - RNA, 14 nt, Human adenovirus F
ggaucaauggagcg

SEQ ID NO: 3940745 - RNA, 13 nt, Human adenovirus F
ggaucauguccac

SEQ ID NO: 3940746 - RNA, 24 nt, Human adenovirus F
ggauccagugcaggaagaggagga

SEQ ID NO: 3940747 - RNA, 19 nt, Human adenovirus F
ggaucccucagagcugcaa

SEQ ID NO: 3940748 - RNA, 14 nt, Human adenovirus F
ggaugauggaggga

SEQ ID NO: 3940749 - RNA, 21 nt, Human adenovirus F
ggauuugccgcagccaguggg

SEQ ID NO: 3940750 - RNA, 18 nt, Human adenovirus F
ggauuuugaguuagcucu

SEQ ID NO: 3940751 - RNA, 15 nt, Human adenovirus F
ggcaaaugcucugca

SEQ ID NO: 3940752 - RNA, 18 nt, Human adenovirus F
ggcaauggcucuguggag

SEQ ID NO: 3940753 - RNA, 16 nt, Human adenovirus F
ggcaccagccagcuca

SEQ ID NO: 3940754 - RNA, 13 nt, Human adenovirus F
ggcacccccccug

SEQ ID NO: 3940755 - RNA, 14 nt, Human adenovirus F
ggcaccggcacuga

SEQ ID NO: 3940756 - RNA, 18 nt, Human adenovirus F
ggcacggcucgcggccgu

SEQ ID NO: 3940757 - RNA, 19 nt, Human adenovirus F
ggcagcagugcuuggaaga

SEQ ID NO: 3940758 - RNA, 20 nt, Human adenovirus F
ggcagcagugcuuggaagag

SEQ ID NO: 3940759 - RNA, 12 nt, Human adenovirus F
ggcaggagcccg

SEQ ID NO: 3940760 - RNA, 19 nt, Human adenovirus F
ggcaggagcugcgggccgg

SEQ ID NO: 3940761 - RNA, 14 nt, Human adenovirus F
ggcaugagggauuc

SEQ ID NO: 3940762 - RNA, 17 nt, Human adenovirus F
ggcauguacggcggcgc

SEQ ID NO: 3940763 - RNA, 12 nt, Human adenovirus F
ggccaaccuaga

SEQ ID NO: 3940764 - RNA, 11 nt, Human adenovirus F
ggccaccgccg

SEQ ID NO: 3940765 - RNA, 15 nt, Human adenovirus F
ggccaugcgccgagc

SEQ ID NO: 3940766 - RNA, 19 nt, Human adenovirus F
ggccauggucauuuuuuca

SEQ ID NO: 3940767 - RNA, 18 nt, Human adenovirus F
acccaacuauuugggagg

SEQ ID NO: 3940768 - RNA, 16 nt, Human adenovirus F
accccaccguggcucc

SEQ ID NO: 3940769 - RNA, 20 nt, Human adenovirus F
accccgccccgaccacaguc

SEQ ID NO: 3940770 - RNA, 16 nt, Human adenovirus F
accccgucuaccccua

SEQ ID NO: 3940771 - RNA, 19 nt, Human adenovirus F
accccuaugacaccuccuc

SEQ ID NO: 3940772 - RNA, 16 nt, Human adenovirus F
acccgaccuaaacucu

SEQ ID NO: 3940773 - RNA, 19 nt, Human adenovirus F
acccgguacaggugggcuu

SEQ ID NO: 3940774 - RNA, 15 nt, Human adenovirus F
acccguucggagcca

SEQ ID NO: 3940775 - RNA, 18 nt, Human adenovirus F
accgacuacuuacuccca

SEQ ID NO: 3940776 - RNA, 14 nt, Human adenovirus F
accgcugcagcugc

SEQ ID NO: 3940777 - RNA, 19 nt, Human adenovirus F
accgcugcagcugcugccg

SEQ ID NO: 3940778 - RNA, 18 nt, Human adenovirus F
accggaguaugccuugca

SEQ ID NO: 3940779 - RNA, 21 nt, Human adenovirus F
accgguuuuguaccaccuugg

SEQ ID NO: 3940780 - RNA, 16 nt, Human adenovirus F
accguuaaucucccuc

SEQ ID NO: 3940781 - RNA, 21 nt, Human adenovirus F
accguucuaugcuccugggua

SEQ ID NO: 3940782 - RNA, 12 nt, Human adenovirus F
accucugcaccc

SEQ ID NO: 3940783 - RNA, 19 nt, Human adenovirus F
accugcaauggcagcccag

SEQ ID NO: 3940784 - RNA, 19 nt, Human adenovirus F
accuguauacgggaaggaa

SEQ ID NO: 3940785 - RNA, 17 nt, Human adenovirus F
accuuacaccaccccua

SEQ ID NO: 3940786 - RNA, 19 nt, Human adenovirus F
accuuuuuacccugaccca

SEQ ID NO: 3940787 - RNA, 19 nt, Human adenovirus F
acgaacacgcugccaacaa

SEQ ID NO: 3940788 - RNA, 18 nt, Human adenovirus F
acgacaaucagaccacaa

SEQ ID NO: 3940789 - RNA, 16 nt, Human adenovirus F
acgacggggauacugc

SEQ ID NO: 3940790 - RNA, 23 nt, Human adenovirus F
acgauaacgcuuuaucuguaaaa

SEQ ID NO: 3940791 - RNA, 22 nt, Human adenovirus F
acgaucgcuccagguggggcgg

SEQ ID NO: 3940792 - RNA, 19 nt, Human adenovirus F
acgcauguaaauuuugcac

SEQ ID NO: 3940793 - RNA, 14 nt, Human adenovirus F
acgccaagccugaa

SEQ ID NO: 3940794 - RNA, 13 nt, Human adenovirus F
acgcccaggagca

SEQ ID NO: 3940795 - RNA, 21 nt, Human adenovirus F
acgccucggaguaccugagcc

SEQ ID NO: 3940796 - RNA, 18 nt, Human adenovirus F
acgccuuacauguggagc

SEQ ID NO: 3940797 - RNA, 18 nt, Human adenovirus F
acgcggggcaggagcugc

SEQ ID NO: 3940798 - RNA, 16 nt, Human adenovirus F
acgcuagaccaacaaa

SEQ ID NO: 3940799 - RNA, 20 nt, Human adenovirus F
acgcugagugacgaucuggg

SEQ ID NO: 3940800 - RNA, 17 nt, Human adenovirus F
acgcuguaccaggaggc

SEQ ID NO: 3940801 - RNA, 22 nt, Human adenovirus F
acggagaugcagagaaaggagu

SEQ ID NO: 3940802 - RNA, 14 nt, Human adenovirus F
acggauuuuugugg

SEQ ID NO: 3940803 - RNA, 17 nt, Human adenovirus F
acggcaaucccagcaga

SEQ ID NO: 3940804 - RNA, 16 nt, Human adenovirus F
acggcccccaucucug

SEQ ID NO: 3940805 - RNA, 16 nt, Human adenovirus F
acgggaugugccaacg

SEQ ID NO: 3940806 - RNA, 23 nt, Human adenovirus F
acgggcggcaaaugcucugcaaa

SEQ ID NO: 3940807 - RNA, 19 nt, Human adenovirus F
acgugaccgagcagcugcg

SEQ ID NO: 3940808 - RNA, 17 nt, Human adenovirus F
acgugcacaaagcucug

SEQ ID NO: 3940809 - RNA, 23 nt, Human adenovirus F
acgugcggugggagugccgccgg

SEQ ID NO: 3940810 - RNA, 17 nt, Human adenovirus F
acgugugugugagggca

SEQ ID NO: 3940811 - RNA, 15 nt, Human adenovirus F
acguucuucacugca

SEQ ID NO: 3940812 - RNA, 18 nt, Human adenovirus F
acuaaaaaaacuccaccc

SEQ ID NO: 3940813 - RNA, 22 nt, Human adenovirus F
acuaaggcuggcacacgcacuu

SEQ ID NO: 3940814 - RNA, 17 nt, Human adenovirus F
acuaucccgccccugcc

SEQ ID NO: 3940815 - RNA, 18 nt, Human adenovirus F
acuaucccgccccugcca

SEQ ID NO: 3940816 - RNA, 21 nt, Human adenovirus F
acuccauuauuuuuauuuuga

SEQ ID NO: 3940817 - RNA, 13 nt, Human adenovirus F
acucucagcugcu

SEQ ID NO: 3940818 - RNA, 19 nt, Human adenovirus F
acucucccuuuccagcaua

SEQ ID NO: 3940819 - RNA, 23 nt, Human adenovirus F
acucucuuacauuggccaccgcc

SEQ ID NO: 3940820 - RNA, 23 nt, Human adenovirus F
acucugaagaugucugaccaacu

SEQ ID NO: 3940821 - RNA, 19 nt, Human adenovirus F
acucuuacaaagugcgcuu

SEQ ID NO: 3940822 - RNA, 14 nt, Human adenovirus F
acucuuacaccucc

SEQ ID NO: 3940823 - RNA, 19 nt, Human adenovirus F
acugaccccauuacuacca

SEQ ID NO: 3940824 - RNA, 16 nt, Human adenovirus F
acugacuuccuggucc

SEQ ID NO: 3940825 - RNA, 18 nt, Human adenovirus F
acugauguaacagcuuug

SEQ ID NO: 3940826 - RNA, 14 nt, Human adenovirus F
acugcauacaacuc

SEQ ID NO: 3940827 - RNA, 19 nt, Human adenovirus F
acugccguugcaaccucug

SEQ ID NO: 3940828 - RNA, 21 nt, Human adenovirus F
acugcuagaaugucacugccg

SEQ ID NO: 3940829 - RNA, 16 nt, Human adenovirus F
acuggagggcgucaug

SEQ ID NO: 3940830 - RNA, 19 nt, Human adenovirus F
acuguuucuccuccccuua

SEQ ID NO: 3940831 - RNA, 15 nt, Human adenovirus F
acuucuucagcucua

SEQ ID NO: 3940832 - RNA, 16 nt, Human adenovirus F
acuuggaagggaaggc

SEQ ID NO: 3940833 - RNA, 14 nt, Human adenovirus F
agaaaaaacccuua

SEQ ID NO: 3940834 - RNA, 22 nt, Human adenovirus F
agaaaauccucagugucuugcc

SEQ ID NO: 3940835 - RNA, 17 nt, Human adenovirus F
agaacaaaacacacucc

SEQ ID NO: 3940836 - RNA, 21 nt, Human adenovirus F
agaacguguugguagagcugg

SEQ ID NO: 3940837 - RNA, 19 nt, Human adenovirus F
agaacuggaguaacacaau

SEQ ID NO: 3940838 - RNA, 21 nt, Human adenovirus F
agaacugggaguugcgcgccg

SEQ ID NO: 3940839 - RNA, 12 nt, Human adenovirus F
agaauaauacag

SEQ ID NO: 3940840 - RNA, 14 nt, Human adenovirus F
agaauguaacucuc

SEQ ID NO: 3940841 - RNA, 13 nt, Human adenovirus F
agaaugucacugc

SEQ ID NO: 3940842 - RNA, 11 nt, Human adenovirus F
agacaauccua

SEQ ID NO: 3940843 - RNA, 13 nt, Human adenovirus F
agacagcaaggaa

SEQ ID NO: 3940844 - RNA, 18 nt, Human adenovirus F
agacauucuugagcaggc

SEQ ID NO: 3940845 - RNA, 18 nt, Human adenovirus F
agaccacaacaacaaacg

SEQ ID NO: 3940846 - RNA, 23 nt, Human adenovirus F
agaccacgucgccaacaguguuu

SEQ ID NO: 3940847 - RNA, 22 nt, Human adenovirus F
agaccucauccgccauugccac

SEQ ID NO: 3940848 - RNA, 19 nt, Human adenovirus F
agacgacugggcggcggcc

SEQ ID NO: 3940849 - RNA, 16 nt, Human adenovirus F
agacgacuucaacccc

SEQ ID NO: 3940850 - RNA, 21 nt, Human adenovirus F
agacgaggaggcggaggagca

SEQ ID NO: 3940851 - RNA, 24 nt, Human adenovirus F
agacgugugugugagggcaaaagu

SEQ ID NO: 3940852 - RNA, 17 nt, Human adenovirus F
agacguuaaagcuggcu

SEQ ID NO: 3940853 - RNA, 13 nt, Human adenovirus F
agacuaaaaacua

SEQ ID NO: 3940854 - RNA, 20 nt, Human adenovirus F
agagccgcggucaacagcug

SEQ ID NO: 3940855 - RNA, 12 nt, Human adenovirus F
agagcuggaggg

SEQ ID NO: 3940856 - RNA, 19 nt, Human adenovirus F
agagcuugggcccugggcu

SEQ ID NO: 3940857 - RNA, 14 nt, Human adenovirus F
agaggaaaaggagg

SEQ ID NO: 3940858 - RNA, 17 nt, Human adenovirus F
agaggaggugaugcugc

SEQ ID NO: 3940859 - RNA, 17 nt, Human adenovirus F
agagggaaguugagaaa

SEQ ID NO: 3940860 - RNA, 15 nt, Human adenovirus F
agagucgucgcaggc

SEQ ID NO: 3940861 - RNA, 15 nt, Human adenovirus F
agaucacaccucucc

SEQ ID NO: 3940862 - RNA, 16 nt, Human adenovirus F
agaugacuucaacccc

SEQ ID NO: 3940863 - RNA, 22 nt, Human adenovirus F
agaugcguccgacggcgccucc

SEQ ID NO: 3940864 - RNA, 21 nt, Human adenovirus F
agauggugggccgcugaaaga

SEQ ID NO: 3940865 - RNA, 18 nt, Human adenovirus F
agauucaagggccagagc

SEQ ID NO: 3940866 - RNA, 16 nt, Human adenovirus F
agauuccaccaaaggu

SEQ ID NO: 3940867 - RNA, 23 nt, Human adenovirus F
agcaaaaauguuaucgggguggg

SEQ ID NO: 3940868 - RNA, 13 nt, Human adenovirus F
agcaaaaccucca

SEQ ID NO: 3940869 - RNA, 12 nt, Human adenovirus F
agcaaacagugc

SEQ ID NO: 3940870 - RNA, 18 nt, Human adenovirus F
agcaaccgcacaugccag

SEQ ID NO: 3940871 - RNA, 18 nt, Human adenovirus F
agcaaguuucgcaaaagc

SEQ ID NO: 3940872 - RNA, 20 nt, Human adenovirus F
agcacaggcggaccuuuuac

SEQ ID NO: 3940873 - RNA, 23 nt, Human adenovirus F
agcaccaacgugcaggccaaccu

SEQ ID NO: 3940874 - RNA, 20 nt, Human adenovirus F
agcacuagaugcagcgcugc

SEQ ID NO: 3940875 - RNA, 20 nt, Human adenovirus F
agcagaaacuacaaaagcag

SEQ ID NO: 3940876 - RNA, 21 nt, Human adenovirus F
agcagccuaagcgcgcacgac

SEQ ID NO: 3940877 - RNA, 18 nt, Human adenovirus F
agcagcuuauccuugcuc

SEQ ID NO: 3940878 - RNA, 15 nt, Human adenovirus F
agcagugggcaaagg

SEQ ID NO: 3940879 - RNA, 21 nt, Human adenovirus F
agcauaauaacucuggcuuug

SEQ ID NO: 3940880 - RNA, 13 nt, Human adenovirus F
agccaaccaggcc

SEQ ID NO: 3940881 - RNA, 13 nt, Human adenovirus F
agccaaugggcuc

SEQ ID NO: 3940882 - RNA, 18 nt, Human adenovirus F
agccacaauaagcagcuu

SEQ ID NO: 3940883 - RNA, 18 nt, Human adenovirus F
agcccagcgcccgggccc

SEQ ID NO: 3940884 - RNA, 20 nt, Human adenovirus F
agcccauucugccaguuggg

SEQ ID NO: 3940885 - RNA, 16 nt, Human adenovirus F
ccauuuggucuaucuc

SEQ ID NO: 3940886 - RNA, 22 nt, Human adenovirus F
cccaauccucaagacuuggaaa

SEQ ID NO: 3940887 - RNA, 17 nt, Human adenovirus F
cccaccgcccccacugu

SEQ ID NO: 3940888 - RNA, 22 nt, Human adenovirus F
cccaccguuguggagucacugc

SEQ ID NO: 3940889 - RNA, 17 nt, Human adenovirus F
cccacuguuucuccucc

SEQ ID NO: 3940890 - RNA, 13 nt, Human adenovirus F
cccacuuaaugcu

SEQ ID NO: 3940891 - RNA, 20 nt, Human adenovirus F
cccagaccaucaauuuugac

SEQ ID NO: 3940892 - RNA, 18 nt, Human adenovirus F
cccagcgcccgggcccug

SEQ ID NO: 3940893 - RNA, 19 nt, Human adenovirus F
cccagguuuaauacaguga

SEQ ID NO: 3940894 - RNA, 14 nt, Human adenovirus F
cccaugagccgcca

SEQ ID NO: 3940895 - RNA, 12 nt, Human adenovirus F
cccaugcagcca

SEQ ID NO: 3940896 - RNA, 12 nt, Human adenovirus F
cccauucugcca

SEQ ID NO: 3940897 - RNA, 20 nt, Human adenovirus F
ccccaccguggcucccaccc

SEQ ID NO: 3940898 - RNA, 17 nt, Human adenovirus F
ccccacuguugccgugg

SEQ ID NO: 3940899 - RNA, 20 nt, Human adenovirus F
ccccagcugguaagcagccu

SEQ ID NO: 3940900 - RNA, 15 nt, Human adenovirus F
cccccaucucugugc

SEQ ID NO: 3940901 - RNA, 20 nt, Human adenovirus F
cccccggcggcgggugcagu

SEQ ID NO: 3940902 - RNA, 20 nt, Human adenovirus F
cccccguuugcuuccuccaa

SEQ ID NO: 3940903 - RNA, 14 nt, Human adenovirus F
ccccggcguacgac

SEQ ID NO: 3940904 - RNA, 14 nt, Human adenovirus F
ccccugccaccgca

SEQ ID NO: 3940905 - RNA, 19 nt, Human adenovirus F
cccgaagccuucaggcagc

SEQ ID NO: 3940906 - RNA, 13 nt, Human adenovirus F
cccgaggacggca

SEQ ID NO: 3940907 - RNA, 14 nt, Human adenovirus F
cccgcccgccgccc

SEQ ID NO: 3940908 - RNA, 16 nt, Human adenovirus F
cccgguacaggugggc

SEQ ID NO: 3940909 - RNA, 15 nt, Human adenovirus F
cccguuugcuuccuc

SEQ ID NO: 3940910 - RNA, 17 nt, Human adenovirus F
cccuccccccuuccacu

SEQ ID NO: 3940911 - RNA, 18 nt, Human adenovirus F
cccucgucgcccucuucu

SEQ ID NO: 3940912 - RNA, 14 nt, Human adenovirus F
cccugaucagccag

SEQ ID NO: 3940913 - RNA, 13 nt, Human adenovirus F
cccuggccuggaa

SEQ ID NO: 3940914 - RNA, 20 nt, Human adenovirus F
cccuuacgaacacuacaauc

SEQ ID NO: 3940915 - RNA, 13 nt, Human adenovirus F
cccuuuccagcau

SEQ ID NO: 3940916 - RNA, 18 nt, Human adenovirus F
ccgaccauuaccaccguc

SEQ ID NO: 3940917 - RNA, 13 nt, Human adenovirus F
ccgagcggcugcu

SEQ ID NO: 3940918 - RNA, 11 nt, Human adenovirus F
ccgagggcuuc

SEQ ID NO: 3940919 - RNA, 13 nt, Human adenovirus F
ccgagguauccag

SEQ ID NO: 3940920 - RNA, 18 nt, Human adenovirus F
ccgagguauccagcucaa

SEQ ID NO: 3940921 - RNA, 20 nt, Human adenovirus F
ccgcaaaugggccuggcagc

SEQ ID NO: 3940922 - RNA, 13 nt, Human adenovirus F
ccgcacuggaugc

SEQ ID NO: 3940923 - RNA, 19 nt, Human adenovirus F
ccgcagacgaacacaauau

SEQ ID NO: 3940924 - RNA, 21 nt, Human adenovirus F
ccgcagcugcuuguaucacag

SEQ ID NO: 3940925 - RNA, 14 nt, Human adenovirus F
ccgccccugccacc

SEQ ID NO: 3940926 - RNA, 18 nt, Human adenovirus F
ccgccguuucucgcccca

SEQ ID NO: 3940927 - RNA, 23 nt, Human adenovirus F
ccgcgaacuaaugcacagccugc

SEQ ID NO: 3940928 - RNA, 18 nt, Human adenovirus F
ccgcggucaacagcugga

SEQ ID NO: 3940929 - RNA, 12 nt, Human adenovirus F
ccggaaaaccaa

SEQ ID NO: 3940930 - RNA, 18 nt, Human adenovirus F
ccggacgggcagccgguc

SEQ ID NO: 3940931 - RNA, 17 nt, Human adenovirus F
ccggagagcgguccguc

SEQ ID NO: 3940932 - RNA, 16 nt, Human adenovirus F
ccggaucuggaggaaa

SEQ ID NO: 3940933 - RNA, 15 nt, Human adenovirus F
ccggccuggacccuu

SEQ ID NO: 3940934 - RNA, 13 nt, Human adenovirus F
ccggguccaggcu

SEQ ID NO: 3940935 - RNA, 14 nt, Human adenovirus F
ccgguacagguggg

SEQ ID NO: 3940936 - RNA, 18 nt, Human adenovirus F
ccgucacucuccgccgcc

SEQ ID NO: 3940937 - RNA, 15 nt, Human adenovirus F
ccgucccugggaugc

SEQ ID NO: 3940938 - RNA, 18 nt, Human adenovirus F
ccgucuccuaacgccacu

SEQ ID NO: 3940939 - RNA, 19 nt, Human adenovirus F
ccguuggaauuuuccugcg

SEQ ID NO: 3940940 - RNA, 20 nt, Human adenovirus F
ccguuucucgccccaccgcc

SEQ ID NO: 3940941 - RNA, 16 nt, Human adenovirus F
ccuaaggacuucaccu

SEQ ID NO: 3940942 - RNA, 16 nt, Human adenovirus F
ccuacaccaaugcaaa

SEQ ID NO: 3940943 - RNA, 15 nt, Human adenovirus F
ccuacggaagggcgg

SEQ ID NO: 3940944 - RNA, 15 nt, Human adenovirus F
ccuacggcaagcgcg

SEQ ID NO: 3940945 - RNA, 15 nt, Human adenovirus F
ccuacgugcacaaag

SEQ ID NO: 3940946 - RNA, 22 nt, Human adenovirus F
ccuagcugcuuuaaucgcugga

SEQ ID NO: 3940947 - RNA, 13 nt, Human adenovirus F
ccuagguccgacc

SEQ ID NO: 3940948 - RNA, 20 nt, Human adenovirus F
ccuaguaaaggcgaaaagcg

SEQ ID NO: 3940949 - RNA, 14 nt, Human adenovirus F
ccuaugacaccucc

SEQ ID NO: 3940950 - RNA, 18 nt, Human adenovirus F
ccucagacgacugggcgg

SEQ ID NO: 3940951 - RNA, 20 nt, Human adenovirus F
ccucagggucaacugggucg

SEQ ID NO: 3940952 - RNA, 19 nt, Human adenovirus F
ccucauacaaaugcucagu

SEQ ID NO: 3940953 - RNA, 12 nt, Human adenovirus F
ccuccaauuuga

SEQ ID NO: 3940954 - RNA, 23 nt, Human adenovirus F
ccuccgguggcucugcagcagcg

SEQ ID NO: 3940955 - RNA, 20 nt, Human adenovirus F
ccuccguggccuugcaagca

SEQ ID NO: 3940956 - RNA, 12 nt, Human adenovirus F
ccucgcuccggc

SEQ ID NO: 3940957 - RNA, 23 nt, Human adenovirus F
ccucggcuacaguuucgcgcacc

SEQ ID NO: 3940958 - RNA, 14 nt, Human adenovirus F
ccucguuaagccac

SEQ ID NO: 3940959 - RNA, 23 nt, Human adenovirus F
ccucuacuauuaccgucaucucu

SEQ ID NO: 3940960 - RNA, 12 nt, Human adenovirus F
ccucuacugcuc

SEQ ID NO: 3940961 - RNA, 13 nt, Human adenovirus F
ccucugacggggg

SEQ ID NO: 3940962 - RNA, 20 nt, Human adenovirus F
ccucuguuugcugcacugcc

SEQ ID NO: 3940963 - RNA, 13 nt, Human adenovirus F
ccucuucugcacc

SEQ ID NO: 3940964 - RNA, 15 nt, Human adenovirus F
ccugaaacgccgccg

SEQ ID NO: 3940965 - RNA, 13 nt, Human adenovirus F
ccugaaauacacu

SEQ ID NO: 3940966 - RNA, 14 nt, Human adenovirus F
ccugagcugccaga

SEQ ID NO: 3940967 - RNA, 18 nt, Human adenovirus F
ccugaggaggaggccauc

SEQ ID NO: 3940968 - RNA, 15 nt, Human adenovirus F
ccugcaaagccaacc

SEQ ID NO: 3940969 - RNA, 14 nt, Human adenovirus F
ccuggaguuugggg

SEQ ID NO: 3940970 - RNA, 22 nt, Human adenovirus F
ccuggccguacgguuucugggc

SEQ ID NO: 3940971 - RNA, 17 nt, Human adenovirus F
ccuguacuugccugacu

SEQ ID NO: 3940972 - RNA, 20 nt, Human adenovirus F
ccugucaugaaaguuccucu

SEQ ID NO: 3940973 - RNA, 17 nt, Human adenovirus F
ccugugcagcgcgcucc

SEQ ID NO: 3940974 - RNA, 20 nt, Human adenovirus F
ccuguuacuauuaaugcaaa

SEQ ID NO: 3940975 - RNA, 16 nt, Human adenovirus F
ccuguucuaaaaccaa

SEQ ID NO: 3940976 - RNA, 14 nt, Human adenovirus F
ccuuaaggaggagg

SEQ ID NO: 3940977 - RNA, 12 nt, Human adenovirus F
ccuuacagccug

SEQ ID NO: 3940978 - RNA, 14 nt, Human adenovirus F
ccuugcaaaaccaa

SEQ ID NO: 3940979 - RNA, 21 nt, Human adenovirus F
ccuugcuacggaggaagaggg

SEQ ID NO: 3940980 - RNA, 17 nt, Human adenovirus F
cgaaaaccggcuggggc

SEQ ID NO: 3940981 - RNA, 21 nt, Human adenovirus F
cgaagacuaucacgcccacca

SEQ ID NO: 3940982 - RNA, 21 nt, Human adenovirus F
cgacaaagcacacagaacaaa

SEQ ID NO: 3940983 - RNA, 14 nt, Human adenovirus F
cgacaccacccggg

SEQ ID NO: 3940984 - RNA, 14 nt, Human adenovirus F
cgacagccagcugu

SEQ ID NO: 3940985 - RNA, 23 nt, Human adenovirus F
cgacgagcuugcucgcuggcuag

SEQ ID NO: 3940986 - RNA, 21 nt, Human adenovirus F
cgagaucacgucugggguuca

SEQ ID NO: 3940987 - RNA, 16 nt, Human adenovirus F
cgagaucggcaccagc

SEQ ID NO: 3940988 - RNA, 21 nt, Human adenovirus F
cgagcaaacggugaacgagga

SEQ ID NO: 3940989 - RNA, 11 nt, Human adenovirus F
cgagccacagg

SEQ ID NO: 3940990 - RNA, 20 nt, Human adenovirus F
cgagcuuuuacugggacagc

SEQ ID NO: 3940991 - RNA, 22 nt, Human adenovirus F
cgaggaaagcuuccagccaauc

SEQ ID NO: 3940992 - RNA, 14 nt, Human adenovirus F
cgaggggcuggccc

SEQ ID NO: 3940993 - RNA, 16 nt, Human adenovirus F
cgaucgcuccaggugg

SEQ ID NO: 3940994 - RNA, 18 nt, Human adenovirus F
cgaugaugccgcaauggu

SEQ ID NO: 3940995 - RNA, 17 nt, Human adenovirus F
cgauggagccagcguca

SEQ ID NO: 3940996 - RNA, 14 nt, Human adenovirus F
cgcaaaagcuggga

SEQ ID NO: 3940997 - RNA, 22 nt, Human adenovirus F
cgcaaggaugaggcgggacuga

SEQ ID NO: 3940998 - RNA, 23 nt, Human adenovirus F
cgcaauggucuuacaugcacauc

SEQ ID NO: 3940999 - RNA, 14 nt, Human adenovirus F
cgcacgcuggagga

SEQ ID NO: 3941000 - RNA, 19 nt, Human adenovirus F
cgcacugguaaaccagcac

SEQ ID NO: 3941001 - RNA, 13 nt, Human adenovirus F
cgcagcgggcagg

SEQ ID NO: 3941002 - RNA, 19 nt, Human adenovirus F
cgcagcgggcaggagcccg

SEQ ID NO: 3941003 - RNA, 20 nt, Human adenovirus F
cgcagcguugcacgcucugc

SEQ ID NO: 3941004 - RNA, 18 nt, Human adenovirus F
cgccaucccccgagcgcc

SEQ ID NO: 3941005 - RNA, 19 nt, Human adenovirus F
cgcccaccaaauuaaauuu

SEQ ID NO: 3941006 - RNA, 21 nt, Human adenovirus F
cgcccucuucugcaccugcac

SEQ ID NO: 3941007 - RNA, 16 nt, Human adenovirus F
cgccgcucaaggcgca

SEQ ID NO: 3941008 - RNA, 15 nt, Human adenovirus F
cgccggacgggcagc

SEQ ID NO: 3941009 - RNA, 22 nt, Human adenovirus F
cgccggcauguacggcggcgcc

SEQ ID NO: 3941010 - RNA, 16 nt, Human adenovirus F
cgccgucggaccugcc

SEQ ID NO: 3941011 - RNA, 18 nt, Human adenovirus F
cgccguuucucgccccac

SEQ ID NO: 3941012 - RNA, 15 nt, Human adenovirus F
cgcgaggagguggcc

SEQ ID NO: 3941013 - RNA, 21 nt, Human adenovirus F
cgcgcaacuuuugcaccaggg

SEQ ID NO: 3941014 - RNA, 11 nt, Human adenovirus F
cgcgccaaccg

SEQ ID NO: 3941015 - RNA, 16 nt, Human adenovirus F
cgcggaagaagaugag

SEQ ID NO: 3941016 - RNA, 12 nt, Human adenovirus F
cgcggggcagga

SEQ ID NO: 3941017 - RNA, 19 nt, Human adenovirus F
cgcuaucaggaagcagcuc

SEQ ID NO: 3941018 - RNA, 17 nt, Human adenovirus F
cgcuaugugcagcaguc

SEQ ID NO: 3941019 - RNA, 13 nt, Human adenovirus F
cgcugcaggcgcu

SEQ ID NO: 3941020 - RNA, 23 nt, Human adenovirus F
cgcugccguuuuuucagauggcu

SEQ ID NO: 3941021 - RNA, 16 nt, Human adenovirus F
cgcuggcuccgcggca

SEQ ID NO: 3941022 - RNA, 17 nt, Human adenovirus F
cgcuucgccuccuggug

SEQ ID NO: 3941023 - RNA, 21 nt, Human adenovirus F
cgcuuggaggagcugucucag

SEQ ID NO: 3941024 - RNA, 11 nt, Human adenovirus F
cggaccugcaa

SEQ ID NO: 3941025 - RNA, 17 nt, Human adenovirus F
cggacgggucgcagcag

SEQ ID NO: 3941026 - RNA, 14 nt, Human adenovirus F
cggagaggggagga

SEQ ID NO: 3941027 - RNA, 20 nt, Human adenovirus F
cggcaaugcuuuugauggug

SEQ ID NO: 3941028 - RNA, 18 nt, Human adenovirus F
cggcaucggaacccucca

SEQ ID NO: 3941029 - RNA, 21 nt, Human adenovirus F
cggcccugcaaagccaaccuu

SEQ ID NO: 3941030 - RNA, 21 nt, Human adenovirus F
cggccuacugccgccaugacu

SEQ ID NO: 3941031 - RNA, 20 nt, Human adenovirus F
cggccuuguaugggcagcau

SEQ ID NO: 3941032 - RNA, 12 nt, Human adenovirus F
cggcgcagcaga

SEQ ID NO: 3941033 - RNA, 18 nt, Human adenovirus F
cggcggccauggaucgca

SEQ ID NO: 3941034 - RNA, 15 nt, Human adenovirus F
cggcgggaagaggac

SEQ ID NO: 3941035 - RNA, 19 nt, Human adenovirus F
cggcguacacuggcuggcc

SEQ ID NO: 3941036 - RNA, 21 nt, Human adenovirus F
cgggcgcacgugucggcggcc

SEQ ID NO: 3941037 - RNA, 15 nt, Human adenovirus F
cgggcggcgccagac

SEQ ID NO: 3941038 - RNA, 19 nt, Human adenovirus F
cggggcuaacuggcagagc

SEQ ID NO: 3941039 - RNA, 15 nt, Human adenovirus F
cgggucgcagcaggu

SEQ ID NO: 3941040 - RNA, 16 nt, Human adenovirus F
cgggucgcagcaggug

SEQ ID NO: 3941041 - RNA, 14 nt, Human adenovirus F
cgggugcaguggcg

SEQ ID NO: 3941042 - RNA, 15 nt, Human adenovirus F
cgguaacgaccucag

SEQ ID NO: 3941043 - RNA, 21 nt, Human adenovirus F
cggugcgaagccgucccccuc

SEQ ID NO: 3941044 - RNA, 23 nt, Human adenovirus F
cggugcguuuuuuugagcuugga

SEQ ID NO: 3941045 - RNA, 16 nt, Human adenovirus F
cgguggcucugcagca

SEQ ID NO: 3941046 - RNA, 18 nt, Human adenovirus F
cgguggcucugcagcagc

SEQ ID NO: 3941047 - RNA, 17 nt, Human adenovirus F
cgguggucuccagaccc

SEQ ID NO: 3941048 - RNA, 21 nt, Human adenovirus F
cguagaguuugggagccagga

SEQ ID NO: 3941049 - RNA, 21 nt, Human adenovirus F
cguagggauugagugggaagc

SEQ ID NO: 3941050 - RNA, 13 nt, Human adenovirus F
cguaggugacaaa

SEQ ID NO: 3941051 - RNA, 18 nt, Human adenovirus F
cguauucacaaagcugug

SEQ ID NO: 3941052 - RNA, 21 nt, Human adenovirus F
cgucaaugccaauaccagcaa

SEQ ID NO: 3941053 - RNA, 18 nt, Human adenovirus F
cgucccaucauuuccaca

SEQ ID NO: 3941054 - RNA, 21 nt, Human adenovirus F
cgucgguggauaccgcugcag

SEQ ID NO: 3941055 - RNA, 23 nt, Human adenovirus F
cgucgguggauaccgcugcagcu

SEQ ID NO: 3941056 - RNA, 23 nt, Human adenovirus F
cgucuaccccuaugacaccuccu

SEQ ID NO: 3941057 - RNA, 21 nt, Human adenovirus F
cgucuuugcggugccugaagc

SEQ ID NO: 3941058 - RNA, 16 nt, Human adenovirus F
cgugcgcacccuggug

SEQ ID NO: 3941059 - RNA, 20 nt, Human adenovirus F
cgugcgcacccugguggcgc

SEQ ID NO: 3941060 - RNA, 20 nt, Human adenovirus F
cguggaaaaacuuggaaacc

SEQ ID NO: 3941061 - RNA, 22 nt, Human adenovirus F
cguggauuccugggguagggug

SEQ ID NO: 3941062 - RNA, 14 nt, Human adenovirus F
cguggcugcaaggu

SEQ ID NO: 3941063 - RNA, 17 nt, Human adenovirus F
cgugggaaggggccagc

SEQ ID NO: 3941064 - RNA, 17 nt, Human adenovirus F
cgugucaccugcaguuc

SEQ ID NO: 3941065 - RNA, 18 nt, Human adenovirus F
cgugugccauuguuaaca

SEQ ID NO: 3941066 - RNA, 16 nt, Human adenovirus F
cguucuaugcuccugg

SEQ ID NO: 3941067 - RNA, 12 nt, Human adenovirus F
cguucuggacuc

SEQ ID NO: 3941068 - RNA, 15 nt, Human adenovirus F
cguugucgccccugu

SEQ ID NO: 3941069 - RNA, 13 nt, Human adenovirus F
cguugugcgcauc

SEQ ID NO: 3941070 - RNA, 14 nt, Human adenovirus F
cguuguggacuucc

SEQ ID NO: 3941071 - RNA, 14 nt, Human adenovirus F
cguuuaaaaacuug

SEQ ID NO: 3941072 - RNA, 14 nt, Human adenovirus F
cuaaagggaacugc

SEQ ID NO: 3941073 - RNA, 17 nt, Human adenovirus F
cuaaaucuuccucccaa

SEQ ID NO: 3941074 - RNA, 13 nt, Human adenovirus F
cuaacaaaaacuu

SEQ ID NO: 3941075 - RNA, 21 nt, Human adenovirus F
cuaaccguuaaucucccuccc

SEQ ID NO: 3941076 - RNA, 22 nt, Human adenovirus F
cuaaggacgguggcaugaggga

SEQ ID NO: 3941077 - RNA, 16 nt, Human adenovirus F
cuaagggaggcagcag

SEQ ID NO: 3941078 - RNA, 18 nt, Human adenovirus F
cuaagugugacauuacuu

SEQ ID NO: 3941079 - RNA, 17 nt, Human adenovirus F
cuaaugccuuaacauuu

SEQ ID NO: 3941080 - RNA, 14 nt, Human adenovirus F
cuaauuuuucacca

SEQ ID NO: 3941081 - RNA, 15 nt, Human adenovirus F
cuacaaaagcagugg

SEQ ID NO: 3941082 - RNA, 15 nt, Human adenovirus F
cuacaagauuccacc

SEQ ID NO: 3941083 - RNA, 16 nt, Human adenovirus F
cuacauccauuuccac

SEQ ID NO: 3941084 - RNA, 22 nt, Human adenovirus F
cuaccacuaccccuaccacccu

SEQ ID NO: 3941085 - RNA, 13 nt, Human adenovirus F
cuaccgcagcugg

SEQ ID NO: 3941086 - RNA, 22 nt, Human adenovirus F
cuaccgccuuuggagguggcac

SEQ ID NO: 3941087 - RNA, 19 nt, Human adenovirus F
cuaccucugcgcugcaaac

SEQ ID NO: 3941088 - RNA, 22 nt, Human adenovirus F
cuacguucgucaggccugcaag

SEQ ID NO: 3941089 - RNA, 13 nt, Human adenovirus F
cuacucuggcucc

SEQ ID NO: 3941090 - RNA, 18 nt, Human adenovirus F
cuagaaugucacugccgu

SEQ ID NO: 3941091 - RNA, 19 nt, Human adenovirus F
cuagaggacguggaggaag

SEQ ID NO: 3941092 - RNA, 11 nt, Human adenovirus F
cuagcaaacag

SEQ ID NO: 3941093 - RNA, 16 nt, Human adenovirus F
cuagcaaacagugcca

SEQ ID NO: 3941094 - RNA, 15 nt, Human adenovirus F
cuagcauaaagggga

SEQ ID NO: 3941095 - RNA, 22 nt, Human adenovirus F
cuagcauaaaggggaccagcug

SEQ ID NO: 3941096 - RNA, 11 nt, Human adenovirus F
cuagcugcuuu

SEQ ID NO: 3941097 - RNA, 11 nt, Human adenovirus F
cuaguacgagc

SEQ ID NO: 3941098 - RNA, 14 nt, Human adenovirus F
cuagucccuccucc

SEQ ID NO: 3941099 - RNA, 21 nt, Human adenovirus F
cuaguuuuaguaaaaugcaac

SEQ ID NO: 3941100 - RNA, 15 nt, Human adenovirus F
cuaucccgccccugc

SEQ ID NO: 3941101 - RNA, 19 nt, Human adenovirus F
cuaucccguguuugacaac

SEQ ID NO: 3941102 - RNA, 17 nt, Human adenovirus F
cuaucuagauaauaacu

SEQ ID NO: 3941103 - RNA, 12 nt, Human adenovirus F
cuaucuuuuccu

SEQ ID NO: 3941104 - RNA, 17 nt, Human adenovirus F
cuaugaggacgagcccu

SEQ ID NO: 3941105 - RNA, 21 nt, Human adenovirus F
cuauuacagguauaaagguug

SEQ ID NO: 3941106 - RNA, 14 nt, Human adenovirus F
cuauugccagcaug

SEQ ID NO: 3941107 - RNA, 12 nt, Human adenovirus F
cuauuuaaagug

SEQ ID NO: 3941108 - RNA, 16 nt, Human adenovirus F
cuauuuaaagugguga

SEQ ID NO: 3941109 - RNA, 22 nt, Human adenovirus F
cuauuucuuugucuaacuaaaa

SEQ ID NO: 3941110 - RNA, 22 nt, Human adenovirus F
cuauuugggaggggaggacgac

SEQ ID NO: 3941111 - RNA, 18 nt, Human adenovirus F
cucaaacacugcgcaaag

SEQ ID NO: 3941112 - RNA, 14 nt, Human adenovirus F
cucaaguacacuga

SEQ ID NO: 3941113 - RNA, 21 nt, Human adenovirus F
cucagcuuauucgccagucca

SEQ ID NO: 3941114 - RNA, 17 nt, Human adenovirus F
cucaggaaccaccaccg

SEQ ID NO: 3941115 - RNA, 19 nt, Human adenovirus F
cucaucugucgcaggguua

SEQ ID NO: 3941116 - RNA, 15 nt, Human adenovirus F
cuccaacacagccgc

SEQ ID NO: 3941117 - RNA, 20 nt, Human adenovirus F
cuccauguggaaccaggcag

SEQ ID NO: 3941118 - RNA, 12 nt, Human adenovirus F
cuccauuauuuu

SEQ ID NO: 3941119 - RNA, 15 nt, Human adenovirus F
cucccaaagugcugu

SEQ ID NO: 3941120 - RNA, 16 nt, Human adenovirus F
cuccgucuagccaacu

SEQ ID NO: 3941121 - RNA, 20 nt, Human adenovirus F
cuccucaacucccagcauuc

SEQ ID NO: 3941122 - RNA, 20 nt, Human adenovirus F
cucgacucgggugcuccuuu

SEQ ID NO: 3941123 - RNA, 16 nt, Human adenovirus F
cucgagguguaacauc

SEQ ID NO: 3941124 - RNA, 15 nt, Human adenovirus F
cucggaccauucuga

SEQ ID NO: 3941125 - RNA, 14 nt, Human adenovirus F
cucggguauggugg

SEQ ID NO: 3941126 - RNA, 17 nt, Human adenovirus F
cucgucguggcauguuu

SEQ ID NO: 3941127 - RNA, 20 nt, Human adenovirus F
cucuagcggcgacggacugc

SEQ ID NO: 3941128 - RNA, 16 nt, Human adenovirus F
cucuccccaccgcugc

SEQ ID NO: 3941129 - RNA, 12 nt, Human adenovirus F
cucucuccggag

SEQ ID NO: 3941130 - RNA, 17 nt, Human adenovirus F
cucugaucuuauggaag

SEQ ID NO: 3941131 - RNA, 13 nt, Human adenovirus F
cucugcagcagcg

SEQ ID NO: 3941132 - RNA, 20 nt, Human adenovirus F
cucuuacauuggccaccgcc

SEQ ID NO: 3941133 - RNA, 17 nt, Human adenovirus F
cugaacaauaaaaucau

SEQ ID NO: 3941134 - RNA, 13 nt, Human adenovirus F
cugaacacuuuug

SEQ ID NO: 3941135 - RNA, 23 nt, Human adenovirus F
cugaaugugucuccgcugggaga

SEQ ID NO: 3941136 - RNA, 15 nt, Human adenovirus F
cugacaguaagcaac

SEQ ID NO: 3941137 - RNA, 13 nt, Human adenovirus F
cugacccuuccca

SEQ ID NO: 3941138 - RNA, 16 nt, Human adenovirus F
cugacgggggaggcac

SEQ ID NO: 3941139 - RNA, 21 nt, Human adenovirus F
cugacgggggaggcacaccuu

SEQ ID NO: 3941140 - RNA, 17 nt, Human adenovirus F
cugagcugccagaggcc

SEQ ID NO: 3941141 - RNA, 15 nt, Human adenovirus F
cugagggccggccug

SEQ ID NO: 3941142 - RNA, 23 nt, Human adenovirus F
cugauccguaauggaaaugaaac

SEQ ID NO: 3941143 - RNA, 19 nt, Human adenovirus F
cugcaacaaaaaaaaaaua

SEQ ID NO: 3941144 - RNA, 22 nt, Human adenovirus F
cugcaccccucaucgcucacug

SEQ ID NO: 3941145 - RNA, 19 nt, Human adenovirus F
cugccaacucgacaacccu

SEQ ID NO: 3941146 - RNA, 17 nt, Human adenovirus F
cugccaccgcaaccaug

SEQ ID NO: 3941147 - RNA, 20 nt, Human adenovirus F
cugccagaacuuccagcugu

SEQ ID NO: 3941148 - RNA, 21 nt, Human adenovirus F
cugccaucgcugaccagcagc

SEQ ID NO: 3941149 - RNA, 17 nt, Human adenovirus F
cugccgcugcgcagcag

SEQ ID NO: 3941150 - RNA, 21 nt, Human adenovirus F
cugcgcaaagucgaggagucc

SEQ ID NO: 3941151 - RNA, 15 nt, Human adenovirus F
cugcgguggaggcca

SEQ ID NO: 3941152 - RNA, 23 nt, Human adenovirus F
cugcuaaagggaacugccagugu

SEQ ID NO: 3941153 - RNA, 19 nt, Human adenovirus F
cugcuacucaacagaaacc

SEQ ID NO: 3941154 - RNA, 23 nt, Human adenovirus F
cuggaacgagaucggcaccagcc

SEQ ID NO: 3941155 - RNA, 20 nt, Human adenovirus F
cuggaggcccuugugccuga

SEQ ID NO: 3941156 - RNA, 23 nt, Human adenovirus F
cuggauacuggcaagagccaccu

SEQ ID NO: 3941157 - RNA, 16 nt, Human adenovirus F
cuggcagcuggagcuu

SEQ ID NO: 3941158 - RNA, 13 nt, Human adenovirus F
cuggcccgcuugg

SEQ ID NO: 3941159 - RNA, 21 nt, Human adenovirus F
cuggccgacaagguggcggcc

SEQ ID NO: 3941160 - RNA, 22 nt, Human adenovirus F
cuggccuuuugaacgaccugca

SEQ ID NO: 3941161 - RNA, 18 nt, Human adenovirus F
cuggcuccgcggcacggc

SEQ ID NO: 3941162 - RNA, 20 nt, Human adenovirus F
cugggacagccuagacgagg

SEQ ID NO: 3941163 - RNA, 17 nt, Human adenovirus F
cugggcggcggccaugg

SEQ ID NO: 3941164 - RNA, 22 nt, Human adenovirus F
cugggcuggaugcauccuccca

SEQ ID NO: 3941165 - RNA, 18 nt, Human adenovirus F
cugggcuuauuggcauga

SEQ ID NO: 3941166 - RNA, 18 nt, Human adenovirus F
cuggggaauggagcugug

SEQ ID NO: 3941167 - RNA, 21 nt, Human adenovirus F
cugggguucauguugugcaga

SEQ ID NO: 3941168 - RNA, 19 nt, Human adenovirus F
cugguaaaccagcacacag

SEQ ID NO: 3941169 - RNA, 14 nt, Human adenovirus F
cuggucccuucccg

SEQ ID NO: 3941170 - RNA, 14 nt, Human adenovirus F
cugugagcgccagc

SEQ ID NO: 3941171 - RNA, 23 nt, Human adenovirus F
cugugaguuuugaggguggggug

SEQ ID NO: 3941172 - RNA, 13 nt, Human adenovirus F
cuguggagaaccu

SEQ ID NO: 3941173 - RNA, 13 nt, Human adenovirus F
cuguuacuauuaa

SEQ ID NO: 3941174 - RNA, 12 nt, Human adenovirus F
cuuaacagcauu

SEQ ID NO: 3941175 - RNA, 19 nt, Human adenovirus F
cuuaacucugaagaugucu

SEQ ID NO: 3941176 - RNA, 15 nt, Human adenovirus F
cuuacaaacaguaac

SEQ ID NO: 3941177 - RNA, 21 nt, Human adenovirus F
cuuaccgcgacaaagcacaca

SEQ ID NO: 3941178 - RNA, 14 nt, Human adenovirus F
cuuauacaccuccc

SEQ ID NO: 3941179 - RNA, 15 nt, Human adenovirus F
cuuaugcgcuguacu

SEQ ID NO: 3941180 - RNA, 20 nt, Human adenovirus F
cuuaugcgcuguacugugca

SEQ ID NO: 3941181 - RNA, 15 nt, Human adenovirus F
cuucaccaaugccau

SEQ ID NO: 3941182 - RNA, 11 nt, Human adenovirus F
cuucagcacuu

SEQ ID NO: 3941183 - RNA, 23 nt, Human adenovirus F
cuucaggcagcagccccaggcca

SEQ ID NO: 3941184 - RNA, 15 nt, Human adenovirus F
cuucaguugaaccac

SEQ ID NO: 3941185 - RNA, 14 nt, Human adenovirus F
cuuccaacccauga

SEQ ID NO: 3941186 - RNA, 13 nt, Human adenovirus F
cuuccuucacucc

SEQ ID NO: 3941187 - RNA, 18 nt, Human adenovirus F
cuucgaagugaugcaccu

SEQ ID NO: 3941188 - RNA, 15 nt, Human adenovirus F
cuucuaucugcaaaa

SEQ ID NO: 3941189 - RNA, 16 nt, Human adenovirus F
cuucuauugcacuuaa

SEQ ID NO: 3941190 - RNA, 19 nt, Human adenovirus F
cuucugugccugucaugaa

SEQ ID NO: 3941191 - RNA, 21 nt, Human adenovirus F
cuugaggagguguuggagaac

SEQ ID NO: 3941192 - RNA, 22 nt, Human adenovirus F
cuugcauaaaagcuucuaucug

SEQ ID NO: 3941193 - RNA, 15 nt, Human adenovirus F
cuugccacuggccuu

SEQ ID NO: 3941194 - RNA, 23 nt, Human adenovirus F
cuugccaggguucucuucaggcu

SEQ ID NO: 3941195 - RNA, 20 nt, Human adenovirus F
cuugcgcaacuucuuuuugg

SEQ ID NO: 3941196 - RNA, 16 nt, Human adenovirus F
cuugcucggugcagcc

SEQ ID NO: 3941197 - RNA, 20 nt, Human adenovirus F
cuuggaaucauccaccuggc

SEQ ID NO: 3941198 - RNA, 19 nt, Human adenovirus F
cuugggaggauuuugaguu

SEQ ID NO: 3941199 - RNA, 22 nt, Human adenovirus F
cuuuaaaaauagaaaacgaaaa

SEQ ID NO: 3941200 - RNA, 22 nt, Human adenovirus F
cuuuaacaacacaggagcuuua

SEQ ID NO: 3941201 - RNA, 12 nt, Human adenovirus F
cuuuacaaaaag

SEQ ID NO: 3941202 - RNA, 11 nt, Human adenovirus F
cuuuacaauua

SEQ ID NO: 3941203 - RNA, 14 nt, Human adenovirus F
cuuuaccccgacag

SEQ ID NO: 3941204 - RNA, 18 nt, Human adenovirus F
cuuuacccgacaacaaaa

SEQ ID NO: 3941205 - RNA, 15 nt, Human adenovirus F
cuuuaugacuauggu

SEQ ID NO: 3941206 - RNA, 14 nt, Human adenovirus F
cuuucaacaaaaag

SEQ ID NO: 3941207 - RNA, 19 nt, Human adenovirus F
cuuucaccgccuuggccag

SEQ ID NO: 3941208 - RNA, 16 nt, Human adenovirus F
cuuucaguuggagcag

SEQ ID NO: 3941209 - RNA, 17 nt, Human adenovirus F
cuuucccccuguaccac

SEQ ID NO: 3941210 - RNA, 15 nt, Human adenovirus F
cuuugccgucaaaag

SEQ ID NO: 3941211 - RNA, 20 nt, Human adenovirus F
cuuuugccacacuaaaguuu

SEQ ID NO: 3941212 - RNA, 15 nt, Human adenovirus F
cuuuuucccaaaaaa

SEQ ID NO: 3941213 - RNA, 17 nt, Human adenovirus F
gaaaaaaaauuuuccca

SEQ ID NO: 3941214 - RNA, 22 nt, Human adenovirus F
gaaaaacgggcggcaaaugcuc

SEQ ID NO: 3941215 - RNA, 13 nt, Human adenovirus F
gaaaaagacagca

SEQ ID NO: 3941216 - RNA, 17 nt, Human adenovirus F
gaaaacucaaacaacaa

SEQ ID NO: 3941217 - RNA, 18 nt, Human adenovirus F
gaaaaguacgaagcuagc

SEQ ID NO: 3941218 - RNA, 19 nt, Human adenovirus F
gaaaauagccgccagccuc

SEQ ID NO: 3941219 - RNA, 16 nt, Human adenovirus F
gaaaauccucaguguc

SEQ ID NO: 3941220 - RNA, 16 nt, Human adenovirus F
gaaacaaaagucaaau

SEQ ID NO: 3941221 - RNA, 19 nt, Human adenovirus F
gaaaccccuuugugcccuc

SEQ ID NO: 3941222 - RNA, 17 nt, Human adenovirus F
gaaaccuuaaccacccc

SEQ ID NO: 3941223 - RNA, 14 nt, Human adenovirus F
gaacaauaaaauau

SEQ ID NO: 3941224 - RNA, 15 nt, Human adenovirus F
gaaccaggcagugga

SEQ ID NO: 3941225 - RNA, 17 nt, Human adenovirus F
gaacccaacuauuuggg

SEQ ID NO: 3941226 - RNA, 21 nt, Human adenovirus F
gaacgaccauaguaacuuuca

SEQ ID NO: 3941227 - RNA, 21 nt, Human adenovirus F
gaacgaggagcgcaacuuuca

SEQ ID NO: 3941228 - RNA, 18 nt, Human adenovirus F
gaacgugaccgagcagcu

SEQ ID NO: 3941229 - RNA, 14 nt, Human adenovirus F
gaacguuuugacau

SEQ ID NO: 3941230 - RNA, 14 nt, Human adenovirus F
gaacuugaagccau

SEQ ID NO: 3941231 - RNA, 16 nt, Human adenovirus F
gaagagacccagguuu

SEQ ID NO: 3941232 - RNA, 17 nt, Human adenovirus F
gaagaggguacuagcag

SEQ ID NO: 3941233 - RNA, 12 nt, Human adenovirus F
gaagcaaucaac

SEQ ID NO: 3941234 - RNA, 22 nt, Human adenovirus F
gaagccaaaucgcgcaaccagu

SEQ ID NO: 3941235 - RNA, 15 nt, Human adenovirus F
gaagccuucaggcag

SEQ ID NO: 3941236 - RNA, 17 nt, Human adenovirus F
gaagccuucaggcagca

SEQ ID NO: 3941237 - RNA, 18 nt, Human adenovirus F
gaagcuugcccuuggaaa

SEQ ID NO: 3941238 - RNA, 17 nt, Human adenovirus F
gaaggaaacgcugugag

SEQ ID NO: 3941239 - RNA, 20 nt, Human adenovirus F
gaagguugacuugcaggaga

SEQ ID NO: 3941240 - RNA, 21 nt, Human adenovirus F
gaaucuaaccacuaccacccu

SEQ ID NO: 3941241 - RNA, 12 nt, Human adenovirus F
gaauuuuugcuu

SEQ ID NO: 3941242 - RNA, 14 nt, Human adenovirus F
gacaaaaucacugu

SEQ ID NO: 3941243 - RNA, 16 nt, Human adenovirus F
aaaaaggcuaaucauu

SEQ ID NO: 3941244 - RNA, 16 nt, Human adenovirus F
aaaaagguucugaagu

SEQ ID NO: 3941245 - RNA, 24 nt, Human adenovirus F
aaaacaaaccacgcccaugcagcc

SEQ ID NO: 3941246 - RNA, 14 nt, Human adenovirus F
aaaacuugcaagga

SEQ ID NO: 3941247 - RNA, 13 nt, Human adenovirus F
aaaauaacucacu

SEQ ID NO: 3941248 - RNA, 18 nt, Human adenovirus F
aaacacugcgcaaagucg

SEQ ID NO: 3941249 - RNA, 14 nt, Human adenovirus F
aaacaugaggagga

SEQ ID NO: 3941250 - RNA, 11 nt, Human adenovirus F
aaaccaaauca

SEQ ID NO: 3941251 - RNA, 21 nt, Human adenovirus F
aaacccguucggagccaaccu

SEQ ID NO: 3941252 - RNA, 21 nt, Human adenovirus F
aaaccgcgccauagcuggagg

SEQ ID NO: 3941253 - RNA, 19 nt, Human adenovirus F
aaaccuacgcccaggagca

SEQ ID NO: 3941254 - RNA, 14 nt, Human adenovirus F
aaaccuggcaacau

SEQ ID NO: 3941255 - RNA, 13 nt, Human adenovirus F
aaacgcugugagu

SEQ ID NO: 3941256 - RNA, 19 nt, Human adenovirus F
aaacgucccaucauuucca

SEQ ID NO: 3941257 - RNA, 21 nt, Human adenovirus F
aaacuaucccguguuugacaa

SEQ ID NO: 3941258 - RNA, 17 nt, Human adenovirus F
aaacuggaagauguccu

SEQ ID NO: 3941259 - RNA, 21 nt, Human adenovirus F
aaacuggcgccauguaauuca

SEQ ID NO: 3941260 - RNA, 15 nt, Human adenovirus F
aaagaagcacaggag

SEQ ID NO: 3941261 - RNA, 16 nt, Human adenovirus F
aaagacguuaaagcug

SEQ ID NO: 3941262 - RNA, 21 nt, Human adenovirus F
aaagagaguucaacagaauca

SEQ ID NO: 3941263 - RNA, 20 nt, Human adenovirus F
aaagcagugggacgaggagg

SEQ ID NO: 3941264 - RNA, 17 nt, Human adenovirus F
aaagcgagccaaagugc

SEQ ID NO: 3941265 - RNA, 16 nt, Human adenovirus F
aaagcuggagcucaca

SEQ ID NO: 3941266 - RNA, 21 nt, Human adenovirus F
aaaggaggucaagccaagcug

SEQ ID NO: 3941267 - RNA, 17 nt, Human adenovirus F
aaaggcgaaaagcggcc

SEQ ID NO: 3941268 - RNA, 16 nt, Human adenovirus F
aaaguagcucuuccaa

SEQ ID NO: 3941269 - RNA, 13 nt, Human adenovirus F
aaaguccagcgcg

SEQ ID NO: 3941270 - RNA, 14 nt, Human adenovirus F
aaagucggccaagu

SEQ ID NO: 3941271 - RNA, 23 nt, Human adenovirus F
aaagugcaagucacgaagaucac

SEQ ID NO: 3941272 - RNA, 14 nt, Human adenovirus F
aaaugacuaacucc

SEQ ID NO: 3941273 - RNA, 17 nt, Human adenovirus F
aaauguucacacucuaa

SEQ ID NO: 3941274 - RNA, 20 nt, Human adenovirus F
aaauuaauugcacuaacucc

SEQ ID NO: 3941275 - RNA, 17 nt, Human adenovirus F
aaauuacagccaaguca

SEQ ID NO: 3941276 - RNA, 21 nt, Human adenovirus F
aaauuuauucccgaagacuau

SEQ ID NO: 3941277 - RNA, 13 nt, Human adenovirus F
aacaaauacaguc

SEQ ID NO: 3941278 - RNA, 12 nt, Human adenovirus F
aacacaaacacg

SEQ ID NO: 3941279 - RNA, 11 nt, Human adenovirus F
aacacaggcgu

SEQ ID NO: 3941280 - RNA, 20 nt, Human adenovirus F
aacacgcugccaacaaaugu

SEQ ID NO: 3941281 - RNA, 18 nt, Human adenovirus F
aacacugcgauuagaaaa

SEQ ID NO: 3941282 - RNA, 21 nt, Human adenovirus F
aacagcagguuaaagccaacu

SEQ ID NO: 3941283 - RNA, 23 nt, Human adenovirus F
aacagcagguuaaagccaacucc

SEQ ID NO: 3941284 - RNA, 16 nt, Human adenovirus F
aacaguuaccaaggcg

SEQ ID NO: 3941285 - RNA, 20 nt, Human adenovirus F
aacaugcuguacgccaacuc

SEQ ID NO: 3941286 - RNA, 21 nt, Human adenovirus F
aaccuugaguuuaaugucucg

SEQ ID NO: 3941287 - RNA, 12 nt, Human adenovirus F
aacgagcaggcc

SEQ ID NO: 3941288 - RNA, 17 nt, Human adenovirus F
aacggcgugcuggaaag

SEQ ID NO: 3941289 - RNA, 20 nt, Human adenovirus F
aacgggguggaaagccuggu

SEQ ID NO: 3941290 - RNA, 22 nt, Human adenovirus F
aacguacucuuuugccacgcag

SEQ ID NO: 3941291 - RNA, 16 nt, Human adenovirus F
aacgucaacuccucuu

SEQ ID NO: 3941292 - RNA, 15 nt, Human adenovirus F
aacgucaaugccaau

SEQ ID NO: 3941293 - RNA, 20 nt, Human adenovirus F
aacgugaccgagcagcugcg

SEQ ID NO: 3941294 - RNA, 22 nt, Human adenovirus F
aacuccaaccaagaaauacaaa

SEQ ID NO: 3941295 - RNA, 22 nt, Human adenovirus F
aacuccgacauguuugucuuua

SEQ ID NO: 3941296 - RNA, 13 nt, Human adenovirus F
aacuuuacaaaau

SEQ ID NO: 3941297 - RNA, 14 nt, Human adenovirus F
aacuuuacaaaaug

SEQ ID NO: 3941298 - RNA, 18 nt, Human adenovirus F
aacuuuuugcccaccgcc

SEQ ID NO: 3941299 - RNA, 21 nt, Human adenovirus F
aagaaauccacuuaccagagc

SEQ ID NO: 3941300 - RNA, 24 nt, Human adenovirus F
aagaagcacaggagauccguggag

SEQ ID NO: 3941301 - RNA, 15 nt, Human adenovirus F
aagacaaaaucacug

SEQ ID NO: 3941302 - RNA, 15 nt, Human adenovirus F
aagacaucaauuuug

SEQ ID NO: 3941303 - RNA, 17 nt, Human adenovirus F
aagaccaacugcagcgc

SEQ ID NO: 3941304 - RNA, 20 nt, Human adenovirus F
aagagcaaaaccuccaggag

SEQ ID NO: 3941305 - RNA, 21 nt, Human adenovirus F
aagaguuuuuacaacgagcag

SEQ ID NO: 3941306 - RNA, 21 nt, Human adenovirus F
aagaugacuucaaccccgucu

SEQ ID NO: 3941307 - RNA, 16 nt, Human adenovirus F
aagaugcgauuuucca

SEQ ID NO: 3941308 - RNA, 23 nt, Human adenovirus F
aagcaaucaaccaacuaacacug

SEQ ID NO: 3941309 - RNA, 16 nt, Human adenovirus F
aagcccggguccaggc

SEQ ID NO: 3941310 - RNA, 16 nt, Human adenovirus F
aagccuucaggcagca

SEQ ID NO: 3941311 - RNA, 19 nt, Human adenovirus F
aagcgcggccgcuacggag

SEQ ID NO: 3941312 - RNA, 19 nt, Human adenovirus F
aagcugcggaaaugcuuua

SEQ ID NO: 3941313 - RNA, 18 nt, Human adenovirus F
aagcuggguggaaagcaa

SEQ ID NO: 3941314 - RNA, 18 nt, Human adenovirus F
aagcuucuuguacucaaa

SEQ ID NO: 3941315 - RNA, 19 nt, Human adenovirus F
aagcuucuuguacucaaau

SEQ ID NO: 3941316 - RNA, 16 nt, Human adenovirus F
aaggaauguggggcgu

SEQ ID NO: 3941317 - RNA, 14 nt, Human adenovirus F
aagggcucugccug

SEQ ID NO: 3941318 - RNA, 16 nt, Human adenovirus F
aagguaaucaggagaa

SEQ ID NO: 3941319 - RNA, 19 nt, Human adenovirus F
aagguauuaacaaaucgau

SEQ ID NO: 3941320 - RNA, 15 nt, Human adenovirus F
aagucguggacgggc

SEQ ID NO: 3941321 - RNA, 23 nt, Human adenovirus F
aagugucccacugcaacucgcag

SEQ ID NO: 3941322 - RNA, 13 nt, Human adenovirus F
aaguuauacagug

SEQ ID NO: 3941323 - RNA, 13 nt, Human adenovirus F
aauauccuucaga

SEQ ID NO: 3941324 - RNA, 13 nt, Human adenovirus F
aauauuggcuacc

SEQ ID NO: 3941325 - RNA, 19 nt, Human adenovirus F
aaucacgaccucccaaagu

SEQ ID NO: 3941326 - RNA, 23 nt, Human adenovirus F
aaucagggcgugcaagugggcuc

SEQ ID NO: 3941327 - RNA, 12 nt, Human adenovirus F
aaucccagcaga

SEQ ID NO: 3941328 - RNA, 14 nt, Human adenovirus F
aaugcgggcucuga

SEQ ID NO: 3941329 - RNA, 21 nt, Human adenovirus F
aaugcuagcccgaacauaguc

SEQ ID NO: 3941330 - RNA, 19 nt, Human adenovirus F
aaugcuggucugcgcuacc

SEQ ID NO: 3941331 - RNA, 11 nt, Human adenovirus F
aauggcucugc

SEQ ID NO: 3941332 - RNA, 15 nt, Human adenovirus F
aaugguaccacgcag

SEQ ID NO: 3941333 - RNA, 13 nt, Human adenovirus F
aauuccacuggca

SEQ ID NO: 3941334 - RNA, 18 nt, Human adenovirus F
aauuguaacugagccuga

SEQ ID NO: 3941335 - RNA, 17 nt, Human adenovirus F
acaaaauggguuacuuu

SEQ ID NO: 3941336 - RNA, 20 nt, Human adenovirus F
acaaacacgcauguaaauuu

SEQ ID NO: 3941337 - RNA, 22 nt, Human adenovirus F
acaaaucgauuaaguugggagg

SEQ ID NO: 3941338 - RNA, 17 nt, Human adenovirus F
acaacccgucuucccuc

SEQ ID NO: 3941339 - RNA, 21 nt, Human adenovirus F
acaagcaaagacagagcuuua

SEQ ID NO: 3941340 - RNA, 11 nt, Human adenovirus F
acaagggcuuc

SEQ ID NO: 3941341 - RNA, 18 nt, Human adenovirus F
acaauccuaacaaaaacu

SEQ ID NO: 3941342 - RNA, 19 nt, Human adenovirus F
acaauuaaaggucuuaaag

SEQ ID NO: 3941343 - RNA, 22 nt, Human adenovirus F
acacaaacauagcaaaagcauu

SEQ ID NO: 3941344 - RNA, 16 nt, Human adenovirus F
acacaaugcaaaaugu

SEQ ID NO: 3941345 - RNA, 20 nt, Human adenovirus F
acacauccauuaaaauuucu

SEQ ID NO: 3941346 - RNA, 23 nt, Human adenovirus F
acaccaccccuagucccuccucc

SEQ ID NO: 3941347 - RNA, 16 nt, Human adenovirus F
acaccaguagcuugga

SEQ ID NO: 3941348 - RNA, 13 nt, Human adenovirus F
acaccccccgccu

SEQ ID NO: 3941349 - RNA, 15 nt, Human adenovirus F
acaccgcuuccaccu

SEQ ID NO: 3941350 - RNA, 20 nt, Human adenovirus F
acacgcauguaaauuuugca

SEQ ID NO: 3941351 - RNA, 12 nt, Human adenovirus F
acacgcugccaa

SEQ ID NO: 3941352 - RNA, 14 nt, Human adenovirus F
acacucccuuugcc

SEQ ID NO: 3941353 - RNA, 21 nt, Human adenovirus F
acacuggcuggcccuggccug

SEQ ID NO: 3941354 - RNA, 16 nt, Human adenovirus F
acacuuuugccaaagu

SEQ ID NO: 3941355 - RNA, 17 nt, Human adenovirus F
acagaugucauaaacgu

SEQ ID NO: 3941356 - RNA, 17 nt, Human adenovirus F
acagcagguuaaagcca

SEQ ID NO: 3941357 - RNA, 18 nt, Human adenovirus F
acagccuagacgaggagg

SEQ ID NO: 3941358 - RNA, 18 nt, Human adenovirus F
acagcguagcacucccuc

SEQ ID NO: 3941359 - RNA, 12 nt, Human adenovirus F
acaggagcgcag

SEQ ID NO: 3941360 - RNA, 20 nt, Human adenovirus F
acaucaggggcucaggaacc

SEQ ID NO: 3941361 - RNA, 14 nt, Human adenovirus F
acaugaacacuucc

SEQ ID NO: 3941362 - RNA, 15 nt, Human adenovirus F
acaugcgcuccaaca

SEQ ID NO: 3941363 - RNA, 23 nt, Human adenovirus F
acauuggcuggaggcuugggagg

SEQ ID NO: 3941364 - RNA, 15 nt, Human adenovirus F
acauuucgugggaag

SEQ ID NO: 3941365 - RNA, 16 nt, Human adenovirus F
accaaaggugguucug

SEQ ID NO: 3941366 - RNA, 19 nt, Human adenovirus F
accaaucacgaccucccaa

SEQ ID NO: 3941367 - RNA, 21 nt, Human adenovirus F
accaccucuucuucuuccucc

SEQ ID NO: 3941368 - RNA, 14 nt, Human adenovirus F
accacgcugcgccc

SEQ ID NO: 3941369 - RNA, 14 nt, Human adenovirus F
accacggugguaca

SEQ ID NO: 3941370 - RNA, 19 nt, Human adenovirus F
accacucaauuaaccuugc

SEQ ID NO: 3941371 - RNA, 14 nt, Human adenovirus F
accacuucgggaga

SEQ ID NO: 3941372 - RNA, 21 nt, Human adenovirus F
accagcacacagggauacugg

SEQ ID NO: 3941373 - RNA, 17 nt, Human adenovirus F
accaguccgggccagac

SEQ ID NO: 3941374 - RNA, 18 nt, Human adenovirus F
accaucuuucaaaaaacc

SEQ ID NO: 3941375 - RNA, 19 nt, Human adenovirus F
ugggaacuguccagggagu

SEQ ID NO: 3941376 - RNA, 14 nt, Human adenovirus F
ugggacagccuaga

SEQ ID NO: 3941377 - RNA, 16 nt, Human adenovirus F
ugggacagcggaggca

SEQ ID NO: 3941378 - RNA, 15 nt, Human adenovirus F
ugggacgaggaggag

SEQ ID NO: 3941379 - RNA, 15 nt, Human adenovirus F
ugggauuacaaauuu

SEQ ID NO: 3941380 - RNA, 14 nt, Human adenovirus F
ugggcaaaggggga

SEQ ID NO: 3941381 - RNA, 19 nt, Human adenovirus F
ugggcacguuugacaaacg

SEQ ID NO: 3941382 - RNA, 16 nt, Human adenovirus F
ugggcauaacuucagc

SEQ ID NO: 3941383 - RNA, 20 nt, Human adenovirus F
ugggcauaacuucagcacuu

SEQ ID NO: 3941384 - RNA, 18 nt, Human adenovirus F
ugggcauaguugcuccca

SEQ ID NO: 3941385 - RNA, 23 nt, Human adenovirus F
ugggcauaguugcucccaaagug

SEQ ID NO: 3941386 - RNA, 18 nt, Human adenovirus F
ugggcucagacuccaaca

SEQ ID NO: 3941387 - RNA, 19 nt, Human adenovirus F
uggggggaaccggcgccgc

SEQ ID NO: 3941388 - RNA, 20 nt, Human adenovirus F
uggguguauaaaagggggcg

SEQ ID NO: 3941389 - RNA, 13 nt, Human adenovirus F
ugguacaggagcg

SEQ ID NO: 3941390 - RNA, 13 nt, Human adenovirus F
ugguagcaguguc

SEQ ID NO: 3941391 - RNA, 11 nt, Human adenovirus F
ugguuggaaaa

SEQ ID NO: 3941392 - RNA, 18 nt, Human adenovirus F
uguacguuuguugcaugu

SEQ ID NO: 3941393 - RNA, 21 nt, Human adenovirus F
uguacuacaauuccacuggca

SEQ ID NO: 3941394 - RNA, 14 nt, Human adenovirus F
uguacucaaaugua

SEQ ID NO: 3941395 - RNA, 18 nt, Human adenovirus F
uguacucaaauguagccc

SEQ ID NO: 3941396 - RNA, 14 nt, Human adenovirus F
uguaguugauaguu

SEQ ID NO: 3941397 - RNA, 14 nt, Human adenovirus F
ugucaggcucugag

SEQ ID NO: 3941398 - RNA, 21 nt, Human adenovirus F
uguccauauuauuuaaauaaa

SEQ ID NO: 3941399 - RNA, 14 nt, Human adenovirus F
uguccgccgccgcu

SEQ ID NO: 3941400 - RNA, 22 nt, Human adenovirus F
ugucugccaauuaucuacgccu

SEQ ID NO: 3941401 - RNA, 20 nt, Human adenovirus F
ugucuuaccaguuaaugcuu

SEQ ID NO: 3941402 - RNA, 12 nt, Human adenovirus F
ugugacaaaauc

SEQ ID NO: 3941403 - RNA, 19 nt, Human adenovirus F
uguggaaucccgcgagccc

SEQ ID NO: 3941404 - RNA, 20 nt, Human adenovirus F
uguggggcgugcgagccccc

SEQ ID NO: 3941405 - RNA, 21 nt, Human adenovirus F
uguguuuuuuacugcuaaagg

SEQ ID NO: 3941406 - RNA, 24 nt, Human adenovirus F
uguucaccuuuuuacccugaccca

SEQ ID NO: 3941407 - RNA, 21 nt, Human adenovirus F
uguucacugaaagccagccgu

SEQ ID NO: 3941408 - RNA, 14 nt, Human adenovirus F
uguuucacauaucg

SEQ ID NO: 3941409 - RNA, 18 nt, Human adenovirus F
uguuuugggucaaaaacc

SEQ ID NO: 3941410 - RNA, 15 nt, Human adenovirus F
uuaaccauggagcua

SEQ ID NO: 3941411 - RNA, 18 nt, Human adenovirus F
uuaaguauucaccaccuu

SEQ ID NO: 3941412 - RNA, 18 nt, Human adenovirus F
uuaaugggcaaaggggga

SEQ ID NO: 3941413 - RNA, 12 nt, Human adenovirus F
uuacaaaaagag

SEQ ID NO: 3941414 - RNA, 17 nt, Human adenovirus F
uuacaaccaaaaacggg

SEQ ID NO: 3941415 - RNA, 18 nt, Human adenovirus F
uuaccccgacagaggccg

SEQ ID NO: 3941416 - RNA, 13 nt, Human adenovirus F
uuacgucagcuac

SEQ ID NO: 3941417 - RNA, 17 nt, Human adenovirus F
uuagcgcacugguaaac

SEQ ID NO: 3941418 - RNA, 15 nt, Human adenovirus F
uuauacaccucccuu

SEQ ID NO: 3941419 - RNA, 15 nt, Human adenovirus F
uuauauuuuaauuuu

SEQ ID NO: 3941420 - RNA, 20 nt, Human adenovirus F
uucaacggaauuguaacuga

SEQ ID NO: 3941421 - RNA, 18 nt, Human adenovirus F
uucagccacuccugcagu

SEQ ID NO: 3941422 - RNA, 22 nt, Human adenovirus F
uucccacuguuucuccuccccu

SEQ ID NO: 3941423 - RNA, 15 nt, Human adenovirus F
uuccuauuacagccc

SEQ ID NO: 3941424 - RNA, 15 nt, Human adenovirus F
uucgccuggagaggc

SEQ ID NO: 3941425 - RNA, 15 nt, Human adenovirus F
uucgcgcaacuuuug

SEQ ID NO: 3941426 - RNA, 15 nt, Human adenovirus F
uucuccugcuugucu

SEQ ID NO: 3941427 - RNA, 22 nt, Human adenovirus F
uucuggacucgucuccugcaag

SEQ ID NO: 3941428 - RNA, 13 nt, Human adenovirus F
uucuuugccaccu

SEQ ID NO: 3941429 - RNA, 16 nt, Human adenovirus F
uugaagaacugggagu

SEQ ID NO: 3941430 - RNA, 12 nt, Human adenovirus F
uugacuugcagg

SEQ ID NO: 3941431 - RNA, 17 nt, Human adenovirus F
uugcgcuaugugcagca

SEQ ID NO: 3941432 - RNA, 16 nt, Human adenovirus F
uugcggugccugaagc

SEQ ID NO: 3941433 - RNA, 17 nt, Human adenovirus F
uugcuacggaggaagag

SEQ ID NO: 3941434 - RNA, 17 nt, Human adenovirus F
uugcucggcgaaaacuc

SEQ ID NO: 3941435 - RNA, 14 nt, Human adenovirus F
uugcugacagcugg

SEQ ID NO: 3941436 - RNA, 17 nt, Human adenovirus F
uuggagcagccugugga

SEQ ID NO: 3941437 - RNA, 17 nt, Human adenovirus F
uuggcagcaacauaacu

SEQ ID NO: 3941438 - RNA, 21 nt, Human adenovirus F
uuggcuggaggcuugggagga

SEQ ID NO: 3941439 - RNA, 17 nt, Human adenovirus F
uugguaacaaggccugg

SEQ ID NO: 3941440 - RNA, 11 nt, Human adenovirus F
uugucugucug

SEQ ID NO: 3941441 - RNA, 12 nt, Human adenovirus F
uugucuguuuuu

SEQ ID NO: 3941442 - RNA, 16 nt, Human adenovirus F
uugugggucugggagu

SEQ ID NO: 3941443 - RNA, 19 nt, Human adenovirus F
uuuaagaaacgaacacgcu

SEQ ID NO: 3941444 - RNA, 14 nt, Human adenovirus F
uuuaauggaaacug

SEQ ID NO: 3941445 - RNA, 20 nt, Human adenovirus F
uuuaauggcacaguguuugc

SEQ ID NO: 3941446 - RNA, 21 nt, Human adenovirus F
uuuaucuguaaaacuucccuu

SEQ ID NO: 3941447 - RNA, 11 nt, Human adenovirus F
uuuccagcaga

SEQ ID NO: 3941448 - RNA, 23 nt, Human adenovirus F
uuuccagcauaauaacucuggcu

SEQ ID NO: 3941449 - RNA, 22 nt, Human adenovirus F
uuugaacagcugaagacacauu

SEQ ID NO: 3941450 - RNA, 12 nt, Human adenovirus F
uuugacagcauu

SEQ ID NO: 3941451 - RNA, 21 nt, Human adenovirus F
uuugcgcaggcgaauaaaagg

SEQ ID NO: 3941452 - RNA, 14 nt, Human adenovirus F
gcauccauaaaggu

SEQ ID NO: 3941453 - RNA, 14 nt, Human adenovirus F
gcaucuaucuuuuc

SEQ ID NO: 3941454 - RNA, 18 nt, Human adenovirus F
gcaucucuugaaugaggu

SEQ ID NO: 3941455 - RNA, 21 nt, Human adenovirus F
gcauguuuucuccauaccaga

SEQ ID NO: 3941456 - RNA, 11 nt, Human adenovirus F
gccaacucgac

SEQ ID NO: 3941457 - RNA, 17 nt, Human adenovirus F
gccaccagccggaggag

SEQ ID NO: 3941458 - RNA, 18 nt, Human adenovirus F
gccaccagccggaggagu

SEQ ID NO: 3941459 - RNA, 16 nt, Human adenovirus F
gccacccaagggaaac

SEQ ID NO: 3941460 - RNA, 13 nt, Human adenovirus F
gccaccuccaccg

SEQ ID NO: 3941461 - RNA, 19 nt, Human adenovirus F
gccaggcguacuuaacgcu

SEQ ID NO: 3941462 - RNA, 18 nt, Human adenovirus F
gccaggguucucuucagg

SEQ ID NO: 3941463 - RNA, 20 nt, Human adenovirus F
gccaucuucccgcaaaagcg

SEQ ID NO: 3941464 - RNA, 14 nt, Human adenovirus F
gccauucuucucuu

SEQ ID NO: 3941465 - RNA, 20 nt, Human adenovirus F
gccauuuaccaauagcagca

SEQ ID NO: 3941466 - RNA, 16 nt, Human adenovirus F
gcccacugaccggcac

SEQ ID NO: 3941467 - RNA, 21 nt, Human adenovirus F
gcccaggagcagcgggaagag

SEQ ID NO: 3941468 - RNA, 12 nt, Human adenovirus F
gccccaccgccc

SEQ ID NO: 3941469 - RNA, 21 nt, Human adenovirus F
gcccccaaaggugcucccaau

SEQ ID NO: 3941470 - RNA, 17 nt, Human adenovirus F
gccccgguugugcagug

SEQ ID NO: 3941471 - RNA, 11 nt, Human adenovirus F
gccccuggccu

SEQ ID NO: 3941472 - RNA, 14 nt, Human adenovirus F
gccccuuggugaag

SEQ ID NO: 3941473 - RNA, 21 nt, Human adenovirus F
gcccgcugagcguucucgcuc

SEQ ID NO: 3941474 - RNA, 15 nt, Human adenovirus F
gcccggguccaggcu

SEQ ID NO: 3941475 - RNA, 20 nt, Human adenovirus F
gcccguggaaaaagacagca

SEQ ID NO: 3941476 - RNA, 21 nt, Human adenovirus F
gcccuuaaguauucaccaccu

SEQ ID NO: 3941477 - RNA, 17 nt, Human adenovirus F
gccgagcuuuuacuggg

SEQ ID NO: 3941478 - RNA, 21 nt, Human adenovirus F
gccgccccuggccuguuuuug

SEQ ID NO: 3941479 - RNA, 16 nt, Human adenovirus F
gccgccgugccagaaa

SEQ ID NO: 3941480 - RNA, 20 nt, Human adenovirus F
gccgcgccaaccguacacgc

SEQ ID NO: 3941481 - RNA, 21 nt, Human adenovirus F
gccgcugucguuaguggaggc

SEQ ID NO: 3941482 - RNA, 22 nt, Human adenovirus F
gccggagaggggaggaaguagg

SEQ ID NO: 3941483 - RNA, 23 nt, Human adenovirus F
gccgucguacaaguugcaaagcu

SEQ ID NO: 3941484 - RNA, 21 nt, Human adenovirus F
gccuaagugugacauuacuuc

SEQ ID NO: 3941485 - RNA, 19 nt, Human adenovirus F
gccuacggcaagcgcggcc

SEQ ID NO: 3941486 - RNA, 15 nt, Human adenovirus F
gccucaaguggggca

SEQ ID NO: 3941487 - RNA, 19 nt, Human adenovirus F
gccucaaguggggcagacg

SEQ ID NO: 3941488 - RNA, 11 nt, Human adenovirus F
gccucccuuug

SEQ ID NO: 3941489 - RNA, 13 nt, Human adenovirus F
gccuccugguggc

SEQ ID NO: 3941490 - RNA, 14 nt, Human adenovirus F
gccugagggcgacg

SEQ ID NO: 3941491 - RNA, 13 nt, Human adenovirus F
gccuucaggcagc

SEQ ID NO: 3941492 - RNA, 16 nt, Human adenovirus F
gccuugcaagcagcuc

SEQ ID NO: 3941493 - RNA, 18 nt, Human adenovirus F
gcgagcccccguggggga

SEQ ID NO: 3941494 - RNA, 22 nt, Human adenovirus F
gcgaguuugacgugccugaggg

SEQ ID NO: 3941495 - RNA, 16 nt, Human adenovirus F
gcgauccggcacuuga

SEQ ID NO: 3941496 - RNA, 19 nt, Human adenovirus F
gcgcaacuuuugcaccagg

SEQ ID NO: 3941497 - RNA, 15 nt, Human adenovirus F
gcgcacccugguggc

SEQ ID NO: 3941498 - RNA, 22 nt, Human adenovirus F
gcgcacggcccccaucucugug

SEQ ID NO: 3941499 - RNA, 21 nt, Human adenovirus F
gcgcagcaguaucaguggagu

SEQ ID NO: 3941500 - RNA, 17 nt, Human adenovirus F
gcgccacucgggaaaga

SEQ ID NO: 3941501 - RNA, 15 nt, Human adenovirus F
gcgccauagcuggag

SEQ ID NO: 3941502 - RNA, 17 nt, Human adenovirus F
gcgccauagcuggaggg

SEQ ID NO: 3941503 - RNA, 16 nt, Human adenovirus F
gcgccgagcggcugcu

SEQ ID NO: 3941504 - RNA, 19 nt, Human adenovirus F
gcgcgcuucgccuccuggu

SEQ ID NO: 3941505 - RNA, 13 nt, Human adenovirus F
gcgcggcggccau

SEQ ID NO: 3941506 - RNA, 13 nt, Human adenovirus F
gcgcgggcaggag

SEQ ID NO: 3941507 - RNA, 15 nt, Human adenovirus F
gcgcugcuacucaac

SEQ ID NO: 3941508 - RNA, 21 nt, Human adenovirus F
gcggaaaccaagggcucugcc

SEQ ID NO: 3941509 - RNA, 14 nt, Human adenovirus F
gcggacccgucucc

SEQ ID NO: 3941510 - RNA, 17 nt, Human adenovirus F
gcggaggugccccagag

SEQ ID NO: 3941511 - RNA, 19 nt, Human adenovirus F
gcggaggugccccagagug

SEQ ID NO: 3941512 - RNA, 15 nt, Human adenovirus F
gcggaguaacacaaa

SEQ ID NO: 3941513 - RNA, 17 nt, Human adenovirus F
gcggaugguggcaagga

SEQ ID NO: 3941514 - RNA, 23 nt, Human adenovirus F
gcggaugguggcaaggagaguga

SEQ ID NO: 3941515 - RNA, 17 nt, Human adenovirus F
gcggccguuuaugggca

SEQ ID NO: 3941516 - RNA, 14 nt, Human adenovirus F
gcggcggccaugga

SEQ ID NO: 3941517 - RNA, 13 nt, Human adenovirus F
gcgggaagagagg

SEQ ID NO: 3941518 - RNA, 12 nt, Human adenovirus F
gcgggaagagga

SEQ ID NO: 3941519 - RNA, 13 nt, Human adenovirus F
gcgggcaggagcc

SEQ ID NO: 3941520 - RNA, 14 nt, Human adenovirus F
gcgggcggcgccag

SEQ ID NO: 3941521 - RNA, 16 nt, Human adenovirus F
gcgggcucugauaaug

SEQ ID NO: 3941522 - RNA, 16 nt, Human adenovirus F
ugaaauuaauugcacu

SEQ ID NO: 3941523 - RNA, 20 nt, Human adenovirus F
ugaaccggaaaaccaacgcu

SEQ ID NO: 3941524 - RNA, 19 nt, Human adenovirus F
ugaaguuaccaaagacaaa

SEQ ID NO: 3941525 - RNA, 19 nt, Human adenovirus F
ugacaaacgcuuuccgggu

SEQ ID NO: 3941526 - RNA, 17 nt, Human adenovirus F
ugacacgcgcaacuucc

SEQ ID NO: 3941527 - RNA, 17 nt, Human adenovirus F
ugacacgggcacucuuc

SEQ ID NO: 3941528 - RNA, 17 nt, Human adenovirus F
ugaccaucacugacgcc

SEQ ID NO: 3941529 - RNA, 11 nt, Human adenovirus F
ugaccuguggg

SEQ ID NO: 3941530 - RNA, 22 nt, Human adenovirus F
ugaccugugggucgcagcaggu

SEQ ID NO: 3941531 - RNA, 18 nt, Human adenovirus F
ugaccuuagaacuaccuc

SEQ ID NO: 3941532 - RNA, 16 nt, Human adenovirus F
ugagaauuauugaaaa

SEQ ID NO: 3941533 - RNA, 22 nt, Human adenovirus F
ugagcaaagacauucccacgcc

SEQ ID NO: 3941534 - RNA, 15 nt, Human adenovirus F
ugagcgccagccgcc

SEQ ID NO: 3941535 - RNA, 18 nt, Human adenovirus F
ugagugggguaacuuuua

SEQ ID NO: 3941536 - RNA, 19 nt, Human adenovirus F
ugaucuuauggaagacucu

SEQ ID NO: 3941537 - RNA, 20 nt, Human adenovirus F
ugaugaagcgugguaaaagg

SEQ ID NO: 3941538 - RNA, 12 nt, Human adenovirus F
ugauggcagcag

SEQ ID NO: 3941539 - RNA, 15 nt, Human adenovirus F
ugauguaacagcuuu

SEQ ID NO: 3941540 - RNA, 15 nt, Human adenovirus F
ugauuucauuuacca

SEQ ID NO: 3941541 - RNA, 12 nt, Human adenovirus F
ugauuuggaaga

SEQ ID NO: 3941542 - RNA, 19 nt, Human adenovirus F
ugauuuucuuugccaccuu

SEQ ID NO: 3941543 - RNA, 22 nt, Human adenovirus F
ugcaaaucuauuucuuugucua

SEQ ID NO: 3941544 - RNA, 14 nt, Human adenovirus F
ugcaacuuggaagg

SEQ ID NO: 3941545 - RNA, 20 nt, Human adenovirus F
ugcaauggcagcccagcgcc

SEQ ID NO: 3941546 - RNA, 14 nt, Human adenovirus F
ugcacacagacucc

SEQ ID NO: 3941547 - RNA, 21 nt, Human adenovirus F
ugcaccgcgcggcggccauga

SEQ ID NO: 3941548 - RNA, 22 nt, Human adenovirus F
ugcacuuuuggccuuugucugu

SEQ ID NO: 3941549 - RNA, 22 nt, Human adenovirus F
ugcagacaagacauggaagaca

SEQ ID NO: 3941550 - RNA, 23 nt, Human adenovirus F
ugcagagcuugggcccugggcuu

SEQ ID NO: 3941551 - RNA, 15 nt, Human adenovirus F
ugcagcgcacgcugg

SEQ ID NO: 3941552 - RNA, 13 nt, Human adenovirus F
ugcagcugcugcc

SEQ ID NO: 3941553 - RNA, 17 nt, Human adenovirus F
ugcaucuaucuuuuccu

SEQ ID NO: 3941554 - RNA, 18 nt, Human adenovirus F
ugccaauuaucuacgccu

SEQ ID NO: 3941555 - RNA, 19 nt, Human adenovirus F
ugccacccaagggaaacaa

SEQ ID NO: 3941556 - RNA, 16 nt, Human adenovirus F
ugccacucgaaaccaa

SEQ ID NO: 3941557 - RNA, 21 nt, Human adenovirus F
ugccaggcggcgaugaaacuu

SEQ ID NO: 3941558 - RNA, 14 nt, Human adenovirus F
ugcccgccagcugg

SEQ ID NO: 3941559 - RNA, 13 nt, Human adenovirus F
ugccggcccccac

SEQ ID NO: 3941560 - RNA, 15 nt, Human adenovirus F
ugccggcucuaggca

SEQ ID NO: 3941561 - RNA, 15 nt, Human adenovirus F
ugccuccagcacugc

SEQ ID NO: 3941562 - RNA, 16 nt, Human adenovirus F
ugccugacucuuacaa

SEQ ID NO: 3941563 - RNA, 17 nt, Human adenovirus F
ugcgagaugcgucgggc

SEQ ID NO: 3941564 - RNA, 21 nt, Human adenovirus F
ugcgcaccaauaugcccaaca

SEQ ID NO: 3941565 - RNA, 22 nt, Human adenovirus F
ugcgccgagcggcugcuucugc

SEQ ID NO: 3941566 - RNA, 18 nt, Human adenovirus F
ugcgcuguacugugcauu

SEQ ID NO: 3941567 - RNA, 16 nt, Human adenovirus F
ugcguggauuccuggg

SEQ ID NO: 3941568 - RNA, 11 nt, Human adenovirus F
ugcuaccuggu

SEQ ID NO: 3941569 - RNA, 23 nt, Human adenovirus F
ugcuacucaacagaaaccucuuc

SEQ ID NO: 3941570 - RNA, 15 nt, Human adenovirus F
ugcuccugcccgggu

SEQ ID NO: 3941571 - RNA, 17 nt, Human adenovirus F
ugcuccuggcgagccca

SEQ ID NO: 3941572 - RNA, 15 nt, Human adenovirus F
ugcucggugcagccg

SEQ ID NO: 3941573 - RNA, 17 nt, Human adenovirus F
ugcugaauauugcggag

SEQ ID NO: 3941574 - RNA, 21 nt, Human adenovirus F
uggaagagggcgaggggcugg

SEQ ID NO: 3941575 - RNA, 13 nt, Human adenovirus F
uggaccuggaaga

SEQ ID NO: 3941576 - RNA, 18 nt, Human adenovirus F
uggagaucuuucuucaga

SEQ ID NO: 3941577 - RNA, 16 nt, Human adenovirus F
uggagcagccugugga

SEQ ID NO: 3941578 - RNA, 14 nt, Human adenovirus F
uggagccgacuuca

SEQ ID NO: 3941579 - RNA, 22 nt, Human adenovirus F
uggauccagugcaggaagagga

SEQ ID NO: 3941580 - RNA, 16 nt, Human adenovirus F
uggcaacaugggagug

SEQ ID NO: 3941581 - RNA, 16 nt, Human adenovirus F
uggcacagcaaacaca

SEQ ID NO: 3941582 - RNA, 19 nt, Human adenovirus F
uggcacaguguuugcuucu

SEQ ID NO: 3941583 - RNA, 17 nt, Human adenovirus F
uggcccaccacucugau

SEQ ID NO: 3941584 - RNA, 22 nt, Human adenovirus F
uggccgacaagguggcggccau

SEQ ID NO: 3941585 - RNA, 21 nt, Human adenovirus F
uggccgcacucagcgaaccca

SEQ ID NO: 3941586 - RNA, 22 nt, Human adenovirus F
uggccugaauuuuuagguuggc

SEQ ID NO: 3941587 - RNA, 18 nt, Human adenovirus F
uggcgccggcgggaagag

SEQ ID NO: 3941588 - RNA, 18 nt, Human adenovirus F
uggcggcuaacuugugga

SEQ ID NO: 3941589 - RNA, 14 nt, Human adenovirus F
uggcucuguggaga

SEQ ID NO: 3941590 - RNA, 16 nt, Human adenovirus F
ugggaacuguccaggg

SEQ ID NO: 3941591 - RNA, 17 nt, Human adenovirus F
gacaaagcacacagaac

SEQ ID NO: 3941592 - RNA, 23 nt, Human adenovirus F
gacaaccggguuuuggacauggc

SEQ ID NO: 3941593 - RNA, 20 nt, Human adenovirus F
gacaacggacgugagagagg

SEQ ID NO: 3941594 - RNA, 17 nt, Human adenovirus F
gacaagguggcggccau

SEQ ID NO: 3941595 - RNA, 12 nt, Human adenovirus F
gacagcaggccg

SEQ ID NO: 3941596 - RNA, 21 nt, Human adenovirus F
gacagggcgcuaacugugcau

SEQ ID NO: 3941597 - RNA, 19 nt, Human adenovirus F
gacaugggggcggaccugc

SEQ ID NO: 3941598 - RNA, 20 nt, Human adenovirus F
gacauguuugucuuuaaaaa

SEQ ID NO: 3941599 - RNA, 17 nt, Human adenovirus F
gaccacaacaacaaacg

SEQ ID NO: 3941600 - RNA, 18 nt, Human adenovirus F
gaccacuggagggcguca

SEQ ID NO: 3941601 - RNA, 14 nt, Human adenovirus F
gaccauauccauua

SEQ ID NO: 3941602 - RNA, 15 nt, Human adenovirus F
gaccccauggaugag

SEQ ID NO: 3941603 - RNA, 15 nt, Human adenovirus F
gaccccguuugcccg

SEQ ID NO: 3941604 - RNA, 18 nt, Human adenovirus F
gaccgcuagggcgcgcuc

SEQ ID NO: 3941605 - RNA, 15 nt, Human adenovirus F
gaccggcgcugggac

SEQ ID NO: 3941606 - RNA, 20 nt, Human adenovirus F
gaccucauccgccauugcca

SEQ ID NO: 3941607 - RNA, 21 nt, Human adenovirus F
gaccugcaauggcagcccagc

SEQ ID NO: 3941608 - RNA, 16 nt, Human adenovirus F
gacgacugggcggcgg

SEQ ID NO: 3941609 - RNA, 23 nt, Human adenovirus F
gacgacugggcggcggccaugga

SEQ ID NO: 3941610 - RNA, 11 nt, Human adenovirus F
gacgagcccug

SEQ ID NO: 3941611 - RNA, 22 nt, Human adenovirus F
gacggaggcaaaacuggaacgc

SEQ ID NO: 3941612 - RNA, 21 nt, Human adenovirus F
gacggggcccguucuggacuc

SEQ ID NO: 3941613 - RNA, 19 nt, Human adenovirus F
gacgugugugugagggcaa

SEQ ID NO: 3941614 - RNA, 18 nt, Human adenovirus F
gacguuaagguaaagcca

SEQ ID NO: 3941615 - RNA, 19 nt, Human adenovirus F
gacuccgugguagccgaug

SEQ ID NO: 3941616 - RNA, 15 nt, Human adenovirus F
gacugggcggcggcc

SEQ ID NO: 3941617 - RNA, 19 nt, Human adenovirus F
gacugggcggcggccaugg

SEQ ID NO: 3941618 - RNA, 14 nt, Human adenovirus F
gacuuccugguccu

SEQ ID NO: 3941619 - RNA, 23 nt, Human adenovirus F
gagacccagguuuaauacaguga

SEQ ID NO: 3941620 - RNA, 15 nt, Human adenovirus F
gagaggcgguggcgc

SEQ ID NO: 3941621 - RNA, 13 nt, Human adenovirus F
gagaguugggggu

SEQ ID NO: 3941622 - RNA, 17 nt, Human adenovirus F
gagaucacgucuggggu

SEQ ID NO: 3941623 - RNA, 13 nt, Human adenovirus F
gagauuuguagug

SEQ ID NO: 3941624 - RNA, 20 nt, Human adenovirus F
gagcaagccgcugacggcgc

SEQ ID NO: 3941625 - RNA, 15 nt, Human adenovirus F
gagcaaguggagcaa

SEQ ID NO: 3941626 - RNA, 13 nt, Human adenovirus F
gagcagauggaga

SEQ ID NO: 3941627 - RNA, 23 nt, Human adenovirus F
gagcagcgggaagagaggcagcc

SEQ ID NO: 3941628 - RNA, 13 nt, Human adenovirus F
gagcagcugcgua

SEQ ID NO: 3941629 - RNA, 21 nt, Human adenovirus F
gagcaugaaacuggaagaugu

SEQ ID NO: 3941630 - RNA, 22 nt, Human adenovirus F
gagcccugaucagccagguggu

SEQ ID NO: 3941631 - RNA, 21 nt, Human adenovirus F
gagcgguccgucacgcgggcc

SEQ ID NO: 3941632 - RNA, 21 nt, Human adenovirus F
gagcucaggguguuuuggguc

SEQ ID NO: 3941633 - RNA, 17 nt, Human adenovirus F
gaggaggccauccugga

SEQ ID NO: 3941634 - RNA, 15 nt, Human adenovirus F
gaggauuaaggguaa

SEQ ID NO: 3941635 - RNA, 20 nt, Human adenovirus F
gaggcagcuucucgaggcca

SEQ ID NO: 3941636 - RNA, 14 nt, Human adenovirus F
gaggccauccugga

SEQ ID NO: 3941637 - RNA, 17 nt, Human adenovirus F
gaggccgucuaccugcg

SEQ ID NO: 3941638 - RNA, 18 nt, Human adenovirus F
gaggccuuucacccagac

SEQ ID NO: 3941639 - RNA, 18 nt, Human adenovirus F
gaggcgauuugggaggga

SEQ ID NO: 3941640 - RNA, 19 nt, Human adenovirus F
gaggguacuagcagugggc

SEQ ID NO: 3941641 - RNA, 20 nt, Human adenovirus F
gaggguacuagcagugggca

SEQ ID NO: 3941642 - RNA, 18 nt, Human adenovirus F
gaggugccccagagugag

SEQ ID NO: 3941643 - RNA, 14 nt, Human adenovirus F
gaguaugccuugca

SEQ ID NO: 3941644 - RNA, 15 nt, Human adenovirus F
gaguuguggagugag

SEQ ID NO: 3941645 - RNA, 19 nt, Human adenovirus F
gauaacgguuguuuuccac

SEQ ID NO: 3941646 - RNA, 16 nt, Human adenovirus F
gauaccgcugcagcug

SEQ ID NO: 3941647 - RNA, 20 nt, Human adenovirus F
gauaccuacuucagccuggg

SEQ ID NO: 3941648 - RNA, 18 nt, Human adenovirus F
gauacugcuccuggcgag

SEQ ID NO: 3941649 - RNA, 19 nt, Human adenovirus F
gauacuggauacuggcaag

SEQ ID NO: 3941650 - RNA, 19 nt, Human adenovirus F
gauacuggcaagagccacc

SEQ ID NO: 3941651 - RNA, 20 nt, Human adenovirus F
gauauuuguaaaagcgggcg

SEQ ID NO: 3941652 - RNA, 24 nt, Human adenovirus F
gaucagguucccgugucaccugca

SEQ ID NO: 3941653 - RNA, 17 nt, Human adenovirus F
gaucccgacucacugga

SEQ ID NO: 3941654 - RNA, 17 nt, Human adenovirus F
gaugaugucgugucugc

SEQ ID NO: 3941655 - RNA, 22 nt, Human adenovirus F
gaugcagguaggaccacuggag

SEQ ID NO: 3941656 - RNA, 22 nt, Human adenovirus F
gaugcaugcgaggggaaaucag

SEQ ID NO: 3941657 - RNA, 22 nt, Human adenovirus F
gaugcgccucaugagcugggag

SEQ ID NO: 3941658 - RNA, 19 nt, Human adenovirus F
gaugcugcugaugaggaaa

SEQ ID NO: 3941659 - RNA, 21 nt, Human adenovirus F
gauggaaacugucaggcucug

SEQ ID NO: 3941660 - RNA, 16 nt, Human adenovirus F
gauggacuaucugcac

SEQ ID NO: 3941661 - RNA, 15 nt, Human adenovirus F
gauggcgauggggcc

SEQ ID NO: 3941662 - RNA, 17 nt, Human adenovirus F
gauggcgugggaguugg

SEQ ID NO: 3941663 - RNA, 20 nt, Human adenovirus F
gauggggguucgccuggaga

SEQ ID NO: 3941664 - RNA, 16 nt, Human adenovirus F
gaugguggcaaggaga

SEQ ID NO: 3941665 - RNA, 12 nt, Human adenovirus F
gaugugccaacg

SEQ ID NO: 3941666 - RNA, 13 nt, Human adenovirus F
gauuaagaaccac

SEQ ID NO: 3941667 - RNA, 14 nt, Human adenovirus F
gauucaagggccag

SEQ ID NO: 3941668 - RNA, 19 nt, Human adenovirus F
gauugugcaacacagccgg

SEQ ID NO: 3941669 - RNA, 18 nt, Human adenovirus F
gauuucauuuaccacccc

SEQ ID NO: 3941670 - RNA, 21 nt, Human adenovirus F
gauuuugaguuagcucugaac

SEQ ID NO: 3941671 - RNA, 16 nt, Human adenovirus F
gcaaacagugccacau

SEQ ID NO: 3941672 - RNA, 19 nt, Human adenovirus F
gcaaagggggggcauuaau

SEQ ID NO: 3941673 - RNA, 16 nt, Human adenovirus F
gcaaaucuauuucuuu

SEQ ID NO: 3941674 - RNA, 10 nt, Human adenovirus F
gcaaaugcuc

SEQ ID NO: 3941675 - RNA, 17 nt, Human adenovirus F
gcaacauaacuuuacaa

SEQ ID NO: 3941676 - RNA, 18 nt, Human adenovirus F
gcaaccccacgccaagcc

SEQ ID NO: 3941677 - RNA, 15 nt, Human adenovirus F
gcaacgcaagagacg

SEQ ID NO: 3941678 - RNA, 17 nt, Human adenovirus F
gcaacgcugcaggcgcu

SEQ ID NO: 3941679 - RNA, 18 nt, Human adenovirus F
gcaacugccaucuucccg

SEQ ID NO: 3941680 - RNA, 15 nt, Human adenovirus F
gcaagcgcggccgcu

SEQ ID NO: 3941681 - RNA, 17 nt, Human adenovirus F
gcaaucccagcagaaac

SEQ ID NO: 3941682 - RNA, 15 nt, Human adenovirus F
gcaauggucuuacau

SEQ ID NO: 3941683 - RNA, 15 nt, Human adenovirus F
gcaauguugccaccg

SEQ ID NO: 3941684 - RNA, 15 nt, Human adenovirus F
gcacacgcacuucaa

SEQ ID NO: 3941685 - RNA, 17 nt, Human adenovirus F
gcaccagccagcucaac

SEQ ID NO: 3941686 - RNA, 22 nt, Human adenovirus F
gcacgcucuugcugugggugga

SEQ ID NO: 3941687 - RNA, 21 nt, Human adenovirus F
gcacggcccccaucucugugc

SEQ ID NO: 3941688 - RNA, 21 nt, Human adenovirus F
gcacuuggggaauuugucaug

SEQ ID NO: 3941689 - RNA, 16 nt, Human adenovirus F
gcagacaagacaugga

SEQ ID NO: 3941690 - RNA, 15 nt, Human adenovirus F
gcagacgaacacaau

SEQ ID NO: 3941691 - RNA, 20 nt, Human adenovirus F
gcagcagauccuucccguga

SEQ ID NO: 3941692 - RNA, 16 nt, Human adenovirus F
gcagcaguaucagugg

SEQ ID NO: 3941693 - RNA, 17 nt, Human adenovirus F
gcagcaguccgucagcu

SEQ ID NO: 3941694 - RNA, 23 nt, Human adenovirus F
gcagccuguggaguggcauuaaa

SEQ ID NO: 3941695 - RNA, 15 nt, Human adenovirus F
gcagcgcccgccucc

SEQ ID NO: 3941696 - RNA, 14 nt, Human adenovirus F
gcagcgggaagaga

SEQ ID NO: 3941697 - RNA, 13 nt, Human adenovirus F
gcagcgggcagga

SEQ ID NO: 3941698 - RNA, 15 nt, Human adenovirus F
gcagcgggcaggagc

SEQ ID NO: 3941699 - RNA, 16 nt, Human adenovirus F
gcagcgggcaggagcc

SEQ ID NO: 3941700 - RNA, 13 nt, Human adenovirus F
gcagcuggagcuu

SEQ ID NO: 3941701 - RNA, 17 nt, Human adenovirus F
gcagcuugaagaacugg

SEQ ID NO: 3941702 - RNA, 16 nt, Human adenovirus F
gcaggacuuggcagaa

SEQ ID NO: 3941703 - RNA, 23 nt, Human adenovirus F
gcaggccagucggcaggcuuccu

SEQ ID NO: 3941704 - RNA, 18 nt, Human adenovirus F
gcaggguuauacucugga

SEQ ID NO: 3941705 - RNA, 18 nt, Human adenovirus F
gcaggguuuuugagcaug

SEQ ID NO: 3941706 - RNA, 19 nt, Human adenovirus F
gcagguaggaccacuggag

SEQ ID NO: 3941707 - RNA, 22 nt, Human adenovirus F
gcagguuuuacgcggggcagga

SEQ ID NO: 3941708 - RNA, 17 nt, Human adenovirus F
gcauaaaagcuucuauc

SEQ ID NO: 3941709 - RNA, 17 nt, Human adenovirus F
guggauauagccaacca

SEQ ID NO: 3941710 - RNA, 23 nt, Human adenovirus F
guggauggggguucgccuggaga

SEQ ID NO: 3941711 - RNA, 16 nt, Human adenovirus F
guggccaacgccaggc

SEQ ID NO: 3941712 - RNA, 15 nt, Human adenovirus F
gugggcguccagugg

SEQ ID NO: 3941713 - RNA, 21 nt, Human adenovirus F
gugggcugauuuggaagauga

SEQ ID NO: 3941714 - RNA, 15 nt, Human adenovirus F
guggucacucucagc

SEQ ID NO: 3941715 - RNA, 23 nt, Human adenovirus F
guggucuaagggaacuucucccc

SEQ ID NO: 3941716 - RNA, 23 nt, Human adenovirus F
gugucaauagcauacagaagacc

SEQ ID NO: 3941717 - RNA, 13 nt, Human adenovirus F
guguuuagcccau

SEQ ID NO: 3941718 - RNA, 17 nt, Human adenovirus F
guuacaaaaugaguggc

SEQ ID NO: 3941719 - RNA, 16 nt, Human adenovirus F
guuaucacccaaagcc

SEQ ID NO: 3941720 - RNA, 18 nt, Human adenovirus F
guucaaaaccucuuacaa

SEQ ID NO: 3941721 - RNA, 18 nt, Human adenovirus F
guucgucaggccugcaag

SEQ ID NO: 3941722 - RNA, 20 nt, Human adenovirus F
guucucgcucgcuacaucca

SEQ ID NO: 3941723 - RNA, 22 nt, Human adenovirus F
guucucgcucgcuacauccauu

SEQ ID NO: 3941724 - RNA, 15 nt, Human adenovirus F
guugacuugcaggag

SEQ ID NO: 3941725 - RNA, 20 nt, Human adenovirus F
guuggacuaccucagcgauc

SEQ ID NO: 3941726 - RNA, 16 nt, Human adenovirus F
guuggcggcccugcaa

SEQ ID NO: 3941727 - RNA, 15 nt, Human adenovirus F
guuugggagccagga

SEQ ID NO: 3941728 - RNA, 14 nt, Human adenovirus F
uaaaaaaaagggaa

SEQ ID NO: 3941729 - RNA, 13 nt, Human adenovirus F
uaaaaacaaccaa

SEQ ID NO: 3941730 - RNA, 14 nt, Human adenovirus F
uaaaaaucuccugc

SEQ ID NO: 3941731 - RNA, 19 nt, Human adenovirus F
uaaaaaugccaggcagcag

SEQ ID NO: 3941732 - RNA, 17 nt, Human adenovirus F
uaaaacuuuauggaugu

SEQ ID NO: 3941733 - RNA, 20 nt, Human adenovirus F
uaaaccaauuugcuaacacu

SEQ ID NO: 3941734 - RNA, 11 nt, Human adenovirus F
uaaacucugag

SEQ ID NO: 3941735 - RNA, 18 nt, Human adenovirus F
uaaagcauaacaugauuu

SEQ ID NO: 3941736 - RNA, 17 nt, Human adenovirus F
uaaagggaacugccagu

SEQ ID NO: 3941737 - RNA, 15 nt, Human adenovirus F
uaaccaacucguuca

SEQ ID NO: 3941738 - RNA, 14 nt, Human adenovirus F
uaaccaccaccgca

SEQ ID NO: 3941739 - RNA, 14 nt, Human adenovirus F
uaaccacuaccacc

SEQ ID NO: 3941740 - RNA, 17 nt, Human adenovirus F
uaaccacuaccacccuc

SEQ ID NO: 3941741 - RNA, 13 nt, Human adenovirus F
uaaccucuacccc

SEQ ID NO: 3941742 - RNA, 23 nt, Human adenovirus F
uaaccuguaugccaacuuuuucc

SEQ ID NO: 3941743 - RNA, 14 nt, Human adenovirus F
uaaccuucgcugcu

SEQ ID NO: 3941744 - RNA, 15 nt, Human adenovirus F
uaacucucuuacauu

SEQ ID NO: 3941745 - RNA, 22 nt, Human adenovirus F
uaagaccguuuucguuccacac

SEQ ID NO: 3941746 - RNA, 14 nt, Human adenovirus F
uaagcaacaaccag

SEQ ID NO: 3941747 - RNA, 19 nt, Human adenovirus F
uaaggacgguggcaugagg

SEQ ID NO: 3941748 - RNA, 15 nt, Human adenovirus F
uaagggaggcagcag

SEQ ID NO: 3941749 - RNA, 16 nt, Human adenovirus F
uaagguaaagccacaa

SEQ ID NO: 3941750 - RNA, 18 nt, Human adenovirus F
uaauaacuuucuuacacu

SEQ ID NO: 3941751 - RNA, 18 nt, Human adenovirus F
uaaucucccuccccccuu

SEQ ID NO: 3941752 - RNA, 15 nt, Human adenovirus F
uaaugcccacaccug

SEQ ID NO: 3941753 - RNA, 15 nt, Human adenovirus F
uacauccauuuccac

SEQ ID NO: 3941754 - RNA, 14 nt, Human adenovirus F
uacauguggagcua

SEQ ID NO: 3941755 - RNA, 16 nt, Human adenovirus F
uacauuggccaccgcc

SEQ ID NO: 3941756 - RNA, 14 nt, Human adenovirus F
uaccacagaaaugu

SEQ ID NO: 3941757 - RNA, 17 nt, Human adenovirus F
uaccagaaagcuacaag

SEQ ID NO: 3941758 - RNA, 21 nt, Human adenovirus F
uacccagcugugguuaaauuu

SEQ ID NO: 3941759 - RNA, 16 nt, Human adenovirus F
uaccccgacagaggcc

SEQ ID NO: 3941760 - RNA, 21 nt, Human adenovirus F
uacccuccguuuacuucaacc

SEQ ID NO: 3941761 - RNA, 14 nt, Human adenovirus F
uacggaggaagagg

SEQ ID NO: 3941762 - RNA, 14 nt, Human adenovirus F
uacuaaaacaaacc

SEQ ID NO: 3941763 - RNA, 15 nt, Human adenovirus F
uacuaaaacaaacca

SEQ ID NO: 3941764 - RNA, 16 nt, Human adenovirus F
uacugcuaaagggaac

SEQ ID NO: 3941765 - RNA, 18 nt, Human adenovirus F
uacuucuuaauaaagaca

SEQ ID NO: 3941766 - RNA, 16 nt, Human adenovirus F
uacuuuuacagaauuc

SEQ ID NO: 3941767 - RNA, 13 nt, Human adenovirus F
uagaaguaaccaa

SEQ ID NO: 3941768 - RNA, 13 nt, Human adenovirus F
uagcaaacagugc

SEQ ID NO: 3941769 - RNA, 17 nt, Human adenovirus F
uagccaguggacaaacc

SEQ ID NO: 3941770 - RNA, 22 nt, Human adenovirus F
uagcccuguacuugccugacuc

SEQ ID NO: 3941771 - RNA, 17 nt, Human adenovirus F
uaggcuuuaacaacaca

SEQ ID NO: 3941772 - RNA, 18 nt, Human adenovirus F
uagggugucugccagagg

SEQ ID NO: 3941773 - RNA, 22 nt, Human adenovirus F
uagucauacauuucgugggaag

SEQ ID NO: 3941774 - RNA, 18 nt, Human adenovirus F
uagugcguccgcccgcuc

SEQ ID NO: 3941775 - RNA, 15 nt, Human adenovirus F
uauaaaaacaaccaa

SEQ ID NO: 3941776 - RNA, 17 nt, Human adenovirus F
uauaaguauuacaaaug

SEQ ID NO: 3941777 - RNA, 15 nt, Human adenovirus F
uauacacucccuuug

SEQ ID NO: 3941778 - RNA, 22 nt, Human adenovirus F
uauccuugcucggcgaaaacuc

SEQ ID NO: 3941779 - RNA, 21 nt, Human adenovirus F
uaucuacgccuccaccaccuu

SEQ ID NO: 3941780 - RNA, 16 nt, Human adenovirus F
uaucuugcaaaacuuu

SEQ ID NO: 3941781 - RNA, 22 nt, Human adenovirus F
uaugaugaaaguagaagucucu

SEQ ID NO: 3941782 - RNA, 17 nt, Human adenovirus F
uaugcgcguugaaaggu

SEQ ID NO: 3941783 - RNA, 17 nt, Human adenovirus F
uaugcuauuuuccagca

SEQ ID NO: 3941784 - RNA, 12 nt, Human adenovirus F
uauggaggagga

SEQ ID NO: 3941785 - RNA, 13 nt, Human adenovirus F
uauggaggaggau

SEQ ID NO: 3941786 - RNA, 12 nt, Human adenovirus F
uaugggcagcau

SEQ ID NO: 3941787 - RNA, 22 nt, Human adenovirus F
uaugugcuggggaauggagcug

SEQ ID NO: 3941788 - RNA, 22 nt, Human adenovirus F
uauuaccgucaucucuacagcc

SEQ ID NO: 3941789 - RNA, 13 nt, Human adenovirus F
uauucaccaccuu

SEQ ID NO: 3941790 - RNA, 18 nt, Human adenovirus F
uauucaccaccuuuaaaa

SEQ ID NO: 3941791 - RNA, 22 nt, Human adenovirus F
uauuccuccggcucuauaaaaa

SEQ ID NO: 3941792 - RNA, 20 nt, Human adenovirus F
ucaaaaagguuuccaaauca

SEQ ID NO: 3941793 - RNA, 16 nt, Human adenovirus F
ucaaaaguccacaaaa

SEQ ID NO: 3941794 - RNA, 17 nt, Human adenovirus F
ucaaacaacaaaaucag

SEQ ID NO: 3941795 - RNA, 16 nt, Human adenovirus F
ucaaacacugcgcaaa

SEQ ID NO: 3941796 - RNA, 18 nt, Human adenovirus F
ucaaauacauaggcauua

SEQ ID NO: 3941797 - RNA, 15 nt, Human adenovirus F
ucaaaugcuccggga

SEQ ID NO: 3941798 - RNA, 21 nt, Human adenovirus F
ucaacgcggggcaccuucagc

SEQ ID NO: 3941799 - RNA, 17 nt, Human adenovirus F
ucaacuccucuugcagg

SEQ ID NO: 3941800 - RNA, 14 nt, Human adenovirus F
ucaagaaauuguga

SEQ ID NO: 3941801 - RNA, 19 nt, Human adenovirus F
ucaaguuuuuccagcagca

SEQ ID NO: 3941802 - RNA, 22 nt, Human adenovirus F
ucaaucagcggcuggaaaauag

SEQ ID NO: 3941803 - RNA, 22 nt, Human adenovirus F
ucacaaagcugugagcgccagc

SEQ ID NO: 3941804 - RNA, 20 nt, Human adenovirus F
ucacauaucgucacuuccgc

SEQ ID NO: 3941805 - RNA, 15 nt, Human adenovirus F
ucacauccaagugcc

SEQ ID NO: 3941806 - RNA, 14 nt, Human adenovirus F
ucacccgcagcugc

SEQ ID NO: 3941807 - RNA, 15 nt, Human adenovirus F
ucacccgcagcugcu

SEQ ID NO: 3941808 - RNA, 21 nt, Human adenovirus F
ucaccgccuuggccagcagcc

SEQ ID NO: 3941809 - RNA, 15 nt, Human adenovirus F
ucacgaccucccaaa

SEQ ID NO: 3941810 - RNA, 19 nt, Human adenovirus F
ucacugccguugcaaccuc

SEQ ID NO: 3941811 - RNA, 13 nt, Human adenovirus F
ucacuuccgccgc

SEQ ID NO: 3941812 - RNA, 14 nt, Human adenovirus F
ucacuuugccagag

SEQ ID NO: 3941813 - RNA, 23 nt, Human adenovirus F
ucagaaccuccgacgcuugcugg

SEQ ID NO: 3941814 - RNA, 22 nt, Human adenovirus F
ucagcuugagagcaagagugcg

SEQ ID NO: 3941815 - RNA, 13 nt, Human adenovirus F
ucaggaacuguuc

SEQ ID NO: 3941816 - RNA, 18 nt, Human adenovirus F
ucaggagguacuccucgc

SEQ ID NO: 3941817 - RNA, 15 nt, Human adenovirus F
ucaggcagcagcccc

SEQ ID NO: 3941818 - RNA, 16 nt, Human adenovirus F
ucaggcagcagcccca

SEQ ID NO: 3941819 - RNA, 20 nt, Human adenovirus F
ucagggucgauggagccagc

SEQ ID NO: 3941820 - RNA, 21 nt, Human adenovirus F
ucagugaaaacguucccgccc

SEQ ID NO: 3941821 - RNA, 22 nt, Human adenovirus F
ucauccauaaugauggcgaugg

SEQ ID NO: 3941822 - RNA, 21 nt, Human adenovirus F
ucaucgaagccguugauguua

SEQ ID NO: 3941823 - RNA, 14 nt, Human adenovirus F
ucaucgccgccgcc

SEQ ID NO: 3941824 - RNA, 14 nt, Human adenovirus F
ucaugcaugcagac

SEQ ID NO: 3941825 - RNA, 18 nt, Human adenovirus F
ucauuuaccaccccagca

SEQ ID NO: 3941826 - RNA, 18 nt, Human adenovirus F
uccacccgugcccaccgu

SEQ ID NO: 3941827 - RNA, 16 nt, Human adenovirus F
uccacguaccagaaag

SEQ ID NO: 3941828 - RNA, 21 nt, Human adenovirus F
uccagcguucaaaaccucuua

SEQ ID NO: 3941829 - RNA, 23 nt, Human adenovirus F
uccaggaaaucaccagcgugagu

SEQ ID NO: 3941830 - RNA, 21 nt, Human adenovirus F
uccaguaaucuucggcaggaa

SEQ ID NO: 3941831 - RNA, 13 nt, Human adenovirus F
uccauagagggcg

SEQ ID NO: 3941832 - RNA, 20 nt, Human adenovirus F
uccauguggaaccaggcagu

SEQ ID NO: 3941833 - RNA, 17 nt, Human adenovirus F
ucccaacaacggggugg

SEQ ID NO: 3941834 - RNA, 22 nt, Human adenovirus F
ucccaacgcgcguuaccacccu

SEQ ID NO: 3941835 - RNA, 21 nt, Human adenovirus F
ucccacuguuucuccuccccu

SEQ ID NO: 3941836 - RNA, 17 nt, Human adenovirus F
ucccagucugccaucgc

SEQ ID NO: 3941837 - RNA, 18 nt, Human adenovirus F
ucccccuguaccaccgca

SEQ ID NO: 3941838 - RNA, 16 nt, Human adenovirus F
uccccgaaacaaaacc

SEQ ID NO: 3941839 - RNA, 22 nt, Human adenovirus F
ucccgccccccacuagcgcccc

SEQ ID NO: 3941840 - RNA, 20 nt, Human adenovirus F
ucccugcacuaugccuuccg

SEQ ID NO: 3941841 - RNA, 21 nt, Human adenovirus F
ucccuucccgacaugaugcaa

SEQ ID NO: 3941842 - RNA, 16 nt, Human adenovirus F
ucccuuucccccugua

SEQ ID NO: 3941843 - RNA, 14 nt, Human adenovirus F
uccgaccccacacg

SEQ ID NO: 3941844 - RNA, 13 nt, Human adenovirus F
uccgcaaggauga

SEQ ID NO: 3941845 - RNA, 14 nt, Human adenovirus F
uccgccauugccac

SEQ ID NO: 3941846 - RNA, 18 nt, Human adenovirus F
uccgcccaugccggcucc

SEQ ID NO: 3941847 - RNA, 12 nt, Human adenovirus F
uccggaggcagu

SEQ ID NO: 3941848 - RNA, 17 nt, Human adenovirus F
uccggguuuuauggcac

SEQ ID NO: 3941849 - RNA, 18 nt, Human adenovirus F
uccucgcugucuggaacc

SEQ ID NO: 3941850 - RNA, 23 nt, Human adenovirus F
uccugaaugugucuccgcuggga

SEQ ID NO: 3941851 - RNA, 19 nt, Human adenovirus F
uccuguguuacgccagaga

SEQ ID NO: 3941852 - RNA, 18 nt, Human adenovirus F
ucgaggaaagcuuccagc

SEQ ID NO: 3941853 - RNA, 18 nt, Human adenovirus F
ucgcaaacaaagaaguac

SEQ ID NO: 3941854 - RNA, 16 nt, Human adenovirus F
ucgccaucaugagucu

SEQ ID NO: 3941855 - RNA, 20 nt, Human adenovirus F
ucgcggggcuaacuggcaga

SEQ ID NO: 3941856 - RNA, 17 nt, Human adenovirus F
ucgcucuguccgccgcc

SEQ ID NO: 3941857 - RNA, 12 nt, Human adenovirus F
ucgcuggcuccg

SEQ ID NO: 3941858 - RNA, 23 nt, Human adenovirus F
ucggacucggaaccugaaagaga

SEQ ID NO: 3941859 - RNA, 16 nt, Human adenovirus F
ucggcaccagccagcu

SEQ ID NO: 3941860 - RNA, 16 nt, Human adenovirus F
ucggcacgcuccuugg

SEQ ID NO: 3941861 - RNA, 12 nt, Human adenovirus F
ucgggcgcgggu

SEQ ID NO: 3941862 - RNA, 12 nt, Human adenovirus F
ucgucacuuccg

SEQ ID NO: 3941863 - RNA, 15 nt, Human adenovirus F
ucuaagggaggcagc

SEQ ID NO: 3941864 - RNA, 23 nt, Human adenovirus F
ucuccauaccagaguaacuuuug

SEQ ID NO: 3941865 - RNA, 15 nt, Human adenovirus F
ucuccccacagccgu

SEQ ID NO: 3941866 - RNA, 20 nt, Human adenovirus F
ucuccuccccuuacaaacag

SEQ ID NO: 3941867 - RNA, 15 nt, Human adenovirus F
ucucgccccaccgcc

SEQ ID NO: 3941868 - RNA, 17 nt, Human adenovirus F
ucucgccccaccgcccc

SEQ ID NO: 3941869 - RNA, 18 nt, Human adenovirus F
ucucgccguaggagaggc

SEQ ID NO: 3941870 - RNA, 19 nt, Human adenovirus F
ucucggccgguaacgccac

SEQ ID NO: 3941871 - RNA, 18 nt, Human adenovirus F
ucugaccaacuagaaauc

SEQ ID NO: 3941872 - RNA, 17 nt, Human adenovirus F
ucuggaaucagcaucuu

SEQ ID NO: 3941873 - RNA, 22 nt, Human adenovirus F
ucuuaacucugaagaugucuga

SEQ ID NO: 3941874 - RNA, 15 nt, Human adenovirus F
ucuuacauuggccac

SEQ ID NO: 3941875 - RNA, 14 nt, Human adenovirus F
ucuucaucccagcc

SEQ ID NO: 3941876 - RNA, 12 nt, Human adenovirus F
ucuucuccuggc

SEQ ID NO: 3941877 - RNA, 20 nt, Human adenovirus F
uggaagagcaaaaccuccag

SEQ ID NO: 3941878 - RNA, 18 nt, Human adenovirus F
uggaagugcuaggcucuu

SEQ ID NO: 3941879 - RNA, 18 nt, Human adenovirus F
uggaaugccugcagcgcu

SEQ ID NO: 3941880 - RNA, 16 nt, Human adenovirus F
uggaauuuuugcuucu

SEQ ID NO: 3941881 - RNA, 17 nt, Human adenovirus F
uggacgacagccagcug

SEQ ID NO: 3941882 - RNA, 14 nt, Human adenovirus F
uggagcagccugug

SEQ ID NO: 3941883 - RNA, 21 nt, Human adenovirus F
uggaggaagaaaccaucgcca

SEQ ID NO: 3941884 - RNA, 13 nt, Human adenovirus F
uggaggcggcugg

SEQ ID NO: 3941885 - RNA, 20 nt, Human adenovirus F
uggaguuggcuucugccaga

SEQ ID NO: 3941886 - RNA, 23 nt, Human adenovirus F
uggcaacccugaggaggaggcca

SEQ ID NO: 3941887 - RNA, 23 nt, Human adenovirus F
uggcagcccagcgcccgggcccu

SEQ ID NO: 3941888 - RNA, 18 nt, Human adenovirus F
uggcauggcagcagauuu

SEQ ID NO: 3941889 - RNA, 14 nt, Human adenovirus F
uggccaacugccac

SEQ ID NO: 3941890 - RNA, 16 nt, Human adenovirus F
uggccaacugccaccu

SEQ ID NO: 3941891 - RNA, 13 nt, Human adenovirus F
uggccauuuucca

SEQ ID NO: 3941892 - RNA, 14 nt, Human adenovirus F
uggccugccgccca

SEQ ID NO: 3941893 - RNA, 18 nt, Human adenovirus F
uggcgcauucccuuuucc

SEQ ID NO: 3941894 - RNA, 19 nt, Human adenovirus F
uggcgccggcgggaagagg

SEQ ID NO: 3941895 - RNA, 20 nt, Human adenovirus F
uggcgccggcgggaagagga

SEQ ID NO: 3941896 - RNA, 18 nt, Human adenovirus F
uggcuacuuaucacaucu

SEQ ID NO: 3941897 - RNA, 20 nt, Human adenovirus F
uggcuggaggcuugggagga

SEQ ID NO: 3941898 - RNA, 14 nt, Human adenovirus F
uggcuuuacacauu

SEQ ID NO: 3941899 - RNA, 21 nt, Human adenovirus F
ugggaaggggccagcaagcug

SEQ ID NO: 3941900 - RNA, 19 nt, Human adenovirus F
ugggaggaagugacggggc

SEQ ID NO: 3941901 - RNA, 14 nt, Human adenovirus F
ugggagugcuggcc

SEQ ID NO: 3941902 - RNA, 21 nt, Human adenovirus F
ugggauuugccgcagccagug

SEQ ID NO: 3941903 - RNA, 17 nt, Human adenovirus F
uggggccuacggaaggg

SEQ ID NO: 3941904 - RNA, 22 nt, Human adenovirus F
ugggggcccugaccgaccuggg

SEQ ID NO: 3941905 - RNA, 17 nt, Human adenovirus F
ugggggcgccauccccc

SEQ ID NO: 3941906 - RNA, 22 nt, Human adenovirus F
uggggguucgccuggagaggcg

SEQ ID NO: 3941907 - RNA, 18 nt, Human adenovirus F
uggguaagugcagaggcg

SEQ ID NO: 3941908 - RNA, 13 nt, Human adenovirus F
ugguaagcagccu

SEQ ID NO: 3941909 - RNA, 19 nt, Human adenovirus F
uggugaguugguagcagug

SEQ ID NO: 3941910 - RNA, 22 nt, Human adenovirus F
uguacaaagucauccaaaucau

SEQ ID NO: 3941911 - RNA, 15 nt, Human adenovirus F
uguacaccaccucuu

SEQ ID NO: 3941912 - RNA, 22 nt, Human adenovirus F
uguaccgccaaaaaagcagccu

SEQ ID NO: 3941913 - RNA, 15 nt, Human adenovirus F
uguacgagaagcccu

SEQ ID NO: 3941914 - RNA, 16 nt, Human adenovirus F
uguacugugcauuugg

SEQ ID NO: 3941915 - RNA, 18 nt, Human adenovirus F
ugucaggcucugagagug

SEQ ID NO: 3941916 - RNA, 19 nt, Human adenovirus F
ugucaugcaacuuggaagg

SEQ ID NO: 3941917 - RNA, 23 nt, Human adenovirus F
ugucaugcaacuuggaagggaag

SEQ ID NO: 3941918 - RNA, 12 nt, Human adenovirus F
ugucgccccugu

SEQ ID NO: 3941919 - RNA, 19 nt, Human adenovirus F
ugucuucccgccuugcuga

SEQ ID NO: 3941920 - RNA, 18 nt, Human adenovirus F
ugugcaauguucaguucu

SEQ ID NO: 3941921 - RNA, 19 nt, Human adenovirus F
uguuaucggggugggaaac

SEQ ID NO: 3941922 - RNA, 14 nt, Human adenovirus F
uguucgggugagua

SEQ ID NO: 3941923 - RNA, 13 nt, Human adenovirus F
uguuggcggcccu

SEQ ID NO: 3941924 - RNA, 18 nt, Human adenovirus F
uguuguagucugccaacg

SEQ ID NO: 3941925 - RNA, 20 nt, Human adenovirus F
uguuucuccuccccuuacaa

SEQ ID NO: 3941926 - RNA, 15 nt, Human adenovirus F
uuaaaaacuugcaag

SEQ ID NO: 3941927 - RNA, 16 nt, Human adenovirus F
uuaaguuauacaguga

SEQ ID NO: 3941928 - RNA, 20 nt, Human adenovirus F
uuaaugcuuuucugagcaca

SEQ ID NO: 3941929 - RNA, 10 nt, Human adenovirus F
uuacaaacag

SEQ ID NO: 3941930 - RNA, 16 nt, Human adenovirus F
uuaccgcgacaaagca

SEQ ID NO: 3941931 - RNA, 16 nt, Human adenovirus F
uuaccgucaucucuac

SEQ ID NO: 3941932 - RNA, 18 nt, Human adenovirus F
uuagcaguaggacgucag

SEQ ID NO: 3941933 - RNA, 11 nt, Human adenovirus F
uuagcucugaa

SEQ ID NO: 3941934 - RNA, 14 nt, Human adenovirus F
uuagguuggcaaug

SEQ ID NO: 3941935 - RNA, 14 nt, Human adenovirus F
uuauacacucccuu

SEQ ID NO: 3941936 - RNA, 13 nt, Human adenovirus F
uuaucuguaaaac

SEQ ID NO: 3941937 - RNA, 13 nt, Human adenovirus F
uucaaggaaacaa

SEQ ID NO: 3941938 - RNA, 23 nt, Human adenovirus F
uucacccacccaccgcuguauuu

SEQ ID NO: 3941939 - RNA, 17 nt, Human adenovirus F
uucaccgccuuggccag

SEQ ID NO: 3941940 - RNA, 17 nt, Human adenovirus F
uuccagcagcaccaccu

SEQ ID NO: 3941941 - RNA, 23 nt, Human adenovirus F
uuccagcagcaccaccugcccuu

SEQ ID NO: 3941942 - RNA, 23 nt, Human adenovirus F
uucccaaaaaaagaauuacuuuu

SEQ ID NO: 3941943 - RNA, 14 nt, Human adenovirus F
uucccacuguuucu

SEQ ID NO: 3941944 - RNA, 17 nt, Human adenovirus F
uuccucauacaaaugcu

SEQ ID NO: 3941945 - RNA, 15 nt, Human adenovirus F
uuccucccaacuuuc

SEQ ID NO: 3941946 - RNA, 15 nt, Human adenovirus F
uucucaccuggcaaa

SEQ ID NO: 3941947 - RNA, 16 nt, Human adenovirus F
uucucaccuggcaaac

SEQ ID NO: 3941948 - RNA, 20 nt, Human adenovirus F
uucucccaggcggaaaccaa

SEQ ID NO: 3941949 - RNA, 18 nt, Human adenovirus F
uucuccuccccuuacaaa

SEQ ID NO: 3941950 - RNA, 17 nt, Human adenovirus F
uucuccugcuugucugu

SEQ ID NO: 3941951 - RNA, 19 nt, Human adenovirus F
uucugacaugcugguuuuc

SEQ ID NO: 3941952 - RNA, 17 nt, Human adenovirus F
uugaagacgacuucaac

SEQ ID NO: 3941953 - RNA, 17 nt, Human adenovirus F
uugacauuccuccgccu

SEQ ID NO: 3941954 - RNA, 22 nt, Human adenovirus F
uugacccgcuuggaggagcugu

SEQ ID NO: 3941955 - RNA, 15 nt, Human adenovirus F
uugaggguacgcugu

SEQ ID NO: 3941956 - RNA, 17 nt, Human adenovirus F
uugauuuucugccacca

SEQ ID NO: 3941957 - RNA, 15 nt, Human adenovirus F
uugcaagauaugucu

SEQ ID NO: 3941958 - RNA, 20 nt, Human adenovirus F
uugcacgcucugcaucucuu

SEQ ID NO: 3941959 - RNA, 22 nt, Human adenovirus F
uugcaugcccgagccggagagg

SEQ ID NO: 3941960 - RNA, 23 nt, Human adenovirus F
uugcaugcccgagccggagaggg

SEQ ID NO: 3941961 - RNA, 18 nt, Human adenovirus F
uugccggcaacgcugcag

SEQ ID NO: 3941962 - RNA, 18 nt, Human adenovirus F
uugccuucuuuucugcuc

SEQ ID NO: 3941963 - RNA, 20 nt, Human adenovirus F
uugcgcaggcgaauaaaagg

SEQ ID NO: 3941964 - RNA, 13 nt, Human adenovirus F
uugcuacauaacu

SEQ ID NO: 3941965 - RNA, 16 nt, Human adenovirus F
uugcugcacugccauc

SEQ ID NO: 3941966 - RNA, 20 nt, Human adenovirus F
uuggaaaucgugcccgugga

SEQ ID NO: 3941967 - RNA, 21 nt, Human adenovirus F
uuggauccagugcaggaagag

SEQ ID NO: 3941968 - RNA, 17 nt, Human adenovirus F
uuguacaaagucaucca

SEQ ID NO: 3941969 - RNA, 16 nt, Human adenovirus F
uuguagucugccaacg

SEQ ID NO: 3941970 - RNA, 21 nt, Human adenovirus F
uuguuguuuuuuguagaugca

SEQ ID NO: 3941971 - RNA, 15 nt, Human adenovirus F
uuuaaaacuuuaugg

SEQ ID NO: 3941972 - RNA, 12 nt, Human adenovirus F
uuuaaacuuuuu

SEQ ID NO: 3941973 - RNA, 23 nt, Human adenovirus F
uuuaauauugcuuuauugccacc

SEQ ID NO: 3941974 - RNA, 19 nt, Human adenovirus F
uuuaauggaaacugaugcu

SEQ ID NO: 3941975 - RNA, 21 nt, Human adenovirus F
uuuaauugaaauuaauugcac

SEQ ID NO: 3941976 - RNA, 23 nt, Human adenovirus F
uuuaccaccccagcacuuggauu

SEQ ID NO: 3941977 - RNA, 13 nt, Human adenovirus F
uuuaugaaucacu

SEQ ID NO: 3941978 - RNA, 21 nt, Human adenovirus F
uuucacguaguaucucauccc

SEQ ID NO: 3941979 - RNA, 12 nt, Human adenovirus F
uuuccaccaggg

SEQ ID NO: 3941980 - RNA, 23 nt, Human adenovirus F
uuuccagcagcaccaccugcccu

SEQ ID NO: 3941981 - RNA, 18 nt, Human adenovirus F
uuucuuaccucguguuuc

SEQ ID NO: 3941982 - RNA, 20 nt, Human adenovirus F
uuugccacacuaaaguuuua

SEQ ID NO: 3941983 - RNA, 15 nt, Human adenovirus F
uuugccuucuuuucu

SEQ ID NO: 3941984 - RNA, 17 nt, Human adenovirus F
uuuggccugaauuuuua

SEQ ID NO: 3941985 - RNA, 15 nt, Human adenovirus F
uuuggcucaacuuua

SEQ ID NO: 3941986 - RNA, 14 nt, Human adenovirus F
uuugggagccagga

SEQ ID NO: 3941987 - RNA, 15 nt, Human adenovirus F
uuuugcaaacuauuc

SEQ ID NO: 3941988 - RNA, 14 nt, Human adenovirus F
uuuuuaugaaacac

SEQ ID NO: 3941989 - RNA, 15 nt, Human adenovirus F
uuuuuaugaaucacu

SEQ ID NO: 3941990 - RNA, 20 nt, Human adenovirus F
cucccuccccccuuccacuu

SEQ ID NO: 3941991 - RNA, 21 nt, Human adenovirus F
cuccgauuuugucccccucug

SEQ ID NO: 3941992 - RNA, 16 nt, Human adenovirus F
cuccugcaguccacuu

SEQ ID NO: 3941993 - RNA, 18 nt, Human adenovirus F
cucgagguguaacauccc

SEQ ID NO: 3941994 - RNA, 23 nt, Human adenovirus F
cucgauuuccauaaacuccucuu

SEQ ID NO: 3941995 - RNA, 19 nt, Human adenovirus F
cucgcuggcuagguaccca

SEQ ID NO: 3941996 - RNA, 18 nt, Human adenovirus F
cucggaguaccugagccc

SEQ ID NO: 3941997 - RNA, 20 nt, Human adenovirus F
cucgucauaggccauuuuga

SEQ ID NO: 3941998 - RNA, 19 nt, Human adenovirus F
cucguuguuuuccucugac

SEQ ID NO: 3941999 - RNA, 23 nt, Human adenovirus F
cucucagcugcuaaccugugcag

SEQ ID NO: 3942000 - RNA, 13 nt, Human adenovirus F
cucugaggacgga

SEQ ID NO: 3942001 - RNA, 18 nt, Human adenovirus F
cucugucuuauccuccuu

SEQ ID NO: 3942002 - RNA, 16 nt, Human adenovirus F
cucuguggagaaccuu

SEQ ID NO: 3942003 - RNA, 23 nt, Human adenovirus F
cucuguuugcugcacugccaucu

SEQ ID NO: 3942004 - RNA, 13 nt, Human adenovirus F
cucuuacaccucc

SEQ ID NO: 3942005 - RNA, 15 nt, Human adenovirus F
cucuucguccuggag

SEQ ID NO: 3942006 - RNA, 15 nt, Human adenovirus F
cucuuggucagcaag

SEQ ID NO: 3942007 - RNA, 15 nt, Human adenovirus F
cugaaauacacugau

SEQ ID NO: 3942008 - RNA, 15 nt, Human adenovirus F
cugaaguucagaaca

SEQ ID NO: 3942009 - RNA, 19 nt, Human adenovirus F
cugaaugcauguacacuau

SEQ ID NO: 3942010 - RNA, 16 nt, Human adenovirus F
cugacgguggaggaau

SEQ ID NO: 3942011 - RNA, 22 nt, Human adenovirus F
cugagccugaucccgaagaggg

SEQ ID NO: 3942012 - RNA, 16 nt, Human adenovirus F
cugaggaggaggccau

SEQ ID NO: 3942013 - RNA, 13 nt, Human adenovirus F
cugaucagccagg

SEQ ID NO: 3942014 - RNA, 16 nt, Human adenovirus F
cugauccacuuacaac

SEQ ID NO: 3942015 - RNA, 18 nt, Human adenovirus F
cugcaauggcagcccagc

SEQ ID NO: 3942016 - RNA, 14 nt, Human adenovirus F
cugcacuaugccuu

SEQ ID NO: 3942017 - RNA, 13 nt, Human adenovirus F
cugccacugaaac

SEQ ID NO: 3942018 - RNA, 13 nt, Human adenovirus F
cugccagagggug

SEQ ID NO: 3942019 - RNA, 13 nt, Human adenovirus F
cugccagugcagg

SEQ ID NO: 3942020 - RNA, 13 nt, Human adenovirus F
cugccaguugggg

SEQ ID NO: 3942021 - RNA, 14 nt, Human adenovirus F
cugcccuuccuccc

SEQ ID NO: 3942022 - RNA, 15 nt, Human adenovirus F
cugcccuuccuccca

SEQ ID NO: 3942023 - RNA, 21 nt, Human adenovirus F
cugccguugcaaccucugcac

SEQ ID NO: 3942024 - RNA, 12 nt, Human adenovirus F
cugcgcccccac

SEQ ID NO: 3942025 - RNA, 13 nt, Human adenovirus F
cugcgggaggaau

SEQ ID NO: 3942026 - RNA, 15 nt, Human adenovirus F
cugcuagaaugucac

SEQ ID NO: 3942027 - RNA, 19 nt, Human adenovirus F
cuggaacaguaacacaggu

SEQ ID NO: 3942028 - RNA, 21 nt, Human adenovirus F
cuggaacgagaucggcaccag

SEQ ID NO: 3942029 - RNA, 19 nt, Human adenovirus F
cuggacucgucuccugcaa

SEQ ID NO: 3942030 - RNA, 20 nt, Human adenovirus F
cuggaggcuugggaggauuu

SEQ ID NO: 3942031 - RNA, 16 nt, Human adenovirus F
cuggaguuggcuucug

SEQ ID NO: 3942032 - RNA, 21 nt, Human adenovirus F
cuggaguuggcuucugccaga

SEQ ID NO: 3942033 - RNA, 17 nt, Human adenovirus F
cuggauuacauggcaau

SEQ ID NO: 3942034 - RNA, 12 nt, Human adenovirus F
cuggcagcagug

SEQ ID NO: 3942035 - RNA, 13 nt, Human adenovirus F
cuggcagcuggag

SEQ ID NO: 3942036 - RNA, 18 nt, Human adenovirus F
cuggccaacugccaccuc

SEQ ID NO: 3942037 - RNA, 17 nt, Human adenovirus F
cuggccuuuugaacgac

SEQ ID NO: 3942038 - RNA, 13 nt, Human adenovirus F
cugggacagccua

SEQ ID NO: 3942039 - RNA, 21 nt, Human adenovirus F
cugggcuggaugcauccuccc

SEQ ID NO: 3942040 - RNA, 13 nt, Human adenovirus F
cugggcuugcuuu

SEQ ID NO: 3942041 - RNA, 23 nt, Human adenovirus F
cuggucaaucucuucguccugga

SEQ ID NO: 3942042 - RNA, 14 nt, Human adenovirus F
cugguggacaacaa

SEQ ID NO: 3942043 - RNA, 12 nt, Human adenovirus F
cugguuaaacaa

SEQ ID NO: 3942044 - RNA, 23 nt, Human adenovirus F
cugguuaaacaagcugaacuuug

SEQ ID NO: 3942045 - RNA, 15 nt, Human adenovirus F
cugucaggcucugag

SEQ ID NO: 3942046 - RNA, 18 nt, Human adenovirus F
cugucauacgcaggcaca

SEQ ID NO: 3942047 - RNA, 20 nt, Human adenovirus F
cugucauacgcaggcacacc

SEQ ID NO: 3942048 - RNA, 13 nt, Human adenovirus F
cuguccagggagu

SEQ ID NO: 3942049 - RNA, 15 nt, Human adenovirus F
cugucuagccgcacg

SEQ ID NO: 3942050 - RNA, 11 nt, Human adenovirus F
cugucuggaac

SEQ ID NO: 3942051 - RNA, 14 nt, Human adenovirus F
cugucugugucucc

SEQ ID NO: 3942052 - RNA, 16 nt, Human adenovirus F
cugugagcuggccugg

SEQ ID NO: 3942053 - RNA, 15 nt, Human adenovirus F
cugugccugucauga

SEQ ID NO: 3942054 - RNA, 22 nt, Human adenovirus F
cuguguuaucacccaaagccaa

SEQ ID NO: 3942055 - RNA, 21 nt, Human adenovirus F
cuuaacccucccgcuaauacu

SEQ ID NO: 3942056 - RNA, 19 nt, Human adenovirus F
cuuaauaccccgucacucu

SEQ ID NO: 3942057 - RNA, 14 nt, Human adenovirus F
cuuacaaacaguaa

SEQ ID NO: 3942058 - RNA, 22 nt, Human adenovirus F
cuuacauaucgcuugccacugg

SEQ ID NO: 3942059 - RNA, 13 nt, Human adenovirus F
cuuaccagagcca

SEQ ID NO: 3942060 - RNA, 15 nt, Human adenovirus F
cuucacuccucgcca

SEQ ID NO: 3942061 - RNA, 21 nt, Human adenovirus F
cuuccaagcgguccauugccu

SEQ ID NO: 3942062 - RNA, 19 nt, Human adenovirus F
cuuccuccaacggcuugca

SEQ ID NO: 3942063 - RNA, 17 nt, Human adenovirus F
cuuccucccccgagaga

SEQ ID NO: 3942064 - RNA, 20 nt, Human adenovirus F
cuucucuucggccuccacau

SEQ ID NO: 3942065 - RNA, 11 nt, Human adenovirus F
cuucugccagu

SEQ ID NO: 3942066 - RNA, 18 nt, Human adenovirus F
cuugcugacuuaucucau

SEQ ID NO: 3942067 - RNA, 14 nt, Human adenovirus F
cuugcuggaccaaa

SEQ ID NO: 3942068 - RNA, 19 nt, Human adenovirus F
cuuggaaaucgugcccgug

SEQ ID NO: 3942069 - RNA, 18 nt, Human adenovirus F
cuuggaaucauccaccug

SEQ ID NO: 3942070 - RNA, 15 nt, Human adenovirus F
cuugggaggauuuug

SEQ ID NO: 3942071 - RNA, 21 nt, Human adenovirus F
cuugucgcagaaucuccugca

SEQ ID NO: 3942072 - RNA, 16 nt, Human adenovirus F
cuuuauugccaccgca

SEQ ID NO: 3942073 - RNA, 16 nt, Human adenovirus F
cuuuccgcgaggccau

SEQ ID NO: 3942074 - RNA, 11 nt, Human adenovirus F
cuuucuuacac

SEQ ID NO: 3942075 - RNA, 17 nt, Human adenovirus F
cuuugucagccaaagua

SEQ ID NO: 3942076 - RNA, 19 nt, Human adenovirus F
cuuuuauugauucaaaaaa

SEQ ID NO: 3942077 - RNA, 19 nt, Human adenovirus F
cuuuugcaccagggcggcg

SEQ ID NO: 3942078 - RNA, 18 nt, Human adenovirus F
gaaaaaccgccacaugaa

SEQ ID NO: 3942079 - RNA, 18 nt, Human adenovirus F
gaaaaccggcuggggcag

SEQ ID NO: 3942080 - RNA, 19 nt, Human adenovirus F
gaaacugaugcuuuuucuc

SEQ ID NO: 3942081 - RNA, 14 nt, Human adenovirus F
gaaagcgugaugga

SEQ ID NO: 3942082 - RNA, 13 nt, Human adenovirus F
gaaaggaguaaag

SEQ ID NO: 3942083 - RNA, 15 nt, Human adenovirus F
gaacacaauauuuau

SEQ ID NO: 3942084 - RNA, 14 nt, Human adenovirus F
gaacauuaauccaa

SEQ ID NO: 3942085 - RNA, 20 nt, Human adenovirus F
gaacauuggggcgcgguggu

SEQ ID NO: 3942086 - RNA, 16 nt, Human adenovirus F
gaaccaggcaguggac

SEQ ID NO: 3942087 - RNA, 17 nt, Human adenovirus F
gaacggcgugcuggaaa

SEQ ID NO: 3942088 - RNA, 19 nt, Human adenovirus F
gaacucaaaguaaaaaacc

SEQ ID NO: 3942089 - RNA, 19 nt, Human adenovirus F
gaagaccgauaguacggcc

SEQ ID NO: 3942090 - RNA, 15 nt, Human adenovirus F
gaagagcugcuggag

SEQ ID NO: 3942091 - RNA, 23 nt, Human adenovirus F
gaagcacauagcgcgacagagca

SEQ ID NO: 3942092 - RNA, 17 nt, Human adenovirus F
gaagcaggguugcuaga

SEQ ID NO: 3942093 - RNA, 22 nt, Human adenovirus F
gaagccacgcugaacuuuuugc

SEQ ID NO: 3942094 - RNA, 22 nt, Human adenovirus F
gaaggggccagcaagcugccgc

SEQ ID NO: 3942095 - RNA, 16 nt, Human adenovirus F
gaagguugacuugcag

SEQ ID NO: 3942096 - RNA, 17 nt, Human adenovirus F
gaagguugacuugcagg

SEQ ID NO: 3942097 - RNA, 23 nt, Human adenovirus F
gaagugcuaggcucuucuuccuc

SEQ ID NO: 3942098 - RNA, 19 nt, Human adenovirus F
gaaguucagaacauggcuc

SEQ ID NO: 3942099 - RNA, 12 nt, Human adenovirus F
gaaucauuucca

SEQ ID NO: 3942100 - RNA, 22 nt, Human adenovirus F
gaaucccgcuauguuggcggcc

SEQ ID NO: 3942101 - RNA, 13 nt, Human adenovirus F
gaaucgcuggaaa

SEQ ID NO: 3942102 - RNA, 13 nt, Human adenovirus F
gacaaaacacuaa

SEQ ID NO: 3942103 - RNA, 15 nt, Human adenovirus F
gacagcaaggaaaga

SEQ ID NO: 3942104 - RNA, 15 nt, Human adenovirus F
gacagccaggcagag

SEQ ID NO: 3942105 - RNA, 13 nt, Human adenovirus F
gacagucugccaa

SEQ ID NO: 3942106 - RNA, 15 nt, Human adenovirus F
gacagucugccaaca

SEQ ID NO: 3942107 - RNA, 21 nt, Human adenovirus F
uccauccaucacgccaacgcc

SEQ ID NO: 3942108 - RNA, 18 nt, Human adenovirus F
ucccaaagucccccuuac

SEQ ID NO: 3942109 - RNA, 11 nt, Human adenovirus F
ucccaaagucg

SEQ ID NO: 3942110 - RNA, 18 nt, Human adenovirus F
ucccaacaaccuacccag

SEQ ID NO: 3942111 - RNA, 16 nt, Human adenovirus F
ucccagcagaaacuac

SEQ ID NO: 3942112 - RNA, 15 nt, Human adenovirus F
ucccagucugccauc

SEQ ID NO: 3942113 - RNA, 18 nt, Human adenovirus F
ucccaucaucgccgccgc

SEQ ID NO: 3942114 - RNA, 19 nt, Human adenovirus F
uccccagcgcccuggauac

SEQ ID NO: 3942115 - RNA, 17 nt, Human adenovirus F
ucccucagagcugcaag

SEQ ID NO: 3942116 - RNA, 18 nt, Human adenovirus F
ucccuggcccccaaaggu

SEQ ID NO: 3942117 - RNA, 20 nt, Human adenovirus F
ucccugggaugcagguagga

SEQ ID NO: 3942118 - RNA, 19 nt, Human adenovirus F
ucccugucguugccagccg

SEQ ID NO: 3942119 - RNA, 15 nt, Human adenovirus F
uccgccauugccacc

SEQ ID NO: 3942120 - RNA, 14 nt, Human adenovirus F
uccgcccgcuccga

SEQ ID NO: 3942121 - RNA, 17 nt, Human adenovirus F
uccgcugggagaaaacc

SEQ ID NO: 3942122 - RNA, 21 nt, Human adenovirus F
uccuagccaguggacaaacca

SEQ ID NO: 3942123 - RNA, 14 nt, Human adenovirus F
uccucccaacuuuc

SEQ ID NO: 3942124 - RNA, 18 nt, Human adenovirus F
uccucugacgggggaggc

SEQ ID NO: 3942125 - RNA, 13 nt, Human adenovirus F
uccuggaccugga

SEQ ID NO: 3942126 - RNA, 18 nt, Human adenovirus F
uccuggccaacugccacc

SEQ ID NO: 3942127 - RNA, 20 nt, Human adenovirus F
uccuggccaacugccaccuc

SEQ ID NO: 3942128 - RNA, 14 nt, Human adenovirus F
uccuggcgagccca

SEQ ID NO: 3942129 - RNA, 14 nt, Human adenovirus F
uccuucugccacgc

SEQ ID NO: 3942130 - RNA, 19 nt, Human adenovirus F
ucgaagguugacuugcagg

SEQ ID NO: 3942131 - RNA, 23 nt, Human adenovirus F
ucgaccgcgaggaaaccgccuac

SEQ ID NO: 3942132 - RNA, 15 nt, Human adenovirus F
ucgacuccucuguga

SEQ ID NO: 3942133 - RNA, 22 nt, Human adenovirus F
ucgagguguaacaucccucacu

SEQ ID NO: 3942134 - RNA, 16 nt, Human adenovirus F
ucgcaacguccucuac

SEQ ID NO: 3942135 - RNA, 24 nt, Human adenovirus F
ucgcacuccacuaaccaggcgagc

SEQ ID NO: 3942136 - RNA, 20 nt, Human adenovirus F
ucgccccugugaguguggag

SEQ ID NO: 3942137 - RNA, 14 nt, Human adenovirus F
ucgccgcagucucc

SEQ ID NO: 3942138 - RNA, 20 nt, Human adenovirus F
ucgcggccguuuaugggcac

SEQ ID NO: 3942139 - RNA, 18 nt, Human adenovirus F
ucgcucacccgcagcugc

SEQ ID NO: 3942140 - RNA, 18 nt, Human adenovirus F
ucggaaccugaaagagag

SEQ ID NO: 3942141 - RNA, 12 nt, Human adenovirus F
ucggcacgcucc

SEQ ID NO: 3942142 - RNA, 15 nt, Human adenovirus F
ucggccuacugccgc

SEQ ID NO: 3942143 - RNA, 21 nt, Human adenovirus F
ucgggaaagacaguggcgcgc

SEQ ID NO: 3942144 - RNA, 23 nt, Human adenovirus F
ucggguugccguccccagcgccc

SEQ ID NO: 3942145 - RNA, 12 nt, Human adenovirus F
ucguacuucugu

SEQ ID NO: 3942146 - RNA, 16 nt, Human adenovirus F
ucguagggauugagug

SEQ ID NO: 3942147 - RNA, 13 nt, Human adenovirus F
ucguuggcgccgg

SEQ ID NO: 3942148 - RNA, 22 nt, Human adenovirus F
ucuacaacgagauaaacagugg

SEQ ID NO: 3942149 - RNA, 19 nt, Human adenovirus F
ucuaccacuucuauugcac

SEQ ID NO: 3942150 - RNA, 20 nt, Human adenovirus F
ucuauagagcuaaggaggag

SEQ ID NO: 3942151 - RNA, 14 nt, Human adenovirus F
ucuccuaacgccac

SEQ ID NO: 3942152 - RNA, 16 nt, Human adenovirus F
ucucgguaacgaccuc

SEQ ID NO: 3942153 - RNA, 23 nt, Human adenovirus F
ucucguuuaauccgugcgcugcc

SEQ ID NO: 3942154 - RNA, 21 nt, Human adenovirus F
ucugauggaguuguggaguga

SEQ ID NO: 3942155 - RNA, 17 nt, Human adenovirus F
ucugcagcauugccacu

SEQ ID NO: 3942156 - RNA, 22 nt, Human adenovirus F
ucugccaauuaucuacgccucc

SEQ ID NO: 3942157 - RNA, 22 nt, Human adenovirus F
ucuuacaaagugcgcuuuacgc

SEQ ID NO: 3942158 - RNA, 13 nt, Human adenovirus F
ucuuacaauuuga

SEQ ID NO: 3942159 - RNA, 20 nt, Human adenovirus F
ucuuaccgcgacaaagcaca

SEQ ID NO: 3942160 - RNA, 19 nt, Human adenovirus F
ucuucaaacauuaagcugc

SEQ ID NO: 3942161 - RNA, 20 nt, Human adenovirus F
ucuucaaucguuuuccugag

SEQ ID NO: 3942162 - RNA, 16 nt, Human adenovirus F
ucuugcaaagacggcg

SEQ ID NO: 3942163 - RNA, 21 nt, Human adenovirus F
ugaacgugaccgagcagcugc

SEQ ID NO: 3942164 - RNA, 14 nt, Human adenovirus F
ugaacguugcauua

SEQ ID NO: 3942165 - RNA, 23 nt, Human adenovirus F
ugaagaccaaucacgaccuccca

SEQ ID NO: 3942166 - RNA, 15 nt, Human adenovirus F
ugaagcuaaccuguu

SEQ ID NO: 3942167 - RNA, 16 nt, Human adenovirus F
ugaauaauucccaaau

SEQ ID NO: 3942168 - RNA, 20 nt, Human adenovirus F
ugaauauugcggagccugag

SEQ ID NO: 3942169 - RNA, 14 nt, Human adenovirus F
ugacaaacaagcug

SEQ ID NO: 3942170 - RNA, 23 nt, Human adenovirus F
ugacagcauuaaccuguaugcca

SEQ ID NO: 3942171 - RNA, 16 nt, Human adenovirus F
ugaccgagcagcugcg

SEQ ID NO: 3942172 - RNA, 22 nt, Human adenovirus F
ugacgaacuuacuagucuuagc

SEQ ID NO: 3942173 - RNA, 13 nt, Human adenovirus F
ugacgugccugag

SEQ ID NO: 3942174 - RNA, 22 nt, Human adenovirus F
ugacuacgaauccagcgaugag

SEQ ID NO: 3942175 - RNA, 12 nt, Human adenovirus F
ugacucuuacaa

SEQ ID NO: 3942176 - RNA, 21 nt, Human adenovirus F
ugagcggaguaacacaaacau

SEQ ID NO: 3942177 - RNA, 18 nt, Human adenovirus F
ugaggcagcgacagggcg

SEQ ID NO: 3942178 - RNA, 15 nt, Human adenovirus F
ugaguuagcucugaa

SEQ ID NO: 3942179 - RNA, 15 nt, Human adenovirus F
ugauaugaugaaagu

SEQ ID NO: 3942180 - RNA, 15 nt, Human adenovirus F
ugaugauggcagcag

SEQ ID NO: 3942181 - RNA, 20 nt, Human adenovirus F
ugaugcuacacaacaaauca

SEQ ID NO: 3942182 - RNA, 18 nt, Human adenovirus F
ugaugcugcugaugagga

SEQ ID NO: 3942183 - RNA, 19 nt, Human adenovirus F
ugauuuccauuggugaguu

SEQ ID NO: 3942184 - RNA, 19 nt, Human adenovirus F
ugcaaacaacgaacuuucu

SEQ ID NO: 3942185 - RNA, 15 nt, Human adenovirus F
ugcaauauaaaaaca

SEQ ID NO: 3942186 - RNA, 19 nt, Human adenovirus F
ugcaauauaaaaacaacca

SEQ ID NO: 3942187 - RNA, 18 nt, Human adenovirus F
ugcaccgcgcggcggcca

SEQ ID NO: 3942188 - RNA, 17 nt, Human adenovirus F
ugcacuaacuccaaaua

SEQ ID NO: 3942189 - RNA, 14 nt, Human adenovirus F
ugcacugagcagcu

SEQ ID NO: 3942190 - RNA, 23 nt, Human adenovirus F
ugcagaggcguacaugccacaga

SEQ ID NO: 3942191 - RNA, 20 nt, Human adenovirus F
ugcagcauugccacuuuuuu

SEQ ID NO: 3942192 - RNA, 18 nt, Human adenovirus F
ugcaggaagaggaggagg

SEQ ID NO: 3942193 - RNA, 18 nt, Human adenovirus F
ugcauccucccaacaacc

SEQ ID NO: 3942194 - RNA, 18 nt, Human adenovirus F
ugccacccgcgcaacaca

SEQ ID NO: 3942195 - RNA, 20 nt, Human adenovirus F
ugccaccgcaaaaaaaucaa

SEQ ID NO: 3942196 - RNA, 16 nt, Human adenovirus F
ugccagaacuuccagc

SEQ ID NO: 3942197 - RNA, 12 nt, Human adenovirus F
ugccagugcagg

SEQ ID NO: 3942198 - RNA, 16 nt, Human adenovirus F
ugccaucugcagcauu

SEQ ID NO: 3942199 - RNA, 20 nt, Human adenovirus F
ugccaucugcagcauugcca

SEQ ID NO: 3942200 - RNA, 18 nt, Human adenovirus F
ugccauuguuaacacggc

SEQ ID NO: 3942201 - RNA, 16 nt, Human adenovirus F
ugcccaacaguacagu

SEQ ID NO: 3942202 - RNA, 17 nt, Human adenovirus F
ugcccaccguuccgccc

SEQ ID NO: 3942203 - RNA, 16 nt, Human adenovirus F
ugcccauuauugcacu

SEQ ID NO: 3942204 - RNA, 15 nt, Human adenovirus F
ugccgagcuuuuacu

SEQ ID NO: 3942205 - RNA, 19 nt, Human adenovirus F
ugccgguuucgcauucccg

SEQ ID NO: 3942206 - RNA, 16 nt, Human adenovirus F
ugccuaccucugacaa

SEQ ID NO: 3942207 - RNA, 17 nt, Human adenovirus F
ugccuccagcacugccg

SEQ ID NO: 3942208 - RNA, 15 nt, Human adenovirus F
ugccugaagcacugg

SEQ ID NO: 3942209 - RNA, 21 nt, Human adenovirus F
ugcgcaacuucuuuuugggag

SEQ ID NO: 3942210 - RNA, 22 nt, Human adenovirus F
ugcgcagcaguaucaguggagu

SEQ ID NO: 3942211 - RNA, 23 nt, Human adenovirus F
ugcgcgguaagaacccagcaugu

SEQ ID NO: 3942212 - RNA, 22 nt, Human adenovirus F
ugcgcuguacugugcauuuggg

SEQ ID NO: 3942213 - RNA, 20 nt, Human adenovirus F
ugcguggguguauaaaaggg

SEQ ID NO: 3942214 - RNA, 12 nt, Human adenovirus F
ugcuaaacauga

SEQ ID NO: 3942215 - RNA, 13 nt, Human adenovirus F
ugcuaaagggaac

SEQ ID NO: 3942216 - RNA, 15 nt, Human adenovirus F
ugcuacacaacaaau

SEQ ID NO: 3942217 - RNA, 18 nt, Human adenovirus F
ugcuacacaacaaaucau

SEQ ID NO: 3942218 - RNA, 22 nt, Human adenovirus F
ugcuacacaacaaaucaucucu

SEQ ID NO: 3942219 - RNA, 17 nt, Human adenovirus F
ugcuacggaggaagagg

SEQ ID NO: 3942220 - RNA, 16 nt, Human adenovirus F
ugcucggugcagccgu

SEQ ID NO: 3942221 - RNA, 12 nt, Human adenovirus F
ugcucugcaaaa

SEQ ID NO: 3942222 - RNA, 13 nt, Human adenovirus F
ugcugacagcugg

SEQ ID NO: 3942223 - RNA, 16 nt, Human adenovirus F
uggaaaacgaggggga

SEQ ID NO: 3942224 - RNA, 19 nt, Human adenovirus F
uggaaacugucaggcucug

SEQ ID NO: 3942225 - RNA, 23 nt, Human adenovirus F
cuugcaggagccgaauugccucg

SEQ ID NO: 3942226 - RNA, 17 nt, Human adenovirus F
cuugcgcaacuucuuuu

SEQ ID NO: 3942227 - RNA, 21 nt, Human adenovirus F
cuugcuuuuucacgacggggu

SEQ ID NO: 3942228 - RNA, 14 nt, Human adenovirus F
cuugucguaaccaa

SEQ ID NO: 3942229 - RNA, 16 nt, Human adenovirus F
cuuucaucuuaacucu

SEQ ID NO: 3942230 - RNA, 22 nt, Human adenovirus F
cuuugcgcgaacagaguggggg

SEQ ID NO: 3942231 - RNA, 14 nt, Human adenovirus F
cuuuugcaccaggg

SEQ ID NO: 3942232 - RNA, 15 nt, Human adenovirus F
cuuuuugggaggaag

SEQ ID NO: 3942233 - RNA, 17 nt, Human adenovirus F
gaaaaccauuuugcgca

SEQ ID NO: 3942234 - RNA, 20 nt, Human adenovirus F
gaaaaccuacgcccaggagc

SEQ ID NO: 3942235 - RNA, 17 nt, Human adenovirus F
gaaacacacaucacugu

SEQ ID NO: 3942236 - RNA, 14 nt, Human adenovirus F
gaaacgaacacgcu

SEQ ID NO: 3942237 - RNA, 19 nt, Human adenovirus F
gaaacugucaggcucugag

SEQ ID NO: 3942238 - RNA, 15 nt, Human adenovirus F
gaaaucacaguuggg

SEQ ID NO: 3942239 - RNA, 17 nt, Human adenovirus F
gaaaucggagagggaag

SEQ ID NO: 3942240 - RNA, 14 nt, Human adenovirus F
gaaauugaaguagg

SEQ ID NO: 3942241 - RNA, 19 nt, Human adenovirus F
gaaauugaaguaggcgguc

SEQ ID NO: 3942242 - RNA, 21 nt, Human adenovirus F
gaacacgcugccaacaaaugu

SEQ ID NO: 3942243 - RNA, 18 nt, Human adenovirus F
gaacagaccuuccaggaa

SEQ ID NO: 3942244 - RNA, 20 nt, Human adenovirus F
gaaccacugauguaacagcu

SEQ ID NO: 3942245 - RNA, 18 nt, Human adenovirus F
gaaccaggcaguggacag

SEQ ID NO: 3942246 - RNA, 22 nt, Human adenovirus F
gaaccuccgacgcuugcuggag

SEQ ID NO: 3942247 - RNA, 22 nt, Human adenovirus F
gaacguguugguagagcuggag

SEQ ID NO: 3942248 - RNA, 16 nt, Human adenovirus F
gaacugggcugcggac

SEQ ID NO: 3942249 - RNA, 15 nt, Human adenovirus F
gaagaagaugcccug

SEQ ID NO: 3942250 - RNA, 18 nt, Human adenovirus F
gaagacauucuugagcag

SEQ ID NO: 3942251 - RNA, 21 nt, Human adenovirus F
gaagccacgcugaacuuuuug

SEQ ID NO: 3942252 - RNA, 17 nt, Human adenovirus F
gaagcuagcauaaaaga

SEQ ID NO: 3942253 - RNA, 22 nt, Human adenovirus F
gaaggauacaacguggcucaau

SEQ ID NO: 3942254 - RNA, 22 nt, Human adenovirus F
gaaggguauaggcuugugcggc

SEQ ID NO: 3942255 - RNA, 18 nt, Human adenovirus F
gaaucuuacuuugacaug

SEQ ID NO: 3942256 - RNA, 15 nt, Human adenovirus F
gaaugcccuuucaaa

SEQ ID NO: 3942257 - RNA, 19 nt, Human adenovirus F
gaauguaacucucccuuuc

SEQ ID NO: 3942258 - RNA, 15 nt, Human adenovirus F
gaauguggugggguc

SEQ ID NO: 3942259 - RNA, 18 nt, Human adenovirus F
gaaugugucuccgcuggg

SEQ ID NO: 3942260 - RNA, 13 nt, Human adenovirus F
gacaaagaggcgu

SEQ ID NO: 3942261 - RNA, 13 nt, Human adenovirus F
gacaagacaugga

SEQ ID NO: 3942262 - RNA, 16 nt, Human adenovirus F
gacaagacauggaaga

SEQ ID NO: 3942263 - RNA, 23 nt, Human adenovirus F
gacaccacccggguuuaccuggu

SEQ ID NO: 3942264 - RNA, 14 nt, Human adenovirus F
gacagcaaggaaag

SEQ ID NO: 3942265 - RNA, 17 nt, Human adenovirus F
gacagcaaggaaagaag

SEQ ID NO: 3942266 - RNA, 14 nt, Human adenovirus F
gacaggcuguaguu

SEQ ID NO: 3942267 - RNA, 15 nt, Human adenovirus F
gacaggucgcagcga

SEQ ID NO: 3942268 - RNA, 21 nt, Human adenovirus F
gacaguaagcaacaaccagcu

SEQ ID NO: 3942269 - RNA, 18 nt, Human adenovirus F
gacauucuugagcaggcc

SEQ ID NO: 3942270 - RNA, 12 nt, Human adenovirus F
gaccaucacuga

SEQ ID NO: 3942271 - RNA, 22 nt, Human adenovirus F
gaccauucugagacaaaagccc

SEQ ID NO: 3942272 - RNA, 16 nt, Human adenovirus F
gacccauuuccaagca

SEQ ID NO: 3942273 - RNA, 20 nt, Human adenovirus F
gaccucccaaagucccccuu

SEQ ID NO: 3942274 - RNA, 22 nt, Human adenovirus F
gaccuuccaggaaaucaccagc

SEQ ID NO: 3942275 - RNA, 17 nt, Human adenovirus F
gacgaagacauucuuga

SEQ ID NO: 3942276 - RNA, 13 nt, Human adenovirus F
gacgacagccagg

SEQ ID NO: 3942277 - RNA, 15 nt, Human adenovirus F
gacgcgaggaugaga

SEQ ID NO: 3942278 - RNA, 17 nt, Human adenovirus F
gacggcaaggaaccagu

SEQ ID NO: 3942279 - RNA, 19 nt, Human adenovirus F
gacggccguaccaagccug

SEQ ID NO: 3942280 - RNA, 22 nt, Human adenovirus F
gacucggaaccugaaagagagu

SEQ ID NO: 3942281 - RNA, 19 nt, Human adenovirus F
gacucguaccuuggucauc

SEQ ID NO: 3942282 - RNA, 22 nt, Human adenovirus F
gacuuuaccccgacagaggccg

SEQ ID NO: 3942283 - RNA, 17 nt, Human adenovirus F
gagacugccaagccuca

SEQ ID NO: 3942284 - RNA, 17 nt, Human adenovirus F
gagaggcgguggcgcag

SEQ ID NO: 3942285 - RNA, 16 nt, Human adenovirus F
gagauccguggagccg

SEQ ID NO: 3942286 - RNA, 22 nt, Human adenovirus F
gagcaagcgcaaguucaaagaa

SEQ ID NO: 3942287 - RNA, 16 nt, Human adenovirus F
gagcaaguggagcaag

SEQ ID NO: 3942288 - RNA, 13 nt, Human adenovirus F
gagcagccugugg

SEQ ID NO: 3942289 - RNA, 15 nt, Human adenovirus F
gagcagccuguggag

SEQ ID NO: 3942290 - RNA, 14 nt, Human adenovirus F
gagcgugguggcaa

SEQ ID NO: 3942291 - RNA, 23 nt, Human adenovirus F
gagcuagugaaacaugaggagga

SEQ ID NO: 3942292 - RNA, 21 nt, Human adenovirus F
gagcucugcaaaaacaaauac

SEQ ID NO: 3942293 - RNA, 11 nt, Human adenovirus F
gagcuggccug

SEQ ID NO: 3942294 - RNA, 13 nt, Human adenovirus F
gagcuggccuggu

SEQ ID NO: 3942295 - RNA, 16 nt, Human adenovirus F
gaggaacguauuuugc

SEQ ID NO: 3942296 - RNA, 9 nt, Human adenovirus F
gaggaggag

SEQ ID NO: 3942297 - RNA, 16 nt, Human adenovirus F
gaggagucccugcacu

SEQ ID NO: 3942298 - RNA, 17 nt, Human adenovirus F
gaggcacaccuuugggc

SEQ ID NO: 3942299 - RNA, 14 nt, Human adenovirus F
gaggcagcagagga

SEQ ID NO: 3942300 - RNA, 16 nt, Human adenovirus F
gaggccguagcccgug

SEQ ID NO: 3942301 - RNA, 15 nt, Human adenovirus F
gaggcgauuugggag

SEQ ID NO: 3942302 - RNA, 23 nt, Human adenovirus F
gagggauucuaagggaggcagca

SEQ ID NO: 3942303 - RNA, 16 nt, Human adenovirus F
gaggguacuagcagug

SEQ ID NO: 3942304 - RNA, 17 nt, Human adenovirus F
gaggguacuagcagugg

SEQ ID NO: 3942305 - RNA, 23 nt, Human adenovirus F
gagguguuggagaacaugaaagu

SEQ ID NO: 3942306 - RNA, 17 nt, Human adenovirus F
gaguaacuuuugccaca

SEQ ID NO: 3942307 - RNA, 14 nt, Human adenovirus F
gagucuggcagcag

SEQ ID NO: 3942308 - RNA, 15 nt, Human adenovirus F
gagucuggcagcagu

SEQ ID NO: 3942309 - RNA, 18 nt, Human adenovirus F
gaguucuugcugacggcc

SEQ ID NO: 3942310 - RNA, 21 nt, Human adenovirus F
gaguuuaaugucucgucgcca

SEQ ID NO: 3942311 - RNA, 16 nt, Human adenovirus F
gaguuuguacccuccg

SEQ ID NO: 3942312 - RNA, 17 nt, Human adenovirus F
gaguuugugcgguccuu

SEQ ID NO: 3942313 - RNA, 18 nt, Human adenovirus F
gauaccgcugcagcugcu

SEQ ID NO: 3942314 - RNA, 18 nt, Human adenovirus F
gauacuuaaaaucagagu

SEQ ID NO: 3942315 - RNA, 12 nt, Human adenovirus F
gaucagcgggca

SEQ ID NO: 3942316 - RNA, 22 nt, Human adenovirus F
gaucaggccuccaauuugacaa

SEQ ID NO: 3942317 - RNA, 23 nt, Human adenovirus F
gaucgccaacagccccagcuggu

SEQ ID NO: 3942318 - RNA, 18 nt, Human adenovirus F
gaucggcaccagccagcu

SEQ ID NO: 3942319 - RNA, 19 nt, Human adenovirus F
gaucuuaagcugcagccag

SEQ ID NO: 3942320 - RNA, 18 nt, Human adenovirus F
gaugaaaguagaagucuc

SEQ ID NO: 3942321 - RNA, 22 nt, Human adenovirus F
gaugaaucgcuggaaaaccuac

SEQ ID NO: 3942322 - RNA, 15 nt, Human adenovirus F
gaugcugcugaugag

SEQ ID NO: 3942323 - RNA, 24 nt, Human adenovirus F
gauggagagcugggacagccuaga

SEQ ID NO: 3942324 - RNA, 14 nt, Human adenovirus F
gauguuuuccaaga

SEQ ID NO: 3942325 - RNA, 21 nt, Human adenovirus F
gauuccugggguagggugucu

SEQ ID NO: 3942326 - RNA, 23 nt, Human adenovirus F
gauuccugggguagggugucugc

SEQ ID NO: 3942327 - RNA, 23 nt, Human adenovirus F
gauucgccauaaugcgggcucug

SEQ ID NO: 3942328 - RNA, 20 nt, Human adenovirus F
gauucuaagggaggcagcag

SEQ ID NO: 3942329 - RNA, 14 nt, Human adenovirus F
gauucuccaaagca

SEQ ID NO: 3942330 - RNA, 17 nt, Human adenovirus F
gauuuacaaaacccccu

SEQ ID NO: 3942331 - RNA, 18 nt, Human adenovirus F
gcaaaaugugcagcaaaa

SEQ ID NO: 3942332 - RNA, 17 nt, Human adenovirus F
gcaaacggugaacgagg

SEQ ID NO: 3942333 - RNA, 17 nt, Human adenovirus F
gcaaacgucaacuccuc

SEQ ID NO: 3942334 - RNA, 13 nt, Human adenovirus F
gcaaccagugggc

SEQ ID NO: 3942335 - RNA, 15 nt, Human adenovirus F
gcaacccugaggagg

SEQ ID NO: 3942336 - RNA, 21 nt, Human adenovirus F
gcaacucauggugccaaagcg

SEQ ID NO: 3942337 - RNA, 16 nt, Human adenovirus F
gcaagccgcugacggc

SEQ ID NO: 3942338 - RNA, 18 nt, Human adenovirus F
gcaagcuucucagcucaa

SEQ ID NO: 3942339 - RNA, 15 nt, Human adenovirus F
gcaaggaaccagugg

SEQ ID NO: 3942340 - RNA, 16 nt, Human adenovirus F
gcaaggaauguggggc

SEQ ID NO: 3942341 - RNA, 21 nt, Human adenovirus F
guacggaccaccagaugaugu

SEQ ID NO: 3942342 - RNA, 17 nt, Human adenovirus F
guacguaccgccucaga

SEQ ID NO: 3942343 - RNA, 18 nt, Human adenovirus F
guacucaaacgcaccauu

SEQ ID NO: 3942344 - RNA, 23 nt, Human adenovirus F
guagcauuuuaacaugagaucau

SEQ ID NO: 3942345 - RNA, 13 nt, Human adenovirus F
guagcguguugga

SEQ ID NO: 3942346 - RNA, 16 nt, Human adenovirus F
guagcucuuccaagcu

SEQ ID NO: 3942347 - RNA, 17 nt, Human adenovirus F
guagcucuuccaagcug

SEQ ID NO: 3942348 - RNA, 17 nt, Human adenovirus F
guaggugacaaagaggc

SEQ ID NO: 3942349 - RNA, 14 nt, Human adenovirus F
guaugaagcuaacc

SEQ ID NO: 3942350 - RNA, 19 nt, Human adenovirus F
guaugguaacuccucuucu

SEQ ID NO: 3942351 - RNA, 16 nt, Human adenovirus F
gucaaaaaagaugcga

SEQ ID NO: 3942352 - RNA, 16 nt, Human adenovirus F
gucacucucagcugcu

SEQ ID NO: 3942353 - RNA, 21 nt, Human adenovirus F
gucagcuacaagauuccacca

SEQ ID NO: 3942354 - RNA, 18 nt, Human adenovirus F
gucauauacuuuaaacaa

SEQ ID NO: 3942355 - RNA, 18 nt, Human adenovirus F
gucaucucuacagccccu

SEQ ID NO: 3942356 - RNA, 14 nt, Human adenovirus F
guccaccugagggg

SEQ ID NO: 3942357 - RNA, 21 nt, Human adenovirus F
guccaggcuaaaacaaaggag

SEQ ID NO: 3942358 - RNA, 17 nt, Human adenovirus F
gucccugggaugcaggu

SEQ ID NO: 3942359 - RNA, 20 nt, Human adenovirus F
guccuggccaacugccaccu

SEQ ID NO: 3942360 - RNA, 15 nt, Human adenovirus F
guccugucgccccug

SEQ ID NO: 3942361 - RNA, 22 nt, Human adenovirus F
gucgcaggguuauacucuggau

SEQ ID NO: 3942362 - RNA, 19 nt, Human adenovirus F
gucgccaucaugagucugu

SEQ ID NO: 3942363 - RNA, 18 nt, Human adenovirus F
gucggcgucgaugguaaa

SEQ ID NO: 3942364 - RNA, 18 nt, Human adenovirus F
gucgggcgugcgggugcc

SEQ ID NO: 3942365 - RNA, 21 nt, Human adenovirus F
gucguacaaguugcaaagcuc

SEQ ID NO: 3942366 - RNA, 15 nt, Human adenovirus F
gucguugccagccgg

SEQ ID NO: 3942367 - RNA, 21 nt, Human adenovirus F
gucuuauccuccuucacaaag

SEQ ID NO: 3942368 - RNA, 18 nt, Human adenovirus F
gugacaaacaagcugucu

SEQ ID NO: 3942369 - RNA, 22 nt, Human adenovirus F
gugacagaaaucaagcggggcg

SEQ ID NO: 3942370 - RNA, 14 nt, Human adenovirus F
gugaccgagcagcu

SEQ ID NO: 3942371 - RNA, 15 nt, Human adenovirus F
gugagauuuguagug

SEQ ID NO: 3942372 - RNA, 15 nt, Human adenovirus F
gugaguguggagcua

SEQ ID NO: 3942373 - RNA, 16 nt, Human adenovirus F
gugcagauggaaacug

SEQ ID NO: 3942374 - RNA, 12 nt, Human adenovirus F
gugcaggucggg

SEQ ID NO: 3942375 - RNA, 16 nt, Human adenovirus F
gugcaguggcggggac

SEQ ID NO: 3942376 - RNA, 20 nt, Human adenovirus F
gugccgagcuuuuacuggga

SEQ ID NO: 3942377 - RNA, 18 nt, Human adenovirus F
gugccgcgcgggcaggag

SEQ ID NO: 3942378 - RNA, 16 nt, Human adenovirus F
gugccguucgcagaaa

SEQ ID NO: 3942379 - RNA, 19 nt, Human adenovirus F
gugccuaugugcuggggaa

SEQ ID NO: 3942380 - RNA, 15 nt, Human adenovirus F
gugccugagggcgac

SEQ ID NO: 3942381 - RNA, 23 nt, Human adenovirus F
gugcucgcaaacaaagaaguaca

SEQ ID NO: 3942382 - RNA, 14 nt, Human adenovirus F
gugcuuccagccuc

SEQ ID NO: 3942383 - RNA, 14 nt, Human adenovirus F
gugcuuggaagagc

SEQ ID NO: 3942384 - RNA, 18 nt, Human adenovirus F
guggaaaaacuuggaaac

SEQ ID NO: 3942385 - RNA, 17 nt, Human adenovirus F
guggaaagccugguaga

SEQ ID NO: 3942386 - RNA, 22 nt, Human adenovirus F
guggaaccaggcaguggacagc

SEQ ID NO: 3942387 - RNA, 16 nt, Human adenovirus F
guggaggguuaauaag

SEQ ID NO: 3942388 - RNA, 23 nt, Human adenovirus F
guggauaccgcugcagcugcugc

SEQ ID NO: 3942389 - RNA, 22 nt, Human adenovirus F
guggcaacccugaggaggaggc

SEQ ID NO: 3942390 - RNA, 22 nt, Human adenovirus F
guggcacagcaaacacaaacac

SEQ ID NO: 3942391 - RNA, 22 nt, Human adenovirus F
gugguggccaacgccaggcguu

SEQ ID NO: 3942392 - RNA, 12 nt, Human adenovirus F
guguauaaaagg

SEQ ID NO: 3942393 - RNA, 14 nt, Human adenovirus F
gugucaguuuccac

SEQ ID NO: 3942394 - RNA, 13 nt, Human adenovirus F
guguccgaaagca

SEQ ID NO: 3942395 - RNA, 13 nt, Human adenovirus F
guguuuauuucuu

SEQ ID NO: 3942396 - RNA, 21 nt, Human adenovirus F
guuaauaagcuggguggaaag

SEQ ID NO: 3942397 - RNA, 13 nt, Human adenovirus F
guuaaucccuuua

SEQ ID NO: 3942398 - RNA, 22 nt, Human adenovirus F
guuagguacuauaacaauuaaa

SEQ ID NO: 3942399 - RNA, 19 nt, Human adenovirus F
guuaugccccacaauguaa

SEQ ID NO: 3942400 - RNA, 18 nt, Human adenovirus F
guugaggguuucggcagc

SEQ ID NO: 3942401 - RNA, 17 nt, Human adenovirus F
guugauguuaugcccca

SEQ ID NO: 3942402 - RNA, 22 nt, Human adenovirus F
guugcauguuggaaaggggugg

SEQ ID NO: 3942403 - RNA, 15 nt, Human adenovirus F
guugcucucuccgga

SEQ ID NO: 3942404 - RNA, 22 nt, Human adenovirus F
guuggaggagauggugggccgc

SEQ ID NO: 3942405 - RNA, 21 nt, Human adenovirus F
guugugcaguguuauaagguc

SEQ ID NO: 3942406 - RNA, 16 nt, Human adenovirus F
guuuaaggagaugcaa

SEQ ID NO: 3942407 - RNA, 14 nt, Human adenovirus F
guuuaccaaaggcu

SEQ ID NO: 3942408 - RNA, 12 nt, Human adenovirus F
guuuccacaaac

SEQ ID NO: 3942409 - RNA, 17 nt, Human adenovirus F
guuuccucgauuuccau

SEQ ID NO: 3942410 - RNA, 19 nt, Human adenovirus F
guuucgcacuccacuaacc

SEQ ID NO: 3942411 - RNA, 23 nt, Human adenovirus F
guuucgcacuccacuaaccaggc

SEQ ID NO: 3942412 - RNA, 20 nt, Human adenovirus F
uaaaaacaaccaacuucaac

SEQ ID NO: 3942413 - RNA, 17 nt, Human adenovirus F
uaaaaacuugcaaggaa

SEQ ID NO: 3942414 - RNA, 19 nt, Human adenovirus F
uaaaaaggauuuugccggc

SEQ ID NO: 3942415 - RNA, 18 nt, Human adenovirus F
uaaagcuuaccuuaaauu

SEQ ID NO: 3942416 - RNA, 13 nt, Human adenovirus F
uaaauaaaacauc

SEQ ID NO: 3942417 - RNA, 16 nt, Human adenovirus F
uaacaacacaggagcu

SEQ ID NO: 3942418 - RNA, 20 nt, Human adenovirus F
uaacacugccuaccgcagcu

SEQ ID NO: 3942419 - RNA, 23 nt, Human adenovirus F
uaacacugcgauuagaaaacggg

SEQ ID NO: 3942420 - RNA, 20 nt, Human adenovirus F
uaaccaacggaggaaaacuc

SEQ ID NO: 3942421 - RNA, 22 nt, Human adenovirus F
uaacgcuucagagcucuucauc

SEQ ID NO: 3942422 - RNA, 17 nt, Human adenovirus F
uaagcgagcagagccca

SEQ ID NO: 3942423 - RNA, 17 nt, Human adenovirus F
uaaggaggaggcuaaug

SEQ ID NO: 3942424 - RNA, 18 nt, Human adenovirus F
uaagggccgaugccaggc

SEQ ID NO: 3942425 - RNA, 22 nt, Human adenovirus F
uaaugcgggcucugauaaugug

SEQ ID NO: 3942426 - RNA, 14 nt, Human adenovirus F
uaauuucugagggg

SEQ ID NO: 3942427 - RNA, 18 nt, Human adenovirus F
uacaaaugcucagucacu

SEQ ID NO: 3942428 - RNA, 19 nt, Human adenovirus F
uacaaggacaggauguacu

SEQ ID NO: 3942429 - RNA, 15 nt, Human adenovirus F
uacaccaacgaggcc

SEQ ID NO: 3942430 - RNA, 12 nt, Human adenovirus F
uacacuaagccu

SEQ ID NO: 3942431 - RNA, 14 nt, Human adenovirus F
uacagcccaacacc

SEQ ID NO: 3942432 - RNA, 12 nt, Human adenovirus F
uacauuggccac

SEQ ID NO: 3942433 - RNA, 16 nt, Human adenovirus F
uaccacuaccccuacc

SEQ ID NO: 3942434 - RNA, 15 nt, Human adenovirus F
uaccagagccauagc

SEQ ID NO: 3942435 - RNA, 16 nt, Human adenovirus F
uaccauuaagaagacu

SEQ ID NO: 3942436 - RNA, 16 nt, Human adenovirus F
uaccccuaccacccua

SEQ ID NO: 3942437 - RNA, 21 nt, Human adenovirus F
uacccuuacgaacacuacaau

SEQ ID NO: 3942438 - RNA, 20 nt, Human adenovirus F
uaccgcgcccccuggggggc

SEQ ID NO: 3942439 - RNA, 20 nt, Human adenovirus F
uaccgucaucucuacagccc

SEQ ID NO: 3942440 - RNA, 13 nt, Human adenovirus F
uaccugcuaccuc

SEQ ID NO: 3942441 - RNA, 16 nt, Human adenovirus F
uacgaacacuacaauc

SEQ ID NO: 3942442 - RNA, 12 nt, Human adenovirus F
uacgagcaggcu

SEQ ID NO: 3942443 - RNA, 17 nt, Human adenovirus F
uacgcccaggagcagcg

SEQ ID NO: 3942444 - RNA, 21 nt, Human adenovirus F
uacggaccaccagaugauguc

SEQ ID NO: 3942445 - RNA, 18 nt, Human adenovirus F
uacgugucuugcaaagac

SEQ ID NO: 3942446 - RNA, 18 nt, Human adenovirus F
uacucauuaaaauucacc

SEQ ID NO: 3942447 - RNA, 18 nt, Human adenovirus F
uacucggagcuggcgccu

SEQ ID NO: 3942448 - RNA, 15 nt, Human adenovirus F
uacucuuucuuacaa

SEQ ID NO: 3942449 - RNA, 19 nt, Human adenovirus F
uacuggcaagagccaccuu

SEQ ID NO: 3942450 - RNA, 16 nt, Human adenovirus F
uacuucuucagcucua

SEQ ID NO: 3942451 - RNA, 23 nt, Human adenovirus F
uagaaggcuacucauuaaaauuc

SEQ ID NO: 3942452 - RNA, 13 nt, Human adenovirus F
uagacgaggagga

SEQ ID NO: 3942453 - RNA, 15 nt, Human adenovirus F
uagagacugccaagc

SEQ ID NO: 3942454 - RNA, 20 nt, Human adenovirus F
uagaguaaaaaaaagggaag

SEQ ID NO: 3942455 - RNA, 21 nt, Human adenovirus F
uagcaccaacgugcaggccaa

SEQ ID NO: 3942456 - RNA, 19 nt, Human adenovirus F
uagcacuagaugcagcgcu

SEQ ID NO: 3942457 - RNA, 16 nt, Human adenovirus F
aaaaacuugcaaggaa

SEQ ID NO: 3942458 - RNA, 21 nt, Human adenovirus F
aaaaauuacagccaagucaaa

SEQ ID NO: 3942459 - RNA, 20 nt, Human adenovirus F
aaaaccuguucuaaaaccaa

SEQ ID NO: 3942460 - RNA, 14 nt, Human adenovirus F
aaaacucaacguua

SEQ ID NO: 3942461 - RNA, 17 nt, Human adenovirus F
aaaagacccauuuccaa

SEQ ID NO: 3942462 - RNA, 14 nt, Human adenovirus F
aaaagucaaaagug

SEQ ID NO: 3942463 - RNA, 17 nt, Human adenovirus F
aaaagucaaaugucugu

SEQ ID NO: 3942464 - RNA, 16 nt, Human adenovirus F
aaaaguccacaaaaac

SEQ ID NO: 3942465 - RNA, 19 nt, Human adenovirus F
aaaaguccacaaaaacucc

SEQ ID NO: 3942466 - RNA, 21 nt, Human adenovirus F
aaaaguccacaaaaacuccaa

SEQ ID NO: 3942467 - RNA, 21 nt, Human adenovirus F
aaaagugaaccggaaaaccaa

SEQ ID NO: 3942468 - RNA, 19 nt, Human adenovirus F
aaaaucuaccacagaaaug

SEQ ID NO: 3942469 - RNA, 16 nt, Human adenovirus F
aaaaugccaggcagca

SEQ ID NO: 3942470 - RNA, 12 nt, Human adenovirus F
aaacaaaaaacu

SEQ ID NO: 3942471 - RNA, 14 nt, Human adenovirus F
aaacacacaucacu

SEQ ID NO: 3942472 - RNA, 12 nt, Human adenovirus F
aaacacugcgca

SEQ ID NO: 3942473 - RNA, 19 nt, Human adenovirus F
aaacagcagguuaaagcca

SEQ ID NO: 3942474 - RNA, 18 nt, Human adenovirus F
aaaccuguucuaaaacca

SEQ ID NO: 3942475 - RNA, 11 nt, Human adenovirus F
aaacuggaaga

SEQ ID NO: 3942476 - RNA, 16 nt, Human adenovirus F
aaacuguaaaccuaac

SEQ ID NO: 3942477 - RNA, 21 nt, Human adenovirus F
aaacugucaggcucugagagu

SEQ ID NO: 3942478 - RNA, 17 nt, Human adenovirus F
aaacuucccuuugacaa

SEQ ID NO: 3942479 - RNA, 15 nt, Human adenovirus F
aaacuugauuuccau

SEQ ID NO: 3942480 - RNA, 22 nt, Human adenovirus F
aaacuuuauggauguuuuccaa

SEQ ID NO: 3942481 - RNA, 13 nt, Human adenovirus F
aaacuuucuccac

SEQ ID NO: 3942482 - RNA, 22 nt, Human adenovirus F
aaagaaauccacuuaccagagc

SEQ ID NO: 3942483 - RNA, 19 nt, Human adenovirus F
aaagaaccagaauugaaga

SEQ ID NO: 3942484 - RNA, 22 nt, Human adenovirus F
aaagcaaguuucgcaaaagcug

SEQ ID NO: 3942485 - RNA, 15 nt, Human adenovirus F
aaagggggcgugucc

SEQ ID NO: 3942486 - RNA, 14 nt, Human adenovirus F
aaaggggugguggg

SEQ ID NO: 3942487 - RNA, 21 nt, Human adenovirus F
aaaguagcucuuccaagcugc

SEQ ID NO: 3942488 - RNA, 19 nt, Human adenovirus F
aaaucaaggccaaaguuca

SEQ ID NO: 3942489 - RNA, 18 nt, Human adenovirus F
aaauccuucgagcaagcc

SEQ ID NO: 3942490 - RNA, 24 nt, Human adenovirus F
aaaucuucaaacauuaagcugcaa

SEQ ID NO: 3942491 - RNA, 18 nt, Human adenovirus F
aaauguagcccuguacuu

SEQ ID NO: 3942492 - RNA, 12 nt, Human adenovirus F
aaauucuggaau

SEQ ID NO: 3942493 - RNA, 20 nt, Human adenovirus F
aaauuugcugacagcuggga

SEQ ID NO: 3942494 - RNA, 20 nt, Human adenovirus F
aacaaaaaaaaaauauuaau

SEQ ID NO: 3942495 - RNA, 23 nt, Human adenovirus F
aacaacgggguggaaagccuggu

SEQ ID NO: 3942496 - RNA, 17 nt, Human adenovirus F
aacacaaugcaaaaugu

SEQ ID NO: 3942497 - RNA, 22 nt, Human adenovirus F
aacacagguucuuugcuggcaa

SEQ ID NO: 3942498 - RNA, 14 nt, Human adenovirus F
aacaccgcuuccac

SEQ ID NO: 3942499 - RNA, 18 nt, Human adenovirus F
aacacugccuaccgcagc

SEQ ID NO: 3942500 - RNA, 20 nt, Human adenovirus F
aacagccuuuguaacaacug

SEQ ID NO: 3942501 - RNA, 17 nt, Human adenovirus F
aacaucggcaccccucu

SEQ ID NO: 3942502 - RNA, 12 nt, Human adenovirus F
aacauuuaugcc

SEQ ID NO: 3942503 - RNA, 15 nt, Human adenovirus F
aaccaagggcucugc

SEQ ID NO: 3942504 - RNA, 14 nt, Human adenovirus F
aaccaggcagugga

SEQ ID NO: 3942505 - RNA, 19 nt, Human adenovirus F
aaccaggccuugcaaaacc

SEQ ID NO: 3942506 - RNA, 12 nt, Human adenovirus F
aaccauggagcu

SEQ ID NO: 3942507 - RNA, 19 nt, Human adenovirus F
aacccacagcuagcuuuau

SEQ ID NO: 3942508 - RNA, 23 nt, Human adenovirus F
aacccaugagccgccagguggua

SEQ ID NO: 3942509 - RNA, 16 nt, Human adenovirus F
aaccccacgccaagcc

SEQ ID NO: 3942510 - RNA, 12 nt, Human adenovirus F
aaccggcggcgu

SEQ ID NO: 3942511 - RNA, 21 nt, Human adenovirus F
aaccggcggcguacacuggcu

SEQ ID NO: 3942512 - RNA, 19 nt, Human adenovirus F
aaccggucguaacaaauac

SEQ ID NO: 3942513 - RNA, 23 nt, Human adenovirus F
aaccuauugguuccauggcccga

SEQ ID NO: 3942514 - RNA, 17 nt, Human adenovirus F
aacgagggggaggacuu

SEQ ID NO: 3942515 - RNA, 18 nt, Human adenovirus F
aacgcccgcuagcucuau

SEQ ID NO: 3942516 - RNA, 21 nt, Human adenovirus F
aacgggcggcaaaugcucugc

SEQ ID NO: 3942517 - RNA, 19 nt, Human adenovirus F
aacgguuguuuuccaccag

SEQ ID NO: 3942518 - RNA, 22 nt, Human adenovirus F
aacguucuucacugcaccuugc

SEQ ID NO: 3942519 - RNA, 18 nt, Human adenovirus F
aacucaaacaacaaaauc

SEQ ID NO: 3942520 - RNA, 22 nt, Human adenovirus F
aacucgcaggccagucggcagg

SEQ ID NO: 3942521 - RNA, 14 nt, Human adenovirus F
aacucucuuacauu

SEQ ID NO: 3942522 - RNA, 13 nt, Human adenovirus F
aacuucuaccauu

SEQ ID NO: 3942523 - RNA, 16 nt, Human adenovirus F
aacuuucuccacgucc

SEQ ID NO: 3942524 - RNA, 14 nt, Human adenovirus F
aacuuucuuacacu

SEQ ID NO: 3942525 - RNA, 15 nt, Human adenovirus F
aacuuuuuuaccacu

SEQ ID NO: 3942526 - RNA, 15 nt, Human adenovirus F
agucaaaaguguuua

SEQ ID NO: 3942527 - RNA, 12 nt, Human adenovirus F
agucaagcucuc

SEQ ID NO: 3942528 - RNA, 19 nt, Human adenovirus F
agucacuacaauauuggcu

SEQ ID NO: 3942529 - RNA, 19 nt, Human adenovirus F
aguccacuuaacagcuccu

SEQ ID NO: 3942530 - RNA, 17 nt, Human adenovirus F
aguccucauucuucuca

SEQ ID NO: 3942531 - RNA, 18 nt, Human adenovirus F
agucuguuuggugggcug

SEQ ID NO: 3942532 - RNA, 18 nt, Human adenovirus F
agugcaggaagaggagga

SEQ ID NO: 3942533 - RNA, 22 nt, Human adenovirus F
agugccgagcuuuuacugggac

SEQ ID NO: 3942534 - RNA, 18 nt, Human adenovirus F
agugcguaagaccucauc

SEQ ID NO: 3942535 - RNA, 18 nt, Human adenovirus F
agugcugucuagccgcac

SEQ ID NO: 3942536 - RNA, 12 nt, Human adenovirus F
aguggccgccga

SEQ ID NO: 3942537 - RNA, 23 nt, Human adenovirus F
aguggggguggaauuacugccag

SEQ ID NO: 3942538 - RNA, 12 nt, Human adenovirus F
aguguggagcua

SEQ ID NO: 3942539 - RNA, 19 nt, Human adenovirus F
aguucgcgguucaggaggu

SEQ ID NO: 3942540 - RNA, 22 nt, Human adenovirus F
aguucuugcugacggccggcca

SEQ ID NO: 3942541 - RNA, 21 nt, Human adenovirus F
aguugcaagauaugucugcca

SEQ ID NO: 3942542 - RNA, 17 nt, Human adenovirus F
auaaaggggaccagcug

SEQ ID NO: 3942543 - RNA, 20 nt, Human adenovirus F
auaacggacgcauuaccauu

SEQ ID NO: 3942544 - RNA, 19 nt, Human adenovirus F
auaauacagacgucucaag

SEQ ID NO: 3942545 - RNA, 12 nt, Human adenovirus F
auacccagcugu

SEQ ID NO: 3942546 - RNA, 17 nt, Human adenovirus F
auaccgcugcagcugcu

SEQ ID NO: 3942547 - RNA, 19 nt, Human adenovirus F
auacgggagggacaagcuu

SEQ ID NO: 3942548 - RNA, 20 nt, Human adenovirus F
auacuuuaaacaagcaaaga

SEQ ID NO: 3942549 - RNA, 20 nt, Human adenovirus F
auagcaccaacgugcaggcc

SEQ ID NO: 3942550 - RNA, 14 nt, Human adenovirus F
auagcuggagggca

SEQ ID NO: 3942551 - RNA, 21 nt, Human adenovirus F
auagcugugucagcuaacucu

SEQ ID NO: 3942552 - RNA, 15 nt, Human adenovirus F
auauacguaaaugug

SEQ ID NO: 3942553 - RNA, 23 nt, Human adenovirus F
auaugucacagccuguuacuauu

SEQ ID NO: 3942554 - RNA, 14 nt, Human adenovirus F
aucacccaaagcca

SEQ ID NO: 3942555 - RNA, 21 nt, Human adenovirus F
aucacuaaaaccaacaaaauc

SEQ ID NO: 3942556 - RNA, 23 nt, Human adenovirus F
aucacuccguucgcucacccgca

SEQ ID NO: 3942557 - RNA, 19 nt, Human adenovirus F
aucaugcuucugacaugcu

SEQ ID NO: 3942558 - RNA, 17 nt, Human adenovirus F
auccaaucguagcaggg

SEQ ID NO: 3942559 - RNA, 18 nt, Human adenovirus F
auccagggcacaguaauc

SEQ ID NO: 3942560 - RNA, 18 nt, Human adenovirus F
auccagugcaggaagagg

SEQ ID NO: 3942561 - RNA, 15 nt, Human adenovirus F
auccccaacaacccg

SEQ ID NO: 3942562 - RNA, 22 nt, Human adenovirus F
auccccgccgccccuggccugu

SEQ ID NO: 3942563 - RNA, 22 nt, Human adenovirus F
aucccgcgcuaaaucuuccucc

SEQ ID NO: 3942564 - RNA, 15 nt, Human adenovirus F
auccuuccaguaauc

SEQ ID NO: 3942565 - RNA, 16 nt, Human adenovirus F
aucgacguucucuccc

SEQ ID NO: 3942566 - RNA, 19 nt, Human adenovirus F
aucgcagcgggcaggagcc

SEQ ID NO: 3942567 - RNA, 17 nt, Human adenovirus F
aucgcucacuggucugu

SEQ ID NO: 3942568 - RNA, 23 nt, Human adenovirus F
aucgcuugccacuggccuuuuga

SEQ ID NO: 3942569 - RNA, 16 nt, Human adenovirus F
aucguaccauguggcg

SEQ ID NO: 3942570 - RNA, 15 nt, Human adenovirus F
aucuaucccuugauu

SEQ ID NO: 3942571 - RNA, 15 nt, Human adenovirus F
aucucccuccccccu

SEQ ID NO: 3942572 - RNA, 16 nt, Human adenovirus F
aucugcaaaaaagccg

SEQ ID NO: 3942573 - RNA, 22 nt, Human adenovirus F
augaauuggcuuagugccggcc

SEQ ID NO: 3942574 - RNA, 15 nt, Human adenovirus F
augcaacuuggaagg

SEQ ID NO: 3942575 - RNA, 20 nt, Human adenovirus F
augcaacuuggaagggaagg

SEQ ID NO: 3942576 - RNA, 17 nt, Human adenovirus F
augccuccagcacugcc

SEQ ID NO: 3942577 - RNA, 18 nt, Human adenovirus F
augccuccagcacugccg

SEQ ID NO: 3942578 - RNA, 16 nt, Human adenovirus F
augccuuacuggagcg

SEQ ID NO: 3942579 - RNA, 12 nt, Human adenovirus F
augcucugcaaa

SEQ ID NO: 3942580 - RNA, 16 nt, Human adenovirus F
auggaaacgcagccug

SEQ ID NO: 3942581 - RNA, 14 nt, Human adenovirus F
auggaaacugucag

SEQ ID NO: 3942582 - RNA, 13 nt, Human adenovirus F
auggaacuaacug

SEQ ID NO: 3942583 - RNA, 22 nt, Human adenovirus F
auggcagcagauuuuggacugu

SEQ ID NO: 3942584 - RNA, 20 nt, Human adenovirus F
auggggccuugggaugcagc

SEQ ID NO: 3942585 - RNA, 18 nt, Human adenovirus F
auggguaagugcagaggc

SEQ ID NO: 3942586 - RNA, 22 nt, Human adenovirus F
augguaaaaaugccaggcagca

SEQ ID NO: 3942587 - RNA, 23 nt, Human adenovirus F
auggucauuuuuucaagggauug

SEQ ID NO: 3942588 - RNA, 14 nt, Human adenovirus F
auggugguagaagg

SEQ ID NO: 3942589 - RNA, 22 nt, Human adenovirus F
auguacuacaauuccacuggca

SEQ ID NO: 3942590 - RNA, 17 nt, Human adenovirus F
auguccuuaaggaggag

SEQ ID NO: 3942591 - RNA, 17 nt, Human adenovirus F
augugcagcaaaaacuc

SEQ ID NO: 3942592 - RNA, 20 nt, Human adenovirus F
augugccgcgcgggcaggag

SEQ ID NO: 3942593 - RNA, 18 nt, Human adenovirus F
augugcuggggaauggag

SEQ ID NO: 3942594 - RNA, 15 nt, Human adenovirus F
auguggaaccaggca

SEQ ID NO: 3942595 - RNA, 17 nt, Human adenovirus F
auuaacauuaggcucaa

SEQ ID NO: 3942596 - RNA, 13 nt, Human adenovirus F
auuacagguauaa

SEQ ID NO: 3942597 - RNA, 18 nt, Human adenovirus F
auuagguggcucuaaguu

SEQ ID NO: 3942598 - RNA, 21 nt, Human adenovirus F
auuauccguuggaauuuuccu

SEQ ID NO: 3942599 - RNA, 21 nt, Human adenovirus F
auucugauggaguuguggagu

SEQ ID NO: 3942600 - RNA, 21 nt, Human adenovirus F
auugccucccugaacuaccag

SEQ ID NO: 3942601 - RNA, 16 nt, Human adenovirus F
auuguaaacgcucugg

SEQ ID NO: 3942602 - RNA, 15 nt, Human adenovirus F
auuguguccugcaac

SEQ ID NO: 3942603 - RNA, 18 nt, Human adenovirus F
auuuauaccauuaagaag

SEQ ID NO: 3942604 - RNA, 16 nt, Human adenovirus F
auuucaccuacucugg

SEQ ID NO: 3942605 - RNA, 14 nt, Human adenovirus F
auuucgugggaagg

SEQ ID NO: 3942606 - RNA, 21 nt, Human adenovirus F
auuucuuugucuaacuaaaaa

SEQ ID NO: 3942607 - RNA, 16 nt, Human adenovirus F
auuucuuuuaaaaaaa

SEQ ID NO: 3942608 - RNA, 20 nt, Human adenovirus F
auuuggaagaugaguuuaaa

SEQ ID NO: 3942609 - RNA, 14 nt, Human adenovirus F
auuuguuuagaaaa

SEQ ID NO: 3942610 - RNA, 20 nt, Human adenovirus F
auuuugacgaucgcuccagg

SEQ ID NO: 3942611 - RNA, 16 nt, Human adenovirus F
caaaacaauucucucu

SEQ ID NO: 3942612 - RNA, 23 nt, Human adenovirus F
caaaacaugcuguacgccaacuc

SEQ ID NO: 3942613 - RNA, 19 nt, Human adenovirus F
caaaagcccggguccaggc

SEQ ID NO: 3942614 - RNA, 19 nt, Human adenovirus F
caaaaguccacaaaaacuc

SEQ ID NO: 3942615 - RNA, 15 nt, Human adenovirus F
caaaaugaguggcuu

SEQ ID NO: 3942616 - RNA, 15 nt, Human adenovirus F
caaaaugugcagcaa

SEQ ID NO: 3942617 - RNA, 21 nt, Human adenovirus F
caaacaacgaacuuucucucu

SEQ ID NO: 3942618 - RNA, 14 nt, Human adenovirus F
caaacauagcaaaa

SEQ ID NO: 3942619 - RNA, 21 nt, Human adenovirus F
caaagacgaauugcagcccac

SEQ ID NO: 3942620 - RNA, 12 nt, Human adenovirus F
caaagccaaccu

SEQ ID NO: 3942621 - RNA, 14 nt, Human adenovirus F
caaauaauuuuccg

SEQ ID NO: 3942622 - RNA, 18 nt, Human adenovirus F
caaaucgcgcaaccagug

SEQ ID NO: 3942623 - RNA, 15 nt, Human adenovirus F
caacaaaaucaggaa

SEQ ID NO: 3942624 - RNA, 22 nt, Human adenovirus F
caacaagaaggugcuuccagcc

SEQ ID NO: 3942625 - RNA, 22 nt, Human adenovirus F
caaccaggccuugcaaaaccaa

SEQ ID NO: 3942626 - RNA, 19 nt, Human adenovirus F
caaccuacccagauuuccu

SEQ ID NO: 3942627 - RNA, 18 nt, Human adenovirus F
caacggacgugagagagg

SEQ ID NO: 3942628 - RNA, 12 nt, Human adenovirus F
caacucugaggu

SEQ ID NO: 3942629 - RNA, 17 nt, Human adenovirus F
caacugcagcgcacgcu

SEQ ID NO: 3942630 - RNA, 17 nt, Human adenovirus F
caacugccaccuccacc

SEQ ID NO: 3942631 - RNA, 23 nt, Human adenovirus F
caagacccgguacaggugggcuu

SEQ ID NO: 3942632 - RNA, 15 nt, Human adenovirus F
caagcacauccaggg

SEQ ID NO: 3942633 - RNA, 17 nt, Human adenovirus F
caagcgcaaguucaaag

SEQ ID NO: 3942634 - RNA, 17 nt, Human adenovirus F
caagcgguccauugccu

SEQ ID NO: 3942635 - RNA, 12 nt, Human adenovirus F
caauacuacaaa

SEQ ID NO: 3942636 - RNA, 13 nt, Human adenovirus F
caauagcagcacc

SEQ ID NO: 3942637 - RNA, 15 nt, Human adenovirus F
caauagcagcaccau

SEQ ID NO: 3942638 - RNA, 22 nt, Human adenovirus F
caaucagggcgugcaagugggc

SEQ ID NO: 3942639 - RNA, 14 nt, Human adenovirus F
caaucccagcagaa

SEQ ID NO: 3942640 - RNA, 19 nt, Human adenovirus F
caaugguaccacgcaggcg

SEQ ID NO: 3942641 - RNA, 19 nt, Human adenovirus F
caauuuugcgucgcuggcu

SEQ ID NO: 3942642 - RNA, 23 nt, Human adenovirus F
ccaagcaagcccauucugccagu

SEQ ID NO: 3942643 - RNA, 17 nt, Human adenovirus F
ccaauccuagccagugg

SEQ ID NO: 3942644 - RNA, 16 nt, Human adenovirus F
ccaaucguagcagggu

SEQ ID NO: 3942645 - RNA, 20 nt, Human adenovirus F
ccacaaaugucuuguggcug

SEQ ID NO: 3942646 - RNA, 16 nt, Human adenovirus F
ccacaauaagcagcuu

SEQ ID NO: 3942647 - RNA, 15 nt, Human adenovirus F
ccacaaucuucaucu

SEQ ID NO: 3942648 - RNA, 20 nt, Human adenovirus F
ccacacuuuuaaaaaggugu

SEQ ID NO: 3942649 - RNA, 16 nt, Human adenovirus F
ccaccacgggaguugc

SEQ ID NO: 3942650 - RNA, 18 nt, Human adenovirus F
ccaccgguuuuguaccac

SEQ ID NO: 3942651 - RNA, 15 nt, Human adenovirus F
ccaccguggcuccca

SEQ ID NO: 3942652 - RNA, 22 nt, Human adenovirus F
ccaccuugauacggauugucuu

SEQ ID NO: 3942653 - RNA, 18 nt, Human adenovirus F
ccacgauguaaccacaga

SEQ ID NO: 3942654 - RNA, 16 nt, Human adenovirus F
ccacgucccuccccgu

SEQ ID NO: 3942655 - RNA, 15 nt, Human adenovirus F
ccacuccugcaauac

SEQ ID NO: 3942656 - RNA, 14 nt, Human adenovirus F
ccacucgaaaccaa

SEQ ID NO: 3942657 - RNA, 16 nt, Human adenovirus F
ccacugccacugaaac

SEQ ID NO: 3942658 - RNA, 15 nt, Human adenovirus F
ccacuugugcaaugu

SEQ ID NO: 3942659 - RNA, 11 nt, Human adenovirus F
ccagaccccau

SEQ ID NO: 3942660 - RNA, 23 nt, Human adenovirus F
ccagacuccgaaaccuuaaccac

SEQ ID NO: 3942661 - RNA, 16 nt, Human adenovirus F
ccagaugucaacggca

SEQ ID NO: 3942662 - RNA, 14 nt, Human adenovirus F
ccagcauggcucag

SEQ ID NO: 3942663 - RNA, 14 nt, Human adenovirus F
ccagccggaggagu

SEQ ID NO: 3942664 - RNA, 22 nt, Human adenovirus F
ccagcgcccgggcccuggaggc

SEQ ID NO: 3942665 - RNA, 23 nt, Human adenovirus F
ccagcguucaaaaccucuuacaa

SEQ ID NO: 3942666 - RNA, 11 nt, Human adenovirus F
ccaggcagcag

SEQ ID NO: 3942667 - RNA, 22 nt, Human adenovirus F
ccaggcguacguaccgccucag

SEQ ID NO: 3942668 - RNA, 23 nt, Human adenovirus F
ccaggugguagacacuaccaccu

SEQ ID NO: 3942669 - RNA, 16 nt, Human adenovirus F
ccaguagcuuggaagc

SEQ ID NO: 3942670 - RNA, 17 nt, Human adenovirus F
ccagucggcaggcuucc

SEQ ID NO: 3942671 - RNA, 16 nt, Human adenovirus F
ccagugcaggaagagg

SEQ ID NO: 3942672 - RNA, 20 nt, Human adenovirus F
ccauagcaacagcguccguc

SEQ ID NO: 3942673 - RNA, 17 nt, Human adenovirus F
ccauaguaacuuucaaa

SEQ ID NO: 3942674 - RNA, 17 nt, Human adenovirus F
ccauauuauuuaaauaa

SEQ ID NO: 3942675 - RNA, 23 nt, Human adenovirus F
ccaucaugagucuguuugguggg

SEQ ID NO: 3942676 - RNA, 21 nt, Human adenovirus F
ccauccuggaccuggaagagg

SEQ ID NO: 3942677 - RNA, 22 nt, Human adenovirus F
ccauuaaaaaucuccugcuccu

SEQ ID NO: 3942678 - RNA, 17 nt, Human adenovirus F
ccauuggcaauguguuu

SEQ ID NO: 3942679 - RNA, 17 nt, Human adenovirus F
cccaccgaguuccugcg

SEQ ID NO: 3942680 - RNA, 22 nt, Human adenovirus F
cccaccgaguuccugcgcugcu

SEQ ID NO: 3942681 - RNA, 22 nt, Human adenovirus F
cccaccuuguguuuaagccaga

SEQ ID NO: 3942682 - RNA, 17 nt, Human adenovirus F
cccacuguugccguggc

SEQ ID NO: 3942683 - RNA, 17 nt, Human adenovirus F
cccagcgcccgggcccu

SEQ ID NO: 3942684 - RNA, 21 nt, Human adenovirus F
cccaggagcagcgggaagaga

SEQ ID NO: 3942685 - RNA, 17 nt, Human adenovirus F
cccauagacaaggaggu

SEQ ID NO: 3942686 - RNA, 18 nt, Human adenovirus F
cccccguuugcuuccucc

SEQ ID NO: 3942687 - RNA, 19 nt, Human adenovirus F
ccccggcggcgggugcagu

SEQ ID NO: 3942688 - RNA, 16 nt, Human adenovirus F
ccccuguaccaccgca

SEQ ID NO: 3942689 - RNA, 20 nt, Human adenovirus F
ccccugugaguguggagcua

SEQ ID NO: 3942690 - RNA, 14 nt, Human adenovirus F
cccgauacccaccu

SEQ ID NO: 3942691 - RNA, 17 nt, Human adenovirus F
cccgcaacggcgcagca

SEQ ID NO: 3942692 - RNA, 18 nt, Human adenovirus F
cccggacuuggcgugcag

SEQ ID NO: 3942693 - RNA, 17 nt, Human adenovirus F
cccggcggcgggugcag

SEQ ID NO: 3942694 - RNA, 16 nt, Human adenovirus F
cccguaaaaaggaggg

SEQ ID NO: 3942695 - RNA, 23 nt, Human adenovirus F
cccguaaccaaguuggugaugcc

SEQ ID NO: 3942696 - RNA, 16 nt, Human adenovirus F
cccguagucucagacg

SEQ ID NO: 3942697 - RNA, 23 nt, Human adenovirus F
cccugaggaggaggccauccugg

SEQ ID NO: 3942698 - RNA, 15 nt, Human adenovirus F
cccugaucagccagg

SEQ ID NO: 3942699 - RNA, 14 nt, Human adenovirus F
cccuggccuggaac

SEQ ID NO: 3942700 - RNA, 16 nt, Human adenovirus F
cccugucguugccagc

SEQ ID NO: 3942701 - RNA, 14 nt, Human adenovirus F
cccugugagugugg

SEQ ID NO: 3942702 - RNA, 17 nt, Human adenovirus F
cccuuuuccagcaacuu

SEQ ID NO: 3942703 - RNA, 21 nt, Human adenovirus F
ccgacgcgcuuugcgcaggcg

SEQ ID NO: 3942704 - RNA, 12 nt, Human adenovirus F
ccgagcagcugc

SEQ ID NO: 3942705 - RNA, 19 nt, Human adenovirus F
ccgagccaccaucuccagc

SEQ ID NO: 3942706 - RNA, 21 nt, Human adenovirus F
ccgagcggcugcuucugccag

SEQ ID NO: 3942707 - RNA, 22 nt, Human adenovirus F
ccgagcggcugcuucugccagu

SEQ ID NO: 3942708 - RNA, 22 nt, Human adenovirus F
ccgagcuuuuacugggacagca

SEQ ID NO: 3942709 - RNA, 21 nt, Human adenovirus F
ccgaucacuccguucgcucac

SEQ ID NO: 3942710 - RNA, 23 nt, Human adenovirus F
ccgcaaccauguucacugaaagc

SEQ ID NO: 3942711 - RNA, 16 nt, Human adenovirus F
ccgcaaugcuggucug

SEQ ID NO: 3942712 - RNA, 20 nt, Human adenovirus F
ccgcacucgcuccacccgcc

SEQ ID NO: 3942713 - RNA, 17 nt, Human adenovirus F
ccgccaugacugccgcu

SEQ ID NO: 3942714 - RNA, 19 nt, Human adenovirus F
ccgccaugacugccgcucg

SEQ ID NO: 3942715 - RNA, 19 nt, Human adenovirus F
ccgccgcucaaggcgcacg

SEQ ID NO: 3942716 - RNA, 23 nt, Human adenovirus F
ccgccuagguccgaccgcugggg

SEQ ID NO: 3942717 - RNA, 16 nt, Human adenovirus F
ccgcgacugcaucuau

SEQ ID NO: 3942718 - RNA, 12 nt, Human adenovirus F
ccgcgcgggcag

SEQ ID NO: 3942719 - RNA, 21 nt, Human adenovirus F
ccgcgcuaaaucuuccuccca

SEQ ID NO: 3942720 - RNA, 16 nt, Human adenovirus F
ccgcuccaucaagccc

SEQ ID NO: 3942721 - RNA, 13 nt, Human adenovirus F
ccgcugaaagacg

SEQ ID NO: 3942722 - RNA, 22 nt, Human adenovirus F
ccggcggcguacacuggcuggc

SEQ ID NO: 3942723 - RNA, 17 nt, Human adenovirus F
ccggggcaauaucucau

SEQ ID NO: 3942724 - RNA, 22 nt, Human adenovirus F
ccggguugggcgcuugccaggg

SEQ ID NO: 3942725 - RNA, 22 nt, Human adenovirus F
ccgucguacaaguugcaaagcu

SEQ ID NO: 3942726 - RNA, 12 nt, Human adenovirus F
ccgucgucaggc

SEQ ID NO: 3942727 - RNA, 22 nt, Human adenovirus F
ccgucuucccucuugggcagga

SEQ ID NO: 3942728 - RNA, 22 nt, Human adenovirus F
ccguggagccgacuucaagccc

SEQ ID NO: 3942729 - RNA, 21 nt, Human adenovirus F
ccguggcuggcgggcaaagcu

SEQ ID NO: 3942730 - RNA, 21 nt, Human adenovirus F
ccguucccacuguuucuccuc

SEQ ID NO: 3942731 - RNA, 13 nt, Human adenovirus F
ccuaacacaggcg

SEQ ID NO: 3942732 - RNA, 19 nt, Human adenovirus F
ccuaacggcaccugcgaaa

SEQ ID NO: 3942733 - RNA, 19 nt, Human adenovirus F
ccuacccacgaaaaggugu

SEQ ID NO: 3942734 - RNA, 15 nt, Human adenovirus F
ccuacccagauuucc

SEQ ID NO: 3942735 - RNA, 23 nt, Human adenovirus F
ccuaucacuaaaaccaacaaaau

SEQ ID NO: 3942736 - RNA, 14 nt, Human adenovirus F
ccuaugugcugggg

SEQ ID NO: 3942737 - RNA, 15 nt, Human adenovirus F
ccuaugugcugggga

SEQ ID NO: 3942738 - RNA, 23 nt, Human adenovirus F
ccucagccugaaauacacugauc

SEQ ID NO: 3942739 - RNA, 14 nt, Human adenovirus F
ccuccaccaccuuc

SEQ ID NO: 3942740 - RNA, 13 nt, Human adenovirus F
ccuccagcacugc

SEQ ID NO: 3942741 - RNA, 17 nt, Human adenovirus F
ccucccuuugcccccca

SEQ ID NO: 3942742 - RNA, 20 nt, Human adenovirus F
ccucgagugcguaagaccuc

SEQ ID NO: 3942743 - RNA, 13 nt, Human adenovirus F
ccucuuacaauuu

SEQ ID NO: 3942744 - RNA, 12 nt, Human adenovirus F
ccugaaaaccau

SEQ ID NO: 3942745 - RNA, 18 nt, Human adenovirus F
ccugaccgaccuggggca

SEQ ID NO: 3942746 - RNA, 13 nt, Human adenovirus F
ccugagcccgggc

SEQ ID NO: 3942747 - RNA, 18 nt, Human adenovirus F
ccugagcccgggccuggu

SEQ ID NO: 3942748 - RNA, 12 nt, Human adenovirus F
ccugaggaggag

SEQ ID NO: 3942749 - RNA, 20 nt, Human adenovirus F
ccugagggccggccuggacc

SEQ ID NO: 3942750 - RNA, 19 nt, Human adenovirus F
ccugcaauggcagcccagc

SEQ ID NO: 3942751 - RNA, 17 nt, Human adenovirus F
ccugcccuuccucccaa

SEQ ID NO: 3942752 - RNA, 12 nt, Human adenovirus F
ccuggaagaggg

SEQ ID NO: 3942753 - RNA, 15 nt, Human adenovirus F
ccuggaccuggaaga

SEQ ID NO: 3942754 - RNA, 18 nt, Human adenovirus F
ccuggcccccaaaggugc

SEQ ID NO: 3942755 - RNA, 14 nt, Human adenovirus F
ccuggccuggaacc

SEQ ID NO: 3942756 - RNA, 18 nt, Human adenovirus F
ccuguuacuauuaaugca

SEQ ID NO: 3942757 - RNA, 18 nt, Human adenovirus F
ccuguucuaaaaccaaac

SEQ ID NO: 3942758 - RNA, 11 nt, Human adenovirus F
caggagcugcg

SEQ ID NO: 3942759 - RNA, 16 nt, Human adenovirus F
caggaucccucagagc

SEQ ID NO: 3942760 - RNA, 14 nt, Human adenovirus F
caggcacaccuuca

SEQ ID NO: 3942761 - RNA, 20 nt, Human adenovirus F
caggcagcagccccaggcca

SEQ ID NO: 3942762 - RNA, 17 nt, Human adenovirus F
caggccgcccuaaccuc

SEQ ID NO: 3942763 - RNA, 13 nt, Human adenovirus F
caggccgcggcgg

SEQ ID NO: 3942764 - RNA, 22 nt, Human adenovirus F
caggccuccaauuugacaauaa

SEQ ID NO: 3942765 - RNA, 22 nt, Human adenovirus F
caggcggaaaccaagggcucug

SEQ ID NO: 3942766 - RNA, 20 nt, Human adenovirus F
caggcguggccuccguggcc

SEQ ID NO: 3942767 - RNA, 22 nt, Human adenovirus F
cagggcgugcaagugggcucag

SEQ ID NO: 3942768 - RNA, 18 nt, Human adenovirus F
caggguuugcaaacugua

SEQ ID NO: 3942769 - RNA, 23 nt, Human adenovirus F
caggguuuuugagcaugaaacug

SEQ ID NO: 3942770 - RNA, 15 nt, Human adenovirus F
cagguguacuggucc

SEQ ID NO: 3942771 - RNA, 16 nt, Human adenovirus F
caguaagcaacaacca

SEQ ID NO: 3942772 - RNA, 19 nt, Human adenovirus F
caguaccgcuccaucaagc

SEQ ID NO: 3942773 - RNA, 18 nt, Human adenovirus F
cagucgcagcgcaucacc

SEQ ID NO: 3942774 - RNA, 19 nt, Human adenovirus F
cagucucgguaacgaccuc

SEQ ID NO: 3942775 - RNA, 20 nt, Human adenovirus F
cagugaaaacguucccgccc

SEQ ID NO: 3942776 - RNA, 13 nt, Human adenovirus F
caguggagcaagg

SEQ ID NO: 3942777 - RNA, 12 nt, Human adenovirus F
caguuggagcag

SEQ ID NO: 3942778 - RNA, 14 nt, Human adenovirus F
cauaagaagccagc

SEQ ID NO: 3942779 - RNA, 15 nt, Human adenovirus F
cauacccgccaacgc

SEQ ID NO: 3942780 - RNA, 14 nt, Human adenovirus F
cauaggccauuuug

SEQ ID NO: 3942781 - RNA, 16 nt, Human adenovirus F
cauauacuuuaaacaa

SEQ ID NO: 3942782 - RNA, 20 nt, Human adenovirus F
caucaugcuucugacaugcu

SEQ ID NO: 3942783 - RNA, 14 nt, Human adenovirus F
cauccauccaucac

SEQ ID NO: 3942784 - RNA, 14 nt, Human adenovirus F
caucucuacagccc

SEQ ID NO: 3942785 - RNA, 15 nt, Human adenovirus F
caucugcggccucag

SEQ ID NO: 3942786 - RNA, 14 nt, Human adenovirus F
caucuuucaaaaaa

SEQ ID NO: 3942787 - RNA, 13 nt, Human adenovirus F
caugacugccgcu

SEQ ID NO: 3942788 - RNA, 22 nt, Human adenovirus F
caugagaucauaguugaggguu

SEQ ID NO: 3942789 - RNA, 17 nt, Human adenovirus F
caugcacaucgccgggc

SEQ ID NO: 3942790 - RNA, 13 nt, Human adenovirus F
caugccuccagca

SEQ ID NO: 3942791 - RNA, 17 nt, Human adenovirus F
cauggaucgcauccugg

SEQ ID NO: 3942792 - RNA, 16 nt, Human adenovirus F
cauggcaauggcucug

SEQ ID NO: 3942793 - RNA, 16 nt, Human adenovirus F
cauguauuuuuacagc

SEQ ID NO: 3942794 - RNA, 14 nt, Human adenovirus F
cauuauugcacuuu

SEQ ID NO: 3942795 - RNA, 19 nt, Human adenovirus F
cauuccauuuauuacaccc

SEQ ID NO: 3942796 - RNA, 18 nt, Human adenovirus F
cauuguuuugcuaccugg

SEQ ID NO: 3942797 - RNA, 19 nt, Human adenovirus F
cauuuaccaccccagcacu

SEQ ID NO: 3942798 - RNA, 20 nt, Human adenovirus F
cauuuaugcccaacaguaca

SEQ ID NO: 3942799 - RNA, 15 nt, Human adenovirus F
cauuucgugggaagg

SEQ ID NO: 3942800 - RNA, 18 nt, Human adenovirus F
cauuucuccgcgacggcg

SEQ ID NO: 3942801 - RNA, 18 nt, Human adenovirus F
ccaaaaaagcagccuaac

SEQ ID NO: 3942802 - RNA, 16 nt, Human adenovirus F
ccaaaaacggggcuuu

SEQ ID NO: 3942803 - RNA, 20 nt, Human adenovirus F
ccaaaaggucaggugcagaa

SEQ ID NO: 3942804 - RNA, 15 nt, Human adenovirus F
ccaaagcagagcucu

SEQ ID NO: 3942805 - RNA, 15 nt, Human adenovirus F
ccaaaggugcuccca

SEQ ID NO: 3942806 - RNA, 23 nt, Human adenovirus F
ccaaaucaaucagcggcuggaaa

SEQ ID NO: 3942807 - RNA, 15 nt, Human adenovirus F
ccaacgugcaggcca

SEQ ID NO: 3942808 - RNA, 18 nt, Human adenovirus F
ccaagcugcggaaaugcu

SEQ ID NO: 3942809 - RNA, 20 nt, Human adenovirus F
ccaagucaaaaaagaugcga

SEQ ID NO: 3942810 - RNA, 18 nt, Human adenovirus F
ccacaaaagcuuucacuu

SEQ ID NO: 3942811 - RNA, 19 nt, Human adenovirus F
ccacccuauggaccaccgc

SEQ ID NO: 3942812 - RNA, 20 nt, Human adenovirus F
ccacccuauggaccaccgcg

SEQ ID NO: 3942813 - RNA, 14 nt, Human adenovirus F
ccaccguggcuccc

SEQ ID NO: 3942814 - RNA, 21 nt, Human adenovirus F
ccacgcaggcgagaguugggg

SEQ ID NO: 3942815 - RNA, 14 nt, Human adenovirus F
ccacguaccagaaa

SEQ ID NO: 3942816 - RNA, 15 nt, Human adenovirus F
ccacucgggaaagac

SEQ ID NO: 3942817 - RNA, 17 nt, Human adenovirus F
ccacugacaguaagcaa

SEQ ID NO: 3942818 - RNA, 17 nt, Human adenovirus F
ccacuucuauugcacuu

SEQ ID NO: 3942819 - RNA, 23 nt, Human adenovirus F
ccagcauaauaacucuggcuuug

SEQ ID NO: 3942820 - RNA, 18 nt, Human adenovirus F
ccagccggaggagugggc

SEQ ID NO: 3942821 - RNA, 16 nt, Human adenovirus F
ccagcgcccgggcccu

SEQ ID NO: 3942822 - RNA, 18 nt, Human adenovirus F
ccagcugguaagcagccu

SEQ ID NO: 3942823 - RNA, 20 nt, Human adenovirus F
ccagcugguaagcagccuaa

SEQ ID NO: 3942824 - RNA, 22 nt, Human adenovirus F
ccagcuguuuaccaaaggcucc

SEQ ID NO: 3942825 - RNA, 13 nt, Human adenovirus F
ccaggcagcaggg

SEQ ID NO: 3942826 - RNA, 14 nt, Human adenovirus F
ccaggcagcagggu

SEQ ID NO: 3942827 - RNA, 18 nt, Human adenovirus F
ccauauccauuaaagcuc

SEQ ID NO: 3942828 - RNA, 17 nt, Human adenovirus F
ccaucaucgccgccgcc

SEQ ID NO: 3942829 - RNA, 13 nt, Human adenovirus F
ccaucauuuccac

SEQ ID NO: 3942830 - RNA, 14 nt, Human adenovirus F
ccaucgccagcgac

SEQ ID NO: 3942831 - RNA, 20 nt, Human adenovirus F
ccaucgugcgcgaacugggc

SEQ ID NO: 3942832 - RNA, 16 nt, Human adenovirus F
ccaucuuucaaaaaac

SEQ ID NO: 3942833 - RNA, 16 nt, Human adenovirus F
ccauggaaacgcagcc

SEQ ID NO: 3942834 - RNA, 22 nt, Human adenovirus F
ccauguggaaccaggcagugga

SEQ ID NO: 3942835 - RNA, 14 nt, Human adenovirus F
ccauuauugcacuu

SEQ ID NO: 3942836 - RNA, 22 nt, Human adenovirus F
ccauucuuauuucgcccgacaa

SEQ ID NO: 3942837 - RNA, 18 nt, Human adenovirus F
cccaacacuuucaccgcc

SEQ ID NO: 3942838 - RNA, 13 nt, Human adenovirus F
cccaacucugagg

SEQ ID NO: 3942839 - RNA, 13 nt, Human adenovirus F
cccaaguggcccu

SEQ ID NO: 3942840 - RNA, 23 nt, Human adenovirus F
cccacaaaagcuuucacuuuaau

SEQ ID NO: 3942841 - RNA, 21 nt, Human adenovirus F
cccacgauguaaccacagaca

SEQ ID NO: 3942842 - RNA, 15 nt, Human adenovirus F
cccacgccaagccug

SEQ ID NO: 3942843 - RNA, 14 nt, Human adenovirus F
cccagcugguaagc

SEQ ID NO: 3942844 - RNA, 15 nt, Human adenovirus F
cccaggaucccucag

SEQ ID NO: 3942845 - RNA, 15 nt, Human adenovirus F
cccaggcggaaacca

SEQ ID NO: 3942846 - RNA, 13 nt, Human adenovirus F
cccauacccgcca

SEQ ID NO: 3942847 - RNA, 12 nt, Human adenovirus F
ccccaccguggc

SEQ ID NO: 3942848 - RNA, 14 nt, Human adenovirus F
ccccagcgcccugg

SEQ ID NO: 3942849 - RNA, 17 nt, Human adenovirus F
ccccagcgcccuggaua

SEQ ID NO: 3942850 - RNA, 19 nt, Human adenovirus F
cccccaccggcuccugugc

SEQ ID NO: 3942851 - RNA, 21 nt, Human adenovirus F
cccccaccggcuccugugcag

SEQ ID NO: 3942852 - RNA, 17 nt, Human adenovirus F
cccccacuagcgccccu

SEQ ID NO: 3942853 - RNA, 20 nt, Human adenovirus F
ccccgugggggaccgagcca

SEQ ID NO: 3942854 - RNA, 15 nt, Human adenovirus F
cccgcacuggaugcc

SEQ ID NO: 3942855 - RNA, 12 nt, Human adenovirus F
cccgccagcugg

SEQ ID NO: 3942856 - RNA, 15 nt, Human adenovirus F
cccgcccgccucuac

SEQ ID NO: 3942857 - RNA, 20 nt, Human adenovirus F
cccgcuauguuggcggcccu

SEQ ID NO: 3942858 - RNA, 20 nt, Human adenovirus F
cccggcggcgggugcagugg

SEQ ID NO: 3942859 - RNA, 14 nt, Human adenovirus F
cccgugucaccugc

SEQ ID NO: 3942860 - RNA, 12 nt, Human adenovirus F
cccuaacauggc

SEQ ID NO: 3942861 - RNA, 13 nt, Human adenovirus F
cccuagucccucc

SEQ ID NO: 3942862 - RNA, 21 nt, Human adenovirus F
cccucaaacacugcgcaaagu

SEQ ID NO: 3942863 - RNA, 18 nt, Human adenovirus F
cccucagacgacugggcg

SEQ ID NO: 3942864 - RNA, 21 nt, Human adenovirus F
cccucgcccuauuccuccggc

SEQ ID NO: 3942865 - RNA, 18 nt, Human adenovirus F
cccugaggaggaggccau

SEQ ID NO: 3942866 - RNA, 18 nt, Human adenovirus F
cccugccgcugcgcagca

SEQ ID NO: 3942867 - RNA, 13 nt, Human adenovirus F
cccuggccuguuu

SEQ ID NO: 3942868 - RNA, 19 nt, Human adenovirus F
cccuuaaguauucaccacc

SEQ ID NO: 3942869 - RNA, 14 nt, Human adenovirus F
cagcgggaagagag

SEQ ID NO: 3942870 - RNA, 14 nt, Human adenovirus F
cagcgggcaggagc

SEQ ID NO: 3942871 - RNA, 21 nt, Human adenovirus F
cagcgugagucgggcucuugg

SEQ ID NO: 3942872 - RNA, 13 nt, Human adenovirus F
cagcuggcaaacc

SEQ ID NO: 3942873 - RNA, 19 nt, Human adenovirus F
cagcuuauucgccagucca

SEQ ID NO: 3942874 - RNA, 17 nt, Human adenovirus F
caggaagcagcucaggu

SEQ ID NO: 3942875 - RNA, 17 nt, Human adenovirus F
caggagcagcgggaaga

SEQ ID NO: 3942876 - RNA, 17 nt, Human adenovirus F
caggagccgaauugccu

SEQ ID NO: 3942877 - RNA, 19 nt, Human adenovirus F
gcaaagcucccaaaagguc

SEQ ID NO: 3942878 - RNA, 16 nt, Human adenovirus F
gcaacguucagccacu

SEQ ID NO: 3942879 - RNA, 14 nt, Human adenovirus F
gcaacucgcaggcc

SEQ ID NO: 3942880 - RNA, 19 nt, Human adenovirus F
gcaagauaugucugccaaa

SEQ ID NO: 3942881 - RNA, 23 nt, Human adenovirus F
gcaagcccauucugccaguuggg

SEQ ID NO: 3942882 - RNA, 20 nt, Human adenovirus F
gcaagccgcugacggcgcag

SEQ ID NO: 3942883 - RNA, 21 nt, Human adenovirus F
gcaagcgcaaguucaaagaag

SEQ ID NO: 3942884 - RNA, 14 nt, Human adenovirus F
gcaaggaaccagug

SEQ ID NO: 3942885 - RNA, 17 nt, Human adenovirus F
gcacaagugccgagcuu

SEQ ID NO: 3942886 - RNA, 19 nt, Human adenovirus F
gcacacgcacuucaagaaa

SEQ ID NO: 3942887 - RNA, 13 nt, Human adenovirus F
gcacagcaaacac

SEQ ID NO: 3942888 - RNA, 15 nt, Human adenovirus F
gcacagcaaacacaa

SEQ ID NO: 3942889 - RNA, 22 nt, Human adenovirus F
gcacagccugcgucgggcucua

SEQ ID NO: 3942890 - RNA, 17 nt, Human adenovirus F
gcaccaauaugcccaac

SEQ ID NO: 3942891 - RNA, 16 nt, Human adenovirus F
gcaccuacuuugacau

SEQ ID NO: 3942892 - RNA, 15 nt, Human adenovirus F
gcaccugcacgcucu

SEQ ID NO: 3942893 - RNA, 13 nt, Human adenovirus F
gcacgggcgcacg

SEQ ID NO: 3942894 - RNA, 19 nt, Human adenovirus F
gcacucgcuccacccgccg

SEQ ID NO: 3942895 - RNA, 15 nt, Human adenovirus F
gcacugguaaaccag

SEQ ID NO: 3942896 - RNA, 17 nt, Human adenovirus F
gcagacgcaauggaaca

SEQ ID NO: 3942897 - RNA, 22 nt, Human adenovirus F
gcagaggaaguuucagacgagg

SEQ ID NO: 3942898 - RNA, 13 nt, Human adenovirus F
gcagaggagguga

SEQ ID NO: 3942899 - RNA, 19 nt, Human adenovirus F
gcagaggaggugaugcugc

SEQ ID NO: 3942900 - RNA, 16 nt, Human adenovirus F
gcagcaacauaacuuu

SEQ ID NO: 3942901 - RNA, 20 nt, Human adenovirus F
gcagcaccaccugcccuucc

SEQ ID NO: 3942902 - RNA, 13 nt, Human adenovirus F
gcagcaguccguc

SEQ ID NO: 3942903 - RNA, 22 nt, Human adenovirus F
gcagccugagcugccagaggcc

SEQ ID NO: 3942904 - RNA, 16 nt, Human adenovirus F
gcagccuguggagugg

SEQ ID NO: 3942905 - RNA, 20 nt, Human adenovirus F
gcagcgacagggcgcuaacu

SEQ ID NO: 3942906 - RNA, 14 nt, Human adenovirus F
gcagcgcccgccuc

SEQ ID NO: 3942907 - RNA, 14 nt, Human adenovirus F
gcagcugcguacgg

SEQ ID NO: 3942908 - RNA, 18 nt, Human adenovirus F
gcaguccacuuaacagcu

SEQ ID NO: 3942909 - RNA, 20 nt, Human adenovirus F
gcagugggacgaggaggaga

SEQ ID NO: 3942910 - RNA, 15 nt, Human adenovirus F
gcaguguuauaaggu

SEQ ID NO: 3942911 - RNA, 17 nt, Human adenovirus F
gcaguucauuuaaaaga

SEQ ID NO: 3942912 - RNA, 20 nt, Human adenovirus F
gcauaaaggggaccagcugu

SEQ ID NO: 3942913 - RNA, 16 nt, Human adenovirus F
gcauaacccuggaauu

SEQ ID NO: 3942914 - RNA, 16 nt, Human adenovirus F
gcauaacuucagcacu

SEQ ID NO: 3942915 - RNA, 19 nt, Human adenovirus F
gcauacguuacucggagcu

SEQ ID NO: 3942916 - RNA, 18 nt, Human adenovirus F
gcauacuguuucacauau

SEQ ID NO: 3942917 - RNA, 15 nt, Human adenovirus F
gcauauaagcucugu

SEQ ID NO: 3942918 - RNA, 16 nt, Human adenovirus F
gcaucggaacccucca

SEQ ID NO: 3942919 - RNA, 18 nt, Human adenovirus F
gcaugccacaauuuacaa

SEQ ID NO: 3942920 - RNA, 17 nt, Human adenovirus F
gcaugcccgagccggag

SEQ ID NO: 3942921 - RNA, 21 nt, Human adenovirus F
gcaugcccgagccggagaggg

SEQ ID NO: 3942922 - RNA, 15 nt, Human adenovirus F
gcauggcagcagauu

SEQ ID NO: 3942923 - RNA, 20 nt, Human adenovirus F
gccaacuccaaccaagaaau

SEQ ID NO: 3942924 - RNA, 23 nt, Human adenovirus F
gccaauuaucuacgccuccacca

SEQ ID NO: 3942925 - RNA, 23 nt, Human adenovirus F
gccacacuaaaguuuuaauggaa

SEQ ID NO: 3942926 - RNA, 19 nt, Human adenovirus F
gccacagguccagaccuca

SEQ ID NO: 3942927 - RNA, 14 nt, Human adenovirus F
gccaccgcaaccau

SEQ ID NO: 3942928 - RNA, 13 nt, Human adenovirus F
gccagagggcaac

SEQ ID NO: 3942929 - RNA, 17 nt, Human adenovirus F
gccagccaaugggcucc

SEQ ID NO: 3942930 - RNA, 24 nt, Human adenovirus F
gccagccaaugggcuccagcgagc

SEQ ID NO: 3942931 - RNA, 12 nt, Human adenovirus F
gccaggcagagg

SEQ ID NO: 3942932 - RNA, 22 nt, Human adenovirus F
gccaguuggggauuggcggcua

SEQ ID NO: 3942933 - RNA, 16 nt, Human adenovirus F
gccauagcuggagggc

SEQ ID NO: 3942934 - RNA, 17 nt, Human adenovirus F
gccaucgacguucucuc

SEQ ID NO: 3942935 - RNA, 17 nt, Human adenovirus F
gccaucgcugaccagca

SEQ ID NO: 3942936 - RNA, 19 nt, Human adenovirus F
gccaucgcugaccagcagc

SEQ ID NO: 3942937 - RNA, 23 nt, Human adenovirus F
gccaugcugaauauugcggagcc

SEQ ID NO: 3942938 - RNA, 22 nt, Human adenovirus F
gccauggaaacgcagccugagc

SEQ ID NO: 3942939 - RNA, 19 nt, Human adenovirus F
gccauggaucgcauccugg

SEQ ID NO: 3942940 - RNA, 14 nt, Human adenovirus F
gcccaggagcagcg

SEQ ID NO: 3942941 - RNA, 14 nt, Human adenovirus F
gccccccggcggcg

SEQ ID NO: 3942942 - RNA, 19 nt, Human adenovirus F
gccccgguugugcaguguu

SEQ ID NO: 3942943 - RNA, 15 nt, Human adenovirus F
gccccuaccagccgu

SEQ ID NO: 3942944 - RNA, 12 nt, Human adenovirus F
gccccugccaac

SEQ ID NO: 3942945 - RNA, 19 nt, Human adenovirus F
gccccugugaguguggagc

SEQ ID NO: 3942946 - RNA, 22 nt, Human adenovirus F
gcccguccuccgaccccacacg

SEQ ID NO: 3942947 - RNA, 18 nt, Human adenovirus F
gcccgucgucaggccgcc

SEQ ID NO: 3942948 - RNA, 14 nt, Human adenovirus F
gcccgugccaccga

SEQ ID NO: 3942949 - RNA, 20 nt, Human adenovirus F
gcccucuucugcaccugcac

SEQ ID NO: 3942950 - RNA, 16 nt, Human adenovirus F
gcccugaucagccagg

SEQ ID NO: 3942951 - RNA, 14 nt, Human adenovirus F
gcccuggccuggaa

SEQ ID NO: 3942952 - RNA, 23 nt, Human adenovirus F
gcccuuucaaaaagguuuccaaa

SEQ ID NO: 3942953 - RNA, 19 nt, Human adenovirus F
gccgcaccgcgcccguccu

SEQ ID NO: 3942954 - RNA, 22 nt, Human adenovirus F
gccgcacucgcuccacccgccg

SEQ ID NO: 3942955 - RNA, 23 nt, Human adenovirus F
gccgcccuaaccucuaccccgcg

SEQ ID NO: 3942956 - RNA, 18 nt, Human adenovirus F
gccgcugacggcgcagcu

SEQ ID NO: 3942957 - RNA, 15 nt, Human adenovirus F
gccggacgggcagcc

SEQ ID NO: 3942958 - RNA, 15 nt, Human adenovirus F
gccggcgggaagagg

SEQ ID NO: 3942959 - RNA, 17 nt, Human adenovirus F
gccgucccugggaugca

SEQ ID NO: 3942960 - RNA, 22 nt, Human adenovirus F
gccguugcucucuccggagccg

SEQ ID NO: 3942961 - RNA, 19 nt, Human adenovirus F
gccguuuaugggcaccugg

SEQ ID NO: 3942962 - RNA, 14 nt, Human adenovirus F
gccuacucuuacaa

SEQ ID NO: 3942963 - RNA, 18 nt, Human adenovirus F
gccucaugagcugggaga

SEQ ID NO: 3942964 - RNA, 21 nt, Human adenovirus F
gccucaugagcugggagaaag

SEQ ID NO: 3942965 - RNA, 17 nt, Human adenovirus F
gccuccguguuuuuuga

SEQ ID NO: 3942966 - RNA, 21 nt, Human adenovirus F
gccucuguuguagucugccaa

SEQ ID NO: 3942967 - RNA, 20 nt, Human adenovirus F
gccugaucccgaagagggua

SEQ ID NO: 3942968 - RNA, 15 nt, Human adenovirus F
gccuugcaagcagcu

SEQ ID NO: 3942969 - RNA, 18 nt, Human adenovirus F
gccuuuuauuaaccgccu

SEQ ID NO: 3942970 - RNA, 13 nt, Human adenovirus F
gcgaacagagugg

SEQ ID NO: 3942971 - RNA, 13 nt, Human adenovirus F
gcgcaaugcagag

SEQ ID NO: 3942972 - RNA, 12 nt, Human adenovirus F
gcgccccugcag

SEQ ID NO: 3942973 - RNA, 22 nt, Human adenovirus F
gcgcccgggcccuggaggcggc

SEQ ID NO: 3942974 - RNA, 16 nt, Human adenovirus F
gcgcgaacugggcugc

SEQ ID NO: 3942975 - RNA, 20 nt, Human adenovirus F
gcgcugcuacucaacagaaa

SEQ ID NO: 3942976 - RNA, 20 nt, Human adenovirus F
gcgcuuuuuuuaggcgccaa

SEQ ID NO: 3942977 - RNA, 23 nt, Human adenovirus F
gcggaccugcaauggcagcccag

SEQ ID NO: 3942978 - RNA, 19 nt, Human adenovirus F
gcggacgggucgcagcagg

SEQ ID NO: 3942979 - RNA, 16 nt, Human adenovirus F
gcggcaaaagcuugag

SEQ ID NO: 3942980 - RNA, 23 nt, Human adenovirus F
gcggcugguuauguuggcgcgga

SEQ ID NO: 3942981 - RNA, 11 nt, Human adenovirus F
gcgggcucuga

SEQ ID NO: 3942982 - RNA, 21 nt, Human adenovirus F
gcggggcaccuucagcuugag

SEQ ID NO: 3942983 - RNA, 16 nt, Human adenovirus F
gcggggcuaacuggca

SEQ ID NO: 3942984 - RNA, 22 nt, Human adenovirus F
gcguagcaccccaauguaaguu

SEQ ID NO: 3942985 - RNA, 19 nt, Human adenovirus F
gcgucaggaauuucuuuua

SEQ ID NO: 3942986 - RNA, 17 nt, Human adenovirus F
gcgugcaagugggcuca

SEQ ID NO: 3942987 - RNA, 20 nt, Human adenovirus F
gcgugcccaucauacagcag

SEQ ID NO: 3942988 - RNA, 21 nt, Human adenovirus F
gcguucgacgcgaggaugaga

SEQ ID NO: 3942989 - RNA, 14 nt, Human adenovirus F
gcguugcacgcucu

SEQ ID NO: 3942990 - RNA, 19 nt, Human adenovirus F
gcuaaagggaacugccagu

SEQ ID NO: 3942991 - RNA, 23 nt, Human adenovirus F
gcuaauacuucuuaauaaagaca

SEQ ID NO: 3942992 - RNA, 20 nt, Human adenovirus F
gcuaauuuuucaccaaaggu

SEQ ID NO: 3942993 - RNA, 16 nt, Human adenovirus F
gcuacggaggaagagg

SEQ ID NO: 3942994 - RNA, 15 nt, Human adenovirus F
gcuagcauaaaagaa

SEQ ID NO: 3942995 - RNA, 22 nt, Human adenovirus F
agcuacuuucaucuuaacucug

SEQ ID NO: 3942996 - RNA, 16 nt, Human adenovirus F
agcugcugccgcgucu

SEQ ID NO: 3942997 - RNA, 12 nt, Human adenovirus F
agcuggccuggu

SEQ ID NO: 3942998 - RNA, 23 nt, Human adenovirus F
agcugucuuaccaguuaaugcuu

SEQ ID NO: 3942999 - RNA, 17 nt, Human adenovirus F
agcuguuuaccaaaggc

SEQ ID NO: 3943000 - RNA, 14 nt, Human adenovirus F
agcuucucagcuca

SEQ ID NO: 3943001 - RNA, 22 nt, Human adenovirus F
agcuuuauuuccuuugucaugu

SEQ ID NO: 3943002 - RNA, 15 nt, Human adenovirus F
aggaaacgcugugag

SEQ ID NO: 3943003 - RNA, 20 nt, Human adenovirus F
aggaagaaaccaucgccagc

SEQ ID NO: 3943004 - RNA, 15 nt, Human adenovirus F
aggaagggcaaaggu

SEQ ID NO: 3943005 - RNA, 18 nt, Human adenovirus F
aggacagucugccaacac

SEQ ID NO: 3943006 - RNA, 18 nt, Human adenovirus F
aggacgucgggccaugcg

SEQ ID NO: 3943007 - RNA, 14 nt, Human adenovirus F
aggacguggaggaa

SEQ ID NO: 3943008 - RNA, 17 nt, Human adenovirus F
aggacuucaccuacaac

SEQ ID NO: 3943009 - RNA, 19 nt, Human adenovirus F
aggagcagauggagagcug

SEQ ID NO: 3943010 - RNA, 17 nt, Human adenovirus F
aggagcagcgggaagag

SEQ ID NO: 3943011 - RNA, 18 nt, Human adenovirus F
aggaggcuaauggccaga

SEQ ID NO: 3943012 - RNA, 18 nt, Human adenovirus F
aggaguuuguacccuccg

SEQ ID NO: 3943013 - RNA, 16 nt, Human adenovirus F
aggcaaaacuggaacg

SEQ ID NO: 3943014 - RNA, 14 nt, Human adenovirus F
aggcagcagggugc

SEQ ID NO: 3943015 - RNA, 19 nt, Human adenovirus F
aggcauuaggccgucccug

SEQ ID NO: 3943016 - RNA, 21 nt, Human adenovirus F
aggccagucggcaggcuuccu

SEQ ID NO: 3943017 - RNA, 20 nt, Human adenovirus F
aggccauccuggaccuggaa

SEQ ID NO: 3943018 - RNA, 12 nt, Human adenovirus F
aggccgcuccca

SEQ ID NO: 3943019 - RNA, 13 nt, Human adenovirus F
aggccuggaacag

SEQ ID NO: 3943020 - RNA, 21 nt, Human adenovirus F
aggcgagaaaauauggaggag

SEQ ID NO: 3943021 - RNA, 16 nt, Human adenovirus F
aggcgcaaucccaggc

SEQ ID NO: 3943022 - RNA, 16 nt, Human adenovirus F
aggcucucaaaaaacg

SEQ ID NO: 3943023 - RNA, 16 nt, Human adenovirus F
aggcucuucuuccucg

SEQ ID NO: 3943024 - RNA, 23 nt, Human adenovirus F
agggcacaguaaucaaggguuuc

SEQ ID NO: 3943025 - RNA, 14 nt, Human adenovirus F
agggccggccugga

SEQ ID NO: 3943026 - RNA, 18 nt, Human adenovirus F
agggcgucaugcucuggg

SEQ ID NO: 3943027 - RNA, 19 nt, Human adenovirus F
agggcgugcaagugggcuc

SEQ ID NO: 3943028 - RNA, 20 nt, Human adenovirus F
aggguaaggggcggagccua

SEQ ID NO: 3943029 - RNA, 15 nt, Human adenovirus F
aggguacuagcagug

SEQ ID NO: 3943030 - RNA, 22 nt, Human adenovirus F
agggucgauggagccagcguca

SEQ ID NO: 3943031 - RNA, 15 nt, Human adenovirus F
aggguguacguuugu

SEQ ID NO: 3943032 - RNA, 14 nt, Human adenovirus F
agggugucugccag

SEQ ID NO: 3943033 - RNA, 14 nt, Human adenovirus F
agguggaccccaug

SEQ ID NO: 3943034 - RNA, 16 nt, Human adenovirus F
agguuacucagcaauc

SEQ ID NO: 3943035 - RNA, 15 nt, Human adenovirus F
agguugacuugcagg

SEQ ID NO: 3943036 - RNA, 23 nt, Human adenovirus F
agguuugacagcauuaaccugua

SEQ ID NO: 3943037 - RNA, 14 nt, Human adenovirus F
aguaaaaagccuga

SEQ ID NO: 3943038 - RNA, 22 nt, Human adenovirus F
aguagguggggccccugaggca

SEQ ID NO: 3943039 - RNA, 16 nt, Human adenovirus F
aguauuacaaaugccu

SEQ ID NO: 3943040 - RNA, 12 nt, Human adenovirus F
agucaaaugucu

SEQ ID NO: 3943041 - RNA, 20 nt, Human adenovirus F
agucaaaugucuguaaagaa

SEQ ID NO: 3943042 - RNA, 18 nt, Human adenovirus F
aguccaaaugacuaacuc

SEQ ID NO: 3943043 - RNA, 12 nt, Human adenovirus F
agucugccaacg

SEQ ID NO: 3943044 - RNA, 15 nt, Human adenovirus F
agucuguuugguggg

SEQ ID NO: 3943045 - RNA, 19 nt, Human adenovirus F
agucuguuuggugggcuga

SEQ ID NO: 3943046 - RNA, 12 nt, Human adenovirus F
agugagcucuuc

SEQ ID NO: 3943047 - RNA, 15 nt, Human adenovirus F
agugaugcaccucuu

SEQ ID NO: 3943048 - RNA, 20 nt, Human adenovirus F
aguggaacuuccggaaggau

SEQ ID NO: 3943049 - RNA, 19 nt, Human adenovirus F
aguggacaaaccaaaacaa

SEQ ID NO: 3943050 - RNA, 18 nt, Human adenovirus F
aguggaguucagcgcgug

SEQ ID NO: 3943051 - RNA, 19 nt, Human adenovirus F
aguggcuucacggaaggaa

SEQ ID NO: 3943052 - RNA, 19 nt, Human adenovirus F
aguuaaccuugaguuuaau

SEQ ID NO: 3943053 - RNA, 15 nt, Human adenovirus F
aguuuaaaaacggug

SEQ ID NO: 3943054 - RNA, 16 nt, Human adenovirus F
aguuuuaauggaaacu

SEQ ID NO: 3943055 - RNA, 21 nt, Human adenovirus F
auaaaagcuucuaucugcaaa

SEQ ID NO: 3943056 - RNA, 15 nt, Human adenovirus F
auaagaagccagcca

SEQ ID NO: 3943057 - RNA, 15 nt, Human adenovirus F
auaaucuuaaaacug

SEQ ID NO: 3943058 - RNA, 19 nt, Human adenovirus F
auacagucaagcucuccac

SEQ ID NO: 3943059 - RNA, 13 nt, Human adenovirus F
auacgggaaggaa

SEQ ID NO: 3943060 - RNA, 20 nt, Human adenovirus F
auacgggguuagcgcacugg

SEQ ID NO: 3943061 - RNA, 15 nt, Human adenovirus F
auacguaaaugugcc

SEQ ID NO: 3943062 - RNA, 19 nt, Human adenovirus F
auacguuacucggagcugg

SEQ ID NO: 3943063 - RNA, 14 nt, Human adenovirus F
auacguuagagugg

SEQ ID NO: 3943064 - RNA, 13 nt, Human adenovirus F
auacugcuccugg

SEQ ID NO: 3943065 - RNA, 19 nt, Human adenovirus F
auagcaaaagcauuuuccu

SEQ ID NO: 3943066 - RNA, 18 nt, Human adenovirus F
auaggcauuaggccgucc

SEQ ID NO: 3943067 - RNA, 15 nt, Human adenovirus F
auauaggacaaaaaa

SEQ ID NO: 3943068 - RNA, 17 nt, Human adenovirus F
auaugucugccaaaaug

SEQ ID NO: 3943069 - RNA, 20 nt, Human adenovirus F
auauuauuuaaauaaaacau

SEQ ID NO: 3943070 - RNA, 14 nt, Human adenovirus F
aucacuguuaaugg

SEQ ID NO: 3943071 - RNA, 14 nt, Human adenovirus F
aucaucgccgccgc

SEQ ID NO: 3943072 - RNA, 24 nt, Human adenovirus F
aucauuuuaaaccaauuugcuaac

SEQ ID NO: 3943073 - RNA, 16 nt, Human adenovirus F
auccagcaacucugaa

SEQ ID NO: 3943074 - RNA, 13 nt, Human adenovirus F
aucccccgagcgc

SEQ ID NO: 3943075 - RNA, 16 nt, Human adenovirus F
aucccgcgcuaaaucu

SEQ ID NO: 3943076 - RNA, 19 nt, Human adenovirus F
auccucaagacuuggaaau

SEQ ID NO: 3943077 - RNA, 17 nt, Human adenovirus F
auccucagugucuugcc

SEQ ID NO: 3943078 - RNA, 23 nt, Human adenovirus F
auccuucagagcauugugguaca

SEQ ID NO: 3943079 - RNA, 15 nt, Human adenovirus F
aucgacgggcagugc

SEQ ID NO: 3943080 - RNA, 15 nt, Human adenovirus F
aucgccaacagcccc

SEQ ID NO: 3943081 - RNA, 16 nt, Human adenovirus F
aucgcugaccagcagc

SEQ ID NO: 3943082 - RNA, 19 nt, Human adenovirus F
aucgcuguggacgacagcc

SEQ ID NO: 3943083 - RNA, 16 nt, Human adenovirus F
aucggcaccagccagc

SEQ ID NO: 3943084 - RNA, 20 nt, Human adenovirus F
aucgugcgcgaacugggcug

SEQ ID NO: 3943085 - RNA, 17 nt, Human adenovirus F
aucuauuucuuugucua

SEQ ID NO: 3943086 - RNA, 16 nt, Human adenovirus F
aucuuaagcugcagcc

SEQ ID NO: 3943087 - RNA, 19 nt, Human adenovirus F
aucuuaagcugcagccaga

SEQ ID NO: 3943088 - RNA, 23 nt, Human adenovirus F
aucuugcaaaacuuucgcuccuu

SEQ ID NO: 3943089 - RNA, 17 nt, Human adenovirus F
augagacgugcgguggg

SEQ ID NO: 3943090 - RNA, 16 nt, Human adenovirus F
augagcugggagaaag

SEQ ID NO: 3943091 - RNA, 17 nt, Human adenovirus F
augagguuuacgcugac

SEQ ID NO: 3943092 - RNA, 18 nt, Human adenovirus F
augauguaacccaacagg

SEQ ID NO: 3943093 - RNA, 18 nt, Human adenovirus F
augcaacuuggaagggaa

SEQ ID NO: 3943094 - RNA, 20 nt, Human adenovirus F
augcagccauguuauggguc

SEQ ID NO: 3943095 - RNA, 16 nt, Human adenovirus F
augcaugcgaggggaa

SEQ ID NO: 3943096 - RNA, 15 nt, Human adenovirus F
augccucccuuugcc

SEQ ID NO: 3943097 - RNA, 11 nt, Human adenovirus F
augccugcagc

SEQ ID NO: 3943098 - RNA, 18 nt, Human adenovirus F
augccuuaacauuuaugc

SEQ ID NO: 3943099 - RNA, 13 nt, Human adenovirus F
augcgauuuucca

SEQ ID NO: 3943100 - RNA, 15 nt, Human adenovirus F
augcgcuccaacacu

SEQ ID NO: 3943101 - RNA, 20 nt, Human adenovirus F
augcgucgggcgugcgggug

SEQ ID NO: 3943102 - RNA, 13 nt, Human adenovirus F
augcuauuuucca

SEQ ID NO: 3943103 - RNA, 15 nt, Human adenovirus F
augcuggucugcgcu

SEQ ID NO: 3943104 - RNA, 18 nt, Human adenovirus F
augcuguagaauuuaugc

SEQ ID NO: 3943105 - RNA, 22 nt, Human adenovirus F
auggaaacugucaggcucugag

SEQ ID NO: 3943106 - RNA, 22 nt, Human adenovirus F
auggagcuauuuaaagugguga

SEQ ID NO: 3943107 - RNA, 23 nt, Human adenovirus F
auggcaauggcucuguggagaac

SEQ ID NO: 3943108 - RNA, 13 nt, Human adenovirus F
augggcaccugga

SEQ ID NO: 3943109 - RNA, 15 nt, Human adenovirus F
auggugguagaaggu

SEQ ID NO: 3943110 - RNA, 18 nt, Human adenovirus F
augguugaaaaagaucag

SEQ ID NO: 3943111 - RNA, 15 nt, Human adenovirus F
auguaaccacagaca

SEQ ID NO: 3943112 - RNA, 19 nt, Human adenovirus F
augugucuccgcugggaga

SEQ ID NO: 3943113 - RNA, 15 nt, Human adenovirus F
auuaccgucaucucu

SEQ ID NO: 3943114 - RNA, 17 nt, Human adenovirus F
auuacgucauugacauu

SEQ ID NO: 3943115 - RNA, 18 nt, Human adenovirus F
auucagggaucgcagcgg

SEQ ID NO: 3943116 - RNA, 24 nt, Human adenovirus F
auuccugggguagggugucugcca

SEQ ID NO: 3943117 - RNA, 19 nt, Human adenovirus F
auucuugagcaggccgccc

SEQ ID NO: 3943118 - RNA, 14 nt, Human adenovirus F
auuggcaugagugg

SEQ ID NO: 3943119 - RNA, 14 nt, Human adenovirus F
auuggucaaaaacu

SEQ ID NO: 3943120 - RNA, 22 nt, Human adenovirus F
auuuaaaguggugagguaugau

SEQ ID NO: 3943121 - RNA, 23 nt, Human adenovirus F
auuuaauggcacaguguuugcuu

SEQ ID NO: 3943122 - RNA, 15 nt, Human adenovirus F
auuucaccuacucug

SEQ ID NO: 3943123 - RNA, 18 nt, Human adenovirus F
auuucaccuacucuggcu

SEQ ID NO: 3943124 - RNA, 18 nt, Human adenovirus F
auuugugggacuuuaugg

SEQ ID NO: 3943125 - RNA, 17 nt, Human adenovirus F
auuuugcgucgcuggcu

SEQ ID NO: 3943126 - RNA, 17 nt, Human adenovirus F
caaaaacggggcuuuaa

SEQ ID NO: 3943127 - RNA, 18 nt, Human adenovirus F
caaaacuuucaacaaaaa

SEQ ID NO: 3943128 - RNA, 13 nt, Human adenovirus F
caaacaacugcaa

SEQ ID NO: 3943129 - RNA, 23 nt, Human adenovirus F
caaacaugugaccguguagccuu

SEQ ID NO: 3943130 - RNA, 14 nt, Human adenovirus F
caaacauugcaaaa

SEQ ID NO: 3943131 - RNA, 13 nt, Human adenovirus F
caaagaagagcug

SEQ ID NO: 3943132 - RNA, 17 nt, Human adenovirus F
caaaguccuggccaacu

SEQ ID NO: 3943133 - RNA, 21 nt, Human adenovirus F
caaagugcugucuagccgcac

SEQ ID NO: 3943134 - RNA, 15 nt, Human adenovirus F
caaaugcucugcaaa

SEQ ID NO: 3943135 - RNA, 21 nt, Human adenovirus F
caaaugucuuguggcugguga

SEQ ID NO: 3943136 - RNA, 14 nt, Human adenovirus F
caacacaggagcuu

SEQ ID NO: 3943137 - RNA, 12 nt, Human adenovirus F
caaccauguuca

SEQ ID NO: 3943138 - RNA, 15 nt, Human adenovirus F
caacccgucuucccu

SEQ ID NO: 3943139 - RNA, 14 nt, Human adenovirus F
caaccuucaagccc

SEQ ID NO: 3943140 - RNA, 11 nt, Human adenovirus F
caacgccaggc

SEQ ID NO: 3943141 - RNA, 14 nt, Human adenovirus F
caacggcaauccca

SEQ ID NO: 3943142 - RNA, 18 nt, Human adenovirus F
caacucauggugccaaag

SEQ ID NO: 3943143 - RNA, 13 nt, Human adenovirus F
caacuccucuugc

SEQ ID NO: 3943144 - RNA, 18 nt, Human adenovirus F
caacugccaccuccaccg

SEQ ID NO: 3943145 - RNA, 13 nt, Human adenovirus F
caagaaacacaaa

SEQ ID NO: 3943146 - RNA, 15 nt, Human adenovirus F
caagaaauacaaagg

SEQ ID NO: 3943147 - RNA, 21 nt, Human adenovirus F
caagaaggugcuuccagccuc

SEQ ID NO: 3943148 - RNA, 13 nt, Human adenovirus F
caagagccaccuu

SEQ ID NO: 3943149 - RNA, 22 nt, Human adenovirus F
caagauaugucugccaaaaugg

SEQ ID NO: 3943150 - RNA, 19 nt, Human adenovirus F
caagcccaauccucaagac

SEQ ID NO: 3943151 - RNA, 19 nt, Human adenovirus F
caaggacagucugccaaca

SEQ ID NO: 3943152 - RNA, 18 nt, Human adenovirus F
caaggcguaaagacugac

SEQ ID NO: 3943153 - RNA, 14 nt, Human adenovirus F
caaguacacugacc

SEQ ID NO: 3943154 - RNA, 23 nt, Human adenovirus F
caaguagggagugauggugggga

SEQ ID NO: 3943155 - RNA, 14 nt, Human adenovirus F
caaguuggugaugc

SEQ ID NO: 3943156 - RNA, 22 nt, Human adenovirus F
caauaagcagcuugaagaacug

SEQ ID NO: 3943157 - RNA, 20 nt, Human adenovirus F
caauauaaugacaaugucca

SEQ ID NO: 3943158 - RNA, 21 nt, Human adenovirus F
caaucagaccacaacaacaaa

SEQ ID NO: 3943159 - RNA, 18 nt, Human adenovirus F
caaucagcggcuggaaaa

SEQ ID NO: 3943160 - RNA, 15 nt, Human adenovirus F
caauccuaacaaaaa

SEQ ID NO: 3943161 - RNA, 14 nt, Human adenovirus F
caauggaacauuaa

SEQ ID NO: 3943162 - RNA, 15 nt, Human adenovirus F
caauuugcuaacacu

SEQ ID NO: 3943163 - RNA, 21 nt, Human adenovirus F
caauuuugcaaacuauucugg

SEQ ID NO: 3943164 - RNA, 20 nt, Human adenovirus F
cacaccucuccccaccgcug

SEQ ID NO: 3943165 - RNA, 23 nt, Human adenovirus F
cacacgucauccgccuccacccu

SEQ ID NO: 3943166 - RNA, 14 nt, Human adenovirus F
cacauugccagcua

SEQ ID NO: 3943167 - RNA, 17 nt, Human adenovirus F
caccaacgugcaggcca

SEQ ID NO: 3943168 - RNA, 21 nt, Human adenovirus F
caccaacgugcaggccaaccu

SEQ ID NO: 3943169 - RNA, 19 nt, Human adenovirus F
caccacauaagaagccagc

SEQ ID NO: 3943170 - RNA, 13 nt, Human adenovirus F
caccagccagcuc

SEQ ID NO: 3943171 - RNA, 20 nt, Human adenovirus F
caccagccgcaccgcggcgu

SEQ ID NO: 3943172 - RNA, 19 nt, Human adenovirus F
caccaggucguaaugagga

SEQ ID NO: 3943173 - RNA, 18 nt, Human adenovirus F
cacccucagacgacuggg

SEQ ID NO: 3943174 - RNA, 15 nt, Human adenovirus F
cacccuuucccaccc

SEQ ID NO: 3943175 - RNA, 24 nt, Human adenovirus F
caccgcccccacuguugccguggc

SEQ ID NO: 3943176 - RNA, 21 nt, Human adenovirus F
caccgccgcaccacugacagu

SEQ ID NO: 3943177 - RNA, 17 nt, Human adenovirus F
caccgcgcccguccucc

SEQ ID NO: 3943178 - RNA, 17 nt, Human adenovirus F
caccgcgcggcggccau

SEQ ID NO: 3943179 - RNA, 22 nt, Human adenovirus F
caccguuagcacugcgguggag

SEQ ID NO: 3943180 - RNA, 17 nt, Human adenovirus F
caccguucccacuguuu

SEQ ID NO: 3943181 - RNA, 16 nt, Human adenovirus F
caccguuguggaguca

SEQ ID NO: 3943182 - RNA, 19 nt, Human adenovirus F
caccucuguuugcugcacu

SEQ ID NO: 3943183 - RNA, 15 nt, Human adenovirus F
caccugcccuuccuc

SEQ ID NO: 3943184 - RNA, 21 nt, Human adenovirus F
caccugcccuuccucccaacu

SEQ ID NO: 3943185 - RNA, 23 nt, Human adenovirus F
caccuucagugucgucuacaacg

SEQ ID NO: 3943186 - RNA, 17 nt, Human adenovirus F
cacgcugacccuuccca

SEQ ID NO: 3943187 - RNA, 17 nt, Human adenovirus F
cacggaacccugccgcu

SEQ ID NO: 3943188 - RNA, 19 nt, Human adenovirus F
cacgguauagccggugcac

SEQ ID NO: 3943189 - RNA, 21 nt, Human adenovirus F
cacuaaccaggcgagcucagg

SEQ ID NO: 3943190 - RNA, 13 nt, Human adenovirus F
cacuaccacccuc

SEQ ID NO: 3943191 - RNA, 17 nt, Human adenovirus F
cacuaccccuaccaccc

SEQ ID NO: 3943192 - RNA, 17 nt, Human adenovirus F
cacuagcgccccugcag

SEQ ID NO: 3943193 - RNA, 12 nt, Human adenovirus F
cacuccugcagu

SEQ ID NO: 3943194 - RNA, 17 nt, Human adenovirus F
cacucuccgccgccgcu

SEQ ID NO: 3943195 - RNA, 22 nt, Human adenovirus F
cacugacuuccugguccugacu

SEQ ID NO: 3943196 - RNA, 23 nt, Human adenovirus F
cacugauguaacagcuuuggaag

SEQ ID NO: 3943197 - RNA, 21 nt, Human adenovirus F
cacugcauacaacucccuggc

SEQ ID NO: 3943198 - RNA, 17 nt, Human adenovirus F
cacugccuaccgcagcu

SEQ ID NO: 3943199 - RNA, 15 nt, Human adenovirus F
cacugcuaccuccuc

SEQ ID NO: 3943200 - RNA, 13 nt, Human adenovirus F
cacuggaugccac

SEQ ID NO: 3943201 - RNA, 15 nt, Human adenovirus F
cacuggcuggcccug

SEQ ID NO: 3943202 - RNA, 15 nt, Human adenovirus F
cacuuaccagagcca

SEQ ID NO: 3943203 - RNA, 15 nt, Human adenovirus F
cacuucuauugcacu

SEQ ID NO: 3943204 - RNA, 17 nt, Human adenovirus F
cagaaacaugccaccca

SEQ ID NO: 3943205 - RNA, 16 nt, Human adenovirus F
cagaagugaagaccaa

SEQ ID NO: 3943206 - RNA, 15 nt, Human adenovirus F
cagaccccauggaca

SEQ ID NO: 3943207 - RNA, 22 nt, Human adenovirus F
cagacggccguaccaagccuga

SEQ ID NO: 3943208 - RNA, 17 nt, Human adenovirus F
cagacuccgcugacggu

SEQ ID NO: 3943209 - RNA, 23 nt, Human adenovirus F
cagacucgagguguaacaucccu

SEQ ID NO: 3943210 - RNA, 20 nt, Human adenovirus F
cagagcucugcaaaaacaaa

SEQ ID NO: 3943211 - RNA, 22 nt, Human adenovirus F
cagaggaaguuucagacgagga

SEQ ID NO: 3943212 - RNA, 22 nt, Human adenovirus F
cagaucacggaacccugccgcu

SEQ ID NO: 3943213 - RNA, 13 nt, Human adenovirus F
cagcaaacacaaa

SEQ ID NO: 3943214 - RNA, 22 nt, Human adenovirus F
cagcaccgcacagaaagcucau

SEQ ID NO: 3943215 - RNA, 16 nt, Human adenovirus F
cagcagauccuucccg

SEQ ID NO: 3943216 - RNA, 16 nt, Human adenovirus F
cagcagccccaggcca

SEQ ID NO: 3943217 - RNA, 22 nt, Human adenovirus F
cagcaggugaaucccgcuaugu

SEQ ID NO: 3943218 - RNA, 18 nt, Human adenovirus F
cagcaguaucaguggagu

SEQ ID NO: 3943219 - RNA, 15 nt, Human adenovirus F
cagcaguccgucagc

SEQ ID NO: 3943220 - RNA, 19 nt, Human adenovirus F
cagcauaauaacucuggcu

SEQ ID NO: 3943221 - RNA, 17 nt, Human adenovirus F
cagcaugagcaagcgca

SEQ ID NO: 3943222 - RNA, 22 nt, Human adenovirus F
cagccaaugggcuccagcgagc

SEQ ID NO: 3943223 - RNA, 18 nt, Human adenovirus F
cagccauguuauggguca

SEQ ID NO: 3943224 - RNA, 16 nt, Human adenovirus F
cagcccagcgcccggg

SEQ ID NO: 3943225 - RNA, 15 nt, Human adenovirus F
cagccggaggagugg

SEQ ID NO: 3943226 - RNA, 20 nt, Human adenovirus F
cagccuccgguggcucugca

SEQ ID NO: 3943227 - RNA, 19 nt, Human adenovirus F
cagccugagcugccagagg

SEQ ID NO: 3943228 - RNA, 20 nt, Human adenovirus F
cagccugagcugccagaggc

SEQ ID NO: 3943229 - RNA, 13 nt, Human adenovirus F
cagcgcccgccuc

SEQ ID NO: 3943230 - RNA, 21 nt, Human adenovirus F
cagcgcccgggcccuggaggc

SEQ ID NO: 3943231 - RNA, 15 nt, Human adenovirus F
cagcgcgcuccauca

SEQ ID NO: 3943232 - RNA, 13 nt, Human adenovirus F
aacugcuccaucu

SEQ ID NO: 3943233 - RNA, 13 nt, Human adenovirus F
aacuuuguuauga

SEQ ID NO: 3943234 - RNA, 17 nt, Human adenovirus F
aagaagagcugcuggag

SEQ ID NO: 3943235 - RNA, 13 nt, Human adenovirus F
aagaagcacagga

SEQ ID NO: 3943236 - RNA, 13 nt, Human adenovirus F
aagaagugugugu

SEQ ID NO: 3943237 - RNA, 22 nt, Human adenovirus F
aagaaguuacaaucuccuagag

SEQ ID NO: 3943238 - RNA, 21 nt, Human adenovirus F
aagaauacuaaaacaaaccac

SEQ ID NO: 3943239 - RNA, 21 nt, Human adenovirus F
aagcaauauugucgcaugccu

SEQ ID NO: 3943240 - RNA, 16 nt, Human adenovirus F
aagccugacucagaaa

SEQ ID NO: 3943241 - RNA, 17 nt, Human adenovirus F
aagcuacaaggacagga

SEQ ID NO: 3943242 - RNA, 21 nt, Human adenovirus F
aagcuucuuguacucaaaugu

SEQ ID NO: 3943243 - RNA, 21 nt, Human adenovirus F
aaggaggaggcuaauggccag

SEQ ID NO: 3943244 - RNA, 21 nt, Human adenovirus F
aaggauuuugccggcucuagg

SEQ ID NO: 3943245 - RNA, 12 nt, Human adenovirus F
aaggcgaaaagc

SEQ ID NO: 3943246 - RNA, 20 nt, Human adenovirus F
aaggucagaaaaaccgccac

SEQ ID NO: 3943247 - RNA, 20 nt, Human adenovirus F
aagguugacuugcaggagac

SEQ ID NO: 3943248 - RNA, 21 nt, Human adenovirus F
aagucauuugguaacaaggcc

SEQ ID NO: 3943249 - RNA, 15 nt, Human adenovirus F
aaguccuggccaacu

SEQ ID NO: 3943250 - RNA, 21 nt, Human adenovirus F
aagugcagaggcguacaugcc

SEQ ID NO: 3943251 - RNA, 16 nt, Human adenovirus F
aaguggaucccagcgu

SEQ ID NO: 3943252 - RNA, 13 nt, Human adenovirus F
aaguuacaaaaug

SEQ ID NO: 3943253 - RNA, 13 nt, Human adenovirus F
aaguuucgggcgc

SEQ ID NO: 3943254 - RNA, 13 nt, Human adenovirus F
aauaaagcuuacc

SEQ ID NO: 3943255 - RNA, 12 nt, Human adenovirus F
aauaagcugggu

SEQ ID NO: 3943256 - RNA, 20 nt, Human adenovirus F
aauaauuuuccgcuugccac

SEQ ID NO: 3943257 - RNA, 15 nt, Human adenovirus F
aauagauagcuuuua

SEQ ID NO: 3943258 - RNA, 13 nt, Human adenovirus F
aauauuaaugccc

SEQ ID NO: 3943259 - RNA, 15 nt, Human adenovirus F
aaucaaggccaaagu

SEQ ID NO: 3943260 - RNA, 21 nt, Human adenovirus F
aaucacgaccucccaaagucc

SEQ ID NO: 3943261 - RNA, 13 nt, Human adenovirus F
aaucaggagaaaa

SEQ ID NO: 3943262 - RNA, 18 nt, Human adenovirus F
aaucagggcgugcaagug

SEQ ID NO: 3943263 - RNA, 18 nt, Human adenovirus F
aaucccgaagccuucagg

SEQ ID NO: 3943264 - RNA, 18 nt, Human adenovirus F
aaucuaccacagaaaugu

SEQ ID NO: 3943265 - RNA, 19 nt, Human adenovirus F
aaucucuucguccuggagu

SEQ ID NO: 3943266 - RNA, 14 nt, Human adenovirus F
aaucuucaaacauu

SEQ ID NO: 3943267 - RNA, 17 nt, Human adenovirus F
aaucuuccucccaaagu

SEQ ID NO: 3943268 - RNA, 22 nt, Human adenovirus F
aaugccuaccucugacaaacac

SEQ ID NO: 3943269 - RNA, 17 nt, Human adenovirus F
aaugcuccgggauaagc

SEQ ID NO: 3943270 - RNA, 22 nt, Human adenovirus F
aaugcuccgggauaagcuaaag

SEQ ID NO: 3943271 - RNA, 16 nt, Human adenovirus F
aauggagcuguggugc

SEQ ID NO: 3943272 - RNA, 16 nt, Human adenovirus F
aauggcagcccagcgc

SEQ ID NO: 3943273 - RNA, 24 nt, Human adenovirus F
aauguaacaugaccaaggacuggu

SEQ ID NO: 3943274 - RNA, 14 nt, Human adenovirus F
aauguaacucuccc

SEQ ID NO: 3943275 - RNA, 13 nt, Human adenovirus F
aauucugaagagg

SEQ ID NO: 3943276 - RNA, 19 nt, Human adenovirus F
aauuuaugccuagcucuaa

SEQ ID NO: 3943277 - RNA, 20 nt, Human adenovirus F
aauuuugcgucgcuggcucc

SEQ ID NO: 3943278 - RNA, 15 nt, Human adenovirus F
aauuuuucgaggaaa

SEQ ID NO: 3943279 - RNA, 13 nt, Human adenovirus F
acaaaaacuccaa

SEQ ID NO: 3943280 - RNA, 14 nt, Human adenovirus F
acaaaauaaugacu

SEQ ID NO: 3943281 - RNA, 19 nt, Human adenovirus F
acaaagucauccaaaucau

SEQ ID NO: 3943282 - RNA, 19 nt, Human adenovirus F
acaacacaggagcuuuaca

SEQ ID NO: 3943283 - RNA, 23 nt, Human adenovirus F
acaaccagcuuaguauuaacacu

SEQ ID NO: 3943284 - RNA, 17 nt, Human adenovirus F
acaacguggcucaaugu

SEQ ID NO: 3943285 - RNA, 22 nt, Human adenovirus F
acaacguggcucaauguaacau

SEQ ID NO: 3943286 - RNA, 12 nt, Human adenovirus F
acaacuacggag

SEQ ID NO: 3943287 - RNA, 20 nt, Human adenovirus F
acaaggacagucugccaaca

SEQ ID NO: 3943288 - RNA, 12 nt, Human adenovirus F
acaaggccugga

SEQ ID NO: 3943289 - RNA, 17 nt, Human adenovirus F
acaaucgcgauguguuu

SEQ ID NO: 3943290 - RNA, 21 nt, Human adenovirus F
acacagaacaaaacacacucc

SEQ ID NO: 3943291 - RNA, 14 nt, Human adenovirus F
acaccggugggcuu

SEQ ID NO: 3943292 - RNA, 16 nt, Human adenovirus F
acaccggugggcuugu

SEQ ID NO: 3943293 - RNA, 18 nt, Human adenovirus F
acaccugggaaaaccugu

SEQ ID NO: 3943294 - RNA, 21 nt, Human adenovirus F
acacuaugguaaaaacccugu

SEQ ID NO: 3943295 - RNA, 15 nt, Human adenovirus F
acacuuucaccgccu

SEQ ID NO: 3943296 - RNA, 22 nt, Human adenovirus F
acagaccgcaggacuuggcaga

SEQ ID NO: 3943297 - RNA, 14 nt, Human adenovirus F
acagagcuuuauga

SEQ ID NO: 3943298 - RNA, 22 nt, Human adenovirus F
acagccuguuacuauuaaugca

SEQ ID NO: 3943299 - RNA, 14 nt, Human adenovirus F
acaggugggcuugg

SEQ ID NO: 3943300 - RNA, 22 nt, Human adenovirus F
acaguggaauuggaaugccugc

SEQ ID NO: 3943301 - RNA, 15 nt, Human adenovirus F
acauaacuuuacaaa

SEQ ID NO: 3943302 - RNA, 16 nt, Human adenovirus F
acauaucgucacuucc

SEQ ID NO: 3943303 - RNA, 18 nt, Human adenovirus F
acaucaauuuugcgucgc

SEQ ID NO: 3943304 - RNA, 22 nt, Human adenovirus F
acaugggggcggaccugcaaug

SEQ ID NO: 3943305 - RNA, 17 nt, Human adenovirus F
acauguuugucuuuaaa

SEQ ID NO: 3943306 - RNA, 15 nt, Human adenovirus F
accaaacagguauaa

SEQ ID NO: 3943307 - RNA, 18 nt, Human adenovirus F
accaaagagcuugaacau

SEQ ID NO: 3943308 - RNA, 12 nt, Human adenovirus F
accaaagguggu

SEQ ID NO: 3943309 - RNA, 22 nt, Human adenovirus F
accaacgaggccuuucacccag

SEQ ID NO: 3943310 - RNA, 15 nt, Human adenovirus F
accacccccaacucu

SEQ ID NO: 3943311 - RNA, 18 nt, Human adenovirus F
accaccccuagucccucc

SEQ ID NO: 3943312 - RNA, 19 nt, Human adenovirus F
accaccccuagucccuccu

SEQ ID NO: 3943313 - RNA, 14 nt, Human adenovirus F
accacccuagcauu

SEQ ID NO: 3943314 - RNA, 15 nt, Human adenovirus F
accaccgcaaacaac

SEQ ID NO: 3943315 - RNA, 13 nt, Human adenovirus F
accaggccuugca

SEQ ID NO: 3943316 - RNA, 16 nt, Human adenovirus F
accaguccgggccaga

SEQ ID NO: 3943317 - RNA, 12 nt, Human adenovirus F
accagugggcuc

SEQ ID NO: 3943318 - RNA, 22 nt, Human adenovirus F
accccacgccaagccugaagcc

SEQ ID NO: 3943319 - RNA, 15 nt, Human adenovirus F
accccgucacucucc

SEQ ID NO: 3943320 - RNA, 17 nt, Human adenovirus F
accccuaugacaccucc

SEQ ID NO: 3943321 - RNA, 14 nt, Human adenovirus F
accccuuugugccc

SEQ ID NO: 3943322 - RNA, 13 nt, Human adenovirus F
acccucaaacacu

SEQ ID NO: 3943323 - RNA, 18 nt, Human adenovirus F
acccucaaacacugcgca

SEQ ID NO: 3943324 - RNA, 19 nt, Human adenovirus F
acccuccaguuuguggagg

SEQ ID NO: 3943325 - RNA, 14 nt, Human adenovirus F
accgccaaaaaagc

SEQ ID NO: 3943326 - RNA, 19 nt, Human adenovirus F
accgccaaaaaagcagccu

SEQ ID NO: 3943327 - RNA, 13 nt, Human adenovirus F
accgccaauuuuu

SEQ ID NO: 3943328 - RNA, 19 nt, Human adenovirus F
accgccuuggccagcagcc

SEQ ID NO: 3943329 - RNA, 23 nt, Human adenovirus F
accgcggcuugucgcagaaucuc

SEQ ID NO: 3943330 - RNA, 23 nt, Human adenovirus F
accgcuaauuuuucaccaaaggu

SEQ ID NO: 3943331 - RNA, 12 nt, Human adenovirus F
accucccaaagu

SEQ ID NO: 3943332 - RNA, 18 nt, Human adenovirus F
accuccgacgcuugcugg

SEQ ID NO: 3943333 - RNA, 12 nt, Human adenovirus F
accucugcgcug

SEQ ID NO: 3943334 - RNA, 17 nt, Human adenovirus F
accucuucuucuuccuc

SEQ ID NO: 3943335 - RNA, 20 nt, Human adenovirus F
accugaaaaccauuuugcgc

SEQ ID NO: 3943336 - RNA, 15 nt, Human adenovirus F
accugaaccacacuu

SEQ ID NO: 3943337 - RNA, 22 nt, Human adenovirus F
accuuaaccacccccaacucug

SEQ ID NO: 3943338 - RNA, 21 nt, Human adenovirus F
accuucaagcccuacaccaau

SEQ ID NO: 3943339 - RNA, 22 nt, Human adenovirus F
acgaagcuagcauaaaagaagc

SEQ ID NO: 3943340 - RNA, 17 nt, Human adenovirus F
acgacgagcuugcucgc

SEQ ID NO: 3943341 - RNA, 20 nt, Human adenovirus F
acgagaucggcaccagccag

SEQ ID NO: 3943342 - RNA, 15 nt, Human adenovirus F
acgagcuugcucgcu

SEQ ID NO: 3943343 - RNA, 21 nt, Human adenovirus F
acgccaagccugaagcccgca

SEQ ID NO: 3943344 - RNA, 16 nt, Human adenovirus F
acgccacuuuuuauga

SEQ ID NO: 3943345 - RNA, 20 nt, Human adenovirus F
acgccuuacauguggagcua

SEQ ID NO: 3943346 - RNA, 16 nt, Human adenovirus F
acgcuguaccaggagg

SEQ ID NO: 3943347 - RNA, 14 nt, Human adenovirus F
acggaaacaaaaaa

SEQ ID NO: 3943348 - RNA, 17 nt, Human adenovirus F
acggaaggaaacgcugu

SEQ ID NO: 3943349 - RNA, 21 nt, Human adenovirus F
acggaagggcggaacagcaua

SEQ ID NO: 3943350 - RNA, 17 nt, Human adenovirus F
acggcaaggaaccagug

SEQ ID NO: 3943351 - RNA, 19 nt, Human adenovirus F
acggccguaccaagccuga

SEQ ID NO: 3943352 - RNA, 16 nt, Human adenovirus F
acggcgcagcagaucc

SEQ ID NO: 3943353 - RNA, 16 nt, Human adenovirus F
acggcguucuagccaa

SEQ ID NO: 3943354 - RNA, 15 nt, Human adenovirus F
acgggagggacaagc

SEQ ID NO: 3943355 - RNA, 15 nt, Human adenovirus F
acggguucucgccuc

SEQ ID NO: 3943356 - RNA, 23 nt, Human adenovirus F
acgguugcccgccagcuggcaaa

SEQ ID NO: 3943357 - RNA, 15 nt, Human adenovirus F
acguaaccuuguauu

SEQ ID NO: 3943358 - RNA, 21 nt, Human adenovirus F
acguaccaaccggagccucaa

SEQ ID NO: 3943359 - RNA, 24 nt, Human adenovirus F
acguaccagaaagcuacaaggaca

SEQ ID NO: 3943360 - RNA, 19 nt, Human adenovirus F
acgugagagaggcgguggc

SEQ ID NO: 3943361 - RNA, 23 nt, Human adenovirus F
acgugagagaggcgguggcgcag

SEQ ID NO: 3943362 - RNA, 19 nt, Human adenovirus F
acguggucauugggcuugu

SEQ ID NO: 3943363 - RNA, 17 nt, Human adenovirus F
acguuugacaaacgcuu

SEQ ID NO: 3943364 - RNA, 20 nt, Human adenovirus F
acuaaacauugauaaaaaug

SEQ ID NO: 3943365 - RNA, 12 nt, Human adenovirus F
acuagcgccccu

SEQ ID NO: 3943366 - RNA, 22 nt, Human adenovirus F
acucauuuuuucaagaaauugu

SEQ ID NO: 3943367 - RNA, 21 nt, Human adenovirus F
acuccucugugagcuggccug

SEQ ID NO: 3943368 - RNA, 23 nt, Human adenovirus F
acuccuuggguuuagccacaucc

SEQ ID NO: 3943369 - RNA, 18 nt, Human adenovirus F
acuccuuuggacaagcuc

SEQ ID NO: 3943370 - RNA, 21 nt, Human adenovirus F
acucgcagcguugcacgcucu

SEQ ID NO: 3943371 - RNA, 15 nt, Human adenovirus F
acucuuacaaaauaa

SEQ ID NO: 3943372 - RNA, 13 nt, Human adenovirus F
acucuugcuggac

SEQ ID NO: 3943373 - RNA, 14 nt, Human adenovirus F
acugaaagccagcc

SEQ ID NO: 3943374 - RNA, 13 nt, Human adenovirus F
acugccaccucca

SEQ ID NO: 3943375 - RNA, 19 nt, Human adenovirus F
acugcgucgucggcucugg

SEQ ID NO: 3943376 - RNA, 22 nt, Human adenovirus F
acugcuaaagggaacugccagu

SEQ ID NO: 3943377 - RNA, 17 nt, Human adenovirus F
acugcuaccuccuccgu

SEQ ID NO: 3943378 - RNA, 18 nt, Human adenovirus F
acugcuagaaugucacug

SEQ ID NO: 3943379 - RNA, 13 nt, Human adenovirus F
acuggccgcgucu

SEQ ID NO: 3943380 - RNA, 17 nt, Human adenovirus F
acuggcuggcccuggcc

SEQ ID NO: 3943381 - RNA, 19 nt, Human adenovirus F
acuggcuggcccuggccug

SEQ ID NO: 3943382 - RNA, 20 nt, Human adenovirus F
acuggcuggcccuggccugg

SEQ ID NO: 3943383 - RNA, 17 nt, Human adenovirus F
acugucaggcucugaga

SEQ ID NO: 3943384 - RNA, 17 nt, Human adenovirus F
acuguugccguggcuac

SEQ ID NO: 3943385 - RNA, 16 nt, Human adenovirus F
acuuaaacccacagcu

SEQ ID NO: 3943386 - RNA, 14 nt, Human adenovirus F
acuucagccugggg

SEQ ID NO: 3943387 - RNA, 15 nt, Human adenovirus F
acuucagccugggga

SEQ ID NO: 3943388 - RNA, 14 nt, Human adenovirus F
acuucuuaauaaag

SEQ ID NO: 3943389 - RNA, 20 nt, Human adenovirus F
acuuuugagguggaccccau

SEQ ID NO: 3943390 - RNA, 12 nt, Human adenovirus F
acuuuuucccca

SEQ ID NO: 3943391 - RNA, 12 nt, Human adenovirus F
agaacaaaacac

SEQ ID NO: 3943392 - RNA, 20 nt, Human adenovirus F
agaaccguaccugcuaccuc

SEQ ID NO: 3943393 - RNA, 23 nt, Human adenovirus F
agaacuuccagcuguuggagaau

SEQ ID NO: 3943394 - RNA, 22 nt, Human adenovirus F
agacauucuugagcaggccgcc

SEQ ID NO: 3943395 - RNA, 13 nt, Human adenovirus F
agaccucaccucg

SEQ ID NO: 3943396 - RNA, 14 nt, Human adenovirus F
agaccuuccaggaa

SEQ ID NO: 3943397 - RNA, 16 nt, Human adenovirus F
agacgacugggcggcg

SEQ ID NO: 3943398 - RNA, 20 nt, Human adenovirus F
agacgcucaccgcccaggga

SEQ ID NO: 3943399 - RNA, 23 nt, Human adenovirus F
agacuccgcugacgguggaggaa

SEQ ID NO: 3943400 - RNA, 19 nt, Human adenovirus F
agacuuugucagccaaagu

SEQ ID NO: 3943401 - RNA, 21 nt, Human adenovirus F
agagcauugugguacaggagc

SEQ ID NO: 3943402 - RNA, 23 nt, Human adenovirus F
agagccgcggucaacagcuggaa

SEQ ID NO: 3943403 - RNA, 15 nt, Human adenovirus F
agagcuaaggaggag

SEQ ID NO: 3943404 - RNA, 23 nt, Human adenovirus F
agaggcguucgacgcgaggauga

SEQ ID NO: 3943405 - RNA, 21 nt, Human adenovirus F
agaguaaaaaaaagggaaguu

SEQ ID NO: 3943406 - RNA, 15 nt, Human adenovirus F
agauccguggagccg

SEQ ID NO: 3943407 - RNA, 12 nt, Human adenovirus F
agaugaggagga

SEQ ID NO: 3943408 - RNA, 14 nt, Human adenovirus F
agaugcccuguccg

SEQ ID NO: 3943409 - RNA, 13 nt, Human adenovirus F
agauuugacgaaa

SEQ ID NO: 3943410 - RNA, 14 nt, Human adenovirus F
agauuuuggacugu

SEQ ID NO: 3943411 - RNA, 23 nt, Human adenovirus F
agcaagcccauucugccaguugg

SEQ ID NO: 3943412 - RNA, 20 nt, Human adenovirus F
agcaccaacgugcaggccaa

SEQ ID NO: 3943413 - RNA, 18 nt, Human adenovirus F
agcagccccaggccaacc

SEQ ID NO: 3943414 - RNA, 15 nt, Human adenovirus F
agcauaauaacucug

SEQ ID NO: 3943415 - RNA, 22 nt, Human adenovirus F
agcauuuauaaucaugcaauag

SEQ ID NO: 3943416 - RNA, 16 nt, Human adenovirus F
agccacauccgcuccu

SEQ ID NO: 3943417 - RNA, 17 nt, Human adenovirus F
agccagccaaugggcuc

SEQ ID NO: 3943418 - RNA, 16 nt, Human adenovirus F
agccauccgcaaggau

SEQ ID NO: 3943419 - RNA, 15 nt, Human adenovirus F
agcccaacaccacca

SEQ ID NO: 3943420 - RNA, 13 nt, Human adenovirus F
agccccaggccaa

SEQ ID NO: 3943421 - RNA, 14 nt, Human adenovirus F
agccccaggccaac

SEQ ID NO: 3943422 - RNA, 22 nt, Human adenovirus F
agccccccucguacgagcaggc

SEQ ID NO: 3943423 - RNA, 16 nt, Human adenovirus F
agcccgcaacggcgca

SEQ ID NO: 3943424 - RNA, 17 nt, Human adenovirus F
agcccgcaacggcgcag

SEQ ID NO: 3943425 - RNA, 14 nt, Human adenovirus F
agcccgggccuggu

SEQ ID NO: 3943426 - RNA, 16 nt, Human adenovirus F
agccgaugcccaacgc

SEQ ID NO: 3943427 - RNA, 14 nt, Human adenovirus F
agccgccagccucc

SEQ ID NO: 3943428 - RNA, 19 nt, Human adenovirus F
agccgcggucaacagcugg

SEQ ID NO: 3943429 - RNA, 22 nt, Human adenovirus F
agccguccacgcucccggaaau

SEQ ID NO: 3943430 - RNA, 15 nt, Human adenovirus F
agccgugaagccaaa

SEQ ID NO: 3943431 - RNA, 20 nt, Human adenovirus F
agccugagcugccagaggcc

SEQ ID NO: 3943432 - RNA, 23 nt, Human adenovirus F
agccuguguuaucacccaaagcc

SEQ ID NO: 3943433 - RNA, 18 nt, Human adenovirus F
agccuuuguuccuuccga

SEQ ID NO: 3943434 - RNA, 17 nt, Human adenovirus F
agcgacaaggcaccauc

SEQ ID NO: 3943435 - RNA, 19 nt, Human adenovirus F
agcgcagucuaagccuggc

SEQ ID NO: 3943436 - RNA, 17 nt, Human adenovirus F
agcgcccgggcccugga

SEQ ID NO: 3943437 - RNA, 23 nt, Human adenovirus F
agcgccgcuugcaagauggccac

SEQ ID NO: 3943438 - RNA, 22 nt, Human adenovirus F
agcgcgcuauaauagcaccaac

SEQ ID NO: 3943439 - RNA, 18 nt, Human adenovirus F
agcgugguaaaagggugc

SEQ ID NO: 3943440 - RNA, 13 nt, Human adenovirus F
agcguguucccaa

SEQ ID NO: 3943441 - RNA, 15 nt, Human adenovirus F
gcucagccccgccgg

SEQ ID NO: 3943442 - RNA, 21 nt, Human adenovirus F
gcucaggaaccaccaccgaaa

SEQ ID NO: 3943443 - RNA, 14 nt, Human adenovirus F
gcucaucugcggcc

SEQ ID NO: 3943444 - RNA, 23 nt, Human adenovirus F
gcuccggguugggcgcuugccag

SEQ ID NO: 3943445 - RNA, 15 nt, Human adenovirus F
gcuccuggguaacgg

SEQ ID NO: 3943446 - RNA, 18 nt, Human adenovirus F
gcuccuuuguacucgagc

SEQ ID NO: 3943447 - RNA, 13 nt, Human adenovirus F
gcucgcuggcuag

SEQ ID NO: 3943448 - RNA, 15 nt, Human adenovirus F
gcucgucguggcaug

SEQ ID NO: 3943449 - RNA, 23 nt, Human adenovirus F
gcucugguagaaagcaaagccau

SEQ ID NO: 3943450 - RNA, 22 nt, Human adenovirus F
gcugacgaagacauucuugagc

SEQ ID NO: 3943451 - RNA, 20 nt, Human adenovirus F
gcugagcguucucgcucgcu

SEQ ID NO: 3943452 - RNA, 16 nt, Human adenovirus F
gcugcagccagacucc

SEQ ID NO: 3943453 - RNA, 14 nt, Human adenovirus F
gcuggaccaaagca

SEQ ID NO: 3943454 - RNA, 17 nt, Human adenovirus F
gcuggggaauggagcug

SEQ ID NO: 3943455 - RNA, 14 nt, Human adenovirus F
gcuguaccaggagg

SEQ ID NO: 3943456 - RNA, 21 nt, Human adenovirus F
gcugucguuaguggaggcagc

SEQ ID NO: 3943457 - RNA, 20 nt, Human adenovirus F
gcugucucaccuacuaccac

SEQ ID NO: 3943458 - RNA, 22 nt, Human adenovirus F
gcuguggugcgguuucaaacau

SEQ ID NO: 3943459 - RNA, 18 nt, Human adenovirus F
gcugugucagcuaacucu

SEQ ID NO: 3943460 - RNA, 18 nt, Human adenovirus F
gcuuacucuuucuuacaa

SEQ ID NO: 3943461 - RNA, 20 nt, Human adenovirus F
gcuuaucccgcgcuaaaucu

SEQ ID NO: 3943462 - RNA, 15 nt, Human adenovirus F
gcuuccggcauuaac

SEQ ID NO: 3943463 - RNA, 14 nt, Human adenovirus F
gcuuggaggagcug

SEQ ID NO: 3943464 - RNA, 13 nt, Human adenovirus F
gcuugggaggauu

SEQ ID NO: 3943465 - RNA, 18 nt, Human adenovirus F
gcuugggggcgccauccc

SEQ ID NO: 3943466 - RNA, 16 nt, Human adenovirus F
gcuuucaguuggagca

SEQ ID NO: 3943467 - RNA, 13 nt, Human adenovirus F
ggaaacugaugcu

SEQ ID NO: 3943468 - RNA, 17 nt, Human adenovirus F
ggaaagacaguggcgcg

SEQ ID NO: 3943469 - RNA, 15 nt, Human adenovirus F
ggaaaucagaugcau

SEQ ID NO: 3943470 - RNA, 19 nt, Human adenovirus F
ggaagccccacggcauggg

SEQ ID NO: 3943471 - RNA, 12 nt, Human adenovirus F
ggaagggaaggc

SEQ ID NO: 3943472 - RNA, 14 nt, Human adenovirus F
ggaauggagcugug

SEQ ID NO: 3943473 - RNA, 20 nt, Human adenovirus F
ggacacggggucuauuugga

SEQ ID NO: 3943474 - RNA, 15 nt, Human adenovirus F
ggacagcaggccgcu

SEQ ID NO: 3943475 - RNA, 21 nt, Human adenovirus F
ggacagccuagacgaggagga

SEQ ID NO: 3943476 - RNA, 22 nt, Human adenovirus F
ggaccccauggaugagcccaca

SEQ ID NO: 3943477 - RNA, 20 nt, Human adenovirus F
ggacccuucaacggaauugu

SEQ ID NO: 3943478 - RNA, 14 nt, Human adenovirus F
ggaccuuggccacc

SEQ ID NO: 3943479 - RNA, 21 nt, Human adenovirus F
ggacgccgaggcacuguucaa

SEQ ID NO: 3943480 - RNA, 23 nt, Human adenovirus F
ggagagcgguccgucacgcgggc

SEQ ID NO: 3943481 - RNA, 14 nt, Human adenovirus F
ggagcagcgggaag

SEQ ID NO: 3943482 - RNA, 18 nt, Human adenovirus F
ggagcucgucguggcaug

SEQ ID NO: 3943483 - RNA, 20 nt, Human adenovirus F
ggaggaaguagguggggccc

SEQ ID NO: 3943484 - RNA, 22 nt, Human adenovirus F
ggaggauuuugaguuagcucug

SEQ ID NO: 3943485 - RNA, 15 nt, Human adenovirus F
ggaggcagcagagga

SEQ ID NO: 3943486 - RNA, 22 nt, Human adenovirus F
ggaggcagugguggaugggggu

SEQ ID NO: 3943487 - RNA, 19 nt, Human adenovirus F
ggaggccauccuggaccug

SEQ ID NO: 3943488 - RNA, 19 nt, Human adenovirus F
ggaggugccccagagugag

SEQ ID NO: 3943489 - RNA, 13 nt, Human adenovirus F
ggagugccgccgg

SEQ ID NO: 3943490 - RNA, 20 nt, Human adenovirus F
ggagugccgccggugauggc

SEQ ID NO: 3943491 - RNA, 21 nt, Human adenovirus F
ggaguucuccguguccugcgc

SEQ ID NO: 3943492 - RNA, 17 nt, Human adenovirus F
ggaguuggaggagaugg

SEQ ID NO: 3943493 - RNA, 18 nt, Human adenovirus F
ggaguuggcuucugccag

SEQ ID NO: 3943494 - RNA, 21 nt, Human adenovirus F
ggaucccucagagcugcaaga

SEQ ID NO: 3943495 - RNA, 15 nt, Human adenovirus F
ggcaacguucagcca

SEQ ID NO: 3943496 - RNA, 20 nt, Human adenovirus F
ggcacaguaaucaaggguuu

SEQ ID NO: 3943497 - RNA, 13 nt, Human adenovirus F
ggcaccagccagc

SEQ ID NO: 3943498 - RNA, 14 nt, Human adenovirus F
ggcaccagccagcu

SEQ ID NO: 3943499 - RNA, 20 nt, Human adenovirus F
ggcacuugaacauucuugcg

SEQ ID NO: 3943500 - RNA, 13 nt, Human adenovirus F
ggcagcagggugc

SEQ ID NO: 3943501 - RNA, 16 nt, Human adenovirus F
ggcagcgacagggcgc

SEQ ID NO: 3943502 - RNA, 22 nt, Human adenovirus F
ggcaggcuuccuuaacaagggc

SEQ ID NO: 3943503 - RNA, 13 nt, Human adenovirus F
ggcauguuuucuc

SEQ ID NO: 3943504 - RNA, 15 nt, Human adenovirus F
ggccauccuggaccu

SEQ ID NO: 3943505 - RNA, 13 nt, Human adenovirus F
ggcccuagaccac

SEQ ID NO: 3943506 - RNA, 14 nt, Human adenovirus F
ggcccugcaaagcc

SEQ ID NO: 3943507 - RNA, 21 nt, Human adenovirus F
ggccgcggcggcuauugccag

SEQ ID NO: 3943508 - RNA, 17 nt, Human adenovirus F
ggccguaccaagccuga

SEQ ID NO: 3943509 - RNA, 17 nt, Human adenovirus F
ggccguuuaugggcacc

SEQ ID NO: 3943510 - RNA, 22 nt, Human adenovirus F
ggccuacggaagggcggaacag

SEQ ID NO: 3943511 - RNA, 13 nt, Human adenovirus F
ggccugguaacga

SEQ ID NO: 3943512 - RNA, 18 nt, Human adenovirus F
ggccuguuuuugagcaca

SEQ ID NO: 3943513 - RNA, 23 nt, Human adenovirus F
ggcgacgacggauuuuuguggga

SEQ ID NO: 3943514 - RNA, 18 nt, Human adenovirus F
ggcgaggggcuggcccgc

SEQ ID NO: 3943515 - RNA, 14 nt, Human adenovirus F
ggcgcaaucuucgc

SEQ ID NO: 3943516 - RNA, 21 nt, Human adenovirus F
ggcgcagcguccgcacgguuu

SEQ ID NO: 3943517 - RNA, 21 nt, Human adenovirus F
ggcgcuuucaguuggagcagc

SEQ ID NO: 3943518 - RNA, 14 nt, Human adenovirus F
ggcggaggagcaga

SEQ ID NO: 3943519 - RNA, 16 nt, Human adenovirus F
ggcggcaacauuccug

SEQ ID NO: 3943520 - RNA, 18 nt, Human adenovirus F
ggcggcccugcaaagcca

SEQ ID NO: 3943521 - RNA, 19 nt, Human adenovirus F
ggcggcgaccugaaaacca

SEQ ID NO: 3943522 - RNA, 22 nt, Human adenovirus F
ggcggggacguaaaguccagcg

SEQ ID NO: 3943523 - RNA, 18 nt, Human adenovirus F
ggcucaauguaacaugac

SEQ ID NO: 3943524 - RNA, 17 nt, Human adenovirus F
ggcucagccccgccggg

SEQ ID NO: 3943525 - RNA, 22 nt, Human adenovirus F
ggcuccgacgcuuggcaccgcc

SEQ ID NO: 3943526 - RNA, 23 nt, Human adenovirus F
ggcuccgacgcuuggcaccgccg

SEQ ID NO: 3943527 - RNA, 21 nt, Human adenovirus F
ggcucugcagcagcgcccgcc

SEQ ID NO: 3943528 - RNA, 20 nt, Human adenovirus F
ggcuugugcggcuuuucgca

SEQ ID NO: 3943529 - RNA, 21 nt, Human adenovirus F
gggaacugccaguguaaagca

SEQ ID NO: 3943530 - RNA, 12 nt, Human adenovirus F
gggaggcagcag

SEQ ID NO: 3943531 - RNA, 17 nt, Human adenovirus F
gggaguaaaaagccuga

SEQ ID NO: 3943532 - RNA, 21 nt, Human adenovirus F
gggauaagcuaaaggaccaaa

SEQ ID NO: 3943533 - RNA, 15 nt, Human adenovirus F
gggcaaaaugggcuu

SEQ ID NO: 3943534 - RNA, 19 nt, Human adenovirus F
gggcaagcuucucagcuca

SEQ ID NO: 3943535 - RNA, 20 nt, Human adenovirus F
gggcaucgucauucuucagu

SEQ ID NO: 3943536 - RNA, 23 nt, Human adenovirus F
gggccccugaggcagcgacaggg

SEQ ID NO: 3943537 - RNA, 12 nt, Human adenovirus F
gggcggaccugc

SEQ ID NO: 3943538 - RNA, 13 nt, Human adenovirus F
gggcggcggccau

SEQ ID NO: 3943539 - RNA, 20 nt, Human adenovirus F
ggggcccugaccgaccuggg

SEQ ID NO: 3943540 - RNA, 19 nt, Human adenovirus F
ggggcguguccgggcucuu

SEQ ID NO: 3943541 - RNA, 14 nt, Human adenovirus F
gggguggaaagccu

SEQ ID NO: 3943542 - RNA, 22 nt, Human adenovirus F
ggguagaguaaaaaaaagggaa

SEQ ID NO: 3943543 - RNA, 18 nt, Human adenovirus F
gggugucugccagagggu

SEQ ID NO: 3943544 - RNA, 17 nt, Human adenovirus F
ggguuucacgcaccagg

SEQ ID NO: 3943545 - RNA, 16 nt, Human adenovirus F
gguaggaacuugaagc

SEQ ID NO: 3943546 - RNA, 17 nt, Human adenovirus F
gguagggugucugccag

SEQ ID NO: 3943547 - RNA, 19 nt, Human adenovirus F
gguauaggcuugugcggcu

SEQ ID NO: 3943548 - RNA, 14 nt, Human adenovirus F
ggucaacagcugga

SEQ ID NO: 3943549 - RNA, 20 nt, Human adenovirus F
ggucaaucucuucguccugg

SEQ ID NO: 3943550 - RNA, 21 nt, Human adenovirus F
ggucagcaagacaccaguagc

SEQ ID NO: 3943551 - RNA, 14 nt, Human adenovirus F
ggucggcacgcucc

SEQ ID NO: 3943552 - RNA, 17 nt, Human adenovirus F
ggucuuagguugcuugc

SEQ ID NO: 3943553 - RNA, 17 nt, Human adenovirus F
ggugacccuaacauggc

SEQ ID NO: 3943554 - RNA, 19 nt, Human adenovirus F
ggugcagccgugaagccaa

SEQ ID NO: 3943555 - RNA, 16 nt, Human adenovirus F
ggugcaguggcgggga

SEQ ID NO: 3943556 - RNA, 19 nt, Human adenovirus F
ggugccugaagcacuggcu

SEQ ID NO: 3943557 - RNA, 16 nt, Human adenovirus F
ggugccuucaccuggg

SEQ ID NO: 3943558 - RNA, 14 nt, Human adenovirus F
ggugcgguuucaaa

SEQ ID NO: 3943559 - RNA, 23 nt, Human adenovirus F
agccccuacgaaacguuuggaga

SEQ ID NO: 3943560 - RNA, 13 nt, Human adenovirus F
agccgccagccuc

SEQ ID NO: 3943561 - RNA, 9 nt, Human adenovirus F
agccgccgc

SEQ ID NO: 3943562 - RNA, 14 nt, Human adenovirus F
agccuucaggcagc

SEQ ID NO: 3943563 - RNA, 19 nt, Human adenovirus F
agccuucaggcagcagccc

SEQ ID NO: 3943564 - RNA, 15 nt, Human adenovirus F
agcgcccgggcccug

SEQ ID NO: 3943565 - RNA, 19 nt, Human adenovirus F
agcgcgacagagcaccauu

SEQ ID NO: 3943566 - RNA, 17 nt, Human adenovirus F
agcgcugccuuugcaau

SEQ ID NO: 3943567 - RNA, 12 nt, Human adenovirus F
agcggcuggaaa

SEQ ID NO: 3943568 - RNA, 14 nt, Human adenovirus F
agcgggcaggagcc

SEQ ID NO: 3943569 - RNA, 23 nt, Human adenovirus F
agcgucuuacauaucgcuugcca

SEQ ID NO: 3943570 - RNA, 19 nt, Human adenovirus F
agcuacguugcgauacugc

SEQ ID NO: 3943571 - RNA, 20 nt, Human adenovirus F
agcuagugaaacaugaggag

SEQ ID NO: 3943572 - RNA, 21 nt, Human adenovirus F
agcucuaaauaugucacagcc

SEQ ID NO: 3943573 - RNA, 13 nt, Human adenovirus F
agcucugaacacu

SEQ ID NO: 3943574 - RNA, 20 nt, Human adenovirus F
agcugcugccgcgucugcug

SEQ ID NO: 3943575 - RNA, 13 nt, Human adenovirus F
agcuggagggcaa

SEQ ID NO: 3943576 - RNA, 22 nt, Human adenovirus F
agcugugagcgccagccgccgu

SEQ ID NO: 3943577 - RNA, 21 nt, Human adenovirus F
agcugugguuaaauuuaaugg

SEQ ID NO: 3943578 - RNA, 20 nt, Human adenovirus F
agcugugucagcuaacucuc

SEQ ID NO: 3943579 - RNA, 16 nt, Human adenovirus F
agcuucuaucugcaaa

SEQ ID NO: 3943580 - RNA, 13 nt, Human adenovirus F
agcuugaggaggu

SEQ ID NO: 3943581 - RNA, 14 nt, Human adenovirus F
agcuuggaagccac

SEQ ID NO: 3943582 - RNA, 13 nt, Human adenovirus F
agcuuuaaacccu

SEQ ID NO: 3943583 - RNA, 23 nt, Human adenovirus F
agcuuuuacugggacagcaggcc

SEQ ID NO: 3943584 - RNA, 12 nt, Human adenovirus F
aggaagcagcuc

SEQ ID NO: 3943585 - RNA, 16 nt, Human adenovirus F
aggaaugcacacagac

SEQ ID NO: 3943586 - RNA, 9 nt, Human adenovirus F
aggacacgg

SEQ ID NO: 3943587 - RNA, 22 nt, Human adenovirus F
aggacagucugccaacacuaac

SEQ ID NO: 3943588 - RNA, 19 nt, Human adenovirus F
aggacgguggcaugaggga

SEQ ID NO: 3943589 - RNA, 18 nt, Human adenovirus F
aggagaggcauggcgggc

SEQ ID NO: 3943590 - RNA, 20 nt, Human adenovirus F
aggagcugucucagcaguug

SEQ ID NO: 3943591 - RNA, 16 nt, Human adenovirus F
aggaggccauccugga

SEQ ID NO: 3943592 - RNA, 17 nt, Human adenovirus F
aggaggcuauuggccag

SEQ ID NO: 3943593 - RNA, 18 nt, Human adenovirus F
aggaggcuauuggccaga

SEQ ID NO: 3943594 - RNA, 22 nt, Human adenovirus F
aggauccauagagggcguugga

SEQ ID NO: 3943595 - RNA, 20 nt, Human adenovirus F
aggcagcuucucgaggccaa

SEQ ID NO: 3943596 - RNA, 20 nt, Human adenovirus F
aggcauaaaguugcggguga

SEQ ID NO: 3943597 - RNA, 17 nt, Human adenovirus F
aggcccuugugccugaa

SEQ ID NO: 3943598 - RNA, 19 nt, Human adenovirus F
aggcccuugugccugaaau

SEQ ID NO: 3943599 - RNA, 19 nt, Human adenovirus F
aggccgcccuaaccucuac

SEQ ID NO: 3943600 - RNA, 14 nt, Human adenovirus F
aggccgcggcggcu

SEQ ID NO: 3943601 - RNA, 14 nt, Human adenovirus F
aggcgagcucaggg

SEQ ID NO: 3943602 - RNA, 19 nt, Human adenovirus F
aggcuuuccgcgaggccau

SEQ ID NO: 3943603 - RNA, 20 nt, Human adenovirus F
agggauacuagcaaacagug

SEQ ID NO: 3943604 - RNA, 16 nt, Human adenovirus F
agggaucgcagcgggc

SEQ ID NO: 3943605 - RNA, 21 nt, Human adenovirus F
agggcgcgcucguagggauug

SEQ ID NO: 3943606 - RNA, 19 nt, Human adenovirus F
agggcggaacagcauacgu

SEQ ID NO: 3943607 - RNA, 22 nt, Human adenovirus F
aggggaaaucagaugcauuuug

SEQ ID NO: 3943608 - RNA, 13 nt, Human adenovirus F
aggggcggagccu

SEQ ID NO: 3943609 - RNA, 19 nt, Human adenovirus F
agggugugaaggcaaaggu

SEQ ID NO: 3943610 - RNA, 14 nt, Human adenovirus F
aggguuucggcagc

SEQ ID NO: 3943611 - RNA, 22 nt, Human adenovirus F
agguaaucaggagaaaaaagac

SEQ ID NO: 3943612 - RNA, 20 nt, Human adenovirus F
agguagccccuuggugaagg

SEQ ID NO: 3943613 - RNA, 13 nt, Human adenovirus F
aggucaaaugcuc

SEQ ID NO: 3943614 - RNA, 22 nt, Human adenovirus F
aggucguaaugaggacauugcu

SEQ ID NO: 3943615 - RNA, 13 nt, Human adenovirus F
agguggggcggcg

SEQ ID NO: 3943616 - RNA, 12 nt, Human adenovirus F
agguuuccaaau

SEQ ID NO: 3943617 - RNA, 17 nt, Human adenovirus F
aguaaaaaaaagggaag

SEQ ID NO: 3943618 - RNA, 15 nt, Human adenovirus F
aguaaucccugucuc

SEQ ID NO: 3943619 - RNA, 21 nt, Human adenovirus F
aguacucuucgcgguuugcug

SEQ ID NO: 3943620 - RNA, 19 nt, Human adenovirus F
aguaucagaauguaacucu

SEQ ID NO: 3943621 - RNA, 18 nt, Human adenovirus F
aguauuacaaaugccucc

SEQ ID NO: 3943622 - RNA, 20 nt, Human adenovirus F
aguccaaagcagagcucugc

SEQ ID NO: 3943623 - RNA, 23 nt, Human adenovirus F
aguccaaagcagagcucugcaaa

SEQ ID NO: 3943624 - RNA, 14 nt, Human adenovirus F
aguccuucugccac

SEQ ID NO: 3943625 - RNA, 21 nt, Human adenovirus F
agucgcaagguaagcuaagga

SEQ ID NO: 3943626 - RNA, 15 nt, Human adenovirus F
agucggcaggcuucc

SEQ ID NO: 3943627 - RNA, 21 nt, Human adenovirus F
agucggccaaguagcauuuua

SEQ ID NO: 3943628 - RNA, 15 nt, Human adenovirus F
agucgucgcaggcgc

SEQ ID NO: 3943629 - RNA, 23 nt, Human adenovirus F
agugaugguggggaguucuugcu

SEQ ID NO: 3943630 - RNA, 17 nt, Human adenovirus F
agugcacugagcagcuu

SEQ ID NO: 3943631 - RNA, 13 nt, Human adenovirus F
agugcaggaagag

SEQ ID NO: 3943632 - RNA, 23 nt, Human adenovirus F
aguggagggauuuaauggcacag

SEQ ID NO: 3943633 - RNA, 15 nt, Human adenovirus F
aguguaccaauccug

SEQ ID NO: 3943634 - RNA, 20 nt, Human adenovirus F
aguucacuuugccagagggc

SEQ ID NO: 3943635 - RNA, 20 nt, Human adenovirus F
aguucuacgugucuugcaaa

SEQ ID NO: 3943636 - RNA, 16 nt, Human adenovirus F
aguucuugcugacggc

SEQ ID NO: 3943637 - RNA, 17 nt, Human adenovirus F
aguuggagcagccugug

SEQ ID NO: 3943638 - RNA, 21 nt, Human adenovirus F
aguugugcuuugcccuccgau

SEQ ID NO: 3943639 - RNA, 16 nt, Human adenovirus F
aguuuaaaaacgguga

SEQ ID NO: 3943640 - RNA, 17 nt, Human adenovirus F
aguuugguagcaaagga

SEQ ID NO: 3943641 - RNA, 15 nt, Human adenovirus F
aguuuuaagguauau

SEQ ID NO: 3943642 - RNA, 12 nt, Human adenovirus F
auaaacuccucu

SEQ ID NO: 3943643 - RNA, 21 nt, Human adenovirus F
auaagcuaaaggaccaaaacu

SEQ ID NO: 3943644 - RNA, 23 nt, Human adenovirus F
auaauuuccgcuaguuuaauauu

SEQ ID NO: 3943645 - RNA, 11 nt, Human adenovirus F
auagccaacca

SEQ ID NO: 3943646 - RNA, 19 nt, Human adenovirus F
auauaaaaacaaccaacuu

SEQ ID NO: 3943647 - RNA, 12 nt, Human adenovirus F
auauccaaaucc

SEQ ID NO: 3943648 - RNA, 17 nt, Human adenovirus F
auaugaugaaaguagaa

SEQ ID NO: 3943649 - RNA, 22 nt, Human adenovirus F
auauuuauacacucccuuugcc

SEQ ID NO: 3943650 - RNA, 22 nt, Human adenovirus F
auauuucaccuacucuggcucc

SEQ ID NO: 3943651 - RNA, 13 nt, Human adenovirus F
aucacccaaagcc

SEQ ID NO: 3943652 - RNA, 16 nt, Human adenovirus F
aucaguuguuugucaa

SEQ ID NO: 3943653 - RNA, 15 nt, Human adenovirus F
aucauauuagguuau

SEQ ID NO: 3943654 - RNA, 20 nt, Human adenovirus F
aucauuuccacaaaugucuu

SEQ ID NO: 3943655 - RNA, 22 nt, Human adenovirus F
auccaaaucucgccuaacauca

SEQ ID NO: 3943656 - RNA, 21 nt, Human adenovirus F
auccauuaaaauuucuuguaa

SEQ ID NO: 3943657 - RNA, 12 nt, Human adenovirus F
aucccagccucg

SEQ ID NO: 3943658 - RNA, 17 nt, Human adenovirus F
aucccaugaccaaaccu

SEQ ID NO: 3943659 - RNA, 21 nt, Human adenovirus F
auccccuauugcgaccggccc

SEQ ID NO: 3943660 - RNA, 17 nt, Human adenovirus F
auccuccuucacaaagu

SEQ ID NO: 3943661 - RNA, 20 nt, Human adenovirus F
aucgccgggcaggacgccuc

SEQ ID NO: 3943662 - RNA, 15 nt, Human adenovirus F
aucucugugcgucgc

SEQ ID NO: 3943663 - RNA, 17 nt, Human adenovirus F
aucuuaagcugcagcca

SEQ ID NO: 3943664 - RNA, 12 nt, Human adenovirus F
aucuucaaacau

SEQ ID NO: 3943665 - RNA, 21 nt, Human adenovirus F
aucuugcaaaacuuucgcucc

SEQ ID NO: 3943666 - RNA, 16 nt, Human adenovirus F
aucuugguccagguuu

SEQ ID NO: 3943667 - RNA, 14 nt, Human adenovirus F
augagcugggagaa

SEQ ID NO: 3943668 - RNA, 20 nt, Human adenovirus F
augagcuuacuuuaaaacuu

SEQ ID NO: 3943669 - RNA, 18 nt, Human adenovirus F
augauuuguggcgguggu

SEQ ID NO: 3943670 - RNA, 20 nt, Human adenovirus F
augcacagccugcgucgggc

SEQ ID NO: 3943671 - RNA, 17 nt, Human adenovirus F
augcacaucgccgggca

SEQ ID NO: 3943672 - RNA, 14 nt, Human adenovirus F
augcagacaagaca

SEQ ID NO: 3943673 - RNA, 21 nt, Human adenovirus F
augccacccaagggaaacaag

SEQ ID NO: 3943674 - RNA, 11 nt, Human adenovirus F
augcccacacc

SEQ ID NO: 3943675 - RNA, 22 nt, Human adenovirus F
augccuaccucugacaaacacg

SEQ ID NO: 3943676 - RNA, 16 nt, Human adenovirus F
augccuccagcacugc

SEQ ID NO: 3943677 - RNA, 16 nt, Human adenovirus F
augcgccgagcggcug

SEQ ID NO: 3943678 - RNA, 20 nt, Human adenovirus F
augcuuuuacguuuaaaugg

SEQ ID NO: 3943679 - RNA, 12 nt, Human adenovirus F
auggaguugugg

SEQ ID NO: 3943680 - RNA, 18 nt, Human adenovirus F
auggcaccgcauaagcug

SEQ ID NO: 3943681 - RNA, 20 nt, Human adenovirus F
augggagugcuggccgggca

SEQ ID NO: 3943682 - RNA, 17 nt, Human adenovirus F
augggccuggcagcugg

SEQ ID NO: 3943683 - RNA, 12 nt, Human adenovirus F
auggggaaggau

SEQ ID NO: 3943684 - RNA, 17 nt, Human adenovirus F
augggggcggaccugca

SEQ ID NO: 3943685 - RNA, 23 nt, Human adenovirus F
augguaaaaaugccaggcagcag

SEQ ID NO: 3943686 - RNA, 19 nt, Human adenovirus F
augguaacuccucuucucc

SEQ ID NO: 3943687 - RNA, 16 nt, Human adenovirus F
augguggcaaggagag

SEQ ID NO: 3943688 - RNA, 19 nt, Human adenovirus F
auguaaaguucuaaaaagc

SEQ ID NO: 3943689 - RNA, 21 nt, Human adenovirus F
auguccccauaaacguucaaa

SEQ ID NO: 3943690 - RNA, 15 nt, Human adenovirus F
augugccgcgcgggc

SEQ ID NO: 3943691 - RNA, 15 nt, Human adenovirus F
augugcuggggaaug

SEQ ID NO: 3943692 - RNA, 20 nt, Human adenovirus F
auguggaaccaggcagugga

SEQ ID NO: 3943693 - RNA, 22 nt, Human adenovirus F
auguucgacuccucugugagcu

SEQ ID NO: 3943694 - RNA, 19 nt, Human adenovirus F
auuaaacgucaaugccaau

SEQ ID NO: 3943695 - RNA, 20 nt, Human adenovirus F
auuacauugguuuuagggac

SEQ ID NO: 3943696 - RNA, 12 nt, Human adenovirus F
auuacugccagu

SEQ ID NO: 3943697 - RNA, 17 nt, Human adenovirus F
auuaggaagggcaaagg

SEQ ID NO: 3943698 - RNA, 18 nt, Human adenovirus F
auuaguuguacaaaguca

SEQ ID NO: 3943699 - RNA, 19 nt, Human adenovirus F
auucccaaauaauuuuccg

SEQ ID NO: 3943700 - RNA, 13 nt, Human adenovirus F
auucuccaaagca

SEQ ID NO: 3943701 - RNA, 13 nt, Human adenovirus F
auucucucuccuu

SEQ ID NO: 3943702 - RNA, 13 nt, Human adenovirus F
auugagugggaag

SEQ ID NO: 3943703 - RNA, 22 nt, Human adenovirus F
auugcagcgguaucugcgugga

SEQ ID NO: 3943704 - RNA, 19 nt, Human adenovirus F
auugccucguagaagucaa

SEQ ID NO: 3943705 - RNA, 19 nt, Human adenovirus F
auuuccauaaacuccucuu

SEQ ID NO: 3943706 - RNA, 22 nt, Human adenovirus F
auuucuuguaaacuggcgccau

SEQ ID NO: 3943707 - RNA, 14 nt, Human adenovirus F
auuuuaaaaugguu

SEQ ID NO: 3943708 - RNA, 11 nt, Human adenovirus F
auuuucugcca

SEQ ID NO: 3943709 - RNA, 17 nt, Human adenovirus F
caaaaaaagaauuacuu

SEQ ID NO: 3943710 - RNA, 17 nt, Human adenovirus F
caaaaaaaucaaggcca

SEQ ID NO: 3943711 - RNA, 15 nt, Human adenovirus F
caaaacaaacuccuu

SEQ ID NO: 3943712 - RNA, 12 nt, Human adenovirus F
caaaacacuaaa

SEQ ID NO: 3943713 - RNA, 23 nt, Human adenovirus F
caaaacuuucgcuccuuuguacu

SEQ ID NO: 3943714 - RNA, 12 nt, Human adenovirus F
caaaaugagugg

SEQ ID NO: 3943715 - RNA, 22 nt, Human adenovirus F
caaaaugugcagcaaaaacucc

SEQ ID NO: 3943716 - RNA, 13 nt, Human adenovirus F
caaacaacaaaau

SEQ ID NO: 3943717 - RNA, 13 nt, Human adenovirus F
caaacacaaacac

SEQ ID NO: 3943718 - RNA, 16 nt, Human adenovirus F
caaacgcaccauugaa

SEQ ID NO: 3943719 - RNA, 20 nt, Human adenovirus F
caaacggcguucuagccaac

SEQ ID NO: 3943720 - RNA, 15 nt, Human adenovirus F
caaagacaaaaucac

SEQ ID NO: 3943721 - RNA, 17 nt, Human adenovirus F
caaagcggcaaaagcuu

SEQ ID NO: 3943722 - RNA, 18 nt, Human adenovirus F
caaagcugugagcgccag

SEQ ID NO: 3943723 - RNA, 13 nt, Human adenovirus F
caaaguaaaaaac

SEQ ID NO: 3943724 - RNA, 15 nt, Human adenovirus F
caaaucgacgguuuc

SEQ ID NO: 3943725 - RNA, 22 nt, Human adenovirus F
caacagggacacgagcugucau

SEQ ID NO: 3943726 - RNA, 19 nt, Human adenovirus F
caacaugggagugcuggcc

SEQ ID NO: 3943727 - RNA, 23 nt, Human adenovirus F
caaccagcgcucuacaauauaau

SEQ ID NO: 3943728 - RNA, 13 nt, Human adenovirus F
caaccaggccuug

SEQ ID NO: 3943729 - RNA, 22 nt, Human adenovirus F
caaccccacgccaagccugaag

SEQ ID NO: 3943730 - RNA, 19 nt, Human adenovirus F
caaccuucaaacccagccg

SEQ ID NO: 3943731 - RNA, 14 nt, Human adenovirus F
caacgcugcaggcg

SEQ ID NO: 3943732 - RNA, 17 nt, Human adenovirus F
caacggcaaucccagca

SEQ ID NO: 3943733 - RNA, 13 nt, Human adenovirus F
caacgugcaggcc

SEQ ID NO: 3943734 - RNA, 20 nt, Human adenovirus F
caacucgacaacccuuaccu

SEQ ID NO: 3943735 - RNA, 21 nt, Human adenovirus F
caacucguucaguggcgcgcu

SEQ ID NO: 3943736 - RNA, 23 nt, Human adenovirus F
caagaucuccaacguagagcuca

SEQ ID NO: 3943737 - RNA, 20 nt, Human adenovirus F
caagcaaagacagagcuuua

SEQ ID NO: 3943738 - RNA, 21 nt, Human adenovirus F
caagcaaagacagagcuuuau

SEQ ID NO: 3943739 - RNA, 14 nt, Human adenovirus F
caagcuaaaugcca

SEQ ID NO: 3943740 - RNA, 17 nt, Human adenovirus F
caaggaaugcacacaga

SEQ ID NO: 3943741 - RNA, 20 nt, Human adenovirus F
caaggaaugcacacagacuc

SEQ ID NO: 3943742 - RNA, 13 nt, Human adenovirus F
caaggccuggaac

SEQ ID NO: 3943743 - RNA, 20 nt, Human adenovirus F
caagggaaacaagcauccca

SEQ ID NO: 3943744 - RNA, 12 nt, Human adenovirus F
caagggcuuccu

SEQ ID NO: 3943745 - RNA, 15 nt, Human adenovirus F
caagguggcggccau

SEQ ID NO: 3943746 - RNA, 21 nt, Human adenovirus F
caaguucaaagaagagcugcu

SEQ ID NO: 3943747 - RNA, 23 nt, Human adenovirus F
caaguuucgggcgcgggugaugg

SEQ ID NO: 3943748 - RNA, 17 nt, Human adenovirus F
caaguuuuuccagcagc

SEQ ID NO: 3943749 - RNA, 19 nt, Human adenovirus F
caauaagcagcuugaagaa

SEQ ID NO: 3943750 - RNA, 15 nt, Human adenovirus F
caauauaaaaacaac

SEQ ID NO: 3943751 - RNA, 21 nt, Human adenovirus F
caaucagcggcuggaaaauag

SEQ ID NO: 3943752 - RNA, 21 nt, Human adenovirus F
caauccugaaugcauguacac

SEQ ID NO: 3943753 - RNA, 14 nt, Human adenovirus F
caauggcagcccag

SEQ ID NO: 3943754 - RNA, 19 nt, Human adenovirus F
caauggcagcccagcgccc

SEQ ID NO: 3943755 - RNA, 19 nt, Human adenovirus F
caaugggcuccagcgagca

SEQ ID NO: 3943756 - RNA, 16 nt, Human adenovirus F
caauuggggcacaccg

SEQ ID NO: 3943757 - RNA, 16 nt, Human adenovirus F
caauuugcuaacacua

SEQ ID NO: 3943758 - RNA, 16 nt, Human adenovirus F
cacaauauuuauacac

SEQ ID NO: 3943759 - RNA, 17 nt, Human adenovirus F
cacacgucauccgccuc

SEQ ID NO: 3943760 - RNA, 13 nt, Human adenovirus F
cacacuccgcaga

SEQ ID NO: 3943761 - RNA, 15 nt, Human adenovirus F
cacagccgccgcucc

SEQ ID NO: 3943762 - RNA, 17 nt, Human adenovirus F
cacauaagaagccagcc

SEQ ID NO: 3943763 - RNA, 17 nt, Human adenovirus F
cacauccagggcacagu

SEQ ID NO: 3943764 - RNA, 13 nt, Human adenovirus F
cacaugaacacuu

SEQ ID NO: 3943765 - RNA, 15 nt, Human adenovirus F
caccacguaaaaggu

SEQ ID NO: 3943766 - RNA, 20 nt, Human adenovirus F
caccauugaaguuucacacu

SEQ ID NO: 3943767 - RNA, 15 nt, Human adenovirus F
caccauuguacgaga

SEQ ID NO: 3943768 - RNA, 16 nt, Human adenovirus F
caccccuagucccucc

SEQ ID NO: 3943769 - RNA, 19 nt, Human adenovirus F
caccgcgcggcggccauga

SEQ ID NO: 3943770 - RNA, 23 nt, Human adenovirus F
caccguucccacuguuucuccuc

SEQ ID NO: 3943771 - RNA, 20 nt, Human adenovirus F
caccguuguggagucacugc

SEQ ID NO: 3943772 - RNA, 22 nt, Human adenovirus F
caccguuguggagucacugcua

SEQ ID NO: 3943773 - RNA, 24 nt, Human adenovirus F
caccuacacggaguaucagaaugu

SEQ ID NO: 3943774 - RNA, 18 nt, Human adenovirus F
caccuacucuggcuccgu

SEQ ID NO: 3943775 - RNA, 21 nt, Human adenovirus F
caccucuguuugcugcacugc

SEQ ID NO: 3943776 - RNA, 18 nt, Human adenovirus F
caccucuucuucuuccuc

SEQ ID NO: 3943777 - RNA, 23 nt, Human adenovirus F
caccucuuguucgaaggcugccg

SEQ ID NO: 3943778 - RNA, 16 nt, Human adenovirus F
caccuugcaaggggag

SEQ ID NO: 3943779 - RNA, 18 nt, Human adenovirus F
cacgcgcucgacaugacu

SEQ ID NO: 3943780 - RNA, 14 nt, Human adenovirus F
cacgcucugcaucu

SEQ ID NO: 3943781 - RNA, 23 nt, Human adenovirus F
cacguuacuuaggcauacaggcu

SEQ ID NO: 3943782 - RNA, 15 nt, Human adenovirus F
cacuaccacccuccu

SEQ ID NO: 3943783 - RNA, 19 nt, Human adenovirus F
cacuagcgccccugcagcc

SEQ ID NO: 3943784 - RNA, 21 nt, Human adenovirus F
cacucgggaaagacaguggcg

SEQ ID NO: 3943785 - RNA, 13 nt, Human adenovirus F
cacugacaguaag

SEQ ID NO: 3943786 - RNA, 15 nt, Human adenovirus F
cacugaccggcaccu

SEQ ID NO: 3943787 - RNA, 16 nt, Human adenovirus F
cacugcaccuugcaag

SEQ ID NO: 3943788 - RNA, 13 nt, Human adenovirus F
cacugcgguggag

SEQ ID NO: 3943789 - RNA, 14 nt, Human adenovirus F
cacuuaccagagcc

SEQ ID NO: 3943790 - RNA, 16 nt, Human adenovirus F
cacuuuacuuaaaccc

SEQ ID NO: 3943791 - RNA, 13 nt, Human adenovirus F
cagaaaacacauu

SEQ ID NO: 3943792 - RNA, 11 nt, Human adenovirus F
cagaacauggc

SEQ ID NO: 3943793 - RNA, 13 nt, Human adenovirus F
cagaauguaacuc

SEQ ID NO: 3943794 - RNA, 13 nt, Human adenovirus F
cagacgcaaugga

SEQ ID NO: 3943795 - RNA, 19 nt, Human adenovirus F
cagacggccguaccaagcc

SEQ ID NO: 3943796 - RNA, 13 nt, Human adenovirus F
acgacuaccucug

SEQ ID NO: 3943797 - RNA, 23 nt, Human adenovirus F
acgacuucaaccccgucuacccc

SEQ ID NO: 3943798 - RNA, 20 nt, Human adenovirus F
acgagcaggcuuugaaagag

SEQ ID NO: 3943799 - RNA, 23 nt, Human adenovirus F
acgagcccugaucagccaggugg

SEQ ID NO: 3943800 - RNA, 19 nt, Human adenovirus F
acgagcuugcucgcuggcu

SEQ ID NO: 3943801 - RNA, 18 nt, Human adenovirus F
acgagguagugagcucuu

SEQ ID NO: 3943802 - RNA, 17 nt, Human adenovirus F
acgaucgcuccaggugg

SEQ ID NO: 3943803 - RNA, 16 nt, Human adenovirus F
acgcaagcgaaugccc

SEQ ID NO: 3943804 - RNA, 22 nt, Human adenovirus F
acgcaccaggucguaaugagga

SEQ ID NO: 3943805 - RNA, 18 nt, Human adenovirus F
acgccgaggcacuguuca

SEQ ID NO: 3943806 - RNA, 16 nt, Human adenovirus F
acgcgcucgacaugac

SEQ ID NO: 3943807 - RNA, 23 nt, Human adenovirus F
acgcugccaacaaauguucgcaa

SEQ ID NO: 3943808 - RNA, 12 nt, Human adenovirus F
acggacaacccg

SEQ ID NO: 3943809 - RNA, 13 nt, Human adenovirus F
acggaggaagagg

SEQ ID NO: 3943810 - RNA, 20 nt, Human adenovirus F
acggcaaucccagcagaaac

SEQ ID NO: 3943811 - RNA, 13 nt, Human adenovirus F
acggcaccugcga

SEQ ID NO: 3943812 - RNA, 19 nt, Human adenovirus F
aacgauucuucugugacaa

SEQ ID NO: 3943813 - RNA, 20 nt, Human adenovirus F
aacgccccgcgagccacagg

SEQ ID NO: 3943814 - RNA, 16 nt, Human adenovirus F
aacgcccgcuagcucu

SEQ ID NO: 3943815 - RNA, 14 nt, Human adenovirus F
aacggaaacaaaaa

SEQ ID NO: 3943816 - RNA, 18 nt, Human adenovirus F
aacggacgcauuaccauu

SEQ ID NO: 3943817 - RNA, 18 nt, Human adenovirus F
aacggcggaugguggcaa

SEQ ID NO: 3943818 - RNA, 20 nt, Human adenovirus F
aacggcgugguggauauagc

SEQ ID NO: 3943819 - RNA, 13 nt, Human adenovirus F
aacguucaaacag

SEQ ID NO: 3943820 - RNA, 14 nt, Human adenovirus F
aacuacaaaagcag

SEQ ID NO: 3943821 - RNA, 16 nt, Human adenovirus F
aacuaccgccuuugga

SEQ ID NO: 3943822 - RNA, 18 nt, Human adenovirus F
aacuaccucgccgcgcag

SEQ ID NO: 3943823 - RNA, 17 nt, Human adenovirus F
aacucaaacaacaaaau

SEQ ID NO: 3943824 - RNA, 22 nt, Human adenovirus F
aacuccuuggguuuagccacau

SEQ ID NO: 3943825 - RNA, 11 nt, Human adenovirus F
aacucugaaga

SEQ ID NO: 3943826 - RNA, 18 nt, Human adenovirus F
aacucugaagaugucuga

SEQ ID NO: 3943827 - RNA, 13 nt, Human adenovirus F
aacugccaccucc

SEQ ID NO: 3943828 - RNA, 15 nt, Human adenovirus F
aacuggucucagaau

SEQ ID NO: 3943829 - RNA, 16 nt, Human adenovirus F
aacuguucuugucgua

SEQ ID NO: 3943830 - RNA, 13 nt, Human adenovirus F
aacuuuuugccca

SEQ ID NO: 3943831 - RNA, 20 nt, Human adenovirus F
aagacauucuugagcaggcc

SEQ ID NO: 3943832 - RNA, 23 nt, Human adenovirus F
aagacguuaagguaaagccacaa

SEQ ID NO: 3943833 - RNA, 22 nt, Human adenovirus F
aagacuaucacgcccaccaaau

SEQ ID NO: 3943834 - RNA, 15 nt, Human adenovirus F
aagagaaucuaacca

SEQ ID NO: 3943835 - RNA, 14 nt, Human adenovirus F
aagagccaccuugu

SEQ ID NO: 3943836 - RNA, 17 nt, Human adenovirus F
aagaucacaccucuccc

SEQ ID NO: 3943837 - RNA, 16 nt, Human adenovirus F
aagauuccaccaaagg

SEQ ID NO: 3943838 - RNA, 15 nt, Human adenovirus F
aagauuuuugaaggu

SEQ ID NO: 3943839 - RNA, 16 nt, Human adenovirus F
aagcagagcucugcaa

SEQ ID NO: 3943840 - RNA, 19 nt, Human adenovirus F
aagccuucaggcagcagcc

SEQ ID NO: 3943841 - RNA, 14 nt, Human adenovirus F
aagcgagcagagcc

SEQ ID NO: 3943842 - RNA, 21 nt, Human adenovirus F
aagcgggcgcaauacucgcag

SEQ ID NO: 3943843 - RNA, 20 nt, Human adenovirus F
aagcgguugcgguacucucg

SEQ ID NO: 3943844 - RNA, 22 nt, Human adenovirus F
aagcugugagcgccagccgccg

SEQ ID NO: 3943845 - RNA, 14 nt, Human adenovirus F
aaggacagucugcc

SEQ ID NO: 3943846 - RNA, 15 nt, Human adenovirus F
aaguccacaaaaacu

SEQ ID NO: 3943847 - RNA, 23 nt, Human adenovirus F
aagugaaccggaaaaccaacgcu

SEQ ID NO: 3943848 - RNA, 18 nt, Human adenovirus F
aagugaagaccaacugca

SEQ ID NO: 3943849 - RNA, 15 nt, Human adenovirus F
aagugggcucagacu

SEQ ID NO: 3943850 - RNA, 19 nt, Human adenovirus F
aaguguuuauuuauuucuu

SEQ ID NO: 3943851 - RNA, 22 nt, Human adenovirus F
aaguucaacaucaaccagugca

SEQ ID NO: 3943852 - RNA, 15 nt, Human adenovirus F
aauaccccgucacuc

SEQ ID NO: 3943853 - RNA, 17 nt, Human adenovirus F
aauauugcggagccuga

SEQ ID NO: 3943854 - RNA, 19 nt, Human adenovirus F
aaucaaccaacuaacacug

SEQ ID NO: 3943855 - RNA, 16 nt, Human adenovirus F
aaucagaugcauuuug

SEQ ID NO: 3943856 - RNA, 22 nt, Human adenovirus F
aaucagaugcauuuuggccuga

SEQ ID NO: 3943857 - RNA, 17 nt, Human adenovirus F
aaucaggaacuguucaa

SEQ ID NO: 3943858 - RNA, 13 nt, Human adenovirus F
aaucgcuggaaaa

SEQ ID NO: 3943859 - RNA, 18 nt, Human adenovirus F
aaucgguaccuuugagau

SEQ ID NO: 3943860 - RNA, 13 nt, Human adenovirus F
aaucuucggcagg

SEQ ID NO: 3943861 - RNA, 17 nt, Human adenovirus F
aaucuugaauaauuccc

SEQ ID NO: 3943862 - RNA, 17 nt, Human adenovirus F
aaugccaggcagcaggg

SEQ ID NO: 3943863 - RNA, 13 nt, Human adenovirus F
aauggaaacugau

SEQ ID NO: 3943864 - RNA, 12 nt, Human adenovirus F
aaugggcaaagg

SEQ ID NO: 3943865 - RNA, 20 nt, Human adenovirus F
aauguaacaugaccaaggac

SEQ ID NO: 3943866 - RNA, 23 nt, Human adenovirus F
aauguagcccuguacuugccuga

SEQ ID NO: 3943867 - RNA, 17 nt, Human adenovirus F
aaugugcagcaaaaacu

SEQ ID NO: 3943868 - RNA, 16 nt, Human adenovirus F
aauucguggccccuac

SEQ ID NO: 3943869 - RNA, 22 nt, Human adenovirus F
aauugauuuucugccaccagcc

SEQ ID NO: 3943870 - RNA, 13 nt, Human adenovirus F
aauuuagcucuaa

SEQ ID NO: 3943871 - RNA, 13 nt, Human adenovirus F
acaaaaacuuaca

SEQ ID NO: 3943872 - RNA, 15 nt, Human adenovirus F
acaaaagcaguggga

SEQ ID NO: 3943873 - RNA, 22 nt, Human adenovirus F
acaaaggaggcgauuugggagg

SEQ ID NO: 3943874 - RNA, 18 nt, Human adenovirus F
acaaagucauccaaauca

SEQ ID NO: 3943875 - RNA, 12 nt, Human adenovirus F
acaacaaaucau

SEQ ID NO: 3943876 - RNA, 13 nt, Human adenovirus F
acaacaacgggca

SEQ ID NO: 3943877 - RNA, 13 nt, Human adenovirus F
acaaggccuggaa

SEQ ID NO: 3943878 - RNA, 14 nt, Human adenovirus F
acaauaagcagcuu

SEQ ID NO: 3943879 - RNA, 19 nt, Human adenovirus F
acaaucagggaaauuuacu

SEQ ID NO: 3943880 - RNA, 18 nt, Human adenovirus F
acaccgucuccaucgccg

SEQ ID NO: 3943881 - RNA, 17 nt, Human adenovirus F
acacgaaaaccggcugg

SEQ ID NO: 3943882 - RNA, 18 nt, Human adenovirus F
acacggggucuauuugga

SEQ ID NO: 3943883 - RNA, 17 nt, Human adenovirus F
acacuaaaguuuuaaug

SEQ ID NO: 3943884 - RNA, 22 nt, Human adenovirus F
acacuccgcagacgaacacaau

SEQ ID NO: 3943885 - RNA, 16 nt, Human adenovirus F
acacugccuaccgcag

SEQ ID NO: 3943886 - RNA, 15 nt, Human adenovirus F
acacuuuuuugcaag

SEQ ID NO: 3943887 - RNA, 15 nt, Human adenovirus F
acagccccagcuggu

SEQ ID NO: 3943888 - RNA, 15 nt, Human adenovirus F
acagucaagcucucc

SEQ ID NO: 3943889 - RNA, 21 nt, Human adenovirus F
acauagcaaaagcauuuuccu

SEQ ID NO: 3943890 - RNA, 13 nt, Human adenovirus F
acauccauuucca

SEQ ID NO: 3943891 - RNA, 13 nt, Human adenovirus F
acaugagcuuacu

SEQ ID NO: 3943892 - RNA, 13 nt, Human adenovirus F
acaugauucucca

SEQ ID NO: 3943893 - RNA, 12 nt, Human adenovirus F
acaugccacaga

SEQ ID NO: 3943894 - RNA, 18 nt, Human adenovirus F
acaugcugguuuucuuua

SEQ ID NO: 3943895 - RNA, 22 nt, Human adenovirus F
acaugcuuaugcgcuguacugu

SEQ ID NO: 3943896 - RNA, 16 nt, Human adenovirus F
acaugcuuuucccauu

SEQ ID NO: 3943897 - RNA, 14 nt, Human adenovirus F
acauggccagcacc

SEQ ID NO: 3943898 - RNA, 19 nt, Human adenovirus F
accaaaacaaaacaaacuc

SEQ ID NO: 3943899 - RNA, 20 nt, Human adenovirus F
accaauaugcccaacaucaa

SEQ ID NO: 3943900 - RNA, 16 nt, Human adenovirus F
accaaucuaucccuug

SEQ ID NO: 3943901 - RNA, 13 nt, Human adenovirus F
accaauuugcuaa

SEQ ID NO: 3943902 - RNA, 22 nt, Human adenovirus F
accacccggguuuaccuggugg

SEQ ID NO: 3943903 - RNA, 17 nt, Human adenovirus F
accaccugcccuuccuc

SEQ ID NO: 3943904 - RNA, 16 nt, Human adenovirus F
accacuaccacccucc

SEQ ID NO: 3943905 - RNA, 22 nt, Human adenovirus F
accacugauguaacagcuuugg

SEQ ID NO: 3943906 - RNA, 17 nt, Human adenovirus F
accauuaagaagacugu

SEQ ID NO: 3943907 - RNA, 19 nt, Human adenovirus F
accauuguacgagaagccc

SEQ ID NO: 3943908 - RNA, 15 nt, Human adenovirus F
acccaacuauuuggg

SEQ ID NO: 3943909 - RNA, 19 nt, Human adenovirus F
acccagguuuaauacagug

SEQ ID NO: 3943910 - RNA, 23 nt, Human adenovirus F
acccccguucccagucugccauc

SEQ ID NO: 3943911 - RNA, 15 nt, Human adenovirus F
accccgacagaggcc

SEQ ID NO: 3943912 - RNA, 17 nt, Human adenovirus F
accccgucacucuccgc

SEQ ID NO: 3943913 - RNA, 17 nt, Human adenovirus F
acccgcacuggaugcca

SEQ ID NO: 3943914 - RNA, 23 nt, Human adenovirus F
acccuucaacggaauuguaacug

SEQ ID NO: 3943915 - RNA, 18 nt, Human adenovirus F
accgcuguauuuugcuac

SEQ ID NO: 3943916 - RNA, 16 nt, Human adenovirus F
accggcuccugugcag

SEQ ID NO: 3943917 - RNA, 20 nt, Human adenovirus F
accgucaucucuacagcccc

SEQ ID NO: 3943918 - RNA, 22 nt, Human adenovirus F
accguucccacuguuucuccuc

SEQ ID NO: 3943919 - RNA, 20 nt, Human adenovirus F
accuacuaccacuaccccua

SEQ ID NO: 3943920 - RNA, 20 nt, Human adenovirus F
accuccgacgcuugcuggag

SEQ ID NO: 3943921 - RNA, 21 nt, Human adenovirus F
accucugacaaacacgcuccc

SEQ ID NO: 3943922 - RNA, 20 nt, Human adenovirus F
accucuucuucuuccuccuc

SEQ ID NO: 3943923 - RNA, 13 nt, Human adenovirus F
accugcacgcucu

SEQ ID NO: 3943924 - RNA, 21 nt, Human adenovirus F
accugcacgcucuugcugugg

SEQ ID NO: 3943925 - RNA, 18 nt, Human adenovirus F
accugcaguucauuuaaa

SEQ ID NO: 3943926 - RNA, 20 nt, Human adenovirus F
accugcaguucauuuaaaag

SEQ ID NO: 3943927 - RNA, 12 nt, Human adenovirus F
accugccccuac

SEQ ID NO: 3943928 - RNA, 17 nt, Human adenovirus F
accuggggccuacggaa

SEQ ID NO: 3943929 - RNA, 16 nt, Human adenovirus F
accuuauacaccuccc

SEQ ID NO: 3943930 - RNA, 19 nt, Human adenovirus F
acgacggggauacugcucc

SEQ ID NO: 3943931 - RNA, 18 nt, Human adenovirus F
gguggaauuacugccagu

SEQ ID NO: 3943932 - RNA, 13 nt, Human adenovirus F
gguggcaaggaga

SEQ ID NO: 3943933 - RNA, 21 nt, Human adenovirus F
gguggggccccugaggcagcg

SEQ ID NO: 3943934 - RNA, 18 nt, Human adenovirus F
ggugugaaggcaaagguc

SEQ ID NO: 3943935 - RNA, 22 nt, Human adenovirus F
gguuacucagcaauccggccca

SEQ ID NO: 3943936 - RNA, 17 nt, Human adenovirus F
gguuucggguggagggu

SEQ ID NO: 3943937 - RNA, 15 nt, Human adenovirus F
gguuugccagacuuu

SEQ ID NO: 3943938 - RNA, 17 nt, Human adenovirus F
guaacagcuuuggaagu

SEQ ID NO: 3943939 - RNA, 13 nt, Human adenovirus F
guaagcuaaggac

SEQ ID NO: 3943940 - RNA, 12 nt, Human adenovirus F
guaccaggaggc

SEQ ID NO: 3943941 - RNA, 21 nt, Human adenovirus F
guacgaagcuagcauaaaaga

SEQ ID NO: 3943942 - RNA, 19 nt, Human adenovirus F
guacggaccaccagaugau

SEQ ID NO: 3943943 - RNA, 14 nt, Human adenovirus F
guagacgcuggaag

SEQ ID NO: 3943944 - RNA, 20 nt, Human adenovirus F
guagagacugccaagccuca

SEQ ID NO: 3943945 - RNA, 15 nt, Human adenovirus F
guagaguuugggagc

SEQ ID NO: 3943946 - RNA, 17 nt, Human adenovirus F
guagcaccccaauguaa

SEQ ID NO: 3943947 - RNA, 15 nt, Human adenovirus F
guagccccuugguga

SEQ ID NO: 3943948 - RNA, 19 nt, Human adenovirus F
guagccgaugcccaacgcu

SEQ ID NO: 3943949 - RNA, 17 nt, Human adenovirus F
guagcguguuggacuug

SEQ ID NO: 3943950 - RNA, 13 nt, Human adenovirus F
guagcuuggaagc

SEQ ID NO: 3943951 - RNA, 20 nt, Human adenovirus F
guagggauugagugggaagc

SEQ ID NO: 3943952 - RNA, 18 nt, Human adenovirus F
guagggugucugccagag

SEQ ID NO: 3943953 - RNA, 18 nt, Human adenovirus F
guaguccucauucuucuc

SEQ ID NO: 3943954 - RNA, 18 nt, Human adenovirus F
guaguuuugcuccagggu

SEQ ID NO: 3943955 - RNA, 20 nt, Human adenovirus F
guauaaguauuacaaaugcc

SEQ ID NO: 3943956 - RNA, 16 nt, Human adenovirus F
guaucagaauguaacu

SEQ ID NO: 3943957 - RNA, 11 nt, Human adenovirus F
guaugggcagc

SEQ ID NO: 3943958 - RNA, 12 nt, Human adenovirus F
guaugggcagca

SEQ ID NO: 3943959 - RNA, 19 nt, Human adenovirus F
gucaaucucuucguccugg

SEQ ID NO: 3943960 - RNA, 22 nt, Human adenovirus F
gucaaucucuucguccuggagu

SEQ ID NO: 3943961 - RNA, 17 nt, Human adenovirus F
gucacagccuguuacua

SEQ ID NO: 3943962 - RNA, 15 nt, Human adenovirus F
gucaccgccaagagc

SEQ ID NO: 3943963 - RNA, 23 nt, Human adenovirus F
gucacuacaauauuggcuaccag

SEQ ID NO: 3943964 - RNA, 21 nt, Human adenovirus F
gucagaacggcgugcuggaaa

SEQ ID NO: 3943965 - RNA, 18 nt, Human adenovirus F
gucaggccgcccgucagg

SEQ ID NO: 3943966 - RNA, 19 nt, Human adenovirus F
gucaggccugcaagaucuc

SEQ ID NO: 3943967 - RNA, 19 nt, Human adenovirus F
gucauacgcuagaccaaca

SEQ ID NO: 3943968 - RNA, 23 nt, Human adenovirus F
gucauauacuuuaaacaagcaaa

SEQ ID NO: 3943969 - RNA, 20 nt, Human adenovirus F
gucccuccccguuaccuggg

SEQ ID NO: 3943970 - RNA, 21 nt, Human adenovirus F
guccuggccaacugccaccuc

SEQ ID NO: 3943971 - RNA, 21 nt, Human adenovirus F
guccugucgccccugccaacu

SEQ ID NO: 3943972 - RNA, 17 nt, Human adenovirus F
guccuuugccccccggc

SEQ ID NO: 3943973 - RNA, 14 nt, Human adenovirus F
gucgcagaaucucc

SEQ ID NO: 3943974 - RNA, 19 nt, Human adenovirus F
gucgccagaguugucuugg

SEQ ID NO: 3943975 - RNA, 20 nt, Human adenovirus F
gucgggccaugcgccgagcg

SEQ ID NO: 3943976 - RNA, 13 nt, Human adenovirus F
gucgucgcaggcg

SEQ ID NO: 3943977 - RNA, 15 nt, Human adenovirus F
gucgucggcucugga

SEQ ID NO: 3943978 - RNA, 20 nt, Human adenovirus F
gucguggcauguuuucucca

SEQ ID NO: 3943979 - RNA, 14 nt, Human adenovirus F
gucguugccagccg

SEQ ID NO: 3943980 - RNA, 16 nt, Human adenovirus F
gucuccagaccccaug

SEQ ID NO: 3943981 - RNA, 11 nt, Human adenovirus F
gucugccaaaa

SEQ ID NO: 3943982 - RNA, 13 nt, Human adenovirus F
gucugcugcugcc

SEQ ID NO: 3943983 - RNA, 21 nt, Human adenovirus F
gucugggaguaaaaagccuga

SEQ ID NO: 3943984 - RNA, 15 nt, Human adenovirus F
gucuuuuuugucugg

SEQ ID NO: 3943985 - RNA, 14 nt, Human adenovirus F
gugacaaagaggcg

SEQ ID NO: 3943986 - RNA, 16 nt, Human adenovirus F
gugaguuuugagggug

SEQ ID NO: 3943987 - RNA, 20 nt, Human adenovirus F
gugcagauggaaacugucag

SEQ ID NO: 3943988 - RNA, 24 nt, Human adenovirus F
gugccguucgcagaaacaugccac

SEQ ID NO: 3943989 - RNA, 14 nt, Human adenovirus F
gugccugaagcacu

SEQ ID NO: 3943990 - RNA, 18 nt, Human adenovirus F
gugcgcgaacugggcugc

SEQ ID NO: 3943991 - RNA, 23 nt, Human adenovirus F
gugcggauuugggaacuguccag

SEQ ID NO: 3943992 - RNA, 17 nt, Human adenovirus F
gugcuccugaagcacau

SEQ ID NO: 3943993 - RNA, 22 nt, Human adenovirus F
gugcuggggaauggagcugugg

SEQ ID NO: 3943994 - RNA, 13 nt, Human adenovirus F
gugcuuggaagag

SEQ ID NO: 3943995 - RNA, 16 nt, Human adenovirus F
guggacgacagccagc

SEQ ID NO: 3943996 - RNA, 12 nt, Human adenovirus F
guggaggcagcu

SEQ ID NO: 3943997 - RNA, 20 nt, Human adenovirus F
guggauaccgcugcagcugc

SEQ ID NO: 3943998 - RNA, 15 nt, Human adenovirus F
guggcaaggagagug

SEQ ID NO: 3943999 - RNA, 15 nt, Human adenovirus F
guggcauggcagcag

SEQ ID NO: 3944000 - RNA, 19 nt, Human adenovirus F
gugggccgcugaaagacgu

SEQ ID NO: 3944001 - RNA, 19 nt, Human adenovirus F
guggggccccugaggcagc

SEQ ID NO: 3944002 - RNA, 17 nt, Human adenovirus F
gugguacaggagcgcag

SEQ ID NO: 3944003 - RNA, 17 nt, Human adenovirus F
gugucuccgcugggaga

SEQ ID NO: 3944004 - RNA, 12 nt, Human adenovirus F
gugucugccaga

SEQ ID NO: 3944005 - RNA, 21 nt, Human adenovirus F
guguugacccgcuuggaggag

SEQ ID NO: 3944006 - RNA, 21 nt, Human adenovirus F
guguuucacguaguaucucau

SEQ ID NO: 3944007 - RNA, 23 nt, Human adenovirus F
guuaaaaagcgagaaaaaaaaga

SEQ ID NO: 3944008 - RNA, 22 nt, Human adenovirus F
guuaacaugauucuccaaagca

SEQ ID NO: 3944009 - RNA, 17 nt, Human adenovirus F
guucacuuugccagagg

SEQ ID NO: 3944010 - RNA, 21 nt, Human adenovirus F
guuccauggcccgaccuguau

SEQ ID NO: 3944011 - RNA, 16 nt, Human adenovirus F
guucgccuggagaggc

SEQ ID NO: 3944012 - RNA, 22 nt, Human adenovirus F
guucuucacugcaccuugcaag

SEQ ID NO: 3944013 - RNA, 15 nt, Human adenovirus F
guuggagcagccugu

SEQ ID NO: 3944014 - RNA, 11 nt, Human adenovirus F
guuggaggaga

SEQ ID NO: 3944015 - RNA, 17 nt, Human adenovirus F
guuggugaugcccggcg

SEQ ID NO: 3944016 - RNA, 12 nt, Human adenovirus F
guuucuccuccc

SEQ ID NO: 3944017 - RNA, 14 nt, Human adenovirus F
uaaaaaugccaggc

SEQ ID NO: 3944018 - RNA, 15 nt, Human adenovirus F
uaaaaauggagaucu

SEQ ID NO: 3944019 - RNA, 13 nt, Human adenovirus F
uaaacccacagcu

SEQ ID NO: 3944020 - RNA, 22 nt, Human adenovirus F
uaaagacguuaagguaaagcca

SEQ ID NO: 3944021 - RNA, 19 nt, Human adenovirus F
uaaagcauaacaugauuug

SEQ ID NO: 3944022 - RNA, 13 nt, Human adenovirus F
uaaaggaccaaaa

SEQ ID NO: 3944023 - RNA, 17 nt, Human adenovirus F
uaaaucuuccucccaaa

SEQ ID NO: 3944024 - RNA, 20 nt, Human adenovirus F
uaaauggaauucgugccacu

SEQ ID NO: 3944025 - RNA, 20 nt, Human adenovirus F
uaaccacccccaacucugag

SEQ ID NO: 3944026 - RNA, 14 nt, Human adenovirus F
uaacuaaaaacgga

SEQ ID NO: 3944027 - RNA, 15 nt, Human adenovirus F
uaacucucccuuucc

SEQ ID NO: 3944028 - RNA, 13 nt, Human adenovirus F
uaacugagccuga

SEQ ID NO: 3944029 - RNA, 23 nt, Human adenovirus F
uaagcgggggaaauuuaaaccug

SEQ ID NO: 3944030 - RNA, 21 nt, Human adenovirus F
uaagcgucggcgccacacugu

SEQ ID NO: 3944031 - RNA, 21 nt, Human adenovirus F
uaagcuggguggaaagcaagu

SEQ ID NO: 3944032 - RNA, 18 nt, Human adenovirus F
uaagggaggcagcagagg

SEQ ID NO: 3944033 - RNA, 14 nt, Human adenovirus F
uaauccaaugcaaa

SEQ ID NO: 3944034 - RNA, 22 nt, Human adenovirus F
uacaaaugucuaauggagcuau

SEQ ID NO: 3944035 - RNA, 15 nt, Human adenovirus F
uacaacgagcaggcc

SEQ ID NO: 3944036 - RNA, 18 nt, Human adenovirus F
uacaauauuggcuaccag

SEQ ID NO: 3944037 - RNA, 18 nt, Human adenovirus F
uacaauccccuugacauu

SEQ ID NO: 3944038 - RNA, 21 nt, Human adenovirus F
uacacugauccacuuacaacc

SEQ ID NO: 3944039 - RNA, 12 nt, Human adenovirus F
uacagccccuac

SEQ ID NO: 3944040 - RNA, 21 nt, Human adenovirus F
uaccaccguugaugacgucau

SEQ ID NO: 3944041 - RNA, 19 nt, Human adenovirus F
uacgagaaaucggagaggg

SEQ ID NO: 3944042 - RNA, 13 nt, Human adenovirus F
uacgcccaggagc

SEQ ID NO: 3944043 - RNA, 17 nt, Human adenovirus F
uacgcggggcaggagcu

SEQ ID NO: 3944044 - RNA, 14 nt, Human adenovirus F
uacgugccuuuuca

SEQ ID NO: 3944045 - RNA, 16 nt, Human adenovirus F
uacgugccuuuucaca

SEQ ID NO: 3944046 - RNA, 22 nt, Human adenovirus F
uacuaccacuaccccuaccacc

SEQ ID NO: 3944047 - RNA, 17 nt, Human adenovirus F
uacuauuaaugcaaaca

SEQ ID NO: 3944048 - RNA, 13 nt, Human adenovirus F
uacucuggcuccg

SEQ ID NO: 3944049 - RNA, 15 nt, Human adenovirus F
uacugcuaaagggaa

SEQ ID NO: 3944050 - RNA, 20 nt, Human adenovirus F
aaaaaccgccacaugaacac

SEQ ID NO: 3944051 - RNA, 14 nt, Human adenovirus F
aaaaagagaaucua

SEQ ID NO: 3944052 - RNA, 17 nt, Human adenovirus F
aaaaccuacgcccagga

SEQ ID NO: 3944053 - RNA, 21 nt, Human adenovirus F
aaaacgucccaucauuuccac

SEQ ID NO: 3944054 - RNA, 19 nt, Human adenovirus F
aaaacguucccgcccucac

SEQ ID NO: 3944055 - RNA, 18 nt, Human adenovirus F
aaaaugugcagcaaaaac

SEQ ID NO: 3944056 - RNA, 15 nt, Human adenovirus F
aaacaagcaaagaca

SEQ ID NO: 3944057 - RNA, 20 nt, Human adenovirus F
aaacagcagguuaaagccaa

SEQ ID NO: 3944058 - RNA, 17 nt, Human adenovirus F
aaacaguaacaacuccu

SEQ ID NO: 3944059 - RNA, 14 nt, Human adenovirus F
aaacccagccgcac

SEQ ID NO: 3944060 - RNA, 21 nt, Human adenovirus F
aaacgagccagauuugaagau

SEQ ID NO: 3944061 - RNA, 17 nt, Human adenovirus F
aaacgcaccauugaagu

SEQ ID NO: 3944062 - RNA, 14 nt, Human adenovirus F
aaacggugaaauga

SEQ ID NO: 3944063 - RNA, 21 nt, Human adenovirus F
aaacuaucccgccccugccac

SEQ ID NO: 3944064 - RNA, 20 nt, Human adenovirus F
aaacuccuuuggacaagcuc

SEQ ID NO: 3944065 - RNA, 23 nt, Human adenovirus F
aaagcaaagccauccgcaaggau

SEQ ID NO: 3944066 - RNA, 17 nt, Human adenovirus F
aaagccauccgcaagga

SEQ ID NO: 3944067 - RNA, 13 nt, Human adenovirus F
aaagcgagccaaa

SEQ ID NO: 3944068 - RNA, 21 nt, Human adenovirus F
aaaguucaacaucaaccagug

SEQ ID NO: 3944069 - RNA, 18 nt, Human adenovirus F
aaauaauaauuuagcucu

SEQ ID NO: 3944070 - RNA, 22 nt, Human adenovirus F
aaauagagccgaucccagagcu

SEQ ID NO: 3944071 - RNA, 16 nt, Human adenovirus F
aaauagccgccagccu

SEQ ID NO: 3944072 - RNA, 21 nt, Human adenovirus F
aaaucacuguuuuuaacuauu

SEQ ID NO: 3944073 - RNA, 18 nt, Human adenovirus F
aaaucguagguuuaaauu

SEQ ID NO: 3944074 - RNA, 19 nt, Human adenovirus F
aaaucuaccacagaaaugu

SEQ ID NO: 3944075 - RNA, 14 nt, Human adenovirus F
aaaugccucccuuu

SEQ ID NO: 3944076 - RNA, 20 nt, Human adenovirus F
aaaugcucugcaaaaaaacg

SEQ ID NO: 3944077 - RNA, 14 nt, Human adenovirus F
aaauuaauugcacu

SEQ ID NO: 3944078 - RNA, 22 nt, Human adenovirus F
aacaaccuucaaacccagccgc

SEQ ID NO: 3944079 - RNA, 18 nt, Human adenovirus F
aacaacgaaauuuccauu

SEQ ID NO: 3944080 - RNA, 21 nt, Human adenovirus F
aacaagaaggugcuuccagcc

SEQ ID NO: 3944081 - RNA, 15 nt, Human adenovirus F
aacaauaaaaucauu

SEQ ID NO: 3944082 - RNA, 13 nt, Human adenovirus F
aacacaaugcaaa

SEQ ID NO: 3944083 - RNA, 22 nt, Human adenovirus F
aacacggagcugucuuaccagu

SEQ ID NO: 3944084 - RNA, 15 nt, Human adenovirus F
aacagauuuaccagu

SEQ ID NO: 3944085 - RNA, 18 nt, Human adenovirus F
aacagcauugugggucug

SEQ ID NO: 3944086 - RNA, 18 nt, Human adenovirus F
aacagcguagcacucccu

SEQ ID NO: 3944087 - RNA, 19 nt, Human adenovirus F
aacaucccucacuaccauu

SEQ ID NO: 3944088 - RNA, 22 nt, Human adenovirus F
aaccagcuuaguauuaacacug

SEQ ID NO: 3944089 - RNA, 22 nt, Human adenovirus F
aaccggcggcguacacuggcug

SEQ ID NO: 3944090 - RNA, 19 nt, Human adenovirus F
aaccgggaaaaccuuuuca

SEQ ID NO: 3944091 - RNA, 14 nt, Human adenovirus F
aaccuauugguucc

SEQ ID NO: 3944092 - RNA, 15 nt, Human adenovirus F
aacgaaaaaggaggu

SEQ ID NO: 3944093 - RNA, 16 nt, Human adenovirus F
aacgaaaaaggagguc

SEQ ID NO: 3944094 - RNA, 20 nt, Human adenovirus F
aacggcggaugguggcaagg

SEQ ID NO: 3944095 - RNA, 14 nt, Human adenovirus F
aacuaacaaugccg

SEQ ID NO: 3944096 - RNA, 22 nt, Human adenovirus F
aacuaccgccuuuggagguggc

SEQ ID NO: 3944097 - RNA, 20 nt, Human adenovirus F
aacuccucuuccuccacagc

SEQ ID NO: 3944098 - RNA, 12 nt, Human adenovirus F
aacuccuuugga

SEQ ID NO: 3944099 - RNA, 15 nt, Human adenovirus F
aacucuuacaccucc

SEQ ID NO: 3944100 - RNA, 16 nt, Human adenovirus F
aacucuuuauuuuucu

SEQ ID NO: 3944101 - RNA, 13 nt, Human adenovirus F
ccgagagaugcau

SEQ ID NO: 3944102 - RNA, 19 nt, Human adenovirus F
ccgagcuucuuagcgaaac

SEQ ID NO: 3944103 - RNA, 23 nt, Human adenovirus F
ccgcaaaugggccuggcagcugg

SEQ ID NO: 3944104 - RNA, 18 nt, Human adenovirus F
ccgcaaccauguucacug

SEQ ID NO: 3944105 - RNA, 20 nt, Human adenovirus F
ccgcauacuguuucacauau

SEQ ID NO: 3944106 - RNA, 22 nt, Human adenovirus F
ccgccagccuccgguggcucug

SEQ ID NO: 3944107 - RNA, 16 nt, Human adenovirus F
ccgccguggacgcacg

SEQ ID NO: 3944108 - RNA, 20 nt, Human adenovirus F
ccgccuuuucucaucacuga

SEQ ID NO: 3944109 - RNA, 16 nt, Human adenovirus F
ccgcgaacuaaugcac

SEQ ID NO: 3944110 - RNA, 13 nt, Human adenovirus F
ccgcgcgggcagg

SEQ ID NO: 3944111 - RNA, 18 nt, Human adenovirus F
ccgcgcuaaaucuuccuc

SEQ ID NO: 3944112 - RNA, 13 nt, Human adenovirus F
ccgcgucugcugc

SEQ ID NO: 3944113 - RNA, 13 nt, Human adenovirus F
ccgcugcagcugc

SEQ ID NO: 3944114 - RNA, 14 nt, Human adenovirus F
ccgcugcagcugcu

SEQ ID NO: 3944115 - RNA, 16 nt, Human adenovirus F
ccggcauguacggcgg

SEQ ID NO: 3944116 - RNA, 22 nt, Human adenovirus F
ccggcauuaacggcguggugga

SEQ ID NO: 3944117 - RNA, 22 nt, Human adenovirus F
ccggcuggggacuuugcuccgc

SEQ ID NO: 3944118 - RNA, 15 nt, Human adenovirus F
ccgggccagacuacu

SEQ ID NO: 3944119 - RNA, 17 nt, Human adenovirus F
ccggguuuaccuggugg

SEQ ID NO: 3944120 - RNA, 19 nt, Human adenovirus F
ccgucaucucuacagcccc

SEQ ID NO: 3944121 - RNA, 14 nt, Human adenovirus F
ccguccccagcgcc

SEQ ID NO: 3944122 - RNA, 22 nt, Human adenovirus F
ccgugauugauagugugguggc

SEQ ID NO: 3944123 - RNA, 15 nt, Human adenovirus F
ccguuaaucucccuc

SEQ ID NO: 3944124 - RNA, 23 nt, Human adenovirus F
ccguuaaucucccuccccccuuc

SEQ ID NO: 3944125 - RNA, 15 nt, Human adenovirus F
ccguuaccuggggcc

SEQ ID NO: 3944126 - RNA, 15 nt, Human adenovirus F
ccguucuaugcuccu

SEQ ID NO: 3944127 - RNA, 15 nt, Human adenovirus F
ccuacucuggcuccg

SEQ ID NO: 3944128 - RNA, 13 nt, Human adenovirus F
ccuacugccgcca

SEQ ID NO: 3944129 - RNA, 16 nt, Human adenovirus F
ccuagacgaggaggac

SEQ ID NO: 3944130 - RNA, 23 nt, Human adenovirus F
ccuagccaguggacaaaccaaaa

SEQ ID NO: 3944131 - RNA, 20 nt, Human adenovirus F
ccuccaguuuguggaggagu

SEQ ID NO: 3944132 - RNA, 16 nt, Human adenovirus F
ccucgcugucuggaac

SEQ ID NO: 3944133 - RNA, 17 nt, Human adenovirus F
ccucuacgucaccuuac

SEQ ID NO: 3944134 - RNA, 20 nt, Human adenovirus F
ccucugugagcuggccuggu

SEQ ID NO: 3944135 - RNA, 18 nt, Human adenovirus F
ccucuugggcaggagugc

SEQ ID NO: 3944136 - RNA, 21 nt, Human adenovirus F
ccugacuauuuuaugcagaca

SEQ ID NO: 3944137 - RNA, 18 nt, Human adenovirus F
ccugcaauggcagcccag

SEQ ID NO: 3944138 - RNA, 17 nt, Human adenovirus F
ccugcagcgcuucuuug

SEQ ID NO: 3944139 - RNA, 22 nt, Human adenovirus F
ccugcggauuaagaaccacuga

SEQ ID NO: 3944140 - RNA, 21 nt, Human adenovirus F
ccugcuugucugucugccaau

SEQ ID NO: 3944141 - RNA, 20 nt, Human adenovirus F
ccuggaagagggcgaggggc

SEQ ID NO: 3944142 - RNA, 18 nt, Human adenovirus F
ccuggccaacugccaccu

SEQ ID NO: 3944143 - RNA, 14 nt, Human adenovirus F
ccugucgccccugc

SEQ ID NO: 3944144 - RNA, 17 nt, Human adenovirus F
ccuucagcuugagagca

SEQ ID NO: 3944145 - RNA, 16 nt, Human adenovirus F
ccuugcaaggggaggc

SEQ ID NO: 3944146 - RNA, 18 nt, Human adenovirus F
ccuuuaaccaccaccgca

SEQ ID NO: 3944147 - RNA, 22 nt, Human adenovirus F
ccuuuaauuaaaguuauucuga

SEQ ID NO: 3944148 - RNA, 16 nt, Human adenovirus F
ccuuuuugggauuaca

SEQ ID NO: 3944149 - RNA, 21 nt, Human adenovirus F
cgaaaaaggaggucaagccaa

SEQ ID NO: 3944150 - RNA, 15 nt, Human adenovirus F
cgaaacuuccaaccc

SEQ ID NO: 3944151 - RNA, 20 nt, Human adenovirus F
cgaccuuuucuaggguguga

SEQ ID NO: 3944152 - RNA, 19 nt, Human adenovirus F
cgacggaacguggaggaaa

SEQ ID NO: 3944153 - RNA, 13 nt, Human adenovirus F
cgagaaaaacaga

SEQ ID NO: 3944154 - RNA, 14 nt, Human adenovirus F
cgagaggaccacuu

SEQ ID NO: 3944155 - RNA, 15 nt, Human adenovirus F
cgagauaaacagugg

SEQ ID NO: 3944156 - RNA, 15 nt, Human adenovirus F
cgagaucggcaccag

SEQ ID NO: 3944157 - RNA, 15 nt, Human adenovirus F
cgagccaaagugcaa

SEQ ID NO: 3944158 - RNA, 22 nt, Human adenovirus F
cgagccacagguccagaccuca

SEQ ID NO: 3944159 - RNA, 14 nt, Human adenovirus F
cgagccggagaggg

SEQ ID NO: 3944160 - RNA, 22 nt, Human adenovirus F
cgagcuuuuacugggacagcag

SEQ ID NO: 3944161 - RNA, 15 nt, Human adenovirus F
cgaggggcuggcccg

SEQ ID NO: 3944162 - RNA, 21 nt, Human adenovirus F
cgaguucacuuugccagaggg

SEQ ID NO: 3944163 - RNA, 20 nt, Human adenovirus F
cgaguuccugcgcugcuacu

SEQ ID NO: 3944164 - RNA, 13 nt, Human adenovirus F
cgauacugcaaac

SEQ ID NO: 3944165 - RNA, 12 nt, Human adenovirus F
cgauuuuguccc

SEQ ID NO: 3944166 - RNA, 22 nt, Human adenovirus F
cgauuuugucccccucugcuac

SEQ ID NO: 3944167 - RNA, 16 nt, Human adenovirus F
cgcaacggcgcagcag

SEQ ID NO: 3944168 - RNA, 20 nt, Human adenovirus F
cgcaacuucuuuuugggagg

SEQ ID NO: 3944169 - RNA, 13 nt, Human adenovirus F
cgcagcagauccu

SEQ ID NO: 3944170 - RNA, 20 nt, Human adenovirus F
cgcagcaguaucaguggagu

SEQ ID NO: 3944171 - RNA, 15 nt, Human adenovirus F
cgcagccugagcugc

SEQ ID NO: 3944172 - RNA, 15 nt, Human adenovirus F
cgcagcgggaacgcu

SEQ ID NO: 3944173 - RNA, 17 nt, Human adenovirus F
cgcaggacuuggcagaa

SEQ ID NO: 3944174 - RNA, 20 nt, Human adenovirus F
cgcaucaccacuugugcaau

SEQ ID NO: 3944175 - RNA, 13 nt, Human adenovirus F
cgccaugacugcc

SEQ ID NO: 3944176 - RNA, 22 nt, Human adenovirus F
cgcccaaacucaucugucgcag

SEQ ID NO: 3944177 - RNA, 22 nt, Human adenovirus F
cgcccaggagcagcgggaagag

SEQ ID NO: 3944178 - RNA, 14 nt, Human adenovirus F
cgccccuaucacua

SEQ ID NO: 3944179 - RNA, 16 nt, Human adenovirus F
cgccgaggcacuguuc

SEQ ID NO: 3944180 - RNA, 15 nt, Human adenovirus F
cgccgccccuggccu

SEQ ID NO: 3944181 - RNA, 16 nt, Human adenovirus F
cgccgccccuggccug

SEQ ID NO: 3944182 - RNA, 17 nt, Human adenovirus F
cgccggcgggaagagga

SEQ ID NO: 3944183 - RNA, 17 nt, Human adenovirus F
cgccuuuucucaucacu

SEQ ID NO: 3944184 - RNA, 22 nt, Human adenovirus F
cgcgaacuaaugcacagccugc

SEQ ID NO: 3944185 - RNA, 18 nt, Human adenovirus F
cgcgaggaaaccgccuac

SEQ ID NO: 3944186 - RNA, 13 nt, Human adenovirus F
cgcgcgggcagga

SEQ ID NO: 3944187 - RNA, 21 nt, Human adenovirus F
cgcgcuucgccuccugguggc

SEQ ID NO: 3944188 - RNA, 16 nt, Human adenovirus F
cgcggacgucaagccc

SEQ ID NO: 3944189 - RNA, 14 nt, Human adenovirus F
cgcuaugugcagca

SEQ ID NO: 3944190 - RNA, 18 nt, Human adenovirus F
cgcucccaaucgaccuaa

SEQ ID NO: 3944191 - RNA, 15 nt, Human adenovirus F
cgcugaccagcagca

SEQ ID NO: 3944192 - RNA, 20 nt, Human adenovirus F
cgcugcgcuucgugcccguc

SEQ ID NO: 3944193 - RNA, 15 nt, Human adenovirus F
cgcuguacugugcau

SEQ ID NO: 3944194 - RNA, 21 nt, Human adenovirus F
cgcuugccacccgcgcaacac

SEQ ID NO: 3944195 - RNA, 17 nt, Human adenovirus F
cggaacccugccgcugc

SEQ ID NO: 3944196 - RNA, 23 nt, Human adenovirus F
cggaacccugccgcugcgcagca

SEQ ID NO: 3944197 - RNA, 22 nt, Human adenovirus F
cggaccugccccuacgugcaca

SEQ ID NO: 3944198 - RNA, 14 nt, Human adenovirus F
cggagacgagcugc

SEQ ID NO: 3944199 - RNA, 21 nt, Human adenovirus F
cggaggcaaaacuggaacgcg

SEQ ID NO: 3944200 - RNA, 17 nt, Human adenovirus F
cggaguaccugagcccg

SEQ ID NO: 3944201 - RNA, 13 nt, Human adenovirus F
cggcaaggaacca

SEQ ID NO: 3944202 - RNA, 21 nt, Human adenovirus F
cggcacgcuccuuggcgguga

SEQ ID NO: 3944203 - RNA, 18 nt, Human adenovirus F
cggccaaguagcauuuua

SEQ ID NO: 3944204 - RNA, 20 nt, Human adenovirus F
cggcggaugguggcaaggag

SEQ ID NO: 3944205 - RNA, 13 nt, Human adenovirus F
cggcgggaagagg

SEQ ID NO: 3944206 - RNA, 17 nt, Human adenovirus F
cggcgggugcaguggcg

SEQ ID NO: 3944207 - RNA, 22 nt, Human adenovirus F
cggcuggaaaauagccgccagc

SEQ ID NO: 3944208 - RNA, 19 nt, Human adenovirus F
cgggaagagaggcagcccc

SEQ ID NO: 3944209 - RNA, 13 nt, Human adenovirus F
cgggcaccggcac

SEQ ID NO: 3944210 - RNA, 14 nt, Human adenovirus F
cgggcaggagcccg

SEQ ID NO: 3944211 - RNA, 20 nt, Human adenovirus F
cgggcgguacuaaggcgggc

SEQ ID NO: 3944212 - RNA, 17 nt, Human adenovirus F
cgggcucuuggucagca

SEQ ID NO: 3944213 - RNA, 18 nt, Human adenovirus F
cggggcuaacuggcagag

SEQ ID NO: 3944214 - RNA, 20 nt, Human adenovirus F
cggguuuuauggcaccgcau

SEQ ID NO: 3944215 - RNA, 22 nt, Human adenovirus F
cgguggcggacgggucgcagca

SEQ ID NO: 3944216 - RNA, 22 nt, Human adenovirus F
cgguggcucugcagcagcgccc

SEQ ID NO: 3944217 - RNA, 14 nt, Human adenovirus F
cgguuccucgcaac

SEQ ID NO: 3944218 - RNA, 17 nt, Human adenovirus F
cgguuuggauccagugc

SEQ ID NO: 3944219 - RNA, 12 nt, Human adenovirus F
cguacacuggcu

SEQ ID NO: 3944220 - RNA, 11 nt, Human adenovirus F
cguagcagggu

SEQ ID NO: 3944221 - RNA, 17 nt, Human adenovirus F
cgucacuuccgccgcac

SEQ ID NO: 3944222 - RNA, 24 nt, Human adenovirus F
cgucagaacggcgugcuggaaagc

SEQ ID NO: 3944223 - RNA, 20 nt, Human adenovirus F
cgucagaauguggugggguc

SEQ ID NO: 3944224 - RNA, 15 nt, Human adenovirus F
cgucauccgccucca

SEQ ID NO: 3944225 - RNA, 18 nt, Human adenovirus F
cguccaguggagcaaggg

SEQ ID NO: 3944226 - RNA, 18 nt, Human adenovirus F
cgugcgcacccugguggc

SEQ ID NO: 3944227 - RNA, 15 nt, Human adenovirus F
cgugcuccugaagca

SEQ ID NO: 3944228 - RNA, 20 nt, Human adenovirus F
cguggccuugcaagcagcuc

SEQ ID NO: 3944229 - RNA, 23 nt, Human adenovirus F
cguguccgggcucuucaucacuu

SEQ ID NO: 3944230 - RNA, 13 nt, Human adenovirus F
cguuaggcuuuaa

SEQ ID NO: 3944231 - RNA, 21 nt, Human adenovirus F
cguucccgcccucacagauca

SEQ ID NO: 3944232 - RNA, 21 nt, Human adenovirus F
cguucccguaaaaaggagggc

SEQ ID NO: 3944233 - RNA, 16 nt, Human adenovirus F
cguucucuccccacag

SEQ ID NO: 3944234 - RNA, 17 nt, Human adenovirus F
cguuggagagcaguuug

SEQ ID NO: 3944235 - RNA, 20 nt, Human adenovirus F
cguuuaugggcaccuggaac

SEQ ID NO: 3944236 - RNA, 13 nt, Human adenovirus F
cuaaaaccaacaa

SEQ ID NO: 3944237 - RNA, 13 nt, Human adenovirus F
cuaaacucugagg

SEQ ID NO: 3944238 - RNA, 23 nt, Human adenovirus F
cuaaggacgguggcaugagggau

SEQ ID NO: 3944239 - RNA, 18 nt, Human adenovirus F
cuaaggacuucaccuaca

SEQ ID NO: 3944240 - RNA, 19 nt, Human adenovirus F
cuacaaaaggcgcacaaga

SEQ ID NO: 3944241 - RNA, 14 nt, Human adenovirus F
cuacccuucugugc

SEQ ID NO: 3944242 - RNA, 18 nt, Human adenovirus F
cuaccgcgaaugcccccc

SEQ ID NO: 3944243 - RNA, 13 nt, Human adenovirus F
cuacgccuccacc

SEQ ID NO: 3944244 - RNA, 17 nt, Human adenovirus F
cuagaaugucacugccg

SEQ ID NO: 3944245 - RNA, 16 nt, Human adenovirus F
cuagaccaacaaacga

SEQ ID NO: 3944246 - RNA, 16 nt, Human adenovirus F
cuagauaauaacuuuc

SEQ ID NO: 3944247 - RNA, 16 nt, Human adenovirus F
cuagccaacuauuugg

SEQ ID NO: 3944248 - RNA, 14 nt, Human adenovirus F
cuagcgugcccauu

SEQ ID NO: 3944249 - RNA, 22 nt, Human adenovirus F
cuaguagguuuucagguggggg

SEQ ID NO: 3944250 - RNA, 17 nt, Human adenovirus F
cuaguuuaauauugcuu

SEQ ID NO: 3944251 - RNA, 15 nt, Human adenovirus F
cuauaauagcaccaa

SEQ ID NO: 3944252 - RNA, 18 nt, Human adenovirus F
cuaucacuaaaaccaaca

SEQ ID NO: 3944253 - RNA, 12 nt, Human adenovirus F
cuaucugcaaaa

SEQ ID NO: 3944254 - RNA, 14 nt, Human adenovirus F
cuaucugcaaaaaa

SEQ ID NO: 3944255 - RNA, 16 nt, Human adenovirus F
cuauuacagcccccac

SEQ ID NO: 3944256 - RNA, 23 nt, Human adenovirus F
cuauuauccguuggaauuuuccu

SEQ ID NO: 3944257 - RNA, 20 nt, Human adenovirus F
cuauucugggacgcucuuau

SEQ ID NO: 3944258 - RNA, 23 nt, Human adenovirus F
cuauuugggaggggaggacgacg

SEQ ID NO: 3944259 - RNA, 14 nt, Human adenovirus F
cucaacuuuaacua

SEQ ID NO: 3944260 - RNA, 22 nt, Human adenovirus F
cucacagaucacggaacccugc

SEQ ID NO: 3944261 - RNA, 18 nt, Human adenovirus F
cucacccgcagcugcuug

SEQ ID NO: 3944262 - RNA, 22 nt, Human adenovirus F
cucagcgaacccaacuauuugg

SEQ ID NO: 3944263 - RNA, 18 nt, Human adenovirus F
cucaggauuacuccaguc

SEQ ID NO: 3944264 - RNA, 13 nt, Human adenovirus F
cucaucacugacu

SEQ ID NO: 3944265 - RNA, 12 nt, Human adenovirus F
cucauccaaauc

SEQ ID NO: 3944266 - RNA, 21 nt, Human adenovirus F
cuccaacguagagcucagcaa

SEQ ID NO: 3944267 - RNA, 12 nt, Human adenovirus F
cuccacccuuuc

SEQ ID NO: 3944268 - RNA, 16 nt, Human adenovirus F
cuccaggguaagcucg

SEQ ID NO: 3944269 - RNA, 18 nt, Human adenovirus F
cuccaguuuguggaggag

SEQ ID NO: 3944270 - RNA, 18 nt, Human adenovirus F
cuccauguggaaccaggc

SEQ ID NO: 3944271 - RNA, 17 nt, Human adenovirus F
cucccaauccuagccag

SEQ ID NO: 3944272 - RNA, 13 nt, Human adenovirus F
cucccauucauug

SEQ ID NO: 3944273 - RNA, 17 nt, Human adenovirus F
cucccugaacuaccaga

SEQ ID NO: 3944274 - RNA, 14 nt, Human adenovirus F
cucccuuuccagca

SEQ ID NO: 3944275 - RNA, 23 nt, Human adenovirus F
cuccgauuuugucccccucugcu

SEQ ID NO: 3944276 - RNA, 17 nt, Human adenovirus F
cuccuaacgccacuuuu

SEQ ID NO: 3944277 - RNA, 18 nt, Human adenovirus F
cuccucguuaagccacgu

SEQ ID NO: 3944278 - RNA, 17 nt, Human adenovirus F
cucgcccuauuccuccg

SEQ ID NO: 3944279 - RNA, 21 nt, Human adenovirus F
cucgcggccguuuaugggcac

SEQ ID NO: 3944280 - RNA, 23 nt, Human adenovirus F
cucuacgucaccuuacaccaccc

SEQ ID NO: 3944281 - RNA, 16 nt, Human adenovirus F
cucuauacgacaccac

SEQ ID NO: 3944282 - RNA, 14 nt, Human adenovirus F
cucugaacacuuuu

SEQ ID NO: 3944283 - RNA, 16 nt, Human adenovirus F
cucugcagcagcgccc

SEQ ID NO: 3944284 - RNA, 23 nt, Human adenovirus F
cucugugagcuggccugguaacg

SEQ ID NO: 3944285 - RNA, 17 nt, Human adenovirus F
cucuuaccuacacuuuu

SEQ ID NO: 3944286 - RNA, 18 nt, Human adenovirus F
cucuucaucccagccucg

SEQ ID NO: 3944287 - RNA, 15 nt, Human adenovirus F
cucuuccaagcugcg

SEQ ID NO: 3944288 - RNA, 12 nt, Human adenovirus F
cucuugcaggag

SEQ ID NO: 3944289 - RNA, 14 nt, Human adenovirus F
cucuuggacuagua

SEQ ID NO: 3944290 - RNA, 13 nt, Human adenovirus F
cucuugggcagga

SEQ ID NO: 3944291 - RNA, 22 nt, Human adenovirus F
cugaacccgguguacaccaccu

SEQ ID NO: 3944292 - RNA, 13 nt, Human adenovirus F
cugaacuuuuugc

SEQ ID NO: 3944293 - RNA, 15 nt, Human adenovirus F
cugaagacacauugg

SEQ ID NO: 3944294 - RNA, 11 nt, Human adenovirus F
cugaagaggaa

SEQ ID NO: 3944295 - RNA, 15 nt, Human adenovirus F
cugaagaggaacgua

SEQ ID NO: 3944296 - RNA, 23 nt, Human adenovirus F
cugaagcccgcaacggcgcagca

SEQ ID NO: 3944297 - RNA, 13 nt, Human adenovirus F
cugacagcuggga

SEQ ID NO: 3944298 - RNA, 15 nt, Human adenovirus F
cugaccagcagcagc

SEQ ID NO: 3944299 - RNA, 18 nt, Human adenovirus F
cugaccccauuacuacca

SEQ ID NO: 3944300 - RNA, 16 nt, Human adenovirus F
cugaccgaccuggggc

SEQ ID NO: 3944301 - RNA, 21 nt, Human adenovirus F
cugaccgaccuggggcaaaac

SEQ ID NO: 3944302 - RNA, 14 nt, Human adenovirus F
cugacgaagacauu

SEQ ID NO: 3944303 - RNA, 16 nt, Human adenovirus F
cugacggcgcagcugu

SEQ ID NO: 3944304 - RNA, 15 nt, Human adenovirus F
cugacuuccuggucc

SEQ ID NO: 3944305 - RNA, 20 nt, Human adenovirus F
cugagggccggccuggaccc

SEQ ID NO: 3944306 - RNA, 14 nt, Human adenovirus F
cugauuugagggua

SEQ ID NO: 3944307 - RNA, 20 nt, Human adenovirus F
cugcaaaaaagccgucugag

SEQ ID NO: 3944308 - RNA, 15 nt, Human adenovirus F
cugcacgcucuugcu

SEQ ID NO: 3944309 - RNA, 14 nt, Human adenovirus F
cugcagcauugcca

SEQ ID NO: 3944310 - RNA, 22 nt, Human adenovirus F
cugcagcgcacgcuggaggacg

SEQ ID NO: 3944311 - RNA, 13 nt, Human adenovirus F
cugcccuuccucc

SEQ ID NO: 3944312 - RNA, 15 nt, Human adenovirus F
cugccguugcaaccu

SEQ ID NO: 3944313 - RNA, 16 nt, Human adenovirus F
cugcuaaccugugcag

SEQ ID NO: 3944314 - RNA, 14 nt, Human adenovirus F
cugcuccuggcgag

SEQ ID NO: 3944315 - RNA, 12 nt, Human adenovirus F
cuggaaccacuu

SEQ ID NO: 3944316 - RNA, 17 nt, Human adenovirus F
cuggagggcgucaugcu

SEQ ID NO: 3944317 - RNA, 18 nt, Human adenovirus F
cuggauacuggcaagagc

SEQ ID NO: 3944318 - RNA, 20 nt, Human adenovirus F
cuggccaacugccaccucca

SEQ ID NO: 3944319 - RNA, 12 nt, Human adenovirus F
cugggacagccu

SEQ ID NO: 3944320 - RNA, 22 nt, Human adenovirus F
cugggacagcggaggcauuuua

SEQ ID NO: 3944321 - RNA, 13 nt, Human adenovirus F
cugggcggcggcc

SEQ ID NO: 3944322 - RNA, 16 nt, Human adenovirus F
cuggggaauggagcug

SEQ ID NO: 3944323 - RNA, 17 nt, Human adenovirus F
cuggggaauggagcugu

SEQ ID NO: 3944324 - RNA, 20 nt, Human adenovirus F
cugguuuccuauuacagccc

SEQ ID NO: 3944325 - RNA, 20 nt, Human adenovirus F
cuguaguauuuacucccgga

SEQ ID NO: 3944326 - RNA, 16 nt, Human adenovirus F
cugucaggcucugaga

SEQ ID NO: 3944327 - RNA, 19 nt, Human adenovirus F
cugucaggcucugagagug

SEQ ID NO: 3944328 - RNA, 21 nt, Human adenovirus F
cuguggacgacagccagcugu

SEQ ID NO: 3944329 - RNA, 21 nt, Human adenovirus F
cuguuccaacggugugccucu

SEQ ID NO: 3944330 - RNA, 17 nt, Human adenovirus F
cuguucuaaaaccaaac

SEQ ID NO: 3944331 - RNA, 14 nt, Human adenovirus F
cuuaaaggagcacu

SEQ ID NO: 3944332 - RNA, 15 nt, Human adenovirus F
cuuaauaaagacaca

SEQ ID NO: 3944333 - RNA, 14 nt, Human adenovirus F
cuuaccagagccau

SEQ ID NO: 3944334 - RNA, 20 nt, Human adenovirus F
cuuaggaagggggccaucga

SEQ ID NO: 3944335 - RNA, 21 nt, Human adenovirus F
cuuauuggcaugaguggggua

SEQ ID NO: 3944336 - RNA, 19 nt, Human adenovirus F
cuucaagcccuacaccaau

SEQ ID NO: 3944337 - RNA, 11 nt, Human adenovirus F
cuucagccugg

SEQ ID NO: 3944338 - RNA, 22 nt, Human adenovirus F
cuucaucacuuucuuccgcauc

SEQ ID NO: 3944339 - RNA, 15 nt, Human adenovirus F
cuuccucccaaagua

SEQ ID NO: 3944340 - RNA, 15 nt, Human adenovirus F
cuucgcccugaaagu

SEQ ID NO: 3944341 - RNA, 21 nt, Human adenovirus F
cuucgccgcagucucccaccu

SEQ ID NO: 3944342 - RNA, 23 nt, Human adenovirus F
cuucggcaggaaagccacgcucg

SEQ ID NO: 3944343 - RNA, 16 nt, Human adenovirus F
cuucgggagacggagg

SEQ ID NO: 3944344 - RNA, 14 nt, Human adenovirus F
cuucucgaggccaa

SEQ ID NO: 3944345 - RNA, 19 nt, Human adenovirus F
cuucuuaauaaagacacaa

SEQ ID NO: 3944346 - RNA, 20 nt, Human adenovirus F
cuugccacccgcgcaacaca

SEQ ID NO: 3944347 - RNA, 18 nt, Human adenovirus F
cuugcucggugcagccgu

SEQ ID NO: 3944348 - RNA, 13 nt, Human adenovirus F
cuugcugacuuau

SEQ ID NO: 3944349 - RNA, 10 nt, Human adenovirus F
cuugggcagg

SEQ ID NO: 3944350 - RNA, 15 nt, Human adenovirus F
cuuguccgcggggag

SEQ ID NO: 3944351 - RNA, 17 nt, Human adenovirus F
cuuguucgaaggcugcc

SEQ ID NO: 3944352 - RNA, 21 nt, Human adenovirus F
cuuuaacaacacaggagcuuu

SEQ ID NO: 3944353 - RNA, 12 nt, Human adenovirus F
cuuuaucuguaa

SEQ ID NO: 3944354 - RNA, 14 nt, Human adenovirus F
cuuuauugccaccg

SEQ ID NO: 3944355 - RNA, 21 nt, Human adenovirus F
cuuuauugccaccgcaaaaaa

SEQ ID NO: 3944356 - RNA, 21 nt, Human adenovirus F
cuuuauuuccuuugucaugua

SEQ ID NO: 3944357 - RNA, 12 nt, Human adenovirus F
cuuucuuacaac

SEQ ID NO: 3944358 - RNA, 15 nt, Human adenovirus F
cuuuugaugguggcu

SEQ ID NO: 3944359 - RNA, 15 nt, Human adenovirus F
gaaaaauuacagcca

SEQ ID NO: 3944360 - RNA, 12 nt, Human adenovirus F
gaaaaccccgcc

SEQ ID NO: 3944361 - RNA, 17 nt, Human adenovirus F
gaaaaccuacgcccagg

SEQ ID NO: 3944362 - RNA, 14 nt, Human adenovirus F
gaaacgagccagau

SEQ ID NO: 3944363 - RNA, 13 nt, Human adenovirus F
gaaacgcugugag

SEQ ID NO: 3944364 - RNA, 19 nt, Human adenovirus F
gaaaguagcucuuccaagc

SEQ ID NO: 3944365 - RNA, 13 nt, Human adenovirus F
gaaauugauuuuc

SEQ ID NO: 3944366 - RNA, 19 nt, Human adenovirus F
gaaauugugaucagaaauu

SEQ ID NO: 3944367 - RNA, 20 nt, Human adenovirus F
gaaauuugcugacagcuggg

SEQ ID NO: 3944368 - RNA, 16 nt, Human adenovirus F
gaacacuuuugccaaa

SEQ ID NO: 3944369 - RNA, 24 nt, Human adenovirus F
gaaccacuucgggagacggaggca

SEQ ID NO: 3944370 - RNA, 19 nt, Human adenovirus F
gaacccaacuauuugggag

SEQ ID NO: 3944371 - RNA, 14 nt, Human adenovirus F
gaaccggcgccgcu

SEQ ID NO: 3944372 - RNA, 21 nt, Human adenovirus F
gaagaacuggaguaacacaau

SEQ ID NO: 3944373 - RNA, 17 nt, Human adenovirus F
gaagagaggcagccccg

SEQ ID NO: 3944374 - RNA, 15 nt, Human adenovirus F
gaagagcaaaaccuc

SEQ ID NO: 3944375 - RNA, 19 nt, Human adenovirus F
gaagaugaggaggacuaug

SEQ ID NO: 3944376 - RNA, 14 nt, Human adenovirus F
gaagcacaggagau

SEQ ID NO: 3944377 - RNA, 23 nt, Human adenovirus F
gaaggcguggaaaaacuuggaaa

SEQ ID NO: 3944378 - RNA, 13 nt, Human adenovirus F
gaaucauuuccag

SEQ ID NO: 3944379 - RNA, 23 nt, Human adenovirus F
gaaucuaaccacuaccacccucc

SEQ ID NO: 3944380 - RNA, 13 nt, Human adenovirus F
gaaucuccugcac

SEQ ID NO: 3944381 - RNA, 18 nt, Human adenovirus F
gaauggagcuguggugcg

SEQ ID NO: 3944382 - RNA, 20 nt, Human adenovirus F
gaauuuggggcaucacucau

SEQ ID NO: 3944383 - RNA, 23 nt, Human adenovirus F
gaauuuguuauacaaguauacau

SEQ ID NO: 3944384 - RNA, 22 nt, Human adenovirus F
gacaacgaggcuuuccgcgagg

SEQ ID NO: 3944385 - RNA, 15 nt, Human adenovirus F
gacaagguggcggcc

SEQ ID NO: 3944386 - RNA, 13 nt, Human adenovirus F
gacagccagcugu

SEQ ID NO: 3944387 - RNA, 15 nt, Human adenovirus F
gacagcugggacagc

SEQ ID NO: 3944388 - RNA, 19 nt, Human adenovirus F
gacagucugccaacacuaa

SEQ ID NO: 3944389 - RNA, 13 nt, Human adenovirus F
gacauuguuuugc

SEQ ID NO: 3944390 - RNA, 20 nt, Human adenovirus F
gacauuguuuugcuaccugg

SEQ ID NO: 3944391 - RNA, 15 nt, Human adenovirus F
gaccgagcagcugcg

SEQ ID NO: 3944392 - RNA, 19 nt, Human adenovirus F
gaccguauucacaaagcug

SEQ ID NO: 3944393 - RNA, 17 nt, Human adenovirus F
gaccuaaacucugagga

SEQ ID NO: 3944394 - RNA, 23 nt, Human adenovirus F
gaccucagggucgauggagccag

SEQ ID NO: 3944395 - RNA, 17 nt, Human adenovirus F
gacgaauugcagcccac

SEQ ID NO: 3944396 - RNA, 14 nt, Human adenovirus F
gacgcuggaagagg

SEQ ID NO: 3944397 - RNA, 18 nt, Human adenovirus F
gacgcuugcuggaguugg

SEQ ID NO: 3944398 - RNA, 17 nt, Human adenovirus F
gacggcuuuggcuguac

SEQ ID NO: 3944399 - RNA, 23 nt, Human adenovirus F
gacgugccugagggcgacgacgg

SEQ ID NO: 3944400 - RNA, 14 nt, Human adenovirus F
gacgugugugugag

SEQ ID NO: 3944401 - RNA, 17 nt, Human adenovirus F
gacugggcggcggccau

SEQ ID NO: 3944402 - RNA, 20 nt, Human adenovirus F
gacuuuaccccgacagaggc

SEQ ID NO: 3944403 - RNA, 17 nt, Human adenovirus F
gacuuugcuccgccggc

SEQ ID NO: 3944404 - RNA, 18 nt, Human adenovirus F
gagacgugcggugggagu

SEQ ID NO: 3944405 - RNA, 22 nt, Human adenovirus F
gagaguugggacucuugcugga

SEQ ID NO: 3944406 - RNA, 22 nt, Human adenovirus F
gagaugcgccucaugagcuggg

SEQ ID NO: 3944407 - RNA, 23 nt, Human adenovirus F
gagauucaagggccagagcaaca

SEQ ID NO: 3944408 - RNA, 22 nt, Human adenovirus F
gagcaaacggugaacgaggagc

SEQ ID NO: 3944409 - RNA, 20 nt, Human adenovirus F
gagcagcgggaagagaggca

SEQ ID NO: 3944410 - RNA, 15 nt, Human adenovirus F
gagccacagguccag

SEQ ID NO: 3944411 - RNA, 20 nt, Human adenovirus F
gagcccccgugggggaccga

SEQ ID NO: 3944412 - RNA, 15 nt, Human adenovirus F
gagcccgggccuggu

SEQ ID NO: 3944413 - RNA, 14 nt, Human adenovirus F
gagccgccaggugg

SEQ ID NO: 3944414 - RNA, 15 nt, Human adenovirus F
gagcugggacagccu

SEQ ID NO: 3944415 - RNA, 16 nt, Human adenovirus F
gagcuuuuacugggac

SEQ ID NO: 3944416 - RNA, 14 nt, Human adenovirus F
gaggaggaggccau

SEQ ID NO: 3944417 - RNA, 14 nt, Human adenovirus F
gaggaggccauccu

SEQ ID NO: 3944418 - RNA, 20 nt, Human adenovirus F
gaggcauuuuagggcguaga

SEQ ID NO: 3944419 - RNA, 19 nt, Human adenovirus F
gaggccauccuggaccugg

SEQ ID NO: 3944420 - RNA, 20 nt, Human adenovirus F
gaggccgguacccagaccau

SEQ ID NO: 3944421 - RNA, 15 nt, Human adenovirus F
gaggcggaggagcag

SEQ ID NO: 3944422 - RNA, 16 nt, Human adenovirus F
gaggcuauuggccaga

SEQ ID NO: 3944423 - RNA, 19 nt, Human adenovirus F
gaggcuuuccgcgaggcca

SEQ ID NO: 3944424 - RNA, 21 nt, Human adenovirus F
gaggcuuuccgcgaggccaug

SEQ ID NO: 3944425 - RNA, 15 nt, Human adenovirus F
gagggcguuggagag

SEQ ID NO: 3944426 - RNA, 11 nt, Human adenovirus F
gagggcuucca

SEQ ID NO: 3944427 - RNA, 22 nt, Human adenovirus F
gagguguaccaguccgggccag

SEQ ID NO: 3944428 - RNA, 13 nt, Human adenovirus F
gaguuaaccuuga

SEQ ID NO: 3944429 - RNA, 19 nt, Human adenovirus F
gaguugucuugguaggcaa

SEQ ID NO: 3944430 - RNA, 21 nt, Human adenovirus F
gauaccgcugcagcugcugcc

SEQ ID NO: 3944431 - RNA, 23 nt, Human adenovirus F
gauauagccaaccaggccuugca

SEQ ID NO: 3944432 - RNA, 14 nt, Human adenovirus F
gaucagccaggugg

SEQ ID NO: 3944433 - RNA, 15 nt, Human adenovirus F
gauccauagagggcg

SEQ ID NO: 3944434 - RNA, 14 nt, Human adenovirus F
gaucguagacaacu

SEQ ID NO: 3944435 - RNA, 19 nt, Human adenovirus F
gaugaaacuugauuuccau

SEQ ID NO: 3944436 - RNA, 15 nt, Human adenovirus F
gaugauggagggaac

SEQ ID NO: 3944437 - RNA, 20 nt, Human adenovirus F
gaugaugucgugucugcgua

SEQ ID NO: 3944438 - RNA, 22 nt, Human adenovirus F
gaugcauuugugggacuuuaug

SEQ ID NO: 3944439 - RNA, 20 nt, Human adenovirus F
gaugcgccucaugagcuggg

SEQ ID NO: 3944440 - RNA, 11 nt, Human adenovirus F
gauggaguugu

SEQ ID NO: 3944441 - RNA, 11 nt, Human adenovirus F
gauggcagcag

SEQ ID NO: 3944442 - RNA, 16 nt, Human adenovirus F
gauggcgauggggccu

SEQ ID NO: 3944443 - RNA, 23 nt, Human adenovirus F
gaugguaaaaaugccaggcagca

SEQ ID NO: 3944444 - RNA, 14 nt, Human adenovirus F
gaugguggcaagga

SEQ ID NO: 3944445 - RNA, 22 nt, Human adenovirus F
uuggaagggaaggcguggaaaa

SEQ ID NO: 3944446 - RNA, 16 nt, Human adenovirus F
uuggaaugccugcagc

SEQ ID NO: 3944447 - RNA, 21 nt, Human adenovirus F
uuggagagcaguuuggcaaug

SEQ ID NO: 3944448 - RNA, 14 nt, Human adenovirus F
uugggggccuuuug

SEQ ID NO: 3944449 - RNA, 19 nt, Human adenovirus F
uuggucaaaaacucuguga

SEQ ID NO: 3944450 - RNA, 12 nt, Human adenovirus F
uuguaccaccuu

SEQ ID NO: 3944451 - RNA, 22 nt, Human adenovirus F
uugugaucagaaauuuagauuu

SEQ ID NO: 3944452 - RNA, 23 nt, Human adenovirus F
uuuaaaacuuuauggauguuuuc

SEQ ID NO: 3944453 - RNA, 14 nt, Human adenovirus F
uuuaaccuuaaaau

SEQ ID NO: 3944454 - RNA, 11 nt, Human adenovirus F
uuuaauacagu

SEQ ID NO: 3944455 - RNA, 16 nt, Human adenovirus F
uuuaugcccaacagua

SEQ ID NO: 3944456 - RNA, 19 nt, Human adenovirus F
uuucaccgccuuggccagc

SEQ ID NO: 3944457 - RNA, 22 nt, Human adenovirus F
uuucacguaguaucucaucccc

SEQ ID NO: 3944458 - RNA, 18 nt, Human adenovirus F
uuuccaugcacucaucca

SEQ ID NO: 3944459 - RNA, 12 nt, Human adenovirus F
uuucccagaguu

SEQ ID NO: 3944460 - RNA, 23 nt, Human adenovirus F
uuugcaucucaaagcuggagcuc

SEQ ID NO: 3944461 - RNA, 16 nt, Human adenovirus F
uuuggacccccaaacc

SEQ ID NO: 3944462 - RNA, 20 nt, Human adenovirus F
uuugguaacaaggccuggaa

SEQ ID NO: 3944463 - RNA, 20 nt, Human adenovirus F
uuuuacgcggggcaggagcu

SEQ ID NO: 3944464 - RNA, 12 nt, Human adenovirus F
uuuuaugaagac

SEQ ID NO: 3944465 - RNA, 21 nt, Human adenovirus F
uuuucagguggggggucggcg

SEQ ID NO: 3944466 - RNA, 16 nt, Human adenovirus F
uuuuccagcaacuuua

SEQ ID NO: 3944467 - RNA, 20 nt, Human adenovirus F
uuuugaugaagcgugguaaa

SEQ ID NO: 3944468 - RNA, 18 nt, Human adenovirus F
uuuuugagcaugaaacug

SEQ ID NO: 3944469 - RNA, 17 nt, Human adenovirus F
uacuggauacuggcaag

SEQ ID NO: 3944470 - RNA, 23 nt, Human adenovirus F
uacuucuucagcucuaagacugu

SEQ ID NO: 3944471 - RNA, 22 nt, Human adenovirus F
uagaaaacgaaaacuuaacccu

SEQ ID NO: 3944472 - RNA, 13 nt, Human adenovirus F
uagccaaccaggc

SEQ ID NO: 3944473 - RNA, 14 nt, Human adenovirus F
uagcucugaacacu

SEQ ID NO: 3944474 - RNA, 15 nt, Human adenovirus F
uagcucuuccaagcu

SEQ ID NO: 3944475 - RNA, 13 nt, Human adenovirus F
uagcuggagggca

SEQ ID NO: 3944476 - RNA, 15 nt, Human adenovirus F
uaggaccacuggagg

SEQ ID NO: 3944477 - RNA, 14 nt, Human adenovirus F
uaggcauacaggcu

SEQ ID NO: 3944478 - RNA, 16 nt, Human adenovirus F
uagggugucugccaga

SEQ ID NO: 3944479 - RNA, 14 nt, Human adenovirus F
uaucacgcccacca

SEQ ID NO: 3944480 - RNA, 18 nt, Human adenovirus F
uaucccgccccugccacc

SEQ ID NO: 3944481 - RNA, 12 nt, Human adenovirus F
uaucuugcaaaa

SEQ ID NO: 3944482 - RNA, 15 nt, Human adenovirus F
uaugggagucuggca

SEQ ID NO: 3944483 - RNA, 23 nt, Human adenovirus F
uauguuagcgaaaacggaaacaa

SEQ ID NO: 3944484 - RNA, 12 nt, Human adenovirus F
uauuacaaaugc

SEQ ID NO: 3944485 - RNA, 22 nt, Human adenovirus F
uauuucuuugucuaacuaaaaa

SEQ ID NO: 3944486 - RNA, 19 nt, Human adenovirus F
uauuuguauaaucuuaaaa

SEQ ID NO: 3944487 - RNA, 20 nt, Human adenovirus F
ucaaacaaccagcgcucuac

SEQ ID NO: 3944488 - RNA, 13 nt, Human adenovirus F
ucaaacaggaaga

SEQ ID NO: 3944489 - RNA, 17 nt, Human adenovirus F
ucaagcccgacauuaag

SEQ ID NO: 3944490 - RNA, 16 nt, Human adenovirus F
ucaaguuugguagcaa

SEQ ID NO: 3944491 - RNA, 13 nt, Human adenovirus F
ucaaucagcggcu

SEQ ID NO: 3944492 - RNA, 16 nt, Human adenovirus F
ucacaacaccgcuucc

SEQ ID NO: 3944493 - RNA, 19 nt, Human adenovirus F
ucacaacaccgcuuccacc

SEQ ID NO: 3944494 - RNA, 14 nt, Human adenovirus F
ucaccuacuaccac

SEQ ID NO: 3944495 - RNA, 14 nt, Human adenovirus F
ucaccuacucuggc

SEQ ID NO: 3944496 - RNA, 17 nt, Human adenovirus F
ucacggaacccugccgc

SEQ ID NO: 3944497 - RNA, 18 nt, Human adenovirus F
ucacucuccgccgccgcu

SEQ ID NO: 3944498 - RNA, 18 nt, Human adenovirus F
ucacugacgcccgccguc

SEQ ID NO: 3944499 - RNA, 18 nt, Human adenovirus F
ucacuuugccagagggca

SEQ ID NO: 3944500 - RNA, 19 nt, Human adenovirus F
ucagaucagcgggcacaga

SEQ ID NO: 3944501 - RNA, 18 nt, Human adenovirus F
ucagcgcgugaccaucac

SEQ ID NO: 3944502 - RNA, 12 nt, Human adenovirus F
ucaggcagcagc

SEQ ID NO: 3944503 - RNA, 13 nt, Human adenovirus F
ucaggguguuuug

SEQ ID NO: 3944504 - RNA, 14 nt, Human adenovirus F
ucauacaaaugcuc

SEQ ID NO: 3944505 - RNA, 19 nt, Human adenovirus F
ucauggcguggaagacgag

SEQ ID NO: 3944506 - RNA, 23 nt, Human adenovirus F
ucaugucccaccacauuggccac

SEQ ID NO: 3944507 - RNA, 19 nt, Human adenovirus F
uccaaaggucagaaaaacc

SEQ ID NO: 3944508 - RNA, 19 nt, Human adenovirus F
uccaaaucauugcauauaa

SEQ ID NO: 3944509 - RNA, 24 nt, Human adenovirus F
uccaaauuuuuaugaaacacacau

SEQ ID NO: 3944510 - RNA, 16 nt, Human adenovirus F
uccaagcgucuuacau

SEQ ID NO: 3944511 - RNA, 13 nt, Human adenovirus F
uccacaaaaacuc

SEQ ID NO: 3944512 - RNA, 14 nt, Human adenovirus F
uccacgcucccgga

SEQ ID NO: 3944513 - RNA, 16 nt, Human adenovirus F
uccagcaacuuuaugu

SEQ ID NO: 3944514 - RNA, 20 nt, Human adenovirus F
uccagcauaauaacucuggc

SEQ ID NO: 3944515 - RNA, 22 nt, Human adenovirus F
uccaggcuaaaacaaaggaggc

SEQ ID NO: 3944516 - RNA, 21 nt, Human adenovirus F
uccagugcaggaagaggagga

SEQ ID NO: 3944517 - RNA, 18 nt, Human adenovirus F
uccauaaacuccucuucc

SEQ ID NO: 3944518 - RNA, 22 nt, Human adenovirus F
uccauaccagaguaacuuuugc

SEQ ID NO: 3944519 - RNA, 23 nt, Human adenovirus F
uccaucgccggaucgccaacagc

SEQ ID NO: 3944520 - RNA, 23 nt, Human adenovirus F
ucccaaagucccccuuacagccu

SEQ ID NO: 3944521 - RNA, 14 nt, Human adenovirus F
ucccaaagugcugu

SEQ ID NO: 3944522 - RNA, 14 nt, Human adenovirus F
ucccaggcggaaac

SEQ ID NO: 3944523 - RNA, 21 nt, Human adenovirus F
ucccgaagccuucaggcagca

SEQ ID NO: 3944524 - RNA, 15 nt, Human adenovirus F
ucccgccccugccac

SEQ ID NO: 3944525 - RNA, 19 nt, Human adenovirus F
ucccgccccugccaccgca

SEQ ID NO: 3944526 - RNA, 15 nt, Human adenovirus F
ucccgcccucacaga

SEQ ID NO: 3944527 - RNA, 16 nt, Human adenovirus F
uccgaaacuuccaacc

SEQ ID NO: 3944528 - RNA, 18 nt, Human adenovirus F
uccgaccauuaccaccgu

SEQ ID NO: 3944529 - RNA, 14 nt, Human adenovirus F
uccgccuccacccu

SEQ ID NO: 3944530 - RNA, 23 nt, Human adenovirus F
uccggguugggcgcuugccaggg

SEQ ID NO: 3944531 - RNA, 12 nt, Human adenovirus F
uccucccaaagu

SEQ ID NO: 3944532 - RNA, 17 nt, Human adenovirus F
uccuccuucacaaaguc

SEQ ID NO: 3944533 - RNA, 16 nt, Human adenovirus F
uccucguuguuuuccu

SEQ ID NO: 3944534 - RNA, 17 nt, Human adenovirus F
uccugacuauuuuaugc

SEQ ID NO: 3944535 - RNA, 21 nt, Human adenovirus F
uccuggcgagcccauaaaagc

SEQ ID NO: 3944536 - RNA, 20 nt, Human adenovirus F
uccugucgccccugccaacu

SEQ ID NO: 3944537 - RNA, 21 nt, Human adenovirus F
uccuuaacaagggcuuccucc

SEQ ID NO: 3944538 - RNA, 13 nt, Human adenovirus F
uccuuaaggagga

SEQ ID NO: 3944539 - RNA, 21 nt, Human adenovirus F
uccuuauucucaccuggcaaa

SEQ ID NO: 3944540 - RNA, 11 nt, Human adenovirus F
ucgauuuccau

SEQ ID NO: 3944541 - RNA, 20 nt, Human adenovirus F
ucgcaaacaaagaaguacau

SEQ ID NO: 3944542 - RNA, 19 nt, Human adenovirus F
ucgcagaaacaugccaccc

SEQ ID NO: 3944543 - RNA, 16 nt, Human adenovirus F
ucgcagaaucuccugc

SEQ ID NO: 3944544 - RNA, 14 nt, Human adenovirus F
ucgcagcgggcagg

SEQ ID NO: 3944545 - RNA, 15 nt, Human adenovirus F
ucgcaugccuccagc

SEQ ID NO: 3944546 - RNA, 20 nt, Human adenovirus F
ucgccaacagccccagcugg

SEQ ID NO: 3944547 - RNA, 16 nt, Human adenovirus F
ucgccccugugagugu

SEQ ID NO: 3944548 - RNA, 23 nt, Human adenovirus F
ucgcgcaacggcaaucccagcag

SEQ ID NO: 3944549 - RNA, 16 nt, Human adenovirus F
ucgcucuguccgccgc

SEQ ID NO: 3944550 - RNA, 19 nt, Human adenovirus F
ucggagccaaccuccgaaa

SEQ ID NO: 3944551 - RNA, 14 nt, Human adenovirus F
ucggcaccagccag

SEQ ID NO: 3944552 - RNA, 14 nt, Human adenovirus F
ucgugucugcguac

SEQ ID NO: 3944553 - RNA, 21 nt, Human adenovirus F
ucuaagggaacuucuccccuu

SEQ ID NO: 3944554 - RNA, 20 nt, Human adenovirus F
ucuaagggaggcagcagagg

SEQ ID NO: 3944555 - RNA, 13 nt, Human adenovirus F
ucuaccacagaaa

SEQ ID NO: 3944556 - RNA, 15 nt, Human adenovirus F
ucuaggcauaaaguu

SEQ ID NO: 3944557 - RNA, 16 nt, Human adenovirus F
ucuauggcccugccgc

SEQ ID NO: 3944558 - RNA, 17 nt, Human adenovirus F
ucucagcaguugcaaga

SEQ ID NO: 3944559 - RNA, 12 nt, Human adenovirus F
ucugacaaacac

SEQ ID NO: 3944560 - RNA, 14 nt, Human adenovirus F
ucugagaguguuuc

SEQ ID NO: 3944561 - RNA, 18 nt, Human adenovirus F
ucugagcacauugccagc

SEQ ID NO: 3944562 - RNA, 19 nt, Human adenovirus F
ucugcaccugcacgcucuu

SEQ ID NO: 3944563 - RNA, 21 nt, Human adenovirus F
ucugcaucucuugaaugaggu

SEQ ID NO: 3944564 - RNA, 17 nt, Human adenovirus F
ucugcuuaacccucccg

SEQ ID NO: 3944565 - RNA, 15 nt, Human adenovirus F
ucuguccgccgccgc

SEQ ID NO: 3944566 - RNA, 18 nt, Human adenovirus F
ucuuaaguuauacaguga

SEQ ID NO: 3944567 - RNA, 13 nt, Human adenovirus F
ucuuauggaagac

SEQ ID NO: 3944568 - RNA, 22 nt, Human adenovirus F
ucuuccaccgguccuagaccug

SEQ ID NO: 3944569 - RNA, 21 nt, Human adenovirus F
ucuucggcaggaaagccacgc

SEQ ID NO: 3944570 - RNA, 15 nt, Human adenovirus F
ucuugagcaggccgc

SEQ ID NO: 3944571 - RNA, 15 nt, Human adenovirus F
ucuugucguaaccaa

SEQ ID NO: 3944572 - RNA, 13 nt, Human adenovirus F
ucuuuacccagac

SEQ ID NO: 3944573 - RNA, 11 nt, Human adenovirus F
ucuuugccacc

SEQ ID NO: 3944574 - RNA, 21 nt, Human adenovirus F
ucuuugggguccggguuugau

SEQ ID NO: 3944575 - RNA, 13 nt, Human adenovirus F
ugaacccacccuc

SEQ ID NO: 3944576 - RNA, 17 nt, Human adenovirus F
ugaagcccgcaacggcg

SEQ ID NO: 3944577 - RNA, 15 nt, Human adenovirus F
ugacaaacaagcugu

SEQ ID NO: 3944578 - RNA, 16 nt, Human adenovirus F
ugacauuccuccgccu

SEQ ID NO: 3944579 - RNA, 18 nt, Human adenovirus F
ugacccacaaucuucauc

SEQ ID NO: 3944580 - RNA, 19 nt, Human adenovirus F
ugaccccaaugacaggcug

SEQ ID NO: 3944581 - RNA, 15 nt, Human adenovirus F
ugaccgagcagcugc

SEQ ID NO: 3944582 - RNA, 15 nt, Human adenovirus F
ugaccggcgcuggga

SEQ ID NO: 3944583 - RNA, 17 nt, Human adenovirus F
ugacggagucuuucagc

SEQ ID NO: 3944584 - RNA, 14 nt, Human adenovirus F
ugacggcgcagcug

SEQ ID NO: 3944585 - RNA, 16 nt, Human adenovirus F
ugacgguaaaggggcg

SEQ ID NO: 3944586 - RNA, 23 nt, Human adenovirus F
ugacuucaaccccgucuacccuu

SEQ ID NO: 3944587 - RNA, 23 nt, Human adenovirus F
ugacuuuaccccgacagaggccg

SEQ ID NO: 3944588 - RNA, 23 nt, Human adenovirus F
ugagauuuguaguggagggauuu

SEQ ID NO: 3944589 - RNA, 18 nt, Human adenovirus F
ugagcaaagacauuccca

SEQ ID NO: 3944590 - RNA, 18 nt, Human adenovirus F
ugagcaagcgcaaguuca

SEQ ID NO: 3944591 - RNA, 18 nt, Human adenovirus F
ugagcaggccgcccaaca

SEQ ID NO: 3944592 - RNA, 17 nt, Human adenovirus F
ugaggauuuggagggcg

SEQ ID NO: 3944593 - RNA, 15 nt, Human adenovirus F
ugagggucgcuggcu

SEQ ID NO: 3944594 - RNA, 21 nt, Human adenovirus F
ugaguugguagcagugucaau

SEQ ID NO: 3944595 - RNA, 17 nt, Human adenovirus F
ugaucccgaagagggua

SEQ ID NO: 3944596 - RNA, 20 nt, Human adenovirus F
ugaucccgaagaggguacua

SEQ ID NO: 3944597 - RNA, 22 nt, Human adenovirus F
ugaugccgcaauggucuuacau

SEQ ID NO: 3944598 - RNA, 19 nt, Human adenovirus F
ugauucuccaaagcagucu

SEQ ID NO: 3944599 - RNA, 16 nt, Human adenovirus F
ugcaaaacaauucucu

SEQ ID NO: 3944600 - RNA, 20 nt, Human adenovirus F
ugcaaaaugugcagcaaaaa

SEQ ID NO: 3944601 - RNA, 20 nt, Human adenovirus F
ugcaaacgagaggaccacuu

SEQ ID NO: 3944602 - RNA, 17 nt, Human adenovirus F
ugcacacaugcuuuucc

SEQ ID NO: 3944603 - RNA, 21 nt, Human adenovirus F
ugcaguccacuuaacagcucc

SEQ ID NO: 3944604 - RNA, 16 nt, Human adenovirus F
ugcauacaacucccug

SEQ ID NO: 3944605 - RNA, 13 nt, Human adenovirus F
ugcauguuggaaa

SEQ ID NO: 3944606 - RNA, 15 nt, Human adenovirus F
ugcauuauggccaug

SEQ ID NO: 3944607 - RNA, 14 nt, Human adenovirus F
ugcauuuuggccug

SEQ ID NO: 3944608 - RNA, 16 nt, Human adenovirus F
ugccaaaguggcucuu

SEQ ID NO: 3944609 - RNA, 13 nt, Human adenovirus F
ugccaacaaaugu

SEQ ID NO: 3944610 - RNA, 18 nt, Human adenovirus F
ugccaccgcaaccauguu

SEQ ID NO: 3944611 - RNA, 22 nt, Human adenovirus F
ugccagaacuuccagcuguugg

SEQ ID NO: 3944612 - RNA, 13 nt, Human adenovirus F
ugccaggcagcag

SEQ ID NO: 3944613 - RNA, 18 nt, Human adenovirus F
ugccauacgggagggaca

SEQ ID NO: 3944614 - RNA, 16 nt, Human adenovirus F
ugcccaccguuccgcc

SEQ ID NO: 3944615 - RNA, 23 nt, Human adenovirus F
ugccccccggcggcgggugcagu

SEQ ID NO: 3944616 - RNA, 21 nt, Human adenovirus F
ugcccgccagcuggcaaaccu

SEQ ID NO: 3944617 - RNA, 19 nt, Human adenovirus F
ugccgcaauggucuuacau

SEQ ID NO: 3944618 - RNA, 20 nt, Human adenovirus F
ugccgcgcgggcaggaggac

SEQ ID NO: 3944619 - RNA, 15 nt, Human adenovirus F
ugccgcggacgucaa

SEQ ID NO: 3944620 - RNA, 14 nt, Human adenovirus F
ugccuccagcacug

SEQ ID NO: 3944621 - RNA, 22 nt, Human adenovirus F
ugccuccguguuuuuugaugcg

SEQ ID NO: 3944622 - RNA, 23 nt, Human adenovirus F
ugccuuaacauuuaugcccaaca

SEQ ID NO: 3944623 - RNA, 20 nt, Human adenovirus F
ugccuuggaaucauccaccu

SEQ ID NO: 3944624 - RNA, 20 nt, Human adenovirus F
ugccuuuucacauccaagug

SEQ ID NO: 3944625 - RNA, 14 nt, Human adenovirus F
ugcggagccugagg

SEQ ID NO: 3944626 - RNA, 19 nt, Human adenovirus F
ugcggugccugaagcacug

SEQ ID NO: 3944627 - RNA, 14 nt, Human adenovirus F
ugcuaacccucaaa

SEQ ID NO: 3944628 - RNA, 17 nt, Human adenovirus F
ugcucccaaagugcugu

SEQ ID NO: 3944629 - RNA, 22 nt, Human adenovirus F
ugcugaauauugcggagccuga

SEQ ID NO: 3944630 - RNA, 14 nt, Human adenovirus F
ugcuuagacccggc

SEQ ID NO: 3944631 - RNA, 13 nt, Human adenovirus F
uggaaagccuggu

SEQ ID NO: 3944632 - RNA, 19 nt, Human adenovirus F
uggaacgagaucggcacca

SEQ ID NO: 3944633 - RNA, 14 nt, Human adenovirus F
uggaacgcaguguu

SEQ ID NO: 3944634 - RNA, 14 nt, Human adenovirus F
uggaaucagcaucu

SEQ ID NO: 3944635 - RNA, 16 nt, Human adenovirus F
uggaauuacugccagu

SEQ ID NO: 3944636 - RNA, 14 nt, Human adenovirus F
uggacauggccagc

SEQ ID NO: 3944637 - RNA, 18 nt, Human adenovirus F
uggaccuggaagagggcg

SEQ ID NO: 3944638 - RNA, 22 nt, Human adenovirus F
uggaggagauggugggccgcug

SEQ ID NO: 3944639 - RNA, 13 nt, Human adenovirus F
uggaggagcuguc

SEQ ID NO: 3944640 - RNA, 11 nt, Human adenovirus F
uggaggcagcu

SEQ ID NO: 3944641 - RNA, 19 nt, Human adenovirus F
uggaggcuugggaggauuu

SEQ ID NO: 3944642 - RNA, 14 nt, Human adenovirus F
uggaguuguggagu

SEQ ID NO: 3944643 - RNA, 14 nt, Human adenovirus F
uggauacuggcaag

SEQ ID NO: 3944644 - RNA, 13 nt, Human adenovirus F
uggaugagcccac

SEQ ID NO: 3944645 - RNA, 16 nt, Human adenovirus F
uggaugcauccuccca

SEQ ID NO: 3944646 - RNA, 16 nt, Human adenovirus F
uggauguuuuccaaga

SEQ ID NO: 3944647 - RNA, 18 nt, Human adenovirus F
uggcaacccugaggagga

SEQ ID NO: 3944648 - RNA, 21 nt, Human adenovirus F
uggcaaugugcucgcaaacaa

SEQ ID NO: 3944649 - RNA, 13 nt, Human adenovirus F
uggcacagcucac

SEQ ID NO: 3944650 - RNA, 22 nt, Human adenovirus F
uggccuuuugaacgaccugcac

SEQ ID NO: 3944651 - RNA, 22 nt, Human adenovirus F
uggcgcauucccuuuuccagca

SEQ ID NO: 3944652 - RNA, 19 nt, Human adenovirus F
uggcgguggucacucucag

SEQ ID NO: 3944653 - RNA, 17 nt, Human adenovirus F
uggcuuuuggaccuggu

SEQ ID NO: 3944654 - RNA, 22 nt, Human adenovirus F
ugggaaggggccagcaagcugc

SEQ ID NO: 3944655 - RNA, 14 nt, Human adenovirus F
ugggacagcaggcc

SEQ ID NO: 3944656 - RNA, 14 nt, Human adenovirus F
ugggacgacagcca

SEQ ID NO: 3944657 - RNA, 18 nt, Human adenovirus F
ugggaggggaggacgacg

SEQ ID NO: 3944658 - RNA, 17 nt, Human adenovirus F
ugggagucuggcagcag

SEQ ID NO: 3944659 - RNA, 17 nt, Human adenovirus F
ugggaguugcgcgccgc

SEQ ID NO: 3944660 - RNA, 14 nt, Human adenovirus F
ugggcguccagugg

SEQ ID NO: 3944661 - RNA, 16 nt, Human adenovirus F
uggggcggcgaccuga

SEQ ID NO: 3944662 - RNA, 20 nt, Human adenovirus F
uggugaauaagcgucggcgc

SEQ ID NO: 3944663 - RNA, 14 nt, Human adenovirus F
ugguggggaguucu

SEQ ID NO: 3944664 - RNA, 22 nt, Human adenovirus F
uguaacaucccucacuaccauu

SEQ ID NO: 3944665 - RNA, 21 nt, Human adenovirus F
uguaacucucccuuuccagca

SEQ ID NO: 3944666 - RNA, 21 nt, Human adenovirus F
uguacaaagucauccaaauca

SEQ ID NO: 3944667 - RNA, 13 nt, Human adenovirus F
ugucaacggcaca

SEQ ID NO: 3944668 - RNA, 17 nt, Human adenovirus F
ugucguugccagccggu

SEQ ID NO: 3944669 - RNA, 20 nt, Human adenovirus F
ugucugccaaaauggcucug

SEQ ID NO: 3944670 - RNA, 15 nt, Human adenovirus F
ugugagcuggccugg

SEQ ID NO: 3944671 - RNA, 14 nt, Human adenovirus F
ugugaguguggagc

SEQ ID NO: 3944672 - RNA, 21 nt, Human adenovirus F
ugugccauuguuaacacggcg

SEQ ID NO: 3944673 - RNA, 21 nt, Human adenovirus F
uguggacgacagccagcuguu

SEQ ID NO: 3944674 - RNA, 18 nt, Human adenovirus F
uguggggcgugcgagccc

SEQ ID NO: 3944675 - RNA, 17 nt, Human adenovirus F
uguuaucacccaaagcc

SEQ ID NO: 3944676 - RNA, 19 nt, Human adenovirus F
uuacaaaaagagaaucuaa

SEQ ID NO: 3944677 - RNA, 19 nt, Human adenovirus F
uuaccacugccacugaaac

SEQ ID NO: 3944678 - RNA, 17 nt, Human adenovirus F
uuacgcggggcaggagc

SEQ ID NO: 3944679 - RNA, 14 nt, Human adenovirus F
uuagcgaaaacgga

SEQ ID NO: 3944680 - RNA, 14 nt, Human adenovirus F
uuagcucugaacac

SEQ ID NO: 3944681 - RNA, 17 nt, Human adenovirus F
uuaggccaucggccaug

SEQ ID NO: 3944682 - RNA, 12 nt, Human adenovirus F
uuauugccaccg

SEQ ID NO: 3944683 - RNA, 19 nt, Human adenovirus F
uuauuguucaaggaaacaa

SEQ ID NO: 3944684 - RNA, 15 nt, Human adenovirus F
uucaaagaagagcug

SEQ ID NO: 3944685 - RNA, 15 nt, Human adenovirus F
uucaagcccuacacc

SEQ ID NO: 3944686 - RNA, 20 nt, Human adenovirus F
uucaccuuuuuacccugacc

SEQ ID NO: 3944687 - RNA, 12 nt, Human adenovirus F
uucacugaaagc

SEQ ID NO: 3944688 - RNA, 23 nt, Human adenovirus F
uucagacgaggaggcggaggagc

SEQ ID NO: 3944689 - RNA, 13 nt, Human adenovirus F
uuccacuggcaac

SEQ ID NO: 3944690 - RNA, 20 nt, Human adenovirus F
uucccgguccauacuugugc

SEQ ID NO: 3944691 - RNA, 15 nt, Human adenovirus F
uuccucuucucuguc

SEQ ID NO: 3944692 - RNA, 16 nt, Human adenovirus F
uucgcauuucuuuuuu

SEQ ID NO: 3944693 - RNA, 17 nt, Human adenovirus F
uucgcccggacacuauu

SEQ ID NO: 3944694 - RNA, 19 nt, Human adenovirus F
uucgucaggccugcaagau

SEQ ID NO: 3944695 - RNA, 16 nt, Human adenovirus F
uucugagucuaccacu

SEQ ID NO: 3944696 - RNA, 22 nt, Human adenovirus F
uucuguuauggaucaagugcuu

SEQ ID NO: 3944697 - RNA, 16 nt, Human adenovirus F
uucuuuuugggaggaa

SEQ ID NO: 3944698 - RNA, 17 nt, Human adenovirus F
uugauauuuaucugccc

SEQ ID NO: 3944699 - RNA, 14 nt, Human adenovirus F
uugcaaaaccaaau

SEQ ID NO: 3944700 - RNA, 22 nt, Human adenovirus F
uugcacuuaacuguucuugucg

SEQ ID NO: 3944701 - RNA, 17 nt, Human adenovirus F
uugcaugguguguuuuu

SEQ ID NO: 3944702 - RNA, 15 nt, Human adenovirus F
uugccgcagccagug

SEQ ID NO: 3944703 - RNA, 15 nt, Human adenovirus F
uugcgcgaacagagu

SEQ ID NO: 3944704 - RNA, 17 nt, Human adenovirus F
uugcgucgcuggcuccg

SEQ ID NO: 3944705 - RNA, 22 nt, Human adenovirus F
uugcuauugaaaauaacucacu

SEQ ID NO: 3944706 - RNA, 16 nt, Human adenovirus F
uugcucucuccggagc

SEQ ID NO: 3944707 - RNA, 14 nt, Human adenovirus F
aagacaccaguagc

SEQ ID NO: 3944708 - RNA, 21 nt, Human adenovirus F
aagacgacuucaaccccgucu

SEQ ID NO: 3944709 - RNA, 14 nt, Human adenovirus F
aagagaaagaugga

SEQ ID NO: 3944710 - RNA, 13 nt, Human adenovirus F
aagaucagguucc

SEQ ID NO: 3944711 - RNA, 16 nt, Human adenovirus F
aagauggcgugggagu

SEQ ID NO: 3944712 - RNA, 19 nt, Human adenovirus F
aagccacaauaagcagcuu

SEQ ID NO: 3944713 - RNA, 17 nt, Human adenovirus F
aagccucucgcucugca

SEQ ID NO: 3944714 - RNA, 20 nt, Human adenovirus F
aagcuacaaggacaggaugu

SEQ ID NO: 3944715 - RNA, 19 nt, Human adenovirus F
aagcucgcgcacagcuucg

SEQ ID NO: 3944716 - RNA, 22 nt, Human adenovirus F
aagcucgucauaggccauuuug

SEQ ID NO: 3944717 - RNA, 13 nt, Human adenovirus F
aagcugccccguc

SEQ ID NO: 3944718 - RNA, 21 nt, Human adenovirus F
aagcugggauuugccgcagcc

SEQ ID NO: 3944719 - RNA, 22 nt, Human adenovirus F
aagcuucuaucugcaaaaaagc

SEQ ID NO: 3944720 - RNA, 16 nt, Human adenovirus F
aaggacgguggcauga

SEQ ID NO: 3944721 - RNA, 17 nt, Human adenovirus F
aaggcccauaccaaaga

SEQ ID NO: 3944722 - RNA, 22 nt, Human adenovirus F
aaggcuggcacacgcacuucaa

SEQ ID NO: 3944723 - RNA, 11 nt, Human adenovirus F
aagggcaaagg

SEQ ID NO: 3944724 - RNA, 17 nt, Human adenovirus F
aaggggcgcgcuccggg

SEQ ID NO: 3944725 - RNA, 19 nt, Human adenovirus F
aaggugggcauaacuucag

SEQ ID NO: 3944726 - RNA, 22 nt, Human adenovirus F
aaguauacauuugaacagcuga

SEQ ID NO: 3944727 - RNA, 15 nt, Human adenovirus F
aaguauuacaaaugc

SEQ ID NO: 3944728 - RNA, 16 nt, Human adenovirus F
aagucauccaaaucau

SEQ ID NO: 3944729 - RNA, 20 nt, Human adenovirus F
aaguccacaaaaacuccaaa

SEQ ID NO: 3944730 - RNA, 13 nt, Human adenovirus F
aaguuaccaaaga

SEQ ID NO: 3944731 - RNA, 15 nt, Human adenovirus F
aaguuaccaaagaca

SEQ ID NO: 3944732 - RNA, 20 nt, Human adenovirus F
aaguuaccaaagacaaaauc

SEQ ID NO: 3944733 - RNA, 12 nt, Human adenovirus F
aauacaauuuuu

SEQ ID NO: 3944734 - RNA, 15 nt, Human adenovirus F
aauagacgccccacu

SEQ ID NO: 3944735 - RNA, 20 nt, Human adenovirus F
aauauuuauacacucccuuu

SEQ ID NO: 3944736 - RNA, 17 nt, Human adenovirus F
aaucagcggcuggaaaa

SEQ ID NO: 3944737 - RNA, 12 nt, Human adenovirus F
aaucauuuccag

SEQ ID NO: 3944738 - RNA, 12 nt, Human adenovirus F
aauccuuuuugg

SEQ ID NO: 3944739 - RNA, 22 nt, Human adenovirus F
aaucuuacuuugacaugggggc

SEQ ID NO: 3944740 - RNA, 18 nt, Human adenovirus F
aaugcaaacaacgaacuu

SEQ ID NO: 3944741 - RNA, 15 nt, Human adenovirus F
aaugcagagcuuggg

SEQ ID NO: 3944742 - RNA, 16 nt, Human adenovirus F
aaugcagagcuugggc

SEQ ID NO: 3944743 - RNA, 20 nt, Human adenovirus F
aauggaacauuaauccaaug

SEQ ID NO: 3944744 - RNA, 15 nt, Human adenovirus F
aauggaaccaagcua

SEQ ID NO: 3944745 - RNA, 19 nt, Human adenovirus F
aaugugucuccgcugggag

SEQ ID NO: 3944746 - RNA, 20 nt, Human adenovirus F
aauguuaucggggugggaaa

SEQ ID NO: 3944747 - RNA, 20 nt, Human adenovirus F
aauuaaccuugcauggugug

SEQ ID NO: 3944748 - RNA, 20 nt, Human adenovirus F
aauugauuuucugccaccag

SEQ ID NO: 3944749 - RNA, 18 nt, Human adenovirus F
aauugccucggcuacagu

SEQ ID NO: 3944750 - RNA, 21 nt, Human adenovirus F
acaaaacccccuaugugccca

SEQ ID NO: 3944751 - RNA, 13 nt, Human adenovirus F
acaaaagcuuuca

SEQ ID NO: 3944752 - RNA, 18 nt, Human adenovirus F
acaaaguccuggccaacu

SEQ ID NO: 3944753 - RNA, 14 nt, Human adenovirus F
acaaaugccucccu

SEQ ID NO: 3944754 - RNA, 12 nt, Human adenovirus F
acaaccagcgcu

SEQ ID NO: 3944755 - RNA, 20 nt, Human adenovirus F
acaacgaagggauacuagca

SEQ ID NO: 3944756 - RNA, 20 nt, Human adenovirus F
acacaauugguuggaaaagu

SEQ ID NO: 3944757 - RNA, 14 nt, Human adenovirus F
acacaggagcuuua

SEQ ID NO: 3944758 - RNA, 17 nt, Human adenovirus F
acaccuccucaacuccc

SEQ ID NO: 3944759 - RNA, 20 nt, Human adenovirus F
acacuaugguaaaaacccug

SEQ ID NO: 3944760 - RNA, 22 nt, Human adenovirus F
acagaauucuaaccguuaaucu

SEQ ID NO: 3944761 - RNA, 17 nt, Human adenovirus F
acagccaagucaaaaaa

SEQ ID NO: 3944762 - RNA, 14 nt, Human adenovirus F
acagccaggcagag

SEQ ID NO: 3944763 - RNA, 19 nt, Human adenovirus F
acagcgaagauguuaacuu

SEQ ID NO: 3944764 - RNA, 17 nt, Human adenovirus F
acagcguagcacucccu

SEQ ID NO: 3944765 - RNA, 22 nt, Human adenovirus F
acagcuaugacccagacgugag

SEQ ID NO: 3944766 - RNA, 15 nt, Human adenovirus F
acagcuccucagccc

SEQ ID NO: 3944767 - RNA, 16 nt, Human adenovirus F
acagcugaagacacau

SEQ ID NO: 3944768 - RNA, 10 nt, Human adenovirus F
acagcuggga

SEQ ID NO: 3944769 - RNA, 22 nt, Human adenovirus F
acagcuucguacuucuguuuua

SEQ ID NO: 3944770 - RNA, 17 nt, Human adenovirus F
acaguccuucugccacg

SEQ ID NO: 3944771 - RNA, 17 nt, Human adenovirus F
acaguuucgcgcaccuc

SEQ ID NO: 3944772 - RNA, 19 nt, Human adenovirus F
acaucaauuuugcgucgcu

SEQ ID NO: 3944773 - RNA, 14 nt, Human adenovirus F
acauccauuuccac

SEQ ID NO: 3944774 - RNA, 16 nt, Human adenovirus F
acauuaugagcaaaga

SEQ ID NO: 3944775 - RNA, 21 nt, Human adenovirus F
acauuguguccugcaacaaaa

SEQ ID NO: 3944776 - RNA, 15 nt, Human adenovirus F
accaaauucugcuag

SEQ ID NO: 3944777 - RNA, 16 nt, Human adenovirus F
accaaggacugguucc

SEQ ID NO: 3944778 - RNA, 14 nt, Human adenovirus F
accaagggcucugc

SEQ ID NO: 3944779 - RNA, 16 nt, Human adenovirus F
accaagggcucugccu

SEQ ID NO: 3944780 - RNA, 14 nt, Human adenovirus F
accacgcaggcgag

SEQ ID NO: 3944781 - RNA, 13 nt, Human adenovirus F
accacgcugcgcc

SEQ ID NO: 3944782 - RNA, 14 nt, Human adenovirus F
accagccgcaccgc

SEQ ID NO: 3944783 - RNA, 23 nt, Human adenovirus F
accaggaggcuauuggccagacg

SEQ ID NO: 3944784 - RNA, 20 nt, Human adenovirus F
accaggccuugcaaaaccaa

SEQ ID NO: 3944785 - RNA, 16 nt, Human adenovirus F
accagugggcucccau

SEQ ID NO: 3944786 - RNA, 12 nt, Human adenovirus F
accauggagcua

SEQ ID NO: 3944787 - RNA, 21 nt, Human adenovirus F
accauguggcgcauucccuuu

SEQ ID NO: 3944788 - RNA, 18 nt, Human adenovirus F
accccuaugacaccuccu

SEQ ID NO: 3944789 - RNA, 15 nt, Human adenovirus F
acccgccgucgucgc

SEQ ID NO: 3944790 - RNA, 15 nt, Human adenovirus F
acccuaguuguggaa

SEQ ID NO: 3944791 - RNA, 15 nt, Human adenovirus F
accgcugcagcugcu

SEQ ID NO: 3944792 - RNA, 12 nt, Human adenovirus F
accggcgccgcu

SEQ ID NO: 3944793 - RNA, 19 nt, Human adenovirus F
accggguuuuggacauggc

SEQ ID NO: 3944794 - RNA, 19 nt, Human adenovirus F
accguaccugcuaccucuu

SEQ ID NO: 3944795 - RNA, 19 nt, Human adenovirus F
accguuguggagucacugc

SEQ ID NO: 3944796 - RNA, 16 nt, Human adenovirus F
accuacgcccaggagc

SEQ ID NO: 3944797 - RNA, 21 nt, Human adenovirus F
accuccaccggcccaccgagu

SEQ ID NO: 3944798 - RNA, 20 nt, Human adenovirus F
accuccgggaguccucagcc

SEQ ID NO: 3944799 - RNA, 16 nt, Human adenovirus F
accuccucaacuccca

SEQ ID NO: 3944800 - RNA, 20 nt, Human adenovirus F
accucgccgcgcaggggcuc

SEQ ID NO: 3944801 - RNA, 19 nt, Human adenovirus F
accucugacaaacacgcuc

SEQ ID NO: 3944802 - RNA, 18 nt, Human adenovirus F
accucugcaccccucauc

SEQ ID NO: 3944803 - RNA, 23 nt, Human adenovirus F
accucugcgcugcaaacaugcuu

SEQ ID NO: 3944804 - RNA, 18 nt, Human adenovirus F
accucuucuucuuccucc

SEQ ID NO: 3944805 - RNA, 13 nt, Human adenovirus F
accugaaaaccau

SEQ ID NO: 3944806 - RNA, 19 nt, Human adenovirus F
accugagggccggccugga

SEQ ID NO: 3944807 - RNA, 19 nt, Human adenovirus F
accugucgcggucguuuaa

SEQ ID NO: 3944808 - RNA, 20 nt, Human adenovirus F
accugugggucgcagcaggu

SEQ ID NO: 3944809 - RNA, 18 nt, Human adenovirus F
accuuagaacuaccucca

SEQ ID NO: 3944810 - RNA, 20 nt, Human adenovirus F
accuucaaacccagccgcac

SEQ ID NO: 3944811 - RNA, 15 nt, Human adenovirus F
accuuggcucgacuc

SEQ ID NO: 3944812 - RNA, 16 nt, Human adenovirus F
accuuguauuuguaua

SEQ ID NO: 3944813 - RNA, 20 nt, Human adenovirus F
acgacugggcggcggccaug

SEQ ID NO: 3944814 - RNA, 10 nt, Human adenovirus F
acgagcugcc

SEQ ID NO: 3944815 - RNA, 12 nt, Human adenovirus F
acgcacgcugac

SEQ ID NO: 3944816 - RNA, 12 nt, Human adenovirus F
acgcccaggagc

SEQ ID NO: 3944817 - RNA, 17 nt, Human adenovirus F
acgcccaugcagccaug

SEQ ID NO: 3944818 - RNA, 22 nt, Human adenovirus F
acgcgauccggcacuugaacau

SEQ ID NO: 3944819 - RNA, 14 nt, Human adenovirus F
acgcggggcaggag

SEQ ID NO: 3944820 - RNA, 12 nt, Human adenovirus F
acgcuguuccaa

SEQ ID NO: 3944821 - RNA, 16 nt, Human adenovirus F
acgcuucagagcucuu

SEQ ID NO: 3944822 - RNA, 21 nt, Human adenovirus F
acggaauuguaacugagccug

SEQ ID NO: 3944823 - RNA, 21 nt, Human adenovirus F
acggccguaccaagccugacu

SEQ ID NO: 3944824 - RNA, 21 nt, Human adenovirus F
acggccuuguaugggcagcau

SEQ ID NO: 3944825 - RNA, 14 nt, Human adenovirus F
acggcgugcuggaa

SEQ ID NO: 3944826 - RNA, 18 nt, Human adenovirus F
acggugaacgaggagcgc

SEQ ID NO: 3944827 - RNA, 14 nt, Human adenovirus F
acgucaacuccucu

SEQ ID NO: 3944828 - RNA, 19 nt, Human adenovirus F
acgucauccgccuccaccc

SEQ ID NO: 3944829 - RNA, 22 nt, Human adenovirus F
acgucccuccccguuaccuggg

SEQ ID NO: 3944830 - RNA, 15 nt, Human adenovirus F
acgugcaggccaacc

SEQ ID NO: 3944831 - RNA, 12 nt, Human adenovirus F
acguucucuccc

SEQ ID NO: 3944832 - RNA, 21 nt, Human adenovirus F
acguugcauuauggccauggu

SEQ ID NO: 3944833 - RNA, 20 nt, Human adenovirus F
acuaaggcgggcacaaagga

SEQ ID NO: 3944834 - RNA, 18 nt, Human adenovirus F
acuacaauauuggcuacc

SEQ ID NO: 3944835 - RNA, 15 nt, Human adenovirus F
acuaccucugcgcug

SEQ ID NO: 3944836 - RNA, 14 nt, Human adenovirus F
acuagcauaaaggg

SEQ ID NO: 3944837 - RNA, 20 nt, Human adenovirus F
acuaucccguguuugacaac

SEQ ID NO: 3944838 - RNA, 15 nt, Human adenovirus F
acucccuggccccca

SEQ ID NO: 3944839 - RNA, 12 nt, Human adenovirus F
acugaaagccag

SEQ ID NO: 3944840 - RNA, 15 nt, Human adenovirus F
acugacgcugcgcuu

SEQ ID NO: 3944841 - RNA, 19 nt, Human adenovirus F
acugacuuccugguccuga

SEQ ID NO: 3944842 - RNA, 13 nt, Human adenovirus F
acugauccacuua

SEQ ID NO: 3944843 - RNA, 12 nt, Human adenovirus F
acugccaccucc

SEQ ID NO: 3944844 - RNA, 21 nt, Human adenovirus F
acugcuacuacuuuaacucuu

SEQ ID NO: 3944845 - RNA, 17 nt, Human adenovirus F
acuggaguaacacaaug

SEQ ID NO: 3944846 - RNA, 21 nt, Human adenovirus F
acuggcuggcccuggccugga

SEQ ID NO: 3944847 - RNA, 17 nt, Human adenovirus F
acugugcauuugggagc

SEQ ID NO: 3944848 - RNA, 22 nt, Human adenovirus F
acuucacggcaggguuugcaaa

SEQ ID NO: 3944849 - RNA, 16 nt, Human adenovirus F
acuucuccauguggaa

SEQ ID NO: 3944850 - RNA, 21 nt, Human adenovirus F
acuucuuaauaaagacacaau

SEQ ID NO: 3944851 - RNA, 22 nt, Human adenovirus F
acuuuugccacacuaaaguuuu

SEQ ID NO: 3944852 - RNA, 13 nt, Human adenovirus F
acuuuuuugcaag

SEQ ID NO: 3944853 - RNA, 14 nt, Human adenovirus F
agaaaccaucgcca

SEQ ID NO: 3944854 - RNA, 15 nt, Human adenovirus F
agaaagauggaaaac

SEQ ID NO: 3944855 - RNA, 17 nt, Human adenovirus F
agaaauagggcccggac

SEQ ID NO: 3944856 - RNA, 18 nt, Human adenovirus F
agaaauugauuuucugcc

SEQ ID NO: 3944857 - RNA, 20 nt, Human adenovirus F
agaacuggaguaacacaaug

SEQ ID NO: 3944858 - RNA, 12 nt, Human adenovirus F
agaauuuaugcc

SEQ ID NO: 3944859 - RNA, 22 nt, Human adenovirus F
agacauuguuuugcuaccuggu

SEQ ID NO: 3944860 - RNA, 15 nt, Human adenovirus F
agaccaucaauuuug

SEQ ID NO: 3944861 - RNA, 17 nt, Human adenovirus F
agacccgguacaggugg

SEQ ID NO: 3944862 - RNA, 23 nt, Human adenovirus F
agaccucaacgcggggcaccuuc

SEQ ID NO: 3944863 - RNA, 16 nt, Human adenovirus F
agaccuuccaggaaau

SEQ ID NO: 3944864 - RNA, 12 nt, Human adenovirus F
agacgaggaggc

SEQ ID NO: 3944865 - RNA, 15 nt, Human adenovirus F
agacuuugucagcca

SEQ ID NO: 3944866 - RNA, 14 nt, Human adenovirus F
agagcacccucuac

SEQ ID NO: 3944867 - RNA, 18 nt, Human adenovirus F
agaggguacuagcagugg

SEQ ID NO: 3944868 - RNA, 18 nt, Human adenovirus F
agaguuugggagccagga

SEQ ID NO: 3944869 - RNA, 22 nt, Human adenovirus F
agaguuuuuacaacgagcaggc

SEQ ID NO: 3944870 - RNA, 15 nt, Human adenovirus F
agauaugucugccaa

SEQ ID NO: 3944871 - RNA, 15 nt, Human adenovirus F
agauccgggcuaugu

SEQ ID NO: 3944872 - RNA, 15 nt, Human adenovirus F
agauggaaacuguca

SEQ ID NO: 3944873 - RNA, 21 nt, Human adenovirus F
agauguccuuaaggaggaggc

SEQ ID NO: 3944874 - RNA, 22 nt, Human adenovirus F
agcaagccgcugacggcgcagc

SEQ ID NO: 3944875 - RNA, 14 nt, Human adenovirus F
agcagcagcagcgg

SEQ ID NO: 3944876 - RNA, 21 nt, Human adenovirus F
agcaguuuugguuacagugga

SEQ ID NO: 3944877 - RNA, 22 nt, Human adenovirus F
agcauaaaagaagcacaggaga

SEQ ID NO: 3944878 - RNA, 21 nt, Human adenovirus F
agcauaaaggggaccagcugu

SEQ ID NO: 3944879 - RNA, 23 nt, Human adenovirus F
agcaucuuaggaagggggccauc

SEQ ID NO: 3944880 - RNA, 17 nt, Human adenovirus F
agcaugaaacuggaaga

SEQ ID NO: 3944881 - RNA, 17 nt, Human adenovirus F
agcaugcuuagccucgg

SEQ ID NO: 3944882 - RNA, 17 nt, Human adenovirus F
agcauuaaccuguaugc

SEQ ID NO: 3944883 - RNA, 12 nt, Human adenovirus F
agccaaccuccg

SEQ ID NO: 3944884 - RNA, 20 nt, Human adenovirus F
agcccauaucugacaacccg

SEQ ID NO: 3944885 - RNA, 22 nt, Human adenovirus F
agcccccgugggggaccgagcc

SEQ ID NO: 3944886 - RNA, 22 nt, Human adenovirus F
agcccgcaacggcgcagcagau

SEQ ID NO: 3944887 - RNA, 21 nt, Human adenovirus F
agcccucaaggaaugcacaca

SEQ ID NO: 3944888 - RNA, 20 nt, Human adenovirus F
agccgaucccagagcucggu

SEQ ID NO: 3944889 - RNA, 17 nt, Human adenovirus F
agccuccgguggcucug

SEQ ID NO: 3944890 - RNA, 19 nt, Human adenovirus F
agccuccgguggcucugca

SEQ ID NO: 3944891 - RNA, 16 nt, Human adenovirus F
agccugaaauacacug

SEQ ID NO: 3944892 - RNA, 18 nt, Human adenovirus F
agccuguguuaucaccca

SEQ ID NO: 3944893 - RNA, 16 nt, Human adenovirus F
agcggccgcgaccgga

SEQ ID NO: 3944894 - RNA, 18 nt, Human adenovirus F
agcggcuuaugcaaacau

SEQ ID NO: 3944895 - RNA, 12 nt, Human adenovirus F
agcgggcacaga

SEQ ID NO: 3944896 - RNA, 12 nt, Human adenovirus F
agcgggcaggag

SEQ ID NO: 3944897 - RNA, 19 nt, Human adenovirus F
agcgucggcgccacacugu

SEQ ID NO: 3944898 - RNA, 15 nt, Human adenovirus F
agcuagcauaaaaga

SEQ ID NO: 3944899 - RNA, 19 nt, Human adenovirus F
agcucaacgcaguggugga

SEQ ID NO: 3944900 - RNA, 20 nt, Human adenovirus F
agcucgcaaacaauaaaaga

SEQ ID NO: 3944901 - RNA, 21 nt, Human adenovirus F
agcucuuccaagcugcggaaa

SEQ ID NO: 3944902 - RNA, 11 nt, Human adenovirus F
agcugcuggag

SEQ ID NO: 3944903 - RNA, 15 nt, Human adenovirus F
agcugguaagcagcc

SEQ ID NO: 3944904 - RNA, 21 nt, Human adenovirus F
agcuuacuuuaaaacuuggca

SEQ ID NO: 3944905 - RNA, 22 nt, Human adenovirus F
aggacgccucggaguaccugag

SEQ ID NO: 3944906 - RNA, 16 nt, Human adenovirus F
aggacucacgccaggc

SEQ ID NO: 3944907 - RNA, 13 nt, Human adenovirus F
aggagacguggga

SEQ ID NO: 3944908 - RNA, 13 nt, Human adenovirus F
aggagcagaugga

SEQ ID NO: 3944909 - RNA, 18 nt, Human adenovirus F
aggagcagcgggaagaga

SEQ ID NO: 3944910 - RNA, 14 nt, Human adenovirus F
aggagcugucucag

SEQ ID NO: 3944911 - RNA, 16 nt, Human adenovirus F
aggaggaccuagagga

SEQ ID NO: 3944912 - RNA, 14 nt, Human adenovirus F
aggagucccugcac

SEQ ID NO: 3944913 - RNA, 23 nt, Human adenovirus F
aggagugcgucagaauguggugg

SEQ ID NO: 3944914 - RNA, 17 nt, Human adenovirus F
aggaucccucagagcug

SEQ ID NO: 3944915 - RNA, 12 nt, Human adenovirus F
aggcagcagggu

SEQ ID NO: 3944916 - RNA, 12 nt, Human adenovirus F
aggcaguggugg

SEQ ID NO: 3944917 - RNA, 13 nt, Human adenovirus F
aggcaguggugga

SEQ ID NO: 3944918 - RNA, 22 nt, Human adenovirus F
aggccauggaaacgcagccuga

SEQ ID NO: 3944919 - RNA, 22 nt, Human adenovirus F
aggccgagguauccagcucaac

SEQ ID NO: 3944920 - RNA, 21 nt, Human adenovirus F
agggaucgcagcgggcaggag

SEQ ID NO: 3944921 - RNA, 22 nt, Human adenovirus F
agggauucuaagggaggcagca

SEQ ID NO: 3944922 - RNA, 17 nt, Human adenovirus F
agggauugagugggaag

SEQ ID NO: 3944923 - RNA, 20 nt, Human adenovirus F
agggcaaaagugucgcgcac

SEQ ID NO: 3944924 - RNA, 17 nt, Human adenovirus F
agggcgucaugcucugg

SEQ ID NO: 3944925 - RNA, 17 nt, Human adenovirus F
agggcucugccugcgga

SEQ ID NO: 3944926 - RNA, 15 nt, Human adenovirus F
aggguaaugucuuuc

SEQ ID NO: 3944927 - RNA, 15 nt, Human adenovirus F
agggucgcaggguuc

SEQ ID NO: 3944928 - RNA, 21 nt, Human adenovirus F
aggguguacguuuguugcaug

SEQ ID NO: 3944929 - RNA, 17 nt, Human adenovirus F
agguagaaguggaggaa

SEQ ID NO: 3944930 - RNA, 11 nt, Human adenovirus F
agguagaaugg

SEQ ID NO: 3944931 - RNA, 23 nt, Human adenovirus F
agguaguccucauucuucucaua

SEQ ID NO: 3944932 - RNA, 15 nt, Human adenovirus F
aggucaucuucuucu

SEQ ID NO: 3944933 - RNA, 17 nt, Human adenovirus F
agguggccauugggcug

SEQ ID NO: 3944934 - RNA, 13 nt, Human adenovirus F
agguuaaagccaa

SEQ ID NO: 3944935 - RNA, 18 nt, Human adenovirus F
agguuacucagcaauccg

SEQ ID NO: 3944936 - RNA, 21 nt, Human adenovirus F
agguuuuacgcggggcaggag

SEQ ID NO: 3944937 - RNA, 14 nt, Human adenovirus F
aguaacacaaacau

SEQ ID NO: 3944938 - RNA, 15 nt, Human adenovirus F
aguaacuuuugccac

SEQ ID NO: 3944939 - RNA, 21 nt, Human adenovirus F
aguauacauuugaacagcuga

SEQ ID NO: 3944940 - RNA, 13 nt, Human adenovirus F
cacaacaaaucau

SEQ ID NO: 3944941 - RNA, 15 nt, Human adenovirus F
cacaauuuacaauuu

SEQ ID NO: 3944942 - RNA, 14 nt, Human adenovirus F
cacagaacaaaaca

SEQ ID NO: 3944943 - RNA, 10 nt, Human adenovirus F
cacaggaaga

SEQ ID NO: 3944944 - RNA, 14 nt, Human adenovirus F
cacaggucaaaugc

SEQ ID NO: 3944945 - RNA, 13 nt, Human adenovirus F
cacaucacuguua

SEQ ID NO: 3944946 - RNA, 18 nt, Human adenovirus F
cacauccaagugccccag

SEQ ID NO: 3944947 - RNA, 17 nt, Human adenovirus F
cacaugaacacuuccgc

SEQ ID NO: 3944948 - RNA, 14 nt, Human adenovirus F
caccaaaggugguu

SEQ ID NO: 3944949 - RNA, 19 nt, Human adenovirus F
caccaauaugcccaacauc

SEQ ID NO: 3944950 - RNA, 15 nt, Human adenovirus F
caccaccgaaauaaa

SEQ ID NO: 3944951 - RNA, 19 nt, Human adenovirus F
caccagccagcucaacggg

SEQ ID NO: 3944952 - RNA, 17 nt, Human adenovirus F
cacccccaacucugagg

SEQ ID NO: 3944953 - RNA, 15 nt, Human adenovirus F
caccccucuccgugc

SEQ ID NO: 3944954 - RNA, 21 nt, Human adenovirus F
cacccggguuuaccuggugga

SEQ ID NO: 3944955 - RNA, 18 nt, Human adenovirus F
caccgcaaugcuggucug

SEQ ID NO: 3944956 - RNA, 16 nt, Human adenovirus F
caccgcauaagcuggc

SEQ ID NO: 3944957 - RNA, 24 nt, Human adenovirus F
cacgcaagucagcaacuacccugu

SEQ ID NO: 3944958 - RNA, 23 nt, Human adenovirus F
cacguacgagaaaucggagaggg

SEQ ID NO: 3944959 - RNA, 14 nt, Human adenovirus F
cacucgcuccaccc

SEQ ID NO: 3944960 - RNA, 16 nt, Human adenovirus F
cacucuuaacagcauu

SEQ ID NO: 3944961 - RNA, 13 nt, Human adenovirus F
cacugacuuccug

SEQ ID NO: 3944962 - RNA, 20 nt, Human adenovirus F
cacugccguugcaaccucug

SEQ ID NO: 3944963 - RNA, 15 nt, Human adenovirus F
cacugcgguggaggc

SEQ ID NO: 3944964 - RNA, 16 nt, Human adenovirus F
cagaaacaugccaccc

SEQ ID NO: 3944965 - RNA, 20 nt, Human adenovirus F
cagaaacuacaaaagcagug

SEQ ID NO: 3944966 - RNA, 14 nt, Human adenovirus F
cagaacaaaacaca

SEQ ID NO: 3944967 - RNA, 21 nt, Human adenovirus F
cagaacguucuucacugcacc

SEQ ID NO: 3944968 - RNA, 13 nt, Human adenovirus F
cagaauguggugg

SEQ ID NO: 3944969 - RNA, 15 nt, Human adenovirus F
cagauggaaacuguc

SEQ ID NO: 3944970 - RNA, 20 nt, Human adenovirus F
cagauugccuccguguuuuu

SEQ ID NO: 3944971 - RNA, 11 nt, Human adenovirus F
cagcaagcugc

SEQ ID NO: 3944972 - RNA, 16 nt, Human adenovirus F
cagcaccaccugcccu

SEQ ID NO: 3944973 - RNA, 13 nt, Human adenovirus F
cagcaccauuagc

SEQ ID NO: 3944974 - RNA, 14 nt, Human adenovirus F
cagcaccgcacaga

SEQ ID NO: 3944975 - RNA, 22 nt, Human adenovirus F
cagcagguuaaagccaacucca

SEQ ID NO: 3944976 - RNA, 21 nt, Human adenovirus F
cagcagugcuuggaagagcaa

SEQ ID NO: 3944977 - RNA, 16 nt, Human adenovirus F
cagccccaggccaacc

SEQ ID NO: 3944978 - RNA, 21 nt, Human adenovirus F
cagccccaggccaaccgcuuu

SEQ ID NO: 3944979 - RNA, 14 nt, Human adenovirus F
cagcccccaccgcc

SEQ ID NO: 3944980 - RNA, 18 nt, Human adenovirus F
cagccgguccccgucagc

SEQ ID NO: 3944981 - RNA, 20 nt, Human adenovirus F
cagccuaacggcaccugcga

SEQ ID NO: 3944982 - RNA, 14 nt, Human adenovirus F
cagcgacagggcgc

SEQ ID NO: 3944983 - RNA, 21 nt, Human adenovirus F
cagcgcccgccucccaaaguc

SEQ ID NO: 3944984 - RNA, 19 nt, Human adenovirus F
cagcgcccuggauacauac

SEQ ID NO: 3944985 - RNA, 22 nt, Human adenovirus F
cagcgcgcuucgccuccuggug

SEQ ID NO: 3944986 - RNA, 21 nt, Human adenovirus F
cagcgggaagagaggcagccc

SEQ ID NO: 3944987 - RNA, 13 nt, Human adenovirus F
cagcgggcacaga

SEQ ID NO: 3944988 - RNA, 17 nt, Human adenovirus F
cagcgguaucugcgugg

SEQ ID NO: 3944989 - RNA, 19 nt, Human adenovirus F
cagcuacaagauuccacca

SEQ ID NO: 3944990 - RNA, 17 nt, Human adenovirus F
cagcugcguacggacca

SEQ ID NO: 3944991 - RNA, 21 nt, Human adenovirus F
cagcugguaagcagccuaagc

SEQ ID NO: 3944992 - RNA, 13 nt, Human adenovirus F
caggaaggccucg

SEQ ID NO: 3944993 - RNA, 14 nt, Human adenovirus F
caggacuuggcaga

SEQ ID NO: 3944994 - RNA, 20 nt, Human adenovirus F
caggaggacuaugucagcuu

SEQ ID NO: 3944995 - RNA, 13 nt, Human adenovirus F
caggaucccucag

SEQ ID NO: 3944996 - RNA, 14 nt, Human adenovirus F
caggaucccucaga

SEQ ID NO: 3944997 - RNA, 16 nt, Human adenovirus F
caggauucgcccgcca

SEQ ID NO: 3944998 - RNA, 16 nt, Human adenovirus F
caggcagcagccccag

SEQ ID NO: 3944999 - RNA, 15 nt, Human adenovirus F
caggcaguggacagc

SEQ ID NO: 3945000 - RNA, 15 nt, Human adenovirus F
caggccuugcaaaac

SEQ ID NO: 3945001 - RNA, 21 nt, Human adenovirus F
caggccuugcaaaaccaaauc

SEQ ID NO: 3945002 - RNA, 19 nt, Human adenovirus F
caggcgcuccacgucccuc

SEQ ID NO: 3945003 - RNA, 16 nt, Human adenovirus F
cagggucgauggagcc

SEQ ID NO: 3945004 - RNA, 22 nt, Human adenovirus F
caggucgggcccgucgucaggc

SEQ ID NO: 3945005 - RNA, 20 nt, Human adenovirus F
cagguucccgugucaccugc

SEQ ID NO: 3945006 - RNA, 23 nt, Human adenovirus F
cagguucccgugucaccugcagu

SEQ ID NO: 3945007 - RNA, 17 nt, Human adenovirus F
caguaccgcuccaucaa

SEQ ID NO: 3945008 - RNA, 15 nt, Human adenovirus F
cagucaagcucucca

SEQ ID NO: 3945009 - RNA, 23 nt, Human adenovirus F
cagucggugggcguccaguggag

SEQ ID NO: 3945010 - RNA, 17 nt, Human adenovirus F
cagugcuuggaagagca

SEQ ID NO: 3945011 - RNA, 18 nt, Human adenovirus F
caguggacaaaccaaaac

SEQ ID NO: 3945012 - RNA, 20 nt, Human adenovirus F
caguguaaagcauaacauga

SEQ ID NO: 3945013 - RNA, 20 nt, Human adenovirus F
caguuggagcagccugugga

SEQ ID NO: 3945014 - RNA, 22 nt, Human adenovirus F
cauaacaccuauguuaggcuuu

SEQ ID NO: 3945015 - RNA, 19 nt, Human adenovirus F
cauaacuaaaaaaacucca

SEQ ID NO: 3945016 - RNA, 17 nt, Human adenovirus F
cauaacugaacaauaaa

SEQ ID NO: 3945017 - RNA, 18 nt, Human adenovirus F
cauaaugcgggcucugau

SEQ ID NO: 3945018 - RNA, 21 nt, Human adenovirus F
cauaaugcgggcucugauaau

SEQ ID NO: 3945019 - RNA, 19 nt, Human adenovirus F
cauacgcuagaccaacaaa

SEQ ID NO: 3945020 - RNA, 20 nt, Human adenovirus F
cauauaagcucugucaguuc

SEQ ID NO: 3945021 - RNA, 21 nt, Human adenovirus F
cauauuucaccuacucuggcu

SEQ ID NO: 3945022 - RNA, 22 nt, Human adenovirus F
caucaauuuugcgucgcuggcu

SEQ ID NO: 3945023 - RNA, 14 nt, Human adenovirus F
cauccuggaccugg

SEQ ID NO: 3945024 - RNA, 19 nt, Human adenovirus F
caucgcugaccagcagcag

SEQ ID NO: 3945025 - RNA, 23 nt, Human adenovirus F
caucguaguuuugcuccagggua

SEQ ID NO: 3945026 - RNA, 21 nt, Human adenovirus F
caucgugcgcgaacugggcug

SEQ ID NO: 3945027 - RNA, 22 nt, Human adenovirus F
caucugcagcauugccacuuuu

SEQ ID NO: 3945028 - RNA, 14 nt, Human adenovirus F
caucuucaccucug

SEQ ID NO: 3945029 - RNA, 15 nt, Human adenovirus F
caugaaacuggaaga

SEQ ID NO: 3945030 - RNA, 18 nt, Human adenovirus F
caugaaaguuccucuucu

SEQ ID NO: 3945031 - RNA, 23 nt, Human adenovirus F
caugagucuguuuggugggcuga

SEQ ID NO: 3945032 - RNA, 17 nt, Human adenovirus F
caugcccgagccggaga

SEQ ID NO: 3945033 - RNA, 16 nt, Human adenovirus F
caugccuuucucccag

SEQ ID NO: 3945034 - RNA, 14 nt, Human adenovirus F
caugcgcuccaaca

SEQ ID NO: 3945035 - RNA, 23 nt, Human adenovirus F
cauuaaaaaucuccugcuccugc

SEQ ID NO: 3945036 - RNA, 19 nt, Human adenovirus F
cauuaagguuacucagcaa

SEQ ID NO: 3945037 - RNA, 20 nt, Human adenovirus F
cauuaauaguggcacagcaa

SEQ ID NO: 3945038 - RNA, 21 nt, Human adenovirus F
cauuaggccgucccugggaug

SEQ ID NO: 3945039 - RNA, 17 nt, Human adenovirus F
cauucccuuuuccagca

SEQ ID NO: 3945040 - RNA, 17 nt, Human adenovirus F
cauucuuaacccgcacu

SEQ ID NO: 3945041 - RNA, 14 nt, Human adenovirus F
cauugccucccuga

SEQ ID NO: 3945042 - RNA, 14 nt, Human adenovirus F
cauuggcuggaggc

SEQ ID NO: 3945043 - RNA, 22 nt, Human adenovirus F
cauuguguccugcaacaaaaaa

SEQ ID NO: 3945044 - RNA, 12 nt, Human adenovirus F
ccaaaacaaaac

SEQ ID NO: 3945045 - RNA, 17 nt, Human adenovirus F
ccaaaacaaaacaaacu

SEQ ID NO: 3945046 - RNA, 11 nt, Human adenovirus F
ccaaaccaaau

SEQ ID NO: 3945047 - RNA, 15 nt, Human adenovirus F
ccaaacuucacggca

SEQ ID NO: 3945048 - RNA, 21 nt, Human adenovirus F
ccaaagacaaaaucacuguuu

SEQ ID NO: 3945049 - RNA, 18 nt, Human adenovirus F
ccaaagguacacaccaaa

SEQ ID NO: 3945050 - RNA, 17 nt, Human adenovirus F
ccaacagccccagcugg

SEQ ID NO: 3945051 - RNA, 13 nt, Human adenovirus F
ccaacgcuacuag

SEQ ID NO: 3945052 - RNA, 18 nt, Human adenovirus F
ccaacggcuugcaagaaa

SEQ ID NO: 3945053 - RNA, 15 nt, Human adenovirus F
ccaacugcagcgcac

SEQ ID NO: 3945054 - RNA, 21 nt, Human adenovirus F
ccaacugcagcgcacgcugga

SEQ ID NO: 3945055 - RNA, 15 nt, Human adenovirus F
ccaacugccaccucc

SEQ ID NO: 3945056 - RNA, 20 nt, Human adenovirus F
uucgcucacccgcagcugcu

SEQ ID NO: 3945057 - RNA, 18 nt, Human adenovirus F
uucggcuugcauaaaagc

SEQ ID NO: 3945058 - RNA, 20 nt, Human adenovirus F
uucggugacaaacaagcugu

SEQ ID NO: 3945059 - RNA, 15 nt, Human adenovirus F
uucuucacugcaccu

SEQ ID NO: 3945060 - RNA, 17 nt, Human adenovirus F
uugaacagcugaagaca

SEQ ID NO: 3945061 - RNA, 17 nt, Human adenovirus F
uugaagaugacuucaac

SEQ ID NO: 3945062 - RNA, 19 nt, Human adenovirus F
uugauuuucuuugccaccu

SEQ ID NO: 3945063 - RNA, 19 nt, Human adenovirus F
uugcacgcucugcaucucu

SEQ ID NO: 3945064 - RNA, 16 nt, Human adenovirus F
uugcacuuaacuguuc

SEQ ID NO: 3945065 - RNA, 14 nt, Human adenovirus F
uugcaucucaaagc

SEQ ID NO: 3945066 - RNA, 20 nt, Human adenovirus F
uugcccgccagcuggcaaac

SEQ ID NO: 3945067 - RNA, 14 nt, Human adenovirus F
uugccuucuuuucu

SEQ ID NO: 3945068 - RNA, 23 nt, Human adenovirus F
uugcgguacucucgaaacuuuuu

SEQ ID NO: 3945069 - RNA, 19 nt, Human adenovirus F
uugcuucuuugaauuuggg

SEQ ID NO: 3945070 - RNA, 23 nt, Human adenovirus F
uuggaaaucgugcccguggaaaa

SEQ ID NO: 3945071 - RNA, 15 nt, Human adenovirus F
uuggagaacaugaaa

SEQ ID NO: 3945072 - RNA, 21 nt, Human adenovirus F
uuggcaauguguuugccaugg

SEQ ID NO: 3945073 - RNA, 13 nt, Human adenovirus F
uuggccuuugucu

SEQ ID NO: 3945074 - RNA, 23 nt, Human adenovirus F
uugggacucuugcuggaccaaag

SEQ ID NO: 3945075 - RNA, 13 nt, Human adenovirus F
uuggggaauuugu

SEQ ID NO: 3945076 - RNA, 19 nt, Human adenovirus F
uuggggaauuugucaugca

SEQ ID NO: 3945077 - RNA, 18 nt, Human adenovirus F
uugugguacaggagcgca

SEQ ID NO: 3945078 - RNA, 14 nt, Human adenovirus F
uuuaauacagugac

SEQ ID NO: 3945079 - RNA, 20 nt, Human adenovirus F
uuuacugcuaaagggaacug

SEQ ID NO: 3945080 - RNA, 12 nt, Human adenovirus F
uuuacuuaaaaa

SEQ ID NO: 3945081 - RNA, 21 nt, Human adenovirus F
uuucagggcaacguucagcca

SEQ ID NO: 3945082 - RNA, 21 nt, Human adenovirus F
uuucauuuaccaccccagcac

SEQ ID NO: 3945083 - RNA, 13 nt, Human adenovirus F
uuuccccauggcu

SEQ ID NO: 3945084 - RNA, 13 nt, Human adenovirus F
uuucuccuccccu

SEQ ID NO: 3945085 - RNA, 14 nt, Human adenovirus F
uuucuccuccccuu

SEQ ID NO: 3945086 - RNA, 18 nt, Human adenovirus F
uuucuuacacuagccauu

SEQ ID NO: 3945087 - RNA, 18 nt, Human adenovirus F
uuugccacacuaaaguuu

SEQ ID NO: 3945088 - RNA, 16 nt, Human adenovirus F
uuuggaagaugaguuu

SEQ ID NO: 3945089 - RNA, 16 nt, Human adenovirus F
uuuguaacaacuguac

SEQ ID NO: 3945090 - RNA, 16 nt, Human adenovirus F
ggguauuugauuuaac

SEQ ID NO: 3945091 - RNA, 13 nt, Human adenovirus F
gggugucugccag

SEQ ID NO: 3945092 - RNA, 15 nt, Human adenovirus F
gguacaggugggcuu

SEQ ID NO: 3945093 - RNA, 22 nt, Human adenovirus F
ggucccuucuggaccuggggcg

SEQ ID NO: 3945094 - RNA, 18 nt, Human adenovirus F
gguccgaccgcugggguu

SEQ ID NO: 3945095 - RNA, 14 nt, Human adenovirus F
ggucuuacaugcac

SEQ ID NO: 3945096 - RNA, 13 nt, Human adenovirus F
ggugaaggugaga

SEQ ID NO: 3945097 - RNA, 19 nt, Human adenovirus F
ggugggcguccaguggagc

SEQ ID NO: 3945098 - RNA, 21 nt, Human adenovirus F
gguggucacucucagcugcua

SEQ ID NO: 3945099 - RNA, 17 nt, Human adenovirus F
gguguauaaaagggggc

SEQ ID NO: 3945100 - RNA, 16 nt, Human adenovirus F
gguguguuuuuucaaa

SEQ ID NO: 3945101 - RNA, 22 nt, Human adenovirus F
gguguugacccgcuuggaggag

SEQ ID NO: 3945102 - RNA, 19 nt, Human adenovirus F
gguuaagagaagaagaugc

SEQ ID NO: 3945103 - RNA, 13 nt, Human adenovirus F
gguuccaccaagc

SEQ ID NO: 3945104 - RNA, 23 nt, Human adenovirus F
gguucugaaguucagaacauggc

SEQ ID NO: 3945105 - RNA, 14 nt, Human adenovirus F
gguuuuugagcaug

SEQ ID NO: 3945106 - RNA, 17 nt, Human adenovirus F
guaagguaaucaggaga

SEQ ID NO: 3945107 - RNA, 18 nt, Human adenovirus F
guaaugucuuuccagggu

SEQ ID NO: 3945108 - RNA, 18 nt, Human adenovirus F
guacacgcggugacggcc

SEQ ID NO: 3945109 - RNA, 18 nt, Human adenovirus F
guaccgccaaaaaagcag

SEQ ID NO: 3945110 - RNA, 17 nt, Human adenovirus F
guacgaacucagucugc

SEQ ID NO: 3945111 - RNA, 22 nt, Human adenovirus F
guacggaccaccagaugauguc

SEQ ID NO: 3945112 - RNA, 17 nt, Human adenovirus F
guacgguuucugggcuu

SEQ ID NO: 3945113 - RNA, 19 nt, Human adenovirus F
guagacgcuggaagaggua

SEQ ID NO: 3945114 - RNA, 16 nt, Human adenovirus F
guaggaccacuggagg

SEQ ID NO: 3945115 - RNA, 13 nt, Human adenovirus F
guaggcaaucucc

SEQ ID NO: 3945116 - RNA, 21 nt, Human adenovirus F
guaguugagcgugguggcaau

SEQ ID NO: 3945117 - RNA, 16 nt, Human adenovirus F
guauaguccagcguuc

SEQ ID NO: 3945118 - RNA, 18 nt, Human adenovirus F
guaugguaacuccucuuc

SEQ ID NO: 3945119 - RNA, 20 nt, Human adenovirus F
guaugguaacuccucuucuc

SEQ ID NO: 3945120 - RNA, 20 nt, Human adenovirus F
guauuaacacuggcagaggc

SEQ ID NO: 3945121 - RNA, 19 nt, Human adenovirus F
gucacucuccgccgccgcu

SEQ ID NO: 3945122 - RNA, 13 nt, Human adenovirus F
gucagaauguggu

SEQ ID NO: 3945123 - RNA, 22 nt, Human adenovirus F
gucagcaacuacccuguagugg

SEQ ID NO: 3945124 - RNA, 15 nt, Human adenovirus F
guccccgucagcaug

SEQ ID NO: 3945125 - RNA, 22 nt, Human adenovirus F
guccuggccaacugccaccucc

SEQ ID NO: 3945126 - RNA, 16 nt, Human adenovirus F
gucgagcuagugaaac

SEQ ID NO: 3945127 - RNA, 20 nt, Human adenovirus F
gucgcuggcuuuuggaccug

SEQ ID NO: 3945128 - RNA, 20 nt, Human adenovirus F
gucugccaaaauggcucugc

SEQ ID NO: 3945129 - RNA, 13 nt, Human adenovirus F
gucuggaaccacu

SEQ ID NO: 3945130 - RNA, 21 nt, Human adenovirus F
gucugggguucauguugugca

SEQ ID NO: 3945131 - RNA, 13 nt, Human adenovirus F
gucugucugccaa

SEQ ID NO: 3945132 - RNA, 13 nt, Human adenovirus F
gugacacccucag

SEQ ID NO: 3945133 - RNA, 21 nt, Human adenovirus F
gugagucgggcucuuggucag

SEQ ID NO: 3945134 - RNA, 14 nt, Human adenovirus F
gugcacuuggggaa

SEQ ID NO: 3945135 - RNA, 14 nt, Human adenovirus F
gugcagacggugga

SEQ ID NO: 3945136 - RNA, 24 nt, Human adenovirus F
gugccgagcuuuuacugggacagc

SEQ ID NO: 3945137 - RNA, 20 nt, Human adenovirus F
gugccgcgcgggcaggagga

SEQ ID NO: 3945138 - RNA, 13 nt, Human adenovirus F
gugccucuguccu

SEQ ID NO: 3945139 - RNA, 20 nt, Human adenovirus F
gugcggcuuuucgcagagac

SEQ ID NO: 3945140 - RNA, 13 nt, Human adenovirus F
gugcuggggaaug

SEQ ID NO: 3945141 - RNA, 22 nt, Human adenovirus F
gugcuuauuaagcgagcagagc

SEQ ID NO: 3945142 - RNA, 23 nt, Human adenovirus F
guggaguuuuacuagacuaaaaa

SEQ ID NO: 3945143 - RNA, 18 nt, Human adenovirus F
gcggggcgucaagaggga

SEQ ID NO: 3945144 - RNA, 19 nt, Human adenovirus F
gcgggggcgucccuggagu

SEQ ID NO: 3945145 - RNA, 18 nt, Human adenovirus F
gcgguaagaacccagcau

SEQ ID NO: 3945146 - RNA, 17 nt, Human adenovirus F
gcggugauauuaagaug

SEQ ID NO: 3945147 - RNA, 13 nt, Human adenovirus F
gcguaacccgccg

SEQ ID NO: 3945148 - RNA, 23 nt, Human adenovirus F
gcgucagguuugacagcauuaac

SEQ ID NO: 3945149 - RNA, 15 nt, Human adenovirus F
gcguccaguggagca

SEQ ID NO: 3945150 - RNA, 17 nt, Human adenovirus F
gcguccgcccgcuccga

SEQ ID NO: 3945151 - RNA, 21 nt, Human adenovirus F
gcgucucgguuaagagaagaa

SEQ ID NO: 3945152 - RNA, 19 nt, Human adenovirus F
gcguucaaaaccucuuaca

SEQ ID NO: 3945153 - RNA, 21 nt, Human adenovirus F
gcuaaaucuuccucccaaagu

SEQ ID NO: 3945154 - RNA, 15 nt, Human adenovirus F
gcuacacaacaaauc

SEQ ID NO: 3945155 - RNA, 22 nt, Human adenovirus F
gcuacaguuucgcgcaccucuu

SEQ ID NO: 3945156 - RNA, 23 nt, Human adenovirus F
gcuaccguucuaugcuccugggu

SEQ ID NO: 3945157 - RNA, 16 nt, Human adenovirus F
gcuagcauaaaagaag

SEQ ID NO: 3945158 - RNA, 13 nt, Human adenovirus F
gcuaucagccgca

SEQ ID NO: 3945159 - RNA, 22 nt, Human adenovirus F
gcuauuaaaauggaaccaagcu

SEQ ID NO: 3945160 - RNA, 21 nt, Human adenovirus F
gcucaacuuuaacuaauguaa

SEQ ID NO: 3945161 - RNA, 14 nt, Human adenovirus F
gcucaaggcgcacg

SEQ ID NO: 3945162 - RNA, 17 nt, Human adenovirus F
gcucacccgcagcugcu

SEQ ID NO: 3945163 - RNA, 16 nt, Human adenovirus F
gcucauugguccagca

SEQ ID NO: 3945164 - RNA, 16 nt, Human adenovirus F
gcucgcgcacagcuuc

SEQ ID NO: 3945165 - RNA, 18 nt, Human adenovirus F
gcucuggacaugacggca

SEQ ID NO: 3945166 - RNA, 12 nt, Human adenovirus F
gcucuguggaga

SEQ ID NO: 3945167 - RNA, 15 nt, Human adenovirus F
gcucuuccaagcugc

SEQ ID NO: 3945168 - RNA, 13 nt, Human adenovirus F
gcugaagacacau

SEQ ID NO: 3945169 - RNA, 20 nt, Human adenovirus F
gcugaauauugcggagccug

SEQ ID NO: 3945170 - RNA, 13 nt, Human adenovirus F
gcugacagcuggg

SEQ ID NO: 3945171 - RNA, 16 nt, Human adenovirus F
gcugacagcugggaca

SEQ ID NO: 3945172 - RNA, 15 nt, Human adenovirus F
gcugcaaucuugaau

SEQ ID NO: 3945173 - RNA, 12 nt, Human adenovirus F
gcugcagccaga

SEQ ID NO: 3945174 - RNA, 18 nt, Human adenovirus F
gcuggcuuuuggaccugg

SEQ ID NO: 3945175 - RNA, 16 nt, Human adenovirus F
gcuggggaauggagcu

SEQ ID NO: 3945176 - RNA, 12 nt, Human adenovirus F
gcuggugugaaa

SEQ ID NO: 3945177 - RNA, 14 nt, Human adenovirus F
gcuguacuccauua

SEQ ID NO: 3945178 - RNA, 17 nt, Human adenovirus F
gcuguacugugcauuug

SEQ ID NO: 3945179 - RNA, 17 nt, Human adenovirus F
gcugugguuaaauuuaa

SEQ ID NO: 3945180 - RNA, 17 nt, Human adenovirus F
gcuguuuaccaaaggcu

SEQ ID NO: 3945181 - RNA, 18 nt, Human adenovirus F
gcuuccaccuuggaagca

SEQ ID NO: 3945182 - RNA, 16 nt, Human adenovirus F
gcuugcccuuggaaau

SEQ ID NO: 3945183 - RNA, 15 nt, Human adenovirus F
gcuuggauuaggaag

SEQ ID NO: 3945184 - RNA, 23 nt, Human adenovirus F
gcuuuaacaacacaggagcuuua

SEQ ID NO: 3945185 - RNA, 22 nt, Human adenovirus F
gcuuucaguuggagcagccugu

SEQ ID NO: 3945186 - RNA, 19 nt, Human adenovirus F
ggaaaccaagggcucugcc

SEQ ID NO: 3945187 - RNA, 19 nt, Human adenovirus F
ggaaacugucaggcucuga

SEQ ID NO: 3945188 - RNA, 19 nt, Human adenovirus F
ggaaauuuacucaacugug

SEQ ID NO: 3945189 - RNA, 21 nt, Human adenovirus F
ggaaccaggcaguggacagcu

SEQ ID NO: 3945190 - RNA, 17 nt, Human adenovirus F
ggaacgcgauccggcac

SEQ ID NO: 3945191 - RNA, 17 nt, Human adenovirus F
ggaacuuccggaaggau

SEQ ID NO: 3945192 - RNA, 19 nt, Human adenovirus F
ccaccgccgcaccacugac

SEQ ID NO: 3945193 - RNA, 19 nt, Human adenovirus F
ccacgucgccaacaguguu

SEQ ID NO: 3945194 - RNA, 20 nt, Human adenovirus F
ccacuguuucuccuccccuu

SEQ ID NO: 3945195 - RNA, 21 nt, Human adenovirus F
ccagacuacuuuuuccaaacu

SEQ ID NO: 3945196 - RNA, 19 nt, Human adenovirus F
ccagacuuugucagccaaa

SEQ ID NO: 3945197 - RNA, 14 nt, Human adenovirus F
ccagcaaaggcgcc

SEQ ID NO: 3945198 - RNA, 13 nt, Human adenovirus F
ccagcaagcugcc

SEQ ID NO: 3945199 - RNA, 12 nt, Human adenovirus F
ccagcacugccg

SEQ ID NO: 3945200 - RNA, 18 nt, Human adenovirus F
ccagcagcaccaccugcc

SEQ ID NO: 3945201 - RNA, 14 nt, Human adenovirus F
ccagccgcacucgc

SEQ ID NO: 3945202 - RNA, 21 nt, Human adenovirus F
ccagcgucagguuugacagca

SEQ ID NO: 3945203 - RNA, 16 nt, Human adenovirus F
ccaggcgagcucaggg

SEQ ID NO: 3945204 - RNA, 16 nt, Human adenovirus F
ccaggcguggccuccg

SEQ ID NO: 3945205 - RNA, 20 nt, Human adenovirus F
ccaggcguggccuccguggc

SEQ ID NO: 3945206 - RNA, 15 nt, Human adenovirus F
ccagggucgcagggu

SEQ ID NO: 3945207 - RNA, 19 nt, Human adenovirus F
ccaguagcuuggaagccac

SEQ ID NO: 3945208 - RNA, 20 nt, Human adenovirus F
ccaucugcagcauugccacu

SEQ ID NO: 3945209 - RNA, 15 nt, Human adenovirus F
ccaugccggcuccga

SEQ ID NO: 3945210 - RNA, 22 nt, Human adenovirus F
ccauggaucgcauccuggcccu

SEQ ID NO: 3945211 - RNA, 14 nt, Human adenovirus F
cuaauggccagagg

SEQ ID NO: 3945212 - RNA, 20 nt, Human adenovirus F
cuacaauccccuugacauuc

SEQ ID NO: 3945213 - RNA, 13 nt, Human adenovirus F
cuacaccaaugca

SEQ ID NO: 3945214 - RNA, 23 nt, Human adenovirus F
cuacaccccccgccuuacauuga

SEQ ID NO: 3945215 - RNA, 12 nt, Human adenovirus F
cuacauaacuga

SEQ ID NO: 3945216 - RNA, 16 nt, Human adenovirus F
cuacccuucugugccu

SEQ ID NO: 3945217 - RNA, 20 nt, Human adenovirus F
cuaccguucuaugcuccugg

SEQ ID NO: 3945218 - RNA, 14 nt, Human adenovirus F
cuacgcccaggagc

SEQ ID NO: 3945219 - RNA, 18 nt, Human adenovirus F
cuacgccuccaccaccuu

SEQ ID NO: 3945220 - RNA, 12 nt, Human adenovirus F
cuacgucaccuu

SEQ ID NO: 3945221 - RNA, 21 nt, Human adenovirus F
cuacguugcgauacugcaaac

SEQ ID NO: 3945222 - RNA, 14 nt, Human adenovirus F
cuacucuggcuccg

SEQ ID NO: 3945223 - RNA, 17 nt, Human adenovirus F
cuacugccgccaugacu

SEQ ID NO: 3945224 - RNA, 18 nt, Human adenovirus F
cuacuucagccuggggaa

SEQ ID NO: 3945225 - RNA, 23 nt, Human adenovirus F
cuagcauaaaggggaccagcugu

SEQ ID NO: 3945226 - RNA, 19 nt, Human adenovirus F
cuagcgccccugcagccgu

SEQ ID NO: 3945227 - RNA, 21 nt, Human adenovirus F
cuagggugugaaggcaaaggu

SEQ ID NO: 3945228 - RNA, 21 nt, Human adenovirus F
cuagugaaacaugaggaggaa

SEQ ID NO: 3945229 - RNA, 18 nt, Human adenovirus F
cuaucaggaagcagcuca

SEQ ID NO: 3945230 - RNA, 15 nt, Human adenovirus F
cuaugaguggaacuu

SEQ ID NO: 3945231 - RNA, 16 nt, Human adenovirus F
cuauguuaggcuuuau

SEQ ID NO: 3945232 - RNA, 11 nt, Human adenovirus F
cuauugccagc

SEQ ID NO: 3945233 - RNA, 13 nt, Human adenovirus F
cucaacugugccu

SEQ ID NO: 3945234 - RNA, 21 nt, Human adenovirus F
cucacguguuagguacuauaa

SEQ ID NO: 3945235 - RNA, 14 nt, Human adenovirus F
cucagacgacgagc

SEQ ID NO: 3945236 - RNA, 16 nt, Human adenovirus F
cucagacuccaacaau

SEQ ID NO: 3945237 - RNA, 22 nt, Human adenovirus F
cucagggucgauggagccagcg

SEQ ID NO: 3945238 - RNA, 15 nt, Human adenovirus F
cucauccgccauugc

SEQ ID NO: 3945239 - RNA, 17 nt, Human adenovirus F
cucauccgccauugcca

SEQ ID NO: 3945240 - RNA, 13 nt, Human adenovirus F
cucauuuuucccg

SEQ ID NO: 3945241 - RNA, 14 nt, Human adenovirus F
cuccaacguagagc

SEQ ID NO: 3945242 - RNA, 19 nt, Human adenovirus F
cuccaauuugacaauaacg

SEQ ID NO: 3945243 - RNA, 21 nt, Human adenovirus F
cuccacaugauacuuuuccau

SEQ ID NO: 3945244 - RNA, 13 nt, Human adenovirus F
cucccacccacga

SEQ ID NO: 3945245 - RNA, 13 nt, Human adenovirus F
cucccuuuccccc

SEQ ID NO: 3945246 - RNA, 14 nt, Human adenovirus F
cuccgccggcaugu

SEQ ID NO: 3945247 - RNA, 18 nt, Human adenovirus F
cuccucaacucccagcau

SEQ ID NO: 3945248 - RNA, 13 nt, Human adenovirus F
cuccugcaauacu

SEQ ID NO: 3945249 - RNA, 17 nt, Human adenovirus F
cucgcugucuggaacca

SEQ ID NO: 3945250 - RNA, 15 nt, Human adenovirus F
cucgggcgcuccugg

SEQ ID NO: 3945251 - RNA, 22 nt, Human adenovirus F
cucggguagcgguuggugcugc

SEQ ID NO: 3945252 - RNA, 17 nt, Human adenovirus F
cucguuguuuuccucug

SEQ ID NO: 3945253 - RNA, 19 nt, Human adenovirus F
cucuguuugcugcacugcc

SEQ ID NO: 3945254 - RNA, 20 nt, Human adenovirus F
cucuuauuguucaaggaaac

SEQ ID NO: 3945255 - RNA, 16 nt, Human adenovirus F
cucuuucuuacaacgc

SEQ ID NO: 3945256 - RNA, 20 nt, Human adenovirus F
cucuuuuugaaucauuucca

SEQ ID NO: 3945257 - RNA, 21 nt, Human adenovirus F
cugaauuuuuagguuggcaau

SEQ ID NO: 3945258 - RNA, 13 nt, Human adenovirus F
cugacaauggaac

SEQ ID NO: 3945259 - RNA, 16 nt, Human adenovirus F
cugacaguaagcaaca

SEQ ID NO: 3945260 - RNA, 17 nt, Human adenovirus F
cugaccgaccuggggca

SEQ ID NO: 3945261 - RNA, 18 nt, Human adenovirus F
cugaccgaccuggggcaa

SEQ ID NO: 3945262 - RNA, 12 nt, Human adenovirus F
cugacuuccugg

SEQ ID NO: 3945263 - RNA, 14 nt, Human adenovirus F
cugagccugauccc

SEQ ID NO: 3945264 - RNA, 23 nt, Human adenovirus F
cugaggaggaggccauccuggac

SEQ ID NO: 3945265 - RNA, 16 nt, Human adenovirus F
cugauaauguguguuu

SEQ ID NO: 3945266 - RNA, 18 nt, Human adenovirus F
cugauccacuuacaacca

SEQ ID NO: 3945267 - RNA, 23 nt, Human adenovirus F
cugcacugccaucugcagcauug

SEQ ID NO: 3945268 - RNA, 17 nt, Human adenovirus F
cugccaaaauggcucug

SEQ ID NO: 3945269 - RNA, 19 nt, Human adenovirus F
cugccaaaauggcucugcu

SEQ ID NO: 3945270 - RNA, 13 nt, Human adenovirus F
cugccagaggccg

SEQ ID NO: 3945271 - RNA, 18 nt, Human adenovirus F
cugccguugcaaccucug

SEQ ID NO: 3945272 - RNA, 20 nt, Human adenovirus F
cugccuaugccgccgugcca

SEQ ID NO: 3945273 - RNA, 20 nt, Human adenovirus F
cugcggauuaagaaccacug

SEQ ID NO: 3945274 - RNA, 18 nt, Human adenovirus F
cugcggcaaugcuuuuga

SEQ ID NO: 3945275 - RNA, 21 nt, Human adenovirus F
cuggaagauguccuuaaggag

SEQ ID NO: 3945276 - RNA, 16 nt, Human adenovirus F
cuggaccuggaagagg

SEQ ID NO: 3945277 - RNA, 20 nt, Human adenovirus F
cuggacgucuuuugacgagc

SEQ ID NO: 3945278 - RNA, 20 nt, Human adenovirus F
cuggacucgucuccugcaag

SEQ ID NO: 3945279 - RNA, 17 nt, Human adenovirus F
cuggaggacgccgaggc

SEQ ID NO: 3945280 - RNA, 20 nt, Human adenovirus F
cuggagggcgucaugcucug

SEQ ID NO: 3945281 - RNA, 19 nt, Human adenovirus F
cuggaguuggcuucugcca

SEQ ID NO: 3945282 - RNA, 20 nt, Human adenovirus F
cuggauacuggcaagagcca

SEQ ID NO: 3945283 - RNA, 16 nt, Human adenovirus F
cuggccaacugccacc

SEQ ID NO: 3945284 - RNA, 19 nt, Human adenovirus F
cuggccaacugccaccucc

SEQ ID NO: 3945285 - RNA, 20 nt, Human adenovirus F
cuggcccuaaccacccgcaa

SEQ ID NO: 3945286 - RNA, 22 nt, Human adenovirus F
cuggccguacgguuucugggcu

SEQ ID NO: 3945287 - RNA, 18 nt, Human adenovirus F
cuggcguuaccaggaaac

SEQ ID NO: 3945288 - RNA, 13 nt, Human adenovirus F
cuggcuggcccug

SEQ ID NO: 3945289 - RNA, 14 nt, Human adenovirus F
cuggcuggcccugg

SEQ ID NO: 3945290 - RNA, 18 nt, Human adenovirus F
cuggcuuccggcauuaac

SEQ ID NO: 3945291 - RNA, 21 nt, Human adenovirus F
cugggauuugccgcagccagu

SEQ ID NO: 3945292 - RNA, 22 nt, Human adenovirus F
cugggauuugccgcagccagug

SEQ ID NO: 3945293 - RNA, 22 nt, Human adenovirus F
cugggguagggugucugccaga

SEQ ID NO: 3945294 - RNA, 22 nt, Human adenovirus F
cuguaagcgggggaaauuuaaa

SEQ ID NO: 3945295 - RNA, 13 nt, Human adenovirus F
cuguacugugcau

SEQ ID NO: 3945296 - RNA, 15 nt, Human adenovirus F
cuguacugugcauuu

SEQ ID NO: 3945297 - RNA, 17 nt, Human adenovirus F
cuguacugugcauuugg

SEQ ID NO: 3945298 - RNA, 22 nt, Human adenovirus F
cuguaguugauaguuuaaggag

SEQ ID NO: 3945299 - RNA, 20 nt, Human adenovirus F
cuguauuuugcuacauaacu

SEQ ID NO: 3945300 - RNA, 13 nt, Human adenovirus F
cugucgccccugc

SEQ ID NO: 3945301 - RNA, 20 nt, Human adenovirus F
cugucguuaguggaggcagc

SEQ ID NO: 3945302 - RNA, 17 nt, Human adenovirus F
cugugcagauggaaacu

SEQ ID NO: 3945303 - RNA, 23 nt, Human adenovirus F
cuguguuacgccagagagccgag

SEQ ID NO: 3945304 - RNA, 14 nt, Human adenovirus F
cuguucuaaaacca

SEQ ID NO: 3945305 - RNA, 16 nt, Human adenovirus F
cuuaacccuaagcaca

SEQ ID NO: 3945306 - RNA, 17 nt, Human adenovirus F
cuuaaguuauacaguga

SEQ ID NO: 3945307 - RNA, 16 nt, Human adenovirus F
cuuaauucuucaugua

SEQ ID NO: 3945308 - RNA, 16 nt, Human adenovirus F
cuuacaugggcauucu

SEQ ID NO: 3945309 - RNA, 15 nt, Human adenovirus F
cuuacuuucugggca

SEQ ID NO: 3945310 - RNA, 20 nt, Human adenovirus F
cuuauuucgcccgacaacaa

SEQ ID NO: 3945311 - RNA, 22 nt, Human adenovirus F
cuucaaacggcggaugguggca

SEQ ID NO: 3945312 - RNA, 19 nt, Human adenovirus F
cuucacaaaguccuggcca

SEQ ID NO: 3945313 - RNA, 18 nt, Human adenovirus F
cuucaccuuaucccauga

SEQ ID NO: 3945314 - RNA, 10 nt, Human adenovirus F
cuuccaaauu

SEQ ID NO: 3945315 - RNA, 23 nt, Human adenovirus F
cuuccaagcgguccauugccucg

SEQ ID NO: 3945316 - RNA, 24 nt, Human adenovirus F
cuucccuuugacaaucagggaaau

SEQ ID NO: 3945317 - RNA, 22 nt, Human adenovirus F
cuuccgacggguuacaggaaaa

SEQ ID NO: 3945318 - RNA, 20 nt, Human adenovirus F
cuuccggaaggauguuaaca

SEQ ID NO: 3945319 - RNA, 23 nt, Human adenovirus F
cuuccucguuguuuuccucugac

SEQ ID NO: 3945320 - RNA, 19 nt, Human adenovirus F
cuucgcccggacacuauuu

SEQ ID NO: 3945321 - RNA, 12 nt, Human adenovirus F
cuucgcugcuuu

SEQ ID NO: 3945322 - RNA, 19 nt, Human adenovirus F
cuucgggagacggaggcaa

SEQ ID NO: 3945323 - RNA, 11 nt, Human adenovirus F
cuucugccaga

SEQ ID NO: 3945324 - RNA, 22 nt, Human adenovirus F
cuugcaaaacuuucgcuccuuu

SEQ ID NO: 3945325 - RNA, 15 nt, Human adenovirus F
cuugcaagcagcucg

SEQ ID NO: 3945326 - RNA, 21 nt, Human adenovirus F
cuugcaggagccgaauugccu

SEQ ID NO: 3945327 - RNA, 15 nt, Human adenovirus F
gcugcgcccccaccg

SEQ ID NO: 3945328 - RNA, 14 nt, Human adenovirus F
gcuggcccuggccu

SEQ ID NO: 3945329 - RNA, 17 nt, Human adenovirus F
gcuggccgugggcgaca

SEQ ID NO: 3945330 - RNA, 17 nt, Human adenovirus F
gcuggcuuuuggaccug

SEQ ID NO: 3945331 - RNA, 13 nt, Human adenovirus F
gcuguagaauuua

SEQ ID NO: 3945332 - RNA, 23 nt, Human adenovirus F
gcuguaguugauaguuuaaggag

SEQ ID NO: 3945333 - RNA, 21 nt, Human adenovirus F
gcugucucaccuacuaccacu

SEQ ID NO: 3945334 - RNA, 20 nt, Human adenovirus F
gcuguuguugauagcgccau

SEQ ID NO: 3945335 - RNA, 14 nt, Human adenovirus F
gcuuacacccgcgg

SEQ ID NO: 3945336 - RNA, 15 nt, Human adenovirus F
gcuucagagcucuuc

SEQ ID NO: 3945337 - RNA, 18 nt, Human adenovirus F
gcuuccuuaacaagggcu

SEQ ID NO: 3945338 - RNA, 23 nt, Human adenovirus F
gcuucucagcucaacgcaguggu

SEQ ID NO: 3945339 - RNA, 11 nt, Human adenovirus F
gcuucugccag

SEQ ID NO: 3945340 - RNA, 17 nt, Human adenovirus F
gcuuuccgcgaggccau

SEQ ID NO: 3945341 - RNA, 19 nt, Human adenovirus F
gcuuuccgcgaggccaugc

SEQ ID NO: 3945342 - RNA, 19 nt, Human adenovirus F
gcuuuccucuuaaugggca

SEQ ID NO: 3945343 - RNA, 22 nt, Human adenovirus F
ggaaacugucaggcucugagag

SEQ ID NO: 3945344 - RNA, 14 nt, Human adenovirus F
ggaaaucagaugca

SEQ ID NO: 3945345 - RNA, 14 nt, Human adenovirus F
ggaagcagcucagg

SEQ ID NO: 3945346 - RNA, 21 nt, Human adenovirus F
ggaauguggggcgugcgagcc

SEQ ID NO: 3945347 - RNA, 15 nt, Human adenovirus F
ggacagcuaugaccc

SEQ ID NO: 3945348 - RNA, 13 nt, Human adenovirus F
ggacgacagccag

SEQ ID NO: 3945349 - RNA, 17 nt, Human adenovirus F
ggacggcaaggaaccag

SEQ ID NO: 3945350 - RNA, 12 nt, Human adenovirus F
ggacggcgccaa

SEQ ID NO: 3945351 - RNA, 23 nt, Human adenovirus F
ggacgucagaacggcgugcugga

SEQ ID NO: 3945352 - RNA, 17 nt, Human adenovirus F
ggacucgucuccugcaa

SEQ ID NO: 3945353 - RNA, 15 nt, Human adenovirus F
ggacuuugcuccgcc

SEQ ID NO: 3945354 - RNA, 20 nt, Human adenovirus F
ggagaggcgguagcggcacg

SEQ ID NO: 3945355 - RNA, 22 nt, Human adenovirus F
ggagccggcgguggcaacccug

SEQ ID NO: 3945356 - RNA, 15 nt, Human adenovirus F
ggaggaagagggucu

SEQ ID NO: 3945357 - RNA, 19 nt, Human adenovirus F
ggaggcgauuugggaggga

SEQ ID NO: 3945358 - RNA, 23 nt, Human adenovirus F
ggaggcuauuggccagacgcagg

SEQ ID NO: 3945359 - RNA, 13 nt, Human adenovirus F
ggagggauuuaau

SEQ ID NO: 3945360 - RNA, 16 nt, Human adenovirus F
ggagggcaaaaugggc

SEQ ID NO: 3945361 - RNA, 16 nt, Human adenovirus F
ggagguagaaguggag

SEQ ID NO: 3945362 - RNA, 18 nt, Human adenovirus F
ggaggucaagccaagcug

SEQ ID NO: 3945363 - RNA, 15 nt, Human adenovirus F
ggagucuggcagcag

SEQ ID NO: 3945364 - RNA, 17 nt, Human adenovirus F
ggagucuuucagcuugg

SEQ ID NO: 3945365 - RNA, 21 nt, Human adenovirus F
ggaguggcauuaaaaacuuug

SEQ ID NO: 3945366 - RNA, 19 nt, Human adenovirus F
ggauaccgcugcagcugcu

SEQ ID NO: 3945367 - RNA, 18 nt, Human adenovirus F
ggauccagugcaggaaga

SEQ ID NO: 3945368 - RNA, 21 nt, Human adenovirus F
ggaucgcagcgggcaggagcc

SEQ ID NO: 3945369 - RNA, 16 nt, Human adenovirus F
ggaucgucgguggaua

SEQ ID NO: 3945370 - RNA, 15 nt, Human adenovirus F
ggauguacuccuuuu

SEQ ID NO: 3945371 - RNA, 15 nt, Human adenovirus F
ggcaauaggcacaga

SEQ ID NO: 3945372 - RNA, 18 nt, Human adenovirus F
ggcacaccuuugggcucc

SEQ ID NO: 3945373 - RNA, 19 nt, Human adenovirus F
ggcacaguaaucaaggguu

SEQ ID NO: 3945374 - RNA, 23 nt, Human adenovirus F
ggcagcccagcgcccgggcccug

SEQ ID NO: 3945375 - RNA, 16 nt, Human adenovirus F
ggcaggagcccgaaga

SEQ ID NO: 3945376 - RNA, 19 nt, Human adenovirus F
ggcaucacucauuuuuuca

SEQ ID NO: 3945377 - RNA, 12 nt, Human adenovirus F
ggcauggcagca

SEQ ID NO: 3945378 - RNA, 17 nt, Human adenovirus F
ggcauggcgggcagugg

SEQ ID NO: 3945379 - RNA, 16 nt, Human adenovirus F
ggcauguacggcggcg

SEQ ID NO: 3945380 - RNA, 23 nt, Human adenovirus F
ggccauggaaacgcagccugagc

SEQ ID NO: 3945381 - RNA, 16 nt, Human adenovirus F
ggcccuaaccacccgc

SEQ ID NO: 3945382 - RNA, 21 nt, Human adenovirus F
ggcccugggcuuauuggcaug

SEQ ID NO: 3945383 - RNA, 19 nt, Human adenovirus F
ggccgaugccaggcggcga

SEQ ID NO: 3945384 - RNA, 15 nt, Human adenovirus F
ggccuuucacccaga

SEQ ID NO: 3945385 - RNA, 20 nt, Human adenovirus F
ggcgagaaaauauggaggag

SEQ ID NO: 3945386 - RNA, 22 nt, Human adenovirus F
ggcgagaaaauauggaggagga

SEQ ID NO: 3945387 - RNA, 17 nt, Human adenovirus F
ggcgaggggcuggcccg

SEQ ID NO: 3945388 - RNA, 15 nt, Human adenovirus F
ggcgcagcgggaacg

SEQ ID NO: 3945389 - RNA, 15 nt, Human adenovirus F
ggcgccggacgggca

SEQ ID NO: 3945390 - RNA, 15 nt, Human adenovirus F
ggcgccggcgggaag

SEQ ID NO: 3945391 - RNA, 14 nt, Human adenovirus F
ggcgcugggacggg

SEQ ID NO: 3945392 - RNA, 19 nt, Human adenovirus F
ggcggacauugccucccug

SEQ ID NO: 3945393 - RNA, 17 nt, Human adenovirus F
ggcggaggugccccaga

SEQ ID NO: 3945394 - RNA, 15 nt, Human adenovirus F
ggcggaugguggcaa

SEQ ID NO: 3945395 - RNA, 18 nt, Human adenovirus F
ggcggaugguggcaagga

SEQ ID NO: 3945396 - RNA, 18 nt, Human adenovirus F
ggcggauuuuugcccgcg

SEQ ID NO: 3945397 - RNA, 14 nt, Human adenovirus F
ggcggcugguuaug

SEQ ID NO: 3945398 - RNA, 17 nt, Human adenovirus F
ggcgguacuaaggcggg

SEQ ID NO: 3945399 - RNA, 14 nt, Human adenovirus F
ggcgguggcgcagc

SEQ ID NO: 3945400 - RNA, 21 nt, Human adenovirus F
ggcuaugaguugugcuuugcc

SEQ ID NO: 3945401 - RNA, 14 nt, Human adenovirus F
ggcucagccccgcc

SEQ ID NO: 3945402 - RNA, 15 nt, Human adenovirus F
ggcugaccggcgcug

SEQ ID NO: 3945403 - RNA, 20 nt, Human adenovirus F
ggcugaugcauuugugggac

SEQ ID NO: 3945404 - RNA, 15 nt, Human adenovirus F
ggcuuccuuaacaag

SEQ ID NO: 3945405 - RNA, 19 nt, Human adenovirus F
ggcuucggugacaaacaag

SEQ ID NO: 3945406 - RNA, 22 nt, Human adenovirus F
ggcuugucgcagaaucuccugc

SEQ ID NO: 3945407 - RNA, 21 nt, Human adenovirus F
gggaaaucagaugcauuuugg

SEQ ID NO: 3945408 - RNA, 22 nt, Human adenovirus F
gggaaggauacaacguggcuca

SEQ ID NO: 3945409 - RNA, 15 nt, Human adenovirus F
gggagggaugcaugc

SEQ ID NO: 3945410 - RNA, 16 nt, Human adenovirus F
gggauucuaagggagg

SEQ ID NO: 3945411 - RNA, 16 nt, Human adenovirus F
gggcacaguaaucaag

SEQ ID NO: 3945412 - RNA, 22 nt, Human adenovirus F
gggcuggcccgcuugggggcgc

SEQ ID NO: 3945413 - RNA, 13 nt, Human adenovirus F
ggggaauggagcu

SEQ ID NO: 3945414 - RNA, 13 nt, Human adenovirus F
ggggaccagcugu

SEQ ID NO: 3945415 - RNA, 15 nt, Human adenovirus F
ggggauuggcggcua

SEQ ID NO: 3945416 - RNA, 23 nt, Human adenovirus F
ggggcgcuuucaguuggagcagc

SEQ ID NO: 3945417 - RNA, 19 nt, Human adenovirus F
gggggcccugaccgaccug

SEQ ID NO: 3945418 - RNA, 14 nt, Human adenovirus F
gggucuauuuggac

SEQ ID NO: 3945419 - RNA, 19 nt, Human adenovirus F
gggugcuacgcgccgaaga

SEQ ID NO: 3945420 - RNA, 13 nt, Human adenovirus F
ggguuuaccuggu

SEQ ID NO: 3945421 - RNA, 17 nt, Human adenovirus F
gguaagugcagaggcgu

SEQ ID NO: 3945422 - RNA, 20 nt, Human adenovirus F
gguaaugucuuuccaggguc

SEQ ID NO: 3945423 - RNA, 16 nt, Human adenovirus F
gguacaggugggcuug

SEQ ID NO: 3945424 - RNA, 16 nt, Human adenovirus F
gguagaaguggaggaa

SEQ ID NO: 3945425 - RNA, 15 nt, Human adenovirus F
gguagugagcucuuc

SEQ ID NO: 3945426 - RNA, 14 nt, Human adenovirus F
gguccagcaaaggc

SEQ ID NO: 3945427 - RNA, 22 nt, Human adenovirus F
gguccauacuugugcauuggca

SEQ ID NO: 3945428 - RNA, 23 nt, Human adenovirus F
gguccuuugccccccggcggcgg

SEQ ID NO: 3945429 - RNA, 13 nt, Human adenovirus F
ggucgcaggguuc

SEQ ID NO: 3945430 - RNA, 14 nt, Human adenovirus F
ggucguaaugagga

SEQ ID NO: 3945431 - RNA, 17 nt, Human adenovirus F
ggucguccugucgcccc

SEQ ID NO: 3945432 - RNA, 22 nt, Human adenovirus F
gguggaccccauggaugagccc

SEQ ID NO: 3945433 - RNA, 20 nt, Human adenovirus F
gguggauaccgcugcagcug

SEQ ID NO: 3945434 - RNA, 23 nt, Human adenovirus F
gguggauaccgcugcagcugcug

SEQ ID NO: 3945435 - RNA, 18 nt, Human adenovirus F
gguggcgcgcgaggaggu

SEQ ID NO: 3945436 - RNA, 22 nt, Human adenovirus F
ggugggcugauuuggaagauga

SEQ ID NO: 3945437 - RNA, 15 nt, Human adenovirus F
gguucucuucaggcu

SEQ ID NO: 3945438 - RNA, 19 nt, Human adenovirus F
gguuguaaagcgagccaaa

SEQ ID NO: 3945439 - RNA, 14 nt, Human adenovirus F
gguuuagccacauc

SEQ ID NO: 3945440 - RNA, 14 nt, Human adenovirus F
guaagugcagaggc

SEQ ID NO: 3945441 - RNA, 11 nt, Human adenovirus F
guaccaggagg

SEQ ID NO: 3945442 - RNA, 19 nt, Human adenovirus F
guaccaguccgggccagac

SEQ ID NO: 3945443 - RNA, 19 nt, Human adenovirus F
ugcauuuuggccugaauuu

SEQ ID NO: 3945444 - RNA, 22 nt, Human adenovirus F
ugccaaagcggcaaaagcuuga

SEQ ID NO: 3945445 - RNA, 21 nt, Human adenovirus F
ugccaucgcugaccagcagca

SEQ ID NO: 3945446 - RNA, 19 nt, Human adenovirus F
ugccgccaugacugccgcu

SEQ ID NO: 3945447 - RNA, 15 nt, Human adenovirus F
ugccgcgcgggcagg

SEQ ID NO: 3945448 - RNA, 16 nt, Human adenovirus F
ugccgcgcgggcagga

SEQ ID NO: 3945449 - RNA, 13 nt, Human adenovirus F
ugccuccagcacu

SEQ ID NO: 3945450 - RNA, 16 nt, Human adenovirus F
ugccucguagaaguca

SEQ ID NO: 3945451 - RNA, 22 nt, Human adenovirus F
ugccucuacugcucguggcaug

SEQ ID NO: 3945452 - RNA, 13 nt, Human adenovirus F
ugccugcagcgcu

SEQ ID NO: 3945453 - RNA, 16 nt, Human adenovirus F
ugccuuucucccaggc

SEQ ID NO: 3945454 - RNA, 15 nt, Human adenovirus F
ugcgaccggcccgga

SEQ ID NO: 3945455 - RNA, 15 nt, Human adenovirus F
ugcgcacccuggugg

SEQ ID NO: 3945456 - RNA, 14 nt, Human adenovirus F
ugcgccccauuaaa

SEQ ID NO: 3945457 - RNA, 13 nt, Human adenovirus F
ugcgggcucugau

SEQ ID NO: 3945458 - RNA, 15 nt, Human adenovirus F
ugcgucgcuggcucc

SEQ ID NO: 3945459 - RNA, 22 nt, Human adenovirus F
ugcguucccguaaaaaggaggg

SEQ ID NO: 3945460 - RNA, 20 nt, Human adenovirus F
ugcuacggaggaagaggguc

SEQ ID NO: 3945461 - RNA, 22 nt, Human adenovirus F
ugcuacuacuuuaacucuuaca

SEQ ID NO: 3945462 - RNA, 17 nt, Human adenovirus F
ugcuauugaaaauaacu

SEQ ID NO: 3945463 - RNA, 15 nt, Human adenovirus F
ugcuccugaagcaca

SEQ ID NO: 3945464 - RNA, 22 nt, Human adenovirus F
ugcucgcaaacaaagaaguaca

SEQ ID NO: 3945465 - RNA, 14 nt, Human adenovirus F
ugcucguggcaugg

SEQ ID NO: 3945466 - RNA, 18 nt, Human adenovirus F
ugcucuuuuugaaucauu

SEQ ID NO: 3945467 - RNA, 14 nt, Human adenovirus F
ugcugcacugccau

SEQ ID NO: 3945468 - RNA, 17 nt, Human adenovirus F
ugcugccucuacugcuc

SEQ ID NO: 3945469 - RNA, 18 nt, Human adenovirus F
ugcuguacgccaacuccg

SEQ ID NO: 3945470 - RNA, 22 nt, Human adenovirus F
ugcuuaucccgcgcuaaaucuu

SEQ ID NO: 3945471 - RNA, 18 nt, Human adenovirus F
ugcuucugccagugcagg

SEQ ID NO: 3945472 - RNA, 12 nt, Human adenovirus F
ugcuuuuucacg

SEQ ID NO: 3945473 - RNA, 20 nt, Human adenovirus F
uggaacauuaauccaaugca

SEQ ID NO: 3945474 - RNA, 22 nt, Human adenovirus F
uggaagagggcgaggggcuggc

SEQ ID NO: 3945475 - RNA, 22 nt, Human adenovirus F
uggaagagguaguugagcgugg

SEQ ID NO: 3945476 - RNA, 13 nt, Human adenovirus F
uggacauggccag

SEQ ID NO: 3945477 - RNA, 15 nt, Human adenovirus F
uggaccuggaagagg

SEQ ID NO: 3945478 - RNA, 14 nt, Human adenovirus F
uggacgggcuggcu

SEQ ID NO: 3945479 - RNA, 16 nt, Human adenovirus F
uggagccgacuucaag

SEQ ID NO: 3945480 - RNA, 22 nt, Human adenovirus F
uggaggaaacccuaguugugga

SEQ ID NO: 3945481 - RNA, 20 nt, Human adenovirus F
uggaggagauggugggccgc

SEQ ID NO: 3945482 - RNA, 18 nt, Human adenovirus F
uggaggaggaucuuaagc

SEQ ID NO: 3945483 - RNA, 21 nt, Human adenovirus F
uggagggcggcaacauuccug

SEQ ID NO: 3945484 - RNA, 16 nt, Human adenovirus F
uggagggcgucaugcu

SEQ ID NO: 3945485 - RNA, 22 nt, Human adenovirus F
uggauaccgcugcagcugcugc

SEQ ID NO: 3945486 - RNA, 18 nt, Human adenovirus F
uggcaucucgauccaaca

SEQ ID NO: 3945487 - RNA, 21 nt, Human adenovirus F
uggcaugagggauucuaaggg

SEQ ID NO: 3945488 - RNA, 15 nt, Human adenovirus F
uggcccaccacucug

SEQ ID NO: 3945489 - RNA, 13 nt, Human adenovirus F
uggccccuaccag

SEQ ID NO: 3945490 - RNA, 17 nt, Human adenovirus F
uggccccuaccagccgu

SEQ ID NO: 3945491 - RNA, 15 nt, Human adenovirus F
uggcccuggccugga

SEQ ID NO: 3945492 - RNA, 16 nt, Human adenovirus F
uggcgcgcgaggaggu

SEQ ID NO: 3945493 - RNA, 19 nt, Human adenovirus F
uggcggcccugcaaagcca

SEQ ID NO: 3945494 - RNA, 15 nt, Human adenovirus F
uggcgggcaguggcc

SEQ ID NO: 3945495 - RNA, 14 nt, Human adenovirus F
uggcucagccccgc

SEQ ID NO: 3945496 - RNA, 16 nt, Human adenovirus F
uggcucugcagcagcg

SEQ ID NO: 3945497 - RNA, 14 nt, Human adenovirus F
ugggacgaggagga

SEQ ID NO: 3945498 - RNA, 15 nt, Human adenovirus F
ugggauggguaagug

SEQ ID NO: 3945499 - RNA, 22 nt, Human adenovirus F
ugggauuugccgcagccagugg

SEQ ID NO: 3945500 - RNA, 17 nt, Human adenovirus F
ugggcguccaguggagc

SEQ ID NO: 3945501 - RNA, 22 nt, Human adenovirus F
ugggcguguuuguggguauaua

SEQ ID NO: 3945502 - RNA, 20 nt, Human adenovirus F
uggggcagaacguucuucac

SEQ ID NO: 3945503 - RNA, 20 nt, Human adenovirus F
uggggcgcgguggucuccag

SEQ ID NO: 3945504 - RNA, 15 nt, Human adenovirus F
ugggucgcagcaggu

SEQ ID NO: 3945505 - RNA, 22 nt, Human adenovirus F
ugguccugacuauuuuaugcag

SEQ ID NO: 3945506 - RNA, 21 nt, Human adenovirus F
ugguuccucauacaaaugcuc

SEQ ID NO: 3945507 - RNA, 22 nt, Human adenovirus F
ugguuuuuuucgcggucggcac

SEQ ID NO: 3945508 - RNA, 17 nt, Human adenovirus F
uguaccaguccgggcca

SEQ ID NO: 3945509 - RNA, 21 nt, Human adenovirus F
uguagccuuuaacugcgcaau

SEQ ID NO: 3945510 - RNA, 14 nt, Human adenovirus F
uguaugggcagcau

SEQ ID NO: 3945511 - RNA, 20 nt, Human adenovirus F
uguauuuguauaaucuuaaa

SEQ ID NO: 3945512 - RNA, 20 nt, Human adenovirus F
ugucacugccguugcaaccu

SEQ ID NO: 3945513 - RNA, 13 nt, Human adenovirus F
uguccuuaaggag

SEQ ID NO: 3945514 - RNA, 19 nt, Human adenovirus F
ugucgguuacuucuucagc

SEQ ID NO: 3945515 - RNA, 21 nt, Human adenovirus F
ugucgucgacgacggcgccgg

SEQ ID NO: 3945516 - RNA, 12 nt, Human adenovirus F
ugugagauuugu

SEQ ID NO: 3945517 - RNA, 17 nt, Human adenovirus F
ugugagcgccagccgcc

SEQ ID NO: 3945518 - RNA, 20 nt, Human adenovirus F
ugugcaacacagccgggaca

SEQ ID NO: 3945519 - RNA, 17 nt, Human adenovirus F
ugugcagauggaaacug

SEQ ID NO: 3945520 - RNA, 16 nt, Human adenovirus F
ugugcagcaaaaacuc

SEQ ID NO: 3945521 - RNA, 21 nt, Human adenovirus F
ugugcccauagacaaggaggu

SEQ ID NO: 3945522 - RNA, 21 nt, Human adenovirus F
ugugccgcgcgggcaggagga

SEQ ID NO: 3945523 - RNA, 15 nt, Human adenovirus F
uguuacgccagagag

SEQ ID NO: 3945524 - RNA, 21 nt, Human adenovirus F
uguucaaggaaacaacagccu

SEQ ID NO: 3945525 - RNA, 17 nt, Human adenovirus F
uguugcauguuggaaag

SEQ ID NO: 3945526 - RNA, 13 nt, Human adenovirus F
uguuuaagccaga

SEQ ID NO: 3945527 - RNA, 13 nt, Human adenovirus F
uguuuuccucuga

SEQ ID NO: 3945528 - RNA, 14 nt, Human adenovirus F
uuaaaccaauuugc

SEQ ID NO: 3945529 - RNA, 20 nt, Human adenovirus F
uuaacacuggcagaggcuua

SEQ ID NO: 3945530 - RNA, 18 nt, Human adenovirus F
uuaacagcuccucagccc

SEQ ID NO: 3945531 - RNA, 21 nt, Human adenovirus F
uuaaccacccccaacucugag

SEQ ID NO: 3945532 - RNA, 14 nt, Human adenovirus F
uuaaccuuaaaauu

SEQ ID NO: 3945533 - RNA, 20 nt, Human adenovirus F
uuaauauccuucagagcauu

SEQ ID NO: 3945534 - RNA, 19 nt, Human adenovirus F
uuaaucucccuccccccuu

SEQ ID NO: 3945535 - RNA, 14 nt, Human adenovirus F
uuacagcccccacc

SEQ ID NO: 3945536 - RNA, 20 nt, Human adenovirus F
uuacauugguuuuagggaca

SEQ ID NO: 3945537 - RNA, 16 nt, Human adenovirus F
uuacauuguucgcugc

SEQ ID NO: 3945538 - RNA, 23 nt, Human adenovirus F
uuagaaguaaccaacggaggaaa

SEQ ID NO: 3945539 - RNA, 14 nt, Human adenovirus F
uuagauguggaaaa

SEQ ID NO: 3945540 - RNA, 22 nt, Human adenovirus F
uuagcacugcgguggaggccau

SEQ ID NO: 3945541 - RNA, 22 nt, Human adenovirus F
uuagcccguuuugcauuuuugg

SEQ ID NO: 3945542 - RNA, 14 nt, Human adenovirus F
uuauaaucaugcaa

SEQ ID NO: 3945543 - RNA, 17 nt, Human adenovirus F
uuaucccaugaccaaac

SEQ ID NO: 3945544 - RNA, 23 nt, Human adenovirus F
uuaugaaacacacaucacuguua

SEQ ID NO: 3945545 - RNA, 16 nt, Human adenovirus F
uucaaacccagccgca

SEQ ID NO: 3945546 - RNA, 23 nt, Human adenovirus F
uucaaagacgccgccuugcaugc

SEQ ID NO: 3945547 - RNA, 22 nt, Human adenovirus F
uucacaaaauggacgaagacug

SEQ ID NO: 3945548 - RNA, 22 nt, Human adenovirus F
uucagacgaggaggcggaggag

SEQ ID NO: 3945549 - RNA, 15 nt, Human adenovirus F
uucaugcaugcagac

SEQ ID NO: 3945550 - RNA, 14 nt, Human adenovirus F
uuccaaacuucacg

SEQ ID NO: 3945551 - RNA, 18 nt, Human adenovirus F
uuccaccaacugcucuuu

SEQ ID NO: 3945552 - RNA, 18 nt, Human adenovirus F
uuccagcagcaccaccug

SEQ ID NO: 3945553 - RNA, 14 nt, Human adenovirus F
uuccagcauaauaa

SEQ ID NO: 3945554 - RNA, 19 nt, Human adenovirus F
uucccgugucaccugcagu

SEQ ID NO: 3945555 - RNA, 22 nt, Human adenovirus F
uucccugucguugccagccggu

SEQ ID NO: 3945556 - RNA, 15 nt, Human adenovirus F
uuccugcgcugcuac

SEQ ID NO: 3945557 - RNA, 20 nt, Human adenovirus F
uucgcagaaacaugccaccc

SEQ ID NO: 3945558 - RNA, 13 nt, Human adenovirus F
uucgcccggacac

SEQ ID NO: 3945559 - RNA, 21 nt, Human coronavirus 229E
uggaaaagacagccuaaugau

SEQ ID NO: 3945560 - RNA, 21 nt, Human coronavirus 229E
uggcucuagguuuguucacau

SEQ ID NO: 3945561 - RNA, 15 nt, Human coronavirus 229E
uggucgcagugccau

SEQ ID NO: 3945562 - RNA, 18 nt, Human coronavirus 229E
uguaaaacuauugaagac

SEQ ID NO: 3945563 - RNA, 23 nt, Human coronavirus 229E
uguaaccacacuuugcuaugcaa

SEQ ID NO: 3945564 - RNA, 19 nt, Human coronavirus 229E
uguaauagaacaguuuaug

SEQ ID NO: 3945565 - RNA, 19 nt, Human coronavirus 229E
uguaauuuugcuuggaaga

SEQ ID NO: 3945566 - RNA, 11 nt, Human coronavirus 229E
uguauuuugcu

SEQ ID NO: 3945567 - RNA, 14 nt, Human coronavirus 229E
ugucugcuguuaau

SEQ ID NO: 3945568 - RNA, 19 nt, Human coronavirus 229E
ugugucugcuguuaaucaa

SEQ ID NO: 3945569 - RNA, 16 nt, Human coronavirus 229E
uguuaaugaugcuauu

SEQ ID NO: 3945570 - RNA, 12 nt, Human coronavirus 229E
uguuacuucugg

SEQ ID NO: 3945571 - RNA, 22 nt, Human coronavirus 229E
uguuaguuccuuuaugaauguu

SEQ ID NO: 3945572 - RNA, 18 nt, Human coronavirus 229E
uguuauuaacagacugag

SEQ ID NO: 3945573 - RNA, 21 nt, Human coronavirus 229E
uguuuaucagcaagcuguugu

SEQ ID NO: 3945574 - RNA, 21 nt, Human coronavirus 229E
uguuuaucauaaacauacguu

SEQ ID NO: 3945575 - RNA, 19 nt, Human coronavirus 229E
uguuuuaugguuugaagau

SEQ ID NO: 3945576 - RNA, 14 nt, Human coronavirus 229E
uuaauuacacuguu

SEQ ID NO: 3945577 - RNA, 14 nt, Human coronavirus 229E
uuacucuguuugca

SEQ ID NO: 3945578 - RNA, 17 nt, Human coronavirus 229E
uuauucagaaaauguau

SEQ ID NO: 3945579 - RNA, 15 nt, Human coronavirus 229E
uuauugcuuuguaaa

SEQ ID NO: 3945580 - RNA, 17 nt, Human coronavirus 229E
uucaaaaacguuucaga

SEQ ID NO: 3945581 - RNA, 21 nt, Human coronavirus 229E
uucaaccacguaauguuucau

SEQ ID NO: 3945582 - RNA, 18 nt, Human coronavirus 229E
uucacuagagaaaugcaa

SEQ ID NO: 3945583 - RNA, 12 nt, Human coronavirus 229E
aaaacgaaagau

SEQ ID NO: 3945584 - RNA, 15 nt, Human coronavirus 229E
aaacuucugccaaga

SEQ ID NO: 3945585 - RNA, 19 nt, Human coronavirus 229E
aaagcucccaaaugguguu

SEQ ID NO: 3945586 - RNA, 15 nt, Human coronavirus 229E
aaaugcaaaagccac

SEQ ID NO: 3945587 - RNA, 16 nt, Human coronavirus 229E
aaauguauuugcuguu

SEQ ID NO: 3945588 - RNA, 13 nt, Human coronavirus 229E
aacaaggcaacuc

SEQ ID NO: 3945589 - RNA, 15 nt, Human coronavirus 229E
aacaggcauuacugu

SEQ ID NO: 3945590 - RNA, 14 nt, Human coronavirus 229E
aacauacguuuauu

SEQ ID NO: 3945591 - RNA, 19 nt, Human coronavirus 229E
aaccacguaauguuucaua

SEQ ID NO: 3945592 - RNA, 13 nt, Human coronavirus 229E
aaccucuauugcu

SEQ ID NO: 3945593 - RNA, 19 nt, Human coronavirus 229E
aacuaauuaagcuuuguuu

SEQ ID NO: 3945594 - RNA, 19 nt, Human coronavirus 229E
aagacaaaaauaagcuuau

SEQ ID NO: 3945595 - RNA, 21 nt, Human coronavirus 229E
aagccacgguggaaaagacag

SEQ ID NO: 3945596 - RNA, 23 nt, Human coronavirus 229E
aagcuuuguuucacuugccauau

SEQ ID NO: 3945597 - RNA, 14 nt, Human coronavirus 229E
aagugcuuuaacug

SEQ ID NO: 3945598 - RNA, 13 nt, Human coronavirus 229E
aauaacuuuguua

SEQ ID NO: 3945599 - RNA, 20 nt, Human coronavirus 229E
aauauaauuuauugcaacuc

SEQ ID NO: 3945600 - RNA, 12 nt, Human coronavirus 229E
aaucaaaagcuc

SEQ ID NO: 3945601 - RNA, 20 nt, Human coronavirus 229E
aaucagaguccugcuucuuc

SEQ ID NO: 3945602 - RNA, 14 nt, Human coronavirus 229E
aaugcaaaagccac

SEQ ID NO: 3945603 - RNA, 14 nt, Human coronavirus 229E
aaugcaaucacugu

SEQ ID NO: 3945604 - RNA, 14 nt, Human coronavirus 229E
aauggaagagccag

SEQ ID NO: 3945605 - RNA, 13 nt, Human coronavirus 229E
aaugguaagccag

SEQ ID NO: 3945606 - RNA, 19 nt, Human coronavirus 229E
aauguauucguuucucaua

SEQ ID NO: 3945607 - RNA, 16 nt, Human coronavirus 229E
aaugucaaaugacaau

SEQ ID NO: 3945608 - RNA, 14 nt, Human coronavirus 229E
aaugucacacaaug

SEQ ID NO: 3945609 - RNA, 13 nt, Human coronavirus 229E
aauugcuguucaa

SEQ ID NO: 3945610 - RNA, 17 nt, Human coronavirus 229E
aauugguggaauugcuu

SEQ ID NO: 3945611 - RNA, 13 nt, Human coronavirus 229E
acagcuuggcacu

SEQ ID NO: 3945612 - RNA, 19 nt, Human coronavirus 229E
acaguuuugggcaauuuuu

SEQ ID NO: 3945613 - RNA, 13 nt, Human coronavirus 229E
acauagauuggcu

SEQ ID NO: 3945614 - RNA, 14 nt, Human coronavirus 229E
acaugggauuucau

SEQ ID NO: 3945615 - RNA, 22 nt, Human coronavirus 229E
accagugcgugaugaaguuucu

SEQ ID NO: 3945616 - RNA, 14 nt, Human coronavirus 229E
acccauuugaagaa

SEQ ID NO: 3945617 - RNA, 19 nt, Human coronavirus 229E
accccauaaagaugcaaaa

SEQ ID NO: 3945618 - RNA, 18 nt, Human coronavirus 229E
accguggcagagcugcuc

SEQ ID NO: 3945619 - RNA, 22 nt, Human coronavirus 229E
accuaucguaguugauugcucc

SEQ ID NO: 3945620 - RNA, 14 nt, Human coronavirus 229E
accugcaacugcug

SEQ ID NO: 3945621 - RNA, 19 nt, Human coronavirus 229E
acgaucagagcugcuuuua

SEQ ID NO: 3945622 - RNA, 15 nt, Human coronavirus 229E
acgcuguuuuaacuu

SEQ ID NO: 3945623 - RNA, 18 nt, Human coronavirus 229E
acgugaaagauggcacug

SEQ ID NO: 3945624 - RNA, 18 nt, Human coronavirus 229E
acuaguuacucuguuugc

SEQ ID NO: 3945625 - RNA, 21 nt, Human coronavirus 229E
acucauuacaaaugugcugga

SEQ ID NO: 3945626 - RNA, 14 nt, Human coronavirus 229E
acucuguuugcaac

SEQ ID NO: 3945627 - RNA, 15 nt, Human coronavirus 229E
acugcacuuaacaag

SEQ ID NO: 3945628 - RNA, 16 nt, Human coronavirus 229E
acugguagauuggcug

SEQ ID NO: 3945629 - RNA, 15 nt, Human coronavirus 229E
acuguuguugaagaa

SEQ ID NO: 3945630 - RNA, 13 nt, Human coronavirus 229E
acuuauaauugca

SEQ ID NO: 3945631 - RNA, 18 nt, Human coronavirus 229E
acuucugccaagagucuu

SEQ ID NO: 3945632 - RNA, 18 nt, Human coronavirus 229E
acuugugucugcuguuaa

SEQ ID NO: 3945633 - RNA, 15 nt, Human coronavirus 229E
acuuucacuacuaga

SEQ ID NO: 3945634 - RNA, 13 nt, Human coronavirus 229E
agaacaguuuaug

SEQ ID NO: 3945635 - RNA, 21 nt, Human coronavirus 229E
agaauucaacccaucucaaac

SEQ ID NO: 3945636 - RNA, 22 nt, Human coronavirus 229E
agaguccugcuucuucucaaac

SEQ ID NO: 3945637 - RNA, 21 nt, Human coronavirus 229E
agagucgcggucguggugaau

SEQ ID NO: 3945638 - RNA, 16 nt, Human coronavirus 229E
agaucagcuuguuguu

SEQ ID NO: 3945639 - RNA, 21 nt, Human coronavirus 229E
agauugcuucauuuuuucuaa

SEQ ID NO: 3945640 - RNA, 15 nt, Human coronavirus 229E
agcacccuugaaaau

SEQ ID NO: 3945641 - RNA, 21 nt, Human coronavirus 229E
agcaugaaaugcaaaagccac

SEQ ID NO: 3945642 - RNA, 11 nt, Human coronavirus 229E
agccuuuguug

SEQ ID NO: 3945643 - RNA, 21 nt, Human coronavirus 229E
agccuuuguugcuuaauugcu

SEQ ID NO: 3945644 - RNA, 15 nt, Human coronavirus 229E
agcguggucuggguu

SEQ ID NO: 3945645 - RNA, 14 nt, Human coronavirus 229E
agcuccaacaggca

SEQ ID NO: 3945646 - RNA, 16 nt, Human coronavirus 229E
agcuuaauuacacugu

SEQ ID NO: 3945647 - RNA, 21 nt, Human coronavirus 229E
agcuuauaggcuauuggaaug

SEQ ID NO: 3945648 - RNA, 16 nt, Human coronavirus 229E
aggcucauuguauguu

SEQ ID NO: 3945649 - RNA, 16 nt, Human coronavirus 229E
aggugaacgcuaguau

SEQ ID NO: 3945650 - RNA, 15 nt, Human coronavirus 229E
aguaaaacacgguga

SEQ ID NO: 3945651 - RNA, 23 nt, Human coronavirus 229E
aguaaagguauaagaaauuugcu

SEQ ID NO: 3945652 - RNA, 16 nt, Human coronavirus 229E
agucaggcaacacugu

SEQ ID NO: 3945653 - RNA, 16 nt, Human coronavirus 229E
aguccugcuucuucuc

SEQ ID NO: 3945654 - RNA, 17 nt, Human coronavirus 229E
aguggcuaauugggcuu

SEQ ID NO: 3945655 - RNA, 20 nt, Human coronavirus 229E
aguuaaaugcauucacuaga

SEQ ID NO: 3945656 - RNA, 22 nt, Human coronavirus 229E
aguuaaaugcauucacuagaga

SEQ ID NO: 3945657 - RNA, 16 nt, Human coronavirus 229E
aguugcuacugcacuu

SEQ ID NO: 3945658 - RNA, 16 nt, Human coronavirus 229E
aguuggaauuuugcuu

SEQ ID NO: 3945659 - RNA, 23 nt, Human coronavirus 229E
aguuucuauugaaacugacauaa

SEQ ID NO: 3945660 - RNA, 16 nt, Human coronavirus 229E
aguuuguuauuucacg

SEQ ID NO: 3945661 - RNA, 15 nt, Human coronavirus 229E
gcacugcuggcucua

SEQ ID NO: 3945662 - RNA, 13 nt, Human coronavirus 229E
gcagguguugugg

SEQ ID NO: 3945663 - RNA, 18 nt, Human coronavirus 229E
gcaguauacuucugcuug

SEQ ID NO: 3945664 - RNA, 15 nt, Human coronavirus 229E
gcaucuuuuaacaaa

SEQ ID NO: 3945665 - RNA, 18 nt, Human coronavirus 229E
gccaaauuacacuguucc

SEQ ID NO: 3945666 - RNA, 19 nt, Human coronavirus 229E
gccacucguacuugcuuug

SEQ ID NO: 3945667 - RNA, 20 nt, Human coronavirus 229E
gccacucguacuugcuuugu

SEQ ID NO: 3945668 - RNA, 23 nt, Human coronavirus 229E
gccacuguguuguuugaaauuca

SEQ ID NO: 3945669 - RNA, 15 nt, Human coronavirus 229E
gccgagcacuacuau

SEQ ID NO: 3945670 - RNA, 17 nt, Human coronavirus 229E
gcuaucgcuauuucacu

SEQ ID NO: 3945671 - RNA, 15 nt, Human coronavirus 229E
gcuccugaggggcuu

SEQ ID NO: 3945672 - RNA, 17 nt, Human coronavirus 229E
gcucuagguuuguucac

SEQ ID NO: 3945673 - RNA, 14 nt, Human coronavirus 229E
gcugacuuggcuug

SEQ ID NO: 3945674 - RNA, 17 nt, Human coronavirus 229E
ggaugaucaugcuuugg

SEQ ID NO: 3945675 - RNA, 13 nt, Human coronavirus 229E
ggcaguguauguu

SEQ ID NO: 3945676 - RNA, 20 nt, Human coronavirus 229E
ggcaguugcugcggcucuua

SEQ ID NO: 3945677 - RNA, 14 nt, Human coronavirus 229E
guccaauggcacuu

SEQ ID NO: 3945678 - RNA, 16 nt, Human coronavirus 229E
guccugcuucuucuca

SEQ ID NO: 3945679 - RNA, 16 nt, Human coronavirus 229E
gucuuuccauugcuga

SEQ ID NO: 3945680 - RNA, 20 nt, Human coronavirus 229E
guggccaaugguguuaaagc

SEQ ID NO: 3945681 - RNA, 21 nt, Human coronavirus 229E
guuacaaauugccaaauuaca

SEQ ID NO: 3945682 - RNA, 15 nt, Human coronavirus 229E
guuacaaccucaauu

SEQ ID NO: 3945683 - RNA, 17 nt, Human coronavirus 229E
guuauugauuucuaaac

SEQ ID NO: 3945684 - RNA, 23 nt, Human coronavirus 229E
guucaaccacguaauguuucaua

SEQ ID NO: 3945685 - RNA, 14 nt, Human coronavirus 229E
guucuuucuuuuau

SEQ ID NO: 3945686 - RNA, 14 nt, Human coronavirus 229E
guugagcuaccugu

SEQ ID NO: 3945687 - RNA, 21 nt, Human coronavirus 229E
guugagcuaccugugucuauu

SEQ ID NO: 3945688 - RNA, 16 nt, Human coronavirus 229E
guuguguauuuugcuu

SEQ ID NO: 3945689 - RNA, 17 nt, Human coronavirus 229E
guuguucuacugguugc

SEQ ID NO: 3945690 - RNA, 16 nt, Human coronavirus 229E
guuuguucacauugca

SEQ ID NO: 3945691 - RNA, 16 nt, Human coronavirus 229E
uaaauuauguugcauu

SEQ ID NO: 3945692 - RNA, 17 nt, Human coronavirus 229E
uaaccacacuuugcuau

SEQ ID NO: 3945693 - RNA, 22 nt, Human coronavirus 229E
uaaccuucuggguuuuaaagau

SEQ ID NO: 3945694 - RNA, 21 nt, Human coronavirus 229E
uaacuaauaccucaucuguug

SEQ ID NO: 3945695 - RNA, 13 nt, Human coronavirus 229E
uaaugaugcuauu

SEQ ID NO: 3945696 - RNA, 17 nt, Human coronavirus 229E
uaaugugucacaaaccu

SEQ ID NO: 3945697 - RNA, 11 nt, Human coronavirus 229E
uaauguuguag

SEQ ID NO: 3945698 - RNA, 21 nt, Human coronavirus 229E
uacgcaacuuugauugcugua

SEQ ID NO: 3945699 - RNA, 19 nt, Human coronavirus 229E
uacuacugguuuugucuau

SEQ ID NO: 3945700 - RNA, 20 nt, Human coronavirus 229E
uacuaucaacccauucaaca

SEQ ID NO: 3945701 - RNA, 17 nt, Human coronavirus 229E
uacuauguuacugaacc

SEQ ID NO: 3945702 - RNA, 20 nt, Human coronavirus 229E
uacuggcgucccacaaccug

SEQ ID NO: 3945703 - RNA, 16 nt, Human coronavirus 229E
uacugguguuaaugau

SEQ ID NO: 3945704 - RNA, 12 nt, Human coronavirus 229E
uacuucugcuug

SEQ ID NO: 3945705 - RNA, 14 nt, Human coronavirus 229E
uagaagacauacuu

SEQ ID NO: 3945706 - RNA, 19 nt, Human coronavirus 229E
uagaugaauacauugcuuu

SEQ ID NO: 3945707 - RNA, 20 nt, Human coronavirus 229E
uaguuacggcuuuucuaaug

SEQ ID NO: 3945708 - RNA, 16 nt, Human coronavirus 229E
uauauugauguuaaua

SEQ ID NO: 3945709 - RNA, 20 nt, Human coronavirus 229E
uauccugcugguguuaauau

SEQ ID NO: 3945710 - RNA, 22 nt, Human coronavirus 229E
uauugugucgcuaccuguuuau

SEQ ID NO: 3945711 - RNA, 13 nt, Human coronavirus 229E
ucaaauugaaaau

SEQ ID NO: 3945712 - RNA, 23 nt, Human coronavirus 229E
ucaacaaggcaacucauugaacc

SEQ ID NO: 3945713 - RNA, 12 nt, Human coronavirus 229E
ucaacagcugcu

SEQ ID NO: 3945714 - RNA, 23 nt, Human coronavirus 229E
ucaauauuauaauggcauuaugg

SEQ ID NO: 3945715 - RNA, 16 nt, Human coronavirus 229E
ucaaugucacuacugc

SEQ ID NO: 3945716 - RNA, 14 nt, Human coronavirus 229E
ucaauuuugaagaa

SEQ ID NO: 3945717 - RNA, 19 nt, Human coronavirus 229E
ucacauuguuuccaaagag

SEQ ID NO: 3945718 - RNA, 15 nt, Human coronavirus 229E
ucaccugcaacugcu

SEQ ID NO: 3945719 - RNA, 13 nt, Human coronavirus 229E
ucacgacagguua

SEQ ID NO: 3945720 - RNA, 14 nt, Human coronavirus 229E
ucagagcugcuuuu

SEQ ID NO: 3945721 - RNA, 19 nt, Human coronavirus 229E
ucaguuuggacacuauaaa

SEQ ID NO: 3945722 - RNA, 19 nt, Human coronavirus 229E
ucauaaacauacguuuauu

SEQ ID NO: 3945723 - RNA, 22 nt, Human coronavirus 229E
ucauugaaccauuuaacuucuc

SEQ ID NO: 3945724 - RNA, 17 nt, Human coronavirus 229E
uccaagacgugaaagau

SEQ ID NO: 3945725 - RNA, 21 nt, Human coronavirus 229E
uccacacuuggguaaguuucu

SEQ ID NO: 3945726 - RNA, 20 nt, Human coronavirus 229E
uccagacagcuugcacaaca

SEQ ID NO: 3945727 - RNA, 15 nt, Human coronavirus 229E
ucgugcucaucuuug

SEQ ID NO: 3945728 - RNA, 22 nt, Human coronavirus 229E
ucguggugaauccaaaccucaa

SEQ ID NO: 3945729 - RNA, 23 nt, Human coronavirus 229E
ucuacaagacaugggauuucauu

SEQ ID NO: 3945730 - RNA, 16 nt, Human coronavirus 229E
ucuuauacacaauggu

SEQ ID NO: 3945731 - RNA, 20 nt, Human coronavirus 229E
ugaaacugacauaauugaug

SEQ ID NO: 3945732 - RNA, 13 nt, Human coronavirus 229E
ugaauacaugaca

SEQ ID NO: 3945733 - RNA, 19 nt, Human coronavirus 229E
ugaccacaacuuuggaagu

SEQ ID NO: 3945734 - RNA, 18 nt, Human coronavirus 229E
ugagcaacaugacagaaa

SEQ ID NO: 3945735 - RNA, 20 nt, Human coronavirus 229E
ugaucaacaaguagauaggc

SEQ ID NO: 3945736 - RNA, 22 nt, Human coronavirus 229E
ugaucaugcuuugguuguuaau

SEQ ID NO: 3945737 - RNA, 22 nt, Human coronavirus 229E
ugauggugcuaaaacugaaccu

SEQ ID NO: 3945738 - RNA, 15 nt, Human coronavirus 229E
ugauuucuaaacuaa

SEQ ID NO: 3945739 - RNA, 16 nt, Human coronavirus 229E
ugcaacugcugaacca

SEQ ID NO: 3945740 - RNA, 21 nt, Human coronavirus 229E
ugcaacuugugucugcuguua

SEQ ID NO: 3945741 - RNA, 17 nt, Human coronavirus 229E
ugcaaugucacauuugu

SEQ ID NO: 3945742 - RNA, 17 nt, Human coronavirus 229E
ugcacagacgcuguuuu

SEQ ID NO: 3945743 - RNA, 19 nt, Human coronavirus 229E
ugcagaaaccacugauuuu

SEQ ID NO: 3945744 - RNA, 19 nt, Human coronavirus 229E
ugcauaugccuuguugcau

SEQ ID NO: 3945745 - RNA, 17 nt, Human coronavirus 229E
ugccaaauuacacuguu

SEQ ID NO: 3945746 - RNA, 19 nt, Human coronavirus 229E
ugcccaaagaccauccaca

SEQ ID NO: 3945747 - RNA, 22 nt, Human coronavirus 229E
ugcuaauauaauuuauugcaac

SEQ ID NO: 3945748 - RNA, 15 nt, Human coronavirus 229E
ugcuauguugucuga

SEQ ID NO: 3945749 - RNA, 20 nt, Human coronavirus 229E
ugcuauguugucugaaaauu

SEQ ID NO: 3945750 - RNA, 22 nt, Human coronavirus 229E
ugcucuuuacaaagaaggcaau

SEQ ID NO: 3945751 - RNA, 15 nt, Human coronavirus 229E
ugcuguaauuuugcu

SEQ ID NO: 3945752 - RNA, 16 nt, Human coronavirus 229E
ugcuguaauuuugcuu

SEQ ID NO: 3945753 - RNA, 13 nt, Human coronavirus 229E
ugcuuaauugcuu

SEQ ID NO: 3945754 - RNA, 12 nt, Human coronavirus 229E
uggaauuuugcu

SEQ ID NO: 3945755 - RNA, 16 nt, Human coronavirus 229E
uggcacuuauaauugc

SEQ ID NO: 3945756 - RNA, 17 nt, Human coronavirus 229E
uggcguuugugcagaug

SEQ ID NO: 3945757 - RNA, 16 nt, Human coronavirus 229E
uggugacuacaaccuu

SEQ ID NO: 3945758 - RNA, 17 nt, Human coronavirus 229E
uggugcuuauagugaua

SEQ ID NO: 3945759 - RNA, 14 nt, Human coronavirus 229E
ugguuuuuauucua

SEQ ID NO: 3945760 - RNA, 20 nt, Human coronavirus 229E
uguaauuuugcuuggaagau

SEQ ID NO: 3945761 - RNA, 15 nt, Human coronavirus 229E
uguauguuuuucgcu

SEQ ID NO: 3945762 - RNA, 12 nt, Human coronavirus 229E
uguauuuugcuu

SEQ ID NO: 3945763 - RNA, 19 nt, Human coronavirus 229E
ugucacauuuguuaacauu

SEQ ID NO: 3945764 - RNA, 14 nt, Human coronavirus 229E
ugucgcuaccuguu

SEQ ID NO: 3945765 - RNA, 15 nt, Human coronavirus 229E
ugugacaucuaaugu

SEQ ID NO: 3945766 - RNA, 21 nt, Human coronavirus 229E
uguugauggugcuaaaacuga

SEQ ID NO: 3945767 - RNA, 22 nt, Human coronavirus 229E
uguugauggugcuaaaacugaa

SEQ ID NO: 3945768 - RNA, 22 nt, Human coronavirus 229E
uguugguagguggagugcuagu

SEQ ID NO: 3945769 - RNA, 13 nt, Human coronavirus 229E
uguuguugaagaa

SEQ ID NO: 3945770 - RNA, 14 nt, Human coronavirus 229E
uguuguugaagaac

SEQ ID NO: 3945771 - RNA, 22 nt, Human coronavirus 229E
aaaauaaggcucugaaaccauu

SEQ ID NO: 3945772 - RNA, 16 nt, Human coronavirus 229E
aaaauucuugcugcau

SEQ ID NO: 3945773 - RNA, 13 nt, Human coronavirus 229E
aaacucugauuga

SEQ ID NO: 3945774 - RNA, 23 nt, Human coronavirus 229E
aaacuucaccugcaacugcugaa

SEQ ID NO: 3945775 - RNA, 17 nt, Human coronavirus 229E
aaauugcccuuuuucuu

SEQ ID NO: 3945776 - RNA, 15 nt, Human coronavirus 229E
aaccagacuauuuug

SEQ ID NO: 3945777 - RNA, 20 nt, Human coronavirus 229E
aacgaaagauugcuucauuu

SEQ ID NO: 3945778 - RNA, 18 nt, Human coronavirus 229E
aagaauucagaaccagag

SEQ ID NO: 3945779 - RNA, 14 nt, Human coronavirus 229E
aagacgugaaagau

SEQ ID NO: 3945780 - RNA, 15 nt, Human coronavirus 229E
aagcccuacaaacag

SEQ ID NO: 3945781 - RNA, 22 nt, Human coronavirus 229E
aaguguugguuucuugaaaaua

SEQ ID NO: 3945782 - RNA, 22 nt, Human coronavirus 229E
aaugagccucuuuguuguguau

SEQ ID NO: 3945783 - RNA, 15 nt, Human coronavirus 229E
aauuacacuguucaa

SEQ ID NO: 3945784 - RNA, 20 nt, Human coronavirus 229E
aauuagcacccuugaaaaua

SEQ ID NO: 3945785 - RNA, 11 nt, Human coronavirus 229E
aauugaaaauu

SEQ ID NO: 3945786 - RNA, 14 nt, Human coronavirus 229E
aauuuauugcaacu

SEQ ID NO: 3945787 - RNA, 18 nt, Human coronavirus 229E
acaauguuuuggccccag

SEQ ID NO: 3945788 - RNA, 19 nt, Human coronavirus 229E
acacaaugguaagccagug

SEQ ID NO: 3945789 - RNA, 12 nt, Human coronavirus 229E
acacccagcugu

SEQ ID NO: 3945790 - RNA, 22 nt, Human coronavirus 229E
acacuaaugagccucuuuguug

SEQ ID NO: 3945791 - RNA, 19 nt, Human coronavirus 229E
acacuggccaauuuuaaug

SEQ ID NO: 3945792 - RNA, 23 nt, Human coronavirus 229E
acacuguggucuugacuuucacu

SEQ ID NO: 3945793 - RNA, 18 nt, Human coronavirus 229E
acacuuggguaaguuucu

SEQ ID NO: 3945794 - RNA, 14 nt, Human coronavirus 229E
accacacuuugcua

SEQ ID NO: 3945795 - RNA, 16 nt, Human coronavirus 229E
accauauucauuguua

SEQ ID NO: 3945796 - RNA, 15 nt, Human coronavirus 229E
accuaaucuugcucu

SEQ ID NO: 3945797 - RNA, 20 nt, Human coronavirus 229E
accuaccugaauacaugaca

SEQ ID NO: 3945798 - RNA, 22 nt, Human coronavirus 229E
accuaucuaguuaguaacugcu

SEQ ID NO: 3945799 - RNA, 16 nt, Human coronavirus 229E
acgaaagauugcuuca

SEQ ID NO: 3945800 - RNA, 18 nt, Human coronavirus 229E
acgacagguuauccaaga

SEQ ID NO: 3945801 - RNA, 14 nt, Human coronavirus 229E
acgacguugaaaag

SEQ ID NO: 3945802 - RNA, 13 nt, Human coronavirus 229E
acguaauguuuca

SEQ ID NO: 3945803 - RNA, 15 nt, Human coronavirus 229E
acucuguuugcaacg

SEQ ID NO: 3945804 - RNA, 19 nt, Human coronavirus 229E
acugaaguucgugcuucca

SEQ ID NO: 3945805 - RNA, 13 nt, Human coronavirus 229E
acugcugaaccag

SEQ ID NO: 3945806 - RNA, 14 nt, Human coronavirus 229E
acugguguuaauga

SEQ ID NO: 3945807 - RNA, 17 nt, Human coronavirus 229E
acugugaccuugcugag

SEQ ID NO: 3945808 - RNA, 22 nt, Human coronavirus 229E
acuucugcuuguaaaacuauug

SEQ ID NO: 3945809 - RNA, 16 nt, Human coronavirus 229E
acuuuagguaauguag

SEQ ID NO: 3945810 - RNA, 21 nt, Human coronavirus 229E
acuuugauugcuguaauuuug

SEQ ID NO: 3945811 - RNA, 19 nt, Human coronavirus 229E
acuuugcauucaauaauug

SEQ ID NO: 3945812 - RNA, 15 nt, Human coronavirus 229E
agaaaccacugauuu

SEQ ID NO: 3945813 - RNA, 22 nt, Human coronavirus 229E
agaaauuugcuacuauguuacu

SEQ ID NO: 3945814 - RNA, 23 nt, Human coronavirus 229E
agaacugccgaaauuuuucuaug

SEQ ID NO: 3945815 - RNA, 22 nt, Human coronavirus 229E
agacagcuugcacaacaaaaag

SEQ ID NO: 3945816 - RNA, 15 nt, Human coronavirus 229E
ugguuucuugaaaau

SEQ ID NO: 3945817 - RNA, 22 nt, Human coronavirus 229E
uguauucguuucucauacauug

SEQ ID NO: 3945818 - RNA, 17 nt, Human coronavirus 229E
ugucacccauuugaaga

SEQ ID NO: 3945819 - RNA, 18 nt, Human coronavirus 229E
ugucacccauuugaagaa

SEQ ID NO: 3945820 - RNA, 13 nt, Human coronavirus 229E
ugucgcuaccugu

SEQ ID NO: 3945821 - RNA, 22 nt, Human coronavirus 229E
ugugcgcuguguugaauugcuu

SEQ ID NO: 3945822 - RNA, 17 nt, Human coronavirus 229E
ugugcuggaguaaucaa

SEQ ID NO: 3945823 - RNA, 13 nt, Human coronavirus 229E
ugugguugugcau

SEQ ID NO: 3945824 - RNA, 16 nt, Human coronavirus 229E
ugugucugcuguuaau

SEQ ID NO: 3945825 - RNA, 22 nt, Human coronavirus 229E
uguucaaauugaaaauugcaau

SEQ ID NO: 3945826 - RNA, 23 nt, Human coronavirus 229E
uguugauggugcuaaaacugaac

SEQ ID NO: 3945827 - RNA, 14 nt, Human coronavirus 229E
uguugguuucuuga

SEQ ID NO: 3945828 - RNA, 18 nt, Human coronavirus 229E
uguugguuucuugaaaau

SEQ ID NO: 3945829 - RNA, 13 nt, Human coronavirus 229E
uguuguuguucua

SEQ ID NO: 3945830 - RNA, 14 nt, Human coronavirus 229E
uguuuaaaauucua

SEQ ID NO: 3945831 - RNA, 16 nt, Human coronavirus 229E
uuaaaauucuaauccu

SEQ ID NO: 3945832 - RNA, 17 nt, Human coronavirus 229E
uuaacuucucaguugag

SEQ ID NO: 3945833 - RNA, 13 nt, Human coronavirus 229E
uuaauuaacauga

SEQ ID NO: 3945834 - RNA, 21 nt, Human coronavirus 229E
uuacgcaacuuugauugcugu

SEQ ID NO: 3945835 - RNA, 15 nt, Human coronavirus 229E
uuacucuguuugcaa

SEQ ID NO: 3945836 - RNA, 21 nt, Human coronavirus 229E
uuagacguggaaccauuuugu

SEQ ID NO: 3945837 - RNA, 23 nt, Human coronavirus 229E
uuauacacaaugguaagccagug

SEQ ID NO: 3945838 - RNA, 22 nt, Human coronavirus 229E
uuauauacccuccgacuuugca

SEQ ID NO: 3945839 - RNA, 13 nt, Human coronavirus 229E
uucacauugcaac

SEQ ID NO: 3945840 - RNA, 14 nt, Human coronavirus 229E
uucagaaccagaga

SEQ ID NO: 3945841 - RNA, 13 nt, Human coronavirus 229E
uuccaauuggacc

SEQ ID NO: 3945842 - RNA, 13 nt, Human coronavirus 229E
uucgauauggaua

SEQ ID NO: 3945843 - RNA, 22 nt, Human coronavirus 229E
uucuaugcguccaauggcacuu

SEQ ID NO: 3945844 - RNA, 19 nt, Human coronavirus 229E
uucuguggaaauggcacuc

SEQ ID NO: 3945845 - RNA, 23 nt, Human coronavirus 229E
uugaaacugacauaauugaugaa

SEQ ID NO: 3945846 - RNA, 19 nt, Human coronavirus 229E
uugauugcuccacuuaugu

SEQ ID NO: 3945847 - RNA, 19 nt, Human coronavirus 229E
uugcaacuugugucugcug

SEQ ID NO: 3945848 - RNA, 21 nt, Human coronavirus 229E
uugcuccacuuauguuugcaa

SEQ ID NO: 3945849 - RNA, 18 nt, Human coronavirus 229E
uuggcaguguauguuuuu

SEQ ID NO: 3945850 - RNA, 15 nt, Human coronavirus 229E
uuggccacucguacu

SEQ ID NO: 3945851 - RNA, 20 nt, Human coronavirus 229E
uugggcaauuuuuauugcuu

SEQ ID NO: 3945852 - RNA, 15 nt, Human coronavirus 229E
uuguucacauugcaa

SEQ ID NO: 3945853 - RNA, 17 nt, Human coronavirus 229E
uuguucacauugcaacu

SEQ ID NO: 3945854 - RNA, 15 nt, Human coronavirus 229E
uuuaaaauucuaauc

SEQ ID NO: 3945855 - RNA, 13 nt, Human coronavirus 229E
uuugcuuguugau

SEQ ID NO: 3945856 - RNA, 18 nt, Human coronavirus 229E
uuuguuuaaaacaucuua

SEQ ID NO: 3945857 - RNA, 20 nt, Human coronavirus 229E
uuuuccauacagcuuggcac

SEQ ID NO: 3945858 - RNA, 17 nt, Human coronavirus 229E
uuuuguucuuucuuuua

SEQ ID NO: 3945859 - RNA, 18 nt, Human coronavirus 229E
uuuuucuccacacugucu

SEQ ID NO: 3945860 - RNA, 22 nt, Human coronavirus 229E
caauaauuaaacuaauuaagcu

SEQ ID NO: 3945861 - RNA, 18 nt, Human coronavirus 229E
caaugaaacuacgucugc

SEQ ID NO: 3945862 - RNA, 16 nt, Human coronavirus 229E
caauguuuuggcccca

SEQ ID NO: 3945863 - RNA, 12 nt, Human coronavirus 229E
caauuugcugag

SEQ ID NO: 3945864 - RNA, 20 nt, Human coronavirus 229E
cacaaaccucuauugcuaau

SEQ ID NO: 3945865 - RNA, 14 nt, Human coronavirus 229E
cacccaagcugcau

SEQ ID NO: 3945866 - RNA, 16 nt, Human coronavirus 229E
caccguggcagagcug

SEQ ID NO: 3945867 - RNA, 17 nt, Human coronavirus 229E
cacuacuagagugacug

SEQ ID NO: 3945868 - RNA, 21 nt, Human coronavirus 229E
cagacuacaaaaagugcacua

SEQ ID NO: 3945869 - RNA, 21 nt, Human coronavirus 229E
cagagaccuugaccacaacuu

SEQ ID NO: 3945870 - RNA, 16 nt, Human coronavirus 229E
cagagauaccacacuu

SEQ ID NO: 3945871 - RNA, 23 nt, Human coronavirus 229E
cagauguuagugagaugcucacu

SEQ ID NO: 3945872 - RNA, 14 nt, Human coronavirus 229E
caggcauuacugug

SEQ ID NO: 3945873 - RNA, 15 nt, Human coronavirus 229E
caggugaugcucaca

SEQ ID NO: 3945874 - RNA, 15 nt, Human coronavirus 229E
cagugcgugaugaag

SEQ ID NO: 3945875 - RNA, 14 nt, Human coronavirus 229E
cauaauugaugaag

SEQ ID NO: 3945876 - RNA, 16 nt, Human coronavirus 229E
cauacguuuauugugu

SEQ ID NO: 3945877 - RNA, 13 nt, Human coronavirus 229E
caugaaaugcaaa

SEQ ID NO: 3945878 - RNA, 22 nt, Human coronavirus 229E
caugaaggcaguugcugcggcu

SEQ ID NO: 3945879 - RNA, 15 nt, Human coronavirus 229E
caugaucccuugcuu

SEQ ID NO: 3945880 - RNA, 16 nt, Human coronavirus 229E
cauuguuuccaaagag

SEQ ID NO: 3945881 - RNA, 18 nt, Human coronavirus 229E
cauuucagucgugcucau

SEQ ID NO: 3945882 - RNA, 22 nt, Human coronavirus 229E
ccagaguauauugauguuaaua

SEQ ID NO: 3945883 - RNA, 21 nt, Human coronavirus 229E
ccauggcagauuuuguucaaa

SEQ ID NO: 3945884 - RNA, 17 nt, Human coronavirus 229E
ccugagguuaaugcaau

SEQ ID NO: 3945885 - RNA, 23 nt, Human coronavirus 229E
cgaaaacggguacuccuaagccu

SEQ ID NO: 3945886 - RNA, 20 nt, Human coronavirus 229E
cgucacagcuaauuugucua

SEQ ID NO: 3945887 - RNA, 21 nt, Human coronavirus 229E
cgugaugaaguuucuauugaa

SEQ ID NO: 3945888 - RNA, 16 nt, Human coronavirus 229E
cguggcagagcugcuc

SEQ ID NO: 3945889 - RNA, 21 nt, Human coronavirus 229E
cuaacgacuuguacguugcuc

SEQ ID NO: 3945890 - RNA, 13 nt, Human coronavirus 229E
cuaauguuguaga

SEQ ID NO: 3945891 - RNA, 22 nt, Human coronavirus 229E
cuagaauucaacccaucucaaa

SEQ ID NO: 3945892 - RNA, 15 nt, Human coronavirus 229E
cuagagaaaugcaac

SEQ ID NO: 3945893 - RNA, 23 nt, Human coronavirus 229E
cuaguauaacucauuacaaaugu

SEQ ID NO: 3945894 - RNA, 17 nt, Human coronavirus 229E
cuauaauugcuguucaa

SEQ ID NO: 3945895 - RNA, 18 nt, Human coronavirus 229E
cuauaauugcuguucaac

SEQ ID NO: 3945896 - RNA, 18 nt, Human coronavirus 229E
cuaugcguccaauggcac

SEQ ID NO: 3945897 - RNA, 17 nt, Human coronavirus 229E
cuauuacacaaacuuca

SEQ ID NO: 3945898 - RNA, 18 nt, Human coronavirus 229E
cucaaucucggaauccuu

SEQ ID NO: 3945899 - RNA, 20 nt, Human coronavirus 229E
cucaauuguuaaugcugcuc

SEQ ID NO: 3945900 - RNA, 15 nt, Human coronavirus 229E
cucagccuuucuaga

SEQ ID NO: 3945901 - RNA, 11 nt, Human coronavirus 229E
cucgcucugag

SEQ ID NO: 3945902 - RNA, 15 nt, Human coronavirus 229E
cucguacuugcuuug

SEQ ID NO: 3945903 - RNA, 12 nt, Human coronavirus 229E
cucguucucaga

SEQ ID NO: 3945904 - RNA, 15 nt, Human coronavirus 229E
cucuagguuuguuca

SEQ ID NO: 3945905 - RNA, 18 nt, Human coronavirus 229E
cucuagguuuguucacau

SEQ ID NO: 3945906 - RNA, 17 nt, Human coronavirus 229E
cugcaacugcugaacca

SEQ ID NO: 3945907 - RNA, 15 nt, Human coronavirus 229E
cugcuuugaauguau

SEQ ID NO: 3945908 - RNA, 14 nt, Human coronavirus 229E
cuggcucuacaaga

SEQ ID NO: 3945909 - RNA, 17 nt, Human coronavirus 229E
cugguagauuggcugcu

SEQ ID NO: 3945910 - RNA, 18 nt, Human coronavirus 229E
cugguugcuguggcuucu

SEQ ID NO: 3945911 - RNA, 14 nt, Human coronavirus 229E
cugugaccuugcug

SEQ ID NO: 3945912 - RNA, 16 nt, Human coronavirus 229E
cugugaccuugcugag

SEQ ID NO: 3945913 - RNA, 15 nt, Human coronavirus 229E
cuguggaaauggcac

SEQ ID NO: 3945914 - RNA, 14 nt, Human coronavirus 229E
cuuaacaagaucca

SEQ ID NO: 3945915 - RNA, 18 nt, Human coronavirus 229E
cuuagacguggaaccauu

SEQ ID NO: 3945916 - RNA, 13 nt, Human coronavirus 229E
cuuauaauugcac

SEQ ID NO: 3945917 - RNA, 21 nt, Human coronavirus 229E
cuucaguuuggacacuauaaa

SEQ ID NO: 3945918 - RNA, 19 nt, Human coronavirus 229E
cuugcgguuuacuacuggu

SEQ ID NO: 3945919 - RNA, 14 nt, Human coronavirus 229E
cuugcuuugucaau

SEQ ID NO: 3945920 - RNA, 14 nt, Human coronavirus 229E
cuuggcacaggacc

SEQ ID NO: 3945921 - RNA, 18 nt, Human coronavirus 229E
cuuggcacugcuggcucu

SEQ ID NO: 3945922 - RNA, 20 nt, Human coronavirus 229E
cuuguacuguggcuucuuug

SEQ ID NO: 3945923 - RNA, 15 nt, Human coronavirus 229E
cuuguugauagugaa

SEQ ID NO: 3945924 - RNA, 17 nt, Human coronavirus 229E
cuuuacugguguuaaug

SEQ ID NO: 3945925 - RNA, 20 nt, Human coronavirus 229E
gaaaacgaaagauugcuuca

SEQ ID NO: 3945926 - RNA, 16 nt, Human coronavirus 229E
gaaaauuuuacuaguu

SEQ ID NO: 3945927 - RNA, 15 nt, Human coronavirus 229E
gaaaguuagugcuga

SEQ ID NO: 3945928 - RNA, 23 nt, Human coronavirus 229E
gacagaaaacgaaagauugcuuc

SEQ ID NO: 3945929 - RNA, 19 nt, Human coronavirus 229E
gacgugaaagauggcacug

SEQ ID NO: 3945930 - RNA, 11 nt, Human coronavirus 229E
gacuuggcacu

SEQ ID NO: 3945931 - RNA, 21 nt, Human coronavirus 229E
gauugcuguaauuuugcuugg

SEQ ID NO: 3945932 - RNA, 19 nt, Human coronavirus 229E
gauuuuuccauacagcuug

SEQ ID NO: 3945933 - RNA, 17 nt, Human coronavirus 229E
gcaaacaguuucagacu

SEQ ID NO: 3945934 - RNA, 17 nt, Human coronavirus 229E
gcaacucuguuauuaac

SEQ ID NO: 3945935 - RNA, 22 nt, Human coronavirus 229E
gcaagaauucagaaccagagau

SEQ ID NO: 3945936 - RNA, 22 nt, Human coronavirus 229E
gcaguguauguuuuucgcuaaa

SEQ ID NO: 3945937 - RNA, 12 nt, Human coronavirus 229E
gcauauugcugg

SEQ ID NO: 3945938 - RNA, 11 nt, Human coronavirus 229E
gccauugcugu

SEQ ID NO: 3945939 - RNA, 20 nt, Human coronavirus 229E
gcuaucucuagcucuauuca

SEQ ID NO: 3945940 - RNA, 14 nt, Human coronavirus 229E
gcucucccaugagc

SEQ ID NO: 3945941 - RNA, 21 nt, Human coronavirus 229E
gcugcaagaauuaaguuacaa

SEQ ID NO: 3945942 - RNA, 16 nt, Human coronavirus 229E
gcuguugauggugcua

SEQ ID NO: 3945943 - RNA, 13 nt, Human coronavirus 229E
ggacuuggcacug

SEQ ID NO: 3945944 - RNA, 20 nt, Human coronavirus 229E
ggaugacaucaugaaggcag

SEQ ID NO: 3945945 - RNA, 16 nt, Human coronavirus 229E
ggcacucacauuuucu

SEQ ID NO: 3945946 - RNA, 13 nt, Human coronavirus 229E
ggcagagcugcuc

SEQ ID NO: 3945947 - RNA, 14 nt, Human coronavirus 229E
gguaaguuucuuga

SEQ ID NO: 3945948 - RNA, 19 nt, Human coronavirus 229E
gguacgaucagagcugcuu

SEQ ID NO: 3945949 - RNA, 12 nt, Human coronavirus 229E
ggugaaugugua

SEQ ID NO: 3945950 - RNA, 21 nt, Human coronavirus 229E
gguucuauaauugcuguucaa

SEQ ID NO: 3945951 - RNA, 19 nt, Human coronavirus 229E
guacccaucaacaagaaag

SEQ ID NO: 3945952 - RNA, 18 nt, Human coronavirus 229E
guagaugaauacauugcu

SEQ ID NO: 3945953 - RNA, 22 nt, Human coronavirus 229E
guauacuuguuuugugaacacc

SEQ ID NO: 3945954 - RNA, 15 nt, Human coronavirus 229E
gucaaucuuugacac

SEQ ID NO: 3945955 - RNA, 17 nt, Human coronavirus 229E
gucacacaauguuuugg

SEQ ID NO: 3945956 - RNA, 16 nt, Human coronavirus 229E
gucuugcucguucuca

SEQ ID NO: 3945957 - RNA, 17 nt, Human coronavirus 229E
gugccauugcuguauug

SEQ ID NO: 3945958 - RNA, 18 nt, Human coronavirus 229E
gugcuuccagacagcuug

SEQ ID NO: 3945959 - RNA, 16 nt, Human coronavirus 229E
gugcuuuaacuguuau

SEQ ID NO: 3945960 - RNA, 16 nt, Human coronavirus 229E
guguugggacagacau

SEQ ID NO: 3945961 - RNA, 18 nt, Human coronavirus 229E
guuaauaacuuuguuaaa

SEQ ID NO: 3945962 - RNA, 21 nt, Human coronavirus 229E
guuauucagaaaauguauuug

SEQ ID NO: 3945963 - RNA, 20 nt, Human coronavirus 229E
guuauuucacgcacaggaca

SEQ ID NO: 3945964 - RNA, 15 nt, Human coronavirus 229E
guucagguucauaac

SEQ ID NO: 3945965 - RNA, 22 nt, Human coronavirus 229E
guuuucagccuuuguugcuuaa

SEQ ID NO: 3945966 - RNA, 13 nt, Human coronavirus 229E
guuuuucgcuaaa

SEQ ID NO: 3945967 - RNA, 12 nt, Human coronavirus 229E
uaaaacugaacc

SEQ ID NO: 3945968 - RNA, 21 nt, Human coronavirus 229E
uaacucauuacaaaugugcug

SEQ ID NO: 3945969 - RNA, 23 nt, Human coronavirus 229E
uaagcuaguggaugaucaugcuu

SEQ ID NO: 3945970 - RNA, 14 nt, Human coronavirus 229E
uaauauuacacugg

SEQ ID NO: 3945971 - RNA, 21 nt, Human coronavirus 229E
uaauugggccuuuguugcauu

SEQ ID NO: 3945972 - RNA, 19 nt, Human coronavirus 229E
uaauugguggaauugcuuu

SEQ ID NO: 3945973 - RNA, 16 nt, Human coronavirus 229E
uaauugguuccuucua

SEQ ID NO: 3945974 - RNA, 16 nt, Human coronavirus 229E
uaauuucaaugucacu

SEQ ID NO: 3945975 - RNA, 23 nt, Human coronavirus 229E
uacaaauugccaaauuacacugu

SEQ ID NO: 3945976 - RNA, 22 nt, Human coronavirus 229E
uacacuggccaauuuuaaugaa

SEQ ID NO: 3945977 - RNA, 11 nt, Human coronavirus 229E
uacacuguucc

SEQ ID NO: 3945978 - RNA, 22 nt, Human coronavirus 229E
uaccauggcagauuuuguucaa

SEQ ID NO: 3945979 - RNA, 14 nt, Human coronavirus 229E
uacuuuuuagcaaa

SEQ ID NO: 3945980 - RNA, 14 nt, Human coronavirus 229E
uagaugccuuuacu

SEQ ID NO: 3945981 - RNA, 18 nt, Human coronavirus 229E
uagauuggcugcuuugaa

SEQ ID NO: 3945982 - RNA, 13 nt, Human coronavirus 229E
uagguuuugacaa

SEQ ID NO: 3945983 - RNA, 19 nt, Human coronavirus 229E
uaguauaacucauuacaaa

SEQ ID NO: 3945984 - RNA, 19 nt, Human coronavirus 229E
uaguuuuggugacuacaac

SEQ ID NO: 3945985 - RNA, 17 nt, Human coronavirus 229E
uauaagaaauuugcuac

SEQ ID NO: 3945986 - RNA, 11 nt, Human coronavirus 229E
uauaauuuaua

SEQ ID NO: 3945987 - RNA, 15 nt, Human coronavirus 229E
uauacuucugcuugu

SEQ ID NO: 3945988 - RNA, 22 nt, Human coronavirus 229E
uauccaagacgugaaagauggc

SEQ ID NO: 3945989 - RNA, 13 nt, Human coronavirus 229E
uauguugucugaa

SEQ ID NO: 3945990 - RNA, 13 nt, Human coronavirus 229E
uauugaaacugac

SEQ ID NO: 3945991 - RNA, 16 nt, Human coronavirus 229E
ucaaaaacguuucaga

SEQ ID NO: 3945992 - RNA, 17 nt, Human coronavirus 229E
ucacacuucacuaccaa

SEQ ID NO: 3945993 - RNA, 13 nt, Human coronavirus 229E
ucagguguucagg

SEQ ID NO: 3945994 - RNA, 18 nt, Human coronavirus 229E
ucgauauggauacacaaa

SEQ ID NO: 3945995 - RNA, 22 nt, Human coronavirus 229E
ucuaacuaauaccucaucuguu

SEQ ID NO: 3945996 - RNA, 17 nt, Human coronavirus 229E
ucuacguacgaguaaaa

SEQ ID NO: 3945997 - RNA, 16 nt, Human coronavirus 229E
ucuaguuaguaacugc

SEQ ID NO: 3945998 - RNA, 12 nt, Human coronavirus 229E
ucuauaauugcu

SEQ ID NO: 3945999 - RNA, 16 nt, Human coronavirus 229E
ucuugcugcaucuuuu

SEQ ID NO: 3946000 - RNA, 22 nt, Human coronavirus 229E
ugaaauuagcacccuugaaaau

SEQ ID NO: 3946001 - RNA, 16 nt, Human coronavirus 229E
ugaauacaugacaguu

SEQ ID NO: 3946002 - RNA, 12 nt, Human coronavirus 229E
ugaauguuacau

SEQ ID NO: 3946003 - RNA, 21 nt, Human coronavirus 229E
ugacaagaaagcguuuacacu

SEQ ID NO: 3946004 - RNA, 17 nt, Human coronavirus 229E
ugacaagccucaggaaa

SEQ ID NO: 3946005 - RNA, 13 nt, Human coronavirus 229E
ugacacuauucag

SEQ ID NO: 3946006 - RNA, 13 nt, Human coronavirus 229E
ugacaucaugaag

SEQ ID NO: 3946007 - RNA, 18 nt, Human coronavirus 229E
ugaccacaacuuuggaag

SEQ ID NO: 3946008 - RNA, 16 nt, Human coronavirus 229E
ugagaugcucacuuuu

SEQ ID NO: 3946009 - RNA, 15 nt, Human coronavirus 229E
ugaguauguugcuau

SEQ ID NO: 3946010 - RNA, 23 nt, Human coronavirus 229E
ugauagugaacaaccuuggaagg

SEQ ID NO: 3946011 - RNA, 19 nt, Human coronavirus 229E
ugaugcuauuacacaaacu

SEQ ID NO: 3946012 - RNA, 21 nt, Human coronavirus 229E
ugauggugcuaaaacugaacc

SEQ ID NO: 3946013 - RNA, 17 nt, Human coronavirus 229E
ugauugcuguaauuuug

SEQ ID NO: 3946014 - RNA, 16 nt, Human coronavirus 229E
ugcaacaacauccucu

SEQ ID NO: 3946015 - RNA, 23 nt, Human coronavirus 229E
ugcaaugucacauuuguuaacau

SEQ ID NO: 3946016 - RNA, 14 nt, Human coronavirus 229E
ugcgugaugaaguu

SEQ ID NO: 3946017 - RNA, 19 nt, Human coronavirus 229E
ugcucguucucagaguucu

SEQ ID NO: 3946018 - RNA, 16 nt, Human coronavirus 229E
uggcagauuuuguuca

SEQ ID NO: 3946019 - RNA, 13 nt, Human coronavirus 229E
uggccccagagac

SEQ ID NO: 3946020 - RNA, 19 nt, Human coronavirus 229E
uggugaguauguugcuauu

SEQ ID NO: 3946021 - RNA, 17 nt, Human coronavirus 229E
aguuuuggugacuacaa

SEQ ID NO: 3946022 - RNA, 13 nt, Human coronavirus 229E
auaaccuaccuga

SEQ ID NO: 3946023 - RNA, 13 nt, Human coronavirus 229E
auaauugcuguuc

SEQ ID NO: 3946024 - RNA, 18 nt, Human coronavirus 229E
auaccucaucuguuguag

SEQ ID NO: 3946025 - RNA, 17 nt, Human coronavirus 229E
auacguugcuguuuaug

SEQ ID NO: 3946026 - RNA, 20 nt, Human coronavirus 229E
auacguuuauuguguuguac

SEQ ID NO: 3946027 - RNA, 12 nt, Human coronavirus 229E
auauaacgguga

SEQ ID NO: 3946028 - RNA, 21 nt, Human coronavirus 229E
auauaugcacauagacccuuu

SEQ ID NO: 3946029 - RNA, 22 nt, Human coronavirus 229E
aucacaccguggcagagcugcu

SEQ ID NO: 3946030 - RNA, 19 nt, Human coronavirus 229E
aucucgcauaauguuugaa

SEQ ID NO: 3946031 - RNA, 17 nt, Human coronavirus 229E
augaugcuauuacacaa

SEQ ID NO: 3946032 - RNA, 23 nt, Human coronavirus 229E
augcauucacuagagaaaugcaa

SEQ ID NO: 3946033 - RNA, 14 nt, Human coronavirus 229E
auguuacugaaccu

SEQ ID NO: 3946034 - RNA, 16 nt, Human coronavirus 229E
auguugucugaaaauu

SEQ ID NO: 3946035 - RNA, 13 nt, Human coronavirus 229E
auuacguacacau

SEQ ID NO: 3946036 - RNA, 19 nt, Human coronavirus 229E
auuacugugaccuugcuga

SEQ ID NO: 3946037 - RNA, 18 nt, Human coronavirus 229E
auuagagguuguugugaa

SEQ ID NO: 3946038 - RNA, 12 nt, Human coronavirus 229E
auuaucuuucuu

SEQ ID NO: 3946039 - RNA, 21 nt, Human coronavirus 229E
auucuaauugggccuuuguug

SEQ ID NO: 3946040 - RNA, 13 nt, Human coronavirus 229E
caaauacguugcu

SEQ ID NO: 3946041 - RNA, 17 nt, Human coronavirus 229E
caaauacguugcuguuu

SEQ ID NO: 3946042 - RNA, 21 nt, Human coronavirus 229E
caacauccucuucuuaacccu

SEQ ID NO: 3946043 - RNA, 12 nt, Human coronavirus 229E
caacuuuggaag

SEQ ID NO: 3946044 - RNA, 22 nt, Human coronavirus 229E
caagacgugaaagauggcacug

SEQ ID NO: 3946045 - RNA, 14 nt, Human coronavirus 229E
caagagucuugcuc

SEQ ID NO: 3946046 - RNA, 21 nt, Human coronavirus 229E
caagcccuacaaacaguugcu

SEQ ID NO: 3946047 - RNA, 13 nt, Human coronavirus 229E
caagugacagaaa

SEQ ID NO: 3946048 - RNA, 16 nt, Human coronavirus 229E
caaucuuugacaccug

SEQ ID NO: 3946049 - RNA, 22 nt, Human coronavirus 229E
caauggcacuuauaauugcaca

SEQ ID NO: 3946050 - RNA, 20 nt, Human coronavirus 229E
caauguuuuggccccagaga

SEQ ID NO: 3946051 - RNA, 20 nt, Human coronavirus 229E
caauuguuaaugcugcuccu

SEQ ID NO: 3946052 - RNA, 13 nt, Human coronavirus 229E
cacaggaccccau

SEQ ID NO: 3946053 - RNA, 21 nt, Human coronavirus 229E
cagaaaauguauuugcuguug

SEQ ID NO: 3946054 - RNA, 15 nt, Human coronavirus 229E
cagaguccugcuucu

SEQ ID NO: 3946055 - RNA, 16 nt, Human coronavirus 229E
cagcuugcacaacaaa

SEQ ID NO: 3946056 - RNA, 14 nt, Human coronavirus 229E
caggugaugcucac

SEQ ID NO: 3946057 - RNA, 22 nt, Human coronavirus 229E
cagucaggaugacaucaugaag

SEQ ID NO: 3946058 - RNA, 16 nt, Human coronavirus 229E
cagucauuugucuuga

SEQ ID NO: 3946059 - RNA, 15 nt, Human coronavirus 229E
caguuuauggcccca

SEQ ID NO: 3946060 - RNA, 21 nt, Human coronavirus 229E
cauaaagaugcaaaauuuaga

SEQ ID NO: 3946061 - RNA, 23 nt, Human coronavirus 229E
cauacagcuuggcacugcuggcu

SEQ ID NO: 3946062 - RNA, 20 nt, Human coronavirus 229E
cauaugccuuguugcauauu

SEQ ID NO: 3946063 - RNA, 20 nt, Human coronavirus 229E
cauugcaacuugugucugcu

SEQ ID NO: 3946064 - RNA, 17 nt, Human coronavirus 229E
cauuggacaaauguacu

SEQ ID NO: 3946065 - RNA, 21 nt, Human coronavirus 229E
cauugucacccauuugaagaa

SEQ ID NO: 3946066 - RNA, 18 nt, Human coronavirus 229E
cauuugaagaauuggaau

SEQ ID NO: 3946067 - RNA, 11 nt, Human coronavirus 229E
ccaacaaugga

SEQ ID NO: 3946068 - RNA, 17 nt, Human coronavirus 229E
ccacguaauguuucaua

SEQ ID NO: 3946069 - RNA, 17 nt, Human coronavirus 229E
ccacuuauguuugcaau

SEQ ID NO: 3946070 - RNA, 18 nt, Human coronavirus 229E
ccguggcagagcugcucu

SEQ ID NO: 3946071 - RNA, 24 nt, Human coronavirus 229E
ccuaucguaguugauugcuccacu

SEQ ID NO: 3946072 - RNA, 19 nt, Human coronavirus 229E
ccugcaacugcugaaccag

SEQ ID NO: 3946073 - RNA, 18 nt, Human coronavirus 229E
ccuuguugcauauugcug

SEQ ID NO: 3946074 - RNA, 12 nt, Human coronavirus 229E
cgaucagagcug

SEQ ID NO: 3946075 - RNA, 15 nt, Human coronavirus 229E
cgaucagagcugcuu

SEQ ID NO: 3946076 - RNA, 13 nt, Human coronavirus 229E
cgcagacuacaaa

SEQ ID NO: 3946077 - RNA, 20 nt, Human coronavirus 229E
cgcuguguugaauugcuuaa

SEQ ID NO: 3946078 - RNA, 23 nt, Human coronavirus 229E
cgucccacaaccuguugagggug

SEQ ID NO: 3946079 - RNA, 19 nt, Human coronavirus 229E
cguuuaaauuauguugcau

SEQ ID NO: 3946080 - RNA, 12 nt, Human coronavirus 229E
cguuucagaacu

SEQ ID NO: 3946081 - RNA, 22 nt, Human coronavirus 229E
cuaauaccucaucuguuguaga

SEQ ID NO: 3946082 - RNA, 17 nt, Human coronavirus 229E
cuaaugagccucuuugu

SEQ ID NO: 3946083 - RNA, 18 nt, Human coronavirus 229E
cuaccugaauacaugaca

SEQ ID NO: 3946084 - RNA, 23 nt, Human coronavirus 229E
cuaguuacucuguuugcaacggc

SEQ ID NO: 3946085 - RNA, 11 nt, Human coronavirus 229E
cuauaauugcu

SEQ ID NO: 3946086 - RNA, 16 nt, Human coronavirus 229E
cuauaauugcuguuca

SEQ ID NO: 3946087 - RNA, 17 nt, Human coronavirus 229E
cuauguuacugaaccua

SEQ ID NO: 3946088 - RNA, 15 nt, Human coronavirus 229E
cucauuguauguuuc

SEQ ID NO: 3946089 - RNA, 17 nt, Human coronavirus 229E
cuccacuuauguuugca

SEQ ID NO: 3946090 - RNA, 16 nt, Human coronavirus 229E
cucgcauaauguuuga

SEQ ID NO: 3946091 - RNA, 12 nt, Human coronavirus 229E
cucuagcucuau

SEQ ID NO: 3946092 - RNA, 14 nt, Human coronavirus 229E
cucugaguugcaaa

SEQ ID NO: 3946093 - RNA, 17 nt, Human coronavirus 229E
cugaguugcaaaccauu

SEQ ID NO: 3946094 - RNA, 19 nt, Human coronavirus 229E
cugaugcugaacgaauggc

SEQ ID NO: 3946095 - RNA, 16 nt, Human coronavirus 229E
cugauguuuuacaaga

SEQ ID NO: 3946096 - RNA, 23 nt, Human coronavirus 229E
cugcugaaccagugcgugaugaa

SEQ ID NO: 3946097 - RNA, 17 nt, Human coronavirus 229E
cugcuuguaaaacuauu

SEQ ID NO: 3946098 - RNA, 15 nt, Human coronavirus 229E
cuggacuuggcacug

SEQ ID NO: 3946099 - RNA, 14 nt, Human coronavirus 229E
cuguauuggucuca

SEQ ID NO: 3946100 - RNA, 18 nt, Human coronavirus 229E
cuguauuggucucaagca

SEQ ID NO: 3946101 - RNA, 20 nt, Human coronavirus 229E
cuguuaccuucaacuugcua

SEQ ID NO: 3946102 - RNA, 14 nt, Human coronavirus 229E
cuguuguugaagaa

SEQ ID NO: 3946103 - RNA, 15 nt, Human coronavirus 229E
cuguuucuggcuugc

SEQ ID NO: 3946104 - RNA, 15 nt, Human coronavirus 229E
cuguuuuaacuuauu

SEQ ID NO: 3946105 - RNA, 16 nt, Human coronavirus 229E
cuuaauuacacuguuc

SEQ ID NO: 3946106 - RNA, 14 nt, Human coronavirus 229E
cuugaggaguuaaa

SEQ ID NO: 3946107 - RNA, 12 nt, Human coronavirus 229E
cuugcugcaucu

SEQ ID NO: 3946108 - RNA, 22 nt, Human coronavirus 229E
cuugcuuugucaaucuuugaca

SEQ ID NO: 3946109 - RNA, 15 nt, Human coronavirus 229E
cuuggcacugcuggc

SEQ ID NO: 3946110 - RNA, 18 nt, Human coronavirus 229E
cuuguaaaacuauugaag

SEQ ID NO: 3946111 - RNA, 15 nt, Human coronavirus 229E
cuuguuacuucugga

SEQ ID NO: 3946112 - RNA, 15 nt, Human coronavirus 229E
cuuucccuaaacgag

SEQ ID NO: 3946113 - RNA, 19 nt, Human coronavirus 229E
cuuuuggcaaaguuaauaa

SEQ ID NO: 3946114 - RNA, 16 nt, Human coronavirus 229E
gaaaauaaggcucuga

SEQ ID NO: 3946115 - RNA, 22 nt, Human coronavirus 229E
gaaagcguuuacacuugcuaau

SEQ ID NO: 3946116 - RNA, 21 nt, Human coronavirus 229E
gaaccagugcgugaugaaguu

SEQ ID NO: 3946117 - RNA, 19 nt, Human coronavirus 229E
gaacugccgaaauuuuucu

SEQ ID NO: 3946118 - RNA, 19 nt, Human coronavirus 229E
gaaguuucuauugaaacug

SEQ ID NO: 3946119 - RNA, 13 nt, Human coronavirus 229E
gaauuuugcuuuu

SEQ ID NO: 3946120 - RNA, 16 nt, Human coronavirus 229E
gacacuauucaggcug

SEQ ID NO: 3946121 - RNA, 20 nt, Human coronavirus 229E
gagagauuuggcgccuuggu

SEQ ID NO: 3946122 - RNA, 18 nt, Human coronavirus 229E
gaguuauauaacggugaa

SEQ ID NO: 3946123 - RNA, 14 nt, Human coronavirus 229E
gaucccuugcuuug

SEQ ID NO: 3946124 - RNA, 15 nt, Human coronavirus 229E
gaucccuugcuuugg

SEQ ID NO: 3946125 - RNA, 15 nt, Human coronavirus 229E
gaucuauguaugaug

SEQ ID NO: 3946126 - RNA, 20 nt, Human coronavirus 229E
gaugguucuauaauugcugu

SEQ ID NO: 3946127 - RNA, 20 nt, Human coronavirus 229E
gauuguuuuaugguuugaag

SEQ ID NO: 3946128 - RNA, 13 nt, Human coronavirus 229E
gauuuuguucaaa

SEQ ID NO: 3946129 - RNA, 15 nt, Human coronavirus 229E
gcaacuugugucugc

SEQ ID NO: 3946130 - RNA, 12 nt, Human coronavirus 229E
gcaaugaaacua

SEQ ID NO: 3946131 - RNA, 17 nt, Human coronavirus 229E
uguuuuaacuuauucua

SEQ ID NO: 3946132 - RNA, 12 nt, Human coronavirus 229E
uguuuugucuga

SEQ ID NO: 3946133 - RNA, 13 nt, Human coronavirus 229E
uuaaaaaugugua

SEQ ID NO: 3946134 - RNA, 20 nt, Human coronavirus 229E
uuaacauuucucgcucugag

SEQ ID NO: 3946135 - RNA, 18 nt, Human coronavirus 229E
uuacugaaccuaggugaa

SEQ ID NO: 3946136 - RNA, 21 nt, Human coronavirus 229E
uuauauaacggugaaugugua

SEQ ID NO: 3946137 - RNA, 20 nt, Human coronavirus 229E
uuauguguugcgacaaccua

SEQ ID NO: 3946138 - RNA, 16 nt, Human coronavirus 229E
uucaaaaauugcaaac

SEQ ID NO: 3946139 - RNA, 23 nt, Human coronavirus 229E
uucaauccguugagcuaccugug

SEQ ID NO: 3946140 - RNA, 21 nt, Human coronavirus 229E
uucaauguaaccacacuuugc

SEQ ID NO: 3946141 - RNA, 15 nt, Human coronavirus 229E
uucacaaaauagcac

SEQ ID NO: 3946142 - RNA, 14 nt, Human coronavirus 229E
uucauuguuauucu

SEQ ID NO: 3946143 - RNA, 13 nt, Human coronavirus 229E
uuccaaagaguca

SEQ ID NO: 3946144 - RNA, 23 nt, Human coronavirus 229E
uucuggguuuuaaagauguuacu

SEQ ID NO: 3946145 - RNA, 13 nt, Human coronavirus 229E
uugauagugaaca

SEQ ID NO: 3946146 - RNA, 17 nt, Human coronavirus 229E
uugaugaaguaaacuaa

SEQ ID NO: 3946147 - RNA, 16 nt, Human coronavirus 229E
uugcaacucuguuauu

SEQ ID NO: 3946148 - RNA, 17 nt, Human coronavirus 229E
uugcauuuagcuuuuuu

SEQ ID NO: 3946149 - RNA, 14 nt, Human coronavirus 229E
uugcuuaauugcuu

SEQ ID NO: 3946150 - RNA, 23 nt, Human coronavirus 229E
uuucaggugaugcucacauacca

SEQ ID NO: 3946151 - RNA, 13 nt, Human coronavirus 229E
uuuccauugcuga

SEQ ID NO: 3946152 - RNA, 15 nt, Human coronavirus 229E
uuugcaucuucuauu

SEQ ID NO: 3946153 - RNA, 17 nt, Human coronavirus 229E
uuuggcguuugugcaga

SEQ ID NO: 3946154 - RNA, 16 nt, Human coronavirus 229E
uuuguaaauacuacua

SEQ ID NO: 3946155 - RNA, 17 nt, Human coronavirus 229E
uuuuauuaucuuggcac

SEQ ID NO: 3946156 - RNA, 12 nt, Human coronavirus 229E
uuuuuauugcuu

SEQ ID NO: 3946157 - RNA, 19 nt, Human coronavirus 229E
aaacaguuucagacuuuuc

SEQ ID NO: 3946158 - RNA, 20 nt, Human coronavirus 229E
aaacaucuuaugguguuguu

SEQ ID NO: 3946159 - RNA, 20 nt, Human coronavirus 229E
aaacaugccacuguguuguu

SEQ ID NO: 3946160 - RNA, 18 nt, Human coronavirus 229E
aaauacguugcuguuuau

SEQ ID NO: 3946161 - RNA, 14 nt, Human coronavirus 229E
aaauuauguugcau

SEQ ID NO: 3946162 - RNA, 12 nt, Human coronavirus 229E
uucagccuuugu

SEQ ID NO: 3946163 - RNA, 14 nt, Human coronavirus 229E
uucuaaacugaacg

SEQ ID NO: 3946164 - RNA, 17 nt, Human coronavirus 229E
uucuauugaaacugaca

SEQ ID NO: 3946165 - RNA, 13 nt, Human coronavirus 229E
uucuuuaguuguu

SEQ ID NO: 3946166 - RNA, 19 nt, Human coronavirus 229E
uugaaaagauccacauaca

SEQ ID NO: 3946167 - RNA, 19 nt, Human coronavirus 229E
uugaagacgccuuaagaaa

SEQ ID NO: 3946168 - RNA, 20 nt, Human coronavirus 229E
uugauggugcuaaaacugaa

SEQ ID NO: 3946169 - RNA, 19 nt, Human coronavirus 229E
uugccaaauuacacuguuc

SEQ ID NO: 3946170 - RNA, 12 nt, Human coronavirus 229E
uugccuguuuuu

SEQ ID NO: 3946171 - RNA, 19 nt, Human coronavirus 229E
uugucgaacaguacaacca

SEQ ID NO: 3946172 - RNA, 20 nt, Human coronavirus 229E
uuuauggccguaucaacacu

SEQ ID NO: 3946173 - RNA, 18 nt, Human coronavirus 229E
uuugcuuuuguucuuucu

SEQ ID NO: 3946174 - RNA, 18 nt, Human coronavirus 229E
aaaaauguguaccacauu

SEQ ID NO: 3946175 - RNA, 16 nt, Human coronavirus 229E
aaacaguugcuacugc

SEQ ID NO: 3946176 - RNA, 22 nt, Human coronavirus 229E
aaagauggcuacagucaaaugg

SEQ ID NO: 3946177 - RNA, 13 nt, Human coronavirus 229E
aaaugcauucacu

SEQ ID NO: 3946178 - RNA, 15 nt, Human coronavirus 229E
aaauuauguugcauu

SEQ ID NO: 3946179 - RNA, 21 nt, Human coronavirus 229E
aaauuuggcaguguauguuuu

SEQ ID NO: 3946180 - RNA, 22 nt, Human coronavirus 229E
aacucauugaaccauuuaacuu

SEQ ID NO: 3946181 - RNA, 19 nt, Human coronavirus 229E
aacuucaccugcaacugcu

SEQ ID NO: 3946182 - RNA, 14 nt, Human coronavirus 229E
aagaaauuugcuac

SEQ ID NO: 3946183 - RNA, 21 nt, Human coronavirus 229E
aagaaauuugcuacuauguua

SEQ ID NO: 3946184 - RNA, 14 nt, Human coronavirus 229E
aagaacaaaagcau

SEQ ID NO: 3946185 - RNA, 13 nt, Human coronavirus 229E
aagacagccuaau

SEQ ID NO: 3946186 - RNA, 18 nt, Human coronavirus 229E
aagacaugggauuucauu

SEQ ID NO: 3946187 - RNA, 23 nt, Human coronavirus 229E
aagcauauauuuacgcaacuuug

SEQ ID NO: 3946188 - RNA, 23 nt, Human coronavirus 229E
aagguccguaaauucacaaaaua

SEQ ID NO: 3946189 - RNA, 20 nt, Human coronavirus 229E
aaucaaucgcuuagcaaugc

SEQ ID NO: 3946190 - RNA, 15 nt, Human coronavirus 229E
aaugucaaaugacaa

SEQ ID NO: 3946191 - RNA, 15 nt, Human coronavirus 229E
aaugugucacaaacc

SEQ ID NO: 3946192 - RNA, 15 nt, Human coronavirus 229E
acagcugcuaugcug

SEQ ID NO: 3946193 - RNA, 21 nt, Human coronavirus 229E
acauaguagaugccuuuacug

SEQ ID NO: 3946194 - RNA, 14 nt, Human coronavirus 229E
acaucuaaugucac

SEQ ID NO: 3946195 - RNA, 22 nt, Human coronavirus 229E
acaucucgcauaauguuugaac

SEQ ID NO: 3946196 - RNA, 21 nt, Human coronavirus 229E
accuaucuaguuaguaacugc

SEQ ID NO: 3946197 - RNA, 13 nt, Human coronavirus 229E
accugcaacugcu

SEQ ID NO: 3946198 - RNA, 12 nt, Human coronavirus 229E
accuucuggguu

SEQ ID NO: 3946199 - RNA, 13 nt, Human coronavirus 229E
acgaucagagcug

SEQ ID NO: 3946200 - RNA, 15 nt, Human coronavirus 229E
acuaaacaugccacu

SEQ ID NO: 3946201 - RNA, 13 nt, Human coronavirus 229E
acuacaaccuuag

SEQ ID NO: 3946202 - RNA, 14 nt, Human coronavirus 229E
acuacgucugcuuu

SEQ ID NO: 3946203 - RNA, 22 nt, Human coronavirus 229E
acuaguuacucuguuugcaacg

SEQ ID NO: 3946204 - RNA, 22 nt, Human coronavirus 229E
acuauaauuuauaguagagucg

SEQ ID NO: 3946205 - RNA, 18 nt, Human coronavirus 229E
acucauuacaaaugugcu

SEQ ID NO: 3946206 - RNA, 18 nt, Human coronavirus 229E
acuccagauuguuuuaug

SEQ ID NO: 3946207 - RNA, 17 nt, Human coronavirus 229E
acucuguuauuaacaga

SEQ ID NO: 3946208 - RNA, 15 nt, Human coronavirus 229E
acugaacgaaaagau

SEQ ID NO: 3946209 - RNA, 14 nt, Human coronavirus 229E
acugguuuugucua

SEQ ID NO: 3946210 - RNA, 19 nt, Human coronavirus 229E
acuguggucuugacuuuca

SEQ ID NO: 3946211 - RNA, 18 nt, Human coronavirus 229E
acuguguuguuugaaauu

SEQ ID NO: 3946212 - RNA, 12 nt, Human coronavirus 229E
acuguuguugaa

SEQ ID NO: 3946213 - RNA, 15 nt, Human coronavirus 229E
acuucaccugcaacu

SEQ ID NO: 3946214 - RNA, 20 nt, Human coronavirus 229E
acuugacacuauucaggcug

SEQ ID NO: 3946215 - RNA, 15 nt, Human coronavirus 229E
acuuggcuugugcuc

SEQ ID NO: 3946216 - RNA, 17 nt, Human coronavirus 229E
acuuggcuugugcucaa

SEQ ID NO: 3946217 - RNA, 14 nt, Human coronavirus 229E
acuugugucugcug

SEQ ID NO: 3946218 - RNA, 14 nt, Human coronavirus 229E
acuuugauugcugu

SEQ ID NO: 3946219 - RNA, 18 nt, Human coronavirus 229E
agaauuggaauuuugguu

SEQ ID NO: 3946220 - RNA, 18 nt, Human coronavirus 229E
agacuauuuugaauuuga

SEQ ID NO: 3946221 - RNA, 22 nt, Human coronavirus 229E
agaucacaccguggcagagcug

SEQ ID NO: 3946222 - RNA, 20 nt, Human coronavirus 229E
agauugcuucauuuuuucua

SEQ ID NO: 3946223 - RNA, 23 nt, Human coronavirus 229E
agauuggcugcuuugaauguauu

SEQ ID NO: 3946224 - RNA, 18 nt, Human coronavirus 229E
agcaguauacuucugcuu

SEQ ID NO: 3946225 - RNA, 23 nt, Human coronavirus 229E
agccaacaauggaagagccaguc

SEQ ID NO: 3946226 - RNA, 17 nt, Human coronavirus 229E
agccguuaauuucaaug

SEQ ID NO: 3946227 - RNA, 14 nt, Human coronavirus 229E
agcuaauuugucua

SEQ ID NO: 3946228 - RNA, 15 nt, Human coronavirus 229E
agcuccaacaggcau

SEQ ID NO: 3946229 - RNA, 22 nt, Human coronavirus 229E
aggaugacaucaugaaggcagu

SEQ ID NO: 3946230 - RNA, 12 nt, Human coronavirus 229E
aggcaauuauua

SEQ ID NO: 3946231 - RNA, 13 nt, Human coronavirus 229E
agucaaaugggcu

SEQ ID NO: 3946232 - RNA, 18 nt, Human coronavirus 229E
agucgcggucguggugaa

SEQ ID NO: 3946233 - RNA, 19 nt, Human coronavirus 229E
agugguaguagaguggcug

SEQ ID NO: 3946234 - RNA, 15 nt, Human coronavirus 229E
auaaagaugcaaaau

SEQ ID NO: 3946235 - RNA, 18 nt, Human coronavirus 229E
auaacggugaauguguau

SEQ ID NO: 3946236 - RNA, 16 nt, Human coronavirus 229E
auaacuuuguuaaauu

SEQ ID NO: 3946237 - RNA, 19 nt, Human coronavirus 229E
auaagaaauuugcuacuau

SEQ ID NO: 3946238 - RNA, 17 nt, Human coronavirus 229E
auacuacuaguguguau

SEQ ID NO: 3946239 - RNA, 18 nt, Human coronavirus 229E
auacuauaggcucauugu

SEQ ID NO: 3946240 - RNA, 19 nt, Human coronavirus 229E
auacuccagauuguuuuau

SEQ ID NO: 3946241 - RNA, 21 nt, Human coronavirus 229E
aucaacacucguuaugugggu

SEQ ID NO: 3946242 - RNA, 22 nt, Human coronavirus 229E
aucucuagcucuauucaggcua

SEQ ID NO: 3946243 - RNA, 20 nt, Human coronavirus 229E
augcgaaaguuagugcugaa

SEQ ID NO: 3946244 - RNA, 19 nt, Human coronavirus 229E
augcucacuuuugacaaga

SEQ ID NO: 3946245 - RNA, 18 nt, Human coronavirus 229E
auggcacuuauaauugca

SEQ ID NO: 3946246 - RNA, 18 nt, Human coronavirus 229E
auguuguuguucuacugg

SEQ ID NO: 3946247 - RNA, 16 nt, Human coronavirus 229E
auuaagcuuuguuuca

SEQ ID NO: 3946248 - RNA, 16 nt, Human coronavirus 229E
auucuucaguuuggac

SEQ ID NO: 3946249 - RNA, 14 nt, Human coronavirus 229E
auugaaaauugcaa

SEQ ID NO: 3946250 - RNA, 16 nt, Human coronavirus 229E
auugcaaacucugauu

SEQ ID NO: 3946251 - RNA, 18 nt, Human coronavirus 229E
auugcuuuguaaauacua

SEQ ID NO: 3946252 - RNA, 15 nt, Human coronavirus 229E
auuggcugcuuugaa

SEQ ID NO: 3946253 - RNA, 16 nt, Human coronavirus 229E
auugguggaauugcuu

SEQ ID NO: 3946254 - RNA, 16 nt, Human coronavirus 229E
auuguuaaugcugcuc

SEQ ID NO: 3946255 - RNA, 17 nt, Human coronavirus 229E
auuguuuuaugguuuga

SEQ ID NO: 3946256 - RNA, 17 nt, Human coronavirus 229E
caaaagcucccaaaugg

SEQ ID NO: 3946257 - RNA, 22 nt, Human coronavirus 229E
caaaauuuagagagcguguuga

SEQ ID NO: 3946258 - RNA, 18 nt, Human coronavirus 229E
caaacuuguuacuucugg

SEQ ID NO: 3946259 - RNA, 23 nt, Human coronavirus 229E
caaagaucgcauugacgagccaa

SEQ ID NO: 3946260 - RNA, 18 nt, Human coronavirus 229E
caaauugaaaauugcaau

SEQ ID NO: 3946261 - RNA, 18 nt, Human coronavirus 229E
caacaauggaagagccag

SEQ ID NO: 3946262 - RNA, 16 nt, Human coronavirus 229E
caacacagauuucaaa

SEQ ID NO: 3946263 - RNA, 12 nt, Human coronavirus 229E
caacagcugcua

SEQ ID NO: 3946264 - RNA, 15 nt, Human coronavirus 229E
caagaauucagaacc

SEQ ID NO: 3946265 - RNA, 22 nt, Human coronavirus 229E
caauguaaccacacuuugcuau

SEQ ID NO: 3946266 - RNA, 16 nt, Human coronavirus 229E
cacaaugguaagccag

SEQ ID NO: 3946267 - RNA, 17 nt, Human coronavirus 229E
cacauuguuuccaaaga

SEQ ID NO: 3946268 - RNA, 13 nt, Human coronavirus 229E
cacauuuguuaac

SEQ ID NO: 3946269 - RNA, 16 nt, Human coronavirus 229E
cacauuuguuaacauu

SEQ ID NO: 3946270 - RNA, 13 nt, Human coronavirus 229E
cacuccuuguaac

SEQ ID NO: 3946271 - RNA, 17 nt, Human coronavirus 229E
cacugcuggcucuacaa

SEQ ID NO: 3946272 - RNA, 14 nt, Human coronavirus 229E
cagaaccagagaua

SEQ ID NO: 3946273 - RNA, 12 nt, Human coronavirus 229E
cagagcugcucu

SEQ ID NO: 3946274 - RNA, 15 nt, Human coronavirus 229E
cagaguucugaaaca

SEQ ID NO: 3946275 - RNA, 14 nt, Human coronavirus 229E
cagccuuuguugcu

SEQ ID NO: 3946276 - RNA, 22 nt, Human coronavirus 229E
cagucuaagcguuauggcuucu

SEQ ID NO: 3946277 - RNA, 15 nt, Human coronavirus 229E
cauauguuuuguaau

SEQ ID NO: 3946278 - RNA, 18 nt, Human coronavirus 229E
cauugacuaaguacacug

SEQ ID NO: 3946279 - RNA, 23 nt, Human coronavirus 229E
ccaagacgugaaagauggcacug

SEQ ID NO: 3946280 - RNA, 23 nt, Human coronavirus 229E
ccacugauuuuuguacuguugcg

SEQ ID NO: 3946281 - RNA, 13 nt, Human coronavirus 229E
ccacuuauguuug

SEQ ID NO: 3946282 - RNA, 16 nt, Human coronavirus 229E
ccagugaaauuagcac

SEQ ID NO: 3946283 - RNA, 15 nt, Human coronavirus 229E
cccagagaccuugac

SEQ ID NO: 3946284 - RNA, 12 nt, Human coronavirus 229E
ccuaagccuucu

SEQ ID NO: 3946285 - RNA, 21 nt, Human coronavirus 229E
ccuagugcacuagaauucaac

SEQ ID NO: 3946286 - RNA, 13 nt, Human coronavirus 229E
ccucaauuuugaa

SEQ ID NO: 3946287 - RNA, 18 nt, Human coronavirus 229E
ccugcuucuucucaaacu

SEQ ID NO: 3946288 - RNA, 13 nt, Human coronavirus 229E
cgagccaacaaug

SEQ ID NO: 3946289 - RNA, 23 nt, Human coronavirus 229E
cggagcuuaauuacacuguucaa

SEQ ID NO: 3946290 - RNA, 18 nt, Human coronavirus 229E
cuaaacaugccacugugu

SEQ ID NO: 3946291 - RNA, 12 nt, Human coronavirus 229E
cuaagccuucuc

SEQ ID NO: 3946292 - RNA, 18 nt, Human coronavirus 229E
cuacaagcccuauucaau

SEQ ID NO: 3946293 - RNA, 14 nt, Human coronavirus 229E
cuagagaaaugcaa

SEQ ID NO: 3946294 - RNA, 21 nt, Human coronavirus 229E
cuaggugaacgcuaguauaac

SEQ ID NO: 3946295 - RNA, 13 nt, Human coronavirus 229E
cuauguuacugaa

SEQ ID NO: 3946296 - RNA, 17 nt, Human coronavirus 229E
cuauuggaauguucaaa

SEQ ID NO: 3946297 - RNA, 13 nt, Human coronavirus 229E
cucaauuguuaau

SEQ ID NO: 3946298 - RNA, 14 nt, Human coronavirus 229E
cucagaguucugaa

SEQ ID NO: 3946299 - RNA, 19 nt, Human coronavirus 229E
cucagauguuuugucugau

SEQ ID NO: 3946300 - RNA, 23 nt, Human coronavirus 229E
cucauugaaccauuuaacuucuc

SEQ ID NO: 3946301 - RNA, 20 nt, Human coronavirus 229E
cucccaugagcaacaugaca

SEQ ID NO: 3946302 - RNA, 15 nt, Human coronavirus 229E
cucugaguugcaaac

SEQ ID NO: 3946303 - RNA, 16 nt, Human coronavirus 229E
cucuuauaguguuuaa

SEQ ID NO: 3946304 - RNA, 18 nt, Human coronavirus 229E
cugacucccgugcuccuu

SEQ ID NO: 3946305 - RNA, 20 nt, Human coronavirus 229E
cugcaacugcugaaccagug

SEQ ID NO: 3946306 - RNA, 17 nt, Human coronavirus 229E
cugcaucuuuuaacaaa

SEQ ID NO: 3946307 - RNA, 23 nt, Human coronavirus 229E
cugccaagagucuugcucguucu

SEQ ID NO: 3946308 - RNA, 17 nt, Human coronavirus 229E
cugcugaaccagugcgu

SEQ ID NO: 3946309 - RNA, 15 nt, Human coronavirus 229E
cugcuucuucucaaa

SEQ ID NO: 3946310 - RNA, 16 nt, Human coronavirus 229E
cuguaauuuugcuugg

SEQ ID NO: 3946311 - RNA, 21 nt, Human coronavirus 229E
cuuaagcaguauacuucugcu

SEQ ID NO: 3946312 - RNA, 19 nt, Human coronavirus 229E
cuuaauuacacuguucaaa

SEQ ID NO: 3946313 - RNA, 15 nt, Human coronavirus 229E
cuuauaguaaguacu

SEQ ID NO: 3946314 - RNA, 19 nt, Human coronavirus 229E
cuucagguaaccuucuggg

SEQ ID NO: 3946315 - RNA, 22 nt, Human coronavirus 229E
cuucauuuuuucuaaacugaac

SEQ ID NO: 3946316 - RNA, 10 nt, Human coronavirus 229E
cuuguugcau

SEQ ID NO: 3946317 - RNA, 13 nt, Human coronavirus 229E
cuuguuuugugaa

SEQ ID NO: 3946318 - RNA, 20 nt, Human coronavirus 229E
cuuuacauaggcgacagaau

SEQ ID NO: 3946319 - RNA, 14 nt, Human coronavirus 229E
cuuuauuuaaagca

SEQ ID NO: 3946320 - RNA, 17 nt, Human coronavirus 229E
gaaaaagauaaaaaguc

SEQ ID NO: 3946321 - RNA, 22 nt, Human coronavirus 229E
gaaagacaaaaauaagcuuaua

SEQ ID NO: 3946322 - RNA, 14 nt, Human coronavirus 229E
gaaaugcaaaagcc

SEQ ID NO: 3946323 - RNA, 20 nt, Human coronavirus 229E
gaacaaaagcaugaaaugca

SEQ ID NO: 3946324 - RNA, 12 nt, Human coronavirus 229E
gaacaguuuaug

SEQ ID NO: 3946325 - RNA, 14 nt, Human coronavirus 229E
gaaccuacagguua

SEQ ID NO: 3946326 - RNA, 16 nt, Human coronavirus 229E
gaagagccagucauuu

SEQ ID NO: 3946327 - RNA, 15 nt, Human coronavirus 229E
gaauacauugcuuuu

SEQ ID NO: 3946328 - RNA, 17 nt, Human coronavirus 229E
gacagaauuguuucuua

SEQ ID NO: 3946329 - RNA, 22 nt, Human coronavirus 229E
gacagguuauccaagacgugaa

SEQ ID NO: 3946330 - RNA, 23 nt, Human coronavirus 229E
gacaucaugaaggcaguugcugc

SEQ ID NO: 3946331 - RNA, 16 nt, Human coronavirus 229E
gagaggugauuguaaa

SEQ ID NO: 3946332 - RNA, 15 nt, Human coronavirus 229E
gagcaacaugacaga

SEQ ID NO: 3946333 - RNA, 17 nt, Human coronavirus 229E
gagccaacaauggaaga

SEQ ID NO: 3946334 - RNA, 20 nt, Human coronavirus 229E
gagccaacaauggaagagcc

SEQ ID NO: 3946335 - RNA, 20 nt, Human coronavirus 229E
gagccagucauuugucuuga

SEQ ID NO: 3946336 - RNA, 13 nt, Human coronavirus 229E
gaguaaucaaaga

SEQ ID NO: 3946337 - RNA, 17 nt, Human coronavirus 229E
gagucaggcaacacugu

SEQ ID NO: 3946338 - RNA, 21 nt, Human coronavirus 229E
gaucaauuccuuuacauaggc

SEQ ID NO: 3946339 - RNA, 13 nt, Human coronavirus 229E
gaugaaguuucua

SEQ ID NO: 3946340 - RNA, 17 nt, Human coronavirus 229E
gaugcaucugaaccaca

SEQ ID NO: 3946341 - RNA, 19 nt, Human coronavirus 229E
gauuggcuucagguguuca

SEQ ID NO: 3946342 - RNA, 19 nt, Human coronavirus 229E
gauuucuaaacuaaacgac

SEQ ID NO: 3946343 - RNA, 21 nt, Human coronavirus 229E
gauuuuguucaaauugaaaau

SEQ ID NO: 3946344 - RNA, 18 nt, Human coronavirus 229E
gcaaacaguuucagacuu

SEQ ID NO: 3946345 - RNA, 23 nt, Human coronavirus 229E
gcaaaguuaauaacuuuguuaaa

SEQ ID NO: 3946346 - RNA, 19 nt, Human coronavirus 229E
gcacagacgcuguuuuaac

SEQ ID NO: 3946347 - RNA, 13 nt, Human coronavirus 229E
gcauuacugugac

SEQ ID NO: 3946348 - RNA, 15 nt, Human coronavirus 229E
gccaaauuacacugu

SEQ ID NO: 3946349 - RNA, 19 nt, Human coronavirus 229E
gccuucucguaaucagagu

SEQ ID NO: 3946350 - RNA, 23 nt, Human coronavirus 229E
gcuguguugaauugcuuaagcag

SEQ ID NO: 3946351 - RNA, 19 nt, Human coronavirus 229E
gcuuaauuacacuguucaa

SEQ ID NO: 3946352 - RNA, 11 nt, Human coronavirus 229E
gcuuguugaua

SEQ ID NO: 3946353 - RNA, 20 nt, Human coronavirus 229E
ggauuucauugucuucaaug

SEQ ID NO: 3946354 - RNA, 21 nt, Human coronavirus 229E
ggccacucguacuugcuuugu

SEQ ID NO: 3946355 - RNA, 16 nt, Human coronavirus 229E
ggccuuuguugcauuu

SEQ ID NO: 3946356 - RNA, 21 nt, Human coronavirus 229E
ggcgcaagaauucagaaccag

SEQ ID NO: 3946357 - RNA, 22 nt, Human coronavirus 229E
ggguugugcguugaugguacaa

SEQ ID NO: 3946358 - RNA, 23 nt, Human coronavirus 229E
gguacgaucagagcugcuuuuaa

SEQ ID NO: 3946359 - RNA, 22 nt, Human coronavirus 229E
gguguuauucgcguuagcaaug

SEQ ID NO: 3946360 - RNA, 21 nt, Human coronavirus 229E
guaaagguuuuuccucagaug

SEQ ID NO: 3946361 - RNA, 12 nt, Human coronavirus 229E
guaaguuucuug

SEQ ID NO: 3946362 - RNA, 13 nt, Human coronavirus 229E
guauuuugcuuua

SEQ ID NO: 3946363 - RNA, 14 nt, Human coronavirus 229E
gucaacagcugcua

SEQ ID NO: 3946364 - RNA, 22 nt, Human coronavirus 229E
gucacaaaccucuauugcuaau

SEQ ID NO: 3946365 - RNA, 23 nt, Human coronavirus 229E
gucuugacuuucacuacuagagu

SEQ ID NO: 3946366 - RNA, 13 nt, Human coronavirus 229E
guggucuggguug

SEQ ID NO: 3946367 - RNA, 14 nt, Human coronavirus 229E
guguguggugcuua

SEQ ID NO: 3946368 - RNA, 13 nt, Human coronavirus 229E
guugcuguugaug

SEQ ID NO: 3946369 - RNA, 17 nt, Human coronavirus 229E
guuuaugugccauugcu

SEQ ID NO: 3946370 - RNA, 14 nt, Human coronavirus 229E
guuucagaacuaga

SEQ ID NO: 3946371 - RNA, 17 nt, Human coronavirus 229E
guuuucuacguacgagu

SEQ ID NO: 3946372 - RNA, 13 nt, Human coronavirus 229E
uaaaacugaaccu

SEQ ID NO: 3946373 - RNA, 19 nt, Human coronavirus 229E
uaaaugcauucacuagaga

SEQ ID NO: 3946374 - RNA, 22 nt, Human coronavirus 229E
uaacaagauccaggauguuguu

SEQ ID NO: 3946375 - RNA, 14 nt, Human coronavirus 229E
uaacucauuacaaa

SEQ ID NO: 3946376 - RNA, 20 nt, Human coronavirus 229E
uaacuuuguuaaauuuggca

SEQ ID NO: 3946377 - RNA, 19 nt, Human coronavirus 229E
uaauaacuuuguuaaauuu

SEQ ID NO: 3946378 - RNA, 14 nt, Human coronavirus 229E
uaaugaaacuaaag

SEQ ID NO: 3946379 - RNA, 23 nt, Human coronavirus 229E
uaaugagccucuuuguuguguau

SEQ ID NO: 3946380 - RNA, 22 nt, Human coronavirus 229E
uaauugcuuauggucuguuucu

SEQ ID NO: 3946381 - RNA, 12 nt, Human coronavirus 229E
uacaaagaaggc

SEQ ID NO: 3946382 - RNA, 17 nt, Human coronavirus 229E
uacaaccucaauuuuga

SEQ ID NO: 3946383 - RNA, 14 nt, Human coronavirus 229E
uaccugugucuauu

SEQ ID NO: 3946384 - RNA, 16 nt, Human coronavirus 229E
uacugcacuuaacaag

SEQ ID NO: 3946385 - RNA, 17 nt, Human coronavirus 229E
uacugguuuugucuauu

SEQ ID NO: 3946386 - RNA, 16 nt, Human coronavirus 229E
uagaauucaacccauc

SEQ ID NO: 3946387 - RNA, 17 nt, Human coronavirus 229E
uaguuacggcuuuucua

SEQ ID NO: 3946388 - RNA, 23 nt, Human coronavirus 229E
uaguuccuuuaugaauguuacau

SEQ ID NO: 3946389 - RNA, 20 nt, Human coronavirus 229E
uaguuguuuugcaucuucua

SEQ ID NO: 3946390 - RNA, 16 nt, Human coronavirus 229E
uaguuuuggcguuugu

SEQ ID NO: 3946391 - RNA, 20 nt, Human coronavirus 229E
uaguuuuggcguuugugcag

SEQ ID NO: 3946392 - RNA, 19 nt, Human coronavirus 229E
uauaagaaauuugcuacua

SEQ ID NO: 3946393 - RNA, 16 nt, Human coronavirus 229E
uauaguguuuaaaauu

SEQ ID NO: 3946394 - RNA, 22 nt, Human coronavirus 229E
uauauacccuccgacuuugcau

SEQ ID NO: 3946395 - RNA, 19 nt, Human coronavirus 229E
uauccugcugguguuaaua

SEQ ID NO: 3946396 - RNA, 15 nt, Human coronavirus 229E
uaugaauguuacauu

SEQ ID NO: 3946397 - RNA, 14 nt, Human coronavirus 229E
uauguuacugaacc

SEQ ID NO: 3946398 - RNA, 17 nt, Human coronavirus 229E
uauguuuuguaauagaa

SEQ ID NO: 3946399 - RNA, 20 nt, Human coronavirus 229E
uauuacaauaauuaaacuaa

SEQ ID NO: 3946400 - RNA, 12 nt, Human coronavirus 229E
uauuuaaagcaa

SEQ ID NO: 3946401 - RNA, 12 nt, Human coronavirus 229E
ucaaacuacaaa

SEQ ID NO: 3946402 - RNA, 15 nt, Human coronavirus 229E
ucaacacagauuuca

SEQ ID NO: 3946403 - RNA, 15 nt, Human coronavirus 229E
ucaacuaacgacuug

SEQ ID NO: 3946404 - RNA, 21 nt, Human coronavirus 229E
ucaagcuaucucuagcucuau

SEQ ID NO: 3946405 - RNA, 15 nt, Human coronavirus 229E
ucaauaccauuuuca

SEQ ID NO: 3946406 - RNA, 15 nt, Human coronavirus 229E
ucacauaccauuugg

SEQ ID NO: 3946407 - RNA, 15 nt, Human coronavirus 229E
ucacauugcaacuug

SEQ ID NO: 3946408 - RNA, 13 nt, Human coronavirus 229E
ucacuagagaaau

SEQ ID NO: 3946409 - RNA, 16 nt, Human coronavirus 229E
ucagcaagcuguuguu

SEQ ID NO: 3946410 - RNA, 17 nt, Human coronavirus 229E
ucauacguuacaaccuc

SEQ ID NO: 3946411 - RNA, 16 nt, Human coronavirus 229E
uccacuuauguuugca

SEQ ID NO: 3946412 - RNA, 17 nt, Human coronavirus 229E
ucgcaaacaguuucaga

SEQ ID NO: 3946413 - RNA, 22 nt, Human coronavirus 229E
ucguucucagaguucugaaaca

SEQ ID NO: 3946414 - RNA, 21 nt, Human coronavirus 229E
ucuaacaucagccguuucaau

SEQ ID NO: 3946415 - RNA, 17 nt, Human coronavirus 229E
ucuacaagcccuauuca

SEQ ID NO: 3946416 - RNA, 18 nt, Human coronavirus 229E
ucuauaauugcuguucaa

SEQ ID NO: 3946417 - RNA, 17 nt, Human coronavirus 229E
ucucugaucuauguaug

SEQ ID NO: 3946418 - RNA, 16 nt, Human coronavirus 229E
ucuucaguuuggacac

SEQ ID NO: 3946419 - RNA, 17 nt, Human coronavirus 229E
ucuugcucguucucaga

SEQ ID NO: 3946420 - RNA, 13 nt, Human coronavirus 229E
ugaaaauaaaucu

SEQ ID NO: 3946421 - RNA, 14 nt, Human coronavirus 229E
ugaagaaccugacu

SEQ ID NO: 3946422 - RNA, 18 nt, Human coronavirus 229E
ugaagaauuggaauuuug

SEQ ID NO: 3946423 - RNA, 13 nt, Human coronavirus 229E
ugacaacauaaau

SEQ ID NO: 3946424 - RNA, 19 nt, Human coronavirus 229E
ugaccagugaaauuagcac

SEQ ID NO: 3946425 - RNA, 14 nt, Human coronavirus 229E
ugagguuaaugcaa

SEQ ID NO: 3946426 - RNA, 19 nt, Human coronavirus 229E
ugaugaaguaaacuaaaca

SEQ ID NO: 3946427 - RNA, 13 nt, Human coronavirus 229E
ugaugaugugaca

SEQ ID NO: 3946428 - RNA, 17 nt, Human coronavirus 229E
ugauuacugguagauug

SEQ ID NO: 3946429 - RNA, 19 nt, Human coronavirus 229E
ugcacaacaaaaagugaau

SEQ ID NO: 3946430 - RNA, 21 nt, Human coronavirus 229E
ugcacagacgcuguuuuaacu

SEQ ID NO: 3946431 - RNA, 21 nt, Human coronavirus 229E
ugcagaugguucuauaauugc

SEQ ID NO: 3946432 - RNA, 13 nt, Human coronavirus 229E
ugcaucugaacca

SEQ ID NO: 3946433 - RNA, 16 nt, Human coronavirus 229E
ugcauucaauaauugg

SEQ ID NO: 3946434 - RNA, 16 nt, Human coronavirus 229E
ugcucguucucagagu

SEQ ID NO: 3946435 - RNA, 18 nt, Human coronavirus 229E
ugcugagcggcgugcuuu

SEQ ID NO: 3946436 - RNA, 17 nt, Human coronavirus 229E
ugcuguauuggucucaa

SEQ ID NO: 3946437 - RNA, 23 nt, Human coronavirus 229E
ugcuucauuuuuucuaaacugaa

SEQ ID NO: 3946438 - RNA, 21 nt, Human coronavirus 229E
uauucuacaagcccuauucaa

SEQ ID NO: 3946439 - RNA, 17 nt, Human coronavirus 229E
uauugcaacucuguuau

SEQ ID NO: 3946440 - RNA, 21 nt, Human coronavirus 229E
ucaaaaauugcaaacucugau

SEQ ID NO: 3946441 - RNA, 18 nt, Human coronavirus 229E
ucaaacuucugccaagag

SEQ ID NO: 3946442 - RNA, 20 nt, Human coronavirus 229E
ucaacaagcuccaacaggca

SEQ ID NO: 3946443 - RNA, 13 nt, Human coronavirus 229E
ucaacagcugcua

SEQ ID NO: 3946444 - RNA, 22 nt, Human coronavirus 229E
ucaacuucagguaaccuucugg

SEQ ID NO: 3946445 - RNA, 18 nt, Human coronavirus 229E
ucaauguaaccacacuuu

SEQ ID NO: 3946446 - RNA, 20 nt, Human coronavirus 229E
ucaauguaaccacacuuugc

SEQ ID NO: 3946447 - RNA, 16 nt, Human coronavirus 229E
ucacaagcccuacaaa

SEQ ID NO: 3946448 - RNA, 13 nt, Human coronavirus 229E
ucagaacuagaaa

SEQ ID NO: 3946449 - RNA, 14 nt, Human coronavirus 229E
ucagccuuucuaga

SEQ ID NO: 3946450 - RNA, 20 nt, Human coronavirus 229E
ucaggcuaucuaugacagac

SEQ ID NO: 3946451 - RNA, 17 nt, Human coronavirus 229E
uccaggauguuguuaau

SEQ ID NO: 3946452 - RNA, 16 nt, Human coronavirus 229E
uccugcuucuucucaa

SEQ ID NO: 3946453 - RNA, 16 nt, Human coronavirus 229E
ucgugcucaucuuugu

SEQ ID NO: 3946454 - RNA, 13 nt, Human coronavirus 229E
ucuaaacugaacg

SEQ ID NO: 3946455 - RNA, 17 nt, Human coronavirus 229E
ucuaauugggccuuugu

SEQ ID NO: 3946456 - RNA, 21 nt, Human coronavirus 229E
ucuauuagagguuguugugaa

SEQ ID NO: 3946457 - RNA, 23 nt, Human coronavirus 229E
ucucaaacuucaccugcaacugc

SEQ ID NO: 3946458 - RNA, 15 nt, Human coronavirus 229E
ucugaaaauuuuacu

SEQ ID NO: 3946459 - RNA, 16 nt, Human coronavirus 229E
ucugauugacaacaua

SEQ ID NO: 3946460 - RNA, 16 nt, Human coronavirus 229E
ucuugaggaguuaaau

SEQ ID NO: 3946461 - RNA, 15 nt, Human coronavirus 229E
ucuuuguuguguauu

SEQ ID NO: 3946462 - RNA, 15 nt, Human coronavirus 229E
ugaaauucaggcuuu

SEQ ID NO: 3946463 - RNA, 16 nt, Human coronavirus 229E
ugaacaaccuuggaag

SEQ ID NO: 3946464 - RNA, 16 nt, Human coronavirus 229E
ugaaucaacuaaacuu

SEQ ID NO: 3946465 - RNA, 14 nt, Human coronavirus 229E
ugaauguuacauug

SEQ ID NO: 3946466 - RNA, 22 nt, Human coronavirus 229E
ugacagaaaacgaaagauugcu

SEQ ID NO: 3946467 - RNA, 17 nt, Human coronavirus 229E
ugacauaauugaugaag

SEQ ID NO: 3946468 - RNA, 16 nt, Human coronavirus 229E
ugagacuuacaucaag

SEQ ID NO: 3946469 - RNA, 14 nt, Human coronavirus 229E
ugagcaacaugaca

SEQ ID NO: 3946470 - RNA, 13 nt, Human coronavirus 229E
ugagcuaccugug

SEQ ID NO: 3946471 - RNA, 16 nt, Human coronavirus 229E
ugaugaaguaaacuaa

SEQ ID NO: 3946472 - RNA, 19 nt, Human coronavirus 229E
ugauuacugguagauuggc

SEQ ID NO: 3946473 - RNA, 13 nt, Human coronavirus 229E
ugauugacaacau

SEQ ID NO: 3946474 - RNA, 13 nt, Human coronavirus 229E
ugcaaacucugau

SEQ ID NO: 3946475 - RNA, 23 nt, Human coronavirus 229E
ugcccaaagaccauccacacuug

SEQ ID NO: 3946476 - RNA, 15 nt, Human coronavirus 229E
ugcuacuauguuacu

SEQ ID NO: 3946477 - RNA, 19 nt, Human coronavirus 229E
ugcuggcucuacaagacau

SEQ ID NO: 3946478 - RNA, 12 nt, Human coronavirus 229E
ugcuuaauugcu

SEQ ID NO: 3946479 - RNA, 22 nt, Human coronavirus 229E
ugcuucauuuuuucuaaacuga

SEQ ID NO: 3946480 - RNA, 19 nt, Human coronavirus 229E
ugcuuguaaaacuauugaa

SEQ ID NO: 3946481 - RNA, 22 nt, Human coronavirus 229E
uggaacgguuucgauauggaua

SEQ ID NO: 3946482 - RNA, 14 nt, Human coronavirus 229E
uggaauguuauucu

SEQ ID NO: 3946483 - RNA, 14 nt, Human coronavirus 229E
uggccccagagacc

SEQ ID NO: 3946484 - RNA, 19 nt, Human coronavirus 229E
uggcuucuguggaaauggc

SEQ ID NO: 3946485 - RNA, 20 nt, Human coronavirus 229E
ugggcugaacacuaguuacu

SEQ ID NO: 3946486 - RNA, 19 nt, Human coronavirus 229E
ugguuggaauguuauucua

SEQ ID NO: 3946487 - RNA, 18 nt, Human coronavirus 229E
uguaacccaccagaucag

SEQ ID NO: 3946488 - RNA, 12 nt, Human coronavirus 229E
uguaccagaugg

SEQ ID NO: 3946489 - RNA, 17 nt, Human coronavirus 229E
ugucgcuaccuguuuau

SEQ ID NO: 3946490 - RNA, 20 nt, Human coronavirus 229E
ugucuauuuuaaugguacug

SEQ ID NO: 3946491 - RNA, 19 nt, Human coronavirus 229E
ugucuuguugccgacacaa

SEQ ID NO: 3946492 - RNA, 19 nt, Human coronavirus 229E
ugugcguugaugguacaaa

SEQ ID NO: 3946493 - RNA, 14 nt, Human coronavirus 229E
uguguuguacguug

SEQ ID NO: 3946494 - RNA, 18 nt, Human coronavirus 229E
uguguuuuauuguaccaa

SEQ ID NO: 3946495 - RNA, 18 nt, Human coronavirus 229E
uguuacuguuguugaaga

SEQ ID NO: 3946496 - RNA, 21 nt, Human coronavirus 229E
uguuauccugcugguguuaau

SEQ ID NO: 3946497 - RNA, 12 nt, Human coronavirus 229E
uguuggugcuau

SEQ ID NO: 3946498 - RNA, 13 nt, Human coronavirus 229E
uguugguuucuug

SEQ ID NO: 3946499 - RNA, 16 nt, Human coronavirus 229E
uguuuugcaucuucua

SEQ ID NO: 3946500 - RNA, 23 nt, Human coronavirus 229E
uguuuuucuccacacugucuugu

SEQ ID NO: 3946501 - RNA, 19 nt, Human coronavirus 229E
uuaacacgggaaauugccc

SEQ ID NO: 3946502 - RNA, 20 nt, Human coronavirus 229E
uuaacacgggaaauugcccu

SEQ ID NO: 3946503 - RNA, 11 nt, Human coronavirus 229E
uuacugugacc

SEQ ID NO: 3946504 - RNA, 13 nt, Human coronavirus 229E
uuauaauugcaca

SEQ ID NO: 3946505 - RNA, 22 nt, Human coronavirus 229E
uuauccugcugguguuaauauu

SEQ ID NO: 3946506 - RNA, 14 nt, Human coronavirus 229E
uuauucuacaagcc

SEQ ID NO: 3946507 - RNA, 21 nt, Human coronavirus 229E
uuauuguaccaacaacacuuu

SEQ ID NO: 3946508 - RNA, 23 nt, Human coronavirus 229E
uucaauguaaccacacuuugcua

SEQ ID NO: 3946509 - RNA, 17 nt, Human coronavirus 229E
uucacuagagaaaugca

SEQ ID NO: 3946510 - RNA, 15 nt, Human coronavirus 229E
uucuauaauugcugu

SEQ ID NO: 3946511 - RNA, 17 nt, Human coronavirus 229E
uucuggacuuggcacug

SEQ ID NO: 3946512 - RNA, 13 nt, Human coronavirus 229E
uugaaaagaucca

SEQ ID NO: 3946513 - RNA, 17 nt, Human coronavirus 229E
uugaagaugcuuguacu

SEQ ID NO: 3946514 - RNA, 14 nt, Human coronavirus 229E
uugauagugaacaa

SEQ ID NO: 3946515 - RNA, 16 nt, Human coronavirus 229E
uugcaaacucugauug

SEQ ID NO: 3946516 - RNA, 13 nt, Human coronavirus 229E
uugcucuuuacaa

SEQ ID NO: 3946517 - RNA, 18 nt, Human coronavirus 229E
uugcuguaauuuugcuug

SEQ ID NO: 3946518 - RNA, 18 nt, Human coronavirus 229E
uugcuuuauuuaaagcaa

SEQ ID NO: 3946519 - RNA, 23 nt, Human coronavirus 229E
uuguaacccaccagaucagcuug

SEQ ID NO: 3946520 - RNA, 23 nt, Human coronavirus 229E
uugucaaacuacaaaugggcuga

SEQ ID NO: 3946521 - RNA, 22 nt, Human coronavirus 229E
uuguugcuuaauugcuuauggu

SEQ ID NO: 3946522 - RNA, 16 nt, Human coronavirus 229E
uuguuuugugaacacc

SEQ ID NO: 3946523 - RNA, 18 nt, Human coronavirus 229E
uuuaaauuauguugcauu

SEQ ID NO: 3946524 - RNA, 20 nt, Human coronavirus 229E
uuuaauugguggaauugcuu

SEQ ID NO: 3946525 - RNA, 15 nt, Human coronavirus 229E
uuuauugcuuuguaa

SEQ ID NO: 3946526 - RNA, 14 nt, Human coronavirus 229E
uuucuauugaaacu

SEQ ID NO: 3946527 - RNA, 23 nt, Human coronavirus 229E
uuucucaacuaacgacuuguacg

SEQ ID NO: 3946528 - RNA, 24 nt, Human coronavirus 229E
uuugccuggcgucgcugaugcuga

SEQ ID NO: 3946529 - RNA, 20 nt, Human coronavirus 229E
uuugucuauaccuuccaauu

SEQ ID NO: 3946530 - RNA, 23 nt, Human coronavirus 229E
uuuuuccauacagcuuggcacug

SEQ ID NO: 3946531 - RNA, 14 nt, Human coronavirus 229E
aacaagaaagacaa

SEQ ID NO: 3946532 - RNA, 18 nt, Human coronavirus 229E
aacaucagccguuucaau

SEQ ID NO: 3946533 - RNA, 16 nt, Human coronavirus 229E
aaccacguaauguuuc

SEQ ID NO: 3946534 - RNA, 15 nt, Human coronavirus 229E
aaccauugugccaga

SEQ ID NO: 3946535 - RNA, 13 nt, Human coronavirus 229E
aaccucaauuuug

SEQ ID NO: 3946536 - RNA, 20 nt, Human coronavirus 229E
aacgaguuauugauuucuaa

SEQ ID NO: 3946537 - RNA, 14 nt, Human coronavirus 229E
aacuuauucuaguu

SEQ ID NO: 3946538 - RNA, 14 nt, Human coronavirus 229E
aagacgcugcaaga

SEQ ID NO: 3946539 - RNA, 17 nt, Human coronavirus 229E
aagcaugaaaugcaaaa

SEQ ID NO: 3946540 - RNA, 19 nt, Human coronavirus 229E
aauaaggcucugaaaccau

SEQ ID NO: 3946541 - RNA, 16 nt, Human coronavirus 229E
aauaauuaaacuaauu

SEQ ID NO: 3946542 - RNA, 17 nt, Human coronavirus 229E
aauccuuuucguuuaug

SEQ ID NO: 3946543 - RNA, 18 nt, Human coronavirus 229E
aaugaugaugugacaucu

SEQ ID NO: 3946544 - RNA, 17 nt, Human coronavirus 229E
aauguuacauuggacaa

SEQ ID NO: 3946545 - RNA, 17 nt, Human coronavirus 229E
aauugaaaauugcaaug

SEQ ID NO: 3946546 - RNA, 24 nt, Human coronavirus 229E
aauugcaaacucugauugacaaca

SEQ ID NO: 3946547 - RNA, 20 nt, Human coronavirus 229E
acaaaugugcuggaguaauc

SEQ ID NO: 3946548 - RNA, 13 nt, Human coronavirus 229E
acaauuugcugag

SEQ ID NO: 3946549 - RNA, 16 nt, Human coronavirus 229E
acacuggccaauuuua

SEQ ID NO: 3946550 - RNA, 20 nt, Human coronavirus 229E
acacuggccaauuuuaauga

SEQ ID NO: 3946551 - RNA, 22 nt, Human coronavirus 229E
acauacuuuuuagcaaacuugu

SEQ ID NO: 3946552 - RNA, 14 nt, Human coronavirus 229E
accaacaacacuuu

SEQ ID NO: 3946553 - RNA, 22 nt, Human coronavirus 229E
accacugauuuuuguacuguug

SEQ ID NO: 3946554 - RNA, 14 nt, Human coronavirus 229E
accuguuuaucaua

SEQ ID NO: 3946555 - RNA, 16 nt, Human coronavirus 229E
acgaucagagcugcuu

SEQ ID NO: 3946556 - RNA, 13 nt, Human coronavirus 229E
acgcagacuacaa

SEQ ID NO: 3946557 - RNA, 13 nt, Human coronavirus 229E
acuagagaaaugc

SEQ ID NO: 3946558 - RNA, 20 nt, Human coronavirus 229E
acugauuuuuguacuguugc

SEQ ID NO: 3946559 - RNA, 22 nt, Human coronavirus 229E
acugguagauuggcugcuuuga

SEQ ID NO: 3946560 - RNA, 14 nt, Human coronavirus 229E
acuuaaaguggcuc

SEQ ID NO: 3946561 - RNA, 17 nt, Human coronavirus 229E
acuucaaaccucagagu

SEQ ID NO: 3946562 - RNA, 14 nt, Human coronavirus 229E
acuuguuacuucug

SEQ ID NO: 3946563 - RNA, 17 nt, Human coronavirus 229E
acuuucacuacuagagu

SEQ ID NO: 3946564 - RNA, 16 nt, Human coronavirus 229E
acuuugauugcuguaa

SEQ ID NO: 3946565 - RNA, 22 nt, Human coronavirus 229E
acuuuuugggcauggaauccug

SEQ ID NO: 3946566 - RNA, 22 nt, Human coronavirus 229E
agaacugccgaaauuuuucuau

SEQ ID NO: 3946567 - RNA, 14 nt, Human coronavirus 229E
agacauacuuuuua

SEQ ID NO: 3946568 - RNA, 20 nt, Human coronavirus 229E
agacguggaaccauuuuguu

SEQ ID NO: 3946569 - RNA, 16 nt, Human coronavirus 229E
agagaaaugcaacaac

SEQ ID NO: 3946570 - RNA, 21 nt, Human coronavirus 229E
agaggugauuguaaagguuuu

SEQ ID NO: 3946571 - RNA, 18 nt, Human coronavirus 229E
agagucaggcaacacugu

SEQ ID NO: 3946572 - RNA, 18 nt, Human coronavirus 229E
agaguucugaaacaaaag

SEQ ID NO: 3946573 - RNA, 23 nt, Human coronavirus 229E
agaguucugaaacaaaagaacaa

SEQ ID NO: 3946574 - RNA, 23 nt, Human coronavirus 229E
agaucacaccguggcagagcugc

SEQ ID NO: 3946575 - RNA, 16 nt, Human coronavirus 229E
agauggcacuguuacc

SEQ ID NO: 3946576 - RNA, 20 nt, Human coronavirus 229E
agaugguuuuuauucuacaa

SEQ ID NO: 3946577 - RNA, 19 nt, Human coronavirus 229E
agauuggcugcuuugaaug

SEQ ID NO: 3946578 - RNA, 18 nt, Human coronavirus 229E
agcaaugcgaaaguuagu

SEQ ID NO: 3946579 - RNA, 21 nt, Human coronavirus 229E
agcacaggcuggguuuucuac

SEQ ID NO: 3946580 - RNA, 20 nt, Human coronavirus 229E
agcaguauacuucugcuugu

SEQ ID NO: 3946581 - RNA, 14 nt, Human coronavirus 229E
agcaugaaaugcaa

SEQ ID NO: 3946582 - RNA, 15 nt, Human coronavirus 229E
agcuuggcacugcug

SEQ ID NO: 3946583 - RNA, 19 nt, Human coronavirus 229E
aggcucauuguauguuucu

SEQ ID NO: 3946584 - RNA, 19 nt, Human coronavirus 229E
aggcuggagucugcagaug

SEQ ID NO: 3946585 - RNA, 12 nt, Human coronavirus 229E
agguuaaugcaa

SEQ ID NO: 3946586 - RNA, 18 nt, Human coronavirus 229E
agguuaaugcaaucacug

SEQ ID NO: 3946587 - RNA, 17 nt, Human coronavirus 229E
agguugaguauuuacaa

SEQ ID NO: 3946588 - RNA, 20 nt, Human coronavirus 229E
aguauauugauguuaauaag

SEQ ID NO: 3946589 - RNA, 17 nt, Human coronavirus 229E
aguuacggcuuuucuaa

SEQ ID NO: 3946590 - RNA, 23 nt, Human coronavirus 229E
aguuccuuuaugaauguuacauu

SEQ ID NO: 3946591 - RNA, 17 nt, Human coronavirus 229E
auacccuccgacuuugc

SEQ ID NO: 3946592 - RNA, 20 nt, Human coronavirus 229E
auacuuguuuugugaacacc

SEQ ID NO: 3946593 - RNA, 17 nt, Human coronavirus 229E
aucucgcauaauguuug

SEQ ID NO: 3946594 - RNA, 16 nt, Human coronavirus 229E
aucuuggcacaggacc

SEQ ID NO: 3946595 - RNA, 13 nt, Human coronavirus 229E
augacagacuuga

SEQ ID NO: 3946596 - RNA, 14 nt, Human coronavirus 229E
augauaguguuuca

SEQ ID NO: 3946597 - RNA, 23 nt, Human coronavirus 229E
augugcgcuguguugaauugcuu

SEQ ID NO: 3946598 - RNA, 22 nt, Human coronavirus 229E
auguguauacuuguuuugugaa

SEQ ID NO: 3946599 - RNA, 12 nt, Human coronavirus 229E
auguuugcaaug

SEQ ID NO: 3946600 - RNA, 15 nt, Human coronavirus 229E
auugcuuuaggaggu

SEQ ID NO: 3946601 - RNA, 13 nt, Human coronavirus 229E
auugcuuuucucu

SEQ ID NO: 3946602 - RNA, 19 nt, Human coronavirus 229E
auuuagagagcguguugaa

SEQ ID NO: 3946603 - RNA, 20 nt, Human coronavirus 229E
auuucuaaacuaaacgacaa

SEQ ID NO: 3946604 - RNA, 14 nt, Human coronavirus 229E
auuucucaacuaac

SEQ ID NO: 3946605 - RNA, 19 nt, Human coronavirus 229E
auuuggcaguguauguuuu

SEQ ID NO: 3946606 - RNA, 12 nt, Human coronavirus 229E
auuuuaaugaaa

SEQ ID NO: 3946607 - RNA, 21 nt, Human coronavirus 229E
auuuugcuuuuguucuuucuu

SEQ ID NO: 3946608 - RNA, 13 nt, Human coronavirus 229E
auuuugguuggaa

SEQ ID NO: 3946609 - RNA, 18 nt, Human coronavirus 229E
caaacaguuucagacuuu

SEQ ID NO: 3946610 - RNA, 16 nt, Human coronavirus 229E
caaauacguugcuguu

SEQ ID NO: 3946611 - RNA, 19 nt, Human coronavirus 229E
caaauugccaaauuacacu

SEQ ID NO: 3946612 - RNA, 22 nt, Human coronavirus 229E
caacuugugucugcuguuaauc

SEQ ID NO: 3946613 - RNA, 23 nt, Human coronavirus 229E
caagauccaggauguuguuaauc

SEQ ID NO: 3946614 - RNA, 15 nt, Human coronavirus 229E
caagcccuacaaaca

SEQ ID NO: 3946615 - RNA, 14 nt, Human coronavirus 229E
caaggcaacucauu

SEQ ID NO: 3946616 - RNA, 23 nt, Human coronavirus 229E
caagguaaguguugguuucuuga

SEQ ID NO: 3946617 - RNA, 15 nt, Human coronavirus 229E
caauggaagagccag

SEQ ID NO: 3946618 - RNA, 22 nt, Human coronavirus 229E
caauuauuauagaaucacaucu

SEQ ID NO: 3946619 - RNA, 17 nt, Human coronavirus 229E
caauuuuaaugaaacua

SEQ ID NO: 3946620 - RNA, 13 nt, Human coronavirus 229E
cacaauuugcuga

SEQ ID NO: 3946621 - RNA, 12 nt, Human coronavirus 229E
cacacuuugcua

SEQ ID NO: 3946622 - RNA, 15 nt, Human coronavirus 229E
cacgguggaaaagac

SEQ ID NO: 3946623 - RNA, 15 nt, Human coronavirus 229E
cacuuugcuaugcaa

SEQ ID NO: 3946624 - RNA, 20 nt, Human coronavirus 229E
cagacuacaaaaagugcacu

SEQ ID NO: 3946625 - RNA, 23 nt, Human coronavirus 229E
cagaugguucuauaauugcuguu

SEQ ID NO: 3946626 - RNA, 13 nt, Human coronavirus 229E
cagcuaucgucac

SEQ ID NO: 3946627 - RNA, 13 nt, Human coronavirus 229E
cagcuuggcacug

SEQ ID NO: 3946628 - RNA, 14 nt, Human coronavirus 229E
caguauacuucugc

SEQ ID NO: 3946629 - RNA, 15 nt, Human coronavirus 229E
cagucgugcucaucu

SEQ ID NO: 3946630 - RNA, 16 nt, Human coronavirus 229E
caguugcuacugcacu

SEQ ID NO: 3946631 - RNA, 12 nt, Human coronavirus 229E
caguuucagacu

SEQ ID NO: 3946632 - RNA, 14 nt, Human coronavirus 229E
caguuuggacacua

SEQ ID NO: 3946633 - RNA, 16 nt, Human coronavirus 229E
cauaacagucaggaug

SEQ ID NO: 3946634 - RNA, 14 nt, Human coronavirus 229E
caugaucccuugcu

SEQ ID NO: 3946635 - RNA, 21 nt, Human coronavirus 229E
ccaaauacguugcuguuuaug

SEQ ID NO: 3946636 - RNA, 20 nt, Human coronavirus 229E
ccaaugguguuaaagcuaaa

SEQ ID NO: 3946637 - RNA, 19 nt, Human coronavirus 229E
ccacaacuuuggaagugca

SEQ ID NO: 3946638 - RNA, 18 nt, Human coronavirus 229E
ccacacugucuuguugcc

SEQ ID NO: 3946639 - RNA, 22 nt, Human coronavirus 229E
cccaucucaaacuucaccugca

SEQ ID NO: 3946640 - RNA, 20 nt, Human coronavirus 229E
ccguuaauuucaaugucacu

SEQ ID NO: 3946641 - RNA, 17 nt, Human coronavirus 229E
ccuacaaacaguugcua

SEQ ID NO: 3946642 - RNA, 12 nt, Human coronavirus 229E
ccuagugcacua

SEQ ID NO: 3946643 - RNA, 20 nt, Human coronavirus 229E
ccuaucguaguugauugcuc

SEQ ID NO: 3946644 - RNA, 16 nt, Human coronavirus 229E
ccugugucuauugugu

SEQ ID NO: 3946645 - RNA, 14 nt, Human coronavirus 229E
ccuuccaauuggac

SEQ ID NO: 3946646 - RNA, 12 nt, Human coronavirus 229E
ccuuuguugcuu

SEQ ID NO: 3946647 - RNA, 16 nt, Human coronavirus 229E
cguauacacuaaugag

SEQ ID NO: 3946648 - RNA, 20 nt, Human coronavirus 229E
cgugaaagauggcacuguua

SEQ ID NO: 3946649 - RNA, 16 nt, Human coronavirus 229E
cuaaacaugccacugu

SEQ ID NO: 3946650 - RNA, 23 nt, Human coronavirus 229E
cuaaacgaguuauugauuucuaa

SEQ ID NO: 3946651 - RNA, 19 nt, Human coronavirus 229E
cuaagauguuccuuaagcu

SEQ ID NO: 3946652 - RNA, 13 nt, Human coronavirus 229E
cuaaguacacuga

SEQ ID NO: 3946653 - RNA, 14 nt, Human coronavirus 229E
cuaauuugucuaua

SEQ ID NO: 3946654 - RNA, 13 nt, Human coronavirus 229E
cuaccuguuuauc

SEQ ID NO: 3946655 - RNA, 21 nt, Human coronavirus 229E
cuacugcagaaaccacugauu

SEQ ID NO: 3946656 - RNA, 16 nt, Human coronavirus 229E
cuaugcguccaauggc

SEQ ID NO: 3946657 - RNA, 16 nt, Human coronavirus 229E
cuauguuacugaaccu

SEQ ID NO: 3946658 - RNA, 21 nt, Human coronavirus 229E
cuauugugucgcuaccuguuu

SEQ ID NO: 3946659 - RNA, 16 nt, Human coronavirus 229E
cuauuuuaaugguacu

SEQ ID NO: 3946660 - RNA, 14 nt, Human coronavirus 229E
cucaauuguuaaug

SEQ ID NO: 3946661 - RNA, 18 nt, Human coronavirus 229E
cucagauguuuugucuga

SEQ ID NO: 3946662 - RNA, 17 nt, Human coronavirus 229E
cucaggaaaaagauaaa

SEQ ID NO: 3946663 - RNA, 12 nt, Human coronavirus 229E
cuccaacaggca

SEQ ID NO: 3946664 - RNA, 20 nt, Human coronavirus 229E
cucguucucagaguucugaa

SEQ ID NO: 3946665 - RNA, 19 nt, Human coronavirus 229E
cucucccaugagcaacaug

SEQ ID NO: 3946666 - RNA, 17 nt, Human coronavirus 229E
cugaugcaucugaacca

SEQ ID NO: 3946667 - RNA, 18 nt, Human coronavirus 229E
cugaugcaucugaaccac

SEQ ID NO: 3946668 - RNA, 14 nt, Human coronavirus 229E
cugcugguguuaau

SEQ ID NO: 3946669 - RNA, 20 nt, Human coronavirus 229E
cugcuuuugugggugcacua

SEQ ID NO: 3946670 - RNA, 16 nt, Human coronavirus 229E
cuggcucuacaagaca

SEQ ID NO: 3946671 - RNA, 16 nt, Human coronavirus 229E
cuguuauccugcuggu

SEQ ID NO: 3946672 - RNA, 17 nt, Human coronavirus 229E
cuguucaaaaauugcaa

SEQ ID NO: 3946673 - RNA, 15 nt, Human coronavirus 229E
cuguuguugaagaac

SEQ ID NO: 3946674 - RNA, 14 nt, Human coronavirus 229E
cuuaauuacacugu

SEQ ID NO: 3946675 - RNA, 18 nt, Human coronavirus 229E
cuuauaggcuauuggaau

SEQ ID NO: 3946676 - RNA, 13 nt, Human coronavirus 229E
cuuauuucucaac

SEQ ID NO: 3946677 - RNA, 16 nt, Human coronavirus 229E
cuucaccugcaacugc

SEQ ID NO: 3946678 - RNA, 19 nt, Human coronavirus 229E
cuucgcaaacaguuucaga

SEQ ID NO: 3946679 - RNA, 23 nt, Human coronavirus 229E
cuucuauuagagguuguugugaa

SEQ ID NO: 3946680 - RNA, 13 nt, Human coronavirus 229E
cuucuuuggccac

SEQ ID NO: 3946681 - RNA, 20 nt, Human coronavirus 229E
cuugaaaauaaggcucugaa

SEQ ID NO: 3946682 - RNA, 17 nt, Human coronavirus 229E
cuugcuuuggcuugaca

SEQ ID NO: 3946683 - RNA, 13 nt, Human coronavirus 229E
cuuguuguuuauc

SEQ ID NO: 3946684 - RNA, 20 nt, Human coronavirus 229E
cuuuacugguguuaaugaug

SEQ ID NO: 3946685 - RNA, 22 nt, Human coronavirus 229E
cuuuguggugaguauguugcua

SEQ ID NO: 3946686 - RNA, 13 nt, Human coronavirus 229E
gaaauucaggcuu

SEQ ID NO: 3946687 - RNA, 14 nt, Human coronavirus 229E
gaaggcaguugcug

SEQ ID NO: 3946688 - RNA, 15 nt, Human coronavirus 229E
gaauuaaguuacaaa

SEQ ID NO: 3946689 - RNA, 23 nt, Human coronavirus 229E
gaauuaaguuacaaauugccaaa

SEQ ID NO: 3946690 - RNA, 11 nt, Human coronavirus 229E
gaauugcuuua

SEQ ID NO: 3946691 - RNA, 17 nt, Human coronavirus 229E
gacaagccucaggaaaa

SEQ ID NO: 3946692 - RNA, 16 nt, Human coronavirus 229E
gaccagugaaauuagc

SEQ ID NO: 3946693 - RNA, 20 nt, Human coronavirus 229E
gagcacuacuauaauuuaua

SEQ ID NO: 3946694 - RNA, 20 nt, Human coronavirus 229E
gagugacugugcccaaagac

SEQ ID NO: 3946695 - RNA, 21 nt, Human coronavirus 229E
gaucacaccguggcagagcug

SEQ ID NO: 3946696 - RNA, 19 nt, Human coronavirus 229E
gauccaggauguuguuaau

SEQ ID NO: 3946697 - RNA, 19 nt, Human coronavirus 229E
gaugcaaaauuuagagagc

SEQ ID NO: 3946698 - RNA, 22 nt, Human coronavirus 229E
gauggugcuaaaacugaaccua

SEQ ID NO: 3946699 - RNA, 17 nt, Human coronavirus 229E
gaugucauacguuacaa

SEQ ID NO: 3946700 - RNA, 19 nt, Human coronavirus 229E
gauugcuguaauuuugcuu

SEQ ID NO: 3946701 - RNA, 19 nt, Human coronavirus 229E
gcagacugauguuuuacaa

SEQ ID NO: 3946702 - RNA, 12 nt, Human coronavirus 229E
gcaucuuuuaac

SEQ ID NO: 3946703 - RNA, 19 nt, Human coronavirus 229E
gcauuacugugaccuugcu

SEQ ID NO: 3946704 - RNA, 20 nt, Human coronavirus 229E
gcauucacuagagaaaugca

SEQ ID NO: 3946705 - RNA, 16 nt, Human coronavirus 229E
gccaauuuuaaugaaa

SEQ ID NO: 3946706 - RNA, 21 nt, Human coronavirus 229E
gccacuguguuguuugaaauu

SEQ ID NO: 3946707 - RNA, 14 nt, Human coronavirus 229E
gccuauaguggcua

SEQ ID NO: 3946708 - RNA, 20 nt, Human coronavirus 229E
gccucuuuguuguguauuuu

SEQ ID NO: 3946709 - RNA, 16 nt, Human coronavirus 229E
gccuuucuagaaaggu

SEQ ID NO: 3946710 - RNA, 23 nt, Human coronavirus 229E
gcggagcuuaauuacacuguuca

SEQ ID NO: 3946711 - RNA, 20 nt, Human coronavirus 229E
gcuauuggaauguucaaaaa

SEQ ID NO: 3946712 - RNA, 19 nt, Human coronavirus 229E
gcugcuuugaauguauucg

SEQ ID NO: 3946713 - RNA, 15 nt, Human coronavirus 229E
gcuguauuggucuca

SEQ ID NO: 3946714 - RNA, 19 nt, Human coronavirus 229E
gcuuagcaaugcgaaaguu

SEQ ID NO: 3946715 - RNA, 23 nt, Human coronavirus 229E
gcuuauggucuguuucuggcuug

SEQ ID NO: 3946716 - RNA, 14 nt, Human coronavirus 229E
ggauacacaaaaaa

SEQ ID NO: 3946717 - RNA, 18 nt, Human coronavirus 229E
ggaucaauuccuuuacau

SEQ ID NO: 3946718 - RNA, 16 nt, Human coronavirus 229E
gguacgaucagagcug

SEQ ID NO: 3946719 - RNA, 12 nt, Human coronavirus 229E
gguuugaagaug

SEQ ID NO: 3946720 - RNA, 23 nt, Human coronavirus 229E
guaauguuucauaugauaguguu

SEQ ID NO: 3946721 - RNA, 18 nt, Human coronavirus 229E
guaauuuugcuuggaaga

SEQ ID NO: 3946722 - RNA, 14 nt, Human coronavirus 229E
gugcagguguugug

SEQ ID NO: 3946723 - RNA, 22 nt, Human coronavirus 229E
guuaggcgcaagaauucagaac

SEQ ID NO: 3946724 - RNA, 17 nt, Human coronavirus 229E
guugauagugaacaacc

SEQ ID NO: 3946725 - RNA, 18 nt, Human coronavirus 229E
guugcauauugcugguug

SEQ ID NO: 3946726 - RNA, 16 nt, Human coronavirus 229E
guuuacacuugcuaau

SEQ ID NO: 3946727 - RNA, 14 nt, Human coronavirus 229E
guuuaugugccauu

SEQ ID NO: 3946728 - RNA, 18 nt, Human coronavirus 229E
guuugauagucacauugu

SEQ ID NO: 3946729 - RNA, 15 nt, Human coronavirus 229E
uaaacuaaacaugcc

SEQ ID NO: 3946730 - RNA, 16 nt, Human coronavirus 229E
uaaagaccucagccuu

SEQ ID NO: 3946731 - RNA, 19 nt, Human coronavirus 229E
uaacaugaucccuugcuuu

SEQ ID NO: 3946732 - RNA, 18 nt, Human coronavirus 229E
uaaccacacuuugcuaug

SEQ ID NO: 3946733 - RNA, 12 nt, Human coronavirus 229E
uaaggcucugaa

SEQ ID NO: 3946734 - RNA, 18 nt, Human coronavirus 229E
uaaucuugcucuuuacaa

SEQ ID NO: 3946735 - RNA, 19 nt, Human coronavirus 229E
uaaucuugcucuuuacaaa

SEQ ID NO: 3946736 - RNA, 21 nt, Human coronavirus 229E
uaaugagccucuuuguugugu

SEQ ID NO: 3946737 - RNA, 17 nt, Human coronavirus 229E
uaauggcuaucgcuauu

SEQ ID NO: 3946738 - RNA, 23 nt, Human coronavirus 229E
uaauugcacagacgcuguuuuaa

SEQ ID NO: 3946739 - RNA, 14 nt, Human coronavirus 229E
uaauugcuguucaa

SEQ ID NO: 3946740 - RNA, 13 nt, Human coronavirus 229E
uaauuugucuaua

SEQ ID NO: 3946741 - RNA, 21 nt, Human coronavirus 229E
uacaaauugccaaauuacacu

SEQ ID NO: 3946742 - RNA, 19 nt, Human coronavirus 229E
uacaaccagacuauuuuga

SEQ ID NO: 3946743 - RNA, 11 nt, Human coronavirus 229E
uacacuguuca

SEQ ID NO: 3946744 - RNA, 18 nt, Human coronavirus 229E
uacuauguuacugaaccu

SEQ ID NO: 3946745 - RNA, 17 nt, Human coronavirus 229E
uagaggacguauugaua

SEQ ID NO: 3946746 - RNA, 17 nt, Human coronavirus 229E
uagcucuauucaggcua

SEQ ID NO: 3946747 - RNA, 14 nt, Human coronavirus 229E
uaguauaacucauu

SEQ ID NO: 3946748 - RNA, 21 nt, Human coronavirus 229E
uaguauaacucauuacaaaug

SEQ ID NO: 3946749 - RNA, 17 nt, Human coronavirus 229E
uagucuuauacacaaug

SEQ ID NO: 3946750 - RNA, 15 nt, Human coronavirus 229E
uagugagaugcucac

SEQ ID NO: 3946751 - RNA, 16 nt, Human coronavirus 229E
uaguuacucuguuugc

SEQ ID NO: 3946752 - RNA, 18 nt, Human coronavirus 229E
uaugcuguuugauaguca

SEQ ID NO: 3946753 - RNA, 12 nt, Human coronavirus 229E
uauguugcuauu

SEQ ID NO: 3946754 - RNA, 15 nt, Human coronavirus 229E
uauguuugcaauggu

SEQ ID NO: 3946755 - RNA, 13 nt, Human coronavirus 229E
agacugauguuuu

SEQ ID NO: 3946756 - RNA, 15 nt, Human coronavirus 229E
agaggugauuguaaa

SEQ ID NO: 3946757 - RNA, 21 nt, Human coronavirus 229E
agagugacugugcccaaagac

SEQ ID NO: 3946758 - RNA, 19 nt, Human coronavirus 229E
agaugcucacuuuugacaa

SEQ ID NO: 3946759 - RNA, 23 nt, Human coronavirus 229E
agauuguuuuaugguuugaagau

SEQ ID NO: 3946760 - RNA, 13 nt, Human coronavirus 229E
agauuuuguucaa

SEQ ID NO: 3946761 - RNA, 14 nt, Human coronavirus 229E
agcccuuugcuugu

SEQ ID NO: 3946762 - RNA, 19 nt, Human coronavirus 229E
agcgucauaccuagcuugc

SEQ ID NO: 3946763 - RNA, 15 nt, Human coronavirus 229E
agcguuuacacuugc

SEQ ID NO: 3946764 - RNA, 20 nt, Human coronavirus 229E
agcguuuacacuugcuaaug

SEQ ID NO: 3946765 - RNA, 12 nt, Human coronavirus 229E
agcuuggcacug

SEQ ID NO: 3946766 - RNA, 14 nt, Human coronavirus 229E
agcuuggcacugcu

SEQ ID NO: 3946767 - RNA, 17 nt, Human coronavirus 229E
agcuuggcacugcuggc

SEQ ID NO: 3946768 - RNA, 23 nt, Human coronavirus 229E
agcuugugccgucaacagcugcu

SEQ ID NO: 3946769 - RNA, 19 nt, Human coronavirus 229E
agguuaaugcaaucacugu

SEQ ID NO: 3946770 - RNA, 12 nt, Human coronavirus 229E
aguauaacucau

SEQ ID NO: 3946771 - RNA, 13 nt, Human coronavirus 229E
aguauaacucauu

SEQ ID NO: 3946772 - RNA, 22 nt, Human coronavirus 229E
agugaacaaccuuggaagguga

SEQ ID NO: 3946773 - RNA, 15 nt, Human coronavirus 229E
agugacagaaaccau

SEQ ID NO: 3946774 - RNA, 17 nt, Human coronavirus 229E
aguuucacgacagguua

SEQ ID NO: 3946775 - RNA, 18 nt, Human coronavirus 229E
auaauauuuaugauguau

SEQ ID NO: 3946776 - RNA, 23 nt, Human coronavirus 229E
auaauggcauuaugguuuugccu

SEQ ID NO: 3946777 - RNA, 16 nt, Human coronavirus 229E
auaccucaucuguugu

SEQ ID NO: 3946778 - RNA, 14 nt, Human coronavirus 229E
auacuucugcuugu

SEQ ID NO: 3946779 - RNA, 16 nt, Human coronavirus 229E
auauugauguuaauaa

SEQ ID NO: 3946780 - RNA, 22 nt, Human coronavirus 229E
aucagaguccugcuucuucuca

SEQ ID NO: 3946781 - RNA, 16 nt, Human coronavirus 229E
aucuuuagguuuugac

SEQ ID NO: 3946782 - RNA, 17 nt, Human coronavirus 229E
augcuauuacacaaacu

SEQ ID NO: 3946783 - RNA, 18 nt, Human coronavirus 229E
augggauuucauugucuu

SEQ ID NO: 3946784 - RNA, 19 nt, Human coronavirus 229E
augguacgaucagagcugc

SEQ ID NO: 3946785 - RNA, 14 nt, Human coronavirus 229E
auuacaaaugugcu

SEQ ID NO: 3946786 - RNA, 22 nt, Human coronavirus 229E
auucaggcacguuuaaauuaug

SEQ ID NO: 3946787 - RNA, 23 nt, Human coronavirus 229E
auucuaauugggccuuuguugca

SEQ ID NO: 3946788 - RNA, 19 nt, Human coronavirus 229E
auucuucaguuuggacacu

SEQ ID NO: 3946789 - RNA, 14 nt, Human coronavirus 229E
auuggcugcuuuga

SEQ ID NO: 3946790 - RNA, 16 nt, Human coronavirus 229E
auuuaacuucucaguu

SEQ ID NO: 3946791 - RNA, 21 nt, Human coronavirus 229E
auuuaccaaucauauaugcac

SEQ ID NO: 3946792 - RNA, 15 nt, Human coronavirus 229E
auuucuaaacuaaac

SEQ ID NO: 3946793 - RNA, 19 nt, Human coronavirus 229E
auuuugaagaaaaccuuag

SEQ ID NO: 3946794 - RNA, 20 nt, Human coronavirus 229E
caaacaguugcuacugcacu

SEQ ID NO: 3946795 - RNA, 18 nt, Human coronavirus 229E
caaagaccauccacacuu

SEQ ID NO: 3946796 - RNA, 18 nt, Human coronavirus 229E
caacuuuggaagugcagg

SEQ ID NO: 3946797 - RNA, 21 nt, Human coronavirus 229E
caagacgugaaagauggcacu

SEQ ID NO: 3946798 - RNA, 15 nt, Human coronavirus OC43 (HCoV-OC43)
aaaacuuggcaagga

SEQ ID NO: 3946799 - RNA, 22 nt, Human coronavirus OC43 (HCoV-OC43)
aaagugcagaauuuaucuggga

SEQ ID NO: 3946800 - RNA, 16 nt, Human coronavirus OC43 (HCoV-OC43)
aacucgcacccacagc

SEQ ID NO: 3946801 - RNA, 17 nt, Human coronavirus OC43 (HCoV-OC43)
aagaaugguuuuacuuu

SEQ ID NO: 3946802 - RNA, 19 nt, Human coronavirus OC43 (HCoV-OC43)
aagacaccucagaaauaua

SEQ ID NO: 3946803 - RNA, 18 nt, Human coronavirus OC43 (HCoV-OC43)
aagccccgccagaagagg

SEQ ID NO: 3946804 - RNA, 17 nt, Human coronavirus OC43 (HCoV-OC43)
aagucgcaguauguuug

SEQ ID NO: 3946805 - RNA, 18 nt, Human coronavirus OC43 (HCoV-OC43)
aauagauagagaagguua

SEQ ID NO: 3946806 - RNA, 21 nt, Human coronavirus OC43 (HCoV-OC43)
aaugguuuuacuuuagaauau

SEQ ID NO: 3946807 - RNA, 17 nt, Human coronavirus OC43 (HCoV-OC43)
aauucuaucuagacuug

SEQ ID NO: 3946808 - RNA, 22 nt, Human coronavirus OC43 (HCoV-OC43)
aauuuuacgccuuaucaugccu

SEQ ID NO: 3946809 - RNA, 20 nt, Human coronavirus OC43 (HCoV-OC43)
acaggaguuaaauguuuaug

SEQ ID NO: 3946810 - RNA, 13 nt, Human coronavirus OC43 (HCoV-OC43)
acuacuugacacu

SEQ ID NO: 3946811 - RNA, 17 nt, Human coronavirus OC43 (HCoV-OC43)
acuauuaugucaugccu

SEQ ID NO: 3946812 - RNA, 13 nt, Human coronavirus OC43 (HCoV-OC43)
agaagauggauga

SEQ ID NO: 3946813 - RNA, 18 nt, Human coronavirus OC43 (HCoV-OC43)
agaguugacugcagagga

SEQ ID NO: 3946814 - RNA, 18 nt, Human coronavirus OC43 (HCoV-OC43)
aagagccagcauguuaag

SEQ ID NO: 3946815 - RNA, 19 nt, Human coronavirus OC43 (HCoV-OC43)
aagauuagaguuggccaaa

SEQ ID NO: 3946816 - RNA, 23 nt, Human coronavirus OC43 (HCoV-OC43)
aauucuugguguuuguguuaauu

SEQ ID NO: 3946817 - RNA, 23 nt, Human coronavirus OC43 (HCoV-OC43)
acaacaagaugguaugaugaaua

SEQ ID NO: 3946818 - RNA, 14 nt, Human coronavirus OC43 (HCoV-OC43)
acagaaguaaauga

SEQ ID NO: 3946819 - RNA, 16 nt, Human coronavirus OC43 (HCoV-OC43)
acauaugaugugaaug

SEQ ID NO: 3946820 - RNA, 21 nt, Human coronavirus OC43 (HCoV-OC43)
agaauuuuggugguggagaaa

SEQ ID NO: 3946821 - RNA, 17 nt, Human coronavirus OC43 (HCoV-OC43)
agaugauuauuuugugg

SEQ ID NO: 3946822 - RNA, 14 nt, Human coronavirus OC43 (HCoV-OC43)
agcaccaguuuaua

SEQ ID NO: 3946823 - RNA, 14 nt, Human coronavirus OC43 (HCoV-OC43)
agcauacugccaaa

SEQ ID NO: 3946824 - RNA, 18 nt, Human coronavirus OC43 (HCoV-OC43)
agcuaauaguuuaaugaa

SEQ ID NO: 3946825 - RNA, 17 nt, Human coronavirus OC43 (HCoV-OC43)
agcuccuaagagugguu

SEQ ID NO: 3946826 - RNA, 17 nt, Human coronavirus OC43 (HCoV-OC43)
aggagauuuaaagugua

SEQ ID NO: 3946827 - RNA, 18 nt, Human coronavirus OC43 (HCoV-OC43)
aguuuagaaauguucaaa

SEQ ID NO: 3946828 - RNA, 19 nt, Human coronavirus OC43 (HCoV-OC43)
aguuuuacaaugauguaaa

SEQ ID NO: 3946829 - RNA, 14 nt, Human coronavirus OC43 (HCoV-OC43)
augcuugguuuaag

SEQ ID NO: 3946830 - RNA, 22 nt, Human coronavirus OC43 (HCoV-OC43)
augguauuuuuacuaucuggga

SEQ ID NO: 3946831 - RNA, 17 nt, Human coronavirus OC43 (HCoV-OC43)
auguucaaaccaggggu

SEQ ID NO: 3946832 - RNA, 22 nt, Human coronavirus OC43 (HCoV-OC43)
auuguugagaaauaauaucuaa

SEQ ID NO: 3946833 - RNA, 18 nt, Human coronavirus OC43 (HCoV-OC43)
auuuuuaggaguuuucac

SEQ ID NO: 3946834 - RNA, 15 nt, Human coronavirus OC43 (HCoV-OC43)
caacagcuuagugau

SEQ ID NO: 3946835 - RNA, 22 nt, Human coronavirus OC43 (HCoV-OC43)
caaugguuuaaaaaucaaacau

SEQ ID NO: 3946836 - RNA, 21 nt, Human coronavirus OC43 (HCoV-OC43)
cagccuuacuuuuguuaaugu

SEQ ID NO: 3946837 - RNA, 13 nt, Human coronavirus OC43 (HCoV-OC43)
cgcucuuaaugcu

SEQ ID NO: 3946838 - RNA, 15 nt, Human coronavirus OC43 (HCoV-OC43)
cuacaccagcaccag

SEQ ID NO: 3946839 - RNA, 11 nt, Human coronavirus OC43 (HCoV-OC43)
cuaucugggaa

SEQ ID NO: 3946840 - RNA, 14 nt, Human coronavirus OC43 (HCoV-OC43)
cuauuacauuuaaa

SEQ ID NO: 3946841 - RNA, 23 nt, Human coronavirus OC43 (HCoV-OC43)
cucagaaauauaagagaaugaac

SEQ ID NO: 3946842 - RNA, 19 nt, Human coronavirus OC43 (HCoV-OC43)
cucugguguaacaccugac

SEQ ID NO: 3946843 - RNA, 15 nt, Human coronavirus OC43 (HCoV-OC43)
cuuacuaaucaugau

SEQ ID NO: 3946844 - RNA, 14 nt, Human coronavirus OC43 (HCoV-OC43)
cuuguucuggcaaa

SEQ ID NO: 3946845 - RNA, 14 nt, Human coronavirus OC43 (HCoV-OC43)
gaaaaugauaauau

SEQ ID NO: 3946846 - RNA, 15 nt, Human coronavirus OC43 (HCoV-OC43)
gaagagcucaaccca

SEQ ID NO: 3946847 - RNA, 22 nt, Human coronavirus OC43 (HCoV-OC43)
gaauccugacgagccccagaag

SEQ ID NO: 3946848 - RNA, 16 nt, Human coronavirus OC43 (HCoV-OC43)
gacugccaucaaccca

SEQ ID NO: 3946849 - RNA, 14 nt, Human coronavirus OC43 (HCoV-OC43)
gagaccauaaugaa

SEQ ID NO: 3946850 - RNA, 13 nt, Human coronavirus OC43 (HCoV-OC43)
gaguuucaaccca

SEQ ID NO: 3946851 - RNA, 18 nt, Human coronavirus OC43 (HCoV-OC43)
gauacuaguuauauuaau

SEQ ID NO: 3946852 - RNA, 19 nt, Human coronavirus OC43 (HCoV-OC43)
gcagaacucgcacccacag

SEQ ID NO: 3946853 - RNA, 17 nt, Human coronavirus OC43 (HCoV-OC43)
gcaguguuuugguaaga

SEQ ID NO: 3946854 - RNA, 22 nt, Human coronavirus OC43 (HCoV-OC43)
gcguauacgcauugaauaaugu

SEQ ID NO: 3946855 - RNA, 22 nt, Human coronavirus OC43 (HCoV-OC43)
gcuaccucucagcaaccaucag

SEQ ID NO: 3946856 - RNA, 23 nt, Human coronavirus OC43 (HCoV-OC43)
gcuauaacuauagguaguacuuu

SEQ ID NO: 3946857 - RNA, 19 nt, Human coronavirus OC43 (HCoV-OC43)
gcuauuucuguucaaacau

SEQ ID NO: 3946858 - RNA, 13 nt, Human coronavirus OC43 (HCoV-OC43)
gcuuauugcuaau

SEQ ID NO: 3946859 - RNA, 18 nt, Human coronavirus OC43 (HCoV-OC43)
ggaacuagugacccacag

SEQ ID NO: 3946860 - RNA, 20 nt, Human coronavirus OC43 (HCoV-OC43)
guaaauccaaacauuaugau

SEQ ID NO: 3946861 - RNA, 14 nt, Human coronavirus OC43 (HCoV-OC43)
guaaugguaaucau

SEQ ID NO: 3946862 - RNA, 17 nt, Human coronavirus OC43 (HCoV-OC43)
uaaagcuacagguacuu

SEQ ID NO: 3946863 - RNA, 16 nt, Human coronavirus OC43 (HCoV-OC43)
uaaaggaauggaauuu

SEQ ID NO: 3946864 - RNA, 18 nt, Human coronavirus OC43 (HCoV-OC43)
uacaaucauauugcaauu

SEQ ID NO: 3946865 - RNA, 22 nt, Human coronavirus OC43 (HCoV-OC43)
uacacugguagugguuacuacu

SEQ ID NO: 3946866 - RNA, 11 nt, Human coronavirus OC43 (HCoV-OC43)
uacuguuaauu

SEQ ID NO: 3946867 - RNA, 15 nt, Human coronavirus OC43 (HCoV-OC43)
uacuuuuuaugcaua

SEQ ID NO: 3946868 - RNA, 18 nt, Human coronavirus OC43 (HCoV-OC43)
uagauaugaaaggaacaa

SEQ ID NO: 3946869 - RNA, 19 nt, Human coronavirus OC43 (HCoV-OC43)
uauggagaagguuaaugaa

SEQ ID NO: 3946870 - RNA, 21 nt, Human coronavirus OC43 (HCoV-OC43)
uaugucaugccucugacuugu

SEQ ID NO: 3946871 - RNA, 22 nt, Human coronavirus OC43 (HCoV-OC43)
uauguuaggccgauaauugagg

SEQ ID NO: 3946872 - RNA, 19 nt, Human coronavirus OC43 (HCoV-OC43)
ucacuugauuauauaaaug

SEQ ID NO: 3946873 - RNA, 16 nt, Human coronavirus OC43 (HCoV-OC43)
ucucagaauuagaaga

SEQ ID NO: 3946874 - RNA, 15 nt, Human coronavirus OC43 (HCoV-OC43)
ugagauuaaguguaa

SEQ ID NO: 3946875 - RNA, 21 nt, Human coronavirus OC43 (HCoV-OC43)
ugauuuuuauuugucagguug

SEQ ID NO: 3946876 - RNA, 15 nt, Human coronavirus OC43 (HCoV-OC43)
ugcacuguucagcag

SEQ ID NO: 3946877 - RNA, 16 nt, Human coronavirus OC43 (HCoV-OC43)
ugcuaccucucagcaa

SEQ ID NO: 3946878 - RNA, 22 nt, Human coronavirus OC43 (HCoV-OC43)
uggaguuucaacccagaaacaa

SEQ ID NO: 3946879 - RNA, 22 nt, Human coronavirus OC43 (HCoV-OC43)
uguguuaaauuauaaagguuua

SEQ ID NO: 3946880 - RNA, 19 nt, Human coronavirus OC43 (HCoV-OC43)
uguuuuauacucagguuua

SEQ ID NO: 3946881 - RNA, 13 nt, Human coronavirus OC43 (HCoV-OC43)
uuaacuauuuuca

SEQ ID NO: 3946882 - RNA, 16 nt, Human coronavirus OC43 (HCoV-OC43)
uucuggcaaaacuugg

SEQ ID NO: 3946883 - RNA, 21 nt, Human coronavirus OC43 (HCoV-OC43)
agcaaccaggcugaugucaau

SEQ ID NO: 3946884 - RNA, 22 nt, Human coronavirus OC43 (HCoV-OC43)
agcuauggagaagguuaaugaa

SEQ ID NO: 3946885 - RNA, 16 nt, Human coronavirus OC43 (HCoV-OC43)
aguguugcagugccca

SEQ ID NO: 3946886 - RNA, 17 nt, Human coronavirus OC43 (HCoV-OC43)
aguugaaaguuuugugu

SEQ ID NO: 3946887 - RNA, 17 nt, Human coronavirus OC43 (HCoV-OC43)
auaagaauggacaagga

SEQ ID NO: 3946888 - RNA, 22 nt, Human coronavirus OC43 (HCoV-OC43)
auaagaauggacaaggagaaaa

SEQ ID NO: 3946889 - RNA, 14 nt, Human coronavirus OC43 (HCoV-OC43)
auauguuuauaaug

SEQ ID NO: 3946890 - RNA, 19 nt, Human coronavirus OC43 (HCoV-OC43)
auguauaguguuggagaaa

SEQ ID NO: 3946891 - RNA, 22 nt, Human coronavirus OC43 (HCoV-OC43)
auguggauuguguauuuuguga

SEQ ID NO: 3946892 - RNA, 15 nt, Human coronavirus OC43 (HCoV-OC43)
auguuuauaauggcu

SEQ ID NO: 3946893 - RNA, 18 nt, Human coronavirus OC43 (HCoV-OC43)
auuaccacugguuuugau

SEQ ID NO: 3946894 - RNA, 22 nt, Human coronavirus OC43 (HCoV-OC43)
auuaccuggcgcagacaggagu

SEQ ID NO: 3946895 - RNA, 12 nt, Human coronavirus OC43 (HCoV-OC43)
auucguuuugaa

SEQ ID NO: 3946896 - RNA, 23 nt, Human coronavirus OC43 (HCoV-OC43)
auugcuagucuuguucuggcaaa

SEQ ID NO: 3946897 - RNA, 20 nt, Human coronavirus OC43 (HCoV-OC43)
caaugauguaaaaccaccag

SEQ ID NO: 3946898 - RNA, 13 nt, Human coronavirus OC43 (HCoV-OC43)
cagcauugcuauu

SEQ ID NO: 3946899 - RNA, 18 nt, Human coronavirus OC43 (HCoV-OC43)
cagguuuugagaccauaa

SEQ ID NO: 3946900 - RNA, 13 nt, Human coronavirus OC43 (HCoV-OC43)
caugauguuaaua

SEQ ID NO: 3946901 - RNA, 11 nt, Human coronavirus OC43 (HCoV-OC43)
ccgccagaaga

SEQ ID NO: 3946902 - RNA, 19 nt, Human coronavirus OC43 (HCoV-OC43)
ccugacgagccccagaagg

SEQ ID NO: 3946903 - RNA, 23 nt, Human coronavirus OC43 (HCoV-OC43)
cuauacugaagacaccucagaaa

SEQ ID NO: 3946904 - RNA, 13 nt, Human coronavirus OC43 (HCoV-OC43)
cugacgagcccca

SEQ ID NO: 3946905 - RNA, 15 nt, Human coronavirus OC43 (HCoV-OC43)
cugugguaaugguaa

SEQ ID NO: 3946906 - RNA, 16 nt, Human coronavirus OC43 (HCoV-OC43)
cuuacuuuuguuaaug

SEQ ID NO: 3946907 - RNA, 18 nt, Human coronavirus OC43 (HCoV-OC43)
gacauuuucaaauuguaa

SEQ ID NO: 3946908 - RNA, 17 nt, Human coronavirus OC43 (HCoV-OC43)
gacguucuuuuaaaaca

SEQ ID NO: 3946909 - RNA, 20 nt, Human coronavirus OC43 (HCoV-OC43)
gacugccaucaacccaaaag

SEQ ID NO: 3946910 - RNA, 22 nt, Human coronavirus OC43 (HCoV-OC43)
gaugucuugcugcuauaauaga

SEQ ID NO: 3946911 - RNA, 15 nt, Human coronavirus OC43 (HCoV-OC43)
gauuauauaaauguu

SEQ ID NO: 3946912 - RNA, 17 nt, Human coronavirus OC43 (HCoV-OC43)
gauucguaguugcuaua

SEQ ID NO: 3946913 - RNA, 18 nt, Human coronavirus OC43 (HCoV-OC43)
gauuuacuuuuugauaaa

SEQ ID NO: 3946914 - RNA, 13 nt, Human coronavirus OC43 (HCoV-OC43)
gcacucucuauca

SEQ ID NO: 3946915 - RNA, 20 nt, Human coronavirus OC43 (HCoV-OC43)
gcagacaagccuaaucauuu

SEQ ID NO: 3946916 - RNA, 17 nt, Human coronavirus OC43 (HCoV-OC43)
gcagguacuaauuauuu

SEQ ID NO: 3946917 - RNA, 23 nt, Human coronavirus OC43 (HCoV-OC43)
gcgcacauccagcagagccucua

SEQ ID NO: 3946918 - RNA, 13 nt, Human coronavirus OC43 (HCoV-OC43)
gcgcuuucacacu

SEQ ID NO: 3946919 - RNA, 15 nt, Human coronavirus OC43 (HCoV-OC43)
gcugcugauauuaau

SEQ ID NO: 3946920 - RNA, 21 nt, Human coronavirus OC43 (HCoV-OC43)
gcuuuaguuaaaauucaagcu

SEQ ID NO: 3946921 - RNA, 21 nt, Human coronavirus OC43 (HCoV-OC43)
gggauuauuauuauaagguug

SEQ ID NO: 3946922 - RNA, 19 nt, Human coronavirus OC43 (HCoV-OC43)
guaaccccucgcagaaaag

SEQ ID NO: 3946923 - RNA, 23 nt, Human coronavirus OC43 (HCoV-OC43)
guaacuaagcauacugccaaaga

SEQ ID NO: 3946924 - RNA, 13 nt, Human coronavirus OC43 (HCoV-OC43)
guacugauacugu

SEQ ID NO: 3946925 - RNA, 22 nt, Human coronavirus OC43 (HCoV-OC43)
guaggcaguuuuaugaguuuua

SEQ ID NO: 3946926 - RNA, 17 nt, Human coronavirus OC43 (HCoV-OC43)
gucaacugcugccacga

SEQ ID NO: 3946927 - RNA, 15 nt, Human coronavirus OC43 (HCoV-OC43)
guccccuucuauuua

SEQ ID NO: 3946928 - RNA, 22 nt, Human coronavirus OC43 (HCoV-OC43)
guuauuacccuacuucagguuc

SEQ ID NO: 3946929 - RNA, 21 nt, Human coronavirus OC43 (HCoV-OC43)
guugguguuuaugauauuaau

SEQ ID NO: 3946930 - RNA, 15 nt, Human coronavirus OC43 (HCoV-OC43)
guuucaacccagaaa

SEQ ID NO: 3946931 - RNA, 19 nt, Human coronavirus OC43 (HCoV-OC43)
guuuuauagaagauucugu

SEQ ID NO: 3946932 - RNA, 13 nt, Human coronavirus OC43 (HCoV-OC43)
uaaaguuacuauu

SEQ ID NO: 3946933 - RNA, 16 nt, Human coronavirus OC43 (HCoV-OC43)
uaagaagauggaugag

SEQ ID NO: 3946934 - RNA, 13 nt, Human coronavirus OC43 (HCoV-OC43)
uaaguuugcuaua

SEQ ID NO: 3946935 - RNA, 19 nt, Human coronavirus OC43 (HCoV-OC43)
uacuaauuauuuaacuugu

SEQ ID NO: 3946936 - RNA, 19 nt, Human coronavirus OC43 (HCoV-OC43)
uacuaguuauauuaaugau

SEQ ID NO: 3946937 - RNA, 19 nt, Human coronavirus OC43 (HCoV-OC43)
uagcuaauaguuuaaugaa

SEQ ID NO: 3946938 - RNA, 14 nt, Human coronavirus OC43 (HCoV-OC43)
uauaguguuggaga

SEQ ID NO: 3946939 - RNA, 23 nt, Human coronavirus OC43 (HCoV-OC43)
uaucaacaacaagaugguaugau

SEQ ID NO: 3946940 - RNA, 16 nt, Human coronavirus OC43 (HCoV-OC43)
uaugaggguguuaauu

SEQ ID NO: 3946941 - RNA, 19 nt, Human coronavirus OC43 (HCoV-OC43)
uauguugguguuuaugaua

SEQ ID NO: 3946942 - RNA, 13 nt, Human coronavirus OC43 (HCoV-OC43)
uauuuuguuaaug

SEQ ID NO: 3946943 - RNA, 19 nt, Human coronavirus OC43 (HCoV-OC43)
ucaacccccauaauuauuc

SEQ ID NO: 3946944 - RNA, 17 nt, Human coronavirus OC43 (HCoV-OC43)
ucaagguauaaaacuag

SEQ ID NO: 3946945 - RNA, 14 nt, Human coronavirus OC43 (HCoV-OC43)
ucguaguugcuaua

SEQ ID NO: 3946946 - RNA, 19 nt, Human coronavirus OC43 (HCoV-OC43)
ugcagaauuuaucugggaa

SEQ ID NO: 3946947 - RNA, 18 nt, Human coronavirus OC43 (HCoV-OC43)
ugcagguacuaauuauuu

SEQ ID NO: 3946948 - RNA, 22 nt, Human coronavirus OC43 (HCoV-OC43)
uguguugucaaugcuuauaaua

SEQ ID NO: 3946949 - RNA, 22 nt, Human coronavirus OC43 (HCoV-OC43)
uguuaauaguggucuuacuugu

SEQ ID NO: 3946950 - RNA, 20 nt, Human coronavirus OC43 (HCoV-OC43)
uguuucuguuagcagguuua

SEQ ID NO: 3946951 - RNA, 11 nt, Human coronavirus OC43 (HCoV-OC43)
uuaauuucaau

SEQ ID NO: 3946952 - RNA, 17 nt, Human coronavirus OC43 (HCoV-OC43)
uuacagacacugguguu

SEQ ID NO: 3946953 - RNA, 21 nt, Human coronavirus OC43 (HCoV-OC43)
uuauaagaauauggcugugua

SEQ ID NO: 3946954 - RNA, 15 nt, Human coronavirus OC43 (HCoV-OC43)
uuauuauaagguuga

SEQ ID NO: 3946955 - RNA, 15 nt, Human coronavirus OC43 (HCoV-OC43)
uucuauaguuuuuac

SEQ ID NO: 3946956 - RNA, 21 nt, Human coronavirus OC43 (HCoV-OC43)
uuggugguggagaaauguuaa

SEQ ID NO: 3946957 - RNA, 18 nt, Human coronavirus OC43 (HCoV-OC43)
uuguugaggcuuauaaua

SEQ ID NO: 3946958 - RNA, 22 nt, Human coronavirus OC43 (HCoV-OC43)
uuuaccauaguggccauuauua

SEQ ID NO: 3946959 - RNA, 23 nt, Human coronavirus OC43 (HCoV-OC43)
uuucugugguaaugguaaucaua

SEQ ID NO: 3946960 - RNA, 16 nt, Human coronavirus OC43 (HCoV-OC43)
aaaggaacaauguaug

SEQ ID NO: 3946961 - RNA, 19 nt, Human coronavirus OC43 (HCoV-OC43)
aacaagaugguaugaugaa

SEQ ID NO: 3946962 - RNA, 21 nt, Human coronavirus OC43 (HCoV-OC43)
aacaaugcacuguucagcagu

SEQ ID NO: 3946963 - RNA, 20 nt, Human coronavirus OC43 (HCoV-OC43)
aagauucuguuuuuaagccu

SEQ ID NO: 3946964 - RNA, 19 nt, Human coronavirus OC43 (HCoV-OC43)
aagccccgccagaagagga

SEQ ID NO: 3946965 - RNA, 20 nt, Human coronavirus OC43 (HCoV-OC43)
aaucaagguagauuuugugc

SEQ ID NO: 3946966 - RNA, 17 nt, Human coronavirus OC43 (HCoV-OC43)
acaaggagaaaaugaua

SEQ ID NO: 3946967 - RNA, 15 nt, Human coronavirus OC43 (HCoV-OC43)
acaggaguuaaaugu

SEQ ID NO: 3946968 - RNA, 19 nt, Human coronavirus OC43 (HCoV-OC43)
acauugguacauaugaaua

SEQ ID NO: 3946969 - RNA, 13 nt, Human coronavirus OC43 (HCoV-OC43)
accaucaggaggg

SEQ ID NO: 3946970 - RNA, 23 nt, Human coronavirus OC43 (HCoV-OC43)
acccaguaauuaguaaaugaaug

SEQ ID NO: 3946971 - RNA, 16 nt, Human coronavirus OC43 (HCoV-OC43)
acuacaccagcaccag

SEQ ID NO: 3946972 - RNA, 17 nt, Human coronavirus OC43 (HCoV-OC43)
acuacuacccugaaccu

SEQ ID NO: 3946973 - RNA, 13 nt, Human coronavirus OC43 (HCoV-OC43)
acuaugguuuaaa

SEQ ID NO: 3946974 - RNA, 14 nt, Human coronavirus OC43 (HCoV-OC43)
acuguuucaaagcu

SEQ ID NO: 3946975 - RNA, 18 nt, Human coronavirus OC43 (HCoV-OC43)
agcacuaagcuuaaagau

SEQ ID NO: 3946976 - RNA, 14 nt, Human coronavirus OC43 (HCoV-OC43)
aggagaaaaugaua

SEQ ID NO: 3946977 - RNA, 14 nt, Human coronavirus OC43 (HCoV-OC43)
aguaugucacagcg

SEQ ID NO: 3946978 - RNA, 17 nt, Human coronavirus OC43 (HCoV-OC43)
agucuuaaaucagagcu

SEQ ID NO: 3946979 - RNA, 17 nt, Human coronavirus OC43 (HCoV-OC43)
auaagcgugguuuucuu

SEQ ID NO: 3946980 - RNA, 16 nt, Human coronavirus OC43 (HCoV-OC43)
auaguguuggagaaag

SEQ ID NO: 3946981 - RNA, 13 nt, Human coronavirus OC43 (HCoV-OC43)
auauuuuugcuaa

SEQ ID NO: 3946982 - RNA, 16 nt, Human coronavirus OC43 (HCoV-OC43)
augaaguuaauuaugg

SEQ ID NO: 3946983 - RNA, 16 nt, Human coronavirus OC43 (HCoV-OC43)
auggacauuuggagac

SEQ ID NO: 3946984 - RNA, 15 nt, Human coronavirus OC43 (HCoV-OC43)
auuauuuuuaaugcu

SEQ ID NO: 3946985 - RNA, 14 nt, Human coronavirus OC43 (HCoV-OC43)
auugcaccaggagu

SEQ ID NO: 3946986 - RNA, 18 nt, Human coronavirus OC43 (HCoV-OC43)
auuuuacgccuuaucaug

SEQ ID NO: 3946987 - RNA, 23 nt, Human coronavirus OC43 (HCoV-OC43)
auuuuuauuugucagguugugac

SEQ ID NO: 3946988 - RNA, 16 nt, Human coronavirus OC43 (HCoV-OC43)
caagcuguuguuaaug

SEQ ID NO: 3946989 - RNA, 18 nt, Human coronavirus OC43 (HCoV-OC43)
cagaaccuuuuauaugau

SEQ ID NO: 3946990 - RNA, 23 nt, Human coronavirus OC43 (HCoV-OC43)
cagaauuuuggugguggagaaau

SEQ ID NO: 3946991 - RNA, 23 nt, Human coronavirus OC43 (HCoV-OC43)
cagauacuaguuauauuaaugau

SEQ ID NO: 3946992 - RNA, 14 nt, Human coronavirus OC43 (HCoV-OC43)
ccgacaagugccca

SEQ ID NO: 3946993 - RNA, 16 nt, Human coronavirus OC43 (HCoV-OC43)
cuaucagaauggaugu

SEQ ID NO: 3946994 - RNA, 23 nt, Human coronavirus OC43 (HCoV-OC43)
cucgaugaaggaguggauuguaa

SEQ ID NO: 3946995 - RNA, 17 nt, Human coronavirus OC43 (HCoV-OC43)
cugacuuguaauaguaa

SEQ ID NO: 3946996 - RNA, 14 nt, Human coronavirus OC43 (HCoV-OC43)
cugcgcuguuaauu

SEQ ID NO: 3946997 - RNA, 22 nt, Human coronavirus OC43 (HCoV-OC43)
cugguuuugaucuuaauuguua

SEQ ID NO: 3946998 - RNA, 20 nt, Human coronavirus OC43 (HCoV-OC43)
cuuaaucuucccaauugcaa

SEQ ID NO: 3946999 - RNA, 13 nt, Human coronavirus OC43 (HCoV-OC43)
gaaauauaagaga

SEQ ID NO: 3947000 - RNA, 15 nt, Human coronavirus OC43 (HCoV-OC43)
gaagagccagcaugu

SEQ ID NO: 3947001 - RNA, 19 nt, Human coronavirus OC43 (HCoV-OC43)
gaaguuaauuauggccaau

SEQ ID NO: 3947002 - RNA, 20 nt, Human coronavirus OC43 (HCoV-OC43)
gacaucagccuucuuaagaa

SEQ ID NO: 3947003 - RNA, 18 nt, Human coronavirus OC43 (HCoV-OC43)
gacugcagaggacaucag

SEQ ID NO: 3947004 - RNA, 22 nt, Human coronavirus OC43 (HCoV-OC43)
gaguccaaaaccacagcgucag

SEQ ID NO: 3947005 - RNA, 15 nt, Human coronavirus OC43 (HCoV-OC43)
gauaaguuugcuaua

SEQ ID NO: 3947006 - RNA, 21 nt, Human coronavirus OC43 (HCoV-OC43)
gaucaguccgaccaguuuaga

SEQ ID NO: 3947007 - RNA, 23 nt, Human coronavirus OC43 (HCoV-OC43)
gaugccacuaaaccucagcaagu

SEQ ID NO: 3947008 - RNA, 15 nt, Human coronavirus OC43 (HCoV-OC43)
gauggaugagcccua

SEQ ID NO: 3947009 - RNA, 23 nt, Human coronavirus OC43 (HCoV-OC43)
gcaacuuuuaaauuguguauuca

SEQ ID NO: 3947010 - RNA, 21 nt, Human coronavirus OC43 (HCoV-OC43)
gcagguguucuuacuaaucau

SEQ ID NO: 3947011 - RNA, 12 nt, Human coronavirus OC43 (HCoV-OC43)
gccuuucacgcu

SEQ ID NO: 3947012 - RNA, 13 nt, Human coronavirus OC43 (HCoV-OC43)
guauuuuugcuaa

SEQ ID NO: 3947013 - RNA, 19 nt, Human coronavirus OC43 (HCoV-OC43)
gugacagucguucagauug

SEQ ID NO: 3947014 - RNA, 23 nt, Human coronavirus OC43 (HCoV-OC43)
guguaccauuuuauuuaaauguu

SEQ ID NO: 3947015 - RNA, 19 nt, Human coronavirus OC43 (HCoV-OC43)
guguugcagugcccaaaag

SEQ ID NO: 3947016 - RNA, 12 nt, Human coronavirus OC43 (HCoV-OC43)
uaauaauuguac

SEQ ID NO: 3947017 - RNA, 23 nt, Human coronavirus OC43 (HCoV-OC43)
uaauauggaggaguuuauucaaa

SEQ ID NO: 3947018 - RNA, 17 nt, Human coronavirus OC43 (HCoV-OC43)
uaaucauauuguuaaua

SEQ ID NO: 3947019 - RNA, 16 nt, Human coronavirus OC43 (HCoV-OC43)
uagaauugauacuacu

SEQ ID NO: 3947020 - RNA, 16 nt, Human coronavirus OC43 (HCoV-OC43)
uaguaaaugaaugaag

SEQ ID NO: 3947021 - RNA, 18 nt, Human coronavirus OC43 (HCoV-OC43)
uaguagagccaauucugg

SEQ ID NO: 3947022 - RNA, 23 nt, Human coronavirus OC43 (HCoV-OC43)
uaguuuuagauguuaaaggugua

SEQ ID NO: 3947023 - RNA, 16 nt, Human coronavirus OC43 (HCoV-OC43)
uauaaucuuaacuauu

SEQ ID NO: 3947024 - RNA, 22 nt, Human coronavirus OC43 (HCoV-OC43)
uauagcaccaccuacugguguu

SEQ ID NO: 3947025 - RNA, 14 nt, Human coronavirus OC43 (HCoV-OC43)
uauaguugccauuu

SEQ ID NO: 3947026 - RNA, 20 nt, Human coronavirus OC43 (HCoV-OC43)
uauauaagcguaauuucaca

SEQ ID NO: 3947027 - RNA, 19 nt, Human coronavirus OC43 (HCoV-OC43)
uaucuagacuugaugcucu

SEQ ID NO: 3947028 - RNA, 16 nt, Human coronavirus OC43 (HCoV-OC43)
uauuuaaauacuacgu

SEQ ID NO: 3947029 - RNA, 17 nt, Human coronavirus OC43 (HCoV-OC43)
uauuuagccauuucaaa

SEQ ID NO: 3947030 - RNA, 18 nt, Human coronavirus OC43 (HCoV-OC43)
uauuuucauuuuuaucaa

SEQ ID NO: 3947031 - RNA, 19 nt, Human coronavirus OC43 (HCoV-OC43)
ucaaaagcuuauugcuaau

SEQ ID NO: 3947032 - RNA, 18 nt, Human coronavirus OC43 (HCoV-OC43)
uacugguguuuaugaauu

SEQ ID NO: 3947033 - RNA, 19 nt, Human coronavirus OC43 (HCoV-OC43)
uacuguugauguuacuaau

SEQ ID NO: 3947034 - RNA, 12 nt, Human coronavirus OC43 (HCoV-OC43)
uauugaugcugc

SEQ ID NO: 3947035 - RNA, 14 nt, Human coronavirus OC43 (HCoV-OC43)
ucaacaaauuauuu

SEQ ID NO: 3947036 - RNA, 15 nt, Human coronavirus OC43 (HCoV-OC43)
uccagcagagccucu

SEQ ID NO: 3947037 - RNA, 17 nt, Human coronavirus OC43 (HCoV-OC43)
uccugacgagccccaga

SEQ ID NO: 3947038 - RNA, 21 nt, Human coronavirus OC43 (HCoV-OC43)
ugaaugcugauuauuuguauu

SEQ ID NO: 3947039 - RNA, 19 nt, Human coronavirus OC43 (HCoV-OC43)
ugauguaaaaccaccaguc

SEQ ID NO: 3947040 - RNA, 19 nt, Human coronavirus OC43 (HCoV-OC43)
ugccacuaaaccucagcaa

SEQ ID NO: 3947041 - RNA, 14 nt, Human coronavirus OC43 (HCoV-OC43)
ugguuuguuauaua

SEQ ID NO: 3947042 - RNA, 16 nt, Human coronavirus OC43 (HCoV-OC43)
uguaauaguaagguua

SEQ ID NO: 3947043 - RNA, 13 nt, Human coronavirus OC43 (HCoV-OC43)
uguuuaauguuua

SEQ ID NO: 3947044 - RNA, 11 nt, Human coronavirus OC43 (HCoV-OC43)
uuaaaacuugg

SEQ ID NO: 3947045 - RNA, 18 nt, Human coronavirus OC43 (HCoV-OC43)
uuauggccaauuggaaga

SEQ ID NO: 3947046 - RNA, 14 nt, Human coronavirus OC43 (HCoV-OC43)
uugauguggaugac

SEQ ID NO: 3947047 - RNA, 16 nt, Human coronavirus OC43 (HCoV-OC43)
uugcuguuuauguuaa

SEQ ID NO: 3947048 - RNA, 18 nt, Human coronavirus OC43 (HCoV-OC43)
uuuaaugcuguugauugu

SEQ ID NO: 3947049 - RNA, 23 nt, Human coronavirus OC43 (HCoV-OC43)
uuuaguuggcauaggugagcacu

SEQ ID NO: 3947050 - RNA, 15 nt, Human coronavirus OC43 (HCoV-OC43)
uuuuaugaguuuuac

SEQ ID NO: 3947051 - RNA, 13 nt, Human coronavirus OC43 (HCoV-OC43)
aacauuaaugcca

SEQ ID NO: 3947052 - RNA, 23 nt, Human coronavirus OC43 (HCoV-OC43)
aagauggcguuaauuucaaugua

SEQ ID NO: 3947053 - RNA, 21 nt, Human coronavirus OC43 (HCoV-OC43)
aagcucagauagauagacuua

SEQ ID NO: 3947054 - RNA, 23 nt, Human coronavirus OC43 (HCoV-OC43)
aauaugaguccaaaaccacagcg

SEQ ID NO: 3947055 - RNA, 14 nt, Human coronavirus OC43 (HCoV-OC43)
aaugaaugaaguua

SEQ ID NO: 3947056 - RNA, 22 nt, Human coronavirus OC43 (HCoV-OC43)
aauggacaaggagaaaaugaua

SEQ ID NO: 3947057 - RNA, 14 nt, Human coronavirus OC43 (HCoV-OC43)
aauuaguaaaugaa

SEQ ID NO: 3947058 - RNA, 19 nt, Human coronavirus OC43 (HCoV-OC43)
aauugccgacaagugccca

SEQ ID NO: 3947059 - RNA, 16 nt, Human coronavirus OC43 (HCoV-OC43)
acucucuaucagaaug

SEQ ID NO: 3947060 - RNA, 23 nt, Human coronavirus OC43 (HCoV-OC43)
agagugguuauuuuguuaaugua

SEQ ID NO: 3947061 - RNA, 16 nt, Human coronavirus OC43 (HCoV-OC43)
agcauacugccaaaga

SEQ ID NO: 3947062 - RNA, 16 nt, Human coronavirus OC43 (HCoV-OC43)
agcuuggcuuaaugau

SEQ ID NO: 3947063 - RNA, 20 nt, Human coronavirus OC43 (HCoV-OC43)
aggaugguuauaauaaauua

SEQ ID NO: 3947064 - RNA, 17 nt, Human coronavirus OC43 (HCoV-OC43)
aggcccuaaucagaauu

SEQ ID NO: 3947065 - RNA, 13 nt, Human coronavirus OC43 (HCoV-OC43)
aggcugaugucaa

SEQ ID NO: 3947066 - RNA, 16 nt, Human coronavirus OC43 (HCoV-OC43)
agugagauuaagugua

SEQ ID NO: 3947067 - RNA, 23 nt, Human coronavirus OC43 (HCoV-OC43)
auacuaaagcgccguauguaaug

SEQ ID NO: 3947068 - RNA, 16 nt, Human coronavirus OC43 (HCoV-OC43)
auacuagugguuuugc

SEQ ID NO: 3947069 - RNA, 18 nt, Human coronavirus OC43 (HCoV-OC43)
auacuaguuauauuaaug

SEQ ID NO: 3947070 - RNA, 17 nt, Human coronavirus OC43 (HCoV-OC43)
auacuuggauguacacu

SEQ ID NO: 3947071 - RNA, 14 nt, Human coronavirus OC43 (HCoV-OC43)
aucaaugguuuaaa

SEQ ID NO: 3947072 - RNA, 17 nt, Human coronavirus OC43 (HCoV-OC43)
auguaaugcugaacacu

SEQ ID NO: 3947073 - RNA, 21 nt, Human coronavirus OC43 (HCoV-OC43)
auuguuauuauuuaguuuuac

SEQ ID NO: 3947074 - RNA, 22 nt, Human coronavirus OC43 (HCoV-OC43)
auuguuugggguuuuaugaauc

SEQ ID NO: 3947075 - RNA, 23 nt, Human coronavirus OC43 (HCoV-OC43)
auuucuuucugauuuuauuaaug

SEQ ID NO: 3947076 - RNA, 20 nt, Human coronavirus OC43 (HCoV-OC43)
auuugucacuugauuauaua

SEQ ID NO: 3947077 - RNA, 20 nt, Human coronavirus OC43 (HCoV-OC43)
caaaccagggguagaagagc

SEQ ID NO: 3947078 - RNA, 13 nt, Human coronavirus OC43 (HCoV-OC43)
caacaaauuauuu

SEQ ID NO: 3947079 - RNA, 15 nt, Human coronavirus OC43 (HCoV-OC43)
caacacuguuucaaa

SEQ ID NO: 3947080 - RNA, 16 nt, Human coronavirus OC43 (HCoV-OC43)
caagaugguauuauuu

SEQ ID NO: 3947081 - RNA, 22 nt, Human coronavirus OC43 (HCoV-OC43)
caaguguaauauuuuugcuaau

SEQ ID NO: 3947082 - RNA, 13 nt, Human coronavirus OC43 (HCoV-OC43)
caauucuggcaau

SEQ ID NO: 3947083 - RNA, 15 nt, Human coronavirus OC43 (HCoV-OC43)
cagaacuuuuaugau

SEQ ID NO: 3947084 - RNA, 21 nt, Human coronavirus OC43 (HCoV-OC43)
cagccuucuuaagaagaugga

SEQ ID NO: 3947085 - RNA, 20 nt, Human coronavirus OC43 (HCoV-OC43)
cgguuuuaaugucucagaau

SEQ ID NO: 3947086 - RNA, 15 nt, Human coronavirus OC43 (HCoV-OC43)
cuacugauuuacaaa

SEQ ID NO: 3947087 - RNA, 20 nt, Human coronavirus OC43 (HCoV-OC43)
cuauauugaaggcucaggaa

SEQ ID NO: 3947088 - RNA, 16 nt, Human coronavirus OC43 (HCoV-OC43)
cucuaucagaauggau

SEQ ID NO: 3947089 - RNA, 16 nt, Human coronavirus OC43 (HCoV-OC43)
cucuuccgaaccagca

SEQ ID NO: 3947090 - RNA, 23 nt, Human coronavirus OC43 (HCoV-OC43)
cuuauauggaccuuaauccuguu

SEQ ID NO: 3947091 - RNA, 20 nt, Human coronavirus OC43 (HCoV-OC43)
gaaaggaguuugaguuugua

SEQ ID NO: 3947092 - RNA, 15 nt, Human coronavirus OC43 (HCoV-OC43)
gaagguuauagcaga

SEQ ID NO: 3947093 - RNA, 22 nt, Human coronavirus OC43 (HCoV-OC43)
gaaugugucaaaagccaaucau

SEQ ID NO: 3947094 - RNA, 22 nt, Human coronavirus OC43 (HCoV-OC43)
gaccacaagcauuuuuggguug

SEQ ID NO: 3947095 - RNA, 14 nt, Human coronavirus OC43 (HCoV-OC43)
gagaaaaugauaau

SEQ ID NO: 3947096 - RNA, 12 nt, Human coronavirus OC43 (HCoV-OC43)
gcuuucaaucaa

SEQ ID NO: 3947097 - RNA, 18 nt, Human coronavirus OC43 (HCoV-OC43)
guuaauguaccauauguu

SEQ ID NO: 3947098 - RNA, 20 nt, Human coronavirus OC43 (HCoV-OC43)
guucagauuguaaucauauu

SEQ ID NO: 3947099 - RNA, 12 nt, Human coronavirus OC43 (HCoV-OC43)
guuuauucaaac

SEQ ID NO: 3947100 - RNA, 19 nt, Human coronavirus OC43 (HCoV-OC43)
guuuguaugaaauucaaau

SEQ ID NO: 3947101 - RNA, 17 nt, Human coronavirus OC43 (HCoV-OC43)
guuuuauacucagguuu

SEQ ID NO: 3947102 - RNA, 19 nt, Human coronavirus OC43 (HCoV-OC43)
uaaauuuaacuaucaauuu

SEQ ID NO: 3947103 - RNA, 19 nt, Human coronavirus OC43 (HCoV-OC43)
uaauaaagacacugguguu

SEQ ID NO: 3947104 - RNA, 16 nt, Human coronavirus OC43 (HCoV-OC43)
uacaccagcaccaguu

SEQ ID NO: 3947105 - RNA, 16 nt, Human coronavirus OC43 (HCoV-OC43)
uaccgcucuuaaugcu

SEQ ID NO: 3947106 - RNA, 20 nt, Human coronavirus OC43 (HCoV-OC43)
uacgguuuuagagacuacau

SEQ ID NO: 3947107 - RNA, 17 nt, Human coronavirus OC43 (HCoV-OC43)
ucuaucagaauggaugu

SEQ ID NO: 3947108 - RNA, 17 nt, Human coronavirus OC43 (HCoV-OC43)
ugggucgcuagcaacca

SEQ ID NO: 3947109 - RNA, 16 nt, Human coronavirus OC43 (HCoV-OC43)
uguccugcagguacua

SEQ ID NO: 3947110 - RNA, 24 nt, Human coronavirus OC43 (HCoV-OC43)
uuaaaugcaaccguucugguagua

SEQ ID NO: 3947111 - RNA, 20 nt, Human coronavirus OC43 (HCoV-OC43)
uuacccucugguaauuauuu

SEQ ID NO: 3947112 - RNA, 21 nt, Human coronavirus OC43 (HCoV-OC43)
uuacuauucuucauaugcugu

SEQ ID NO: 3947113 - RNA, 16 nt, Human coronavirus OC43 (HCoV-OC43)
uuauuuuuaaugcugu

SEQ ID NO: 3947114 - RNA, 13 nt, Human coronavirus OC43 (HCoV-OC43)
uucagguuuugag

SEQ ID NO: 3947115 - RNA, 12 nt, Human coronavirus OC43 (HCoV-OC43)
uugcagugccca

SEQ ID NO: 3947116 - RNA, 18 nt, Human coronavirus OC43 (HCoV-OC43)
uugcgauuguaauuauug

SEQ ID NO: 3947117 - RNA, 16 nt, Human coronavirus OC43 (HCoV-OC43)
uuguaugaaauucaaa

SEQ ID NO: 3947118 - RNA, 12 nt, Human coronavirus OC43 (HCoV-OC43)
uuuaaauugugu

SEQ ID NO: 3947119 - RNA, 20 nt, Human coronavirus OC43 (HCoV-OC43)
uuucuguuagcagguuuaau

SEQ ID NO: 3947120 - RNA, 14 nt, Human coronavirus OC43 [HCoV-OC43]
aaaucguucuggua

SEQ ID NO: 3947121 - RNA, 22 nt, Human coronavirus OC43 [HCoV-OC43]
aacaaguugucaguuguauuau

SEQ ID NO: 3947122 - RNA, 16 nt, Human coronavirus OC43 [HCoV-OC43]
aaccagcgucaacugc

SEQ ID NO: 3947123 - RNA, 16 nt, Human coronavirus OC43 [HCoV-OC43]
aacccaagcaaacugc

SEQ ID NO: 3947124 - RNA, 15 nt, Human coronavirus OC43 [HCoV-OC43]
aagauggaugagccc

SEQ ID NO: 3947125 - RNA, 16 nt, Human coronavirus OC43 [HCoV-OC43]
aaggaacaauguaugu

SEQ ID NO: 3947126 - RNA, 17 nt, Human coronavirus OC43 [HCoV-OC43]
aaggauguuuaugaauu

SEQ ID NO: 3947127 - RNA, 12 nt, Human coronavirus OC43 [HCoV-OC43]
aaggauuuuacg

SEQ ID NO: 3947128 - RNA, 20 nt, Human coronavirus OC43 [HCoV-OC43]
aagugaaagacuugcggaag

SEQ ID NO: 3947129 - RNA, 14 nt, Human coronavirus OC43 [HCoV-OC43]
aauggcauccucaa

SEQ ID NO: 3947130 - RNA, 22 nt, Human coronavirus OC43 [HCoV-OC43]
aaugguguuacucuuagcacua

SEQ ID NO: 3947131 - RNA, 20 nt, Human coronavirus OC43 [HCoV-OC43]
aauuguuugggguuuuauga

SEQ ID NO: 3947132 - RNA, 20 nt, Human coronavirus OC43 [HCoV-OC43]
aauuuugagccauuuacugu

SEQ ID NO: 3947133 - RNA, 17 nt, Human coronavirus OC43 [HCoV-OC43]
acaaugcccuuuaugcu

SEQ ID NO: 3947134 - RNA, 15 nt, Human coronavirus OC43 [HCoV-OC43]
acaauuggguaauuu

SEQ ID NO: 3947135 - RNA, 17 nt, Human coronavirus OC43 [HCoV-OC43]
acagcucuuuguaaauc

SEQ ID NO: 3947136 - RNA, 21 nt, Human coronavirus OC43 [HCoV-OC43]
acaguagguagugguuacugu

SEQ ID NO: 3947137 - RNA, 17 nt, Human coronavirus OC43 [HCoV-OC43]
acuaguuauauuaauga

SEQ ID NO: 3947138 - RNA, 11 nt, Human coronavirus OC43 [HCoV-OC43]
acuauaaucuu

SEQ ID NO: 3947139 - RNA, 22 nt, Human coronavirus OC43 [HCoV-OC43]
acuauagauaaguuugcuauac

SEQ ID NO: 3947140 - RNA, 22 nt, Human coronavirus OC43 [HCoV-OC43]
acuauugauugugcugcauuug

SEQ ID NO: 3947141 - RNA, 12 nt, Human coronavirus OC43 [HCoV-OC43]
acucuuguuuac

SEQ ID NO: 3947142 - RNA, 22 nt, Human coronavirus OC43 [HCoV-OC43]
acugcugaugaagcuauuaaau

SEQ ID NO: 3947143 - RNA, 16 nt, Human coronavirus OC43 [HCoV-OC43]
acuuguaauaauauug

SEQ ID NO: 3947144 - RNA, 19 nt, Human coronavirus OC43 [HCoV-OC43]
agaacucgcacccacagcu

SEQ ID NO: 3947145 - RNA, 19 nt, Human coronavirus OC43 [HCoV-OC43]
agacaggaguuaaauguuu

SEQ ID NO: 3947146 - RNA, 17 nt, Human coronavirus OC43 [HCoV-OC43]
agagcguccucuggaaa

SEQ ID NO: 3947147 - RNA, 22 nt, Human coronavirus OC43 [HCoV-OC43]
agaugguauuauuuuuaaugcu

SEQ ID NO: 3947148 - RNA, 19 nt, Human coronavirus OC43 [HCoV-OC43]
agcuccuaaaaauuucugu

SEQ ID NO: 3947149 - RNA, 21 nt, Human coronavirus OC43 [HCoV-OC43]
agcuuauugcuaaugcauuua

SEQ ID NO: 3947150 - RNA, 11 nt, Human coronavirus OC43 [HCoV-OC43]
aggguucuggc

SEQ ID NO: 3947151 - RNA, 18 nt, Human coronavirus OC43 [HCoV-OC43]
aggugguuuguaugaaau

SEQ ID NO: 3947152 - RNA, 16 nt, Human coronavirus OC43 [HCoV-OC43]
agucaauauuauuuua

SEQ ID NO: 3947153 - RNA, 18 nt, Human coronavirus OC43 [HCoV-OC43]
aguguugcagugcccaaa

SEQ ID NO: 3947154 - RNA, 12 nt, Human coronavirus OC43 [HCoV-OC43]
aguguuuuggua

SEQ ID NO: 3947155 - RNA, 16 nt, Human coronavirus OC43 [HCoV-OC43]
auaaacaaugcacugu

SEQ ID NO: 3947156 - RNA, 17 nt, Human coronavirus OC43 [HCoV-OC43]
auaaaggcuuguuuuau

SEQ ID NO: 3947157 - RNA, 18 nt, Human coronavirus OC43 [HCoV-OC43]
auaagccccgccagaaga

SEQ ID NO: 3947158 - RNA, 23 nt, Human coronavirus OC43 [HCoV-OC43]
auaaucuaaacauguuuuugaua

SEQ ID NO: 3947159 - RNA, 14 nt, Human coronavirus OC43 [HCoV-OC43]
auacaaaguauuau

SEQ ID NO: 3947160 - RNA, 18 nt, Human coronavirus OC43 [HCoV-OC43]
auacgcauugaauaaugu

SEQ ID NO: 3947161 - RNA, 16 nt, Human coronavirus OC43 [HCoV-OC43]
auagauuuggugcuau

SEQ ID NO: 3947162 - RNA, 21 nt, Human coronavirus OC43 [HCoV-OC43]
auagcuccuaagagugguuau

SEQ ID NO: 3947163 - RNA, 14 nt, Human coronavirus OC43 [HCoV-OC43]
auaguaagguuaag

SEQ ID NO: 3947164 - RNA, 15 nt, Human coronavirus OC43 [HCoV-OC43]
auauaagcguaauuu

SEQ ID NO: 3947165 - RNA, 20 nt, Human coronavirus OC43 [HCoV-OC43]
auaucuaaauuuuaaggaug

SEQ ID NO: 3947166 - RNA, 16 nt, Human coronavirus OC43 [HCoV-OC43]
aucaagaugguauuau

SEQ ID NO: 3947167 - RNA, 14 nt, Human coronavirus OC43 [HCoV-OC43]
aucauauugcaauu

SEQ ID NO: 3947168 - RNA, 14 nt, Human coronavirus OC43 [HCoV-OC43]
aucauuagugcaga

SEQ ID NO: 3947169 - RNA, 17 nt, Human coronavirus OC43 [HCoV-OC43]
auccuauuacauuuaaa

SEQ ID NO: 3947170 - RNA, 17 nt, Human coronavirus OC43 [HCoV-OC43]
augcaaaugcugaagcu

SEQ ID NO: 3947171 - RNA, 14 nt, Human coronavirus OC43 [HCoV-OC43]
augcaauucaauua

SEQ ID NO: 3947172 - RNA, 15 nt, Human coronavirus OC43 [HCoV-OC43]
augcagcauguaaau

SEQ ID NO: 3947173 - RNA, 13 nt, Human coronavirus OC43 [HCoV-OC43]
augcauaguuuua

SEQ ID NO: 3947174 - RNA, 20 nt, Human coronavirus OC43 [HCoV-OC43]
auggagaugcugguuuuacu

SEQ ID NO: 3947175 - RNA, 22 nt, Human coronavirus OC43 [HCoV-OC43]
auguaaaucacaguugguugaa

SEQ ID NO: 3947176 - RNA, 21 nt, Human coronavirus OC43 [HCoV-OC43]
auguauagugaguucccugcu

SEQ ID NO: 3947177 - RNA, 15 nt, Human coronavirus OC43 [HCoV-OC43]
augucccacugcugc

SEQ ID NO: 3947178 - RNA, 23 nt, Human coronavirus OC43 [HCoV-OC43]
auguuaaaacuuggaacuaguga

SEQ ID NO: 3947179 - RNA, 14 nt, Human coronavirus OC43 [HCoV-OC43]
auuauuuaguuuua

SEQ ID NO: 3947180 - RNA, 12 nt, Human coronavirus OC43 [HCoV-OC43]
auucugcuuuag

SEQ ID NO: 3947181 - RNA, 22 nt, Human coronavirus OC43 [HCoV-OC43]
auugggaacguaagacauuuuc

SEQ ID NO: 3947182 - RNA, 17 nt, Human coronavirus OC43 [HCoV-OC43]
auugguuuuuauuuggu

SEQ ID NO: 3947183 - RNA, 19 nt, Human coronavirus OC43 [HCoV-OC43]
auuguaaucauauuguuaa

SEQ ID NO: 3947184 - RNA, 19 nt, Human coronavirus OC43 [HCoV-OC43]
auuguggaggcaauucuug

SEQ ID NO: 3947185 - RNA, 21 nt, Human coronavirus OC43 [HCoV-OC43]
auuuugcaugauguuaauagu

SEQ ID NO: 3947186 - RNA, 23 nt, Human coronavirus OC43 [HCoV-OC43]
auuuuggugguggagaaauguua

SEQ ID NO: 3947187 - RNA, 17 nt, Human coronavirus OC43 [HCoV-OC43]
auuuuguuaauguaaau

SEQ ID NO: 3947188 - RNA, 22 nt, Human coronavirus OC43 [HCoV-OC43]
caaacugguuuucuuagcuguu

SEQ ID NO: 3947189 - RNA, 21 nt, Human coronavirus OC43 [HCoV-OC43]
caaccagcgucaacugcugcc

SEQ ID NO: 3947190 - RNA, 16 nt, Human coronavirus OC43 [HCoV-OC43]
caacuauguugguguu

SEQ ID NO: 3947191 - RNA, 19 nt, Human coronavirus OC43 [HCoV-OC43]
caaguaacuaagcauacug

SEQ ID NO: 3947192 - RNA, 22 nt, Human coronavirus OC43 [HCoV-OC43]
cacuucuagacaauauuuacuc

SEQ ID NO: 3947193 - RNA, 18 nt, Human coronavirus OC43 [HCoV-OC43]
cagaaaauuuugaauaag

SEQ ID NO: 3947194 - RNA, 17 nt, Human coronavirus OC43 [HCoV-OC43]
cagaaauauaagagaau

SEQ ID NO: 3947195 - RNA, 15 nt, Human coronavirus OC43 [HCoV-OC43]
cagauagauagacuu

SEQ ID NO: 3947196 - RNA, 16 nt, Human coronavirus OC43 [HCoV-OC43]
cagcuuauaugacugu

SEQ ID NO: 3947197 - RNA, 19 nt, Human coronavirus OC43 [HCoV-OC43]
caggaguuaaauguuuaug

SEQ ID NO: 3947198 - RNA, 13 nt, Human coronavirus OC43 [HCoV-OC43]
cagguuguuuauu

SEQ ID NO: 3947199 - RNA, 14 nt, Human coronavirus OC43 [HCoV-OC43]
caguggauacacuu

SEQ ID NO: 3947200 - RNA, 15 nt, Human coronavirus OC43 [HCoV-OC43]
caucuggugguaacc

SEQ ID NO: 3947201 - RNA, 18 nt, Human coronavirus OC43 [HCoV-OC43]
uuaaacgguuacacuguu

SEQ ID NO: 3947202 - RNA, 21 nt, Human coronavirus OC43 [HCoV-OC43]
uuaaagaucguguaauguaua

SEQ ID NO: 3947203 - RNA, 21 nt, Human coronavirus OC43 [HCoV-OC43]
uuaauuguuauuauuuaguuu

SEQ ID NO: 3947204 - RNA, 19 nt, Human coronavirus OC43 [HCoV-OC43]
uuacccucugguaauuauu

SEQ ID NO: 3947205 - RNA, 15 nt, Human coronavirus OC43 [HCoV-OC43]
uuagaguuggccaaa

SEQ ID NO: 3947206 - RNA, 14 nt, Human coronavirus OC43 [HCoV-OC43]
uucagcaguguuuu

SEQ ID NO: 3947207 - RNA, 16 nt, Human coronavirus OC43 [HCoV-OC43]
uucagcaguguuuugg

SEQ ID NO: 3947208 - RNA, 16 nt, Human coronavirus OC43 [HCoV-OC43]
uucuaaugguaaucuc

SEQ ID NO: 3947209 - RNA, 19 nt, Human coronavirus OC43 [HCoV-OC43]
uugaccuacaauuggguaa

SEQ ID NO: 3947210 - RNA, 20 nt, Human coronavirus OC43 [HCoV-OC43]
uuguccugcagguacuaauu

SEQ ID NO: 3947211 - RNA, 15 nt, Human coronavirus OC43 [HCoV-OC43]
uuguuacuaaguuuu

SEQ ID NO: 3947212 - RNA, 16 nt, Human coronavirus OC43 [HCoV-OC43]
uuuacaauuucaaauu

SEQ ID NO: 3947213 - RNA, 14 nt, Human coronavirus OC43 [HCoV-OC43]
uuucuuucugauuu

SEQ ID NO: 3947214 - RNA, 16 nt, Human coronavirus OC43 [HCoV-OC43]
uuugauacuuuuaauu

SEQ ID NO: 3947215 - RNA, 14 nt, Human coronavirus OC43 [HCoV-OC43]
uuuuaugcauauuu

SEQ ID NO: 3947216 - RNA, 16 nt, Human coronavirus OC43 [HCoV-OC43]
uuuucagauuaaauuu

SEQ ID NO: 3947217 - RNA, 11 nt, Human coronavirus OC43 [HCoV-OC43]
ugcuguugauu

SEQ ID NO: 3947218 - RNA, 12 nt, Human coronavirus OC43 [HCoV-OC43]
uggcauggacac

SEQ ID NO: 3947219 - RNA, 15 nt, Human coronavirus OC43 [HCoV-OC43]
uggccaaagugcaga

SEQ ID NO: 3947220 - RNA, 15 nt, Human coronavirus OC43 [HCoV-OC43]
uguaaucauauuguu

SEQ ID NO: 3947221 - RNA, 16 nt, Human coronavirus OC43 [HCoV-OC43]
uguacagguuguugau

SEQ ID NO: 3947222 - RNA, 19 nt, Human coronavirus OC43 [HCoV-OC43]
uguagaagaauugcaugac

SEQ ID NO: 3947223 - RNA, 19 nt, Human coronavirus OC43 [HCoV-OC43]
ugucaaccuccguacuguu

SEQ ID NO: 3947224 - RNA, 16 nt, Human coronavirus OC43 [HCoV-OC43]
ugugguaguacaacca

SEQ ID NO: 3947225 - RNA, 21 nt, Human coronavirus OC43 [HCoV-OC43]
uguguuaaauuauaaagguuu

SEQ ID NO: 3947226 - RNA, 19 nt, Human coronavirus OC43 [HCoV-OC43]
uguuaauguaccauauguu

SEQ ID NO: 3947227 - RNA, 14 nt, Human coronavirus OC43 [HCoV-OC43]
uguucuacugauuu

SEQ ID NO: 3947228 - RNA, 19 nt, Human coronavirus OC43 [HCoV-OC43]
uguugacuuuauuaccugg

SEQ ID NO: 3947229 - RNA, 14 nt, Human coronavirus OC43 [HCoV-OC43]
uguugcagugccca

SEQ ID NO: 3947230 - RNA, 20 nt, Human coronavirus OC43 [HCoV-OC43]
uuaaaacagccgauggcaac

SEQ ID NO: 3947231 - RNA, 20 nt, Human coronavirus OC43 [HCoV-OC43]
uuacuagcauacuuaguggu

SEQ ID NO: 3947232 - RNA, 17 nt, Human coronavirus OC43 [HCoV-OC43]
uuacuaggcugcaugau

SEQ ID NO: 3947233 - RNA, 15 nt, Human coronavirus OC43 [HCoV-OC43]
uuaggccaaggcauu

SEQ ID NO: 3947234 - RNA, 22 nt, Human coronavirus OC43 [HCoV-OC43]
uuaucaagaaggugguacuuuu

SEQ ID NO: 3947235 - RNA, 16 nt, Human coronavirus OC43 [HCoV-OC43]
uuaucuugguuguguu

SEQ ID NO: 3947236 - RNA, 18 nt, Human coronavirus OC43 [HCoV-OC43]
uuaugauaaauauuuugg

SEQ ID NO: 3947237 - RNA, 13 nt, Human coronavirus OC43 [HCoV-OC43]
uuauguggccccu

SEQ ID NO: 3947238 - RNA, 14 nt, Human coronavirus OC43 [HCoV-OC43]
uucgcauguaaaug

SEQ ID NO: 3947239 - RNA, 14 nt, Human coronavirus OC43 [HCoV-OC43]
uucuacugauuuac

SEQ ID NO: 3947240 - RNA, 14 nt, Human coronavirus OC43 [HCoV-OC43]
uugcgauuguaauu

SEQ ID NO: 3947241 - RNA, 12 nt, Human coronavirus OC43 [HCoV-OC43]
uugcuaaugcau

SEQ ID NO: 3947242 - RNA, 13 nt, Human coronavirus OC43 [HCoV-OC43]
uuguauuauaauu

SEQ ID NO: 3947243 - RNA, 23 nt, Human coronavirus OC43 [HCoV-OC43]
uuguauuuuuaacggcaaguuuu

SEQ ID NO: 3947244 - RNA, 21 nt, Human coronavirus OC43 [HCoV-OC43]
uugucauccuaaccuggguaa

SEQ ID NO: 3947245 - RNA, 16 nt, Human coronavirus OC43 [HCoV-OC43]
uuuauaugauucuaau

SEQ ID NO: 3947246 - RNA, 15 nt, Human coronavirus OC43 [HCoV-OC43]
uuucaaauuguaauu

SEQ ID NO: 3947247 - RNA, 20 nt, Human coronavirus OC43 [HCoV-OC43]
uuugauaaaguaaaguuauc

SEQ ID NO: 3947248 - RNA, 22 nt, Human coronavirus OC43 [HCoV-OC43]
uuugcaaucuagcauuuguuaa

SEQ ID NO: 3947249 - RNA, 12 nt, Human coronavirus OC43 [HCoV-OC43]
aauuguuauuau

SEQ ID NO: 3947250 - RNA, 21 nt, Human coronavirus OC43 [HCoV-OC43]
aauuuuucuuuggguauuaua

SEQ ID NO: 3947251 - RNA, 18 nt, Human coronavirus OC43 [HCoV-OC43]
acacaggaugguuauaau

SEQ ID NO: 3947252 - RNA, 23 nt, Human coronavirus OC43 [HCoV-OC43]
acaccucagaaauauaagagaau

SEQ ID NO: 3947253 - RNA, 21 nt, Human coronavirus OC43 [HCoV-OC43]
acacugguaaaauuuagugca

SEQ ID NO: 3947254 - RNA, 21 nt, Human coronavirus OC43 [HCoV-OC43]
acagacauaauucuugguguu

SEQ ID NO: 3947255 - RNA, 16 nt, Human coronavirus OC43 [HCoV-OC43]
acuacguuuuuaauaa

SEQ ID NO: 3947256 - RNA, 16 nt, Human coronavirus OC43 [HCoV-OC43]
acuagugacccacagu

SEQ ID NO: 3947257 - RNA, 15 nt, Human coronavirus OC43 [HCoV-OC43]
acuagugguuuugcu

SEQ ID NO: 3947258 - RNA, 15 nt, Human coronavirus OC43 [HCoV-OC43]
acucgcacccacagc

SEQ ID NO: 3947259 - RNA, 16 nt, Human coronavirus OC43 [HCoV-OC43]
acucgcacccacagcu

SEQ ID NO: 3947260 - RNA, 15 nt, Human coronavirus OC43 [HCoV-OC43]
acucucuaucagaau

SEQ ID NO: 3947261 - RNA, 11 nt, Human coronavirus OC43 [HCoV-OC43]
acuguuaauuc

SEQ ID NO: 3947262 - RNA, 23 nt, Human coronavirus OC43 [HCoV-OC43]
acuuuuuaugcauauuuuacaga

SEQ ID NO: 3947263 - RNA, 17 nt, Human coronavirus OC43 [HCoV-OC43]
agaaagaugguuuuuau

SEQ ID NO: 3947264 - RNA, 22 nt, Human coronavirus OC43 [HCoV-OC43]
agaaggugguacuuuuuaugca

SEQ ID NO: 3947265 - RNA, 17 nt, Human coronavirus OC43 [HCoV-OC43]
agaauauggcuguguau

SEQ ID NO: 3947266 - RNA, 15 nt, Human coronavirus OC43 [HCoV-OC43]
agaauggaugucuug

SEQ ID NO: 3947267 - RNA, 15 nt, Human coronavirus OC43 [HCoV-OC43]
agaaugguuuuacuu

SEQ ID NO: 3947268 - RNA, 12 nt, Human coronavirus OC43 [HCoV-OC43]
agagccagcaug

SEQ ID NO: 3947269 - RNA, 18 nt, Human coronavirus OC43 [HCoV-OC43]
agagugguuauuuuguua

SEQ ID NO: 3947270 - RNA, 20 nt, Human coronavirus OC43 [HCoV-OC43]
agaguuccuagucaugcuug

SEQ ID NO: 3947271 - RNA, 13 nt, Human coronavirus OC43 [HCoV-OC43]
agaucguguguau

SEQ ID NO: 3947272 - RNA, 13 nt, Human coronavirus OC43 [HCoV-OC43]
agcauaacuauag

SEQ ID NO: 3947273 - RNA, 21 nt, Human coronavirus OC43 [HCoV-OC43]
agccccagaaggauguuuaug

SEQ ID NO: 3947274 - RNA, 15 nt, Human coronavirus OC43 [HCoV-OC43]
agccuuacuuuuguu

SEQ ID NO: 3947275 - RNA, 16 nt, Human coronavirus OC43 [HCoV-OC43]
aggcagacucauuuac

SEQ ID NO: 3947276 - RNA, 12 nt, Human coronavirus OC43 [HCoV-OC43]
agggaagagcca

SEQ ID NO: 3947277 - RNA, 20 nt, Human coronavirus OC43 [HCoV-OC43]
agguuauagcagacuauaga

SEQ ID NO: 3947278 - RNA, 16 nt, Human coronavirus OC43 [HCoV-OC43]
aguacuuuuguaaaua

SEQ ID NO: 3947279 - RNA, 16 nt, Human coronavirus OC43 [HCoV-OC43]
agucagacagaaaauu

SEQ ID NO: 3947280 - RNA, 13 nt, Human coronavirus OC43 [HCoV-OC43]
agugacccacagu

SEQ ID NO: 3947281 - RNA, 21 nt, Human coronavirus OC43 [HCoV-OC43]
auaaagacacugguguuauuu

SEQ ID NO: 3947282 - RNA, 22 nt, Human coronavirus OC43 [HCoV-OC43]
auagaggauuuacuuuuugaua

SEQ ID NO: 3947283 - RNA, 18 nt, Human coronavirus OC43 [HCoV-OC43]
auaguguuggagaaagug

SEQ ID NO: 3947284 - RNA, 21 nt, Human coronavirus OC43 [HCoV-OC43]
auauuaauaucccugauuuac

SEQ ID NO: 3947285 - RNA, 15 nt, Human coronavirus OC43 [HCoV-OC43]
aucagaauuuuggug

SEQ ID NO: 3947286 - RNA, 15 nt, Human coronavirus OC43 [HCoV-OC43]
aucgcagauguuuac

SEQ ID NO: 3947287 - RNA, 20 nt, Human coronavirus OC43 [HCoV-OC43]
augaaaacaauucuugguuc

SEQ ID NO: 3947288 - RNA, 16 nt, Human coronavirus OC43 [HCoV-OC43]
augaggguguuaauuu

SEQ ID NO: 3947289 - RNA, 11 nt, Human coronavirus OC43 [HCoV-OC43]
augauguaaaa

SEQ ID NO: 3947290 - RNA, 20 nt, Human coronavirus OC43 [HCoV-OC43]
auggacaccgcauuguugag

SEQ ID NO: 3947291 - RNA, 14 nt, Human coronavirus OC43 [HCoV-OC43]
auuaauuaguugaa

SEQ ID NO: 3947292 - RNA, 23 nt, Human coronavirus OC43 [HCoV-OC43]
auuacucaguuucaaaagggaaa

SEQ ID NO: 3947293 - RNA, 21 nt, Human coronavirus OC43 [HCoV-OC43]
auuauuauguggauuguguau

SEQ ID NO: 3947294 - RNA, 13 nt, Human coronavirus OC43 [HCoV-OC43]
auuguaauuauug

SEQ ID NO: 3947295 - RNA, 22 nt, Human coronavirus OC43 [HCoV-OC43]
auuucaaaugagcuauuguuaa

SEQ ID NO: 3947296 - RNA, 15 nt, Human coronavirus OC43 [HCoV-OC43]
auuugggcuauuugc

SEQ ID NO: 3947297 - RNA, 15 nt, Human coronavirus OC43 [HCoV-OC43]
auuugguuuuauaga

SEQ ID NO: 3947298 - RNA, 13 nt, Human coronavirus OC43 [HCoV-OC43]
auuuuaucaauuu

SEQ ID NO: 3947299 - RNA, 17 nt, Human coronavirus OC43 [HCoV-OC43]
caaccuuccugauuuua

SEQ ID NO: 3947300 - RNA, 13 nt, Human coronavirus OC43 [HCoV-OC43]
caagugcccaagg

SEQ ID NO: 3947301 - RNA, 17 nt, Human coronavirus OC43 [HCoV-OC43]
caaugcccuuuaugcua

SEQ ID NO: 3947302 - RNA, 23 nt, Human coronavirus OC43 [HCoV-OC43]
caaugcuuauaauaguacugcua

SEQ ID NO: 3947303 - RNA, 19 nt, Human coronavirus OC43 [HCoV-OC43]
cagcgucaacugcugccac

SEQ ID NO: 3947304 - RNA, 22 nt, Human coronavirus OC43 [HCoV-OC43]
cagguguuguuuccuguuuaua

SEQ ID NO: 3947305 - RNA, 18 nt, Human coronavirus OC43 [HCoV-OC43]
caguccuugauguggaug

SEQ ID NO: 3947306 - RNA, 19 nt, Human coronavirus OC43 [HCoV-OC43]
caguguuuugguaagagag

SEQ ID NO: 3947307 - RNA, 14 nt, Human coronavirus OC43 [HCoV-OC43]
cauacucugacggu

SEQ ID NO: 3947308 - RNA, 12 nt, Human coronavirus OC43 [HCoV-OC43]
cauaugcuguug

SEQ ID NO: 3947309 - RNA, 14 nt, Human coronavirus OC43 [HCoV-OC43]
cauuaacuauuuug

SEQ ID NO: 3947310 - RNA, 19 nt, Human coronavirus OC43 [HCoV-OC43]
cauuuguuuauugguuaca

SEQ ID NO: 3947311 - RNA, 13 nt, Human coronavirus OC43 [HCoV-OC43]
ccaauucuggcaa

SEQ ID NO: 3947312 - RNA, 17 nt, Human coronavirus OC43 [HCoV-OC43]
ccacuaaaccucagcaa

SEQ ID NO: 3947313 - RNA, 19 nt, Human coronavirus OC43 [HCoV-OC43]
ccagcauugcuauuucgga

SEQ ID NO: 3947314 - RNA, 22 nt, Human coronavirus OC43 [HCoV-OC43]
cccuauacugaagacaccucag

SEQ ID NO: 3947315 - RNA, 21 nt, Human coronavirus OC43 [HCoV-OC43]
cgcgcacauccagcagagccu

SEQ ID NO: 3947316 - RNA, 21 nt, Human coronavirus OC43 [HCoV-OC43]
cgucuuaccgcucuuaaugcu

SEQ ID NO: 3947317 - RNA, 17 nt, Human coronavirus OC43 [HCoV-OC43]
cuaaucaugauguaguu

SEQ ID NO: 3947318 - RNA, 12 nt, Human coronavirus OC43 [HCoV-OC43]
cuaauguuucug

SEQ ID NO: 3947319 - RNA, 23 nt, Human coronavirus OC43 [HCoV-OC43]
cuaauuuugagccauuuacuguu

SEQ ID NO: 3947320 - RNA, 14 nt, Human coronavirus OC43 [HCoV-OC43]
cuaccucucagcaa

SEQ ID NO: 3947321 - RNA, 15 nt, Human coronavirus OC43 [HCoV-OC43]
cuauagguaguacuu

SEQ ID NO: 3947322 - RNA, 19 nt, Human coronavirus OC43 [HCoV-OC43]
cucaggaaggucugcuccu

SEQ ID NO: 3947323 - RNA, 16 nt, Human coronavirus OC43 [HCoV-OC43]
cuccugguaagcaauc

SEQ ID NO: 3947324 - RNA, 14 nt, Human coronavirus OC43 [HCoV-OC43]
cucgcacccacagc

SEQ ID NO: 3947325 - RNA, 13 nt, Human coronavirus OC43 [HCoV-OC43]
cucugguguaaca

SEQ ID NO: 3947326 - RNA, 17 nt, Human coronavirus OC43 [HCoV-OC43]
cuggaaaucguucuggu

SEQ ID NO: 3947327 - RNA, 17 nt, Human coronavirus OC43 [HCoV-OC43]
cugguaauggcauccuc

SEQ ID NO: 3947328 - RNA, 17 nt, Human coronavirus OC43 [HCoV-OC43]
cuuaauaacccugcaua

SEQ ID NO: 3947329 - RNA, 15 nt, Human coronavirus OC43 [HCoV-OC43]
cuuacuaaucaugau

SEQ ID NO: 3947330 - RNA, 20 nt, Human coronavirus OC43 [HCoV-OC43]
cuugguguuuguguuaauua

SEQ ID NO: 3947331 - RNA, 14 nt, Human coronavirus OC43 [HCoV-OC43]
cuuuuuaugcauau

SEQ ID NO: 3947332 - RNA, 19 nt, Human coronavirus OC43 [HCoV-OC43]
gaaugcugauuauuuguau

SEQ ID NO: 3947333 - RNA, 20 nt, Human coronavirus OC43 [HCoV-OC43]
gacaccgcauuguugagaaa

SEQ ID NO: 3947334 - RNA, 13 nt, Human coronavirus OC43 [HCoV-OC43]
gaccaguacggca

SEQ ID NO: 3947335 - RNA, 18 nt, Human coronavirus OC43 [HCoV-OC43]
gagccaauucuggcaaua

SEQ ID NO: 3947336 - RNA, 20 nt, Human coronavirus OC43 [HCoV-OC43]
gauuguguauuuugugaaua

SEQ ID NO: 3947337 - RNA, 15 nt, Human coronavirus OC43 [HCoV-OC43]
gcaaccaucaggagg

SEQ ID NO: 3947338 - RNA, 20 nt, Human coronavirus OC43 [HCoV-OC43]
gcaauaaaagucuuaaauca

SEQ ID NO: 3947339 - RNA, 18 nt, Human coronavirus OC43 [HCoV-OC43]
gcagacucuuguuuacaa

SEQ ID NO: 3947340 - RNA, 18 nt, Human coronavirus OC43 [HCoV-OC43]
gcagcaaaauaagaguag

SEQ ID NO: 3947341 - RNA, 19 nt, Human coronavirus OC43 [HCoV-OC43]
gcagccugaugucuuuuau

SEQ ID NO: 3947342 - RNA, 23 nt, Human coronavirus OC43 [HCoV-OC43]
gcauggacaccgcauuguugaga

SEQ ID NO: 3947343 - RNA, 16 nt, Human coronavirus OC43 [HCoV-OC43]
auagauagagaagguu

SEQ ID NO: 3947344 - RNA, 18 nt, Human coronavirus OC43 [HCoV-OC43]
auagguaguacuuuugua

SEQ ID NO: 3947345 - RNA, 22 nt, Human coronavirus OC43 [HCoV-OC43]
auaguaagguuaagaaugguuu

SEQ ID NO: 3947346 - RNA, 13 nt, Human coronavirus OC43 [HCoV-OC43]
auauaaguguugc

SEQ ID NO: 3947347 - RNA, 22 nt, Human coronavirus OC43 [HCoV-OC43]
auauagaagcuuggcuuaauga

SEQ ID NO: 3947348 - RNA, 20 nt, Human coronavirus OC43 [HCoV-OC43]
auauugacggagucuacugg

SEQ ID NO: 3947349 - RNA, 19 nt, Human coronavirus OC43 [HCoV-OC43]
aucaugauguaguuuaugc

SEQ ID NO: 3947350 - RNA, 19 nt, Human coronavirus OC43 [HCoV-OC43]
aucauuagugcagaaugcu

SEQ ID NO: 3947351 - RNA, 15 nt, Human coronavirus OC43 [HCoV-OC43]
aucuagacuugaugc

SEQ ID NO: 3947352 - RNA, 17 nt, Human coronavirus OC43 [HCoV-OC43]
augaauauuauguaaaa

SEQ ID NO: 3947353 - RNA, 20 nt, Human coronavirus OC43 [HCoV-OC43]
augaggguguuaauuuuacg

SEQ ID NO: 3947354 - RNA, 20 nt, Human coronavirus OC43 [HCoV-OC43]
augaguccaaaaccacagcg

SEQ ID NO: 3947355 - RNA, 15 nt, Human coronavirus OC43 [HCoV-OC43]
augaguuuuacaaug

SEQ ID NO: 3947356 - RNA, 12 nt, Human coronavirus OC43 [HCoV-OC43]
augauauuugga

SEQ ID NO: 3947357 - RNA, 22 nt, Human coronavirus OC43 [HCoV-OC43]
augauuauggguuauuguuguu

SEQ ID NO: 3947358 - RNA, 14 nt, Human coronavirus OC43 [HCoV-OC43]
augcauauuuuaca

SEQ ID NO: 3947359 - RNA, 21 nt, Human coronavirus OC43 [HCoV-OC43]
auggagaagguuaaugaaugu

SEQ ID NO: 3947360 - RNA, 19 nt, Human coronavirus OC43 [HCoV-OC43]
auggcacugaagggaagug

SEQ ID NO: 3947361 - RNA, 20 nt, Human coronavirus OC43 [HCoV-OC43]
augguauuauuuuuaaugcu

SEQ ID NO: 3947362 - RNA, 20 nt, Human coronavirus OC43 [HCoV-OC43]
auguggaugacguuuaggua

SEQ ID NO: 3947363 - RNA, 22 nt, Human coronavirus OC43 [HCoV-OC43]
auguuuuugauacuuuuaauuu

SEQ ID NO: 3947364 - RNA, 19 nt, Human coronavirus OC43 [HCoV-OC43]
auuaaacucagugaaaaug

SEQ ID NO: 3947365 - RNA, 18 nt, Human coronavirus OC43 [HCoV-OC43]
auuaaagaucguguaaug

SEQ ID NO: 3947366 - RNA, 19 nt, Human coronavirus OC43 [HCoV-OC43]
auuaugcagcauguaaauc

SEQ ID NO: 3947367 - RNA, 13 nt, Human coronavirus OC43 [HCoV-OC43]
auuauuuuaauaa

SEQ ID NO: 3947368 - RNA, 19 nt, Human coronavirus OC43 [HCoV-OC43]
auucaagcuguuguuaaug

SEQ ID NO: 3947369 - RNA, 16 nt, Human coronavirus OC43 [HCoV-OC43]
auuccgacuagguuuc

SEQ ID NO: 3947370 - RNA, 19 nt, Human coronavirus OC43 [HCoV-OC43]
auucuugguucucuggaau

SEQ ID NO: 3947371 - RNA, 13 nt, Human coronavirus OC43 [HCoV-OC43]
auugaugcugcua

SEQ ID NO: 3947372 - RNA, 21 nt, Human coronavirus OC43 [HCoV-OC43]
auugcguauacgcauugaaua

SEQ ID NO: 3947373 - RNA, 21 nt, Human coronavirus OC43 [HCoV-OC43]
auuuaacaaugcccuuuaugc

SEQ ID NO: 3947374 - RNA, 15 nt, Human coronavirus OC43 [HCoV-OC43]
auuuaccugcugcua

SEQ ID NO: 3947375 - RNA, 22 nt, Human coronavirus OC43 [HCoV-OC43]
auuuauucuaguuagcugcaua

SEQ ID NO: 3947376 - RNA, 19 nt, Human coronavirus OC43 [HCoV-OC43]
auuucuguccguguaaauu

SEQ ID NO: 3947377 - RNA, 21 nt, Human coronavirus OC43 [HCoV-OC43]
auuuuuaggaguuuucacuuu

SEQ ID NO: 3947378 - RNA, 12 nt, Human coronavirus OC43 [HCoV-OC43]
auuuuuguugag

SEQ ID NO: 3947379 - RNA, 19 nt, Human coronavirus OC43 [HCoV-OC43]
aaaugcaaccguucuggua

SEQ ID NO: 3947380 - RNA, 15 nt, Human coronavirus OC43 [HCoV-OC43]
aacagccgauggcaa

SEQ ID NO: 3947381 - RNA, 21 nt, Human coronavirus OC43 [HCoV-OC43]
aacuauagaauugauacuacu

SEQ ID NO: 3947382 - RNA, 16 nt, Human coronavirus OC43 [HCoV-OC43]
aaucaagguagauuuu

SEQ ID NO: 3947383 - RNA, 21 nt, Human coronavirus OC43 [HCoV-OC43]
aaucaugauguaguuuaugca

SEQ ID NO: 3947384 - RNA, 17 nt, Human coronavirus OC43 [HCoV-OC43]
aaugaaggugcugaaug

SEQ ID NO: 3947385 - RNA, 21 nt, Human coronavirus OC43 [HCoV-OC43]
aaugaugaugaugcuugguuu

SEQ ID NO: 3947386 - RNA, 12 nt, Human coronavirus OC43 [HCoV-OC43]
aaugguuauuac

SEQ ID NO: 3947387 - RNA, 20 nt, Human coronavirus OC43 [HCoV-OC43]
acaaguguaauauuuuugcu

SEQ ID NO: 3947388 - RNA, 15 nt, Human coronavirus OC43 [HCoV-OC43]
acagacacugguguu

SEQ ID NO: 3947389 - RNA, 17 nt, Human coronavirus OC43 [HCoV-OC43]
acaguuccccauucuug

SEQ ID NO: 3947390 - RNA, 14 nt, Human coronavirus OC43 [HCoV-OC43]
accaagguuauuaa

SEQ ID NO: 3947391 - RNA, 16 nt, Human coronavirus OC43 [HCoV-OC43]
accaguuauuuugcuu

SEQ ID NO: 3947392 - RNA, 23 nt, Human coronavirus OC43 [HCoV-OC43]
accaucaggagggaauguuguac

SEQ ID NO: 3947393 - RNA, 16 nt, Human coronavirus OC43 [HCoV-OC43]
acccccauaauuauuc

SEQ ID NO: 3947394 - RNA, 17 nt, Human coronavirus OC43 [HCoV-OC43]
accugcgcuguuaauua

SEQ ID NO: 3947395 - RNA, 15 nt, Human coronavirus OC43 [HCoV-OC43]
acuacaccagcacca

SEQ ID NO: 3947396 - RNA, 14 nt, Human coronavirus OC43 [HCoV-OC43]
acuuuagaauauug

SEQ ID NO: 3947397 - RNA, 15 nt, Human coronavirus OC43 [HCoV-OC43]
agaauuuugguggug

SEQ ID NO: 3947398 - RNA, 13 nt, Human coronavirus OC43 [HCoV-OC43]
agacaccucagaa

SEQ ID NO: 3947399 - RNA, 22 nt, Human coronavirus OC43 [HCoV-OC43]
agacaggaguuaaauguuuaug

SEQ ID NO: 3947400 - RNA, 22 nt, Human coronavirus OC43 [HCoV-OC43]
agagaguugacugcagaggaca

SEQ ID NO: 3947401 - RNA, 20 nt, Human coronavirus OC43 [HCoV-OC43]
agauuagaguuggccaaagu

SEQ ID NO: 3947402 - RNA, 14 nt, Human coronavirus OC43 [HCoV-OC43]
agccccgccagaag

SEQ ID NO: 3947403 - RNA, 11 nt, Human coronavirus OC43 [HCoV-OC43]
aggaugucuuu

SEQ ID NO: 3947404 - RNA, 14 nt, Human coronavirus OC43 [HCoV-OC43]
aggcugaugucaau

SEQ ID NO: 3947405 - RNA, 17 nt, Human coronavirus OC43 [HCoV-OC43]
aggucaacaaauuauuu

SEQ ID NO: 3947406 - RNA, 22 nt, Human coronavirus OC43 [HCoV-OC43]
agguguaccauuuuauuuaaau

SEQ ID NO: 3947407 - RNA, 19 nt, Human coronavirus OC43 [HCoV-OC43]
agguuuacaauuucaaauu

SEQ ID NO: 3947408 - RNA, 19 nt, Human coronavirus OC43 [HCoV-OC43]
aguagagcguccucuggaa

SEQ ID NO: 3947409 - RNA, 14 nt, Human coronavirus OC43 [HCoV-OC43]
auaaaaguguugau

SEQ ID NO: 3947410 - RNA, 23 nt, Human coronavirus OC43 [HCoV-OC43]
auaaagacacugguguuauuuau

SEQ ID NO: 3947411 - RNA, 17 nt, Human coronavirus OC43 [HCoV-OC43]
auaaguacugauacugu

SEQ ID NO: 3947412 - RNA, 21 nt, Human coronavirus OC43 [HCoV-OC43]
auaaguacugauacuguugau

SEQ ID NO: 3947413 - RNA, 21 nt, Human coronavirus OC43 [HCoV-OC43]
auacuuagugguuuguuauau

SEQ ID NO: 3947414 - RNA, 22 nt, Human coronavirus OC43 [HCoV-OC43]
caaaagccgcgugcagcaaaau

SEQ ID NO: 3947415 - RNA, 18 nt, Human coronavirus OC43 [HCoV-OC43]
caacggcuuuugcuguua

SEQ ID NO: 3947416 - RNA, 22 nt, Human coronavirus OC43 [HCoV-OC43]
caccaccuacugguguuuauga

SEQ ID NO: 3947417 - RNA, 16 nt, Human coronavirus OC43 [HCoV-OC43]
cagaaggauguuuaug

SEQ ID NO: 3947418 - RNA, 21 nt, Human coronavirus OC43 [HCoV-OC43]
cagacacugguguuguuacua

SEQ ID NO: 3947419 - RNA, 19 nt, Human coronavirus OC43 [HCoV-OC43]
cagagccucuagugcagga

SEQ ID NO: 3947420 - RNA, 12 nt, Human coronavirus OC43 [HCoV-OC43]
caggagggaaug

SEQ ID NO: 3947421 - RNA, 16 nt, Human coronavirus OC43 [HCoV-OC43]
caggaguuaaauguuu

SEQ ID NO: 3947422 - RNA, 23 nt, Human coronavirus OC43 [HCoV-OC43]
caguaauuaguaaaugaaugaag

SEQ ID NO: 3947423 - RNA, 13 nt, Human coronavirus OC43 [HCoV-OC43]
cauacugccaaag

SEQ ID NO: 3947424 - RNA, 17 nt, Human coronavirus OC43 [HCoV-OC43]
cauauugcaauuuggau

SEQ ID NO: 3947425 - RNA, 14 nt, Human coronavirus OC43 [HCoV-OC43]
cauccagcagagcc

SEQ ID NO: 3947426 - RNA, 23 nt, Human coronavirus OC43 [HCoV-OC43]
cauuaugauaaauauuuuggagu

SEQ ID NO: 3947427 - RNA, 14 nt, Human coronavirus OC43 [HCoV-OC43]
ccacuaaaccucag

SEQ ID NO: 3947428 - RNA, 13 nt, Human coronavirus OC43 [HCoV-OC43]
ccauauguuuaua

SEQ ID NO: 3947429 - RNA, 15 nt, Human coronavirus OC43 [HCoV-OC43]
ccauuauuaugugga

SEQ ID NO: 3947430 - RNA, 13 nt, Human coronavirus OC43 [HCoV-OC43]
ccauuuguuuauu

SEQ ID NO: 3947431 - RNA, 14 nt, Human coronavirus OC43 [HCoV-OC43]
cgccagaagaggag

SEQ ID NO: 3947432 - RNA, 15 nt, Human coronavirus OC43 [HCoV-OC43]
cguuuuucuuuggau

SEQ ID NO: 3947433 - RNA, 16 nt, Human coronavirus OC43 [HCoV-OC43]
cguuuuucuuuggauc

SEQ ID NO: 3947434 - RNA, 20 nt, Human coronavirus OC43 [HCoV-OC43]
cuaaguuuuuguuuaauguu

SEQ ID NO: 3947435 - RNA, 20 nt, Human coronavirus OC43 [HCoV-OC43]
cuauagauaaguuugcuaua

SEQ ID NO: 3947436 - RNA, 12 nt, Human coronavirus OC43 [HCoV-OC43]
cuaucugggaac

SEQ ID NO: 3947437 - RNA, 14 nt, Human coronavirus OC43 [HCoV-OC43]
cucagaauuagaag

SEQ ID NO: 3947438 - RNA, 22 nt, Human coronavirus OC43 [HCoV-OC43]
cucuaccccuauggcagauguc

SEQ ID NO: 3947439 - RNA, 21 nt, Human coronavirus OC43 [HCoV-OC43]
cucuuaaugcuuauguuucuc

SEQ ID NO: 3947440 - RNA, 19 nt, Human coronavirus OC43 [HCoV-OC43]
cugugauaacauuaaugcc

SEQ ID NO: 3947441 - RNA, 19 nt, Human coronavirus OC43 [HCoV-OC43]
cuucuuaagaagauggaug

SEQ ID NO: 3947442 - RNA, 16 nt, Human coronavirus OC43 [HCoV-OC43]
cuugguucucuggaau

SEQ ID NO: 3947443 - RNA, 23 nt, Human coronavirus OC43 [HCoV-OC43]
cuuguacuugccgaccacaagca

SEQ ID NO: 3947444 - RNA, 21 nt, Human coronavirus OC43 [HCoV-OC43]
cuuguuagaucuuuuugcaau

SEQ ID NO: 3947445 - RNA, 21 nt, Human coronavirus OC43 [HCoV-OC43]
cuuuggcugccaccucugcua

SEQ ID NO: 3947446 - RNA, 16 nt, Human coronavirus OC43 [HCoV-OC43]
gaaaauguugauuuua

SEQ ID NO: 3947447 - RNA, 13 nt, Human coronavirus OC43 [HCoV-OC43]
gaagcugauuuuu

SEQ ID NO: 3947448 - RNA, 16 nt, Human coronavirus OC43 [HCoV-OC43]
gacaccucagaaauau

SEQ ID NO: 3947449 - RNA, 19 nt, Human coronavirus OC43 [HCoV-OC43]
gaugcaacuaauucugcuu

SEQ ID NO: 3947450 - RNA, 12 nt, Human coronavirus OC43 [HCoV-OC43]
gauuauuauuau

SEQ ID NO: 3947451 - RNA, 18 nt, Human coronavirus OC43 [HCoV-OC43]
gauuauuuguauuuucau

SEQ ID NO: 3947452 - RNA, 19 nt, Human coronavirus OC43 [HCoV-OC43]
gcagaauuuaucugggaau

SEQ ID NO: 3947453 - RNA, 15 nt, Human coronavirus OC43 [HCoV-OC43]
gcagcauguaaauca

SEQ ID NO: 3947454 - RNA, 10 nt, Human coronavirus OC43 [HCoV-OC43]
gcagugccca

SEQ ID NO: 3947455 - RNA, 14 nt, Human coronavirus OC43 [HCoV-OC43]
gcauccucaagugg

SEQ ID NO: 3947456 - RNA, 15 nt, Human coronavirus OC43 [HCoV-OC43]
gcguaguagagccaa

SEQ ID NO: 3947457 - RNA, 13 nt, Human coronavirus OC43 [HCoV-OC43]
gcuauaacuauag

SEQ ID NO: 3947458 - RNA, 24 nt, Human coronavirus OC43 [HCoV-OC43]
gcuauuucggaauauuaaaugcaa

SEQ ID NO: 3947459 - RNA, 14 nt, Human coronavirus OC43 [HCoV-OC43]
ggaaaauguugauu

SEQ ID NO: 3947460 - RNA, 12 nt, Human coronavirus OC43 [HCoV-OC43]
ggacaaggugug

SEQ ID NO: 3947461 - RNA, 22 nt, Human coronavirus OC43 [HCoV-OC43]
ggacccaaguagcgaugaggcu

SEQ ID NO: 3947462 - RNA, 17 nt, Human coronavirus OC43 [HCoV-OC43]
ggcccuaaucagaauuu

SEQ ID NO: 3947463 - RNA, 13 nt, Human coronavirus OC43 [HCoV-OC43]
gguuucacagcau

SEQ ID NO: 3947464 - RNA, 17 nt, Human coronavirus OC43 [HCoV-OC43]
guaaaauuuagugcagc

SEQ ID NO: 3947465 - RNA, 16 nt, Human coronavirus OC43 [HCoV-OC43]
guacagguuguugauu

SEQ ID NO: 3947466 - RNA, 23 nt, Human coronavirus OC43 [HCoV-OC43]
guacugauacuguugauguuacu

SEQ ID NO: 3947467 - RNA, 18 nt, Human coronavirus OC43 [HCoV-OC43]
guaggcaguuuuaugagu

SEQ ID NO: 3947468 - RNA, 15 nt, Human coronavirus OC43 [HCoV-OC43]
guauaaaacuaggua

SEQ ID NO: 3947469 - RNA, 15 nt, Human coronavirus OC43 [HCoV-OC43]
guaugaugaauauga

SEQ ID NO: 3947470 - RNA, 22 nt, Human coronavirus OC43 [HCoV-OC43]
gugcacauauaagcgugguuuu

SEQ ID NO: 3947471 - RNA, 18 nt, Human coronavirus OC43 [HCoV-OC43]
gugcuauaagugcuucuu

SEQ ID NO: 3947472 - RNA, 15 nt, Human coronavirus OC43 [HCoV-OC43]
gugugcaaaguuaua

SEQ ID NO: 3947473 - RNA, 18 nt, Human coronavirus OC43 [HCoV-OC43]
guucagauuguaaucaua

SEQ ID NO: 3947474 - RNA, 20 nt, Human coronavirus OC43 [HCoV-OC43]
uaaauacuacguuguuucuu

SEQ ID NO: 3947475 - RNA, 22 nt, Human coronavirus OC43 [HCoV-OC43]
uaacuauagauaaguuugcuau

SEQ ID NO: 3947476 - RNA, 15 nt, Human coronavirus OC43 [HCoV-OC43]
uaauauuuuugcuaa

SEQ ID NO: 3947477 - RNA, 11 nt, Human coronavirus OC43 [HCoV-OC43]
uaaugcuguug

SEQ ID NO: 3947478 - RNA, 17 nt, Human coronavirus OC43 [HCoV-OC43]
uaaugguauuuuugcua

SEQ ID NO: 3947479 - RNA, 20 nt, Human coronavirus OC43 [HCoV-OC43]
uaauuauggccaauuggaag

SEQ ID NO: 3947480 - RNA, 22 nt, Human coronavirus OC43 [HCoV-OC43]
uaauuauuguaguuuuguuguu

SEQ ID NO: 3947481 - RNA, 18 nt, Human coronavirus OC43 [HCoV-OC43]
uacaggaaaaguuuucau

SEQ ID NO: 3947482 - RNA, 20 nt, Human coronavirus OC43 [HCoV-OC43]
uacauccuauagugugguag

SEQ ID NO: 3947483 - RNA, 16 nt, Human coronavirus OC43 [HCoV-OC43]
uacuaaguaugucaca

SEQ ID NO: 3947484 - RNA, 18 nt, Human coronavirus OC43 [HCoV-OC43]
uacugaagacaccucaga

SEQ ID NO: 3947485 - RNA, 17 nt, Human coronavirus OC43 [HCoV-OC43]
uagagcguccucuggaa

SEQ ID NO: 3947486 - RNA, 20 nt, Human coronavirus OC43 [HCoV-OC43]
uagauaugaaaggaacaaug

SEQ ID NO: 3947487 - RNA, 20 nt, Human coronavirus OC43 [HCoV-OC43]
uauaacggcgcaauuagguu

SEQ ID NO: 3947488 - RNA, 18 nt, Human coronavirus OC43 [HCoV-OC43]
uauaauaguacugcuauu

SEQ ID NO: 3947489 - RNA, 21 nt, Human coronavirus OC43 [HCoV-OC43]
uauagugaguucccugcuaua

SEQ ID NO: 3947490 - RNA, 23 nt, Human coronavirus OC43 [HCoV-OC43]
uauugcaacaacucucuaauaga

SEQ ID NO: 3947491 - RNA, 18 nt, Human coronavirus OC43 [HCoV-OC43]
ucaacaacaagaugguau

SEQ ID NO: 3947492 - RNA, 13 nt, Human coronavirus OC43 [HCoV-OC43]
ucaguuucaaaag

SEQ ID NO: 3947493 - RNA, 15 nt, Human coronavirus OC43 [HCoV-OC43]
uccugacgagcccca

SEQ ID NO: 3947494 - RNA, 20 nt, Human coronavirus OC43 [HCoV-OC43]
uccuuaccaacggcuuuugc

SEQ ID NO: 3947495 - RNA, 16 nt, Human coronavirus OC43 [HCoV-OC43]
ucgaauacaaaguauu

SEQ ID NO: 3947496 - RNA, 14 nt, Human coronavirus OC43 [HCoV-OC43]
ucuauuuauguguu

SEQ ID NO: 3947497 - RNA, 17 nt, Human coronavirus OC43 [HCoV-OC43]
ucuggcaauagaacccc

SEQ ID NO: 3947498 - RNA, 18 nt, Human coronavirus OC43 [HCoV-OC43]
ucuuaccgcucuuaaugc

SEQ ID NO: 3947499 - RNA, 17 nt, Human coronavirus OC43 [HCoV-OC43]
ugacgagccccagaagg

SEQ ID NO: 3947500 - RNA, 18 nt, Human coronavirus OC43 [HCoV-OC43]
ugacgagccccagaagga

SEQ ID NO: 3947501 - RNA, 16 nt, Human coronavirus OC43 [HCoV-OC43]
ugagccauuuacuguu

SEQ ID NO: 3947502 - RNA, 20 nt, Human coronavirus OC43 [HCoV-OC43]
ugcagaacucgcacccacag

SEQ ID NO: 3947503 - RNA, 17 nt, Human coronavirus OC43 [HCoV-OC43]
ugccaggcagucugaua

SEQ ID NO: 3947504 - RNA, 17 nt, Human coronavirus OC43 [HCoV-OC43]
gcccaagggaagagcca

SEQ ID NO: 3947505 - RNA, 15 nt, Human coronavirus OC43 [HCoV-OC43]
gcccuauacugaaga

SEQ ID NO: 3947506 - RNA, 16 nt, Human coronavirus OC43 [HCoV-OC43]
gcuaagucaaaaucaa

SEQ ID NO: 3947507 - RNA, 16 nt, Human coronavirus OC43 [HCoV-OC43]
gcuacagguacuuaua

SEQ ID NO: 3947508 - RNA, 12 nt, Human coronavirus OC43 [HCoV-OC43]
gcuauuucuguu

SEQ ID NO: 3947509 - RNA, 17 nt, Human coronavirus OC43 [HCoV-OC43]
ggaacuagugacccaca

SEQ ID NO: 3947510 - RNA, 19 nt, Human coronavirus OC43 [HCoV-OC43]
ggaauccugacgagcccca

SEQ ID NO: 3947511 - RNA, 22 nt, Human coronavirus OC43 [HCoV-OC43]
ggaugccacuaaaccucagcaa

SEQ ID NO: 3947512 - RNA, 16 nt, Human coronavirus OC43 [HCoV-OC43]
ggcucaggaaggucug

SEQ ID NO: 3947513 - RNA, 23 nt, Human coronavirus OC43 [HCoV-OC43]
guaauauggaggaguuuauucaa

SEQ ID NO: 3947514 - RNA, 18 nt, Human coronavirus OC43 [HCoV-OC43]
guaauccaaacauuauga

SEQ ID NO: 3947515 - RNA, 20 nt, Human coronavirus OC43 [HCoV-OC43]
guaauccaaacauuaugagu

SEQ ID NO: 3947516 - RNA, 16 nt, Human coronavirus OC43 [HCoV-OC43]
guagaaggacaaggug

SEQ ID NO: 3947517 - RNA, 19 nt, Human coronavirus OC43 [HCoV-OC43]
guagagcguccucuggaaa

SEQ ID NO: 3947518 - RNA, 19 nt, Human coronavirus OC43 [HCoV-OC43]
guaucgcagccuuacuuuu

SEQ ID NO: 3947519 - RNA, 15 nt, Human coronavirus OC43 [HCoV-OC43]
gucaauauuauuuua

SEQ ID NO: 3947520 - RNA, 16 nt, Human coronavirus OC43 [HCoV-OC43]
gugcugaaugagaauu

SEQ ID NO: 3947521 - RNA, 15 nt, Human coronavirus OC43 [HCoV-OC43]
guggucauaagaaug

SEQ ID NO: 3947522 - RNA, 19 nt, Human coronavirus OC43 [HCoV-OC43]
gugucaaaagccaaucauc

SEQ ID NO: 3947523 - RNA, 18 nt, Human coronavirus OC43 [HCoV-OC43]
guuacuauauugaaggcu

SEQ ID NO: 3947524 - RNA, 18 nt, Human coronavirus OC43 [HCoV-OC43]
guuaucgguuuacuaauu

SEQ ID NO: 3947525 - RNA, 15 nt, Human coronavirus OC43 [HCoV-OC43]
guucugguaauggca

SEQ ID NO: 3947526 - RNA, 13 nt, Human coronavirus OC43 [HCoV-OC43]
guucuuuuaaaac

SEQ ID NO: 3947527 - RNA, 18 nt, Human coronavirus OC43 [HCoV-OC43]
guuuagaaauguucaaac

SEQ ID NO: 3947528 - RNA, 20 nt, Human coronavirus OC43 [HCoV-OC43]
guuuuacuagcauacuuagu

SEQ ID NO: 3947529 - RNA, 16 nt, Human coronavirus OC43 [HCoV-OC43]
uaaauuucugugguaa

SEQ ID NO: 3947530 - RNA, 19 nt, Human coronavirus OC43 [HCoV-OC43]
uaauguguaucuuggccuu

SEQ ID NO: 3947531 - RNA, 18 nt, Human coronavirus OC43 [HCoV-OC43]
uacugaagcuaaggggua

SEQ ID NO: 3947532 - RNA, 11 nt, Human coronavirus OC43 [HCoV-OC43]
uagaaauguuc

SEQ ID NO: 3947533 - RNA, 15 nt, Human coronavirus OC43 [HCoV-OC43]
uagugacccacaguu

SEQ ID NO: 3947534 - RNA, 17 nt, Human coronavirus OC43 [HCoV-OC43]
uauaacuauagguagua

SEQ ID NO: 3947535 - RNA, 18 nt, Human coronavirus OC43 [HCoV-OC43]
uauaaguacugauacugu

SEQ ID NO: 3947536 - RNA, 19 nt, Human coronavirus OC43 [HCoV-OC43]
uauauugaaggcucaggaa

SEQ ID NO: 3947537 - RNA, 21 nt, Human coronavirus OC43 [HCoV-OC43]
uaucaacccccauaauuauuc

SEQ ID NO: 3947538 - RNA, 15 nt, Human coronavirus OC43 [HCoV-OC43]
uaucagguuguuuau

SEQ ID NO: 3947539 - RNA, 13 nt, Human coronavirus OC43 [HCoV-OC43]
uauuaauggacau

SEQ ID NO: 3947540 - RNA, 21 nt, Human coronavirus OC43 [HCoV-OC43]
uauucaaacaagcucuccuaa

SEQ ID NO: 3947541 - RNA, 19 nt, Human coronavirus OC43 [HCoV-OC43]
ucaagcuguuguuaaugca

SEQ ID NO: 3947542 - RNA, 17 nt, Human coronavirus OC43 [HCoV-OC43]
ucacacuauuaugucau

SEQ ID NO: 3947543 - RNA, 19 nt, Human coronavirus OC43 [HCoV-OC43]
uccugacgagccccagaag

SEQ ID NO: 3947544 - RNA, 13 nt, Human coronavirus OC43 [HCoV-OC43]
ucgcacccacagc

SEQ ID NO: 3947545 - RNA, 14 nt, Human coronavirus OC43 [HCoV-OC43]
ucuuucugauuuua

SEQ ID NO: 3947546 - RNA, 18 nt, Human coronavirus OC43 [HCoV-OC43]
ugaaugaaguuaauuaug

SEQ ID NO: 3947547 - RNA, 17 nt, Human coronavirus OC43 [HCoV-OC43]
ugccacuaaaccucagc

SEQ ID NO: 3947548 - RNA, 17 nt, Human coronavirus OC43 [HCoV-OC43]
ugcccaagggaagagcc

SEQ ID NO: 3947549 - RNA, 13 nt, Human coronavirus OC43 [HCoV-OC43]
uggagaaauguua

SEQ ID NO: 3947550 - RNA, 21 nt, Human coronavirus OC43 [HCoV-OC43]
uggcuauucuuuggcagauuu

SEQ ID NO: 3947551 - RNA, 16 nt, Human coronavirus OC43 [HCoV-OC43]
uguaauguauaguguu

SEQ ID NO: 3947552 - RNA, 17 nt, Human coronavirus OC43 [HCoV-OC43]
ugucucagaauuagaag

SEQ ID NO: 3947553 - RNA, 17 nt, Human coronavirus OC43 [HCoV-OC43]
uguguauuuaaauacua

SEQ ID NO: 3947554 - RNA, 20 nt, Human coronavirus OC43 [HCoV-OC43]
uuaacuaucaauuuccuaaa

SEQ ID NO: 3947555 - RNA, 14 nt, Human coronavirus OC43 [HCoV-OC43]
uuaacuugugauaa

SEQ ID NO: 3947556 - RNA, 17 nt, Human coronavirus OC43 [HCoV-OC43]
uuaagaugauuauuuug

SEQ ID NO: 3947557 - RNA, 15 nt, Human coronavirus OC43 [HCoV-OC43]
uuaauuauggccaau

SEQ ID NO: 3947558 - RNA, 16 nt, Human coronavirus OC43 [HCoV-OC43]
uuaauuucaauguaga

SEQ ID NO: 3947559 - RNA, 22 nt, Human coronavirus OC43 [HCoV-OC43]
uuagaccauaaucuaaacaugu

SEQ ID NO: 3947560 - RNA, 22 nt, Human coronavirus OC43 [HCoV-OC43]
uuauauggaccuuaauccuguu

SEQ ID NO: 3947561 - RNA, 22 nt, Human coronavirus OC43 [HCoV-OC43]
uuauguggauuguguauuuugu

SEQ ID NO: 3947562 - RNA, 19 nt, Human coronavirus OC43 [HCoV-OC43]
uuauguuaaguccaaaguc

SEQ ID NO: 3947563 - RNA, 14 nt, Human coronavirus OC43 [HCoV-OC43]
uucaacccagaaac

SEQ ID NO: 3947564 - RNA, 22 nt, Human coronavirus OC43 [HCoV-OC43]
uucaacuuugcgguauguguaa

SEQ ID NO: 3947565 - RNA, 22 nt, Human coronavirus OC43 [HCoV-OC43]
uugaauaagccccgccagaaga

SEQ ID NO: 3947566 - RNA, 15 nt, Human coronavirus OC43 [HCoV-OC43]
uugaauaauguguau

SEQ ID NO: 3947567 - RNA, 17 nt, Human coronavirus OC43 [HCoV-OC43]
uugcagugcccaaaagc

SEQ ID NO: 3947568 - RNA, 12 nt, Human coronavirus OC43 [HCoV-OC43]
uuguuaaugcaa

SEQ ID NO: 3947569 - RNA, 15 nt, Human coronavirus OC43 [HCoV-OC43]
uuugaguuuguagaa

SEQ ID NO: 3947570 - RNA, 12 nt, Human coronavirus OC43 [HCoV-OC43]
cauugcuauuuc

SEQ ID NO: 3947571 - RNA, 22 nt, Human coronavirus OC43 [HCoV-OC43]
ccagcaccaguuuauaucugga

SEQ ID NO: 3947572 - RNA, 20 nt, Human coronavirus OC43 [HCoV-OC43]
ccuauuaauggacauuugga

SEQ ID NO: 3947573 - RNA, 20 nt, Human coronavirus OC43 [HCoV-OC43]
cgcauugaauaauguguauc

SEQ ID NO: 3947574 - RNA, 19 nt, Human coronavirus OC43 [HCoV-OC43]
cuaagcauacugccaaaga

SEQ ID NO: 3947575 - RNA, 16 nt, Human coronavirus OC43 [HCoV-OC43]
cuaaucagaauuuugg

SEQ ID NO: 3947576 - RNA, 17 nt, Human coronavirus OC43 [HCoV-OC43]
cuauaaaaguguugaug

SEQ ID NO: 3947577 - RNA, 19 nt, Human coronavirus OC43 [HCoV-OC43]
cuauggagaagguuaauga

SEQ ID NO: 3947578 - RNA, 17 nt, Human coronavirus OC43 [HCoV-OC43]
cuauguugguguuuaug

SEQ ID NO: 3947579 - RNA, 23 nt, Human coronavirus OC43 [HCoV-OC43]
cucaguuucaaaagggaaaggag

SEQ ID NO: 3947580 - RNA, 15 nt, Human coronavirus OC43 [HCoV-OC43]
cuccuauaaguacug

SEQ ID NO: 3947581 - RNA, 19 nt, Human coronavirus OC43 [HCoV-OC43]
cucucuaucagaauggaug

SEQ ID NO: 3947582 - RNA, 19 nt, Human coronavirus OC43 [HCoV-OC43]
cugcagguacuaauuauuu

SEQ ID NO: 3947583 - RNA, 20 nt, Human coronavirus OC43 [HCoV-OC43]
cugcuauagaggauuuacuu

SEQ ID NO: 3947584 - RNA, 16 nt, Human coronavirus OC43 [HCoV-OC43]
cugggucgcuagcaac

SEQ ID NO: 3947585 - RNA, 19 nt, Human coronavirus OC43 [HCoV-OC43]
cugguacagacacaacaga

SEQ ID NO: 3947586 - RNA, 20 nt, Human coronavirus OC43 [HCoV-OC43]
cuguucgggucuugcuguua

SEQ ID NO: 3947587 - RNA, 17 nt, Human coronavirus OC43 [HCoV-OC43]
cuuccaguagaucugcu

SEQ ID NO: 3947588 - RNA, 15 nt, Human coronavirus OC43 [HCoV-OC43]
cuugcuguuaaaagu

SEQ ID NO: 3947589 - RNA, 22 nt, Human coronavirus OC43 [HCoV-OC43]
cuugguguuuguguuaauuaug

SEQ ID NO: 3947590 - RNA, 13 nt, Human coronavirus OC43 [HCoV-OC43]
gaaaaguuuucau

SEQ ID NO: 3947591 - RNA, 15 nt, Human coronavirus OC43 [HCoV-OC43]
gaaaaugauaauaua

SEQ ID NO: 3947592 - RNA, 16 nt, Human coronavirus OC43 [HCoV-OC43]
gaauggaauuuuucuu

SEQ ID NO: 3947593 - RNA, 19 nt, Human coronavirus OC43 [HCoV-OC43]
gacaagugcccaagggaag

SEQ ID NO: 3947594 - RNA, 15 nt, Human coronavirus OC43 [HCoV-OC43]
gagaaauaauaucua

SEQ ID NO: 3947595 - RNA, 16 nt, Human coronavirus OC43 [HCoV-OC43]
gagcguccucuggaaa

SEQ ID NO: 3947596 - RNA, 16 nt, Human coronavirus OC43 [HCoV-OC43]
gaggcaauucuuguac

SEQ ID NO: 3947597 - RNA, 21 nt, Human coronavirus OC43 [HCoV-OC43]
gauacagguguuguuuccugu

SEQ ID NO: 3947598 - RNA, 15 nt, Human coronavirus OC43 [HCoV-OC43]
gauacuagugguuuu

SEQ ID NO: 3947599 - RNA, 20 nt, Human coronavirus OC43 [HCoV-OC43]
gauaugaaaggaacaaugua

SEQ ID NO: 3947600 - RNA, 16 nt, Human coronavirus OC43 [HCoV-OC43]
gaugguaugaugaaua

SEQ ID NO: 3947601 - RNA, 19 nt, Human coronavirus OC43 [HCoV-OC43]
gauuauauaaauguuacau

SEQ ID NO: 3947602 - RNA, 17 nt, Human coronavirus OC43 [HCoV-OC43]
gcacaacacuguuucaa

SEQ ID NO: 3947603 - RNA, 16 nt, Human coronavirus OC43 [HCoV-OC43]
gcagugcccaaaagcc

SEQ ID NO: 3947604 - RNA, 22 nt, Human coronavirus OC43 [HCoV-OC43]
gcauucgcuaauacuguagagg

SEQ ID NO: 3947605 - RNA, 15 nt, Human coronavirus OC43 [HCoV-OC43]
gccaauucuggcaau

SEQ ID NO: 3947606 - RNA, 17 nt, Human coronavirus OC43 [HCoV-OC43]
gccuuacuuuuguuaau

SEQ ID NO: 3947607 - RNA, 17 nt, Human coronavirus OC43 [HCoV-OC43]
gcuaagggguacuggua

SEQ ID NO: 3947608 - RNA, 15 nt, Human coronavirus OC43 [HCoV-OC43]
gcuaccucucagcaa

SEQ ID NO: 3947609 - RNA, 18 nt, Human coronavirus OC43 [HCoV-OC43]
gcuagucuuguucuggca

SEQ ID NO: 3947610 - RNA, 20 nt, Human coronavirus OC43 [HCoV-OC43]
gcuagucuuguucuggcaaa

SEQ ID NO: 3947611 - RNA, 20 nt, Human coronavirus OC43 [HCoV-OC43]
gcuaugcuuguuuuacuauu

SEQ ID NO: 3947612 - RNA, 20 nt, Human coronavirus OC43 [HCoV-OC43]
gcucuccuaaaguuacuauu

SEQ ID NO: 3947613 - RNA, 18 nt, Human coronavirus OC43 [HCoV-OC43]
ggaucgcguaguagagcc

SEQ ID NO: 3947614 - RNA, 14 nt, Human coronavirus OC43 [HCoV-OC43]
ggcaucugguggua

SEQ ID NO: 3947615 - RNA, 19 nt, Human coronavirus OC43 [HCoV-OC43]
ggugcccucuccauuaaau

SEQ ID NO: 3947616 - RNA, 12 nt, Human coronavirus OC43 [HCoV-OC43]
gguucucuggaa

SEQ ID NO: 3947617 - RNA, 14 nt, Human coronavirus OC43 [HCoV-OC43]
gguucucuggaauu

SEQ ID NO: 3947618 - RNA, 19 nt, Human coronavirus OC43 [HCoV-OC43]
gguuuuaaugucucagaau

SEQ ID NO: 3947619 - RNA, 24 nt, Human coronavirus OC43 [HCoV-OC43]
guaaauaauacuuggauguacacu

SEQ ID NO: 3947620 - RNA, 19 nt, Human coronavirus OC43 [HCoV-OC43]
guaccacuuuguauuuuua

SEQ ID NO: 3947621 - RNA, 19 nt, Human coronavirus OC43 [HCoV-OC43]
guacuggcuauucuuuggc

SEQ ID NO: 3947622 - RNA, 23 nt, Human coronavirus OC43 [HCoV-OC43]
guaguacaaccacguacaaucaa

SEQ ID NO: 3947623 - RNA, 22 nt, Human coronavirus OC43 [HCoV-OC43]
guaucagguuguuuauuagaac

SEQ ID NO: 3947624 - RNA, 15 nt, Human coronavirus OC43 [HCoV-OC43]
guaugagugauuuua

SEQ ID NO: 3947625 - RNA, 17 nt, Human coronavirus OC43 [HCoV-OC43]
gucccagcuacugaagc

SEQ ID NO: 3947626 - RNA, 17 nt, Human coronavirus OC43 [HCoV-OC43]
gucugcagacucuuguu

SEQ ID NO: 3947627 - RNA, 14 nt, Human coronavirus OC43 [HCoV-OC43]
guggcauuuuuggc

SEQ ID NO: 3947628 - RNA, 18 nt, Human coronavirus OC43 [HCoV-OC43]
gugguaaugguaaucaua

SEQ ID NO: 3947629 - RNA, 22 nt, Human coronavirus OC43 [HCoV-OC43]
gugugccuauugcaccaggagu

SEQ ID NO: 3947630 - RNA, 16 nt, Human coronavirus OC43 [HCoV-OC43]
guuaaugcgacuuauu

SEQ ID NO: 3947631 - RNA, 18 nt, Human coronavirus OC43 [HCoV-OC43]
guuaaugcgacuuauuau

SEQ ID NO: 3947632 - RNA, 22 nt, Human coronavirus OC43 [HCoV-OC43]
guuaauuauggccaauuggaag

SEQ ID NO: 3947633 - RNA, 21 nt, Human coronavirus OC43 [HCoV-OC43]
guuaauuuuacgccuuaucau

SEQ ID NO: 3947634 - RNA, 22 nt, Human coronavirus OC43 [HCoV-OC43]
guuacacaccugugcacauaua

SEQ ID NO: 3947635 - RNA, 15 nt, Human coronavirus OC43 [HCoV-OC43]
guuacuauauugaag

SEQ ID NO: 3947636 - RNA, 22 nt, Human coronavirus OC43 [HCoV-OC43]
guucagcaguguuuugguaaga

SEQ ID NO: 3947637 - RNA, 19 nt, Human coronavirus OC43 [HCoV-OC43]
guuuauuagaacuggaagu

SEQ ID NO: 3947638 - RNA, 13 nt, Human coronavirus OC43 [HCoV-OC43]
guuuugagaccau

SEQ ID NO: 3947639 - RNA, 20 nt, Human coronavirus OC43 [HCoV-OC43]
uaaacauguuuuugauacuu

SEQ ID NO: 3947640 - RNA, 18 nt, Human coronavirus OC43 [HCoV-OC43]
uaaauuccuaaaggaaug

SEQ ID NO: 3947641 - RNA, 21 nt, Human coronavirus OC43 [HCoV-OC43]
uaacaaugcccuuuaugcuau

SEQ ID NO: 3947642 - RNA, 16 nt, Human coronavirus OC43 [HCoV-OC43]
uaagaauggacaagga

SEQ ID NO: 3947643 - RNA, 14 nt, Human coronavirus OC43 [HCoV-OC43]
uaauuaguugaaag

SEQ ID NO: 3947644 - RNA, 19 nt, Human coronavirus OC43 [HCoV-OC43]
uaggcagcgaauguaguaa

SEQ ID NO: 3947645 - RNA, 18 nt, Human coronavirus OC43 [HCoV-OC43]
uagguagugguuacugug

SEQ ID NO: 3947646 - RNA, 17 nt, Human coronavirus OC43 [HCoV-OC43]
uaguggcauuuuuggca

SEQ ID NO: 3947647 - RNA, 20 nt, Human coronavirus OC43 [HCoV-OC43]
uaugaguccaaaaccacagc

SEQ ID NO: 3947648 - RNA, 15 nt, Human coronavirus OC43 [HCoV-OC43]
uauuuugcaugaugu

SEQ ID NO: 3947649 - RNA, 23 nt, Human coronavirus OC43 [HCoV-OC43]
uccagcagagccucuagugcagg

SEQ ID NO: 3947650 - RNA, 20 nt, Human coronavirus OC43 [HCoV-OC43]
ucuaggcagcgaauguagua

SEQ ID NO: 3947651 - RNA, 14 nt, Human coronavirus OC43 [HCoV-OC43]
ugagccauuuacug

SEQ ID NO: 3947652 - RNA, 13 nt, Human coronavirus OC43 [HCoV-OC43]
ugagguuaaugcg

SEQ ID NO: 3947653 - RNA, 17 nt, Human coronavirus OC43 [HCoV-OC43]
ugauucguaguugcuau

SEQ ID NO: 3947654 - RNA, 14 nt, Human coronavirus OC43 [HCoV-OC43]
ugccacgaugguau

SEQ ID NO: 3947655 - RNA, 17 nt, Human coronavirus OC43 [HCoV-OC43]
ugcgauuguaauuauug

SEQ ID NO: 3947656 - RNA, 15 nt, Human coronavirus OC43 [HCoV-OC43]
ugcuuguuuuacuau

SEQ ID NO: 3947657 - RNA, 19 nt, Human coronavirus OC43 [HCoV-OC43]
uguacuucagauacuaguu

SEQ ID NO: 3947658 - RNA, 23 nt, Human coronavirus OC43 [HCoV-OC43]
uguaguuuaugcacaacacuguu

SEQ ID NO: 3947659 - RNA, 19 nt, Human coronavirus OC43 [HCoV-OC43]
uguauagauaugaaaggaa

SEQ ID NO: 3947660 - RNA, 13 nt, Human coronavirus OC43 [HCoV-OC43]
ugucucagaauua

SEQ ID NO: 3947661 - RNA, 13 nt, Human coronavirus OC43 [HCoV-OC43]
uguucuacugauu

SEQ ID NO: 3947662 - RNA, 21 nt, Human coronavirus OC43 [HCoV-OC43]
uguucuuacuaaucaugaugu

SEQ ID NO: 3947663 - RNA, 23 nt, Human coronavirus OC43 [HCoV-OC43]
aaacaaugcacuguucagcagug

SEQ ID NO: 3947664 - RNA, 14 nt, Human coronavirus OC43 [HCoV-OC43]
aaacugguuuucuu

SEQ ID NO: 3947665 - RNA, 21 nt, Human coronavirus OC43 [HCoV-OC43]
aaagcuccuaaaaauuucugu

SEQ ID NO: 3947666 - RNA, 14 nt, Human coronavirus OC43 [HCoV-OC43]
aaagugauuauugu

SEQ ID NO: 3947667 - RNA, 16 nt, Human coronavirus OC43 [HCoV-OC43]
aacagaacuuuuauga

SEQ ID NO: 3947668 - RNA, 14 nt, Human coronavirus OC43 [HCoV-OC43]
aacggcuuuugcug

SEQ ID NO: 3947669 - RNA, 15 nt, Human coronavirus OC43 [HCoV-OC43]
aacuaagcauacugc

SEQ ID NO: 3947670 - RNA, 20 nt, Human coronavirus OC43 [HCoV-OC43]
aacugcugccacgaugguau

SEQ ID NO: 3947671 - RNA, 15 nt, Human coronavirus OC43 [HCoV-OC43]
aagaaugguuuuacu

SEQ ID NO: 3947672 - RNA, 15 nt, Human coronavirus OC43 [HCoV-OC43]
aagccgcgugcagca

SEQ ID NO: 3947673 - RNA, 17 nt, Human coronavirus OC43 [HCoV-OC43]
aaggaaaauguugauuu

SEQ ID NO: 3947674 - RNA, 17 nt, Human coronavirus OC43 [HCoV-OC43]
aagucgcaguauguuug

SEQ ID NO: 3947675 - RNA, 23 nt, Human coronavirus OC43 [HCoV-OC43]
aauaugagcagccugaugucuuu

SEQ ID NO: 3947676 - RNA, 20 nt, Human coronavirus OC43 [HCoV-OC43]
aaucugccuugcugguguag

SEQ ID NO: 3947677 - RNA, 21 nt, Human coronavirus OC43 [HCoV-OC43]
aauggaauuuuucuuugggua

SEQ ID NO: 3947678 - RNA, 16 nt, Human coronavirus OC43 [HCoV-OC43]
aaugguauuuuugcua

SEQ ID NO: 3947679 - RNA, 15 nt, Human coronavirus OC43 [HCoV-OC43]
aauuauuuuuuauga

SEQ ID NO: 3947680 - RNA, 19 nt, Human coronavirus OC43 [HCoV-OC43]
aauuguaauuuuaauauga

SEQ ID NO: 3947681 - RNA, 23 nt, Human coronavirus OC43 [HCoV-OC43]
acaagcucuccuaaaguuacuau

SEQ ID NO: 3947682 - RNA, 13 nt, Human coronavirus OC43 [HCoV-OC43]
acaagugcccaag

SEQ ID NO: 3947683 - RNA, 19 nt, Human coronavirus OC43 [HCoV-OC43]
accagggguagaagagcuc

SEQ ID NO: 3947684 - RNA, 14 nt, Human coronavirus OC43 [HCoV-OC43]
acuaagcuuaaaga

SEQ ID NO: 3947685 - RNA, 23 nt, Human coronavirus OC43 [HCoV-OC43]
acuaauuuugagccauuuacugu

SEQ ID NO: 3947686 - RNA, 14 nt, Human coronavirus OC43 [HCoV-OC43]
acuaggcugcauga

SEQ ID NO: 3947687 - RNA, 18 nt, Human coronavirus OC43 [HCoV-OC43]
agaacucgcacccacagc

SEQ ID NO: 3947688 - RNA, 15 nt, Human coronavirus OC43 [HCoV-OC43]
agaagaggagcccca

SEQ ID NO: 3947689 - RNA, 17 nt, Human coronavirus OC43 [HCoV-OC43]
agaauauuggguuacac

SEQ ID NO: 3947690 - RNA, 17 nt, Human coronavirus OC43 [HCoV-OC43]
agaauuagaagaugcuu

SEQ ID NO: 3947691 - RNA, 17 nt, Human coronavirus OC43 [HCoV-OC43]
agacacugguguuauuu

SEQ ID NO: 3947692 - RNA, 17 nt, Human coronavirus OC43 [HCoV-OC43]
agagccaauucuggcaa

SEQ ID NO: 3947693 - RNA, 17 nt, Human coronavirus OC43 [HCoV-OC43]
agagugguuauuuuguu

SEQ ID NO: 3947694 - RNA, 16 nt, Human coronavirus OC43 [HCoV-OC43]
agaucuuuuugcaauc

SEQ ID NO: 3947695 - RNA, 20 nt, Human coronavirus OC43 [HCoV-OC43]
agcgccacacauuagucuua

SEQ ID NO: 3947696 - RNA, 15 nt, Human coronavirus OC43 [HCoV-OC43]
agcgccguauguaau

SEQ ID NO: 3947697 - RNA, 14 nt, Human coronavirus OC43 [HCoV-OC43]
agcgugguuuucuu

SEQ ID NO: 3947698 - RNA, 20 nt, Human coronavirus OC43 [HCoV-OC43]
agcuccuaaaaauuucuguc

SEQ ID NO: 3947699 - RNA, 19 nt, Human coronavirus OC43 [HCoV-OC43]
agcuguuguuaaugcaaau

SEQ ID NO: 3947700 - RNA, 13 nt, Human coronavirus OC43 [HCoV-OC43]
agcuuauaugacu

SEQ ID NO: 3947701 - RNA, 23 nt, Human coronavirus OC43 [HCoV-OC43]
agcuuauugcuaaugcauuuaac

SEQ ID NO: 3947702 - RNA, 20 nt, Human coronavirus OC43 [HCoV-OC43]
aggcacucucuaucagaaug

SEQ ID NO: 3947703 - RNA, 23 nt, Human coronavirus OC43 [HCoV-OC43]
aggcgaaggucaacaaauuauuu

SEQ ID NO: 3947704 - RNA, 15 nt, Human coronavirus OC43 [HCoV-OC43]
agguacuaauuauuu

SEQ ID NO: 3947705 - RNA, 16 nt, Human coronavirus OC43 [HCoV-OC43]
agucauuuaacuauag

SEQ ID NO: 3947706 - RNA, 17 nt, Human coronavirus OC43 [HCoV-OC43]
aguccaaaaccacagcg

SEQ ID NO: 3947707 - RNA, 22 nt, Human coronavirus OC43 [HCoV-OC43]
agucgcaguauguuuguuuaug

SEQ ID NO: 3947708 - RNA, 12 nt, Human coronavirus OC43 [HCoV-OC43]
aguuaaauguuu

SEQ ID NO: 3947709 - RNA, 19 nt, Human coronavirus OC43 [HCoV-OC43]
auaagaauggacaaggaga

SEQ ID NO: 3947710 - RNA, 16 nt, Human coronavirus OC43 [HCoV-OC43]
auaagaguagagaguu

SEQ ID NO: 3947711 - RNA, 17 nt, Human coronavirus OC43 [HCoV-OC43]
auaauauugaugcugcu

SEQ ID NO: 3947712 - RNA, 14 nt, Human coronavirus OC43 [HCoV-OC43]
auacagguguuguu

SEQ ID NO: 3947713 - RNA, 22 nt, Human coronavirus OC43 [HCoV-OC43]
auacgcauugaauaauguguau

SEQ ID NO: 3947714 - RNA, 22 nt, Human coronavirus OC43 [HCoV-OC43]
auacugaagacaccucagaaau

SEQ ID NO: 3947715 - RNA, 19 nt, Human coronavirus OC43 [HCoV-OC43]
auaucguaccacuuuguau

SEQ ID NO: 3947716 - RNA, 23 nt, Human coronavirus OC43 [HCoV-OC43]
aucagaauggaugucuugcugcu

SEQ ID NO: 3947717 - RNA, 18 nt, Human coronavirus OC43 [HCoV-OC43]
aucgguuuacuaauuuug

SEQ ID NO: 3947718 - RNA, 15 nt, Human coronavirus OC43 [HCoV-OC43]
augaauagguuacag

SEQ ID NO: 3947719 - RNA, 20 nt, Human coronavirus OC43 [HCoV-OC43]
augauguaaaaccaccaguc

SEQ ID NO: 3947720 - RNA, 14 nt, Human coronavirus OC43 [HCoV-OC43]
augaugugaaugcu

SEQ ID NO: 3947721 - RNA, 17 nt, Human coronavirus OC43 [HCoV-OC43]
auggcauuuggauacag

SEQ ID NO: 3947722 - RNA, 18 nt, Human coronavirus OC43 [HCoV-OC43]
augggaauucguuuugaa

SEQ ID NO: 3947723 - RNA, 16 nt, Human coronavirus OC43 [HCoV-OC43]
augguaugaugaauau

SEQ ID NO: 3947724 - RNA, 12 nt, Human coronavirus OC43 [HCoV-OC43]
auguauggcuuu

SEQ ID NO: 3947725 - RNA, 15 nt, Human coronavirus OC43 [HCoV-OC43]
auuaaacgguuacac

SEQ ID NO: 3947726 - RNA, 14 nt, Human coronavirus OC43 [HCoV-OC43]
auuaguugaaaguu

SEQ ID NO: 3947727 - RNA, 17 nt, Human coronavirus OC43 [HCoV-OC43]
auuauaauuuaccugcu

SEQ ID NO: 3947728 - RNA, 20 nt, Human coronavirus OC43 [HCoV-OC43]
auuaugauaaauauuuugga

SEQ ID NO: 3947729 - RNA, 15 nt, Human coronavirus OC43 [HCoV-OC43]
auuauuguaguuuug

SEQ ID NO: 3947730 - RNA, 18 nt, Human coronavirus OC43 [HCoV-OC43]
auucaagaaguuauugau

SEQ ID NO: 3947731 - RNA, 17 nt, Human coronavirus OC43 [HCoV-OC43]
auuguguauuuugugaa

SEQ ID NO: 3947732 - RNA, 15 nt, Human coronavirus OC43 [HCoV-OC43]
auuuuuacuaucugg

SEQ ID NO: 3947733 - RNA, 21 nt, Human coronavirus OC43 [HCoV-OC43]
auuuuuggguuggucugcaga

SEQ ID NO: 3947734 - RNA, 16 nt, Human coronavirus OC43 [HCoV-OC43]
caaaauaagaguagag

SEQ ID NO: 3947735 - RNA, 21 nt, Human coronavirus OC43 [HCoV-OC43]
caacaagaugguaugaugaau

SEQ ID NO: 3947736 - RNA, 15 nt, Human coronavirus OC43 [HCoV-OC43]
caacuaauucugcuu

SEQ ID NO: 3947737 - RNA, 15 nt, Human coronavirus OC43 [HCoV-OC43]
caacuugauguguau

SEQ ID NO: 3947738 - RNA, 21 nt, Human coronavirus OC43 [HCoV-OC43]
caagaaauucuaucuagacuu

SEQ ID NO: 3947739 - RNA, 20 nt, Human coronavirus OC43 [HCoV-OC43]
caaucauauugcaauuugga

SEQ ID NO: 3947740 - RNA, 19 nt, Human coronavirus OC43 [HCoV-OC43]
cacccaguaauuaguaaau

SEQ ID NO: 3947741 - RNA, 22 nt, Human coronavirus OC43 [HCoV-OC43]
cagaauuuaucugggaauccug

SEQ ID NO: 3947742 - RNA, 21 nt, Human coronavirus OC43 [HCoV-OC43]
caggaucgcguaguagagcca

SEQ ID NO: 3947743 - RNA, 18 nt, Human coronavirus OC43 [HCoV-OC43]
cagggguagaagagcuca

SEQ ID NO: 3947744 - RNA, 16 nt, Human coronavirus OC43 [HCoV-OC43]
caguagaucugcuaua

SEQ ID NO: 3947745 - RNA, 12 nt, Human coronavirus OC43 [HCoV-OC43]
cagugcccaaaa

SEQ ID NO: 3947746 - RNA, 22 nt, Human coronavirus OC43 [HCoV-OC43]
cauaaugaaggugcugaaugag

SEQ ID NO: 3947747 - RNA, 21 nt, Human coronavirus OC43 [HCoV-OC43]
cauuaugauaaauauuuugga

SEQ ID NO: 3947748 - RNA, 16 nt, Human coronavirus OC43 [HCoV-OC43]
cauuauuauguggauu

SEQ ID NO: 3947749 - RNA, 17 nt, Human coronavirus OC43 [HCoV-OC43]
ccaguuuagaaauguuc

SEQ ID NO: 3947750 - RNA, 21 nt, Human coronavirus OC43 [HCoV-OC43]
ccauaauuauucuuauaugga

SEQ ID NO: 3947751 - RNA, 20 nt, Human coronavirus OC43 [HCoV-OC43]
ccgccagaagaggagcccca

SEQ ID NO: 3947752 - RNA, 16 nt, Human coronavirus OC43 [HCoV-OC43]
ccuacugguguuuaug

SEQ ID NO: 3947753 - RNA, 16 nt, Human coronavirus OC43 [HCoV-OC43]
cuaaguuuuuguuuaa

SEQ ID NO: 3947754 - RNA, 13 nt, Human coronavirus OC43 [HCoV-OC43]
cuagguacuggcu

SEQ ID NO: 3947755 - RNA, 21 nt, Human coronavirus OC43 [HCoV-OC43]
cuagugguuuugcuguuuaug

SEQ ID NO: 3947756 - RNA, 17 nt, Human coronavirus OC43 [HCoV-OC43]
cuaguuagcugcauaau

SEQ ID NO: 3947757 - RNA, 20 nt, Human coronavirus OC43 [HCoV-OC43]
cuauagcggucguguuucug

SEQ ID NO: 3947758 - RNA, 11 nt, Human coronavirus OC43 [HCoV-OC43]
cucauuuacuu

SEQ ID NO: 3947759 - RNA, 15 nt, Human coronavirus OC43 [HCoV-OC43]
cucugguaauuauuu

SEQ ID NO: 3947760 - RNA, 15 nt, Human coronavirus OC43 [HCoV-OC43]
cucuuguuuacaagg

SEQ ID NO: 3947761 - RNA, 17 nt, Human coronavirus OC43 [HCoV-OC43]
cugaaaagaaagauggu

SEQ ID NO: 3947762 - RNA, 15 nt, Human coronavirus OC43 [HCoV-OC43]
cugauacuguugaug

SEQ ID NO: 3947763 - RNA, 21 nt, Human coronavirus OC43 [HCoV-OC43]
cugauacuguugauguuacua

SEQ ID NO: 3947764 - RNA, 12 nt, Human coronavirus OC43 [HCoV-OC43]
cugcugaugaag

SEQ ID NO: 3947765 - RNA, 15 nt, Human coronavirus OC43 [HCoV-OC43]
cugguuuuacuagca

SEQ ID NO: 3947766 - RNA, 13 nt, Human coronavirus OC43 [HCoV-OC43]
cuugauguggaug

SEQ ID NO: 3947767 - RNA, 14 nt, Human coronavirus OC43 [HCoV-OC43]
cuuguucuggcaaa

SEQ ID NO: 3947768 - RNA, 14 nt, Human coronavirus OC43 [HCoV-OC43]
cuuguuuacaagga

SEQ ID NO: 3947769 - RNA, 18 nt, Human coronavirus OC43 [HCoV-OC43]
cuuguuuuacuauucuuc

SEQ ID NO: 3947770 - RNA, 16 nt, Human coronavirus OC43 [HCoV-OC43]
gacaagccuaaucauu

SEQ ID NO: 3947771 - RNA, 12 nt, Human coronavirus OC43 [HCoV-OC43]
gacaagugccca

SEQ ID NO: 3947772 - RNA, 12 nt, Human coronavirus OC43 [HCoV-OC43]
gagaagaaauau

SEQ ID NO: 3947773 - RNA, 18 nt, Human coronavirus OC43 [HCoV-OC43]
gaucuuaauuguuauuau

SEQ ID NO: 3947774 - RNA, 16 nt, Human coronavirus OC43 [HCoV-OC43]
gaugucuuuuauucag

SEQ ID NO: 3947775 - RNA, 16 nt, Human coronavirus OC43 [HCoV-OC43]
gaugugaaugcugauu

SEQ ID NO: 3947776 - RNA, 13 nt, Human coronavirus OC43 [HCoV-OC43]
gauugugcugcau

SEQ ID NO: 3947777 - RNA, 17 nt, Human coronavirus OC43 [HCoV-OC43]
gcaccagauuugucacu

SEQ ID NO: 3947778 - RNA, 17 nt, Human coronavirus OC43 [HCoV-OC43]
gcagcaaaauaagagua

SEQ ID NO: 3947779 - RNA, 13 nt, Human coronavirus OC43 [HCoV-OC43]
gcagucauuuaac

SEQ ID NO: 3947780 - RNA, 17 nt, Human coronavirus OC43 [HCoV-OC43]
gcauuguugagaaauaa

SEQ ID NO: 3947781 - RNA, 16 nt, Human coronavirus OC43 [HCoV-OC43]
gccacuaaaccucagc

SEQ ID NO: 3947782 - RNA, 14 nt, Human coronavirus OC43 [HCoV-OC43]
gccauuuacuguua

SEQ ID NO: 3947783 - RNA, 17 nt, Human coronavirus OC43 [HCoV-OC43]
gccgacaagugcccaag

SEQ ID NO: 3947784 - RNA, 15 nt, Human coronavirus OC43 [HCoV-OC43]
gcgcaauuagguuug

SEQ ID NO: 3947785 - RNA, 16 nt, Human coronavirus OC43 [HCoV-OC43]
gcgcacauccagcaga

SEQ ID NO: 3947786 - RNA, 23 nt, Human coronavirus OC43 [HCoV-OC43]
gcguaguagagccaauucuggca

SEQ ID NO: 3947787 - RNA, 15 nt, Human coronavirus OC43 [HCoV-OC43]
gcuaauguuucuguu

SEQ ID NO: 3947788 - RNA, 17 nt, Human coronavirus OC43 [HCoV-OC43]
gcuagucuuguucuggc

SEQ ID NO: 3947789 - RNA, 21 nt, Human coronavirus OC43 [HCoV-OC43]
gcuauaagugcuucuuuacaa

SEQ ID NO: 3947790 - RNA, 12 nt, Human coronavirus OC43 [HCoV-OC43]
gcuauuguuaac

SEQ ID NO: 3947791 - RNA, 15 nt, Human coronavirus OC43 [HCoV-OC43]
gcucaacccaagcaa

SEQ ID NO: 3947792 - RNA, 18 nt, Human coronavirus OC43 [HCoV-OC43]
gcuccauaugguuuguau

SEQ ID NO: 3947793 - RNA, 16 nt, Human coronavirus OC43 [HCoV-OC43]
gcugcaugaugcuuag

SEQ ID NO: 3947794 - RNA, 19 nt, Human coronavirus OC43 [HCoV-OC43]
ggcuauuccgacuagguuu

SEQ ID NO: 3947795 - RNA, 14 nt, Human coronavirus OC43 [HCoV-OC43]
gggguagaagagcu

SEQ ID NO: 3947796 - RNA, 19 nt, Human coronavirus OC43 [HCoV-OC43]
guaaauccaaacauuauga

SEQ ID NO: 3947797 - RNA, 17 nt, Human coronavirus OC43 [HCoV-OC43]
guaaucauauuguuaau

SEQ ID NO: 3947798 - RNA, 17 nt, Human coronavirus OC43 [HCoV-OC43]
guagagccaauucuggc

SEQ ID NO: 3947799 - RNA, 17 nt, Human coronavirus OC43 [HCoV-OC43]
guaggauauuguagagu

SEQ ID NO: 3947800 - RNA, 14 nt, Human coronavirus OC43 [HCoV-OC43]
gucuuguucuggca

SEQ ID NO: 3947801 - RNA, 20 nt, Human coronavirus OC43 [HCoV-OC43]
gugcccaagggaagagccag

SEQ ID NO: 3947802 - RNA, 14 nt, Human coronavirus OC43 [HCoV-OC43]
guuaauguaaauaa

SEQ ID NO: 3947803 - RNA, 16 nt, Human coronavirus OC43 [HCoV-OC43]
guucuuacuaaucaug

SEQ ID NO: 3947804 - RNA, 22 nt, Human coronavirus OC43 [HCoV-OC43]
guuguacccuacuauucuuggu

SEQ ID NO: 3947805 - RNA, 19 nt, Human coronavirus OC43 [HCoV-OC43]
guuuaugauauuaaucaug

SEQ ID NO: 3947806 - RNA, 15 nt, Human coronavirus OC43 [HCoV-OC43]
guuuggguacuuauu

SEQ ID NO: 3947807 - RNA, 14 nt, Human coronavirus OC43 [HCoV-OC43]
uaaugguuugggua

SEQ ID NO: 3947808 - RNA, 20 nt, Human coronavirus OC43 [HCoV-OC43]
uacucaguuucaaaagggaa

SEQ ID NO: 3947809 - RNA, 18 nt, Human coronavirus OC43 [HCoV-OC43]
uacuccugguaagcaauc

SEQ ID NO: 3947810 - RNA, 14 nt, Human coronavirus OC43 [HCoV-OC43]
uaguaaaugaauga

SEQ ID NO: 3947811 - RNA, 14 nt, Human coronavirus OC43 [HCoV-OC43]
uagugacccacagu

SEQ ID NO: 3947812 - RNA, 22 nt, Human coronavirus OC43 [HCoV-OC43]
uauaaguguugcagugcccaaa

SEQ ID NO: 3947813 - RNA, 14 nt, Human coronavirus OC43 [HCoV-OC43]
uauguuuguuuaug

SEQ ID NO: 3947814 - RNA, 15 nt, Human coronavirus OC43 [HCoV-OC43]
ucagcaaccaucagg

SEQ ID NO: 3947815 - RNA, 16 nt, Human coronavirus OC43 [HCoV-OC43]
ucauaagaauggacaa

SEQ ID NO: 3947816 - RNA, 13 nt, Human coronavirus OC43 [HCoV-OC43]
ucauuagugcaga

SEQ ID NO: 3947817 - RNA, 23 nt, Human coronavirus OC43 [HCoV-OC43]
uccacauaucguaauauggcacu

SEQ ID NO: 3947818 - RNA, 20 nt, Human coronavirus OC43 [HCoV-OC43]
uccuaaccuggguaaucauc

SEQ ID NO: 3947819 - RNA, 17 nt, Human coronavirus OC43 [HCoV-OC43]
uccuauaaguacugaua

SEQ ID NO: 3947820 - RNA, 17 nt, Human coronavirus OC43 [HCoV-OC43]
uccugacgagccccaga

SEQ ID NO: 3947821 - RNA, 17 nt, Human coronavirus OC43 [HCoV-OC43]
ucuacaggaaaaguuuu

SEQ ID NO: 3947822 - RNA, 20 nt, Human coronavirus OC43 [HCoV-OC43]
ucugggaauccugacgagcc

SEQ ID NO: 3947823 - RNA, 13 nt, Human coronavirus OC43 [HCoV-OC43]
ugaaaauaauguu

SEQ ID NO: 3947824 - RNA, 16 nt, Human coronavirus OC43 [HCoV-OC43]
ugaaggugcugaauga

SEQ ID NO: 3947825 - RNA, 18 nt, Human coronavirus OC43 [HCoV-OC43]
ugagcccuauacugaaga

SEQ ID NO: 3947826 - RNA, 18 nt, Human coronavirus OC43 [HCoV-OC43]
ugaguccaaaaccacagc

SEQ ID NO: 3947827 - RNA, 13 nt, Human coronavirus OC43 [HCoV-OC43]
ugauuauuuguau

SEQ ID NO: 3947828 - RNA, 13 nt, Human coronavirus OC43 [HCoV-OC43]
ugcagaauuuauc

SEQ ID NO: 3947829 - RNA, 22 nt, Human coronavirus OC43 [HCoV-OC43]
ugcaggaucgcguaguagagcc

SEQ ID NO: 3947830 - RNA, 16 nt, Human coronavirus OC43 [HCoV-OC43]
ugccgacaagugccca

SEQ ID NO: 3947831 - RNA, 19 nt, Human coronavirus OC43 [HCoV-OC43]
uggaacuagugacccacag

SEQ ID NO: 3947832 - RNA, 20 nt, Human coronavirus OC43 [HCoV-OC43]
uggauuguaaaauacaaaca

SEQ ID NO: 3947833 - RNA, 19 nt, Human coronavirus OC43 [HCoV-OC43]
uggccaaagugcagaauuu

SEQ ID NO: 3947834 - RNA, 12 nt, Human coronavirus OC43 [HCoV-OC43]
ugguaauuauuu

SEQ ID NO: 3947835 - RNA, 15 nt, Human coronavirus OC43 [HCoV-OC43]
ugguauuuuugcuaa

SEQ ID NO: 3947836 - RNA, 20 nt, Human coronavirus OC43 [HCoV-OC43]
ugucaaccuccguacuguua

SEQ ID NO: 3947837 - RNA, 19 nt, Human coronavirus OC43 [HCoV-OC43]
ugucccacugcugcugaua

SEQ ID NO: 3947838 - RNA, 13 nt, Human coronavirus OC43 [HCoV-OC43]
uuaaauuccuaaa

SEQ ID NO: 3947839 - RNA, 12 nt, Human coronavirus OC43 [HCoV-OC43]
uuaauguaaaua

SEQ ID NO: 3947840 - RNA, 22 nt, Human coronavirus OC43 [HCoV-OC43]
uuacaaugauguaaaaccacca

SEQ ID NO: 3947841 - RNA, 13 nt, Human coronavirus OC43 [HCoV-OC43]
uuauuuugcauga

SEQ ID NO: 3947842 - RNA, 20 nt, Human coronavirus OC43 [HCoV-OC43]
uuccuagauuuauucuaguu

SEQ ID NO: 3947843 - RNA, 23 nt, Human coronavirus OC43 [HCoV-OC43]
uugcuaauuuuauuuugcaugau

SEQ ID NO: 3947844 - RNA, 23 nt, Human coronavirus OC43 [HCoV-OC43]
uuuaacggcaaguuuuugucgaa

SEQ ID NO: 3947845 - RNA, 13 nt, Human coronavirus OC43 [HCoV-OC43]
uuucuuucugauu

SEQ ID NO: 3947846 - RNA, 22 nt, Human coronavirus OC43 [HCoV-OC43]
uuugaauaagccccgccagaag

SEQ ID NO: 3947847 - RNA, 20 nt, Human coronavirus OC43 [HCoV-OC43]
aaaacuacaccagcaccagu

SEQ ID NO: 3947848 - RNA, 16 nt, Human coronavirus OC43 [HCoV-OC43]
aaaacuuggaacuagu

SEQ ID NO: 3947849 - RNA, 18 nt, Human coronavirus OC43 [HCoV-OC43]
aaacaacuugauguguau

SEQ ID NO: 3947850 - RNA, 16 nt, Human coronavirus OC43 [HCoV-OC43]
aaagaacuauggcauu

SEQ ID NO: 3947851 - RNA, 14 nt, Human coronavirus OC43 [HCoV-OC43]
aaauguuuuugcuu

SEQ ID NO: 3947852 - RNA, 16 nt, Human coronavirus OC43 [HCoV-OC43]
aacuaauucugcuuua

SEQ ID NO: 3947853 - RNA, 15 nt, Human coronavirus OC43 [HCoV-OC43]
aacuagguacuggcu

SEQ ID NO: 3947854 - RNA, 17 nt, Human coronavirus OC43 [HCoV-OC43]
aacuggaaguuuuugga

SEQ ID NO: 3947855 - RNA, 16 nt, Human coronavirus OC43 [HCoV-OC43]
aagauggcguuaauuu

SEQ ID NO: 3947856 - RNA, 20 nt, Human coronavirus OC43 [HCoV-OC43]
aaggaaaauguugauuuuau

SEQ ID NO: 3947857 - RNA, 16 nt, Human coronavirus OC43 [HCoV-OC43]
aaguuaauuauggcca

SEQ ID NO: 3947858 - RNA, 16 nt, Human coronavirus OC43 [HCoV-OC43]
aaguuuuguguuguaa

SEQ ID NO: 3947859 - RNA, 20 nt, Human coronavirus OC43 [HCoV-OC43]
aauaagagauuugguuuuau

SEQ ID NO: 3947860 - RNA, 19 nt, Human coronavirus OC43 [HCoV-OC43]
aauaaugguauaggcacuu

SEQ ID NO: 3947861 - RNA, 21 nt, Human coronavirus OC43 [HCoV-OC43]
aauauuauguaaaauggccuu

SEQ ID NO: 3947862 - RNA, 22 nt, Human herpesvirus 1
aaucagcguucacccggcggcg

SEQ ID NO: 3947863 - RNA, 14 nt, Human herpesvirus 1
aaucggcggccgcc

SEQ ID NO: 3947864 - RNA, 16 nt, Human herpesvirus 1
aauuucaccgccccag

SEQ ID NO: 3947865 - RNA, 18 nt, Human herpesvirus 1
aauuugcacccagccuuu

SEQ ID NO: 3947866 - RNA, 16 nt, Human herpesvirus 1
acaacaagucucuggg

SEQ ID NO: 3947867 - RNA, 20 nt, Human herpesvirus 1
acaacccuacaaccugacca

SEQ ID NO: 3947868 - RNA, 17 nt, Human herpesvirus 1
acaauccccaggacacc

SEQ ID NO: 3947869 - RNA, 17 nt, Human herpesvirus 1
acaaucgcgaccacccc

SEQ ID NO: 3947870 - RNA, 15 nt, Human herpesvirus 1
acacaccagcggguc

SEQ ID NO: 3947871 - RNA, 22 nt, Human herpesvirus 1
acacacgggggagcgcucuugu

SEQ ID NO: 3947872 - RNA, 18 nt, Human herpesvirus 1
acaccccccaugcgggcu

SEQ ID NO: 3947873 - RNA, 16 nt, Human herpesvirus 1
acacccuaccccaguc

SEQ ID NO: 3947874 - RNA, 18 nt, Human herpesvirus 1
acaccugcaccacccccg

SEQ ID NO: 3947875 - RNA, 14 nt, Human herpesvirus 1
acacgacggccucg

SEQ ID NO: 3947876 - RNA, 18 nt, Human herpesvirus 1
acacuggguucuccugga

SEQ ID NO: 3947877 - RNA, 15 nt, Human herpesvirus 1
acagggcgggccgcc

SEQ ID NO: 3947878 - RNA, 22 nt, Human herpesvirus 1
acauaaccgaccgcagucccug

SEQ ID NO: 3947879 - RNA, 19 nt, Human herpesvirus 1
acauccaggcgggccuacc

SEQ ID NO: 3947880 - RNA, 23 nt, Human herpesvirus 1
acaugaccgcccgccccucgcca

SEQ ID NO: 3947881 - RNA, 16 nt, Human herpesvirus 1
acaugcggaaagcaag

SEQ ID NO: 3947882 - RNA, 23 nt, Human herpesvirus 1
acauggcccuggugucugccaug

SEQ ID NO: 3947883 - RNA, 16 nt, Human herpesvirus 1
acauguccgugccgcu

SEQ ID NO: 3947884 - RNA, 20 nt, Human herpesvirus 1
accaacacaacggcaugccu

SEQ ID NO: 3947885 - RNA, 22 nt, Human herpesvirus 1
accaacccgccccuaaccaggc

SEQ ID NO: 3947886 - RNA, 15 nt, Human herpesvirus 1
accaacgccgaugua

SEQ ID NO: 3947887 - RNA, 14 nt, Human herpesvirus 1
accacacaccagcg

SEQ ID NO: 3947888 - RNA, 14 nt, Human herpesvirus 1
accacaggugggug

SEQ ID NO: 3947889 - RNA, 16 nt, Human herpesvirus 1
accacgccacaacagc

SEQ ID NO: 3947890 - RNA, 18 nt, Human herpesvirus 1
accacgccccuuuccccc

SEQ ID NO: 3947891 - RNA, 20 nt, Human herpesvirus 1
accacgccccuuucccccug

SEQ ID NO: 3947892 - RNA, 16 nt, Human herpesvirus 1
accacgcccgaccaca

SEQ ID NO: 3947893 - RNA, 18 nt, Human herpesvirus 1
accacgugcacagccugg

SEQ ID NO: 3947894 - RNA, 21 nt, Human herpesvirus 1
accagaauaaugaccaccaca

SEQ ID NO: 3947895 - RNA, 14 nt, Human herpesvirus 1
accagcgcaccguc

SEQ ID NO: 3947896 - RNA, 18 nt, Human herpesvirus 1
accagcugagccgcgccg

SEQ ID NO: 3947897 - RNA, 18 nt, Human herpesvirus 1
accagguaauaccaaaua

SEQ ID NO: 3947898 - RNA, 23 nt, Human herpesvirus 1
accaguuuugcgaggagcccgcc

SEQ ID NO: 3947899 - RNA, 15 nt, Human herpesvirus 1
accauggccccccgc

SEQ ID NO: 3947900 - RNA, 15 nt, Human herpesvirus 1
acccaaaccccggau

SEQ ID NO: 3947901 - RNA, 17 nt, Human herpesvirus 1
acccaaccaaaccaggc

SEQ ID NO: 3947902 - RNA, 20 nt, Human herpesvirus 1
acccaaccaaaccaggcgug

SEQ ID NO: 3947903 - RNA, 15 nt, Human herpesvirus 1
acccaacccccggcc

SEQ ID NO: 3947904 - RNA, 16 nt, Human herpesvirus 1
acccaagccgccccag

SEQ ID NO: 3947905 - RNA, 15 nt, Human herpesvirus 1
acccagccuuuaacu

SEQ ID NO: 3947906 - RNA, 16 nt, Human herpesvirus 1
accccaccccugugcu

SEQ ID NO: 3947907 - RNA, 17 nt, Human herpesvirus 1
accccagggaccuccug

SEQ ID NO: 3947908 - RNA, 22 nt, Human herpesvirus 1
accccaguccccgggcccagcc

SEQ ID NO: 3947909 - RNA, 17 nt, Human herpesvirus 1
acccccaacgccacgca

SEQ ID NO: 3947910 - RNA, 13 nt, Human herpesvirus 1
accccccaugcca

SEQ ID NO: 3947911 - RNA, 12 nt, Human herpesvirus 1
accccccuggcc

SEQ ID NO: 3947912 - RNA, 13 nt, Human herpesvirus 1
acccccggcccca

SEQ ID NO: 3947913 - RNA, 16 nt, Human herpesvirus 1
acccccucgaccacca

SEQ ID NO: 3947914 - RNA, 16 nt, Human herpesvirus 1
accccgggcgcgcccu

SEQ ID NO: 3947915 - RNA, 14 nt, Human herpesvirus 1
acccgacucaccuc

SEQ ID NO: 3947916 - RNA, 19 nt, Human herpesvirus 1
acccgcaacgcgcuggggc

SEQ ID NO: 3947917 - RNA, 23 nt, Human herpesvirus 1
acccgccccuaaccaggccucca

SEQ ID NO: 3947918 - RNA, 18 nt, Human herpesvirus 1
acccgcgacccccgggcu

SEQ ID NO: 3947919 - RNA, 21 nt, Human herpesvirus 1
acccgugacacccuaccccag

SEQ ID NO: 3947920 - RNA, 14 nt, Human herpesvirus 1
acccucucuucccu

SEQ ID NO: 3947921 - RNA, 17 nt, Human herpesvirus 1
acccugcgcgagcaccu

SEQ ID NO: 3947922 - RNA, 22 nt, Human herpesvirus 1
acccuggcgccaaagcugcugg

SEQ ID NO: 3947923 - RNA, 21 nt, Human herpesvirus 1
accgacagcacucacagcccc

SEQ ID NO: 3947924 - RNA, 15 nt, Human herpesvirus 1
accgacauggagcug

SEQ ID NO: 3947925 - RNA, 15 nt, Human herpesvirus 1
accgaggggccaagu

SEQ ID NO: 3947926 - RNA, 15 nt, Human herpesvirus 1
accgcagccuggucg

SEQ ID NO: 3947927 - RNA, 14 nt, Human herpesvirus 1
accgccaucagccu

SEQ ID NO: 3947928 - RNA, 22 nt, Human herpesvirus 1
accgccggcggcgacgugcccc

SEQ ID NO: 3947929 - RNA, 16 nt, Human herpesvirus 1
accgcgugaccccagg

SEQ ID NO: 3947930 - RNA, 16 nt, Human herpesvirus 1
accgcgugcccacguc

SEQ ID NO: 3947931 - RNA, 17 nt, Human herpesvirus 1
accgcguguuccccggg

SEQ ID NO: 3947932 - RNA, 20 nt, Human herpesvirus 1
accgcuuuauaggccgggac

SEQ ID NO: 3947933 - RNA, 18 nt, Human herpesvirus 1
accggcgcuacuucaccu

SEQ ID NO: 3947934 - RNA, 16 nt, Human herpesvirus 1
accgggcccccgcccc

SEQ ID NO: 3947935 - RNA, 17 nt, Human herpesvirus 1
accgggcccggccaggc

SEQ ID NO: 3947936 - RNA, 19 nt, Human herpesvirus 1
accgguucucccuguucaa

SEQ ID NO: 3947937 - RNA, 15 nt, Human herpesvirus 1
accgucauccacacc

SEQ ID NO: 3947938 - RNA, 20 nt, Human herpesvirus 1
accgucccguagucccaucc

SEQ ID NO: 3947939 - RNA, 22 nt, Human herpesvirus 1
accgucgccgcgggccacgcca

SEQ ID NO: 3947940 - RNA, 17 nt, Human herpesvirus 1
accgucggaggcccccc

SEQ ID NO: 3947941 - RNA, 18 nt, Human herpesvirus 1
accgugacuaagcguccc

SEQ ID NO: 3947942 - RNA, 18 nt, Human herpesvirus 1
accuccgcgagcagagcc

SEQ ID NO: 3947943 - RNA, 23 nt, Human herpesvirus 1
accucgggugcauauccugggau

SEQ ID NO: 3947944 - RNA, 21 nt, Human herpesvirus 1
accugacgcgccuagccaacc

SEQ ID NO: 3947945 - RNA, 14 nt, Human herpesvirus 1
accugcucacgacc

SEQ ID NO: 3947946 - RNA, 22 nt, Human herpesvirus 1
accuggggcgcgcggucggcaa

SEQ ID NO: 3947947 - RNA, 21 nt, Human herpesvirus 1
acgacccucgagauccccggg

SEQ ID NO: 3947948 - RNA, 20 nt, Human herpesvirus 1
acgaccuguugauggccugu

SEQ ID NO: 3947949 - RNA, 15 nt, Human herpesvirus 1
acgagaugcugcgcu

SEQ ID NO: 3947950 - RNA, 18 nt, Human herpesvirus 1
acgagcacccugcugccc

SEQ ID NO: 3947951 - RNA, 13 nt, Human herpesvirus 1
acgagcuccuggc

SEQ ID NO: 3947952 - RNA, 16 nt, Human herpesvirus 1
acgagcuccuggccua

SEQ ID NO: 3947953 - RNA, 14 nt, Human herpesvirus 1
acgagcugacccug

SEQ ID NO: 3947954 - RNA, 24 nt, Human herpesvirus 1
acgaggcggccaacgacuuccucg

SEQ ID NO: 3947955 - RNA, 19 nt, Human herpesvirus 1
acgaguaucugcgggccgc

SEQ ID NO: 3947956 - RNA, 14 nt, Human herpesvirus 1
gggggucggcaggc

SEQ ID NO: 3947957 - RNA, 22 nt, Human herpesvirus 1
ggggucaaccacgaacccccau

SEQ ID NO: 3947958 - RNA, 16 nt, Human herpesvirus 1
ggggucaggucugcgg

SEQ ID NO: 3947959 - RNA, 12 nt, Human herpesvirus 1
ggguaccacagg

SEQ ID NO: 3947960 - RNA, 23 nt, Human herpesvirus 1
ggguauaaauuccggaaggggac

SEQ ID NO: 3947961 - RNA, 16 nt, Human herpesvirus 1
ggguauauaaggccug

SEQ ID NO: 3947962 - RNA, 20 nt, Human herpesvirus 1
gggucagcuccucgcgcggc

SEQ ID NO: 3947963 - RNA, 23 nt, Human herpesvirus 1
gggucccuccuuagcacgaucga

SEQ ID NO: 3947964 - RNA, 18 nt, Human herpesvirus 1
gggucuccgaaagccacc

SEQ ID NO: 3947965 - RNA, 23 nt, Human herpesvirus 1
gggucuguuggggacacuggguu

SEQ ID NO: 3947966 - RNA, 16 nt, Human herpesvirus 1
gggugacgguggacag

SEQ ID NO: 3947967 - RNA, 17 nt, Human herpesvirus 1
gggugcgggggggucag

SEQ ID NO: 3947968 - RNA, 18 nt, Human herpesvirus 1
gguacaacgcgacgcaca

SEQ ID NO: 3947969 - RNA, 16 nt, Human herpesvirus 1
gguaccgcgugacccc

SEQ ID NO: 3947970 - RNA, 23 nt, Human herpesvirus 1
gguacgaagaccagggcccguug

SEQ ID NO: 3947971 - RNA, 13 nt, Human herpesvirus 1
gguagcgggggac

SEQ ID NO: 3947972 - RNA, 19 nt, Human herpesvirus 1
gguauggcugcccccccgc

SEQ ID NO: 3947973 - RNA, 12 nt, Human herpesvirus 1
gguccacaccca

SEQ ID NO: 3947974 - RNA, 22 nt, Human herpesvirus 1
gguccgcggggccucccccgga

SEQ ID NO: 3947975 - RNA, 20 nt, Human herpesvirus 1
gguccguguuucucgcccca

SEQ ID NO: 3947976 - RNA, 20 nt, Human herpesvirus 1
gguccucgugcccucgcggg

SEQ ID NO: 3947977 - RNA, 13 nt, Human herpesvirus 1
ggucguccgcgga

SEQ ID NO: 3947978 - RNA, 15 nt, Human herpesvirus 1
ggucuaucacacccg

SEQ ID NO: 3947979 - RNA, 17 nt, Human herpesvirus 1
ggucucccagggagccc

SEQ ID NO: 3947980 - RNA, 19 nt, Human herpesvirus 1
ggucucccagggagccccg

SEQ ID NO: 3947981 - RNA, 16 nt, Human herpesvirus 1
ggucugucucgucucc

SEQ ID NO: 3947982 - RNA, 17 nt, Human herpesvirus 1
ggugaacgccuccgccc

SEQ ID NO: 3947983 - RNA, 18 nt, Human herpesvirus 1
ggugacgccgacgaggac

SEQ ID NO: 3947984 - RNA, 21 nt, Human herpesvirus 1
gguggaucuuagccuccccgg

SEQ ID NO: 3947985 - RNA, 16 nt, Human herpesvirus 1
gguggaugccucucuc

SEQ ID NO: 3947986 - RNA, 13 nt, Human herpesvirus 1
gguggcacagaac

SEQ ID NO: 3947987 - RNA, 20 nt, Human herpesvirus 1
gguggcgaccacgggcuguc

SEQ ID NO: 3947988 - RNA, 15 nt, Human herpesvirus 1
ggugggcguccugga

SEQ ID NO: 3947989 - RNA, 23 nt, Human herpesvirus 1
gguggucucuggccgcgcccacu

SEQ ID NO: 3947990 - RNA, 18 nt, Human herpesvirus 1
ggugucugggaauagagc

SEQ ID NO: 3947991 - RNA, 15 nt, Human herpesvirus 1
gguucccccccgugg

SEQ ID NO: 3947992 - RNA, 16 nt, Human herpesvirus 1
gguucucccuguucaa

SEQ ID NO: 3947993 - RNA, 23 nt, Human herpesvirus 1
gguugcggcccgcguuuggccug

SEQ ID NO: 3947994 - RNA, 23 nt, Human herpesvirus 1
guaacguuccgccuggaggacgg

SEQ ID NO: 3947995 - RNA, 14 nt, Human herpesvirus 1
guaaggacacgcgc

SEQ ID NO: 3947996 - RNA, 16 nt, Human herpesvirus 1
guacccuuaauaaauu

SEQ ID NO: 3947997 - RNA, 19 nt, Human herpesvirus 1
guaccugcagacgguggug

SEQ ID NO: 3947998 - RNA, 16 nt, Human herpesvirus 1
guacgccccaccggca

SEQ ID NO: 3947999 - RNA, 16 nt, Human herpesvirus 1
guacgccgccaccgug

SEQ ID NO: 3948000 - RNA, 19 nt, Human herpesvirus 1
guacgccgccaccguggcc

SEQ ID NO: 3948001 - RNA, 16 nt, Human herpesvirus 1
guacucccaccagcug

SEQ ID NO: 3948002 - RNA, 17 nt, Human herpesvirus 1
acgccucccccacaucc

SEQ ID NO: 3948003 - RNA, 15 nt, Human herpesvirus 1
acgccugccaaccug

SEQ ID NO: 3948004 - RNA, 19 nt, Human herpesvirus 1
acgccuggggucgcggccg

SEQ ID NO: 3948005 - RNA, 17 nt, Human herpesvirus 1
acgcgaccgucgccgcg

SEQ ID NO: 3948006 - RNA, 16 nt, Human herpesvirus 1
acgcgagcgaggcccc

SEQ ID NO: 3948007 - RNA, 18 nt, Human herpesvirus 1
acgcgcaccuguuccgcc

SEQ ID NO: 3948008 - RNA, 22 nt, Human herpesvirus 1
acgcgccgcgggcccccggccg

SEQ ID NO: 3948009 - RNA, 21 nt, Human herpesvirus 1
acgcgcgcgaccucaccacca

SEQ ID NO: 3948010 - RNA, 11 nt, Human herpesvirus 1
acgcgcguccu

SEQ ID NO: 3948011 - RNA, 18 nt, Human herpesvirus 1
acgcgcguccuucuuguc

SEQ ID NO: 3948012 - RNA, 14 nt, Human herpesvirus 1
acgcgggccccggg

SEQ ID NO: 3948013 - RNA, 17 nt, Human herpesvirus 1
acgcuggggguccuggu

SEQ ID NO: 3948014 - RNA, 13 nt, Human herpesvirus 1
acggcauaugcaa

SEQ ID NO: 3948015 - RNA, 17 nt, Human herpesvirus 1
acggcauucgggccugc

SEQ ID NO: 3948016 - RNA, 22 nt, Human herpesvirus 1
acggcgaaugcagcgccggccu

SEQ ID NO: 3948017 - RNA, 14 nt, Human herpesvirus 1
acggcggaccuggc

SEQ ID NO: 3948018 - RNA, 14 nt, Human herpesvirus 1
acgggcggccaccc

SEQ ID NO: 3948019 - RNA, 19 nt, Human herpesvirus 1
acggggccgggagcgccag

SEQ ID NO: 3948020 - RNA, 20 nt, Human herpesvirus 1
acgggguaugugauaugcua

SEQ ID NO: 3948021 - RNA, 21 nt, Human herpesvirus 1
acgguggugcccagcggccug

SEQ ID NO: 3948022 - RNA, 16 nt, Human herpesvirus 1
acguccugggccaccu

SEQ ID NO: 3948023 - RNA, 23 nt, Human herpesvirus 1
acgucgccccuguggcccuggcg

SEQ ID NO: 3948024 - RNA, 18 nt, Human herpesvirus 1
acgugguccgcggggccu

SEQ ID NO: 3948025 - RNA, 17 nt, Human herpesvirus 1
acguucgcgcgccaucu

SEQ ID NO: 3948026 - RNA, 14 nt, Human herpesvirus 1
acuacauuaaauug

SEQ ID NO: 3948027 - RNA, 22 nt, Human herpesvirus 1
acuacgcuucggccgccaccca

SEQ ID NO: 3948028 - RNA, 11 nt, Human herpesvirus 1
acuccccggac

SEQ ID NO: 3948029 - RNA, 12 nt, Human herpesvirus 1
acuccccggacc

SEQ ID NO: 3948030 - RNA, 12 nt, Human herpesvirus 1
acuccggccgcg

SEQ ID NO: 3948031 - RNA, 13 nt, Human herpesvirus 1
acuccgucuuggu

SEQ ID NO: 3948032 - RNA, 16 nt, Human herpesvirus 1
acucgacccacugccu

SEQ ID NO: 3948033 - RNA, 16 nt, Human herpesvirus 1
acucucccccaccgcc

SEQ ID NO: 3948034 - RNA, 14 nt, Human herpesvirus 1
acucucgcaccauc

SEQ ID NO: 3948035 - RNA, 11 nt, Human herpesvirus 1
acucugggcgu

SEQ ID NO: 3948036 - RNA, 23 nt, Human herpesvirus 1
acugcggucugucucgucuccuc

SEQ ID NO: 3948037 - RNA, 22 nt, Human herpesvirus 1
acuggaggaggaggaagaggag

SEQ ID NO: 3948038 - RNA, 20 nt, Human herpesvirus 1
acuggccgggagcaccacau

SEQ ID NO: 3948039 - RNA, 16 nt, Human herpesvirus 1
acuggguucuccugga

SEQ ID NO: 3948040 - RNA, 20 nt, Human herpesvirus 1
acuucccgguaugguaauua

SEQ ID NO: 3948041 - RNA, 18 nt, Human herpesvirus 1
agacaccuuggcccuggc

SEQ ID NO: 3948042 - RNA, 21 nt, Human herpesvirus 1
agaccggauggaggagccccu

SEQ ID NO: 3948043 - RNA, 14 nt, Human herpesvirus 1
agaccuauguguuu

SEQ ID NO: 3948044 - RNA, 16 nt, Human herpesvirus 1
agacgcugcuccgccu

SEQ ID NO: 3948045 - RNA, 18 nt, Human herpesvirus 1
agacggcauucgggccug

SEQ ID NO: 3948046 - RNA, 16 nt, Human herpesvirus 1
agagcggggccguggc

SEQ ID NO: 3948047 - RNA, 13 nt, Human herpesvirus 1
agaggcccacgcc

SEQ ID NO: 3948048 - RNA, 18 nt, Human herpesvirus 1
agagucgacgaccugggg

SEQ ID NO: 3948049 - RNA, 18 nt, Human herpesvirus 1
agagucggagcccgcugg

SEQ ID NO: 3948050 - RNA, 13 nt, Human herpesvirus 1
agcagagccgcaa

SEQ ID NO: 3948051 - RNA, 19 nt, Human herpesvirus 1
agcagguccgcggugggcu

SEQ ID NO: 3948052 - RNA, 18 nt, Human herpesvirus 1
agcaucgggaugcugccc

SEQ ID NO: 3948053 - RNA, 21 nt, Human herpesvirus 1
agcauucgcucucgccuuucc

SEQ ID NO: 3948054 - RNA, 16 nt, Human herpesvirus 1
agccacccacgccgcc

SEQ ID NO: 3948055 - RNA, 15 nt, Human herpesvirus 1
agcccaacccacacg

SEQ ID NO: 3948056 - RNA, 18 nt, Human herpesvirus 1
agcccaacccacacgcac

SEQ ID NO: 3948057 - RNA, 21 nt, Human herpesvirus 1
agcccacaugcggaaagcaag

SEQ ID NO: 3948058 - RNA, 22 nt, Human herpesvirus 1
agccccaaagcgcauacgccuc

SEQ ID NO: 3948059 - RNA, 12 nt, Human herpesvirus 1
agccccccagcc

SEQ ID NO: 3948060 - RNA, 20 nt, Human herpesvirus 1
agccccggucuccccgggag

SEQ ID NO: 3948061 - RNA, 14 nt, Human herpesvirus 1
agcccggaggcgcc

SEQ ID NO: 3948062 - RNA, 15 nt, Human herpesvirus 1
agcccggccguguga

SEQ ID NO: 3948063 - RNA, 23 nt, Human herpesvirus 1
agcccucccgaccgacaccccca

SEQ ID NO: 3948064 - RNA, 16 nt, Human herpesvirus 1
agcccugcucgggcag

SEQ ID NO: 3948065 - RNA, 23 nt, Human herpesvirus 1
agccgcgauuccgagggccgggc

SEQ ID NO: 3948066 - RNA, 13 nt, Human herpesvirus 1
agcgaaggcugcc

SEQ ID NO: 3948067 - RNA, 15 nt, Human herpesvirus 1
agcgccccggcgacc

SEQ ID NO: 3948068 - RNA, 14 nt, Human herpesvirus 1
agcgcccuccugac

SEQ ID NO: 3948069 - RNA, 21 nt, Human herpesvirus 1
agcguauaccaacccgccccu

SEQ ID NO: 3948070 - RNA, 20 nt, Human herpesvirus 1
agcgucccugggcccuggcc

SEQ ID NO: 3948071 - RNA, 17 nt, Human herpesvirus 1
agcgugacgcacccccu

SEQ ID NO: 3948072 - RNA, 21 nt, Human herpesvirus 1
agcuccuggccuacgucuccg

SEQ ID NO: 3948073 - RNA, 20 nt, Human herpesvirus 1
agcucgcggagggcggccag

SEQ ID NO: 3948074 - RNA, 18 nt, Human herpesvirus 1
agcuugcgucccuccccg

SEQ ID NO: 3948075 - RNA, 15 nt, Human herpesvirus 1
agcuuuccgagggcg

SEQ ID NO: 3948076 - RNA, 18 nt, Human herpesvirus 1
aggacaaacccaaccguc

SEQ ID NO: 3948077 - RNA, 14 nt, Human herpesvirus 1
aggaccccgugggc

SEQ ID NO: 3948078 - RNA, 15 nt, Human herpesvirus 1
aggaccgcgcccccg

SEQ ID NO: 3948079 - RNA, 14 nt, Human herpesvirus 1
aggagaucgccauc

SEQ ID NO: 3948080 - RNA, 15 nt, Human herpesvirus 1
aggaggccgccacgc

SEQ ID NO: 3948081 - RNA, 19 nt, Human herpesvirus 1
aggauucggcccucuugga

SEQ ID NO: 3948082 - RNA, 18 nt, Human herpesvirus 1
aggcccgcaagcugaacc

SEQ ID NO: 3948083 - RNA, 21 nt, Human herpesvirus 1
aggccuuguuccgcuucccgg

SEQ ID NO: 3948084 - RNA, 19 nt, Human herpesvirus 1
aggcgcucgucgccuggcu

SEQ ID NO: 3948085 - RNA, 23 nt, Human herpesvirus 1
agggaaagcaaagaggggcuggg

SEQ ID NO: 3948086 - RNA, 15 nt, Human herpesvirus 1
agggagccccggucu

SEQ ID NO: 3948087 - RNA, 15 nt, Human herpesvirus 1
agggcagggccgcgg

SEQ ID NO: 3948088 - RNA, 16 nt, Human herpesvirus 1
agggcaucgcgguggu

SEQ ID NO: 3948089 - RNA, 14 nt, Human herpesvirus 1
agggccgugcccau

SEQ ID NO: 3948090 - RNA, 19 nt, Human herpesvirus 1
agggcugccagaccucaac

SEQ ID NO: 3948091 - RNA, 18 nt, Human herpesvirus 1
aggggcgcuuaccgccac

SEQ ID NO: 3948092 - RNA, 22 nt, Human herpesvirus 1
agggggggggggcauuucagug

SEQ ID NO: 3948093 - RNA, 23 nt, Human herpesvirus 1
agggggucugucgguccacggcc

SEQ ID NO: 3948094 - RNA, 14 nt, Human herpesvirus 1
agggugucccagga

SEQ ID NO: 3948095 - RNA, 19 nt, Human herpesvirus 1
agguacggggcggcccgug

SEQ ID NO: 3948096 - RNA, 20 nt, Human herpesvirus 1
aggugcccccgcgccucccg

SEQ ID NO: 3948097 - RNA, 23 nt, Human herpesvirus 1
aguaacaugcgcacgugauguag

SEQ ID NO: 3948098 - RNA, 19 nt, Human herpesvirus 1
aguaugccccccuggcgag

SEQ ID NO: 3948099 - RNA, 15 nt, Human herpesvirus 1
aguccgaagaggaag

SEQ ID NO: 3948100 - RNA, 21 nt, Human herpesvirus 1
agucggcaagauccucgggcu

SEQ ID NO: 3948101 - RNA, 19 nt, Human herpesvirus 1
agucuucggggcccggccc

SEQ ID NO: 3948102 - RNA, 13 nt, Human herpesvirus 1
agugaaagacacg

SEQ ID NO: 3948103 - RNA, 16 nt, Human herpesvirus 1
aguucgagcagccgcg

SEQ ID NO: 3948104 - RNA, 18 nt, Human herpesvirus 1
aguuggcauuggauccgg

SEQ ID NO: 3948105 - RNA, 21 nt, Human herpesvirus 1
aguugggccgggcgacccaga

SEQ ID NO: 3948106 - RNA, 18 nt, Human herpesvirus 1
aguuuguggacccaaagc

SEQ ID NO: 3948107 - RNA, 20 nt, Human herpesvirus 1
auaaagccgccacccucucu

SEQ ID NO: 3948108 - RNA, 20 nt, Human herpesvirus 1
auaaauuuuacaaacagauu

SEQ ID NO: 3948109 - RNA, 17 nt, Human herpesvirus 1
auacggugcgggcggcc

SEQ ID NO: 3948110 - RNA, 19 nt, Human herpesvirus 1
auagccauccccgcgucca

SEQ ID NO: 3948111 - RNA, 13 nt, Human herpesvirus 1
auauccugagccc

SEQ ID NO: 3948112 - RNA, 12 nt, Human herpesvirus 1
auaugccugugu

SEQ ID NO: 3948113 - RNA, 15 nt, Human herpesvirus 1
auaugccuguguguc

SEQ ID NO: 3948114 - RNA, 18 nt, Human herpesvirus 1
aucaccaaccacccgggg

SEQ ID NO: 3948115 - RNA, 22 nt, Human herpesvirus 1
aucaccccgcaauuugcaccca

SEQ ID NO: 3948116 - RNA, 17 nt, Human herpesvirus 1
aucagcuguggacccga

SEQ ID NO: 3948117 - RNA, 11 nt, Human herpesvirus 1
cucgccccgga

SEQ ID NO: 3948118 - RNA, 20 nt, Human herpesvirus 1
cucgcgcguggaccuggggg

SEQ ID NO: 3948119 - RNA, 19 nt, Human herpesvirus 1
cucgcggagcuguacgugc

SEQ ID NO: 3948120 - RNA, 14 nt, Human herpesvirus 1
cucgcugcccuucu

SEQ ID NO: 3948121 - RNA, 16 nt, Human herpesvirus 1
cucgcugcuggcggac

SEQ ID NO: 3948122 - RNA, 18 nt, Human herpesvirus 1
cucggcccccgaggccag

SEQ ID NO: 3948123 - RNA, 19 nt, Human herpesvirus 1
cucguacgcaugggccgcc

SEQ ID NO: 3948124 - RNA, 15 nt, Human herpesvirus 1
cucgucgggguggca

SEQ ID NO: 3948125 - RNA, 16 nt, Human herpesvirus 1
cucgucuccucuucuc

SEQ ID NO: 3948126 - RNA, 13 nt, Human herpesvirus 1
cucguuugccgcc

SEQ ID NO: 3948127 - RNA, 14 nt, Human herpesvirus 1
cucucccgggccgc

SEQ ID NO: 3948128 - RNA, 12 nt, Human herpesvirus 1
cucucuucucuc

SEQ ID NO: 3948129 - RNA, 16 nt, Human herpesvirus 1
cucuggacgcccgggc

SEQ ID NO: 3948130 - RNA, 15 nt, Human herpesvirus 1
cucuggacuggacca

SEQ ID NO: 3948131 - RNA, 23 nt, Human herpesvirus 1
cucugggggcgacccguaaaugg

SEQ ID NO: 3948132 - RNA, 22 nt, Human herpesvirus 1
cucugggucugugccaccagcc

SEQ ID NO: 3948133 - RNA, 14 nt, Human herpesvirus 1
cucuucgcuuuccu

SEQ ID NO: 3948134 - RNA, 13 nt, Human herpesvirus 1
uccggccuggggg

SEQ ID NO: 3948135 - RNA, 19 nt, Human herpesvirus 1
uccggccugggggccgucc

SEQ ID NO: 3948136 - RNA, 12 nt, Human herpesvirus 1
uccggggguccg

SEQ ID NO: 3948137 - RNA, 22 nt, Human herpesvirus 1
uccggucgccccgacccccuug

SEQ ID NO: 3948138 - RNA, 19 nt, Human herpesvirus 1
uccguggccccggccccca

SEQ ID NO: 3948139 - RNA, 18 nt, Human herpesvirus 1
uccuaacccagaccccgg

SEQ ID NO: 3948140 - RNA, 22 nt, Human herpesvirus 1
uccuacgccggggcggucguca

SEQ ID NO: 3948141 - RNA, 14 nt, Human herpesvirus 1
uccugauguggcug

SEQ ID NO: 3948142 - RNA, 16 nt, Human herpesvirus 1
uccugauguggcugcu

SEQ ID NO: 3948143 - RNA, 22 nt, Human herpesvirus 1
uccuguaaguacgcccucccgc

SEQ ID NO: 3948144 - RNA, 23 nt, Human herpesvirus 1
uccuuacgcuaaucccccggcuc

SEQ ID NO: 3948145 - RNA, 18 nt, Human herpesvirus 1
ucgaccaccauccccgcu

SEQ ID NO: 3948146 - RNA, 23 nt, Human herpesvirus 1
ucgacggcuucuacgcgcgcgac

SEQ ID NO: 3948147 - RNA, 19 nt, Human herpesvirus 1
ucgacucuaucgcgcgcau

SEQ ID NO: 3948148 - RNA, 18 nt, Human herpesvirus 1
ucgagaugagccagaccc

SEQ ID NO: 3948149 - RNA, 14 nt, Human herpesvirus 1
ucgagaugggccag

SEQ ID NO: 3948150 - RNA, 20 nt, Human herpesvirus 1
ucgagccaacgcccugacca

SEQ ID NO: 3948151 - RNA, 21 nt, Human herpesvirus 1
ucgaucguccaucaccacgcc

SEQ ID NO: 3948152 - RNA, 23 nt, Human herpesvirus 1
ucgccccguacaaguucaaggcc

SEQ ID NO: 3948153 - RNA, 13 nt, Human herpesvirus 1
ucgccgcggcucc

SEQ ID NO: 3948154 - RNA, 15 nt, Human herpesvirus 1
ucgccuggcugaccc

SEQ ID NO: 3948155 - RNA, 23 nt, Human herpesvirus 1
ucgcgauacccucgggcaucucg

SEQ ID NO: 3948156 - RNA, 18 nt, Human herpesvirus 1
ucgcggagggcggccagc

SEQ ID NO: 3948157 - RNA, 13 nt, Human herpesvirus 1
ucgcggccgcgac

SEQ ID NO: 3948158 - RNA, 15 nt, Human herpesvirus 1
ucgcggcuucgcggu

SEQ ID NO: 3948159 - RNA, 16 nt, Human herpesvirus 1
ucgcgggccucguggg

SEQ ID NO: 3948160 - RNA, 16 nt, Human herpesvirus 1
ucgcgguagcccggcc

SEQ ID NO: 3948161 - RNA, 19 nt, Human herpesvirus 1
ucgcgguggucuucaagga

SEQ ID NO: 3948162 - RNA, 21 nt, Human herpesvirus 1
ucgcuagaccacgccccuuuc

SEQ ID NO: 3948163 - RNA, 22 nt, Human herpesvirus 1
ucgcuugguuucggaugggagg

SEQ ID NO: 3948164 - RNA, 14 nt, Human herpesvirus 1
ucggcaggcaccgc

SEQ ID NO: 3948165 - RNA, 20 nt, Human herpesvirus 1
ucggccgccgacgaccuggu

SEQ ID NO: 3948166 - RNA, 20 nt, Human herpesvirus 1
ucggccguuucuccgcccga

SEQ ID NO: 3948167 - RNA, 20 nt, Human herpesvirus 1
ucgggcauggccccggggcg

SEQ ID NO: 3948168 - RNA, 13 nt, Human herpesvirus 1
ucgugcccuucca

SEQ ID NO: 3948169 - RNA, 13 nt, Human herpesvirus 1
ucuacaacaacua

SEQ ID NO: 3948170 - RNA, 12 nt, Human herpesvirus 1
ucucccagggag

SEQ ID NO: 3948171 - RNA, 17 nt, Human herpesvirus 1
ucucccagggagccccg

SEQ ID NO: 3948172 - RNA, 21 nt, Human herpesvirus 1
ucuccgaucccaacuccucag

SEQ ID NO: 3948173 - RNA, 15 nt, Human herpesvirus 1
ucuccggacccccgc

SEQ ID NO: 3948174 - RNA, 23 nt, Human herpesvirus 1
ucugggcccgacagaccuccccg

SEQ ID NO: 3948175 - RNA, 15 nt, Human herpesvirus 1
ucugggggccugucc

SEQ ID NO: 3948176 - RNA, 20 nt, Human herpesvirus 1
ucuuccacgaacccagcgac

SEQ ID NO: 3948177 - RNA, 15 nt, Human herpesvirus 1
ugaaaccggccaacg

SEQ ID NO: 3948178 - RNA, 18 nt, Human herpesvirus 1
ugaaagacacgggcacca

SEQ ID NO: 3948179 - RNA, 14 nt, Human herpesvirus 1
ugaaccccaacgcc

SEQ ID NO: 3948180 - RNA, 18 nt, Human herpesvirus 1
ugaacgacugggccgagg

SEQ ID NO: 3948181 - RNA, 22 nt, Human herpesvirus 1
ugaagcccccaacaugacccag

SEQ ID NO: 3948182 - RNA, 13 nt, Human herpesvirus 1
ugaccccagggau

SEQ ID NO: 3948183 - RNA, 20 nt, Human herpesvirus 1
ugacccuaggaggccgccac

SEQ ID NO: 3948184 - RNA, 15 nt, Human herpesvirus 1
ugacgccucagggcc

SEQ ID NO: 3948185 - RNA, 16 nt, Human herpesvirus 1
ugacggccgacgacga

SEQ ID NO: 3948186 - RNA, 19 nt, Human herpesvirus 1
ugauaaugaucaagcggcg

SEQ ID NO: 3948187 - RNA, 22 nt, Human herpesvirus 1
ugaucuuggcguuauucccaaa

SEQ ID NO: 3948188 - RNA, 17 nt, Human herpesvirus 1
aaaagaccgcaucgaca

SEQ ID NO: 3948189 - RNA, 15 nt, Human herpesvirus 1
aaacgccucccccug

SEQ ID NO: 3948190 - RNA, 20 nt, Human herpesvirus 1
aaacggccgaagccacgccc

SEQ ID NO: 3948191 - RNA, 20 nt, Human herpesvirus 1
aaacucauuaaugggcggcc

SEQ ID NO: 3948192 - RNA, 21 nt, Human herpesvirus 1
aaagcugcuggcgcgcacccc

SEQ ID NO: 3948193 - RNA, 22 nt, Human herpesvirus 1
aacagcucgcggaggagccagu

SEQ ID NO: 3948194 - RNA, 11 nt, Human herpesvirus 1
aaccaggccgu

SEQ ID NO: 3948195 - RNA, 15 nt, Human herpesvirus 1
aacccaaccaaacca

SEQ ID NO: 3948196 - RNA, 23 nt, Human herpesvirus 1
aacccacacgcacuugcggcaag

SEQ ID NO: 3948197 - RNA, 16 nt, Human herpesvirus 1
aaccccacgcccccgc

SEQ ID NO: 3948198 - RNA, 17 nt, Human herpesvirus 1
aaccuccgggggcggcg

SEQ ID NO: 3948199 - RNA, 12 nt, Human herpesvirus 1
aacgacggcccg

SEQ ID NO: 3948200 - RNA, 22 nt, Human herpesvirus 1
aacgcaacggcgggagcugggu

SEQ ID NO: 3948201 - RNA, 21 nt, Human herpesvirus 1
aacgccgcuaccgacgcuccc

SEQ ID NO: 3948202 - RNA, 17 nt, Human herpesvirus 1
aacgccuccccuguugg

SEQ ID NO: 3948203 - RNA, 21 nt, Human herpesvirus 1
aacuucgacccgcaacgcgcu

SEQ ID NO: 3948204 - RNA, 19 nt, Human herpesvirus 1
aagacccccccggagccgg

SEQ ID NO: 3948205 - RNA, 17 nt, Human herpesvirus 1
aagauggccgaccccaa

SEQ ID NO: 3948206 - RNA, 13 nt, Human herpesvirus 1
aagccacaaaaug

SEQ ID NO: 3948207 - RNA, 14 nt, Human herpesvirus 1
aagccuacuacucg

SEQ ID NO: 3948208 - RNA, 17 nt, Human herpesvirus 1
aagccuacuacucggaa

SEQ ID NO: 3948209 - RNA, 18 nt, Human herpesvirus 1
aagcgacggacgugcgcc

SEQ ID NO: 3948210 - RNA, 19 nt, Human herpesvirus 1
aagcuagccgaggcccggg

SEQ ID NO: 3948211 - RNA, 17 nt, Human herpesvirus 1
aagcugaugucccucau

SEQ ID NO: 3948212 - RNA, 10 nt, Human herpesvirus 1
aaggccuggg

SEQ ID NO: 3948213 - RNA, 19 nt, Human herpesvirus 1
aagucgguagcgggggacg

SEQ ID NO: 3948214 - RNA, 13 nt, Human herpesvirus 1
aauaaaaacauug

SEQ ID NO: 3948215 - RNA, 24 nt, Human herpesvirus 1
aaucauaaccacgcccagcgcaga

SEQ ID NO: 3948216 - RNA, 18 nt, Human herpesvirus 1
cccgucgaagcugauguc

SEQ ID NO: 3948217 - RNA, 15 nt, Human herpesvirus 1
cccgugucugugggc

SEQ ID NO: 3948218 - RNA, 18 nt, Human herpesvirus 1
cccgugugccgcgccugg

SEQ ID NO: 3948219 - RNA, 21 nt, Human herpesvirus 1
cccuaaccaggccuccacccc

SEQ ID NO: 3948220 - RNA, 13 nt, Human herpesvirus 1
cccuaccccaguc

SEQ ID NO: 3948221 - RNA, 21 nt, Human herpesvirus 1
ccuaccggccccugggccccg

SEQ ID NO: 3948222 - RNA, 13 nt, Human herpesvirus 1
ccuagccgcagca

SEQ ID NO: 3948223 - RNA, 18 nt, Human herpesvirus 1
ccuaugccacgccagggc

SEQ ID NO: 3948224 - RNA, 14 nt, Human herpesvirus 1
ccucagggccuccg

SEQ ID NO: 3948225 - RNA, 14 nt, Human herpesvirus 1
ccucaggucauccu

SEQ ID NO: 3948226 - RNA, 19 nt, Human herpesvirus 1
ccuccaccacccaacccca

SEQ ID NO: 3948227 - RNA, 11 nt, Human herpesvirus 1
ccuccaugggg

SEQ ID NO: 3948228 - RNA, 22 nt, Human herpesvirus 1
ccucccgauaaaaagcgccccg

SEQ ID NO: 3948229 - RNA, 17 nt, Human herpesvirus 1
ccucccgucaccgguuc

SEQ ID NO: 3948230 - RNA, 16 nt, Human herpesvirus 1
ccuccgacgcccagca

SEQ ID NO: 3948231 - RNA, 16 nt, Human herpesvirus 1
ccuccgcgccaggccc

SEQ ID NO: 3948232 - RNA, 21 nt, Human herpesvirus 1
ccuccgcgccaggcccgccgc

SEQ ID NO: 3948233 - RNA, 17 nt, Human herpesvirus 1
ccuccgcuggggccccc

SEQ ID NO: 3948234 - RNA, 15 nt, Human herpesvirus 1
ccucgaccaccaccu

SEQ ID NO: 3948235 - RNA, 13 nt, Human herpesvirus 1
ccucgaugacguc

SEQ ID NO: 3948236 - RNA, 21 nt, Human herpesvirus 1
ccucgcgccacacucaccggc

SEQ ID NO: 3948237 - RNA, 17 nt, Human herpesvirus 1
ccucucacacagcaucc

SEQ ID NO: 3948238 - RNA, 21 nt, Human herpesvirus 1
ccucucguucuccggggcccg

SEQ ID NO: 3948239 - RNA, 14 nt, Human herpesvirus 1
ccucugggcccgcc

SEQ ID NO: 3948240 - RNA, 23 nt, Human herpesvirus 1
ccucugggucugugccaccagcc

SEQ ID NO: 3948241 - RNA, 20 nt, Human herpesvirus 1
ccucugugucagguggcccu

SEQ ID NO: 3948242 - RNA, 16 nt, Human herpesvirus 1
ccugagcccggcggcg

SEQ ID NO: 3948243 - RNA, 17 nt, Human herpesvirus 1
ccugaucgccggcgcgg

SEQ ID NO: 3948244 - RNA, 13 nt, Human herpesvirus 1
ccugcccccugga

SEQ ID NO: 3948245 - RNA, 18 nt, Human herpesvirus 1
ccugcccgacagggccgu

SEQ ID NO: 3948246 - RNA, 16 nt, Human herpesvirus 1
ccugcgaggugcgcca

SEQ ID NO: 3948247 - RNA, 17 nt, Human herpesvirus 1
ccugcgccccgccgccc

SEQ ID NO: 3948248 - RNA, 20 nt, Human herpesvirus 1
ccugcuuauucucggggagc

SEQ ID NO: 3948249 - RNA, 22 nt, Human herpesvirus 1
ccuggagcucaaucuggcccaa

SEQ ID NO: 3948250 - RNA, 21 nt, Human herpesvirus 1
ccuggaggacggcgccggggc

SEQ ID NO: 3948251 - RNA, 15 nt, Human herpesvirus 1
ccuggauucgcugga

SEQ ID NO: 3948252 - RNA, 11 nt, Human herpesvirus 1
ccuggccagga

SEQ ID NO: 3948253 - RNA, 20 nt, Human herpesvirus 1
ccuggccccaguccccaaga

SEQ ID NO: 3948254 - RNA, 19 nt, Human herpesvirus 1
ccuggccgaggacaccccu

SEQ ID NO: 3948255 - RNA, 17 nt, Human herpesvirus 1
ccuggcgagcccagacc

SEQ ID NO: 3948256 - RNA, 16 nt, Human herpesvirus 1
ccuggcuggccgcucg

SEQ ID NO: 3948257 - RNA, 14 nt, Human herpesvirus 1
ccugggccaccuga

SEQ ID NO: 3948258 - RNA, 17 nt, Human herpesvirus 1
ccugggggacugcaucg

SEQ ID NO: 3948259 - RNA, 13 nt, Human herpesvirus 1
ccugggggcaccc

SEQ ID NO: 3948260 - RNA, 13 nt, Human herpesvirus 1
ccugggguuccug

SEQ ID NO: 3948261 - RNA, 16 nt, Human herpesvirus 1
ccuggucagaggccca

SEQ ID NO: 3948262 - RNA, 18 nt, Human herpesvirus 1
ccugucgcacccacagcu

SEQ ID NO: 3948263 - RNA, 21 nt, Human herpesvirus 1
ccuguguccgcuucucuuugg

SEQ ID NO: 3948264 - RNA, 18 nt, Human herpesvirus 1
ccuguuugucgccuggcu

SEQ ID NO: 3948265 - RNA, 19 nt, Human herpesvirus 1
ccuuccccccccccccuua

SEQ ID NO: 3948266 - RNA, 20 nt, Human herpesvirus 1
ccuuccuaacccagaccccg

SEQ ID NO: 3948267 - RNA, 20 nt, Human herpesvirus 1
ccuucugcgggucaccugcc

SEQ ID NO: 3948268 - RNA, 12 nt, Human herpesvirus 1
ccuucuucgccu

SEQ ID NO: 3948269 - RNA, 13 nt, Human herpesvirus 1
ccuuuggggcgcu

SEQ ID NO: 3948270 - RNA, 18 nt, Human herpesvirus 1
ccuuuguccccgccgaca

SEQ ID NO: 3948271 - RNA, 18 nt, Human herpesvirus 1
cgaacaaacgacccacca

SEQ ID NO: 3948272 - RNA, 18 nt, Human herpesvirus 1
cgaacaucuugagggggg

SEQ ID NO: 3948273 - RNA, 14 nt, Human herpesvirus 1
cgaacccagcgacc

SEQ ID NO: 3948274 - RNA, 21 nt, Human herpesvirus 1
cgaagacccccccggagccgg

SEQ ID NO: 3948275 - RNA, 15 nt, Human herpesvirus 1
cgaagagggggaccc

SEQ ID NO: 3948276 - RNA, 14 nt, Human herpesvirus 1
cgaagcuucggggg

SEQ ID NO: 3948277 - RNA, 12 nt, Human herpesvirus 1
cgacaacagccc

SEQ ID NO: 3948278 - RNA, 12 nt, Human herpesvirus 1
cgacaacugccu

SEQ ID NO: 3948279 - RNA, 12 nt, Human herpesvirus 1
cgacacccccau

SEQ ID NO: 3948280 - RNA, 13 nt, Human herpesvirus 1
cgacagccccccc

SEQ ID NO: 3948281 - RNA, 19 nt, Human herpesvirus 1
cgacagcccccccaagcgc

SEQ ID NO: 3948282 - RNA, 23 nt, Human herpesvirus 1
cgaccaacgucgccgcccugagc

SEQ ID NO: 3948283 - RNA, 22 nt, Human herpesvirus 1
cgaccaccauccccgcucccuc

SEQ ID NO: 3948284 - RNA, 17 nt, Human herpesvirus 1
cgaccagcgccgggugg

SEQ ID NO: 3948285 - RNA, 14 nt, Human herpesvirus 1
cgaccaggcgcgcc

SEQ ID NO: 3948286 - RNA, 19 nt, Human herpesvirus 1
cgaccaggcgcgccgcgag

SEQ ID NO: 3948287 - RNA, 21 nt, Human herpesvirus 1
cgacccccauggagcacgagc

SEQ ID NO: 3948288 - RNA, 15 nt, Human herpesvirus 1
cgacccgcaacgcgc

SEQ ID NO: 3948289 - RNA, 19 nt, Human herpesvirus 1
cgacccugaucccccgcgc

SEQ ID NO: 3948290 - RNA, 15 nt, Human herpesvirus 1
cgaccgacuccccgc

SEQ ID NO: 3948291 - RNA, 18 nt, Human herpesvirus 1
cgaccgcagucccugagu

SEQ ID NO: 3948292 - RNA, 19 nt, Human herpesvirus 1
cgaccgcagucccugaguu

SEQ ID NO: 3948293 - RNA, 21 nt, Human herpesvirus 1
cgaccgcgcccucgccacacc

SEQ ID NO: 3948294 - RNA, 13 nt, Human herpesvirus 1
cgacgaccugggg

SEQ ID NO: 3948295 - RNA, 13 nt, Human herpesvirus 1
cgacgcacacacc

SEQ ID NO: 3948296 - RNA, 14 nt, Human herpesvirus 1
cgacgcacacaccc

SEQ ID NO: 3948297 - RNA, 19 nt, Human herpesvirus 1
cgacgccgugggcaauggc

SEQ ID NO: 3948298 - RNA, 14 nt, Human herpesvirus 1
cgacggcccgacca

SEQ ID NO: 3948299 - RNA, 17 nt, Human herpesvirus 1
cgacgucgcgccugggu

SEQ ID NO: 3948300 - RNA, 16 nt, Human herpesvirus 1
cgacgugguccgcggg

SEQ ID NO: 3948301 - RNA, 22 nt, Human herpesvirus 1
cgacugccagcuaugggcccug

SEQ ID NO: 3948302 - RNA, 13 nt, Human herpesvirus 1
cgacugccccccc

SEQ ID NO: 3948303 - RNA, 18 nt, Human herpesvirus 1
cgacugggggggauccgc

SEQ ID NO: 3948304 - RNA, 21 nt, Human herpesvirus 1
cgacugggggggauccgcccu

SEQ ID NO: 3948305 - RNA, 14 nt, Human herpesvirus 1
cgacuugccccccu

SEQ ID NO: 3948306 - RNA, 16 nt, Human herpesvirus 1
cgagaucaaggacagc

SEQ ID NO: 3948307 - RNA, 20 nt, Human herpesvirus 1
cgagccaacgcccugaccaa

SEQ ID NO: 3948308 - RNA, 18 nt, Human herpesvirus 1
cgagcccaccguggcccg

SEQ ID NO: 3948309 - RNA, 14 nt, Human herpesvirus 1
cgagcccagacccc

SEQ ID NO: 3948310 - RNA, 14 nt, Human herpesvirus 1
cgagccgacggccc

SEQ ID NO: 3948311 - RNA, 19 nt, Human herpesvirus 1
cgagcucccagagacccca

SEQ ID NO: 3948312 - RNA, 23 nt, Human herpesvirus 1
cgaggacaccccucguggccccg

SEQ ID NO: 3948313 - RNA, 14 nt, Human herpesvirus 1
cgaggagguggacg

SEQ ID NO: 3948314 - RNA, 21 nt, Human herpesvirus 1
cgaggcgcauaaagggccggu

SEQ ID NO: 3948315 - RNA, 16 nt, Human herpesvirus 1
cgagggccgggcccca

SEQ ID NO: 3948316 - RNA, 19 nt, Human herpesvirus 1
cgaggggcagcugggggag

SEQ ID NO: 3948317 - RNA, 17 nt, Human herpesvirus 1
cgaggucccgugcaacc

SEQ ID NO: 3948318 - RNA, 13 nt, Human herpesvirus 1
cgagucuggaagg

SEQ ID NO: 3948319 - RNA, 20 nt, Human herpesvirus 1
cgaucccaacaacucccccg

SEQ ID NO: 3948320 - RNA, 15 nt, Human herpesvirus 1
cgaugagccaaccuc

SEQ ID NO: 3948321 - RNA, 17 nt, Human herpesvirus 1
cgaugcgaucgagccgu

SEQ ID NO: 3948322 - RNA, 11 nt, Human herpesvirus 1
cgauggcagga

SEQ ID NO: 3948323 - RNA, 16 nt, Human herpesvirus 1
cgauggcaggagccgc

SEQ ID NO: 3948324 - RNA, 11 nt, Human herpesvirus 1
cgcaagccccu

SEQ ID NO: 3948325 - RNA, 18 nt, Human herpesvirus 1
cgcaagcuaugcagcccc

SEQ ID NO: 3948326 - RNA, 15 nt, Human herpesvirus 1
cgcacauccucaccc

SEQ ID NO: 3948327 - RNA, 19 nt, Human herpesvirus 1
cgcaccaagccgcucuccg

SEQ ID NO: 3948328 - RNA, 22 nt, Human herpesvirus 1
cgcagcguccgguuggccgcgc

SEQ ID NO: 3948329 - RNA, 18 nt, Human herpesvirus 1
cgcagggcgccaugcgug

SEQ ID NO: 3948330 - RNA, 19 nt, Human herpesvirus 1
cgcaugaucuccggacccc

SEQ ID NO: 3948331 - RNA, 14 nt, Human herpesvirus 1
cgccaaacgccagc

SEQ ID NO: 3948332 - RNA, 17 nt, Human herpesvirus 1
cgccaaacgccagccug

SEQ ID NO: 3948333 - RNA, 14 nt, Human herpesvirus 1
cgccacaccacgcc

SEQ ID NO: 3948334 - RNA, 12 nt, Human herpesvirus 1
cgccacccaggc

SEQ ID NO: 3948335 - RNA, 19 nt, Human herpesvirus 1
cgccacccaggcgcugggc

SEQ ID NO: 3948336 - RNA, 16 nt, Human herpesvirus 1
cgccacgcgcggcugg

SEQ ID NO: 3948337 - RNA, 15 nt, Human herpesvirus 1
gaucgccugucuccu

SEQ ID NO: 3948338 - RNA, 14 nt, Human herpesvirus 1
gaucguccaccucc

SEQ ID NO: 3948339 - RNA, 15 nt, Human herpesvirus 1
gaucuacugcugggc

SEQ ID NO: 3948340 - RNA, 20 nt, Human herpesvirus 1
gaucuacugcugggccaugg

SEQ ID NO: 3948341 - RNA, 14 nt, Human herpesvirus 1
gaugcccacgggca

SEQ ID NO: 3948342 - RNA, 17 nt, Human herpesvirus 1
gauggaggagccccugc

SEQ ID NO: 3948343 - RNA, 12 nt, Human herpesvirus 1
gauggcccugga

SEQ ID NO: 3948344 - RNA, 13 nt, Human herpesvirus 1
gauggccugugcu

SEQ ID NO: 3948345 - RNA, 17 nt, Human herpesvirus 1
gaugggcaucgugggcg

SEQ ID NO: 3948346 - RNA, 17 nt, Human herpesvirus 1
gaugggcgaccuggggc

SEQ ID NO: 3948347 - RNA, 13 nt, Human herpesvirus 1
gauggggagagcc

SEQ ID NO: 3948348 - RNA, 14 nt, Human herpesvirus 1
gauggggagagccc

SEQ ID NO: 3948349 - RNA, 15 nt, Human herpesvirus 1
gauggggagagccca

SEQ ID NO: 3948350 - RNA, 13 nt, Human herpesvirus 1
gauguaggcuggu

SEQ ID NO: 3948351 - RNA, 13 nt, Human herpesvirus 1
gauucagcgggcg

SEQ ID NO: 3948352 - RNA, 13 nt, Human herpesvirus 1
gauuccgagggcc

SEQ ID NO: 3948353 - RNA, 22 nt, Human herpesvirus 1
gauuccgccaacgcacuguggc

SEQ ID NO: 3948354 - RNA, 21 nt, Human herpesvirus 1
gauugguccuugucugugccg

SEQ ID NO: 3948355 - RNA, 16 nt, Human herpesvirus 1
gcaacucgccccacga

SEQ ID NO: 3948356 - RNA, 16 nt, Human herpesvirus 1
gcaagguggugauggg

SEQ ID NO: 3948357 - RNA, 13 nt, Human herpesvirus 1
gcaauuugcaccc

SEQ ID NO: 3948358 - RNA, 16 nt, Human herpesvirus 1
gcaauuugcacccagc

SEQ ID NO: 3948359 - RNA, 18 nt, Human herpesvirus 1
gcaauuugcacccagccu

SEQ ID NO: 3948360 - RNA, 21 nt, Human herpesvirus 1
gcacacccccauccggugguc

SEQ ID NO: 3948361 - RNA, 18 nt, Human herpesvirus 1
gcacaucaaggugggcca

SEQ ID NO: 3948362 - RNA, 17 nt, Human herpesvirus 1
gcacauccucacccuca

SEQ ID NO: 3948363 - RNA, 20 nt, Human herpesvirus 1
gcacaugggggaggugcccc

SEQ ID NO: 3948364 - RNA, 21 nt, Human herpesvirus 1
gcaccaccgacucucccaccg

SEQ ID NO: 3948365 - RNA, 23 nt, Human herpesvirus 1
gcaccaccgacucucccaccgcc

SEQ ID NO: 3948366 - RNA, 16 nt, Human herpesvirus 1
gcacccaaggggccgu

SEQ ID NO: 3948367 - RNA, 14 nt, Human herpesvirus 1
gcaccccccccaaa

SEQ ID NO: 3948368 - RNA, 16 nt, Human herpesvirus 1
gcaccgagccaagggc

SEQ ID NO: 3948369 - RNA, 12 nt, Human herpesvirus 1
gcaccgggcccc

SEQ ID NO: 3948370 - RNA, 18 nt, Human herpesvirus 1
gcaccgugggacaccggc

SEQ ID NO: 3948371 - RNA, 17 nt, Human herpesvirus 1
gcacgaccugcgcuucg

SEQ ID NO: 3948372 - RNA, 19 nt, Human herpesvirus 1
gcacgagcgcgcugcucag

SEQ ID NO: 3948373 - RNA, 21 nt, Human herpesvirus 1
gcacgaguucaaccucgggug

SEQ ID NO: 3948374 - RNA, 15 nt, Human herpesvirus 1
gcacgccaaugcccu

SEQ ID NO: 3948375 - RNA, 20 nt, Human herpesvirus 1
gcacgccaaugcccucccug

SEQ ID NO: 3948376 - RNA, 13 nt, Human herpesvirus 1
gcacgcccccgcg

SEQ ID NO: 3948377 - RNA, 18 nt, Human herpesvirus 1
gcacggaacacaaggcca

SEQ ID NO: 3948378 - RNA, 21 nt, Human herpesvirus 1
gcacggaacacaaggccaaga

SEQ ID NO: 3948379 - RNA, 14 nt, Human herpesvirus 1
gcacucccugccgc

SEQ ID NO: 3948380 - RNA, 19 nt, Human herpesvirus 1
gcacuugcggcaagacccg

SEQ ID NO: 3948381 - RNA, 21 nt, Human herpesvirus 1
gcacuuuccccaugcgacagc

SEQ ID NO: 3948382 - RNA, 23 nt, Human herpesvirus 1
gcagacgguggugcccagcggcc

SEQ ID NO: 3948383 - RNA, 19 nt, Human herpesvirus 1
gcagcaugggacccacaga

SEQ ID NO: 3948384 - RNA, 23 nt, Human herpesvirus 1
gcagcguccgguuggccgcgcgg

SEQ ID NO: 3948385 - RNA, 22 nt, Human herpesvirus 1
gcaggcgacggcgucucccggg

SEQ ID NO: 3948386 - RNA, 19 nt, Human herpesvirus 1
gcaggcgguugucgggggu

SEQ ID NO: 3948387 - RNA, 13 nt, Human herpesvirus 1
gcagucccugagu

SEQ ID NO: 3948388 - RNA, 20 nt, Human herpesvirus 1
gcagugcauggcgcucaggg

SEQ ID NO: 3948389 - RNA, 15 nt, Human herpesvirus 1
gcaguucgagcagcc

SEQ ID NO: 3948390 - RNA, 14 nt, Human herpesvirus 1
gcauacgcucgggc

SEQ ID NO: 3948391 - RNA, 12 nt, Human herpesvirus 1
gcauccagggag

SEQ ID NO: 3948392 - RNA, 16 nt, Human herpesvirus 1
gcauccgagcaccccc

SEQ ID NO: 3948393 - RNA, 22 nt, Human herpesvirus 1
gcaucgacacgcgcguccuucu

SEQ ID NO: 3948394 - RNA, 11 nt, Human herpesvirus 1
gcaucgcgcgg

SEQ ID NO: 3948395 - RNA, 20 nt, Human herpesvirus 1
gcaucggaacacgccuaccg

SEQ ID NO: 3948396 - RNA, 14 nt, Human herpesvirus 1
gcaugcaccccaga

SEQ ID NO: 3948397 - RNA, 18 nt, Human herpesvirus 1
gcauggcgcagcugggac

SEQ ID NO: 3948398 - RNA, 16 nt, Human herpesvirus 1
gcauucgggccugccu

SEQ ID NO: 3948399 - RNA, 21 nt, Human herpesvirus 1
gcauucgggccugccugcggc

SEQ ID NO: 3948400 - RNA, 23 nt, Human herpesvirus 1
gcauucgggccugccugcggcuc

SEQ ID NO: 3948401 - RNA, 16 nt, Human herpesvirus 1
gcauuuauugacccaa

SEQ ID NO: 3948402 - RNA, 14 nt, Human herpesvirus 1
gccaaagccccgga

SEQ ID NO: 3948403 - RNA, 14 nt, Human herpesvirus 1
gccaacgcccugac

SEQ ID NO: 3948404 - RNA, 18 nt, Human herpesvirus 1
gccaagaagaagggcacg

SEQ ID NO: 3948405 - RNA, 22 nt, Human herpesvirus 1
gccacaccacgccacaacagcc

SEQ ID NO: 3948406 - RNA, 13 nt, Human herpesvirus 1
gccaccagccugg

SEQ ID NO: 3948407 - RNA, 13 nt, Human herpesvirus 1
gccaccauccuca

SEQ ID NO: 3948408 - RNA, 20 nt, Human herpesvirus 1
gccaccauccucaagcaggc

SEQ ID NO: 3948409 - RNA, 15 nt, Human herpesvirus 1
gccacccacccacca

SEQ ID NO: 3948410 - RNA, 17 nt, Human herpesvirus 1
gccacccacgccgccuc

SEQ ID NO: 3948411 - RNA, 19 nt, Human herpesvirus 1
gccaccccgaacaacaugg

SEQ ID NO: 3948412 - RNA, 22 nt, Human herpesvirus 1
gccacccgacaacagcccccgg

SEQ ID NO: 3948413 - RNA, 23 nt, Human herpesvirus 1
gccacccgacaacagcccccggg

SEQ ID NO: 3948414 - RNA, 14 nt, Human herpesvirus 1
gccacccucucuuc

SEQ ID NO: 3948415 - RNA, 12 nt, Human herpesvirus 1
gccaccgugggc

SEQ ID NO: 3948416 - RNA, 15 nt, Human herpesvirus 1
gccaccgugggccgg

SEQ ID NO: 3948417 - RNA, 14 nt, Human herpesvirus 1
gccaccucgcccac

SEQ ID NO: 3948418 - RNA, 18 nt, Human herpesvirus 1
gccacgucgaccgcgccc

SEQ ID NO: 3948419 - RNA, 16 nt, Human herpesvirus 1
gccacuggccgggagc

SEQ ID NO: 3948420 - RNA, 14 nt, Human herpesvirus 1
gccacuuccccgac

SEQ ID NO: 3948421 - RNA, 18 nt, Human herpesvirus 1
gccagaacucgccccgga

SEQ ID NO: 3948422 - RNA, 13 nt, Human herpesvirus 1
gccagcgacccgc

SEQ ID NO: 3948423 - RNA, 22 nt, Human herpesvirus 1
gccagcgcggcggggcccggcc

SEQ ID NO: 3948424 - RNA, 14 nt, Human herpesvirus 1
gccagggcgcuacg

SEQ ID NO: 3948425 - RNA, 19 nt, Human herpesvirus 1
gccaggucggcgaccgcca

SEQ ID NO: 3948426 - RNA, 22 nt, Human herpesvirus 1
gccaggucggcgaccgccagcc

SEQ ID NO: 3948427 - RNA, 16 nt, Human herpesvirus 1
gccaguccgcugcacc

SEQ ID NO: 3948428 - RNA, 16 nt, Human herpesvirus 1
gccauauccugagccc

SEQ ID NO: 3948429 - RNA, 16 nt, Human herpesvirus 1
gccaucgccucggcca

SEQ ID NO: 3948430 - RNA, 12 nt, Human herpesvirus 1
gccaugcuggcg

SEQ ID NO: 3948431 - RNA, 21 nt, Human herpesvirus 1
cgccagcgcggcggggcccgg

SEQ ID NO: 3948432 - RNA, 21 nt, Human herpesvirus 1
cgccagggcgcccccgcgcgg

SEQ ID NO: 3948433 - RNA, 18 nt, Human herpesvirus 1
cgccagugcguuccggac

SEQ ID NO: 3948434 - RNA, 19 nt, Human herpesvirus 1
cgccaucagccuuaccacg

SEQ ID NO: 3948435 - RNA, 21 nt, Human herpesvirus 1
cgcccaacucucgcaccaucc

SEQ ID NO: 3948436 - RNA, 17 nt, Human herpesvirus 1
cgcccaaugggccgggc

SEQ ID NO: 3948437 - RNA, 21 nt, Human herpesvirus 1
cgcccaccggaagcccaaccc

SEQ ID NO: 3948438 - RNA, 16 nt, Human herpesvirus 1
cgcccagcagcucccc

SEQ ID NO: 3948439 - RNA, 17 nt, Human herpesvirus 1
cgccccacacagcccuc

SEQ ID NO: 3948440 - RNA, 23 nt, Human herpesvirus 1
cgccccccaaaccauguccggca

SEQ ID NO: 3948441 - RNA, 18 nt, Human herpesvirus 1
cgccccccccccgucacc

SEQ ID NO: 3948442 - RNA, 18 nt, Human herpesvirus 1
cgccccgccguggcauuc

SEQ ID NO: 3948443 - RNA, 22 nt, Human herpesvirus 1
cgccccgugucugugggccaag

SEQ ID NO: 3948444 - RNA, 17 nt, Human herpesvirus 1
cgccccuaaccaggccu

SEQ ID NO: 3948445 - RNA, 12 nt, Human herpesvirus 1
cgccccucgggu

SEQ ID NO: 3948446 - RNA, 14 nt, Human herpesvirus 1
cgccccuuuccccc

SEQ ID NO: 3948447 - RNA, 15 nt, Human herpesvirus 1
cgcccgccccuggcg

SEQ ID NO: 3948448 - RNA, 14 nt, Human herpesvirus 1
cgcccgcgacgcca

SEQ ID NO: 3948449 - RNA, 16 nt, Human herpesvirus 1
cgcccggggccagcgc

SEQ ID NO: 3948450 - RNA, 21 nt, Human herpesvirus 1
cgcccguguucgagggccaag

SEQ ID NO: 3948451 - RNA, 19 nt, Human herpesvirus 1
cgccgaagagucggagccc

SEQ ID NO: 3948452 - RNA, 17 nt, Human herpesvirus 1
cgccgaccgacuccccg

SEQ ID NO: 3948453 - RNA, 15 nt, Human herpesvirus 1
cgccgacgaccuggu

SEQ ID NO: 3948454 - RNA, 16 nt, Human herpesvirus 1
cgccgacggacagcca

SEQ ID NO: 3948455 - RNA, 21 nt, Human herpesvirus 1
cgccgaucccgacuccccgga

SEQ ID NO: 3948456 - RNA, 16 nt, Human herpesvirus 1
cgccgcgacccgcacg

SEQ ID NO: 3948457 - RNA, 21 nt, Human herpesvirus 1
cgccgcgacccgcacgagccg

SEQ ID NO: 3948458 - RNA, 23 nt, Human herpesvirus 1
cgccgcggcucccggcccgggcc

SEQ ID NO: 3948459 - RNA, 19 nt, Human herpesvirus 1
cgccgcuaccgacgcuccc

SEQ ID NO: 3948460 - RNA, 22 nt, Human herpesvirus 1
cgccgcuaccgacgcucccguc

SEQ ID NO: 3948461 - RNA, 12 nt, Human herpesvirus 1
cgccggagccgg

SEQ ID NO: 3948462 - RNA, 21 nt, Human herpesvirus 1
cgccggcaugcaccccagagg

SEQ ID NO: 3948463 - RNA, 13 nt, Human herpesvirus 1
cgccggggcgguc

SEQ ID NO: 3948464 - RNA, 20 nt, Human herpesvirus 1
cgccuaccggccccugggcc

SEQ ID NO: 3948465 - RNA, 14 nt, Human herpesvirus 1
cgccucagggccuc

SEQ ID NO: 3948466 - RNA, 14 nt, Human herpesvirus 1
cgccucggccaccg

SEQ ID NO: 3948467 - RNA, 21 nt, Human herpesvirus 1
cgccucggucaccccaauccc

SEQ ID NO: 3948468 - RNA, 20 nt, Human herpesvirus 1
cgcgaaaucguggcgcggcu

SEQ ID NO: 3948469 - RNA, 16 nt, Human herpesvirus 1
cgcgacaacgagcccc

SEQ ID NO: 3948470 - RNA, 18 nt, Human herpesvirus 1
cgcgacccaccgggcccg

SEQ ID NO: 3948471 - RNA, 20 nt, Human herpesvirus 1
cgcgaccccauggccgcucc

SEQ ID NO: 3948472 - RNA, 21 nt, Human herpesvirus 1
cgcgacccucaccggguacgg

SEQ ID NO: 3948473 - RNA, 16 nt, Human herpesvirus 1
cgcgaccucaccacca

SEQ ID NO: 3948474 - RNA, 22 nt, Human herpesvirus 1
cgcgaccucaccaccaaggccc

SEQ ID NO: 3948475 - RNA, 19 nt, Human herpesvirus 1
cgcgacgccauggaccgca

SEQ ID NO: 3948476 - RNA, 23 nt, Human herpesvirus 1
cgcgacgggcagugaggguggca

SEQ ID NO: 3948477 - RNA, 17 nt, Human herpesvirus 1
cgcgagcucccagagac

SEQ ID NO: 3948478 - RNA, 18 nt, Human herpesvirus 1
cgcgagcucccugcggcu

SEQ ID NO: 3948479 - RNA, 21 nt, Human herpesvirus 1
cgcgaucccccgcccccggcu

SEQ ID NO: 3948480 - RNA, 18 nt, Human herpesvirus 1
cgcgccaaacgccagccu

SEQ ID NO: 3948481 - RNA, 12 nt, Human herpesvirus 1
cgcgccaucugg

SEQ ID NO: 3948482 - RNA, 14 nt, Human herpesvirus 1
cgcgcccacuacac

SEQ ID NO: 3948483 - RNA, 16 nt, Human herpesvirus 1
cgcgcccacuacacca

SEQ ID NO: 3948484 - RNA, 23 nt, Human herpesvirus 1
cgcgcccgggcgcguccccggcc

SEQ ID NO: 3948485 - RNA, 16 nt, Human herpesvirus 1
cgcgccgcgggccccc

SEQ ID NO: 3948486 - RNA, 14 nt, Human herpesvirus 1
cgcgccucccggcc

SEQ ID NO: 3948487 - RNA, 11 nt, Human herpesvirus 1
cgcgccugggu

SEQ ID NO: 3948488 - RNA, 12 nt, Human herpesvirus 1
cgcgcgcgcuuu

SEQ ID NO: 3948489 - RNA, 19 nt, Human herpesvirus 1
cgcgcgggggcgccggugg

SEQ ID NO: 3948490 - RNA, 17 nt, Human herpesvirus 1
cgcgcuaacggugaccc

SEQ ID NO: 3948491 - RNA, 18 nt, Human herpesvirus 1
cgcgcucaaccaccgcuc

SEQ ID NO: 3948492 - RNA, 12 nt, Human herpesvirus 1
cgcgcuccuccc

SEQ ID NO: 3948493 - RNA, 12 nt, Human herpesvirus 1
cgcggaccaccg

SEQ ID NO: 3948494 - RNA, 13 nt, Human herpesvirus 1
cgcggaggagcca

SEQ ID NO: 3948495 - RNA, 19 nt, Human herpesvirus 1
cgcggcaaagaccuuccgg

SEQ ID NO: 3948496 - RNA, 16 nt, Human herpesvirus 1
cgcggccgugggcgcc

SEQ ID NO: 3948497 - RNA, 14 nt, Human herpesvirus 1
cgcggcggggcccg

SEQ ID NO: 3948498 - RNA, 17 nt, Human herpesvirus 1
cgcggcggggcccggcc

SEQ ID NO: 3948499 - RNA, 21 nt, Human herpesvirus 1
cgcggcuucaucgcgccccuc

SEQ ID NO: 3948500 - RNA, 21 nt, Human herpesvirus 1
cgcgggcgacgccccggccgc

SEQ ID NO: 3948501 - RNA, 17 nt, Human herpesvirus 1
cgcgggcguucccgagc

SEQ ID NO: 3948502 - RNA, 19 nt, Human herpesvirus 1
cgcggggacacgauuccgg

SEQ ID NO: 3948503 - RNA, 12 nt, Human herpesvirus 1
cgcggggccucc

SEQ ID NO: 3948504 - RNA, 20 nt, Human herpesvirus 1
cgcgguggacagccaggagc

SEQ ID NO: 3948505 - RNA, 20 nt, Human herpesvirus 1
cgcgguuuaccgccaccagc

SEQ ID NO: 3948506 - RNA, 19 nt, Human herpesvirus 1
cgcguauagccuaugccac

SEQ ID NO: 3948507 - RNA, 15 nt, Human herpesvirus 1
cgcguccacccggag

SEQ ID NO: 3948508 - RNA, 17 nt, Human herpesvirus 1
cgcgucgacgucgcgcc

SEQ ID NO: 3948509 - RNA, 22 nt, Human herpesvirus 1
cgcgucgacgucgcgccugggu

SEQ ID NO: 3948510 - RNA, 17 nt, Human herpesvirus 1
cgcgucuggccccggcg

SEQ ID NO: 3948511 - RNA, 19 nt, Human herpesvirus 1
cgcgugcccacgucgcccc

SEQ ID NO: 3948512 - RNA, 22 nt, Human herpesvirus 1
cgcguguaauacuugcgcggcu

SEQ ID NO: 3948513 - RNA, 21 nt, Human herpesvirus 1
cgcguguuccccgggagcccc

SEQ ID NO: 3948514 - RNA, 12 nt, Human herpesvirus 1
cgcuagaccacg

SEQ ID NO: 3948515 - RNA, 21 nt, Human herpesvirus 1
cgcuauaaagccgccacccuc

SEQ ID NO: 3948516 - RNA, 13 nt, Human herpesvirus 1
cgcuaucggggcc

SEQ ID NO: 3948517 - RNA, 14 nt, Human herpesvirus 1
cgcuaucuccuggg

SEQ ID NO: 3948518 - RNA, 18 nt, Human herpesvirus 1
cgcuaugacggcaauaaa

SEQ ID NO: 3948519 - RNA, 22 nt, Human herpesvirus 1
cgcucccaaccgcgacccuccg

SEQ ID NO: 3948520 - RNA, 15 nt, Human herpesvirus 1
cgcugcccgacccgg

SEQ ID NO: 3948521 - RNA, 17 nt, Human herpesvirus 1
cgcugcccuucugucug

SEQ ID NO: 3948522 - RNA, 17 nt, Human herpesvirus 1
cgcugcgucggcauggu

SEQ ID NO: 3948523 - RNA, 20 nt, Human herpesvirus 1
cgcugcuccgccuggccugc

SEQ ID NO: 3948524 - RNA, 14 nt, Human herpesvirus 1
cgcugcugcggcca

SEQ ID NO: 3948525 - RNA, 15 nt, Human herpesvirus 1
cgcugcugcggccag

SEQ ID NO: 3948526 - RNA, 19 nt, Human herpesvirus 1
cgcuggcaacucgccccac

SEQ ID NO: 3948527 - RNA, 13 nt, Human herpesvirus 1
cgcuggggcugcc

SEQ ID NO: 3948528 - RNA, 16 nt, Human herpesvirus 1
cgcuuccaucgccccu

SEQ ID NO: 3948529 - RNA, 18 nt, Human herpesvirus 1
cgcuucccgguaugguaa

SEQ ID NO: 3948530 - RNA, 21 nt, Human herpesvirus 1
cggaaacugccuccaccgggc

SEQ ID NO: 3948531 - RNA, 21 nt, Human herpesvirus 1
cggacaacauccccccgacca

SEQ ID NO: 3948532 - RNA, 18 nt, Human herpesvirus 1
cggacccaaaauaauaaa

SEQ ID NO: 3948533 - RNA, 12 nt, Human herpesvirus 1
cggacccgcauc

SEQ ID NO: 3948534 - RNA, 21 nt, Human herpesvirus 1
cggacccgcaucccccgucug

SEQ ID NO: 3948535 - RNA, 21 nt, Human herpesvirus 1
cggacccucucuucucucccg

SEQ ID NO: 3948536 - RNA, 23 nt, Human herpesvirus 1
cggacgcgcggcgcgagcucccu

SEQ ID NO: 3948537 - RNA, 13 nt, Human herpesvirus 1
cggagcucccggg

SEQ ID NO: 3948538 - RNA, 16 nt, Human herpesvirus 1
cggagggaaccaccau

SEQ ID NO: 3948539 - RNA, 17 nt, Human herpesvirus 1
cggaggucuccgucacc

SEQ ID NO: 3948540 - RNA, 22 nt, Human herpesvirus 1
cggagguggggcgggggccccg

SEQ ID NO: 3948541 - RNA, 17 nt, Human herpesvirus 1
cggcaaagaccuuccgg

SEQ ID NO: 3948542 - RNA, 17 nt, Human herpesvirus 1
cggcaagauccucgggc

SEQ ID NO: 3948543 - RNA, 16 nt, Human herpesvirus 1
cggcaagcggagcggc

SEQ ID NO: 3948544 - RNA, 19 nt, Human herpesvirus 1
cggcaccuauggcgccuga

SEQ ID NO: 3948545 - RNA, 15 nt, Human herpesvirus 1
ugccgucgcuagacc

SEQ ID NO: 3948546 - RNA, 19 nt, Human herpesvirus 1
ugccugacccucuccggga

SEQ ID NO: 3948547 - RNA, 11 nt, Human herpesvirus 1
ugccugugugu

SEQ ID NO: 3948548 - RNA, 21 nt, Human herpesvirus 1
ugcgauucuagccucgugggg

SEQ ID NO: 3948549 - RNA, 22 nt, Human herpesvirus 1
ugcgauucuuuuaucccacgcg

SEQ ID NO: 3948550 - RNA, 23 nt, Human herpesvirus 1
ugcgcgaucccccgcccccggcu

SEQ ID NO: 3948551 - RNA, 20 nt, Human herpesvirus 1
ugcgcgggguuacgcgggcc

SEQ ID NO: 3948552 - RNA, 21 nt, Human herpesvirus 1
ugcgcgggguuacgcgggccc

SEQ ID NO: 3948553 - RNA, 17 nt, Human herpesvirus 1
ugcggaaagcaagaaca

SEQ ID NO: 3948554 - RNA, 23 nt, Human herpesvirus 1
ugcggacccucucuucucucccg

SEQ ID NO: 3948555 - RNA, 21 nt, Human herpesvirus 1
ugcggccggcgggacucuggg

SEQ ID NO: 3948556 - RNA, 17 nt, Human herpesvirus 1
ugcgggcgguccauuaa

SEQ ID NO: 3948557 - RNA, 17 nt, Human herpesvirus 1
ugcgggguugggauggg

SEQ ID NO: 3948558 - RNA, 15 nt, Human herpesvirus 1
ugcgguccggagaca

SEQ ID NO: 3948559 - RNA, 16 nt, Human herpesvirus 1
ugcgguccggagccgc

SEQ ID NO: 3948560 - RNA, 14 nt, Human herpesvirus 1
ugcguagcauaccu

SEQ ID NO: 3948561 - RNA, 18 nt, Human herpesvirus 1
ugcgucgggccucccgga

SEQ ID NO: 3948562 - RNA, 17 nt, Human herpesvirus 1
ugcgugccggucgccgc

SEQ ID NO: 3948563 - RNA, 20 nt, Human herpesvirus 1
ugcucuggggucccugucgc

SEQ ID NO: 3948564 - RNA, 23 nt, Human herpesvirus 1
ugcucuggggucccugucgccuc

SEQ ID NO: 3948565 - RNA, 14 nt, Human herpesvirus 1
ugcugcgcggcgcc

SEQ ID NO: 3948566 - RNA, 20 nt, Human herpesvirus 1
ugcuuauucucggggagcuu

SEQ ID NO: 3948567 - RNA, 19 nt, Human herpesvirus 1
uggaacgaggccgcagccu

SEQ ID NO: 3948568 - RNA, 18 nt, Human herpesvirus 1
uggagccugagcuggcga

SEQ ID NO: 3948569 - RNA, 19 nt, Human herpesvirus 1
uggagcucaaucuggccca

SEQ ID NO: 3948570 - RNA, 16 nt, Human herpesvirus 1
uggaggacggcgccgg

SEQ ID NO: 3948571 - RNA, 20 nt, Human herpesvirus 1
uggcacaccaccgaccucaa

SEQ ID NO: 3948572 - RNA, 17 nt, Human herpesvirus 1
uggccagcggcccgggg

SEQ ID NO: 3948573 - RNA, 17 nt, Human herpesvirus 1
uggccaucgguccccuc

SEQ ID NO: 3948574 - RNA, 21 nt, Human herpesvirus 1
uggccccccgcguccaaaccc

SEQ ID NO: 3948575 - RNA, 17 nt, Human herpesvirus 1
uggcccccgccucuggg

SEQ ID NO: 3948576 - RNA, 16 nt, Human herpesvirus 1
uggccccggcccccaa

SEQ ID NO: 3948577 - RNA, 21 nt, Human herpesvirus 1
uggcccuggcggacggcggcc

SEQ ID NO: 3948578 - RNA, 15 nt, Human herpesvirus 1
uggccgggagcacca

SEQ ID NO: 3948579 - RNA, 20 nt, Human herpesvirus 1
uggcgcguaucugguccccg

SEQ ID NO: 3948580 - RNA, 12 nt, Human herpesvirus 1
uggcuccgggcc

SEQ ID NO: 3948581 - RNA, 23 nt, Human herpesvirus 1
uggcuucggccguuucuccgccc

SEQ ID NO: 3948582 - RNA, 22 nt, Human herpesvirus 1
ugggcccugcuccggcggggcc

SEQ ID NO: 3948583 - RNA, 22 nt, Human herpesvirus 1
ugggccgggccgcccacuuccc

SEQ ID NO: 3948584 - RNA, 14 nt, Human herpesvirus 1
ugggcgcucacgag

SEQ ID NO: 3948585 - RNA, 15 nt, Human herpesvirus 1
ugggcggccucuccg

SEQ ID NO: 3948586 - RNA, 18 nt, Human herpesvirus 1
uggggacgguggcgccgc

SEQ ID NO: 3948587 - RNA, 19 nt, Human herpesvirus 1
ugggggccugucccauccg

SEQ ID NO: 3948588 - RNA, 15 nt, Human herpesvirus 1
uggggggguccggca

SEQ ID NO: 3948589 - RNA, 15 nt, Human herpesvirus 1
ugggguuucuguguu

SEQ ID NO: 3948590 - RNA, 14 nt, Human herpesvirus 1
uggguggucucugg

SEQ ID NO: 3948591 - RNA, 20 nt, Human herpesvirus 1
uggguguguuuauugggcgc

SEQ ID NO: 3948592 - RNA, 16 nt, Human herpesvirus 1
uggguuucacugaaac

SEQ ID NO: 3948593 - RNA, 15 nt, Human herpesvirus 1
uggucagaggcccac

SEQ ID NO: 3948594 - RNA, 14 nt, Human herpesvirus 1
ugguccgccuagcc

SEQ ID NO: 3948595 - RNA, 16 nt, Human herpesvirus 1
ugguccucgaggaggc

SEQ ID NO: 3948596 - RNA, 22 nt, Human herpesvirus 1
uggucggcgucggugaucccca

SEQ ID NO: 3948597 - RNA, 18 nt, Human herpesvirus 1
uggucucuggccgcgccc

SEQ ID NO: 3948598 - RNA, 15 nt, Human herpesvirus 1
uggugcgagcugcag

SEQ ID NO: 3948599 - RNA, 20 nt, Human herpesvirus 1
ugguggcaccuccccagcgg

SEQ ID NO: 3948600 - RNA, 16 nt, Human herpesvirus 1
uguacugcggucuguc

SEQ ID NO: 3948601 - RNA, 20 nt, Human herpesvirus 1
uguaucgcaucuuuccugug

SEQ ID NO: 3948602 - RNA, 14 nt, Human herpesvirus 1
ugucacgcgggagg

SEQ ID NO: 3948603 - RNA, 21 nt, Human herpesvirus 1
uguccccgaacaaacgaccca

SEQ ID NO: 3948604 - RNA, 19 nt, Human herpesvirus 1
agccgccccagcaccgaca

SEQ ID NO: 3948605 - RNA, 14 nt, Human herpesvirus 1
agccggccccggca

SEQ ID NO: 3948606 - RNA, 15 nt, Human herpesvirus 1
agccguaacccaacc

SEQ ID NO: 3948607 - RNA, 20 nt, Human herpesvirus 1
agccuaugccacgccagggc

SEQ ID NO: 3948608 - RNA, 14 nt, Human herpesvirus 1
agccuuuaacuaca

SEQ ID NO: 3948609 - RNA, 15 nt, Human herpesvirus 1
agccuuuaacuacau

SEQ ID NO: 3948610 - RNA, 15 nt, Human herpesvirus 1
agcgaagcagccgcc

SEQ ID NO: 3948611 - RNA, 17 nt, Human herpesvirus 1
agcgacguccugggcca

SEQ ID NO: 3948612 - RNA, 22 nt, Human herpesvirus 1
agcgacguccugggccaccuga

SEQ ID NO: 3948613 - RNA, 17 nt, Human herpesvirus 1
agcgcccgucggucugc

SEQ ID NO: 3948614 - RNA, 21 nt, Human herpesvirus 1
agcgccggcggucgcgcuccu

SEQ ID NO: 3948615 - RNA, 15 nt, Human herpesvirus 1
agcgcggccgugggc

SEQ ID NO: 3948616 - RNA, 12 nt, Human herpesvirus 1
agcgcugcugcg

SEQ ID NO: 3948617 - RNA, 19 nt, Human herpesvirus 1
agcggcacgaccggcucca

SEQ ID NO: 3948618 - RNA, 15 nt, Human herpesvirus 1
agcgggggggcggcc

SEQ ID NO: 3948619 - RNA, 18 nt, Human herpesvirus 1
agcucccagagaccccag

SEQ ID NO: 3948620 - RNA, 20 nt, Human herpesvirus 1
agcucccagagaccccaggg

SEQ ID NO: 3948621 - RNA, 15 nt, Human herpesvirus 1
agcucgcggcccggg

SEQ ID NO: 3948622 - RNA, 22 nt, Human herpesvirus 1
agcucgucgggguggcacagaa

SEQ ID NO: 3948623 - RNA, 21 nt, Human herpesvirus 1
agcugaugucccucauuuuac

SEQ ID NO: 3948624 - RNA, 22 nt, Human herpesvirus 1
agcuguccgagacccccaacgc

SEQ ID NO: 3948625 - RNA, 16 nt, Human herpesvirus 1
agcuucagcgccguca

SEQ ID NO: 3948626 - RNA, 14 nt, Human herpesvirus 1
aggacaaacccaac

SEQ ID NO: 3948627 - RNA, 12 nt, Human herpesvirus 1
aggagcgccggc

SEQ ID NO: 3948628 - RNA, 16 nt, Human herpesvirus 1
aggaugccagccaggg

SEQ ID NO: 3948629 - RNA, 20 nt, Human herpesvirus 1
aggaugccagccagggcggc

SEQ ID NO: 3948630 - RNA, 19 nt, Human herpesvirus 1
aggauggagagcgaaggcu

SEQ ID NO: 3948631 - RNA, 15 nt, Human herpesvirus 1
aggcacggcagcaug

SEQ ID NO: 3948632 - RNA, 14 nt, Human herpesvirus 1
aggcccgccgccac

SEQ ID NO: 3948633 - RNA, 13 nt, Human herpesvirus 1
aggcccgggccac

SEQ ID NO: 3948634 - RNA, 16 nt, Human herpesvirus 1
aggcccgggccacggc

SEQ ID NO: 3948635 - RNA, 15 nt, Human herpesvirus 1
aggccuccacccccu

SEQ ID NO: 3948636 - RNA, 15 nt, Human herpesvirus 1
aggcgaccgccggcg

SEQ ID NO: 3948637 - RNA, 19 nt, Human herpesvirus 1
aggcgcauaaagggccggu

SEQ ID NO: 3948638 - RNA, 13 nt, Human herpesvirus 1
aggcgccugcccc

SEQ ID NO: 3948639 - RNA, 23 nt, Human herpesvirus 1
aggcgccugccccgccacccagu

SEQ ID NO: 3948640 - RNA, 15 nt, Human herpesvirus 1
aggcgcuuccccgcg

SEQ ID NO: 3948641 - RNA, 12 nt, Human herpesvirus 1
aggcggccgagg

SEQ ID NO: 3948642 - RNA, 18 nt, Human herpesvirus 1
aggcugucgacgcccccu

SEQ ID NO: 3948643 - RNA, 17 nt, Human herpesvirus 1
agggcgacgccgugggc

SEQ ID NO: 3948644 - RNA, 13 nt, Human herpesvirus 1
agggcgaggaggg

SEQ ID NO: 3948645 - RNA, 19 nt, Human herpesvirus 1
agggcgaggagggcggcga

SEQ ID NO: 3948646 - RNA, 14 nt, Human herpesvirus 1
agggcgcccccgcg

SEQ ID NO: 3948647 - RNA, 18 nt, Human herpesvirus 1
agggcggccagccgcgcg

SEQ ID NO: 3948648 - RNA, 17 nt, Human herpesvirus 1
aggggaaaagugaaaga

SEQ ID NO: 3948649 - RNA, 18 nt, Human herpesvirus 1
aggggaaaagugaaagac

SEQ ID NO: 3948650 - RNA, 11 nt, Human herpesvirus 1
agggggacccc

SEQ ID NO: 3948651 - RNA, 18 nt, Human herpesvirus 1
aggguauggggcggggga

SEQ ID NO: 3948652 - RNA, 13 nt, Human herpesvirus 1
agggugucccagg

SEQ ID NO: 3948653 - RNA, 14 nt, Human herpesvirus 1
agguacggggcggc

SEQ ID NO: 3948654 - RNA, 22 nt, Human herpesvirus 1
aguacaaccccucgcgggugga

SEQ ID NO: 3948655 - RNA, 16 nt, Human herpesvirus 1
agucccgaagaccgcc

SEQ ID NO: 3948656 - RNA, 23 nt, Human herpesvirus 1
agucccuccaaucgccgguuccu

SEQ ID NO: 3948657 - RNA, 16 nt, Human herpesvirus 1
agucccugaguuggga

SEQ ID NO: 3948658 - RNA, 17 nt, Human herpesvirus 1
agucccugaguugggaa

SEQ ID NO: 3948659 - RNA, 13 nt, Human herpesvirus 1
agugccccgaccc

SEQ ID NO: 3948660 - RNA, 16 nt, Human herpesvirus 1
aguggcaggaggugga

SEQ ID NO: 3948661 - RNA, 20 nt, Human herpesvirus 1
aguguuucguuccuuccccc

SEQ ID NO: 3948662 - RNA, 20 nt, Human herpesvirus 1
aguucaccguggccugggac

SEQ ID NO: 3948663 - RNA, 21 nt, Human herpesvirus 1
aguugagccgcgccauccuca

SEQ ID NO: 3948664 - RNA, 13 nt, Human herpesvirus 1
aguuuauccugga

SEQ ID NO: 3948665 - RNA, 22 nt, Human herpesvirus 1
auaaaggcggugguaucuaguu

SEQ ID NO: 3948666 - RNA, 17 nt, Human herpesvirus 1
auaaccgaccgcagucc

SEQ ID NO: 3948667 - RNA, 20 nt, Human herpesvirus 1
auaguuugguccccccucua

SEQ ID NO: 3948668 - RNA, 14 nt, Human herpesvirus 1
auauaaggccuggg

SEQ ID NO: 3948669 - RNA, 16 nt, Human herpesvirus 1
aucaaggugggccagc

SEQ ID NO: 3948670 - RNA, 21 nt, Human herpesvirus 1
aucaccccgcaauuugcaccc

SEQ ID NO: 3948671 - RNA, 20 nt, Human herpesvirus 1
aucacccgagucucugggcg

SEQ ID NO: 3948672 - RNA, 18 nt, Human herpesvirus 1
aucagccucgucccgccc

SEQ ID NO: 3948673 - RNA, 22 nt, Human herpesvirus 1
aucagccuuaccacgcccgacc

SEQ ID NO: 3948674 - RNA, 14 nt, Human herpesvirus 1
auccaccaccuuca

SEQ ID NO: 3948675 - RNA, 14 nt, Human herpesvirus 1
auccagggagaaac

SEQ ID NO: 3948676 - RNA, 23 nt, Human herpesvirus 1
aucccacaaacacaaaacacacg

SEQ ID NO: 3948677 - RNA, 21 nt, Human herpesvirus 1
aucccacguccccgggucugu

SEQ ID NO: 3948678 - RNA, 15 nt, Human herpesvirus 1
aucccaggaucacac

SEQ ID NO: 3948679 - RNA, 18 nt, Human herpesvirus 1
aucccggguuaauguaaa

SEQ ID NO: 3948680 - RNA, 16 nt, Human herpesvirus 1
auccguggccccggcc

SEQ ID NO: 3948681 - RNA, 15 nt, Human herpesvirus 1
auccucaagcaggcc

SEQ ID NO: 3948682 - RNA, 13 nt, Human herpesvirus 1
aucgccccuggcg

SEQ ID NO: 3948683 - RNA, 23 nt, Human herpesvirus 1
aucgccggggaccgcagccuggu

SEQ ID NO: 3948684 - RNA, 22 nt, Human herpesvirus 1
aucgcgggcgccauggcgggac

SEQ ID NO: 3948685 - RNA, 15 nt, Human herpesvirus 1
aucgggaugcugccc

SEQ ID NO: 3948686 - RNA, 16 nt, Human herpesvirus 1
aucgggaugcugcccc

SEQ ID NO: 3948687 - RNA, 12 nt, Human herpesvirus 1
aucgucggugcc

SEQ ID NO: 3948688 - RNA, 13 nt, Human herpesvirus 1
aucuccugggggc

SEQ ID NO: 3948689 - RNA, 17 nt, Human herpesvirus 1
aucucugggcgggccgu

SEQ ID NO: 3948690 - RNA, 21 nt, Human herpesvirus 1
aucucuguaacggggacccca

SEQ ID NO: 3948691 - RNA, 16 nt, Human herpesvirus 1
augcacgaccuguuga

SEQ ID NO: 3948692 - RNA, 20 nt, Human herpesvirus 1
augggcaucgugggcggcgu

SEQ ID NO: 3948693 - RNA, 19 nt, Human herpesvirus 1
augggcuacuaccuaggca

SEQ ID NO: 3948694 - RNA, 18 nt, Human herpesvirus 1
auggugaucgccugucuc

SEQ ID NO: 3948695 - RNA, 12 nt, Human herpesvirus 1
augguugcagug

SEQ ID NO: 3948696 - RNA, 20 nt, Human herpesvirus 1
auguccccaaaauaaaagac

SEQ ID NO: 3948697 - RNA, 18 nt, Human herpesvirus 1
augucggguccaaacucc

SEQ ID NO: 3948698 - RNA, 13 nt, Human herpesvirus 1
augugauaugcua

SEQ ID NO: 3948699 - RNA, 18 nt, Human herpesvirus 1
auguggauaaaaagccag

SEQ ID NO: 3948700 - RNA, 17 nt, Human herpesvirus 1
auuacuuuaagcgcugc

SEQ ID NO: 3948701 - RNA, 17 nt, Human herpesvirus 1
auuggcucggacgagac

SEQ ID NO: 3948702 - RNA, 11 nt, Human herpesvirus 1
auuuggggcgc

SEQ ID NO: 3948703 - RNA, 16 nt, Human herpesvirus 1
caaaaaccgccccccc

SEQ ID NO: 3948704 - RNA, 13 nt, Human herpesvirus 1
caaacaggagcug

SEQ ID NO: 3948705 - RNA, 19 nt, Human herpesvirus 1
caacacaacggcaugccuc

SEQ ID NO: 3948706 - RNA, 18 nt, Human herpesvirus 1
caaccacccgcaccccca

SEQ ID NO: 3948707 - RNA, 19 nt, Human herpesvirus 1
caacccccuaagacccacc

SEQ ID NO: 3948708 - RNA, 18 nt, Human herpesvirus 1
caaccccggucucccagg

SEQ ID NO: 3948709 - RNA, 21 nt, Human herpesvirus 1
caacggcaugccucugcgggc

SEQ ID NO: 3948710 - RNA, 19 nt, Human herpesvirus 1
caacuccagaccaccgguc

SEQ ID NO: 3948711 - RNA, 15 nt, Human herpesvirus 1
caagaccccccuggc

SEQ ID NO: 3948712 - RNA, 16 nt, Human herpesvirus 1
caagauggccgacccc

SEQ ID NO: 3948713 - RNA, 22 nt, Human herpesvirus 1
caagccccuagccccgcccccu

SEQ ID NO: 3948714 - RNA, 13 nt, Human herpesvirus 1
caagccgccccag

SEQ ID NO: 3948715 - RNA, 15 nt, Human herpesvirus 1
caagccgcucuccgg

SEQ ID NO: 3948716 - RNA, 16 nt, Human herpesvirus 1
caagccgcucuccgga

SEQ ID NO: 3948717 - RNA, 14 nt, Human herpesvirus 1
caaggacagcggcc

SEQ ID NO: 3948718 - RNA, 19 nt, Human herpesvirus 1
caaggcguccauucucccg

SEQ ID NO: 3948719 - RNA, 17 nt, Human herpesvirus 1
cccugagccgcuuuccu

SEQ ID NO: 3948720 - RNA, 15 nt, Human herpesvirus 1
cccugaguugggaau

SEQ ID NO: 3948721 - RNA, 21 nt, Human herpesvirus 1
cccugcgcgagcaccugcggg

SEQ ID NO: 3948722 - RNA, 18 nt, Human herpesvirus 1
cccugcugcaggcccccc

SEQ ID NO: 3948723 - RNA, 19 nt, Human herpesvirus 1
cccuggacacccucuucgu

SEQ ID NO: 3948724 - RNA, 23 nt, Human herpesvirus 1
cccuggacgugggccucacccac

SEQ ID NO: 3948725 - RNA, 14 nt, Human herpesvirus 1
cccuggcgagccca

SEQ ID NO: 3948726 - RNA, 17 nt, Human herpesvirus 1
cccuggugaagaccacu

SEQ ID NO: 3948727 - RNA, 19 nt, Human herpesvirus 1
cccugguguuucuggggag

SEQ ID NO: 3948728 - RNA, 20 nt, Human herpesvirus 1
cccugguguuucuggggagc

SEQ ID NO: 3948729 - RNA, 13 nt, Human herpesvirus 1
cccugucgccucc

SEQ ID NO: 3948730 - RNA, 13 nt, Human herpesvirus 1
cccugugucgcgc

SEQ ID NO: 3948731 - RNA, 19 nt, Human herpesvirus 1
cccuguuggucggggagug

SEQ ID NO: 3948732 - RNA, 16 nt, Human herpesvirus 1
cccuuaauaaauuuua

SEQ ID NO: 3948733 - RNA, 17 nt, Human herpesvirus 1
cccuuguauguccccaa

SEQ ID NO: 3948734 - RNA, 20 nt, Human herpesvirus 1
ccgaaccaccacugcacucc

SEQ ID NO: 3948735 - RNA, 18 nt, Human herpesvirus 1
ccgaagagucggagcccg

SEQ ID NO: 3948736 - RNA, 17 nt, Human herpesvirus 1
ccgacaacagcccccgg

SEQ ID NO: 3948737 - RNA, 16 nt, Human herpesvirus 1
ccgacaccaccagcug

SEQ ID NO: 3948738 - RNA, 15 nt, Human herpesvirus 1
ccgacaucaccaccg

SEQ ID NO: 3948739 - RNA, 15 nt, Human herpesvirus 1
ccgaccacccggaac

SEQ ID NO: 3948740 - RNA, 13 nt, Human herpesvirus 1
ccgacccccuugu

SEQ ID NO: 3948741 - RNA, 16 nt, Human herpesvirus 1
ccgaccucggacgcca

SEQ ID NO: 3948742 - RNA, 16 nt, Human herpesvirus 1
ccgacgaaucccccaa

SEQ ID NO: 3948743 - RNA, 13 nt, Human herpesvirus 1
ccgacgaggugcg

SEQ ID NO: 3948744 - RNA, 17 nt, Human herpesvirus 1
ccgacgcccagcagcuc

SEQ ID NO: 3948745 - RNA, 22 nt, Human herpesvirus 1
ccgacggcccgaagccugcugu

SEQ ID NO: 3948746 - RNA, 18 nt, Human herpesvirus 1
ccgacggcguaguggagg

SEQ ID NO: 3948747 - RNA, 14 nt, Human herpesvirus 1
ccgacucaccucaa

SEQ ID NO: 3948748 - RNA, 15 nt, Human herpesvirus 1
ccgacugccagcuau

SEQ ID NO: 3948749 - RNA, 22 nt, Human herpesvirus 1
ccgagaguuugaucguggacgg

SEQ ID NO: 3948750 - RNA, 15 nt, Human herpesvirus 1
ccgagcuuguuuucg

SEQ ID NO: 3948751 - RNA, 17 nt, Human herpesvirus 1
ccgaggcgauuagccag

SEQ ID NO: 3948752 - RNA, 15 nt, Human herpesvirus 1
ccgaucgcagcgucc

SEQ ID NO: 3948753 - RNA, 21 nt, Human herpesvirus 1
ccgauucucuuccgacgccau

SEQ ID NO: 3948754 - RNA, 20 nt, Human herpesvirus 1
ccgcaaaucccaccaaacug

SEQ ID NO: 3948755 - RNA, 13 nt, Human herpesvirus 1
ccgcaaccagcug

SEQ ID NO: 3948756 - RNA, 16 nt, Human herpesvirus 1
ccgcaacgcgcugggg

SEQ ID NO: 3948757 - RNA, 22 nt, Human herpesvirus 1
ccgcaauuucaccgccccagca

SEQ ID NO: 3948758 - RNA, 18 nt, Human herpesvirus 1
ccgcaauuugcacccagc

SEQ ID NO: 3948759 - RNA, 21 nt, Human herpesvirus 1
ccgcaauuugcacccagccuu

SEQ ID NO: 3948760 - RNA, 22 nt, Human herpesvirus 1
ccgcaauuugcacccagccuuu

SEQ ID NO: 3948761 - RNA, 13 nt, Human herpesvirus 1
ccgcagccugguc

SEQ ID NO: 3948762 - RNA, 17 nt, Human herpesvirus 1
ccgcagccuucucccgg

SEQ ID NO: 3948763 - RNA, 15 nt, Human herpesvirus 1
ccgcauacuccggcc

SEQ ID NO: 3948764 - RNA, 19 nt, Human herpesvirus 1
ccgcaucccccgucugggu

SEQ ID NO: 3948765 - RNA, 14 nt, Human herpesvirus 1
ccgccagcgcggcg

SEQ ID NO: 3948766 - RNA, 19 nt, Human herpesvirus 1
ccgccaucgagccaacgcc

SEQ ID NO: 3948767 - RNA, 16 nt, Human herpesvirus 1
ccgccaucgccuaccu

SEQ ID NO: 3948768 - RNA, 20 nt, Human herpesvirus 1
ccgcccaaugggccgggccg

SEQ ID NO: 3948769 - RNA, 17 nt, Human herpesvirus 1
ccgcccaccgcugggcg

SEQ ID NO: 3948770 - RNA, 18 nt, Human herpesvirus 1
ccgccccccccccgucac

SEQ ID NO: 3948771 - RNA, 17 nt, Human herpesvirus 1
ccgccccuaucgcucga

SEQ ID NO: 3948772 - RNA, 12 nt, Human herpesvirus 1
ccgcccgccccu

SEQ ID NO: 3948773 - RNA, 17 nt, Human herpesvirus 1
ccgcccgugcugccguc

SEQ ID NO: 3948774 - RNA, 17 nt, Human herpesvirus 1
ccgcccuggacacccuc

SEQ ID NO: 3948775 - RNA, 15 nt, Human herpesvirus 1
ccgccgacgaccugg

SEQ ID NO: 3948776 - RNA, 22 nt, Human herpesvirus 1
ccgccgcaaagccacccacgcc

SEQ ID NO: 3948777 - RNA, 15 nt, Human herpesvirus 1
ccgccucggcccgcg

SEQ ID NO: 3948778 - RNA, 18 nt, Human herpesvirus 1
ccgccucgguccaccgca

SEQ ID NO: 3948779 - RNA, 23 nt, Human herpesvirus 1
ccgccuggaggacggcgccgggg

SEQ ID NO: 3948780 - RNA, 16 nt, Human herpesvirus 1
ccgccuggucccccgg

SEQ ID NO: 3948781 - RNA, 15 nt, Human herpesvirus 1
ccgcgaccaccccga

SEQ ID NO: 3948782 - RNA, 13 nt, Human herpesvirus 1
ccgcgacccccgg

SEQ ID NO: 3948783 - RNA, 16 nt, Human herpesvirus 1
ccgcgagauggccgcc

SEQ ID NO: 3948784 - RNA, 15 nt, Human herpesvirus 1
ccgcgagcagagccg

SEQ ID NO: 3948785 - RNA, 19 nt, Human herpesvirus 1
ccgcgcaugaucuccggac

SEQ ID NO: 3948786 - RNA, 16 nt, Human herpesvirus 1
ccgcgccgucgggcgu

SEQ ID NO: 3948787 - RNA, 12 nt, Human herpesvirus 1
ccgcgcgggggc

SEQ ID NO: 3948788 - RNA, 16 nt, Human herpesvirus 1
ccgcgcuaugacggca

SEQ ID NO: 3948789 - RNA, 19 nt, Human herpesvirus 1
ccgcgcuaugacggcaaua

SEQ ID NO: 3948790 - RNA, 22 nt, Human herpesvirus 1
ccgcggccccagcccucucccc

SEQ ID NO: 3948791 - RNA, 16 nt, Human herpesvirus 1
ccgcggccuggguugg

SEQ ID NO: 3948792 - RNA, 18 nt, Human herpesvirus 1
ccgcggccuggguuggcg

SEQ ID NO: 3948793 - RNA, 15 nt, Human herpesvirus 1
ccgcgggaggccgcc

SEQ ID NO: 3948794 - RNA, 14 nt, Human herpesvirus 1
ccgcgggccacgcc

SEQ ID NO: 3948795 - RNA, 21 nt, Human herpesvirus 1
ccgcgggccacgccacccugc

SEQ ID NO: 3948796 - RNA, 16 nt, Human herpesvirus 1
ccgcgggcccccggcc

SEQ ID NO: 3948797 - RNA, 14 nt, Human herpesvirus 1
ccgcgguccagacc

SEQ ID NO: 3948798 - RNA, 16 nt, Human herpesvirus 1
ccgcgguggacagcca

SEQ ID NO: 3948799 - RNA, 19 nt, Human herpesvirus 1
ccgcgguggacagccagga

SEQ ID NO: 3948800 - RNA, 14 nt, Human herpesvirus 1
ccgcguccacccgg

SEQ ID NO: 3948801 - RNA, 21 nt, Human herpesvirus 1
ccgcguuugagaccgccggca

SEQ ID NO: 3948802 - RNA, 15 nt, Human herpesvirus 1
ccgcuccccaagcau

SEQ ID NO: 3948803 - RNA, 20 nt, Human herpesvirus 1
ccgcucggcggcagcccgga

SEQ ID NO: 3948804 - RNA, 15 nt, Human herpesvirus 1
ccgcucugacggccc

SEQ ID NO: 3948805 - RNA, 18 nt, Human herpesvirus 1
ccgcugcccgacccggcc

SEQ ID NO: 3948806 - RNA, 14 nt, Human herpesvirus 1
ccgcugcgcauccc

SEQ ID NO: 3948807 - RNA, 17 nt, Human herpesvirus 1
ccgcugcgcaucccccc

SEQ ID NO: 3948808 - RNA, 21 nt, Human herpesvirus 1
ccgcuucucuuuggccauccc

SEQ ID NO: 3948809 - RNA, 18 nt, Human herpesvirus 1
ccgcuuuaucccacggcc

SEQ ID NO: 3948810 - RNA, 22 nt, Human herpesvirus 1
ccggaagcccaacccacacgca

SEQ ID NO: 3948811 - RNA, 18 nt, Human herpesvirus 1
ccggacgcgcggcgcgag

SEQ ID NO: 3948812 - RNA, 16 nt, Human herpesvirus 1
ccggagcucgcggcac

SEQ ID NO: 3948813 - RNA, 20 nt, Human herpesvirus 1
ccggccccugggccccggga

SEQ ID NO: 3948814 - RNA, 15 nt, Human herpesvirus 1
ccggcccuaacccca

SEQ ID NO: 3948815 - RNA, 15 nt, Human herpesvirus 1
ccggcccugcugcug

SEQ ID NO: 3948816 - RNA, 20 nt, Human herpesvirus 1
ccggcgcguguaccacaucc

SEQ ID NO: 3948817 - RNA, 23 nt, Human herpesvirus 1
ccggcggacccccggaggcgccu

SEQ ID NO: 3948818 - RNA, 19 nt, Human herpesvirus 1
ccggcggccccuggcgccg

SEQ ID NO: 3948819 - RNA, 15 nt, Human herpesvirus 1
ccggcggcgcuggcg

SEQ ID NO: 3948820 - RNA, 21 nt, Human herpesvirus 1
ccggcgggguuauaggccacg

SEQ ID NO: 3948821 - RNA, 12 nt, Human herpesvirus 1
ccgggagccccg

SEQ ID NO: 3948822 - RNA, 17 nt, Human herpesvirus 1
ccgggccgcaccgggcc

SEQ ID NO: 3948823 - RNA, 22 nt, Human herpesvirus 1
ccgggccggagcucgcggcacg

SEQ ID NO: 3948824 - RNA, 19 nt, Human herpesvirus 1
ccgggcgcgugcugcgccu

SEQ ID NO: 3948825 - RNA, 13 nt, Human herpesvirus 1
ccgggcguugggg

SEQ ID NO: 3948826 - RNA, 14 nt, Human herpesvirus 1
ccggggagggcagg

SEQ ID NO: 3948827 - RNA, 16 nt, Human herpesvirus 1
ccggggagggcagggc

SEQ ID NO: 3948828 - RNA, 17 nt, Human herpesvirus 1
ccggggcucucggggcc

SEQ ID NO: 3948829 - RNA, 21 nt, Human herpesvirus 1
ccggggcucucggggccgcag

SEQ ID NO: 3948830 - RNA, 22 nt, Human herpesvirus 1
ccggggcuggcacaccaccgac

SEQ ID NO: 3948831 - RNA, 17 nt, Human herpesvirus 1
ccggggggucggcaggc

SEQ ID NO: 3948832 - RNA, 18 nt, Human herpesvirus 1
ccggguagcguacggacc

SEQ ID NO: 3948833 - RNA, 17 nt, Human herpesvirus 1
ccgguaccaucaaccac

SEQ ID NO: 3948834 - RNA, 12 nt, Human herpesvirus 1
cgcgcauggcag

SEQ ID NO: 3948835 - RNA, 19 nt, Human herpesvirus 1
cgcgccaaacgccagccug

SEQ ID NO: 3948836 - RNA, 17 nt, Human herpesvirus 1
cgcgccacacucaccgg

SEQ ID NO: 3948837 - RNA, 15 nt, Human herpesvirus 1
cgcgccauccucacg

SEQ ID NO: 3948838 - RNA, 20 nt, Human herpesvirus 1
cgcgcccacuacaccagcca

SEQ ID NO: 3948839 - RNA, 19 nt, Human herpesvirus 1
cgcgccccaaggcgcugcg

SEQ ID NO: 3948840 - RNA, 13 nt, Human herpesvirus 1
cgcgcccccgucc

SEQ ID NO: 3948841 - RNA, 15 nt, Human herpesvirus 1
cgcgccccgccggcg

SEQ ID NO: 3948842 - RNA, 14 nt, Human herpesvirus 1
cgcgccgcgggccc

SEQ ID NO: 3948843 - RNA, 22 nt, Human herpesvirus 1
cgcgccgcugcccgacccggcc

SEQ ID NO: 3948844 - RNA, 22 nt, Human herpesvirus 1
cgcgccguuggcccccgccucu

SEQ ID NO: 3948845 - RNA, 21 nt, Human herpesvirus 1
cgcgccuagccaaccuguggc

SEQ ID NO: 3948846 - RNA, 15 nt, Human herpesvirus 1
cgcgcgaccucacca

SEQ ID NO: 3948847 - RNA, 13 nt, Human herpesvirus 1
cgcgcgucccccg

SEQ ID NO: 3948848 - RNA, 21 nt, Human herpesvirus 1
cgcgcucaaccaccgcucccc

SEQ ID NO: 3948849 - RNA, 16 nt, Human herpesvirus 1
cgcggaccaccgggcc

SEQ ID NO: 3948850 - RNA, 15 nt, Human herpesvirus 1
cgcggaggagggcgu

SEQ ID NO: 3948851 - RNA, 18 nt, Human herpesvirus 1
cgcggcccggggccugcu

SEQ ID NO: 3948852 - RNA, 21 nt, Human herpesvirus 1
cgcggcccuuaaugggcaacc

SEQ ID NO: 3948853 - RNA, 19 nt, Human herpesvirus 1
cgcggcgcgagcucccugc

SEQ ID NO: 3948854 - RNA, 18 nt, Human herpesvirus 1
cgcggcggggcccggcca

SEQ ID NO: 3948855 - RNA, 15 nt, Human herpesvirus 1
cgcggcguccgcgcc

SEQ ID NO: 3948856 - RNA, 18 nt, Human herpesvirus 1
cgcggcguccgcgccccu

SEQ ID NO: 3948857 - RNA, 17 nt, Human herpesvirus 1
cgcggcucguggccagg

SEQ ID NO: 3948858 - RNA, 15 nt, Human herpesvirus 1
cgcgggcccccggcc

SEQ ID NO: 3948859 - RNA, 12 nt, Human herpesvirus 1
cgcggggccccc

SEQ ID NO: 3948860 - RNA, 19 nt, Human herpesvirus 1
cgcggggccucccccggac

SEQ ID NO: 3948861 - RNA, 20 nt, Human herpesvirus 1
cgcgggguuacgcgggcccc

SEQ ID NO: 3948862 - RNA, 21 nt, Human herpesvirus 1
cgcgguacagaucggcgccgc

SEQ ID NO: 3948863 - RNA, 14 nt, Human herpesvirus 1
cgcguccccggccc

SEQ ID NO: 3948864 - RNA, 17 nt, Human herpesvirus 1
cgcgucucuggggagcc

SEQ ID NO: 3948865 - RNA, 14 nt, Human herpesvirus 1
cgcguggaccuggg

SEQ ID NO: 3948866 - RNA, 22 nt, Human herpesvirus 1
cgcguguacugcggucugucuc

SEQ ID NO: 3948867 - RNA, 20 nt, Human herpesvirus 1
cgcguguuccccgggagccc

SEQ ID NO: 3948868 - RNA, 23 nt, Human herpesvirus 1
cgcuacugcgcgaucguccaccu

SEQ ID NO: 3948869 - RNA, 22 nt, Human herpesvirus 1
cgcuacugcgugggccgcgcgg

SEQ ID NO: 3948870 - RNA, 16 nt, Human herpesvirus 1
cgcuacuucaccuucg

SEQ ID NO: 3948871 - RNA, 22 nt, Human herpesvirus 1
cgcuagccgaucccucgcgagg

SEQ ID NO: 3948872 - RNA, 15 nt, Human herpesvirus 1
cgcucccucagcauc

SEQ ID NO: 3948873 - RNA, 17 nt, Human herpesvirus 1
cgcucccucgaccacca

SEQ ID NO: 3948874 - RNA, 16 nt, Human herpesvirus 1
cgcuccgacgacgcgc

SEQ ID NO: 3948875 - RNA, 12 nt, Human herpesvirus 1
cgcuccucugcg

SEQ ID NO: 3948876 - RNA, 22 nt, Human herpesvirus 1
cgcuccucugcggccggcggga

SEQ ID NO: 3948877 - RNA, 16 nt, Human herpesvirus 1
cgcugcuccgccuggc

SEQ ID NO: 3948878 - RNA, 19 nt, Human herpesvirus 1
cgcugcugcggccagucca

SEQ ID NO: 3948879 - RNA, 13 nt, Human herpesvirus 1
cgcuggaccucac

SEQ ID NO: 3948880 - RNA, 16 nt, Human herpesvirus 1
cgcuggccgacguggc

SEQ ID NO: 3948881 - RNA, 21 nt, Human herpesvirus 1
cgcugggcgagguggagcugc

SEQ ID NO: 3948882 - RNA, 18 nt, Human herpesvirus 1
cgcuggggguccuggugg

SEQ ID NO: 3948883 - RNA, 18 nt, Human herpesvirus 1
cgcuggucgucgggcgcc

SEQ ID NO: 3948884 - RNA, 18 nt, Human herpesvirus 1
cgcuguugccggaacgca

SEQ ID NO: 3948885 - RNA, 12 nt, Human herpesvirus 1
cgcuuggagcca

SEQ ID NO: 3948886 - RNA, 22 nt, Human herpesvirus 1
cgcuuugugggggaccaggucc

SEQ ID NO: 3948887 - RNA, 16 nt, Human herpesvirus 1
cggaaacccguccggg

SEQ ID NO: 3948888 - RNA, 17 nt, Human herpesvirus 1
cggaaacguucgcgcgc

SEQ ID NO: 3948889 - RNA, 20 nt, Human herpesvirus 1
cggaacgcaccgaggggcca

SEQ ID NO: 3948890 - RNA, 17 nt, Human herpesvirus 1
cggaaggggacacgggc

SEQ ID NO: 3948891 - RNA, 13 nt, Human herpesvirus 1
cggacccgggccg

SEQ ID NO: 3948892 - RNA, 20 nt, Human herpesvirus 1
cggacccucucuucucuccc

SEQ ID NO: 3948893 - RNA, 16 nt, Human herpesvirus 1
cggagccgcgcggcca

SEQ ID NO: 3948894 - RNA, 15 nt, Human herpesvirus 1
cggagguccagcgcc

SEQ ID NO: 3948895 - RNA, 23 nt, Human herpesvirus 1
cggagguggggcgggggccccgc

SEQ ID NO: 3948896 - RNA, 22 nt, Human herpesvirus 1
cggcaccuauggcgccugacgc

SEQ ID NO: 3948897 - RNA, 15 nt, Human herpesvirus 1
cggcacgccuggggu

SEQ ID NO: 3948898 - RNA, 17 nt, Human herpesvirus 1
cggcacuuucugacgcc

SEQ ID NO: 3948899 - RNA, 17 nt, Human herpesvirus 1
cggcagcccggaggcgc

SEQ ID NO: 3948900 - RNA, 22 nt, Human herpesvirus 1
cggcauggugaucgccugucuc

SEQ ID NO: 3948901 - RNA, 23 nt, Human herpesvirus 1
cggccaacgccgcgacccgcacg

SEQ ID NO: 3948902 - RNA, 21 nt, Human herpesvirus 1
cggccacgcaaaaccaggccg

SEQ ID NO: 3948903 - RNA, 18 nt, Human herpesvirus 1
cggccacuggccgggagc

SEQ ID NO: 3948904 - RNA, 14 nt, Human herpesvirus 1
cggccagccgcgcg

SEQ ID NO: 3948905 - RNA, 16 nt, Human herpesvirus 1
cggccaguugagccgc

SEQ ID NO: 3948906 - RNA, 16 nt, Human herpesvirus 1
cggccccugauggagc

SEQ ID NO: 3948907 - RNA, 16 nt, Human herpesvirus 1
cggcccgaagccugcu

SEQ ID NO: 3948908 - RNA, 18 nt, Human herpesvirus 1
cggccgccacccaggcgc

SEQ ID NO: 3948909 - RNA, 14 nt, Human herpesvirus 1
cggccgcgguacag

SEQ ID NO: 3948910 - RNA, 20 nt, Human herpesvirus 1
cggccggauucccgggccgg

SEQ ID NO: 3948911 - RNA, 19 nt, Human herpesvirus 1
cggccuauggcuccugcga

SEQ ID NO: 3948912 - RNA, 21 nt, Human herpesvirus 1
cggcgacgugcccccuccucg

SEQ ID NO: 3948913 - RNA, 20 nt, Human herpesvirus 1
cggcgagcguauaccaaccc

SEQ ID NO: 3948914 - RNA, 18 nt, Human herpesvirus 1
cggcgccucuggacugga

SEQ ID NO: 3948915 - RNA, 20 nt, Human herpesvirus 1
cggcgcgcuucuacccgugu

SEQ ID NO: 3948916 - RNA, 16 nt, Human herpesvirus 1
cggcggcagcccggag

SEQ ID NO: 3948917 - RNA, 15 nt, Human herpesvirus 1
cggcggccccuggcg

SEQ ID NO: 3948918 - RNA, 21 nt, Human herpesvirus 1
cggcguccgcgccccucuggc

SEQ ID NO: 3948919 - RNA, 16 nt, Human herpesvirus 1
cggcgugggcgcguuu

SEQ ID NO: 3948920 - RNA, 22 nt, Human herpesvirus 1
cggcucaacgagcuccuggccu

SEQ ID NO: 3948921 - RNA, 21 nt, Human herpesvirus 1
cggcucggccuauggcuccug

SEQ ID NO: 3948922 - RNA, 23 nt, Human herpesvirus 1
cggcuggcgcggugccugacgcc

SEQ ID NO: 3948923 - RNA, 19 nt, Human herpesvirus 1
cggcuguagcgccccggcg

SEQ ID NO: 3948924 - RNA, 16 nt, Human herpesvirus 1
cgggacgaggccgugc

SEQ ID NO: 3948925 - RNA, 17 nt, Human herpesvirus 1
cgggauccucggccagc

SEQ ID NO: 3948926 - RNA, 19 nt, Human herpesvirus 1
cgggauccucggccagcuc

SEQ ID NO: 3948927 - RNA, 14 nt, Human herpesvirus 1
cgggcacgccaagc

SEQ ID NO: 3948928 - RNA, 18 nt, Human herpesvirus 1
cgggcccagccuucccgu

SEQ ID NO: 3948929 - RNA, 20 nt, Human herpesvirus 1
cgggcgaaaaaaggcggugc

SEQ ID NO: 3948930 - RNA, 14 nt, Human herpesvirus 1
cgggcgacgcacac

SEQ ID NO: 3948931 - RNA, 12 nt, Human herpesvirus 1
cgggcgcguccc

SEQ ID NO: 3948932 - RNA, 22 nt, Human herpesvirus 1
cgggcgggugaacgagccgacg

SEQ ID NO: 3948933 - RNA, 19 nt, Human herpesvirus 1
cgggcuacccucacuaucg

SEQ ID NO: 3948934 - RNA, 21 nt, Human herpesvirus 1
cgggcuacuggugggugagcg

SEQ ID NO: 3948935 - RNA, 14 nt, Human herpesvirus 1
cgggcuccaguccc

SEQ ID NO: 3948936 - RNA, 16 nt, Human herpesvirus 1
cggggccgcccuggcc

SEQ ID NO: 3948937 - RNA, 17 nt, Human herpesvirus 1
cggggccgcccuggccg

SEQ ID NO: 3948938 - RNA, 22 nt, Human herpesvirus 1
cggggcggggccuuggcggccg

SEQ ID NO: 3948939 - RNA, 20 nt, Human herpesvirus 1
cggggcucucggggccgcag

SEQ ID NO: 3948940 - RNA, 14 nt, Human herpesvirus 1
cggggcuggcacac

SEQ ID NO: 3948941 - RNA, 15 nt, Human herpesvirus 1
cgggggauggggaga

SEQ ID NO: 3948942 - RNA, 20 nt, Human herpesvirus 1
cgggggauggggagagccca

SEQ ID NO: 3948943 - RNA, 14 nt, Human herpesvirus 1
cgggggcccugcca

SEQ ID NO: 3948944 - RNA, 24 nt, Human herpesvirus 1
cggguccaaacucccgacaccacc

SEQ ID NO: 3948945 - RNA, 15 nt, Human herpesvirus 1
cggguucccccggca

SEQ ID NO: 3948946 - RNA, 19 nt, Human herpesvirus 1
cgguacauggcccuggugu

SEQ ID NO: 3948947 - RNA, 16 nt, Human herpesvirus 1
cgguacgaagaccagg

SEQ ID NO: 3948948 - RNA, 12 nt, Human herpesvirus 1
uuucccacgcca

SEQ ID NO: 3948949 - RNA, 12 nt, Human herpesvirus 1
uuuccccucccg

SEQ ID NO: 3948950 - RNA, 15 nt, Human herpesvirus 1
uuuggguccgggccc

SEQ ID NO: 3948951 - RNA, 16 nt, Human herpesvirus 1
uuuguguuccgugucu

SEQ ID NO: 3948952 - RNA, 13 nt, Human herpesvirus 1
uuuguuguaaaua

SEQ ID NO: 3948953 - RNA, 17 nt, Human herpesvirus 1
uuuugucggugggggcu

SEQ ID NO: 3948954 - RNA, 17 nt, Human herpesvirus 1
uuuugugccuaccgcuu

SEQ ID NO: 3948955 - RNA, 20 nt, Human herpesvirus 1
acucagggcucuacccucug

SEQ ID NO: 3948956 - RNA, 16 nt, Human herpesvirus 1
acucccgacaccacca

SEQ ID NO: 3948957 - RNA, 22 nt, Human herpesvirus 1
acuccucagcgcgauccgacau

SEQ ID NO: 3948958 - RNA, 11 nt, Human herpesvirus 1
acuccuccccg

SEQ ID NO: 3948959 - RNA, 22 nt, Human herpesvirus 1
acugccucccccgcccuggaca

SEQ ID NO: 3948960 - RNA, 18 nt, Human herpesvirus 1
acugggcgaccgccggcg

SEQ ID NO: 3948961 - RNA, 19 nt, Human herpesvirus 1
acuuccuauaagacucucc

SEQ ID NO: 3948962 - RNA, 20 nt, Human herpesvirus 1
agaacaauaaaggcgguggu

SEQ ID NO: 3948963 - RNA, 22 nt, Human herpesvirus 1
agaaccuuuaggaugccagcca

SEQ ID NO: 3948964 - RNA, 11 nt, Human herpesvirus 1
agacacccccc

SEQ ID NO: 3948965 - RNA, 17 nt, Human herpesvirus 1
agaccaggccuggucag

SEQ ID NO: 3948966 - RNA, 22 nt, Human herpesvirus 1
agaccguggccgacaacugccu

SEQ ID NO: 3948967 - RNA, 21 nt, Human herpesvirus 1
agacggcauucgggccugccu

SEQ ID NO: 3948968 - RNA, 19 nt, Human herpesvirus 1
agacucucccccaccgccc

SEQ ID NO: 3948969 - RNA, 22 nt, Human herpesvirus 1
agagucggagcccgcuggggcg

SEQ ID NO: 3948970 - RNA, 12 nt, Human herpesvirus 1
agauagagcugc

SEQ ID NO: 3948971 - RNA, 22 nt, Human herpesvirus 1
agaucaaggacagcggccugcu

SEQ ID NO: 3948972 - RNA, 18 nt, Human herpesvirus 1
agaucuacugcugggcca

SEQ ID NO: 3948973 - RNA, 20 nt, Human herpesvirus 1
agauuguccgcggggccucc

SEQ ID NO: 3948974 - RNA, 13 nt, Human herpesvirus 1
agauuuuucugua

SEQ ID NO: 3948975 - RNA, 21 nt, Human herpesvirus 1
agcaaccccaugaaggcccug

SEQ ID NO: 3948976 - RNA, 13 nt, Human herpesvirus 1
agcagcgcccggc

SEQ ID NO: 3948977 - RNA, 15 nt, Human herpesvirus 1
agcaggucgacggcu

SEQ ID NO: 3948978 - RNA, 14 nt, Human herpesvirus 1
agcauaccugggug

SEQ ID NO: 3948979 - RNA, 21 nt, Human herpesvirus 1
agccaauccgugucggggagg

SEQ ID NO: 3948980 - RNA, 14 nt, Human herpesvirus 1
agccacccacccac

SEQ ID NO: 3948981 - RNA, 17 nt, Human herpesvirus 1
agccauauccugagccc

SEQ ID NO: 3948982 - RNA, 16 nt, Human herpesvirus 1
agcccccaaaccccac

SEQ ID NO: 3948983 - RNA, 17 nt, Human herpesvirus 1
agcccccagaugcccac

SEQ ID NO: 3948984 - RNA, 17 nt, Human herpesvirus 1
agccccggcccugaugc

SEQ ID NO: 3948985 - RNA, 18 nt, Human herpesvirus 1
agccccggucuccccggg

SEQ ID NO: 3948986 - RNA, 16 nt, Human herpesvirus 1
agccgacggcccgaag

SEQ ID NO: 3948987 - RNA, 23 nt, Human herpesvirus 1
agccgccacccucucuucccuca

SEQ ID NO: 3948988 - RNA, 18 nt, Human herpesvirus 1
agccgcgccgacaucacc

SEQ ID NO: 3948989 - RNA, 13 nt, Human herpesvirus 1
agccucuguguca

SEQ ID NO: 3948990 - RNA, 18 nt, Human herpesvirus 1
agccucugugucaggugg

SEQ ID NO: 3948991 - RNA, 16 nt, Human herpesvirus 1
agccugcggccggaug

SEQ ID NO: 3948992 - RNA, 17 nt, Human herpesvirus 1
agcgaccccacggccuc

SEQ ID NO: 3948993 - RNA, 20 nt, Human herpesvirus 1
agcgcacggaacacaaggcc

SEQ ID NO: 3948994 - RNA, 13 nt, Human herpesvirus 1
agcgcacugcccg

SEQ ID NO: 3948995 - RNA, 18 nt, Human herpesvirus 1
agcgcacugcccgacgcc

SEQ ID NO: 3948996 - RNA, 23 nt, Human herpesvirus 1
agcgcgcugcucagcgccaaggu

SEQ ID NO: 3948997 - RNA, 14 nt, Human herpesvirus 1
agcgcggaggaggg

SEQ ID NO: 3948998 - RNA, 23 nt, Human herpesvirus 1
agcgggucuuuuguguuggcccu

SEQ ID NO: 3948999 - RNA, 20 nt, Human herpesvirus 1
agcguccgggcgcuuggcau

SEQ ID NO: 3949000 - RNA, 18 nt, Human herpesvirus 1
agcguguucguggaacca

SEQ ID NO: 3949001 - RNA, 16 nt, Human herpesvirus 1
agcucaaucuggccca

SEQ ID NO: 3949002 - RNA, 18 nt, Human herpesvirus 1
agcucgcggagggcggcc

SEQ ID NO: 3949003 - RNA, 22 nt, Human herpesvirus 1
aggaacccgcgcuaugacggca

SEQ ID NO: 3949004 - RNA, 15 nt, Human herpesvirus 1
aggacagcggccugc

SEQ ID NO: 3949005 - RNA, 14 nt, Human herpesvirus 1
aggaccgcgccccc

SEQ ID NO: 3949006 - RNA, 22 nt, Human herpesvirus 1
aggacgcccgcgacgccaugga

SEQ ID NO: 3949007 - RNA, 13 nt, Human herpesvirus 1
aggagacaauacc

SEQ ID NO: 3949008 - RNA, 21 nt, Human herpesvirus 1
aggagacaauaccggaaggaa

SEQ ID NO: 3949009 - RNA, 21 nt, Human herpesvirus 1
aggagccccugcccgacaggg

SEQ ID NO: 3949010 - RNA, 19 nt, Human herpesvirus 1
aggagcucaagaaccccac

SEQ ID NO: 3949011 - RNA, 13 nt, Human herpesvirus 1
aggcccacgccuc

SEQ ID NO: 3949012 - RNA, 13 nt, Human herpesvirus 1
aggccccccgccg

SEQ ID NO: 3949013 - RNA, 22 nt, Human herpesvirus 1
aggcccgcaagcugaaccccaa

SEQ ID NO: 3949014 - RNA, 18 nt, Human herpesvirus 1
aggccggcgccgacacgc

SEQ ID NO: 3949015 - RNA, 15 nt, Human herpesvirus 1
aggccugggauccca

SEQ ID NO: 3949016 - RNA, 12 nt, Human herpesvirus 1
aggcgcuucccc

SEQ ID NO: 3949017 - RNA, 12 nt, Human herpesvirus 1
aggcggccuggg

SEQ ID NO: 3949018 - RNA, 14 nt, Human herpesvirus 1
agggaccuccugga

SEQ ID NO: 3949019 - RNA, 20 nt, Human herpesvirus 1
agggaccuccuggacuuuga

SEQ ID NO: 3949020 - RNA, 15 nt, Human herpesvirus 1
agggagaaaccccag

SEQ ID NO: 3949021 - RNA, 20 nt, Human herpesvirus 1
agggauccacgacaaccccg

SEQ ID NO: 3949022 - RNA, 12 nt, Human herpesvirus 1
agggcagggccg

SEQ ID NO: 3949023 - RNA, 17 nt, Human herpesvirus 1
aggggggaaagguggac

SEQ ID NO: 3949024 - RNA, 18 nt, Human herpesvirus 1
aggucaaaugccgggcca

SEQ ID NO: 3949025 - RNA, 15 nt, Human herpesvirus 1
agguccagcgccgca

SEQ ID NO: 3949026 - RNA, 18 nt, Human herpesvirus 1
aggucuccgucaccgcga

SEQ ID NO: 3949027 - RNA, 13 nt, Human herpesvirus 1
aggugcgccaggu

SEQ ID NO: 3949028 - RNA, 23 nt, Human herpesvirus 1
aggugcuucuguuuggcgccccc

SEQ ID NO: 3949029 - RNA, 15 nt, Human herpesvirus 1
aggugggccagccgc

SEQ ID NO: 3949030 - RNA, 13 nt, Human herpesvirus 1
agguugggggccg

SEQ ID NO: 3949031 - RNA, 17 nt, Human herpesvirus 1
aguacgcccucccgcug

SEQ ID NO: 3949032 - RNA, 19 nt, Human herpesvirus 1
agucccaucccccgauccc

SEQ ID NO: 3949033 - RNA, 16 nt, Human herpesvirus 1
aguccgcugcaccgau

SEQ ID NO: 3949034 - RNA, 23 nt, Human herpesvirus 1
agucuucggggcccggcccauug

SEQ ID NO: 3949035 - RNA, 20 nt, Human herpesvirus 1
agugaaagacacgggcacca

SEQ ID NO: 3949036 - RNA, 21 nt, Human herpesvirus 1
agugggcguggcuucggccgu

SEQ ID NO: 3949037 - RNA, 14 nt, Human herpesvirus 1
aguguacccuggcg

SEQ ID NO: 3949038 - RNA, 14 nt, Human herpesvirus 1
aguucgagcagccg

SEQ ID NO: 3949039 - RNA, 12 nt, Human herpesvirus 1
aguugccccacc

SEQ ID NO: 3949040 - RNA, 23 nt, Human herpesvirus 1
aguuguucggucauaagcuucag

SEQ ID NO: 3949041 - RNA, 21 nt, Human herpesvirus 1
aguuuguguuggcgacuggcg

SEQ ID NO: 3949042 - RNA, 12 nt, Human herpesvirus 1
auaaaaagccag

SEQ ID NO: 3949043 - RNA, 14 nt, Human herpesvirus 1
auaaaagaccaaaa

SEQ ID NO: 3949044 - RNA, 18 nt, Human herpesvirus 1
auaaccacgcccagcgca

SEQ ID NO: 3949045 - RNA, 14 nt, Human herpesvirus 1
auacacagccaccc

SEQ ID NO: 3949046 - RNA, 20 nt, Human herpesvirus 1
auagcaacaaggccguggac

SEQ ID NO: 3949047 - RNA, 21 nt, Human herpesvirus 1
auauaguuugguccccccucu

SEQ ID NO: 3949048 - RNA, 23 nt, Human herpesvirus 1
auauuuuucaauaaaaggcauua

SEQ ID NO: 3949049 - RNA, 12 nt, Human herpesvirus 1
aucaccacgccc

SEQ ID NO: 3949050 - RNA, 15 nt, Human herpesvirus 1
aucaccaugcuggag

SEQ ID NO: 3949051 - RNA, 15 nt, Human herpesvirus 1
aucauaaccacgccc

SEQ ID NO: 3949052 - RNA, 16 nt, Human herpesvirus 1
aucauagcccuggugu

SEQ ID NO: 3949053 - RNA, 22 nt, Human herpesvirus 1
aucauugccgcguugguccucg

SEQ ID NO: 3949054 - RNA, 21 nt, Human herpesvirus 1
auccaaaaccacaaccucccg

SEQ ID NO: 3949055 - RNA, 19 nt, Human herpesvirus 1
aucccaccaaacuggcaca

SEQ ID NO: 3949056 - RNA, 18 nt, Human herpesvirus 1
auccccaacgcgcugccc

SEQ ID NO: 3949057 - RNA, 16 nt, Human herpesvirus 1
aucccgacuccccgga

SEQ ID NO: 3949058 - RNA, 16 nt, Human herpesvirus 1
auccgaacgcagcccc

SEQ ID NO: 3949059 - RNA, 15 nt, Human herpesvirus 1
aucgccgcggcuccc

SEQ ID NO: 3949060 - RNA, 20 nt, Human herpesvirus 1
aucgcucgaccucuccacac

SEQ ID NO: 3949061 - RNA, 14 nt, Human herpesvirus 1
aucgguccccucug

SEQ ID NO: 3949062 - RNA, 15 nt, Human herpesvirus 1
aucugacgcgcccca

SEQ ID NO: 3949063 - RNA, 17 nt, Human herpesvirus 1
aucugggauggcuccug

SEQ ID NO: 3949064 - RNA, 17 nt, Human herpesvirus 1
aucuguguucccuggcc

SEQ ID NO: 3949065 - RNA, 11 nt, Human herpesvirus 1
augccuguggg

SEQ ID NO: 3949066 - RNA, 13 nt, Human herpesvirus 1
augcggaaagcaa

SEQ ID NO: 3949067 - RNA, 14 nt, Human herpesvirus 1
augcggaaagcaag

SEQ ID NO: 3949068 - RNA, 20 nt, Human herpesvirus 1
augcgggauccucggccagc

SEQ ID NO: 3949069 - RNA, 19 nt, Human herpesvirus 1
augcuggaggaucacgagu

SEQ ID NO: 3949070 - RNA, 19 nt, Human herpesvirus 1
auggaguccacgguaggcc

SEQ ID NO: 3949071 - RNA, 22 nt, Human herpesvirus 1
auggaguccacgguaggcccag

SEQ ID NO: 3949072 - RNA, 16 nt, Human herpesvirus 1
accaccauccccgcuc

SEQ ID NO: 3949073 - RNA, 17 nt, Human herpesvirus 1
accaccauccccgcucc

SEQ ID NO: 3949074 - RNA, 13 nt, Human herpesvirus 1
accaccauggccc

SEQ ID NO: 3949075 - RNA, 18 nt, Human herpesvirus 1
accaccauggccccccgc

SEQ ID NO: 3949076 - RNA, 16 nt, Human herpesvirus 1
accacgugcacagccu

SEQ ID NO: 3949077 - RNA, 23 nt, Human herpesvirus 1
accagcagguccgcggugggcug

SEQ ID NO: 3949078 - RNA, 13 nt, Human herpesvirus 1
accagcgcaccgu

SEQ ID NO: 3949079 - RNA, 14 nt, Human herpesvirus 1
accagcgggucuuu

SEQ ID NO: 3949080 - RNA, 21 nt, Human herpesvirus 1
accagcgggucuuuuguguug

SEQ ID NO: 3949081 - RNA, 17 nt, Human herpesvirus 1
accaucccccggccacc

SEQ ID NO: 3949082 - RNA, 21 nt, Human herpesvirus 1
accaucccggguuaauguaaa

SEQ ID NO: 3949083 - RNA, 22 nt, Human herpesvirus 1
accaucccggguuaauguaaau

SEQ ID NO: 3949084 - RNA, 19 nt, Human herpesvirus 1
accauggccccccgcgucc

SEQ ID NO: 3949085 - RNA, 23 nt, Human herpesvirus 1
accauguccggcagggggauggg

SEQ ID NO: 3949086 - RNA, 21 nt, Human herpesvirus 1
acccaaaacacacggagcugc

SEQ ID NO: 3949087 - RNA, 18 nt, Human herpesvirus 1
acccaccgacacaugcac

SEQ ID NO: 3949088 - RNA, 19 nt, Human herpesvirus 1
accccaacgccuccccugu

SEQ ID NO: 3949089 - RNA, 15 nt, Human herpesvirus 1
accccaugaaggccc

SEQ ID NO: 3949090 - RNA, 15 nt, Human herpesvirus 1
accccauggacccca

SEQ ID NO: 3949091 - RNA, 20 nt, Human herpesvirus 1
acccccccggagccgggcgc

SEQ ID NO: 3949092 - RNA, 19 nt, Human herpesvirus 1
acccccucgaccaccaucc

SEQ ID NO: 3949093 - RNA, 19 nt, Human herpesvirus 1
accccgcaauuugcaccca

SEQ ID NO: 3949094 - RNA, 22 nt, Human herpesvirus 1
accccgcaauuugcacccagcc

SEQ ID NO: 3949095 - RNA, 19 nt, Human herpesvirus 1
accccggggcucagccaga

SEQ ID NO: 3949096 - RNA, 18 nt, Human herpesvirus 1
acccgaaacugcuuccgu

SEQ ID NO: 3949097 - RNA, 12 nt, Human herpesvirus 1
acccgacacuga

SEQ ID NO: 3949098 - RNA, 22 nt, Human herpesvirus 1
acccgaggcggccugggucuuc

SEQ ID NO: 3949099 - RNA, 19 nt, Human herpesvirus 1
acccgcacuacgaguacau

SEQ ID NO: 3949100 - RNA, 18 nt, Human herpesvirus 1
acccgcuaaccaccaagg

SEQ ID NO: 3949101 - RNA, 22 nt, Human herpesvirus 1
acccggggggcugcgaguccug

SEQ ID NO: 3949102 - RNA, 18 nt, Human herpesvirus 1
acccuaggaggccgccac

SEQ ID NO: 3949103 - RNA, 15 nt, Human herpesvirus 1
acccuccgcuggggc

SEQ ID NO: 3949104 - RNA, 13 nt, Human herpesvirus 1
acccugcugcagg

SEQ ID NO: 3949105 - RNA, 14 nt, Human herpesvirus 1
acccugcugcaggc

SEQ ID NO: 3949106 - RNA, 13 nt, Human herpesvirus 1
accgaagaggugc

SEQ ID NO: 3949107 - RNA, 17 nt, Human herpesvirus 1
accgcaacuucccaccc

SEQ ID NO: 3949108 - RNA, 14 nt, Human herpesvirus 1
accgcagucccuga

SEQ ID NO: 3949109 - RNA, 18 nt, Human herpesvirus 1
accgcauacuccggccgc

SEQ ID NO: 3949110 - RNA, 12 nt, Human herpesvirus 1
accgcaucgaca

SEQ ID NO: 3949111 - RNA, 15 nt, Human herpesvirus 1
accgccaucagccuu

SEQ ID NO: 3949112 - RNA, 14 nt, Human herpesvirus 1
accgcccgccccuc

SEQ ID NO: 3949113 - RNA, 18 nt, Human herpesvirus 1
accgcccgccccucgcca

SEQ ID NO: 3949114 - RNA, 23 nt, Human herpesvirus 1
accgccggcggcgacgugccccc

SEQ ID NO: 3949115 - RNA, 15 nt, Human herpesvirus 1
accgcgagcgccgcu

SEQ ID NO: 3949116 - RNA, 15 nt, Human herpesvirus 1
accggcacccggccu

SEQ ID NO: 3949117 - RNA, 23 nt, Human herpesvirus 1
accggccccugggccccgggaca

SEQ ID NO: 3949118 - RNA, 13 nt, Human herpesvirus 1
accguggccuggg

SEQ ID NO: 3949119 - RNA, 17 nt, Human herpesvirus 1
accguugcccgggccgu

SEQ ID NO: 3949120 - RNA, 18 nt, Human herpesvirus 1
accucaccaccaaggccc

SEQ ID NO: 3949121 - RNA, 13 nt, Human herpesvirus 1
accucgcccaccc

SEQ ID NO: 3949122 - RNA, 15 nt, Human herpesvirus 1
accugcgcuucgccg

SEQ ID NO: 3949123 - RNA, 17 nt, Human herpesvirus 1
accuucaucgaccucaa

SEQ ID NO: 3949124 - RNA, 16 nt, Human herpesvirus 1
accuuccgguccugga

SEQ ID NO: 3949125 - RNA, 14 nt, Human herpesvirus 1
acgacaucuugucg

SEQ ID NO: 3949126 - RNA, 12 nt, Human herpesvirus 1
acgaccacgaga

SEQ ID NO: 3949127 - RNA, 23 nt, Human herpesvirus 1
acgaccuguugauggccugugcu

SEQ ID NO: 3949128 - RNA, 20 nt, Human herpesvirus 1
acgagcacccugcugccccc

SEQ ID NO: 3949129 - RNA, 17 nt, Human herpesvirus 1
acgaugaccgcccccag

SEQ ID NO: 3949130 - RNA, 15 nt, Human herpesvirus 1
acgccaacgccgcca

SEQ ID NO: 3949131 - RNA, 13 nt, Human herpesvirus 1
acgccacaacagc

SEQ ID NO: 3949132 - RNA, 20 nt, Human herpesvirus 1
acgcccacuuuauucgcguc

SEQ ID NO: 3949133 - RNA, 19 nt, Human herpesvirus 1
acgcccgcaaacaggagcu

SEQ ID NO: 3949134 - RNA, 12 nt, Human herpesvirus 1
acgccucccccu

SEQ ID NO: 3949135 - RNA, 21 nt, Human herpesvirus 1
acgccuccgcccgugcugccg

SEQ ID NO: 3949136 - RNA, 20 nt, Human herpesvirus 1
acgccuggggucgcggccgc

SEQ ID NO: 3949137 - RNA, 21 nt, Human herpesvirus 1
acgcgccgcgggcccccggcc

SEQ ID NO: 3949138 - RNA, 22 nt, Human herpesvirus 1
acgcgcggcugguccacaccca

SEQ ID NO: 3949139 - RNA, 21 nt, Human herpesvirus 1
acgcggggcuguacucgaccc

SEQ ID NO: 3949140 - RNA, 15 nt, Human herpesvirus 1
acgcgucauaugcaa

SEQ ID NO: 3949141 - RNA, 13 nt, Human herpesvirus 1
acgcuuggagcca

SEQ ID NO: 3949142 - RNA, 19 nt, Human herpesvirus 1
acggaacacaaggccaaga

SEQ ID NO: 3949143 - RNA, 18 nt, Human herpesvirus 1
acggcagcaugggaccca

SEQ ID NO: 3949144 - RNA, 18 nt, Human herpesvirus 1
acggccgaagccacgccc

SEQ ID NO: 3949145 - RNA, 20 nt, Human herpesvirus 1
acgggcggccacccccccgg

SEQ ID NO: 3949146 - RNA, 22 nt, Human herpesvirus 1
acgggcgucaccaugcagcgcc

SEQ ID NO: 3949147 - RNA, 21 nt, Human herpesvirus 1
acggguguggggacccgcccc

SEQ ID NO: 3949148 - RNA, 18 nt, Human herpesvirus 1
acgguucgcgaacccuuu

SEQ ID NO: 3949149 - RNA, 15 nt, Human herpesvirus 1
acguccugggccacc

SEQ ID NO: 3949150 - RNA, 15 nt, Human herpesvirus 1
acgucgaccgcgccc

SEQ ID NO: 3949151 - RNA, 16 nt, Human herpesvirus 1
acgucgcgccugggug

SEQ ID NO: 3949152 - RNA, 17 nt, Human herpesvirus 1
acgugcacagccuggcc

SEQ ID NO: 3949153 - RNA, 14 nt, Human herpesvirus 1
acgugcccccuccu

SEQ ID NO: 3949154 - RNA, 20 nt, Human herpesvirus 1
acgugcccccuccucguccg

SEQ ID NO: 3949155 - RNA, 18 nt, Human herpesvirus 1
acgugcgcgaucccccgc

SEQ ID NO: 3949156 - RNA, 17 nt, Human herpesvirus 1
acguucgagcgccaccu

SEQ ID NO: 3949157 - RNA, 19 nt, Human herpesvirus 1
acuacauuaaauuggguuc

SEQ ID NO: 3949158 - RNA, 12 nt, Human herpesvirus 1
acuaccuaggca

SEQ ID NO: 3949159 - RNA, 15 nt, Human herpesvirus 1
cggcagcgcuccgac

SEQ ID NO: 3949160 - RNA, 18 nt, Human herpesvirus 1
cggcagucuccuggcagc

SEQ ID NO: 3949161 - RNA, 22 nt, Human herpesvirus 1
cggcagucuccuggcagcccug

SEQ ID NO: 3949162 - RNA, 16 nt, Human herpesvirus 1
cggccaacgccgcgac

SEQ ID NO: 3949163 - RNA, 18 nt, Human herpesvirus 1
cggccaccucgcccaccc

SEQ ID NO: 3949164 - RNA, 16 nt, Human herpesvirus 1
cggccacuggccggga

SEQ ID NO: 3949165 - RNA, 22 nt, Human herpesvirus 1
cggccagaucuacugcugggcc

SEQ ID NO: 3949166 - RNA, 14 nt, Human herpesvirus 1
cggcccacccuggc

SEQ ID NO: 3949167 - RNA, 15 nt, Human herpesvirus 1
cggcccacccuggcg

SEQ ID NO: 3949168 - RNA, 14 nt, Human herpesvirus 1
cggccccugggccc

SEQ ID NO: 3949169 - RNA, 17 nt, Human herpesvirus 1
cggcccuaaccccaccc

SEQ ID NO: 3949170 - RNA, 18 nt, Human herpesvirus 1
cggcccuaaccccacccc

SEQ ID NO: 3949171 - RNA, 17 nt, Human herpesvirus 1
cggccgaagccacgccc

SEQ ID NO: 3949172 - RNA, 17 nt, Human herpesvirus 1
cggccgccacccaggcg

SEQ ID NO: 3949173 - RNA, 15 nt, Human herpesvirus 1
cggccgcccuucccg

SEQ ID NO: 3949174 - RNA, 17 nt, Human herpesvirus 1
cggccgcgacccaggcg

SEQ ID NO: 3949175 - RNA, 21 nt, Human herpesvirus 1
cggccgcgacccaggcggcga

SEQ ID NO: 3949176 - RNA, 21 nt, Human herpesvirus 1
cggccggauucccgggccgga

SEQ ID NO: 3949177 - RNA, 15 nt, Human herpesvirus 1
cggccguugucuccc

SEQ ID NO: 3949178 - RNA, 22 nt, Human herpesvirus 1
cggccguuucuccgcccgaccg

SEQ ID NO: 3949179 - RNA, 14 nt, Human herpesvirus 1
cggcgaccgccagc

SEQ ID NO: 3949180 - RNA, 16 nt, Human herpesvirus 1
cggcgaccgccagccg

SEQ ID NO: 3949181 - RNA, 16 nt, Human herpesvirus 1
cggcgagguggacguc

SEQ ID NO: 3949182 - RNA, 16 nt, Human herpesvirus 1
cggcgccgacacgcgg

SEQ ID NO: 3949183 - RNA, 15 nt, Human herpesvirus 1
cggcgccgaccaccc

SEQ ID NO: 3949184 - RNA, 20 nt, Human herpesvirus 1
cggcgccgcccgccccuggc

SEQ ID NO: 3949185 - RNA, 16 nt, Human herpesvirus 1
cggcgcgacaacgagc

SEQ ID NO: 3949186 - RNA, 15 nt, Human herpesvirus 1
cggcgcuggcggcca

SEQ ID NO: 3949187 - RNA, 13 nt, Human herpesvirus 1
cggcggcgaggcc

SEQ ID NO: 3949188 - RNA, 14 nt, Human herpesvirus 1
cggcggcgcuccuc

SEQ ID NO: 3949189 - RNA, 14 nt, Human herpesvirus 1
cggcgggagcuggg

SEQ ID NO: 3949190 - RNA, 19 nt, Human herpesvirus 1
cggcggucgcgcuccucug

SEQ ID NO: 3949191 - RNA, 19 nt, Human herpesvirus 1
cggcguccgcgccccucug

SEQ ID NO: 3949192 - RNA, 17 nt, Human herpesvirus 1
cggcguuaaccgcaccc

SEQ ID NO: 3949193 - RNA, 14 nt, Human herpesvirus 1
cggcuacaggggcc

SEQ ID NO: 3949194 - RNA, 15 nt, Human herpesvirus 1
cggcucggccuaugg

SEQ ID NO: 3949195 - RNA, 22 nt, Human herpesvirus 1
cggcugguccacacccaguggc

SEQ ID NO: 3949196 - RNA, 16 nt, Human herpesvirus 1
cgggaacaccuccgcg

SEQ ID NO: 3949197 - RNA, 18 nt, Human herpesvirus 1
cgggaccugaaccccagc

SEQ ID NO: 3949198 - RNA, 19 nt, Human herpesvirus 1
cgggaccugaaccccagcc

SEQ ID NO: 3949199 - RNA, 21 nt, Human herpesvirus 1
cgggagccccggaccccacgc

SEQ ID NO: 3949200 - RNA, 14 nt, Human herpesvirus 1
cgggagccccgguc

SEQ ID NO: 3949201 - RNA, 19 nt, Human herpesvirus 1
cgggcaaguaugccccccu

SEQ ID NO: 3949202 - RNA, 22 nt, Human herpesvirus 1
cgggcaaguaugccccccuggc

SEQ ID NO: 3949203 - RNA, 16 nt, Human herpesvirus 1
cgggcaccacacacca

SEQ ID NO: 3949204 - RNA, 15 nt, Human herpesvirus 1
cgggcagugagggug

SEQ ID NO: 3949205 - RNA, 18 nt, Human herpesvirus 1
cgggcaucggaacacgcc

SEQ ID NO: 3949206 - RNA, 16 nt, Human herpesvirus 1
cgggccacggcgccga

SEQ ID NO: 3949207 - RNA, 17 nt, Human herpesvirus 1
cgggccgccucgggggc

SEQ ID NO: 3949208 - RNA, 21 nt, Human herpesvirus 1
cgggccgccucgggggcggga

SEQ ID NO: 3949209 - RNA, 21 nt, Human herpesvirus 1
cgggccgugauuccucuccgc

SEQ ID NO: 3949210 - RNA, 17 nt, Human herpesvirus 1
cgggccguuucccaccc

SEQ ID NO: 3949211 - RNA, 15 nt, Human herpesvirus 1
cgggccugccugcgg

SEQ ID NO: 3949212 - RNA, 17 nt, Human herpesvirus 1
cgggcgacgccccggcc

SEQ ID NO: 3949213 - RNA, 19 nt, Human herpesvirus 1
cgggcgaugagccaaccuc

SEQ ID NO: 3949214 - RNA, 18 nt, Human herpesvirus 1
cgggcgcaauugcggcca

SEQ ID NO: 3949215 - RNA, 14 nt, Human herpesvirus 1
cgggcgcugggugg

SEQ ID NO: 3949216 - RNA, 21 nt, Human herpesvirus 1
cgggcgcuugcgcaccuggug

SEQ ID NO: 3949217 - RNA, 22 nt, Human herpesvirus 1
cgggcgguucgccgccaccagc

SEQ ID NO: 3949218 - RNA, 22 nt, Human herpesvirus 1
cgggcuacccucacuaucgagg

SEQ ID NO: 3949219 - RNA, 15 nt, Human herpesvirus 1
cgggcucguccccug

SEQ ID NO: 3949220 - RNA, 20 nt, Human herpesvirus 1
cgggcucgucuuggccacca

SEQ ID NO: 3949221 - RNA, 16 nt, Human herpesvirus 1
cggggaccccaucagc

SEQ ID NO: 3949222 - RNA, 18 nt, Human herpesvirus 1
cggggaccuugccccggc

SEQ ID NO: 3949223 - RNA, 18 nt, Human herpesvirus 1
cggggcagagccgcccgu

SEQ ID NO: 3949224 - RNA, 13 nt, Human herpesvirus 1
cggggccagcgcc

SEQ ID NO: 3949225 - RNA, 12 nt, Human herpesvirus 1
cggggcccggcc

SEQ ID NO: 3949226 - RNA, 11 nt, Human herpesvirus 1
cggggcgccgu

SEQ ID NO: 3949227 - RNA, 15 nt, Human herpesvirus 1
cggggcggggacggg

SEQ ID NO: 3949228 - RNA, 17 nt, Human herpesvirus 1
cggggcggggacgggga

SEQ ID NO: 3949229 - RNA, 19 nt, Human herpesvirus 1
cggggcucucggggccgca

SEQ ID NO: 3949230 - RNA, 15 nt, Human herpesvirus 1
cggggggugggaccu

SEQ ID NO: 3949231 - RNA, 12 nt, Human herpesvirus 1
cggguccgcggg

SEQ ID NO: 3949232 - RNA, 15 nt, Human herpesvirus 1
cgguacauggcccug

SEQ ID NO: 3949233 - RNA, 21 nt, Human herpesvirus 1
cgguccggagccgcgcggcca

SEQ ID NO: 3949234 - RNA, 16 nt, Human herpesvirus 1
cgguccugacggccaa

SEQ ID NO: 3949235 - RNA, 18 nt, Human herpesvirus 1
cggugaccgcgugcccac

SEQ ID NO: 3949236 - RNA, 21 nt, Human herpesvirus 1
cggugccaguccgcugcaccg

SEQ ID NO: 3949237 - RNA, 16 nt, Human herpesvirus 1
cggugcgucugggccc

SEQ ID NO: 3949238 - RNA, 16 nt, Human herpesvirus 1
cggugguccgccuagc

SEQ ID NO: 3949239 - RNA, 17 nt, Human herpesvirus 1
cgguuacucggcccccg

SEQ ID NO: 3949240 - RNA, 18 nt, Human herpesvirus 1
cgguugcccccgaacacc

SEQ ID NO: 3949241 - RNA, 17 nt, Human herpesvirus 1
cgguuggggaggcugua

SEQ ID NO: 3949242 - RNA, 15 nt, Human herpesvirus 1
cgguugguccagacg

SEQ ID NO: 3949243 - RNA, 13 nt, Human herpesvirus 1
cguaaccuccggg

SEQ ID NO: 3949244 - RNA, 21 nt, Human herpesvirus 1
cguagcgucgcgacagaacug

SEQ ID NO: 3949245 - RNA, 22 nt, Human herpesvirus 1
cguauacagaacauuguuuugg

SEQ ID NO: 3949246 - RNA, 16 nt, Human herpesvirus 1
cgucaccaugcagcgc

SEQ ID NO: 3949247 - RNA, 19 nt, Human herpesvirus 1
cgucacgcaagaccaggcc

SEQ ID NO: 3949248 - RNA, 17 nt, Human herpesvirus 1
cgucauagugggccucc

SEQ ID NO: 3949249 - RNA, 16 nt, Human herpesvirus 1
cguccaucaccacgcc

SEQ ID NO: 3949250 - RNA, 21 nt, Human herpesvirus 1
cguccaucauagcccuggugu

SEQ ID NO: 3949251 - RNA, 21 nt, Human herpesvirus 1
cguccgccgagucuucggggc

SEQ ID NO: 3949252 - RNA, 13 nt, Human herpesvirus 1
cguccgcgccccu

SEQ ID NO: 3949253 - RNA, 17 nt, Human herpesvirus 1
cguccgguuggccgcgc

SEQ ID NO: 3949254 - RNA, 23 nt, Human herpesvirus 1
cguccuuugggcgggaggaagcc

SEQ ID NO: 3949255 - RNA, 19 nt, Human herpesvirus 1
cgucgacucuaucgcgcgc

SEQ ID NO: 3949256 - RNA, 23 nt, Human herpesvirus 1
cgucgccgcccugagcgcccucc

SEQ ID NO: 3949257 - RNA, 16 nt, Human herpesvirus 1
cgucgccgcgggccac

SEQ ID NO: 3949258 - RNA, 23 nt, Human herpesvirus 1
cgucgccuggcugacccacgcgg

SEQ ID NO: 3949259 - RNA, 16 nt, Human herpesvirus 1
cgucgggaggccacag

SEQ ID NO: 3949260 - RNA, 17 nt, Human herpesvirus 1
cgucucucuuccccccc

SEQ ID NO: 3949261 - RNA, 17 nt, Human herpesvirus 1
cgucucuggggagccuc

SEQ ID NO: 3949262 - RNA, 22 nt, Human herpesvirus 1
cgucuugguggguggguggcug

SEQ ID NO: 3949263 - RNA, 23 nt, Human herpesvirus 1
cgugaacgcucuacugcagaugc

SEQ ID NO: 3949264 - RNA, 18 nt, Human herpesvirus 1
cgugacacccuaccccag

SEQ ID NO: 3949265 - RNA, 21 nt, Human herpesvirus 1
cgugacacccuaccccagucc

SEQ ID NO: 3949266 - RNA, 13 nt, Human herpesvirus 1
cgugaccccaggg

SEQ ID NO: 3949267 - RNA, 21 nt, Human herpesvirus 1
cgugacgcacccccugacccc

SEQ ID NO: 3949268 - RNA, 15 nt, Human herpesvirus 1
cgugcacagccuggc

SEQ ID NO: 3949269 - RNA, 17 nt, Human herpesvirus 1
cgugcacagccuggccg

SEQ ID NO: 3949270 - RNA, 22 nt, Human herpesvirus 1
cgugcccucgcgggccucgugg

SEQ ID NO: 3949271 - RNA, 12 nt, Human herpesvirus 1
cgugcccuucca

SEQ ID NO: 3949272 - RNA, 14 nt, Human herpesvirus 1
cgugcuccugugag

SEQ ID NO: 3949273 - RNA, 17 nt, Human herpesvirus 1
cgugcucgugugguaca

SEQ ID NO: 3949274 - RNA, 19 nt, Human herpesvirus 1
cgugcuuguuuguguuccg

SEQ ID NO: 3949275 - RNA, 17 nt, Human herpesvirus 1
cguggauacggucaccc

SEQ ID NO: 3949276 - RNA, 15 nt, Human herpesvirus 1
cgugggccucaccca

SEQ ID NO: 3949277 - RNA, 14 nt, Human herpesvirus 1
cguguuugugggga

SEQ ID NO: 3949278 - RNA, 21 nt, Human herpesvirus 1
cguuauucccaaacagggccu

SEQ ID NO: 3949279 - RNA, 15 nt, Human herpesvirus 1
cguuccucacugccu

SEQ ID NO: 3949280 - RNA, 19 nt, Human herpesvirus 1
cguugcagggccuggugcu

SEQ ID NO: 3949281 - RNA, 11 nt, Human herpesvirus 1
cguuggccccc

SEQ ID NO: 3949282 - RNA, 17 nt, Human herpesvirus 1
cguuggcccccgccucu

SEQ ID NO: 3949283 - RNA, 20 nt, Human herpesvirus 1
cguugucuccccgauggccc

SEQ ID NO: 3949284 - RNA, 16 nt, Human herpesvirus 1
cuaaccaggccuccac

SEQ ID NO: 3949285 - RNA, 13 nt, Human herpesvirus 1
cuacauuaaauug

SEQ ID NO: 3949286 - RNA, 14 nt, Human herpesvirus 1
cuacugcugggcca

SEQ ID NO: 3949287 - RNA, 17 nt, Human herpesvirus 1
cuagccgaggcccggga

SEQ ID NO: 3949288 - RNA, 18 nt, Human herpesvirus 1
cuauaagacucuccccca

SEQ ID NO: 3949289 - RNA, 16 nt, Human herpesvirus 1
cuaugacggcaauaaa

SEQ ID NO: 3949290 - RNA, 21 nt, Human herpesvirus 1
cuauuuucccccccgggccgc

SEQ ID NO: 3949291 - RNA, 16 nt, Human herpesvirus 1
cucaacgagcuccugg

SEQ ID NO: 3949292 - RNA, 16 nt, Human herpesvirus 1
cucaagaaccccacca

SEQ ID NO: 3949293 - RNA, 21 nt, Human herpesvirus 1
cucaagcacacacgggggagc

SEQ ID NO: 3949294 - RNA, 14 nt, Human herpesvirus 1
cucacagggcgggc

SEQ ID NO: 3949295 - RNA, 18 nt, Human herpesvirus 1
cucacagggcgggccgcc

SEQ ID NO: 3949296 - RNA, 21 nt, Human herpesvirus 1
cucagcauccuuaaccgcugg

SEQ ID NO: 3949297 - RNA, 15 nt, Human herpesvirus 1
cucagggccuccgac

SEQ ID NO: 3949298 - RNA, 14 nt, Human herpesvirus 1
cucaugcgcgguga

SEQ ID NO: 3949299 - RNA, 20 nt, Human herpesvirus 1
cucauuuguggacgccgggg

SEQ ID NO: 3949300 - RNA, 22 nt, Human herpesvirus 1
cuccaaucgccgguuccucccg

SEQ ID NO: 3949301 - RNA, 14 nt, Human herpesvirus 1
cuccaccacccaac

SEQ ID NO: 3949302 - RNA, 22 nt, Human herpesvirus 1
cuccaggcugucgacgcccccu

SEQ ID NO: 3949303 - RNA, 23 nt, Human herpesvirus 1
cuccaggcugucgacgcccccuc

SEQ ID NO: 3949304 - RNA, 14 nt, Human herpesvirus 1
cuccaggugcgccu

SEQ ID NO: 3949305 - RNA, 23 nt, Human herpesvirus 1
cucccaacccccuaagacccacc

SEQ ID NO: 3949306 - RNA, 17 nt, Human herpesvirus 1
cucccaccgccaucagc

SEQ ID NO: 3949307 - RNA, 13 nt, Human herpesvirus 1
cuccccagcggcc

SEQ ID NO: 3949308 - RNA, 13 nt, Human herpesvirus 1
cucccccaccgcc

SEQ ID NO: 3949309 - RNA, 16 nt, Human herpesvirus 1
cucccccguguccugg

SEQ ID NO: 3949310 - RNA, 21 nt, Human herpesvirus 1
cucccccuccgcaucccagga

SEQ ID NO: 3949311 - RNA, 16 nt, Human herpesvirus 1
cuccccgccgcggccu

SEQ ID NO: 3949312 - RNA, 18 nt, Human herpesvirus 1
cuccccuucccucccccu

SEQ ID NO: 3949313 - RNA, 15 nt, Human herpesvirus 1
cuccgaaagccacca

SEQ ID NO: 3949314 - RNA, 18 nt, Human herpesvirus 1
cuccgacgacgcgcagcc

SEQ ID NO: 3949315 - RNA, 20 nt, Human herpesvirus 1
cuccgcaacggggcgccguc

SEQ ID NO: 3949316 - RNA, 16 nt, Human herpesvirus 1
cuccuccccgcgccgu

SEQ ID NO: 3949317 - RNA, 20 nt, Human herpesvirus 1
cuccucuucuccccuucccu

SEQ ID NO: 3949318 - RNA, 18 nt, Human herpesvirus 1
cuccuggaacgaggccgc

SEQ ID NO: 3949319 - RNA, 13 nt, Human herpesvirus 1
cucgagaugagcc

SEQ ID NO: 3949320 - RNA, 12 nt, Human herpesvirus 1
cucgcaccagcc

SEQ ID NO: 3949321 - RNA, 14 nt, Human herpesvirus 1
cucgcaccaucccg

SEQ ID NO: 3949322 - RNA, 21 nt, Human herpesvirus 1
cucgcgaguacuuccacgccc

SEQ ID NO: 3949323 - RNA, 14 nt, Human herpesvirus 1
cucggaaacugccu

SEQ ID NO: 3949324 - RNA, 21 nt, Human herpesvirus 1
cucggccaccgugggccggcg

SEQ ID NO: 3949325 - RNA, 21 nt, Human herpesvirus 1
cucggccuauggcuccugcga

SEQ ID NO: 3949326 - RNA, 21 nt, Human herpesvirus 1
cucggcgacgugauggccguc

SEQ ID NO: 3949327 - RNA, 15 nt, Human herpesvirus 1
cucggcgccucugga

SEQ ID NO: 3949328 - RNA, 15 nt, Human herpesvirus 1
cucggcgggcacgcc

SEQ ID NO: 3949329 - RNA, 18 nt, Human herpesvirus 1
cucgggaacggacggggu

SEQ ID NO: 3949330 - RNA, 19 nt, Human herpesvirus 1
cucguccgcgccccccgac

SEQ ID NO: 3949331 - RNA, 17 nt, Human herpesvirus 1
cucguggcgucucgccg

SEQ ID NO: 3949332 - RNA, 14 nt, Human herpesvirus 1
cucguucugcugca

SEQ ID NO: 3949333 - RNA, 14 nt, Human herpesvirus 1
cucuacccucugga

SEQ ID NO: 3949334 - RNA, 16 nt, Human herpesvirus 1
cucucgcaccaucccg

SEQ ID NO: 3949335 - RNA, 16 nt, Human herpesvirus 1
cucuggacuggaccac

SEQ ID NO: 3949336 - RNA, 13 nt, Human herpesvirus 1
cucugggggccug

SEQ ID NO: 3949337 - RNA, 15 nt, Human herpesvirus 1
cucuucuccccuucc

SEQ ID NO: 3949338 - RNA, 13 nt, Human herpesvirus 1
cugaccagcgcac

SEQ ID NO: 3949339 - RNA, 13 nt, Human herpesvirus 1
cugacccucuccg

SEQ ID NO: 3949340 - RNA, 16 nt, Human herpesvirus 1
cugcagaaucacgagc

SEQ ID NO: 3949341 - RNA, 14 nt, Human herpesvirus 1
cugcagaugcagag

SEQ ID NO: 3949342 - RNA, 13 nt, Human herpesvirus 1
cugccauggagcg

SEQ ID NO: 3949343 - RNA, 19 nt, Human herpesvirus 1
cugccccccccaccccaga

SEQ ID NO: 3949344 - RNA, 17 nt, Human herpesvirus 1
cugccccgcuucauccc

SEQ ID NO: 3949345 - RNA, 22 nt, Human herpesvirus 1
cugccgucgcuagaccacgccc

SEQ ID NO: 3949346 - RNA, 12 nt, Human herpesvirus 1
cugccucccccg

SEQ ID NO: 3949347 - RNA, 12 nt, Human herpesvirus 1
cugcggccggcg

SEQ ID NO: 3949348 - RNA, 16 nt, Human herpesvirus 1
cugcgggucaccugcc

SEQ ID NO: 3949349 - RNA, 13 nt, Human herpesvirus 1
cugcgugggccgc

SEQ ID NO: 3949350 - RNA, 16 nt, Human herpesvirus 1
cugcucacgaccccca

SEQ ID NO: 3949351 - RNA, 16 nt, Human herpesvirus 1
cugcuccgccuggccu

SEQ ID NO: 3949352 - RNA, 18 nt, Human herpesvirus 1
cugcugcggcccacccug

SEQ ID NO: 3949353 - RNA, 20 nt, Human herpesvirus 1
cuggacguccccgaggaccc

SEQ ID NO: 3949354 - RNA, 13 nt, Human herpesvirus 1
cuggagcucaauc

SEQ ID NO: 3949355 - RNA, 21 nt, Human herpesvirus 1
cuggaucccaacgaccccgcc

SEQ ID NO: 3949356 - RNA, 15 nt, Human herpesvirus 1
cuggccgcgcccacu

SEQ ID NO: 3949357 - RNA, 16 nt, Human herpesvirus 1
cuggccgcgcccacua

SEQ ID NO: 3949358 - RNA, 11 nt, Human herpesvirus 1
cuggccggccu

SEQ ID NO: 3949359 - RNA, 17 nt, Human herpesvirus 1
cuggccgggagcaccac

SEQ ID NO: 3949360 - RNA, 16 nt, Human herpesvirus 1
cuggcgcaaccacgcc

SEQ ID NO: 3949361 - RNA, 23 nt, Human herpesvirus 1
cuggcgcccccccaacgggggac

SEQ ID NO: 3949362 - RNA, 15 nt, Human herpesvirus 1
cuggggcccccaggg

SEQ ID NO: 3949363 - RNA, 23 nt, Human herpesvirus 1
cugggggcacccacgcccgcgac

SEQ ID NO: 3949364 - RNA, 14 nt, Human herpesvirus 1
cuggggucgcggcc

SEQ ID NO: 3949365 - RNA, 23 nt, Human herpesvirus 1
cuggucgucgggcgccaaagccc

SEQ ID NO: 3949366 - RNA, 18 nt, Human herpesvirus 1
cuggugcugucugacaca

SEQ ID NO: 3949367 - RNA, 15 nt, Human herpesvirus 1
cugguggcaccuccc

SEQ ID NO: 3949368 - RNA, 20 nt, Human herpesvirus 1
cuguaaguacgcccucccgc

SEQ ID NO: 3949369 - RNA, 21 nt, Human herpesvirus 1
cuguacgacugggggggaucc

SEQ ID NO: 3949370 - RNA, 19 nt, Human herpesvirus 1
cuguacucgacccacugcc

SEQ ID NO: 3949371 - RNA, 14 nt, Human herpesvirus 1
cuguaugacagcgg

SEQ ID NO: 3949372 - RNA, 22 nt, Human herpesvirus 1
cuguccaccgggaagcagggcc

SEQ ID NO: 3949373 - RNA, 18 nt, Human herpesvirus 1
cugucgaucguccaucac

SEQ ID NO: 3949374 - RNA, 16 nt, Human herpesvirus 1
cugucgcacccacagc

SEQ ID NO: 3949375 - RNA, 20 nt, Human herpesvirus 1
cugugggccaagauggccca

SEQ ID NO: 3949376 - RNA, 16 nt, Human herpesvirus 1
cuguugguauaggucc

SEQ ID NO: 3949377 - RNA, 17 nt, Human herpesvirus 1
cuuaccaucccccggcc

SEQ ID NO: 3949378 - RNA, 21 nt, Human herpesvirus 1
cuucauccccgagaaccagcg

SEQ ID NO: 3949379 - RNA, 13 nt, Human herpesvirus 1
cuuccccacggga

SEQ ID NO: 3949380 - RNA, 11 nt, Human herpesvirus 1
cuuccccuucc

SEQ ID NO: 3949381 - RNA, 18 nt, Human herpesvirus 1
cuuccucguacgcauggg

SEQ ID NO: 3949382 - RNA, 13 nt, Human herpesvirus 1
cuucggggcccgg

SEQ ID NO: 3949383 - RNA, 14 nt, Human herpesvirus 1
cuucuacaccuccc

SEQ ID NO: 3949384 - RNA, 13 nt, Human herpesvirus 1
cuucuccgcgugg

SEQ ID NO: 3949385 - RNA, 13 nt, Human herpesvirus 1
cuuggagccagcc

SEQ ID NO: 3949386 - RNA, 17 nt, Human herpesvirus 1
cuugggcccgggggccu

SEQ ID NO: 3949387 - RNA, 20 nt, Human herpesvirus 1
cuugggguugacgcuggggg

SEQ ID NO: 3949388 - RNA, 14 nt, Human herpesvirus 1
cuuggucuggccca

SEQ ID NO: 3949389 - RNA, 21 nt, Human herpesvirus 1
cuugguucggggccgcccugg

SEQ ID NO: 3949390 - RNA, 17 nt, Human herpesvirus 1
cuuugggcgggaggaag

SEQ ID NO: 3949391 - RNA, 19 nt, Human herpesvirus 1
cuuuuuuuauugggaggcg

SEQ ID NO: 3949392 - RNA, 17 nt, Human herpesvirus 1
gaaaccccagcauaccu

SEQ ID NO: 3949393 - RNA, 23 nt, Human herpesvirus 1
gaaacucggccgucccggggcag

SEQ ID NO: 3949394 - RNA, 18 nt, Human herpesvirus 1
cagcucgcggaggagcca

SEQ ID NO: 3949395 - RNA, 23 nt, Human herpesvirus 1
cagcucgcggcccggggccugcu

SEQ ID NO: 3949396 - RNA, 14 nt, Human herpesvirus 1
cagcugagccgcgc

SEQ ID NO: 3949397 - RNA, 20 nt, Human herpesvirus 1
cagcuugaagaucgccgggu

SEQ ID NO: 3949398 - RNA, 23 nt, Human herpesvirus 1
cagcuuuuuuugcgaaccguccc

SEQ ID NO: 3949399 - RNA, 14 nt, Human herpesvirus 1
caggaccgccugcc

SEQ ID NO: 3949400 - RNA, 23 nt, Human herpesvirus 1
caggacuuccccuuccucgcgga

SEQ ID NO: 3949401 - RNA, 16 nt, Human herpesvirus 1
caggaucacaccgguc

SEQ ID NO: 3949402 - RNA, 17 nt, Human herpesvirus 1
caggaucacaccgguca

SEQ ID NO: 3949403 - RNA, 17 nt, Human herpesvirus 1
caggccaucgccgggga

SEQ ID NO: 3949404 - RNA, 16 nt, Human herpesvirus 1
caggcccgccgccacu

SEQ ID NO: 3949405 - RNA, 19 nt, Human herpesvirus 1
caggcgacggcgucucccg

SEQ ID NO: 3949406 - RNA, 18 nt, Human herpesvirus 1
caggcgccuccggggguc

SEQ ID NO: 3949407 - RNA, 13 nt, Human herpesvirus 1
caggcggcgaacg

SEQ ID NO: 3949408 - RNA, 16 nt, Human herpesvirus 1
cagggaccuccuggac

SEQ ID NO: 3949409 - RNA, 11 nt, Human herpesvirus 1
cagggagaaac

SEQ ID NO: 3949410 - RNA, 23 nt, Human herpesvirus 1
cagggcgacgccgugggcaaugg

SEQ ID NO: 3949411 - RNA, 16 nt, Human herpesvirus 1
caggucccccacacca

SEQ ID NO: 3949412 - RNA, 21 nt, Human herpesvirus 1
caggugggugcuuuggaaacu

SEQ ID NO: 3949413 - RNA, 22 nt, Human herpesvirus 1
caguaccgccagggcgcuacga

SEQ ID NO: 3949414 - RNA, 23 nt, Human herpesvirus 1
caguacuggaaguaccugcagac

SEQ ID NO: 3949415 - RNA, 13 nt, Human herpesvirus 1
cagucccugaguu

SEQ ID NO: 3949416 - RNA, 19 nt, Human herpesvirus 1
cagucgcccgaagacaccc

SEQ ID NO: 3949417 - RNA, 22 nt, Human herpesvirus 1
cagucggcaagauccucgggcu

SEQ ID NO: 3949418 - RNA, 12 nt, Human herpesvirus 1
cagucuccuggc

SEQ ID NO: 3949419 - RNA, 13 nt, Human herpesvirus 1
cagugaggguggc

SEQ ID NO: 3949420 - RNA, 13 nt, Human herpesvirus 1
caguguacccugg

SEQ ID NO: 3949421 - RNA, 18 nt, Human herpesvirus 1
caguucgagcagccgcgc

SEQ ID NO: 3949422 - RNA, 16 nt, Human herpesvirus 1
caguuuauccuggagc

SEQ ID NO: 3949423 - RNA, 19 nt, Human herpesvirus 1
cauaaccgaccgcaguccc

SEQ ID NO: 3949424 - RNA, 22 nt, Human herpesvirus 1
cauaaccgaccgcagucccuga

SEQ ID NO: 3949425 - RNA, 17 nt, Human herpesvirus 1
cauacacgagcacccug

SEQ ID NO: 3949426 - RNA, 23 nt, Human herpesvirus 1
cauacacgagcacccugcugccc

SEQ ID NO: 3949427 - RNA, 14 nt, Human herpesvirus 1
cauauccaccaccu

SEQ ID NO: 3949428 - RNA, 13 nt, Human herpesvirus 1
caucacccgggug

SEQ ID NO: 3949429 - RNA, 18 nt, Human herpesvirus 1
caucccccgccuuuuugg

SEQ ID NO: 3949430 - RNA, 19 nt, Human herpesvirus 1
cauccccgagaaccagcgc

SEQ ID NO: 3949431 - RNA, 17 nt, Human herpesvirus 1
cauccccgcuccccaag

SEQ ID NO: 3949432 - RNA, 21 nt, Human herpesvirus 1
caucgaguauguacugcggcu

SEQ ID NO: 3949433 - RNA, 14 nt, Human herpesvirus 1
caucgccgcggcuc

SEQ ID NO: 3949434 - RNA, 14 nt, Human herpesvirus 1
caucgccucggcca

SEQ ID NO: 3949435 - RNA, 21 nt, Human herpesvirus 1
caucgguccccucugggcccg

SEQ ID NO: 3949436 - RNA, 15 nt, Human herpesvirus 1
caucucgcgccccga

SEQ ID NO: 3949437 - RNA, 19 nt, Human herpesvirus 1
caucugggauggcuccugg

SEQ ID NO: 3949438 - RNA, 23 nt, Human herpesvirus 1
caucugggauggcuccuggccag

SEQ ID NO: 3949439 - RNA, 23 nt, Human herpesvirus 1
caugaagccacuguuuuccgccc

SEQ ID NO: 3949440 - RNA, 21 nt, Human herpesvirus 1
caugaccgcccgccccucgcc

SEQ ID NO: 3949441 - RNA, 13 nt, Human herpesvirus 1
caugcacgaccug

SEQ ID NO: 3949442 - RNA, 12 nt, Human herpesvirus 1
caugccacccuc

SEQ ID NO: 3949443 - RNA, 17 nt, Human herpesvirus 1
caugcggcugcagagca

SEQ ID NO: 3949444 - RNA, 12 nt, Human herpesvirus 1
cauggaaggaac

SEQ ID NO: 3949445 - RNA, 17 nt, Human herpesvirus 1
cauggagcacgagcagg

SEQ ID NO: 3949446 - RNA, 14 nt, Human herpesvirus 1
cauggccaugacgg

SEQ ID NO: 3949447 - RNA, 17 nt, Human herpesvirus 1
cauggccaugacggguc

SEQ ID NO: 3949448 - RNA, 19 nt, Human herpesvirus 1
cauggcgccacaccacgcc

SEQ ID NO: 3949449 - RNA, 23 nt, Human herpesvirus 1
caugggaugucuuacuguauauc

SEQ ID NO: 3949450 - RNA, 14 nt, Human herpesvirus 1
cauuaucccauucc

SEQ ID NO: 3949451 - RNA, 14 nt, Human herpesvirus 1
ccaaaauaaaagac

SEQ ID NO: 3949452 - RNA, 15 nt, Human herpesvirus 1
ccaaacgccagccug

SEQ ID NO: 3949453 - RNA, 19 nt, Human herpesvirus 1
ccaaagcugcuggcgcgca

SEQ ID NO: 3949454 - RNA, 16 nt, Human herpesvirus 1
ccaacaauccccagga

SEQ ID NO: 3949455 - RNA, 20 nt, Human herpesvirus 1
ccaacccggacgcguccggg

SEQ ID NO: 3949456 - RNA, 12 nt, Human herpesvirus 1
ccaaccugaccg

SEQ ID NO: 3949457 - RNA, 13 nt, Human herpesvirus 1
ccaacgacggccc

SEQ ID NO: 3949458 - RNA, 17 nt, Human herpesvirus 1
ccaacgucuccuccacc

SEQ ID NO: 3949459 - RNA, 21 nt, Human herpesvirus 1
ccaacgucuccuccaccaccc

SEQ ID NO: 3949460 - RNA, 15 nt, Human herpesvirus 1
ccaacucucgcacca

SEQ ID NO: 3949461 - RNA, 20 nt, Human herpesvirus 1
ccaacucucgcaccaucccg

SEQ ID NO: 3949462 - RNA, 13 nt, Human herpesvirus 1
ccaagauggccca

SEQ ID NO: 3949463 - RNA, 19 nt, Human herpesvirus 1
ccaagccgggacuccgcgg

SEQ ID NO: 3949464 - RNA, 20 nt, Human herpesvirus 1
ccaaguacgccgccaccgug

SEQ ID NO: 3949465 - RNA, 20 nt, Human herpesvirus 1
ccaaucgccgguuccucccg

SEQ ID NO: 3949466 - RNA, 17 nt, Human herpesvirus 1
ccacaacaacgaccagg

SEQ ID NO: 3949467 - RNA, 19 nt, Human herpesvirus 1
ccacacagcccucccgacc

SEQ ID NO: 3949468 - RNA, 21 nt, Human herpesvirus 1
ccacacucaccggcggacccc

SEQ ID NO: 3949469 - RNA, 23 nt, Human herpesvirus 1
ccacagcuuuggguucguuccgg

SEQ ID NO: 3949470 - RNA, 22 nt, Human herpesvirus 1
ccacauaaccgaccgcaguccc

SEQ ID NO: 3949471 - RNA, 13 nt, Human herpesvirus 1
ccacaugcggaaa

SEQ ID NO: 3949472 - RNA, 23 nt, Human herpesvirus 1
ccacaugcggaaagcaagaacaa

SEQ ID NO: 3949473 - RNA, 15 nt, Human herpesvirus 1
ccaccaaggcccggg

SEQ ID NO: 3949474 - RNA, 14 nt, Human herpesvirus 1
ccaccauccccgcu

SEQ ID NO: 3949475 - RNA, 19 nt, Human herpesvirus 1
ccaccauggccccccgcgu

SEQ ID NO: 3949476 - RNA, 20 nt, Human herpesvirus 1
ccacccccccggaggaaacc

SEQ ID NO: 3949477 - RNA, 22 nt, Human herpesvirus 1
ccacccccccggaggaaacccc

SEQ ID NO: 3949478 - RNA, 19 nt, Human herpesvirus 1
ccacccggccauccgcgcc

SEQ ID NO: 3949479 - RNA, 19 nt, Human herpesvirus 1
ccacccuccgcuggggccc

SEQ ID NO: 3949480 - RNA, 22 nt, Human herpesvirus 1
ccacccucucuucccucagguc

SEQ ID NO: 3949481 - RNA, 12 nt, Human herpesvirus 1
ccacccuggagc

SEQ ID NO: 3949482 - RNA, 16 nt, Human herpesvirus 1
ccaccgacagccugaa

SEQ ID NO: 3949483 - RNA, 17 nt, Human herpesvirus 1
ccaccgccaucagccuu

SEQ ID NO: 3949484 - RNA, 21 nt, Human herpesvirus 1
ccaccgccaucagccuuacca

SEQ ID NO: 3949485 - RNA, 22 nt, Human herpesvirus 1
ccaccgggaagcagggcccgcc

SEQ ID NO: 3949486 - RNA, 11 nt, Human herpesvirus 1
ccaccgggccu

SEQ ID NO: 3949487 - RNA, 17 nt, Human herpesvirus 1
ccacgacacccacccca

SEQ ID NO: 3949488 - RNA, 15 nt, Human herpesvirus 1
ccacgcaaacaacac

SEQ ID NO: 3949489 - RNA, 22 nt, Human herpesvirus 1
ccacgcagccagaacucgcccc

SEQ ID NO: 3949490 - RNA, 18 nt, Human herpesvirus 1
ccacgcccccgccgcccg

SEQ ID NO: 3949491 - RNA, 21 nt, Human herpesvirus 1
ccacgccccuuucccccuguu

SEQ ID NO: 3949492 - RNA, 20 nt, Human herpesvirus 1
ccacgcccuuccccacggga

SEQ ID NO: 3949493 - RNA, 23 nt, Human herpesvirus 1
ccacgccgacgccaacgccgcca

SEQ ID NO: 3949494 - RNA, 16 nt, Human herpesvirus 1
ccacgcucuccccugc

SEQ ID NO: 3949495 - RNA, 14 nt, Human herpesvirus 1
ccacggccucgcca

SEQ ID NO: 3949496 - RNA, 18 nt, Human herpesvirus 1
ccacggguguggggaccc

SEQ ID NO: 3949497 - RNA, 15 nt, Human herpesvirus 1
ccacgguaggcccag

SEQ ID NO: 3949498 - RNA, 16 nt, Human herpesvirus 1
ccacgguaggcccagc

SEQ ID NO: 3949499 - RNA, 22 nt, Human herpesvirus 1
ccacguccccgggucuguuggg

SEQ ID NO: 3949500 - RNA, 14 nt, Human herpesvirus 1
ccacgugcacagcc

SEQ ID NO: 3949501 - RNA, 15 nt, Human herpesvirus 1
ccacuacaccagcca

SEQ ID NO: 3949502 - RNA, 21 nt, Human herpesvirus 1
ccacuggccgggagcaccaca

SEQ ID NO: 3949503 - RNA, 18 nt, Human herpesvirus 1
ccacuguuuuccgcccca

SEQ ID NO: 3949504 - RNA, 21 nt, Human herpesvirus 1
ccagacccaacccccggcccc

SEQ ID NO: 3949505 - RNA, 16 nt, Human herpesvirus 1
ccagaccccgggcgcg

SEQ ID NO: 3949506 - RNA, 17 nt, Human herpesvirus 1
ccagaccggcaccaccg

SEQ ID NO: 3949507 - RNA, 18 nt, Human herpesvirus 1
ccagacgacaucagcugu

SEQ ID NO: 3949508 - RNA, 22 nt, Human herpesvirus 1
ccagacgcgggcgacgcacaca

SEQ ID NO: 3949509 - RNA, 15 nt, Human herpesvirus 1
ccagagaccccaggg

SEQ ID NO: 3949510 - RNA, 21 nt, Human herpesvirus 1
gaaacuguccugucuuggggc

SEQ ID NO: 3949511 - RNA, 16 nt, Human herpesvirus 1
gaacaacaugggccug

SEQ ID NO: 3949512 - RNA, 17 nt, Human herpesvirus 1
gaacaacaugggccuga

SEQ ID NO: 3949513 - RNA, 19 nt, Human herpesvirus 1
gaacaauaaaggcgguggu

SEQ ID NO: 3949514 - RNA, 20 nt, Human herpesvirus 1
gaacaucuugaggggggaga

SEQ ID NO: 3949515 - RNA, 15 nt, Human herpesvirus 1
gaaccccaacgccau

SEQ ID NO: 3949516 - RNA, 19 nt, Human herpesvirus 1
gaaccccaacgccaucgcc

SEQ ID NO: 3949517 - RNA, 20 nt, Human herpesvirus 1
gaacccgcgcuaugacggca

SEQ ID NO: 3949518 - RNA, 19 nt, Human herpesvirus 1
gaaccuagggaacccagag

SEQ ID NO: 3949519 - RNA, 15 nt, Human herpesvirus 1
gaacgaggcccgcaa

SEQ ID NO: 3949520 - RNA, 13 nt, Human herpesvirus 1
gaacgcaggcgcu

SEQ ID NO: 3949521 - RNA, 18 nt, Human herpesvirus 1
gaagaggaggagggggcc

SEQ ID NO: 3949522 - RNA, 21 nt, Human herpesvirus 1
gaagcucgaacgcggguggga

SEQ ID NO: 3949523 - RNA, 22 nt, Human herpesvirus 1
gaaggaacccgcgcuaugacgg

SEQ ID NO: 3949524 - RNA, 22 nt, Human herpesvirus 1
gaaugcagcgccggccuccccg

SEQ ID NO: 3949525 - RNA, 23 nt, Human herpesvirus 1
gacaaccccggucucccagggag

SEQ ID NO: 3949526 - RNA, 18 nt, Human herpesvirus 1
gacaacgcgacaggccag

SEQ ID NO: 3949527 - RNA, 13 nt, Human herpesvirus 1
gacaccaccagcu

SEQ ID NO: 3949528 - RNA, 16 nt, Human herpesvirus 1
gacacgggcaccacac

SEQ ID NO: 3949529 - RNA, 16 nt, Human herpesvirus 1
gacacugaaaugcccc

SEQ ID NO: 3949530 - RNA, 22 nt, Human herpesvirus 1
gacagcggggacucgggcgagu

SEQ ID NO: 3949531 - RNA, 16 nt, Human herpesvirus 1
gacaugaccgcccgcc

SEQ ID NO: 3949532 - RNA, 19 nt, Human herpesvirus 1
gacaugaccgcccgccccu

SEQ ID NO: 3949533 - RNA, 19 nt, Human herpesvirus 1
gacauuaaccaccugcgcu

SEQ ID NO: 3949534 - RNA, 15 nt, Human herpesvirus 1
gaccaacgacggccc

SEQ ID NO: 3949535 - RNA, 15 nt, Human herpesvirus 1
gaccacacacccccc

SEQ ID NO: 3949536 - RNA, 20 nt, Human herpesvirus 1
gaccaccauccccgcucccc

SEQ ID NO: 3949537 - RNA, 21 nt, Human herpesvirus 1
gaccaccauccccgcucccca

SEQ ID NO: 3949538 - RNA, 20 nt, Human herpesvirus 1
gaccaccggucgucccucgc

SEQ ID NO: 3949539 - RNA, 14 nt, Human herpesvirus 1
gaccacgccccuuu

SEQ ID NO: 3949540 - RNA, 15 nt, Human herpesvirus 1
gaccacgugcacagc

SEQ ID NO: 3949541 - RNA, 20 nt, Human herpesvirus 1
gaccagccguccucgcacca

SEQ ID NO: 3949542 - RNA, 15 nt, Human herpesvirus 1
gaccagcgcacugcc

SEQ ID NO: 3949543 - RNA, 23 nt, Human herpesvirus 1
gaccaucacccgagucucugggc

SEQ ID NO: 3949544 - RNA, 13 nt, Human herpesvirus 1
gacccaaaauaau

SEQ ID NO: 3949545 - RNA, 20 nt, Human herpesvirus 1
gaccccagcgaccccacggc

SEQ ID NO: 3949546 - RNA, 20 nt, Human herpesvirus 1
gacccccaacgccacgcagc

SEQ ID NO: 3949547 - RNA, 16 nt, Human herpesvirus 1
gaccccgcccaugggu

SEQ ID NO: 3949548 - RNA, 15 nt, Human herpesvirus 1
gaccccgggcgcgcc

SEQ ID NO: 3949549 - RNA, 18 nt, Human herpesvirus 1
gaccccggggcucagcca

SEQ ID NO: 3949550 - RNA, 20 nt, Human herpesvirus 1
gacccgcaacgcgcuggggc

SEQ ID NO: 3949551 - RNA, 14 nt, Human herpesvirus 1
gacccgcauccccc

SEQ ID NO: 3949552 - RNA, 21 nt, Human herpesvirus 1
gacccguuccagccccccagc

SEQ ID NO: 3949553 - RNA, 23 nt, Human herpesvirus 1
gacccuaggaggccgccacgcgc

SEQ ID NO: 3949554 - RNA, 20 nt, Human herpesvirus 1
gaccgacagcacucacagcc

SEQ ID NO: 3949555 - RNA, 23 nt, Human herpesvirus 1
gaccgacagcacucacagccccg

SEQ ID NO: 3949556 - RNA, 14 nt, Human herpesvirus 1
gaccgaguacccgc

SEQ ID NO: 3949557 - RNA, 17 nt, Human herpesvirus 1
gaccgcagucccugagu

SEQ ID NO: 3949558 - RNA, 16 nt, Human herpesvirus 1
gaccgcaucgacacgc

SEQ ID NO: 3949559 - RNA, 20 nt, Human herpesvirus 1
gaccgcccccagcugggccc

SEQ ID NO: 3949560 - RNA, 17 nt, Human herpesvirus 1
gaccgcccgccccucgc

SEQ ID NO: 3949561 - RNA, 17 nt, Human herpesvirus 1
gaccgccugccgcgcgg

SEQ ID NO: 3949562 - RNA, 19 nt, Human herpesvirus 1
gaccgcguguacgggcugu

SEQ ID NO: 3949563 - RNA, 22 nt, Human herpesvirus 1
gaccgcuucaagcaggucgacg

SEQ ID NO: 3949564 - RNA, 15 nt, Human herpesvirus 1
gaccggauggaggag

SEQ ID NO: 3949565 - RNA, 19 nt, Human herpesvirus 1
gaccuauguguuucagaua

SEQ ID NO: 3949566 - RNA, 22 nt, Human herpesvirus 1
gaccuccccgcgcaugcucugg

SEQ ID NO: 3949567 - RNA, 21 nt, Human herpesvirus 1
gaccugcuuauucucggggag

SEQ ID NO: 3949568 - RNA, 12 nt, Human herpesvirus 1
gaccuggggcgc

SEQ ID NO: 3949569 - RNA, 10 nt, Human herpesvirus 1
gaccuggggg

SEQ ID NO: 3949570 - RNA, 13 nt, Human herpesvirus 1
gacgacgcccgcc

SEQ ID NO: 3949571 - RNA, 14 nt, Human herpesvirus 1
gacgacgcccgccg

SEQ ID NO: 3949572 - RNA, 13 nt, Human herpesvirus 1
gacgagauuuaau

SEQ ID NO: 3949573 - RNA, 16 nt, Human herpesvirus 1
gacgagccgcgcgccg

SEQ ID NO: 3949574 - RNA, 14 nt, Human herpesvirus 1
gacgccagcuuucc

SEQ ID NO: 3949575 - RNA, 23 nt, Human herpesvirus 1
gacgccagcuuuccgcugagccu

SEQ ID NO: 3949576 - RNA, 12 nt, Human herpesvirus 1
gacgccgcgcag

SEQ ID NO: 3949577 - RNA, 15 nt, Human herpesvirus 1
gacgcgcagccggcg

SEQ ID NO: 3949578 - RNA, 18 nt, Human herpesvirus 1
gacgcucccgucgcccga

SEQ ID NO: 3949579 - RNA, 23 nt, Human herpesvirus 1
gacggcccgaccaacgucgccgc

SEQ ID NO: 3949580 - RNA, 14 nt, Human herpesvirus 1
gacggcggaccugg

SEQ ID NO: 3949581 - RNA, 13 nt, Human herpesvirus 1
gacgggcagugag

SEQ ID NO: 3949582 - RNA, 17 nt, Human herpesvirus 1
gacgucaauugcccgag

SEQ ID NO: 3949583 - RNA, 15 nt, Human herpesvirus 1
gacguccugggccac

SEQ ID NO: 3949584 - RNA, 22 nt, Human herpesvirus 1
gacguccugggccaccugacgc

SEQ ID NO: 3949585 - RNA, 19 nt, Human herpesvirus 1
gacgucgccccuguggccc

SEQ ID NO: 3949586 - RNA, 21 nt, Human herpesvirus 1
gacgucugggaacacaggcgc

SEQ ID NO: 3949587 - RNA, 16 nt, Human herpesvirus 1
gacguuuuccucgucc

SEQ ID NO: 3949588 - RNA, 21 nt, Human herpesvirus 1
gacuaagcgucccugggcccu

SEQ ID NO: 3949589 - RNA, 21 nt, Human herpesvirus 1
gacucaagcacacacggggga

SEQ ID NO: 3949590 - RNA, 23 nt, Human herpesvirus 1
gacucaagcacacacgggggagc

SEQ ID NO: 3949591 - RNA, 23 nt, Human herpesvirus 1
gacucagggcucuacccucugga

SEQ ID NO: 3949592 - RNA, 21 nt, Human herpesvirus 1
gacucguuauugcacccccga

SEQ ID NO: 3949593 - RNA, 21 nt, Human herpesvirus 1
gagaaacggccgaagccacgc

SEQ ID NO: 3949594 - RNA, 19 nt, Human herpesvirus 1
gagaccagucgcccgaaga

SEQ ID NO: 3949595 - RNA, 14 nt, Human herpesvirus 1
gagacgggcgguuc

SEQ ID NO: 3949596 - RNA, 12 nt, Human herpesvirus 1
gagagcccacau

SEQ ID NO: 3949597 - RNA, 18 nt, Human herpesvirus 1
gagaguuugaucguggac

SEQ ID NO: 3949598 - RNA, 17 nt, Human herpesvirus 1
gagcacccugcugcccc

SEQ ID NO: 3949599 - RNA, 17 nt, Human herpesvirus 1
gagccaacgcccugacc

SEQ ID NO: 3949600 - RNA, 17 nt, Human herpesvirus 1
gagcccacaugcggaaa

SEQ ID NO: 3949601 - RNA, 22 nt, Human herpesvirus 1
gagcccacaugcggaaagcaag

SEQ ID NO: 3949602 - RNA, 23 nt, Human herpesvirus 1
gagcccacaugcggaaagcaaga

SEQ ID NO: 3949603 - RNA, 23 nt, Human herpesvirus 1
gagcccagaccccuucuccccac

SEQ ID NO: 3949604 - RNA, 13 nt, Human herpesvirus 1
gagccccccgcug

SEQ ID NO: 3949605 - RNA, 18 nt, Human herpesvirus 1
gagccgugcaccguggga

SEQ ID NO: 3949606 - RNA, 20 nt, Human herpesvirus 1
gagccucugugucagguggc

SEQ ID NO: 3949607 - RNA, 16 nt, Human herpesvirus 1
gagccuguuguggcuc

SEQ ID NO: 3949608 - RNA, 21 nt, Human herpesvirus 1
auggcacaccgguccccggag

SEQ ID NO: 3949609 - RNA, 15 nt, Human herpesvirus 1
auggcccuccaggcu

SEQ ID NO: 3949610 - RNA, 16 nt, Human herpesvirus 1
auggcugcccccccgc

SEQ ID NO: 3949611 - RNA, 14 nt, Human herpesvirus 1
augggcccugcucc

SEQ ID NO: 3949612 - RNA, 17 nt, Human herpesvirus 1
augggcggccccggccg

SEQ ID NO: 3949613 - RNA, 17 nt, Human herpesvirus 1
augucccucauuuuaca

SEQ ID NO: 3949614 - RNA, 15 nt, Human herpesvirus 1
auguuuaugggauuu

SEQ ID NO: 3949615 - RNA, 18 nt, Human herpesvirus 1
auugacccaaaacacacg

SEQ ID NO: 3949616 - RNA, 21 nt, Human herpesvirus 1
auugcacccccgacgaggugc

SEQ ID NO: 3949617 - RNA, 23 nt, Human herpesvirus 1
auuuccgacgaacgcggaccccc

SEQ ID NO: 3949618 - RNA, 14 nt, Human herpesvirus 1
caaaaccacaaccu

SEQ ID NO: 3949619 - RNA, 13 nt, Human herpesvirus 1
caaaauaaaagac

SEQ ID NO: 3949620 - RNA, 13 nt, Human herpesvirus 1
caaacaaccagcc

SEQ ID NO: 3949621 - RNA, 13 nt, Human herpesvirus 1
caaacgacccacc

SEQ ID NO: 3949622 - RNA, 14 nt, Human herpesvirus 1
caaacgccagccug

SEQ ID NO: 3949623 - RNA, 16 nt, Human herpesvirus 1
caaagugccccgaccc

SEQ ID NO: 3949624 - RNA, 16 nt, Human herpesvirus 1
caaaugccgggccaag

SEQ ID NO: 3949625 - RNA, 14 nt, Human herpesvirus 1
caacaacucccccg

SEQ ID NO: 3949626 - RNA, 21 nt, Human herpesvirus 1
caaccccagggaccuccugga

SEQ ID NO: 3949627 - RNA, 19 nt, Human herpesvirus 1
caaccccggucucccaggg

SEQ ID NO: 3949628 - RNA, 19 nt, Human herpesvirus 1
caaccgcgacccuccggga

SEQ ID NO: 3949629 - RNA, 20 nt, Human herpesvirus 1
caaccgcgacccuccgggau

SEQ ID NO: 3949630 - RNA, 23 nt, Human herpesvirus 1
caaccucgggugcauauccuggg

SEQ ID NO: 3949631 - RNA, 14 nt, Human herpesvirus 1
caacgaggguuggg

SEQ ID NO: 3949632 - RNA, 14 nt, Human herpesvirus 1
caacgccuccccug

SEQ ID NO: 3949633 - RNA, 22 nt, Human herpesvirus 1
caacgcgaccgucgccgcgggc

SEQ ID NO: 3949634 - RNA, 14 nt, Human herpesvirus 1
caacgcgcuggggc

SEQ ID NO: 3949635 - RNA, 20 nt, Human herpesvirus 1
caacgucuccuccaccaccc

SEQ ID NO: 3949636 - RNA, 15 nt, Human herpesvirus 1
caacuccagaccacc

SEQ ID NO: 3949637 - RNA, 20 nt, Human herpesvirus 1
caagaagaagggcacgagcg

SEQ ID NO: 3949638 - RNA, 17 nt, Human herpesvirus 1
caagaccaacccagcca

SEQ ID NO: 3949639 - RNA, 18 nt, Human herpesvirus 1
caagcccccgcccgaccg

SEQ ID NO: 3949640 - RNA, 22 nt, Human herpesvirus 1
caagccgcgauuccgagggccg

SEQ ID NO: 3949641 - RNA, 18 nt, Human herpesvirus 1
caaggugggccagccgca

SEQ ID NO: 3949642 - RNA, 18 nt, Human herpesvirus 1
caaguucaaggccaccau

SEQ ID NO: 3949643 - RNA, 20 nt, Human herpesvirus 1
caauaaaagaccacaccaac

SEQ ID NO: 3949644 - RNA, 23 nt, Human herpesvirus 1
caauccgugucggggaggggaaa

SEQ ID NO: 3949645 - RNA, 14 nt, Human herpesvirus 1
caaugggccgggcc

SEQ ID NO: 3949646 - RNA, 21 nt, Human herpesvirus 1
cacaaacacaaaacacacggg

SEQ ID NO: 3949647 - RNA, 20 nt, Human herpesvirus 1
cacaaacaucuggaggcuuu

SEQ ID NO: 3949648 - RNA, 14 nt, Human herpesvirus 1
cacaaccucccggg

SEQ ID NO: 3949649 - RNA, 18 nt, Human herpesvirus 1
cacaacggcaugccucug

SEQ ID NO: 3949650 - RNA, 16 nt, Human herpesvirus 1
cacacaccccccaugc

SEQ ID NO: 3949651 - RNA, 17 nt, Human herpesvirus 1
cacaccaccgaccucaa

SEQ ID NO: 3949652 - RNA, 16 nt, Human herpesvirus 1
cacaccccccaugcca

SEQ ID NO: 3949653 - RNA, 17 nt, Human herpesvirus 1
cacauaaccgaccgcag

SEQ ID NO: 3949654 - RNA, 19 nt, Human herpesvirus 1
cacaugcggaaagcaagaa

SEQ ID NO: 3949655 - RNA, 20 nt, Human herpesvirus 1
caccaacaaccuucugcggg

SEQ ID NO: 3949656 - RNA, 13 nt, Human herpesvirus 1
caccacccaaccc

SEQ ID NO: 3949657 - RNA, 18 nt, Human herpesvirus 1
caccacccaaccccaacu

SEQ ID NO: 3949658 - RNA, 15 nt, Human herpesvirus 1
caccacgccacaaca

SEQ ID NO: 3949659 - RNA, 16 nt, Human herpesvirus 1
caccauccccgcuccc

SEQ ID NO: 3949660 - RNA, 11 nt, Human herpesvirus 1
cacccaacaac

SEQ ID NO: 3949661 - RNA, 18 nt, Human herpesvirus 1
caccccaacgccuccccu

SEQ ID NO: 3949662 - RNA, 13 nt, Human herpesvirus 1
caccccccaugcc

SEQ ID NO: 3949663 - RNA, 19 nt, Human herpesvirus 1
cacccgccccuccauccca

SEQ ID NO: 3949664 - RNA, 14 nt, Human herpesvirus 1
cacccuaccccagu

SEQ ID NO: 3949665 - RNA, 21 nt, Human herpesvirus 1
cacccucucuucccucagguc

SEQ ID NO: 3949666 - RNA, 13 nt, Human herpesvirus 1
caccgcucccccc

SEQ ID NO: 3949667 - RNA, 15 nt, Human herpesvirus 1
caccggcggaccccc

SEQ ID NO: 3949668 - RNA, 17 nt, Human herpesvirus 1
caccgucauccacaccu

SEQ ID NO: 3949669 - RNA, 14 nt, Human herpesvirus 1
caccguggccuggg

SEQ ID NO: 3949670 - RNA, 21 nt, Human herpesvirus 1
caccguggccugggacugggu

SEQ ID NO: 3949671 - RNA, 17 nt, Human herpesvirus 1
caccucccagugucccg

SEQ ID NO: 3949672 - RNA, 22 nt, Human herpesvirus 1
caccuccggagcgugacgcacc

SEQ ID NO: 3949673 - RNA, 23 nt, Human herpesvirus 1
caccuguguggcgguugguccag

SEQ ID NO: 3949674 - RNA, 16 nt, Human herpesvirus 1
caccuuggcccuggcu

SEQ ID NO: 3949675 - RNA, 19 nt, Human herpesvirus 1
cacgaccuguugauggccu

SEQ ID NO: 3949676 - RNA, 22 nt, Human herpesvirus 1
cacgagaucaaggacagcggcc

SEQ ID NO: 3949677 - RNA, 13 nt, Human herpesvirus 1
cacgagccggggc

SEQ ID NO: 3949678 - RNA, 15 nt, Human herpesvirus 1
cacgagcgcgcugcu

SEQ ID NO: 3949679 - RNA, 21 nt, Human herpesvirus 1
cacgcaguacuggaaguaccu

SEQ ID NO: 3949680 - RNA, 12 nt, Human herpesvirus 1
cacgcccgacca

SEQ ID NO: 3949681 - RNA, 17 nt, Human herpesvirus 1
cacgcgccgccgacucc

SEQ ID NO: 3949682 - RNA, 20 nt, Human herpesvirus 1
cacgcgcgacgggcagugag

SEQ ID NO: 3949683 - RNA, 19 nt, Human herpesvirus 1
cacgcgcguccuucuuguc

SEQ ID NO: 3949684 - RNA, 16 nt, Human herpesvirus 1
cacggcgucgcuguga

SEQ ID NO: 3949685 - RNA, 12 nt, Human herpesvirus 1
cacgggcgccac

SEQ ID NO: 3949686 - RNA, 15 nt, Human herpesvirus 1
cacgguucccgagag

SEQ ID NO: 3949687 - RNA, 17 nt, Human herpesvirus 1
cacgucgaccgcgcccu

SEQ ID NO: 3949688 - RNA, 17 nt, Human herpesvirus 1
cacgugcacagccuggc

SEQ ID NO: 3949689 - RNA, 14 nt, Human herpesvirus 1
cacgugcgugccgg

SEQ ID NO: 3949690 - RNA, 13 nt, Human herpesvirus 1
cacuacaccagcc

SEQ ID NO: 3949691 - RNA, 21 nt, Human herpesvirus 1
cacucaaaaagccccaaagcg

SEQ ID NO: 3949692 - RNA, 18 nt, Human herpesvirus 1
cacucgacccccgcgucc

SEQ ID NO: 3949693 - RNA, 20 nt, Human herpesvirus 1
cacuggccgggagcaccaca

SEQ ID NO: 3949694 - RNA, 18 nt, Human herpesvirus 1
cacuggguucuccuggaa

SEQ ID NO: 3949695 - RNA, 16 nt, Human herpesvirus 1
cacuguggcucuccuc

SEQ ID NO: 3949696 - RNA, 18 nt, Human herpesvirus 1
cacuugcggcaagacccg

SEQ ID NO: 3949697 - RNA, 14 nt, Human herpesvirus 1
cagaccgaagaggu

SEQ ID NO: 3949698 - RNA, 22 nt, Human herpesvirus 1
cagacgaaaagccccgggccgc

SEQ ID NO: 3949699 - RNA, 12 nt, Human herpesvirus 1
cagacgcacccg

SEQ ID NO: 3949700 - RNA, 20 nt, Human herpesvirus 1
cagacgcugcuccgccuggc

SEQ ID NO: 3949701 - RNA, 19 nt, Human herpesvirus 1
cagagacaacgcgacaggc

SEQ ID NO: 3949702 - RNA, 14 nt, Human herpesvirus 1
cagagaccccaggg

SEQ ID NO: 3949703 - RNA, 15 nt, Human herpesvirus 1
cagauagagcugcuc

SEQ ID NO: 3949704 - RNA, 15 nt, Human herpesvirus 1
cagaugcccacgggc

SEQ ID NO: 3949705 - RNA, 19 nt, Human herpesvirus 1
cagcacggcgucgcuguga

SEQ ID NO: 3949706 - RNA, 14 nt, Human herpesvirus 1
cagcagacgcugcu

SEQ ID NO: 3949707 - RNA, 22 nt, Human herpesvirus 1
cagcagacgcugcuccgccugg

SEQ ID NO: 3949708 - RNA, 14 nt, Human herpesvirus 1
cagcaucccccgcc

SEQ ID NO: 3949709 - RNA, 22 nt, Human herpesvirus 1
cagcaucgggaugcugccccgc

SEQ ID NO: 3949710 - RNA, 20 nt, Human herpesvirus 1
cagccagaacucgccccgga

SEQ ID NO: 3949711 - RNA, 20 nt, Human herpesvirus 1
cagcccccagaugcccacgg

SEQ ID NO: 3949712 - RNA, 14 nt, Human herpesvirus 1
cagcccccccaagc

SEQ ID NO: 3949713 - RNA, 13 nt, Human herpesvirus 1
cagccgcgccgcu

SEQ ID NO: 3949714 - RNA, 14 nt, Human herpesvirus 1
cagccgcgccgcug

SEQ ID NO: 3949715 - RNA, 16 nt, Human herpesvirus 1
cagccgggacgaggcc

SEQ ID NO: 3949716 - RNA, 23 nt, Human herpesvirus 1
cagccugccucuccccccaggcc

SEQ ID NO: 3949717 - RNA, 14 nt, Human herpesvirus 1
cagccugcggccgg

SEQ ID NO: 3949718 - RNA, 15 nt, Human herpesvirus 1
cagccuuaccacgcc

SEQ ID NO: 3949719 - RNA, 21 nt, Human herpesvirus 1
cagcgacguccugggccaccu

SEQ ID NO: 3949720 - RNA, 14 nt, Human herpesvirus 1
cagcgccaagguca

SEQ ID NO: 3949721 - RNA, 19 nt, Human herpesvirus 1
cagcgccaaggucaccgac

SEQ ID NO: 3949722 - RNA, 22 nt, Human herpesvirus 1
cagcgccgcaaccagcugcacg

SEQ ID NO: 3949723 - RNA, 20 nt, Human herpesvirus 1
cagcgcggcggggcccggcc

SEQ ID NO: 3949724 - RNA, 17 nt, Human herpesvirus 1
cagcucgcggaggagcc

SEQ ID NO: 3949725 - RNA, 13 nt, Human herpesvirus 1
ugcacagccuggc

SEQ ID NO: 3949726 - RNA, 14 nt, Human herpesvirus 1
ugcacagccuggcc

SEQ ID NO: 3949727 - RNA, 21 nt, Human herpesvirus 1
ugcacccccgacgaggugcgc

SEQ ID NO: 3949728 - RNA, 13 nt, Human herpesvirus 1
ugcacucccugcc

SEQ ID NO: 3949729 - RNA, 15 nt, Human herpesvirus 1
ugcagggccuggugc

SEQ ID NO: 3949730 - RNA, 23 nt, Human herpesvirus 1
ugccaaagcgcccgucggucugc

SEQ ID NO: 3949731 - RNA, 17 nt, Human herpesvirus 1
ugccacuccggcgccgc

SEQ ID NO: 3949732 - RNA, 16 nt, Human herpesvirus 1
ugccaucgcgcccccu

SEQ ID NO: 3949733 - RNA, 21 nt, Human herpesvirus 1
ugccccaccguugcccgggcc

SEQ ID NO: 3949734 - RNA, 21 nt, Human herpesvirus 1
ugccccggccggauucccggg

SEQ ID NO: 3949735 - RNA, 12 nt, Human herpesvirus 1
ugccccugguga

SEQ ID NO: 3949736 - RNA, 21 nt, Human herpesvirus 1
ugcccuccccccgcccccggc

SEQ ID NO: 3949737 - RNA, 19 nt, Human herpesvirus 1
ugcccucccugacggccau

SEQ ID NO: 3949738 - RNA, 11 nt, Human herpesvirus 1
ugcccucgcgg

SEQ ID NO: 3949739 - RNA, 21 nt, Human herpesvirus 1
ugccgcccguugcagggccug

SEQ ID NO: 3949740 - RNA, 17 nt, Human herpesvirus 1
ugccggucggcgggccc

SEQ ID NO: 3949741 - RNA, 19 nt, Human herpesvirus 1
ugccggucggcgggcccgc

SEQ ID NO: 3949742 - RNA, 15 nt, Human herpesvirus 1
ugccuccaccgggcc

SEQ ID NO: 3949743 - RNA, 15 nt, Human herpesvirus 1
ugccucuccccccag

SEQ ID NO: 3949744 - RNA, 14 nt, Human herpesvirus 1
ugccugacccucuc

SEQ ID NO: 3949745 - RNA, 18 nt, Human herpesvirus 1
ugcgauggcgacacaccu

SEQ ID NO: 3949746 - RNA, 14 nt, Human herpesvirus 1
ugcgauucuagccu

SEQ ID NO: 3949747 - RNA, 21 nt, Human herpesvirus 1
ugcgccuggauucgcuggacc

SEQ ID NO: 3949748 - RNA, 18 nt, Human herpesvirus 1
ugcggaaagcaagaacaa

SEQ ID NO: 3949749 - RNA, 13 nt, Human herpesvirus 1
ugcggcccgcguu

SEQ ID NO: 3949750 - RNA, 15 nt, Human herpesvirus 1
ugcggccggcgggac

SEQ ID NO: 3949751 - RNA, 22 nt, Human herpesvirus 1
ugcggccggcgggacucugggc

SEQ ID NO: 3949752 - RNA, 20 nt, Human herpesvirus 1
ugcgggaguuucuccgcggu

SEQ ID NO: 3949753 - RNA, 20 nt, Human herpesvirus 1
ugcgguucguucuggacggg

SEQ ID NO: 3949754 - RNA, 17 nt, Human herpesvirus 1
ugcgucgggccucccgg

SEQ ID NO: 3949755 - RNA, 19 nt, Human herpesvirus 1
ugcguucaucggacccccc

SEQ ID NO: 3949756 - RNA, 20 nt, Human herpesvirus 1
ugcucacgacccccaaguuc

SEQ ID NO: 3949757 - RNA, 15 nt, Human herpesvirus 1
uggacgcccgggcgc

SEQ ID NO: 3949758 - RNA, 20 nt, Human herpesvirus 1
uggagagcgaaggcugccgc

SEQ ID NO: 3949759 - RNA, 17 nt, Human herpesvirus 1
uggcaacucgccccacg

SEQ ID NO: 3949760 - RNA, 15 nt, Human herpesvirus 1
uggcacaccgguccc

SEQ ID NO: 3949761 - RNA, 13 nt, Human herpesvirus 1
uggcaggagccgc

SEQ ID NO: 3949762 - RNA, 21 nt, Human herpesvirus 1
uggccaggggcauccgggacc

SEQ ID NO: 3949763 - RNA, 20 nt, Human herpesvirus 1
uggccccaguccccaagacc

SEQ ID NO: 3949764 - RNA, 22 nt, Human herpesvirus 1
uggcccuuccuaacccagaccc

SEQ ID NO: 3949765 - RNA, 21 nt, Human herpesvirus 1
uggccgacaacugccugaccc

SEQ ID NO: 3949766 - RNA, 21 nt, Human herpesvirus 1
uggccgcucgguggcuccggg

SEQ ID NO: 3949767 - RNA, 17 nt, Human herpesvirus 1
uggccggggagggcagg

SEQ ID NO: 3949768 - RNA, 15 nt, Human herpesvirus 1
uggccgugggucugu

SEQ ID NO: 3949769 - RNA, 10 nt, Human herpesvirus 1
uggcgccccc

SEQ ID NO: 3949770 - RNA, 13 nt, Human herpesvirus 1
uggcgccccggcc

SEQ ID NO: 3949771 - RNA, 14 nt, Human herpesvirus 1
uggcgccccggccc

SEQ ID NO: 3949772 - RNA, 19 nt, Human herpesvirus 1
uggcgccgccugguccccc

SEQ ID NO: 3949773 - RNA, 17 nt, Human herpesvirus 1
uggcgcggugccugacg

SEQ ID NO: 3949774 - RNA, 18 nt, Human herpesvirus 1
uggcgcggugccugacgc

SEQ ID NO: 3949775 - RNA, 19 nt, Human herpesvirus 1
uggcgcgucguucgggcgg

SEQ ID NO: 3949776 - RNA, 16 nt, Human herpesvirus 1
uggcgucggcggcucc

SEQ ID NO: 3949777 - RNA, 22 nt, Human herpesvirus 1
uggcguucgucgcccuccacca

SEQ ID NO: 3949778 - RNA, 15 nt, Human herpesvirus 1
uggcuccuggccagg

SEQ ID NO: 3949779 - RNA, 15 nt, Human herpesvirus 1
uggcugacccacgcg

SEQ ID NO: 3949780 - RNA, 20 nt, Human herpesvirus 1
uggcuggguuuuuggcccug

SEQ ID NO: 3949781 - RNA, 23 nt, Human herpesvirus 1
ugggaacggacacgcggggacac

SEQ ID NO: 3949782 - RNA, 12 nt, Human herpesvirus 1
ugggcauccagg

SEQ ID NO: 3949783 - RNA, 16 nt, Human herpesvirus 1
ugggcauccagggaga

SEQ ID NO: 3949784 - RNA, 17 nt, Human herpesvirus 1
ugggccaccgacagccu

SEQ ID NO: 3949785 - RNA, 23 nt, Human herpesvirus 1
ugggccauggacagcgaccuggg

SEQ ID NO: 3949786 - RNA, 13 nt, Human herpesvirus 1
ugggccgggccgc

SEQ ID NO: 3949787 - RNA, 17 nt, Human herpesvirus 1
ugggccucacccacgcc

SEQ ID NO: 3949788 - RNA, 20 nt, Human herpesvirus 1
ugggccucucguucuccggg

SEQ ID NO: 3949789 - RNA, 23 nt, Human herpesvirus 1
ugggccucucguucuccggggcc

SEQ ID NO: 3949790 - RNA, 21 nt, Human herpesvirus 1
ugggcggccccggccgcccuu

SEQ ID NO: 3949791 - RNA, 13 nt, Human herpesvirus 1
uggggcgcuggcc

SEQ ID NO: 3949792 - RNA, 12 nt, Human herpesvirus 1
ugggggacgagg

SEQ ID NO: 3949793 - RNA, 22 nt, Human herpesvirus 1
ugggucugugccaccagccugg

SEQ ID NO: 3949794 - RNA, 21 nt, Human herpesvirus 1
uggguuggcgucgggaccauc

SEQ ID NO: 3949795 - RNA, 19 nt, Human herpesvirus 1
ugguaucaaacucauuugu

SEQ ID NO: 3949796 - RNA, 16 nt, Human herpesvirus 1
uggucccccggggacc

SEQ ID NO: 3949797 - RNA, 18 nt, Human herpesvirus 1
ugguccgcggggccuccc

SEQ ID NO: 3949798 - RNA, 20 nt, Human herpesvirus 1
uggucggcgagcuggauggc

SEQ ID NO: 3949799 - RNA, 20 nt, Human herpesvirus 1
uggucuucaaggagaacauc

SEQ ID NO: 3949800 - RNA, 16 nt, Human herpesvirus 1
uggugaucgccugucu

SEQ ID NO: 3949801 - RNA, 21 nt, Human herpesvirus 1
uggugucugccauggagcgca

SEQ ID NO: 3949802 - RNA, 17 nt, Human herpesvirus 1
uguaacuucgacccgca

SEQ ID NO: 3949803 - RNA, 17 nt, Human herpesvirus 1
uguaaguacgcccuccc

SEQ ID NO: 3949804 - RNA, 21 nt, Human herpesvirus 1
ugucccgacauuaaccaccug

SEQ ID NO: 3949805 - RNA, 18 nt, Human herpesvirus 1
uguccuggggauggccau

SEQ ID NO: 3949806 - RNA, 21 nt, Human herpesvirus 1
ugucucgucuccucuucuccc

SEQ ID NO: 3949807 - RNA, 19 nt, Human herpesvirus 1
ugucugccauggagcgcac

SEQ ID NO: 3949808 - RNA, 16 nt, Human herpesvirus 1
uguggacgccggggcc

SEQ ID NO: 3949809 - RNA, 21 nt, Human herpesvirus 1
uguggcgcgaggggggguccg

SEQ ID NO: 3949810 - RNA, 12 nt, Human herpesvirus 1
uguggggacccg

SEQ ID NO: 3949811 - RNA, 12 nt, Human herpesvirus 1
ugugggguccuc

SEQ ID NO: 3949812 - RNA, 17 nt, Human herpesvirus 1
uuaaaaaucgugaguca

SEQ ID NO: 3949813 - RNA, 16 nt, Human herpesvirus 1
uucaccccgaagcccc

SEQ ID NO: 3949814 - RNA, 16 nt, Human herpesvirus 1
uucaucgcgccccucg

SEQ ID NO: 3949815 - RNA, 19 nt, Human herpesvirus 1
uucccccccgaccggcacc

SEQ ID NO: 3949816 - RNA, 21 nt, Human herpesvirus 1
uucccgaaacuucaucacccc

SEQ ID NO: 3949817 - RNA, 11 nt, Human herpesvirus 1
uucccgggccg

SEQ ID NO: 3949818 - RNA, 13 nt, Human herpesvirus 1
uuccgcugagccu

SEQ ID NO: 3949819 - RNA, 11 nt, Human herpesvirus 1
uucgaggaggu

SEQ ID NO: 3949820 - RNA, 21 nt, Human herpesvirus 1
uucgcaccaacaaccuucugc

SEQ ID NO: 3949821 - RNA, 15 nt, Human herpesvirus 1
uucgcuggaccucac

SEQ ID NO: 3949822 - RNA, 15 nt, Human herpesvirus 1
uucggacagacucaa

SEQ ID NO: 3949823 - RNA, 20 nt, Human herpesvirus 1
uucuacgcgcgcgaccucac

SEQ ID NO: 3949824 - RNA, 16 nt, Human herpesvirus 1
uucuccggggcccggc

SEQ ID NO: 3949825 - RNA, 18 nt, Human herpesvirus 1
uucugcgggucaccugcc

SEQ ID NO: 3949826 - RNA, 12 nt, Human herpesvirus 1
uugcacccagcc

SEQ ID NO: 3949827 - RNA, 14 nt, Human herpesvirus 1
uugcacccagccuu

SEQ ID NO: 3949828 - RNA, 11 nt, Human herpesvirus 1
uugcccucuuu

SEQ ID NO: 3949829 - RNA, 23 nt, Human herpesvirus 1
uuggccgucccguuaccaagacc

SEQ ID NO: 3949830 - RNA, 24 nt, Human herpesvirus 1
uugguauagguccacggccacugg

SEQ ID NO: 3949831 - RNA, 20 nt, Human herpesvirus 1
uuguacccuuaauaaauuuu

SEQ ID NO: 3949832 - RNA, 18 nt, Human herpesvirus 1
uuguccccgaacaaacga

SEQ ID NO: 3949833 - RNA, 15 nt, Human herpesvirus 1
uugucgucucucuuc

SEQ ID NO: 3949834 - RNA, 16 nt, Human herpesvirus 1
uuguggacccaaagcc

SEQ ID NO: 3949835 - RNA, 14 nt, Human herpesvirus 1
uuguuccgcuuccc

SEQ ID NO: 3949836 - RNA, 13 nt, Human herpesvirus 1
uuuaaccuccccc

SEQ ID NO: 3949837 - RNA, 20 nt, Human herpesvirus 1
uuuaacuacauuaaauuggg

SEQ ID NO: 3949838 - RNA, 14 nt, Human herpesvirus 1
uuuccgcugagccu

SEQ ID NO: 3949839 - RNA, 22 nt, Human herpesvirus 1
uuucguccaccaaagucucugu

SEQ ID NO: 3949840 - RNA, 16 nt, Human herpesvirus 1
uuucguuccuuccccc

SEQ ID NO: 3949841 - RNA, 18 nt, Human herpesvirus 1
uuugcacccagccuuuaa

SEQ ID NO: 3949842 - RNA, 12 nt, Human herpesvirus 1
uuuguggggagg

SEQ ID NO: 3949843 - RNA, 15 nt, Human herpesvirus 1
gcucggaaacugccu

SEQ ID NO: 3949844 - RNA, 15 nt, Human herpesvirus 1
gcucggcggcagccc

SEQ ID NO: 3949845 - RNA, 21 nt, Human herpesvirus 1
gcucgucagggccggcggcgc

SEQ ID NO: 3949846 - RNA, 15 nt, Human herpesvirus 1
gcucgucgccuggcu

SEQ ID NO: 3949847 - RNA, 15 nt, Human herpesvirus 1
gcugaccgacccucc

SEQ ID NO: 3949848 - RNA, 22 nt, Human herpesvirus 1
gcugagccgcgccgacaucacc

SEQ ID NO: 3949849 - RNA, 23 nt, Human herpesvirus 1
gcugcagaaucacgagcugaccc

SEQ ID NO: 3949850 - RNA, 15 nt, Human herpesvirus 1
gcugcagagcaaccc

SEQ ID NO: 3949851 - RNA, 23 nt, Human herpesvirus 1
gcugccgucgcuagaccacgccc

SEQ ID NO: 3949852 - RNA, 13 nt, Human herpesvirus 1
gcugcggcccacc

SEQ ID NO: 3949853 - RNA, 17 nt, Human herpesvirus 1
gcugcgguugcccccga

SEQ ID NO: 3949854 - RNA, 16 nt, Human herpesvirus 1
gcugcuccgccuggcc

SEQ ID NO: 3949855 - RNA, 18 nt, Human herpesvirus 1
gcuggcacaccaccgacc

SEQ ID NO: 3949856 - RNA, 23 nt, Human herpesvirus 1
gcugggaccccggcggccccugg

SEQ ID NO: 3949857 - RNA, 20 nt, Human herpesvirus 1
gcuggggcccccaggguccg

SEQ ID NO: 3949858 - RNA, 23 nt, Human herpesvirus 1
gcuggucgucgggcgccaaagcc

SEQ ID NO: 3949859 - RNA, 16 nt, Human herpesvirus 1
gcuguagcgccccggc

SEQ ID NO: 3949860 - RNA, 15 nt, Human herpesvirus 1
gcuguuguaggcggu

SEQ ID NO: 3949861 - RNA, 14 nt, Human herpesvirus 1
gcuuccggccuggg

SEQ ID NO: 3949862 - RNA, 23 nt, Human herpesvirus 1
gcuuccggccugggggccguccu

SEQ ID NO: 3949863 - RNA, 16 nt, Human herpesvirus 1
gcuucggccguuucuc

SEQ ID NO: 3949864 - RNA, 14 nt, Human herpesvirus 1
gcuuggagccagcc

SEQ ID NO: 3949865 - RNA, 15 nt, Human herpesvirus 1
gcuuuauacacagau

SEQ ID NO: 3949866 - RNA, 14 nt, Human herpesvirus 1
ggaaagcaagaaca

SEQ ID NO: 3949867 - RNA, 13 nt, Human herpesvirus 1
ggaacaccuccgc

SEQ ID NO: 3949868 - RNA, 12 nt, Human herpesvirus 1
ggaacccagagu

SEQ ID NO: 3949869 - RNA, 13 nt, Human herpesvirus 1
ggaacgaggcccg

SEQ ID NO: 3949870 - RNA, 22 nt, Human herpesvirus 1
ggaacgaggcccgcaagcugaa

SEQ ID NO: 3949871 - RNA, 14 nt, Human herpesvirus 1
ggaaggaacccgcg

SEQ ID NO: 3949872 - RNA, 15 nt, Human herpesvirus 1
ggacagcgaccuggg

SEQ ID NO: 3949873 - RNA, 12 nt, Human herpesvirus 1
ggaccaccgccc

SEQ ID NO: 3949874 - RNA, 19 nt, Human herpesvirus 1
ggacccaagccgccccagc

SEQ ID NO: 3949875 - RNA, 23 nt, Human herpesvirus 1
ggaccccacgacacccaccccaa

SEQ ID NO: 3949876 - RNA, 14 nt, Human herpesvirus 1
ggaccccagcgacc

SEQ ID NO: 3949877 - RNA, 21 nt, Human herpesvirus 1
ggacccgcaucccccgucugg

SEQ ID NO: 3949878 - RNA, 15 nt, Human herpesvirus 1
ggacccgccccggag

SEQ ID NO: 3949879 - RNA, 15 nt, Human herpesvirus 1
ggaccgcagccuggu

SEQ ID NO: 3949880 - RNA, 15 nt, Human herpesvirus 1
ggaccgccucggucc

SEQ ID NO: 3949881 - RNA, 13 nt, Human herpesvirus 1
ggaccgggguccc

SEQ ID NO: 3949882 - RNA, 17 nt, Human herpesvirus 1
ggacgaccugugauggg

SEQ ID NO: 3949883 - RNA, 14 nt, Human herpesvirus 1
ggacggcgccgggg

SEQ ID NO: 3949884 - RNA, 18 nt, Human herpesvirus 1
ggacggcggggcagagcc

SEQ ID NO: 3949885 - RNA, 23 nt, Human herpesvirus 1
ggacuacacggagguccagcgcc

SEQ ID NO: 3949886 - RNA, 14 nt, Human herpesvirus 1
ggacugggcaagcc

SEQ ID NO: 3949887 - RNA, 19 nt, Human herpesvirus 1
ggacugggugccaaagcgc

SEQ ID NO: 3949888 - RNA, 14 nt, Human herpesvirus 1
ggagaacccgacca

SEQ ID NO: 3949889 - RNA, 12 nt, Human herpesvirus 1
ggagagcccaca

SEQ ID NO: 3949890 - RNA, 15 nt, Human herpesvirus 1
ggaggaagaccugcu

SEQ ID NO: 3949891 - RNA, 19 nt, Human herpesvirus 1
ggaggcgccugccccgcca

SEQ ID NO: 3949892 - RNA, 19 nt, Human herpesvirus 1
ggaggcuguaggucuggga

SEQ ID NO: 3949893 - RNA, 21 nt, Human herpesvirus 1
ggaggggcuccuuagcgcggc

SEQ ID NO: 3949894 - RNA, 18 nt, Human herpesvirus 1
ggagggugguuccccccc

SEQ ID NO: 3949895 - RNA, 16 nt, Human herpesvirus 1
ggaggugcccccgcgc

SEQ ID NO: 3949896 - RNA, 19 nt, Human herpesvirus 1
ggagguggggcgggggccc

SEQ ID NO: 3949897 - RNA, 19 nt, Human herpesvirus 1
ggaucaccaaccacccggg

SEQ ID NO: 3949898 - RNA, 20 nt, Human herpesvirus 1
ggaucccaacgaccccgccc

SEQ ID NO: 3949899 - RNA, 23 nt, Human herpesvirus 1
ggaucgccuguugggccuuaucc

SEQ ID NO: 3949900 - RNA, 23 nt, Human herpesvirus 1
ggaugaaaaugaaccagacccua

SEQ ID NO: 3949901 - RNA, 15 nt, Human herpesvirus 1
ggaugccagccaggg

SEQ ID NO: 3949902 - RNA, 14 nt, Human herpesvirus 1
ggauggggagagcc

SEQ ID NO: 3949903 - RNA, 17 nt, Human herpesvirus 1
ggauggggagagcccac

SEQ ID NO: 3949904 - RNA, 19 nt, Human herpesvirus 1
ggauggggagagcccacau

SEQ ID NO: 3949905 - RNA, 15 nt, Human herpesvirus 1
ggaugucgcccgucu

SEQ ID NO: 3949906 - RNA, 14 nt, Human herpesvirus 1
ggauucccgggccg

SEQ ID NO: 3949907 - RNA, 22 nt, Human herpesvirus 1
ggcaagcccuacaccggccacc

SEQ ID NO: 3949908 - RNA, 22 nt, Human herpesvirus 1
ggcacccaaggggccgugcggg

SEQ ID NO: 3949909 - RNA, 17 nt, Human herpesvirus 1
ggcaccgcaccagcgcg

SEQ ID NO: 3949910 - RNA, 18 nt, Human herpesvirus 1
ggcagcaugggacccaca

SEQ ID NO: 3949911 - RNA, 16 nt, Human herpesvirus 1
ggcagcccggaggcgc

SEQ ID NO: 3949912 - RNA, 20 nt, Human herpesvirus 1
ggcauccagggagaaacccc

SEQ ID NO: 3949913 - RNA, 18 nt, Human herpesvirus 1
ggccaaccagcguccgcc

SEQ ID NO: 3949914 - RNA, 14 nt, Human herpesvirus 1
ggccaagcuagccg

SEQ ID NO: 3949915 - RNA, 16 nt, Human herpesvirus 1
ggccaaguacgccgcc

SEQ ID NO: 3949916 - RNA, 19 nt, Human herpesvirus 1
ggccaaguuggcccccgga

SEQ ID NO: 3949917 - RNA, 22 nt, Human herpesvirus 1
ggccacgcaaaaccaggccgac

SEQ ID NO: 3949918 - RNA, 22 nt, Human herpesvirus 1
ggccacggguguggggacccgc

SEQ ID NO: 3949919 - RNA, 16 nt, Human herpesvirus 1
ggccacuggccgggag

SEQ ID NO: 3949920 - RNA, 21 nt, Human herpesvirus 1
ggccacuggccgggagcacca

SEQ ID NO: 3949921 - RNA, 14 nt, Human herpesvirus 1
ggccauggcccgcc

SEQ ID NO: 3949922 - RNA, 16 nt, Human herpesvirus 1
ggccauguugggccgc

SEQ ID NO: 3949923 - RNA, 14 nt, Human herpesvirus 1
ggcccaacagccgc

SEQ ID NO: 3949924 - RNA, 13 nt, Human herpesvirus 1
ggcccaaggcccc

SEQ ID NO: 3949925 - RNA, 17 nt, Human herpesvirus 1
ggcccagcauguccgcc

SEQ ID NO: 3949926 - RNA, 22 nt, Human herpesvirus 1
ggccccauacacgagcacccug

SEQ ID NO: 3949927 - RNA, 23 nt, Human herpesvirus 1
ggccccauacacgagcacccugc

SEQ ID NO: 3949928 - RNA, 14 nt, Human herpesvirus 1
ggccccgacagccc

SEQ ID NO: 3949929 - RNA, 12 nt, Human herpesvirus 1
ggccccgcgucu

SEQ ID NO: 3949930 - RNA, 16 nt, Human herpesvirus 1
ggccccggggagacag

SEQ ID NO: 3949931 - RNA, 13 nt, Human herpesvirus 1
ggccccugggccc

SEQ ID NO: 3949932 - RNA, 14 nt, Human herpesvirus 1
ggcccgaagccugc

SEQ ID NO: 3949933 - RNA, 16 nt, Human herpesvirus 1
ggcccgcaagcugaac

SEQ ID NO: 3949934 - RNA, 14 nt, Human herpesvirus 1
ggcccgccucggag

SEQ ID NO: 3949935 - RNA, 17 nt, Human herpesvirus 1
ggcccgcgggaggccgc

SEQ ID NO: 3949936 - RNA, 16 nt, Human herpesvirus 1
ggcccgcguuuggccu

SEQ ID NO: 3949937 - RNA, 22 nt, Human herpesvirus 1
ggcccggcccauugggcgggag

SEQ ID NO: 3949938 - RNA, 11 nt, Human herpesvirus 1
ggcccggggcc

SEQ ID NO: 3949939 - RNA, 21 nt, Human herpesvirus 1
ggccgccacgcgcggcugguc

SEQ ID NO: 3949940 - RNA, 16 nt, Human herpesvirus 1
ggccgccgacgaccug

SEQ ID NO: 3949941 - RNA, 12 nt, Human herpesvirus 1
ggccgccgcgga

SEQ ID NO: 3949942 - RNA, 19 nt, Human herpesvirus 1
ggccgcgcccacuacacca

SEQ ID NO: 3949943 - RNA, 21 nt, Human herpesvirus 1
ggccgcgguggacagccagga

SEQ ID NO: 3949944 - RNA, 19 nt, Human herpesvirus 1
ggccggauucccgggccgg

SEQ ID NO: 3949945 - RNA, 15 nt, Human herpesvirus 1
ggccggccuggcggc

SEQ ID NO: 3949946 - RNA, 12 nt, Human herpesvirus 1
ggccgggagcgc

SEQ ID NO: 3949947 - RNA, 20 nt, Human herpesvirus 1
ggccggggagggcagggccg

SEQ ID NO: 3949948 - RNA, 21 nt, Human herpesvirus 1
ggccggggagggcagggccgc

SEQ ID NO: 3949949 - RNA, 17 nt, Human herpesvirus 1
ggccgugauuccucucc

SEQ ID NO: 3949950 - RNA, 23 nt, Human herpesvirus 1
ggccgugguccucgaggaggcgg

SEQ ID NO: 3949951 - RNA, 17 nt, Human herpesvirus 1
ggccucccccggacgac

SEQ ID NO: 3949952 - RNA, 19 nt, Human herpesvirus 1
ggccuccgcguacgaggac

SEQ ID NO: 3949953 - RNA, 15 nt, Human herpesvirus 1
ggccucgugggcacu

SEQ ID NO: 3949954 - RNA, 21 nt, Human herpesvirus 1
ggccucucguucuccggggcc

SEQ ID NO: 3949955 - RNA, 18 nt, Human herpesvirus 1
ggccugaacaaacaaacc

SEQ ID NO: 3949956 - RNA, 21 nt, Human herpesvirus 1
ggccuggugcucgugggccuc

SEQ ID NO: 3949957 - RNA, 18 nt, Human herpesvirus 1
ggccuuguuccgcuuccc

SEQ ID NO: 3949958 - RNA, 22 nt, Human herpesvirus 1
ggcgacaacgcgaccgucgccg

SEQ ID NO: 3949959 - RNA, 12 nt, Human herpesvirus 1
ggcgacacaccu

SEQ ID NO: 3949960 - RNA, 13 nt, Human herpesvirus 1
auccacaccgcgg

SEQ ID NO: 3949961 - RNA, 16 nt, Human herpesvirus 1
aucccacguccccggg

SEQ ID NO: 3949962 - RNA, 14 nt, Human herpesvirus 1
auccccaggacacc

SEQ ID NO: 3949963 - RNA, 18 nt, Human herpesvirus 1
auccccccgucagccugc

SEQ ID NO: 3949964 - RNA, 15 nt, Human herpesvirus 1
aucccccgcgcggcu

SEQ ID NO: 3949965 - RNA, 16 nt, Human herpesvirus 1
aucccccggccacccc

SEQ ID NO: 3949966 - RNA, 13 nt, Human herpesvirus 1
auccgacaugucc

SEQ ID NO: 3949967 - RNA, 24 nt, Human herpesvirus 1
auccgggaagacgaccagccgucc

SEQ ID NO: 3949968 - RNA, 15 nt, Human herpesvirus 1
auccgucgggaggcc

SEQ ID NO: 3949969 - RNA, 20 nt, Human herpesvirus 1
auccguggccccggccccca

SEQ ID NO: 3949970 - RNA, 15 nt, Human herpesvirus 1
auccuggagcaccga

SEQ ID NO: 3949971 - RNA, 16 nt, Human herpesvirus 1
aucgcaucuuuccugu

SEQ ID NO: 3949972 - RNA, 22 nt, Human herpesvirus 1
aucgccggguggcacgggccca

SEQ ID NO: 3949973 - RNA, 17 nt, Human herpesvirus 1
aucgccgguuccucccg

SEQ ID NO: 3949974 - RNA, 19 nt, Human herpesvirus 1
aucgcgaccaccccaaaua

SEQ ID NO: 3949975 - RNA, 18 nt, Human herpesvirus 1
aucgcucgaccucuccac

SEQ ID NO: 3949976 - RNA, 20 nt, Human herpesvirus 1
aucgguccccucugggcccg

SEQ ID NO: 3949977 - RNA, 14 nt, Human herpesvirus 1
aucguccaccuccg

SEQ ID NO: 3949978 - RNA, 16 nt, Human herpesvirus 1
aucgucgccugccccc

SEQ ID NO: 3949979 - RNA, 19 nt, Human herpesvirus 1
aucgugagucacagcgacc

SEQ ID NO: 3949980 - RNA, 13 nt, Human herpesvirus 1
aucuccggacccc

SEQ ID NO: 3949981 - RNA, 22 nt, Human herpesvirus 1
aucuccugggggcacccacgcc

SEQ ID NO: 3949982 - RNA, 12 nt, Human herpesvirus 1
aucuugucccca

SEQ ID NO: 3949983 - RNA, 19 nt, Human herpesvirus 1
aucuuugaggaccgcgccc

SEQ ID NO: 3949984 - RNA, 22 nt, Human herpesvirus 1
augaagccacuguuuuccgccc

SEQ ID NO: 3949985 - RNA, 12 nt, Human herpesvirus 1
augagccagacc

SEQ ID NO: 3949986 - RNA, 17 nt, Human herpesvirus 1
augaguacgaggaucug

SEQ ID NO: 3949987 - RNA, 19 nt, Human herpesvirus 1
augauccucaucgagggca

SEQ ID NO: 3949988 - RNA, 13 nt, Human herpesvirus 1
augcacgcccccg

SEQ ID NO: 3949989 - RNA, 17 nt, Human herpesvirus 1
augcccacgggucgugc

SEQ ID NO: 3949990 - RNA, 13 nt, Human herpesvirus 1
augccgugccgcc

SEQ ID NO: 3949991 - RNA, 15 nt, Human herpesvirus 1
augccgugccgcccg

SEQ ID NO: 3949992 - RNA, 20 nt, Human herpesvirus 1
auggcacaccgguccccgga

SEQ ID NO: 3949993 - RNA, 23 nt, Human herpesvirus 1
auggcacgaguucaaccucgggu

SEQ ID NO: 3949994 - RNA, 21 nt, Human herpesvirus 1
auggcccaguguacccuggcg

SEQ ID NO: 3949995 - RNA, 13 nt, Human herpesvirus 1
auggcgacacacc

SEQ ID NO: 3949996 - RNA, 13 nt, Human herpesvirus 1
auggggagagccc

SEQ ID NO: 3949997 - RNA, 21 nt, Human herpesvirus 1
auggguugugguuauaugcac

SEQ ID NO: 3949998 - RNA, 13 nt, Human herpesvirus 1
auguccccaaaau

SEQ ID NO: 3949999 - RNA, 16 nt, Human herpesvirus 1
auguccccaaaauaaa

SEQ ID NO: 3950000 - RNA, 22 nt, Human herpesvirus 1
auguguguaaaauaaauuauug

SEQ ID NO: 3950001 - RNA, 17 nt, Human herpesvirus 1
auguuugcgggccuggg

SEQ ID NO: 3950002 - RNA, 11 nt, Human herpesvirus 1
auuaaagacaa

SEQ ID NO: 3950003 - RNA, 18 nt, Human herpesvirus 1
auuccgcggccccagccc

SEQ ID NO: 3950004 - RNA, 15 nt, Human herpesvirus 1
auucgcuggaccuca

SEQ ID NO: 3950005 - RNA, 19 nt, Human herpesvirus 1
auucucccgaaccaggccg

SEQ ID NO: 3950006 - RNA, 20 nt, Human herpesvirus 1
auucucgucuguccucggga

SEQ ID NO: 3950007 - RNA, 12 nt, Human herpesvirus 1
auugggcgggag

SEQ ID NO: 3950008 - RNA, 15 nt, Human herpesvirus 1
caaaauaaaagacca

SEQ ID NO: 3950009 - RNA, 17 nt, Human herpesvirus 1
caaaauaaaagaccaaa

SEQ ID NO: 3950010 - RNA, 12 nt, Human herpesvirus 1
caaagcugcugg

SEQ ID NO: 3950011 - RNA, 13 nt, Human herpesvirus 1
caaauaaagccac

SEQ ID NO: 3950012 - RNA, 17 nt, Human herpesvirus 1
caaaucccggcgccggu

SEQ ID NO: 3950013 - RNA, 11 nt, Human herpesvirus 1
caacaaacccc

SEQ ID NO: 3950014 - RNA, 13 nt, Human herpesvirus 1
caacagggguuca

SEQ ID NO: 3950015 - RNA, 17 nt, Human herpesvirus 1
caaccccggucucccag

SEQ ID NO: 3950016 - RNA, 23 nt, Human herpesvirus 1
caaccccuuuggggcgcuggccg

SEQ ID NO: 3950017 - RNA, 17 nt, Human herpesvirus 1
caaccugauccgcggcg

SEQ ID NO: 3950018 - RNA, 13 nt, Human herpesvirus 1
caacgaccccgcc

SEQ ID NO: 3950019 - RNA, 14 nt, Human herpesvirus 1
caacgcacuguggc

SEQ ID NO: 3950020 - RNA, 19 nt, Human herpesvirus 1
caacgccaucgccucggcc

SEQ ID NO: 3950021 - RNA, 12 nt, Human herpesvirus 1
caacgcgacgca

SEQ ID NO: 3950022 - RNA, 12 nt, Human herpesvirus 1
caacgggggacc

SEQ ID NO: 3950023 - RNA, 14 nt, Human herpesvirus 1
caacgucgccgccc

SEQ ID NO: 3950024 - RNA, 14 nt, Human herpesvirus 1
caacgucuccucca

SEQ ID NO: 3950025 - RNA, 21 nt, Human herpesvirus 1
caacgucuccuccaccaccca

SEQ ID NO: 3950026 - RNA, 21 nt, Human herpesvirus 1
caacucucgcaccaucccggg

SEQ ID NO: 3950027 - RNA, 23 nt, Human herpesvirus 1
caacucucgcaccaucccggguu

SEQ ID NO: 3950028 - RNA, 16 nt, Human herpesvirus 1
caacugacgcuggccg

SEQ ID NO: 3950029 - RNA, 14 nt, Human herpesvirus 1
caagaacaauaaag

SEQ ID NO: 3950030 - RNA, 14 nt, Human herpesvirus 1
caagaccaccuccu

SEQ ID NO: 3950031 - RNA, 21 nt, Human herpesvirus 1
caagagacgucgccccugugg

SEQ ID NO: 3950032 - RNA, 14 nt, Human herpesvirus 1
caagagcgcucccc

SEQ ID NO: 3950033 - RNA, 19 nt, Human herpesvirus 1
caagaucuuucggugucua

SEQ ID NO: 3950034 - RNA, 19 nt, Human herpesvirus 1
caagcuaugcagccccgug

SEQ ID NO: 3950035 - RNA, 18 nt, Human herpesvirus 1
caaggacagcggccugcu

SEQ ID NO: 3950036 - RNA, 19 nt, Human herpesvirus 1
caaggacgcccgcgacgcc

SEQ ID NO: 3950037 - RNA, 15 nt, Human herpesvirus 1
caaggagcgccggcg

SEQ ID NO: 3950038 - RNA, 17 nt, Human herpesvirus 1
caaguacgccgccaccg

SEQ ID NO: 3950039 - RNA, 12 nt, Human herpesvirus 1
caauccccagga

SEQ ID NO: 3950040 - RNA, 19 nt, Human herpesvirus 1
caauccgugucggggaggg

SEQ ID NO: 3950041 - RNA, 16 nt, Human herpesvirus 1
cacaacacaaacaucu

SEQ ID NO: 3950042 - RNA, 15 nt, Human herpesvirus 1
cacaacgccagccug

SEQ ID NO: 3950043 - RNA, 21 nt, Human herpesvirus 1
cacaacggcaugccucugcgg

SEQ ID NO: 3950044 - RNA, 10 nt, Human herpesvirus 1
cacacacccu

SEQ ID NO: 3950045 - RNA, 17 nt, Human herpesvirus 1
cacacacgggggagcgc

SEQ ID NO: 3950046 - RNA, 16 nt, Human herpesvirus 1
cacacagcccucccga

SEQ ID NO: 3950047 - RNA, 16 nt, Human herpesvirus 1
cacaccacgccacaac

SEQ ID NO: 3950048 - RNA, 21 nt, Human herpesvirus 1
cacaccaucucccccgugucc

SEQ ID NO: 3950049 - RNA, 18 nt, Human herpesvirus 1
cacauaaauuuggcuggu

SEQ ID NO: 3950050 - RNA, 15 nt, Human herpesvirus 1
caccaaggcccgggc

SEQ ID NO: 3950051 - RNA, 16 nt, Human herpesvirus 1
caccacacaccagcgg

SEQ ID NO: 3950052 - RNA, 21 nt, Human herpesvirus 1
caccacauaaccgaccgcagu

SEQ ID NO: 3950053 - RNA, 14 nt, Human herpesvirus 1
caccaucucccccg

SEQ ID NO: 3950054 - RNA, 22 nt, Human herpesvirus 1
cacccacgccgccucggcccgc

SEQ ID NO: 3950055 - RNA, 18 nt, Human herpesvirus 1
caccccccgacgccagcu

SEQ ID NO: 3950056 - RNA, 20 nt, Human herpesvirus 1
cacccccgaguucccccggg

SEQ ID NO: 3950057 - RNA, 18 nt, Human herpesvirus 1
cacccggagguuccggag

SEQ ID NO: 3950058 - RNA, 13 nt, Human herpesvirus 1
cacccuaccccag

SEQ ID NO: 3950059 - RNA, 14 nt, Human herpesvirus 1
cacccugcugcagg

SEQ ID NO: 3950060 - RNA, 13 nt, Human herpesvirus 1
caccgcccacaga

SEQ ID NO: 3950061 - RNA, 18 nt, Human herpesvirus 1
caccgccccccuguuccc

SEQ ID NO: 3950062 - RNA, 12 nt, Human herpesvirus 1
caccgcugggcg

SEQ ID NO: 3950063 - RNA, 23 nt, Human herpesvirus 1
caccggguacggcgucugggcca

SEQ ID NO: 3950064 - RNA, 23 nt, Human herpesvirus 1
caccgguuuccgcgacccaccgg

SEQ ID NO: 3950065 - RNA, 21 nt, Human herpesvirus 1
caccgucggaggccccccaga

SEQ ID NO: 3950066 - RNA, 17 nt, Human herpesvirus 1
caccuacuacgaugggg

SEQ ID NO: 3950067 - RNA, 21 nt, Human herpesvirus 1
caccucgaggacacccgcgca

SEQ ID NO: 3950068 - RNA, 21 nt, Human herpesvirus 1
caccucgcccacccacuccuc

SEQ ID NO: 3950069 - RNA, 15 nt, Human herpesvirus 1
caccugcgcucccuc

SEQ ID NO: 3950070 - RNA, 13 nt, Human herpesvirus 1
caccuuggcccug

SEQ ID NO: 3950071 - RNA, 16 nt, Human herpesvirus 1
cacgacaaccccgguc

SEQ ID NO: 3950072 - RNA, 22 nt, Human herpesvirus 1
cacgacaaccccggucucccag

SEQ ID NO: 3950073 - RNA, 18 nt, Human herpesvirus 1
cacgagcgcgcugcucag

SEQ ID NO: 3950074 - RNA, 23 nt, Human herpesvirus 1
cacgagcgcgcugcucagcgcca

SEQ ID NO: 3950075 - RNA, 22 nt, Human herpesvirus 1
cacgaggcaguuaacugucugg

SEQ ID NO: 3950076 - RNA, 22 nt, Human herpesvirus 1
cacgcacuugcggcaagacccg

SEQ ID NO: 3950077 - RNA, 14 nt, Human herpesvirus 1
cacgcaucgacgug

SEQ ID NO: 3950078 - RNA, 17 nt, Human herpesvirus 1
cacgcccccgccgcccg

SEQ ID NO: 3950079 - RNA, 12 nt, Human herpesvirus 1
cacgccgccucg

SEQ ID NO: 3950080 - RNA, 19 nt, Human herpesvirus 1
cacgcucuccccugcugcc

SEQ ID NO: 3950081 - RNA, 19 nt, Human herpesvirus 1
cacggagggaaccaccauc

SEQ ID NO: 3950082 - RNA, 20 nt, Human herpesvirus 1
cacggcaaggagcgccggcg

SEQ ID NO: 3950083 - RNA, 18 nt, Human herpesvirus 1
cacggccacuggccggga

SEQ ID NO: 3950084 - RNA, 23 nt, Human herpesvirus 1
cacggcgaaugcagcgccggccu

SEQ ID NO: 3950085 - RNA, 15 nt, Human herpesvirus 1
cacggcuaccuggcc

SEQ ID NO: 3950086 - RNA, 19 nt, Human herpesvirus 1
cacggcuaccuggccccag

SEQ ID NO: 3950087 - RNA, 16 nt, Human herpesvirus 1
cacggguggccgggcg

SEQ ID NO: 3950088 - RNA, 14 nt, Human herpesvirus 1
cacgguaggcccag

SEQ ID NO: 3950089 - RNA, 23 nt, Human herpesvirus 1
cacgguggugcaguucgagcagc

SEQ ID NO: 3950090 - RNA, 21 nt, Human herpesvirus 1
cacguacacggguggccgggc

SEQ ID NO: 3950091 - RNA, 17 nt, Human herpesvirus 1
cacgugcugcugcggcc

SEQ ID NO: 3950092 - RNA, 22 nt, Human herpesvirus 1
cacguugggguuguugcuggcg

SEQ ID NO: 3950093 - RNA, 18 nt, Human herpesvirus 1
cacguuuaccccgcagcc

SEQ ID NO: 3950094 - RNA, 19 nt, Human herpesvirus 1
cacucaaaaagccccaaag

SEQ ID NO: 3950095 - RNA, 20 nt, Human herpesvirus 1
cacucccgucucgcugcccu

SEQ ID NO: 3950096 - RNA, 17 nt, Human herpesvirus 1
cacugcacucccugccg

SEQ ID NO: 3950097 - RNA, 22 nt, Human herpesvirus 1
cagaccccuucuccccacaaca

SEQ ID NO: 3950098 - RNA, 17 nt, Human herpesvirus 1
cagacgagcgcgcuugu

SEQ ID NO: 3950099 - RNA, 18 nt, Human herpesvirus 1
cagacgagcgcgcuuguc

SEQ ID NO: 3950100 - RNA, 21 nt, Human herpesvirus 1
cagacgcccuccgaggagauc

SEQ ID NO: 3950101 - RNA, 23 nt, Human herpesvirus 1
cagacgcugcuccgccuggccug

SEQ ID NO: 3950102 - RNA, 20 nt, Human herpesvirus 1
cagacucaagcacacacggg

SEQ ID NO: 3950103 - RNA, 14 nt, Human herpesvirus 1
cagagccgcccguc

SEQ ID NO: 3950104 - RNA, 17 nt, Human herpesvirus 1
cagaggcgcgcgcaccu

SEQ ID NO: 3950105 - RNA, 18 nt, Human herpesvirus 1
cagagguguucacgcacc

SEQ ID NO: 3950106 - RNA, 15 nt, Human herpesvirus 1
cagaucggcgccgcg

SEQ ID NO: 3950107 - RNA, 23 nt, Human herpesvirus 1
cagcaccgacaccgcacugcggc

SEQ ID NO: 3950108 - RNA, 19 nt, Human herpesvirus 1
cagcaccguuaccaccgau

SEQ ID NO: 3950109 - RNA, 23 nt, Human herpesvirus 1
cagcagacgcugcuccgccuggc

SEQ ID NO: 3950110 - RNA, 21 nt, Human herpesvirus 1
cagccaauccgugucggggag

SEQ ID NO: 3950111 - RNA, 15 nt, Human herpesvirus 1
cagccccccagccuc

SEQ ID NO: 3950112 - RNA, 17 nt, Human herpesvirus 1
cagccccccagccuccc

SEQ ID NO: 3950113 - RNA, 17 nt, Human herpesvirus 1
cagcccccccaagcgcc

SEQ ID NO: 3950114 - RNA, 22 nt, Human herpesvirus 1
cagccccgcauaucccacccug

SEQ ID NO: 3950115 - RNA, 21 nt, Human herpesvirus 1
cagccucgucccgcccguguu

SEQ ID NO: 3950116 - RNA, 21 nt, Human herpesvirus 1
cagccugccucuccccccagg

SEQ ID NO: 3950117 - RNA, 17 nt, Human herpesvirus 1
cagccuggucgaggcgg

SEQ ID NO: 3950118 - RNA, 19 nt, Human herpesvirus 1
cagccuguuuguccugggg

SEQ ID NO: 3950119 - RNA, 15 nt, Human herpesvirus 1
cagccuucucccggu

SEQ ID NO: 3950120 - RNA, 19 nt, Human herpesvirus 1
cagcgacguccugggccac

SEQ ID NO: 3950121 - RNA, 16 nt, Human herpesvirus 1
cagcgccgcaaccagc

SEQ ID NO: 3950122 - RNA, 19 nt, Human herpesvirus 1
cagcguauccacccccgcc

SEQ ID NO: 3950123 - RNA, 19 nt, Human herpesvirus 1
cagcuuuuaccgcuuccuc

SEQ ID NO: 3950124 - RNA, 20 nt, Human herpesvirus 1
caggaaauccguggccccgg

SEQ ID NO: 3950125 - RNA, 13 nt, Human herpesvirus 1
caggccccccgcc

SEQ ID NO: 3950126 - RNA, 13 nt, Human herpesvirus 1
caggccuccaccc

SEQ ID NO: 3950127 - RNA, 22 nt, Human herpesvirus 1
caggcgcugucuccccggggcc

SEQ ID NO: 3950128 - RNA, 21 nt, Human herpesvirus 1
caggcugucgacgcccccucc

SEQ ID NO: 3950129 - RNA, 12 nt, Human herpesvirus 1
cagggaccuccu

SEQ ID NO: 3950130 - RNA, 15 nt, Human herpesvirus 1
cagggaccuccugga

SEQ ID NO: 3950131 - RNA, 22 nt, Human herpesvirus 1
cagggauccacgacaaccccgg

SEQ ID NO: 3950132 - RNA, 23 nt, Human herpesvirus 1
cagggccggcggcgcuccucgcc

SEQ ID NO: 3950133 - RNA, 16 nt, Human herpesvirus 1
cagggccucgcugacc

SEQ ID NO: 3950134 - RNA, 13 nt, Human herpesvirus 1
cagggcgggccgc

SEQ ID NO: 3950135 - RNA, 21 nt, Human herpesvirus 1
cagggcuacgugcucgacagc

SEQ ID NO: 3950136 - RNA, 18 nt, Human herpesvirus 1
cagggcucuacccucugg

SEQ ID NO: 3950137 - RNA, 17 nt, Human herpesvirus 1
caggguaccgcgugacc

SEQ ID NO: 3950138 - RNA, 19 nt, Human herpesvirus 1
caguaacaugcgcacguga

SEQ ID NO: 3950139 - RNA, 14 nt, Human herpesvirus 1
caguaccgccaggg

SEQ ID NO: 3950140 - RNA, 21 nt, Human herpesvirus 1
cagucaaacgaccucaucagc

SEQ ID NO: 3950141 - RNA, 21 nt, Human herpesvirus 1
cagucgcccgaagacaccccc

SEQ ID NO: 3950142 - RNA, 19 nt, Human herpesvirus 1
cagucuccuggcagcccug

SEQ ID NO: 3950143 - RNA, 16 nt, Human herpesvirus 1
cagucuucggcgguga

SEQ ID NO: 3950144 - RNA, 12 nt, Human herpesvirus 1
caguggcuccgg

SEQ ID NO: 3950145 - RNA, 15 nt, Human herpesvirus 1
cauaaccgaccgcag

SEQ ID NO: 3950146 - RNA, 14 nt, Human herpesvirus 1
cauaccgaccacac

SEQ ID NO: 3950147 - RNA, 14 nt, Human herpesvirus 1
cauagcccuggugu

SEQ ID NO: 3950148 - RNA, 18 nt, Human herpesvirus 1
cauaucgcuucccgaccu

SEQ ID NO: 3950149 - RNA, 23 nt, Human herpesvirus 1
caucaaggcggagaacaccgaug

SEQ ID NO: 3950150 - RNA, 17 nt, Human herpesvirus 1
caucagcucgcggcccg

SEQ ID NO: 3950151 - RNA, 20 nt, Human herpesvirus 1
caucagcuguggacccgagc

SEQ ID NO: 3950152 - RNA, 22 nt, Human herpesvirus 1
caucagcuguggacccgagcuc

SEQ ID NO: 3950153 - RNA, 22 nt, Human herpesvirus 1
caucccacaaacacaaaacaca

SEQ ID NO: 3950154 - RNA, 17 nt, Human herpesvirus 1
caucccaggaucacacc

SEQ ID NO: 3950155 - RNA, 17 nt, Human herpesvirus 1
caucccccgucuggguu

SEQ ID NO: 3950156 - RNA, 20 nt, Human herpesvirus 1
cauccgaacgcagccccgcu

SEQ ID NO: 3950157 - RNA, 17 nt, Human herpesvirus 1
cauccugcggcucgugg

SEQ ID NO: 3950158 - RNA, 20 nt, Human herpesvirus 1
caucgacacgcgcguccuuc

SEQ ID NO: 3950159 - RNA, 21 nt, Human herpesvirus 1
caucgacacgcgcguccuucu

SEQ ID NO: 3950160 - RNA, 19 nt, Human herpesvirus 1
caucgccucggccaccgug

SEQ ID NO: 3950161 - RNA, 16 nt, Human herpesvirus 1
caucggcaaggacgcc

SEQ ID NO: 3950162 - RNA, 20 nt, Human herpesvirus 1
caucggcaaggacgcccgcg

SEQ ID NO: 3950163 - RNA, 20 nt, Human herpesvirus 1
caucgguguguccuuuuggg

SEQ ID NO: 3950164 - RNA, 19 nt, Human herpesvirus 1
caucugaagccguccgacc

SEQ ID NO: 3950165 - RNA, 14 nt, Human herpesvirus 1
caugacccagaccg

SEQ ID NO: 3950166 - RNA, 22 nt, Human herpesvirus 1
caugcgggcucggcuccccgcc

SEQ ID NO: 3950167 - RNA, 24 nt, Human herpesvirus 1
cauggaccccagcgaccccacggc

SEQ ID NO: 3950168 - RNA, 12 nt, Human herpesvirus 1
cauggccaugac

SEQ ID NO: 3950169 - RNA, 15 nt, Human herpesvirus 1
cauggcgggacuggg

SEQ ID NO: 3950170 - RNA, 17 nt, Human herpesvirus 1
cauggugaucgccuguc

SEQ ID NO: 3950171 - RNA, 14 nt, Human herpesvirus 1
cauggugccgaccg

SEQ ID NO: 3950172 - RNA, 21 nt, Human herpesvirus 1
cauuuauugacccaaaacaca

SEQ ID NO: 3950173 - RNA, 18 nt, Human herpesvirus 1
ccaaaauaaaagaccaaa

SEQ ID NO: 3950174 - RNA, 21 nt, Human herpesvirus 1
ccaaacccaccgacacaugca

SEQ ID NO: 3950175 - RNA, 15 nt, Human herpesvirus 1
ccaaacucccgacac

SEQ ID NO: 3950176 - RNA, 20 nt, Human herpesvirus 1
ccaaacucccgacaccacca

SEQ ID NO: 3950177 - RNA, 19 nt, Human herpesvirus 1
ccaaauaaagccacugaaa

SEQ ID NO: 3950178 - RNA, 23 nt, Human herpesvirus 1
ccaacaacucccccgcgcgcccc

SEQ ID NO: 3950179 - RNA, 20 nt, Human herpesvirus 1
ccaacaauccccaggacacc

SEQ ID NO: 3950180 - RNA, 19 nt, Human herpesvirus 1
ccaacgaccccgcccaugg

SEQ ID NO: 3950181 - RNA, 15 nt, Human herpesvirus 1
ccaacgcguccgugg

SEQ ID NO: 3950182 - RNA, 13 nt, Human herpesvirus 1
gccuccacccccu

SEQ ID NO: 3950183 - RNA, 16 nt, Human herpesvirus 1
gccuccacccccucga

SEQ ID NO: 3950184 - RNA, 12 nt, Human herpesvirus 1
gccucccgauca

SEQ ID NO: 3950185 - RNA, 19 nt, Human herpesvirus 1
gccuccgcccgugcugccg

SEQ ID NO: 3950186 - RNA, 23 nt, Human herpesvirus 1
gccucggcccgcgaacggcacgc

SEQ ID NO: 3950187 - RNA, 23 nt, Human herpesvirus 1
gccucucacacagcaucccccgc

SEQ ID NO: 3950188 - RNA, 17 nt, Human herpesvirus 1
gccugccaaccugaucc

SEQ ID NO: 3950189 - RNA, 18 nt, Human herpesvirus 1
gccugccucuccccccag

SEQ ID NO: 3950190 - RNA, 22 nt, Human herpesvirus 1
gccugggaucccacguccccgg

SEQ ID NO: 3950191 - RNA, 18 nt, Human herpesvirus 1
gccuggucccccggggac

SEQ ID NO: 3950192 - RNA, 20 nt, Human herpesvirus 1
gccuguuguggcucggggcg

SEQ ID NO: 3950193 - RNA, 14 nt, Human herpesvirus 1
gcgaaugcagcgcc

SEQ ID NO: 3950194 - RNA, 19 nt, Human herpesvirus 1
gcgaccuggggcgcgcggu

SEQ ID NO: 3950195 - RNA, 13 nt, Human herpesvirus 1
gcgacgggcagug

SEQ ID NO: 3950196 - RNA, 15 nt, Human herpesvirus 1
gcgacgggcagugag

SEQ ID NO: 3950197 - RNA, 16 nt, Human herpesvirus 1
gcgacguccugggcca

SEQ ID NO: 3950198 - RNA, 18 nt, Human herpesvirus 1
gcgacguccugggccacc

SEQ ID NO: 3950199 - RNA, 14 nt, Human herpesvirus 1
gcgagcccagaccc

SEQ ID NO: 3950200 - RNA, 18 nt, Human herpesvirus 1
gcgagcucccagagaccc

SEQ ID NO: 3950201 - RNA, 13 nt, Human herpesvirus 1
gcgaggugcgcca

SEQ ID NO: 3950202 - RNA, 18 nt, Human herpesvirus 1
gcgagguggagcugcccg

SEQ ID NO: 3950203 - RNA, 14 nt, Human herpesvirus 1
gcgcaccuggugau

SEQ ID NO: 3950204 - RNA, 17 nt, Human herpesvirus 1
gcgcagaggcggccaga

SEQ ID NO: 3950205 - RNA, 16 nt, Human herpesvirus 1
gcgcagguggugcaug

SEQ ID NO: 3950206 - RNA, 14 nt, Human herpesvirus 1
gcgcauccccccgu

SEQ ID NO: 3950207 - RNA, 20 nt, Human herpesvirus 1
gcgcauccgucgggaggcca

SEQ ID NO: 3950208 - RNA, 22 nt, Human herpesvirus 1
gcgcauccgucgggaggccaca

SEQ ID NO: 3950209 - RNA, 22 nt, Human herpesvirus 1
gcgccaacgcguccguggagcg

SEQ ID NO: 3950210 - RNA, 14 nt, Human herpesvirus 1
gcgccacacucacc

SEQ ID NO: 3950211 - RNA, 21 nt, Human herpesvirus 1
gcgccacgguggugcaguucg

SEQ ID NO: 3950212 - RNA, 15 nt, Human herpesvirus 1
gcgccaucuggaccg

SEQ ID NO: 3950213 - RNA, 18 nt, Human herpesvirus 1
gcgcccacuacaccagcc

SEQ ID NO: 3950214 - RNA, 19 nt, Human herpesvirus 1
gcgcccacuacaccagcca

SEQ ID NO: 3950215 - RNA, 18 nt, Human herpesvirus 1
gcgccccgccgccccaca

SEQ ID NO: 3950216 - RNA, 14 nt, Human herpesvirus 1
gcgcccuccugacc

SEQ ID NO: 3950217 - RNA, 13 nt, Human herpesvirus 1
gcgccgacggaca

SEQ ID NO: 3950218 - RNA, 19 nt, Human herpesvirus 1
gcgccgcaaccagcugcac

SEQ ID NO: 3950219 - RNA, 20 nt, Human herpesvirus 1
gcgccgcugcccgacccggc

SEQ ID NO: 3950220 - RNA, 21 nt, Human herpesvirus 1
gcgccgucuuucuccccaacg

SEQ ID NO: 3950221 - RNA, 21 nt, Human herpesvirus 1
gcgccuagccaaccuguggca

SEQ ID NO: 3950222 - RNA, 21 nt, Human herpesvirus 1
gcgccugccccgccacccagu

SEQ ID NO: 3950223 - RNA, 23 nt, Human herpesvirus 1
gcgccuggcgucuccucuggggg

SEQ ID NO: 3950224 - RNA, 17 nt, Human herpesvirus 1
gcgcgaaaucguggcgc

SEQ ID NO: 3950225 - RNA, 16 nt, Human herpesvirus 1
gcgcgaauugacccua

SEQ ID NO: 3950226 - RNA, 17 nt, Human herpesvirus 1
gcgcgaccucaccacca

SEQ ID NO: 3950227 - RNA, 14 nt, Human herpesvirus 1
gcgcgaucccccgc

SEQ ID NO: 3950228 - RNA, 22 nt, Human herpesvirus 1
gcgcgauccgacauguccgugc

SEQ ID NO: 3950229 - RNA, 15 nt, Human herpesvirus 1
gcgcgccugccgcag

SEQ ID NO: 3950230 - RNA, 17 nt, Human herpesvirus 1
gcgcgcgucgacgucgc

SEQ ID NO: 3950231 - RNA, 17 nt, Human herpesvirus 1
gcgcgcuuguccccgaa

SEQ ID NO: 3950232 - RNA, 14 nt, Human herpesvirus 1
gcgcgggggcgccg

SEQ ID NO: 3950233 - RNA, 19 nt, Human herpesvirus 1
gcgcgggguuacgcgggcc

SEQ ID NO: 3950234 - RNA, 17 nt, Human herpesvirus 1
gcgcguccuucuugucg

SEQ ID NO: 3950235 - RNA, 20 nt, Human herpesvirus 1
gcgcuaagugcccaggacgg

SEQ ID NO: 3950236 - RNA, 14 nt, Human herpesvirus 1
gcgcuaugacggca

SEQ ID NO: 3950237 - RNA, 19 nt, Human herpesvirus 1
gcgcucaaccaccgcuccc

SEQ ID NO: 3950238 - RNA, 13 nt, Human herpesvirus 1
gcgcuccucugcg

SEQ ID NO: 3950239 - RNA, 12 nt, Human herpesvirus 1
gcgcuccugaug

SEQ ID NO: 3950240 - RNA, 18 nt, Human herpesvirus 1
gcgcuucauagucgccga

SEQ ID NO: 3950241 - RNA, 18 nt, Human herpesvirus 1
gcggaaagcaagaacaau

SEQ ID NO: 3950242 - RNA, 14 nt, Human herpesvirus 1
gcggagggcggcca

SEQ ID NO: 3950243 - RNA, 22 nt, Human herpesvirus 1
gcggcaaagaccuuccgguccu

SEQ ID NO: 3950244 - RNA, 16 nt, Human herpesvirus 1
gcggcagucuccuggc

SEQ ID NO: 3950245 - RNA, 17 nt, Human herpesvirus 1
gcggccaacgacuuccu

SEQ ID NO: 3950246 - RNA, 17 nt, Human herpesvirus 1
gcggccacacagccggc

SEQ ID NO: 3950247 - RNA, 21 nt, Human herpesvirus 1
gcggccagaucuacugcuggg

SEQ ID NO: 3950248 - RNA, 19 nt, Human herpesvirus 1
gcggccaguugagccgcgc

SEQ ID NO: 3950249 - RNA, 19 nt, Human herpesvirus 1
gcggcccacccuggcgcca

SEQ ID NO: 3950250 - RNA, 13 nt, Human herpesvirus 1
gcggcccccgcga

SEQ ID NO: 3950251 - RNA, 20 nt, Human herpesvirus 1
gcggccccggccgcccuucc

SEQ ID NO: 3950252 - RNA, 20 nt, Human herpesvirus 1
gcggccccugauggagccug

SEQ ID NO: 3950253 - RNA, 13 nt, Human herpesvirus 1
gcggccccuggcg

SEQ ID NO: 3950254 - RNA, 13 nt, Human herpesvirus 1
gcggccgugggcg

SEQ ID NO: 3950255 - RNA, 14 nt, Human herpesvirus 1
gcggcgcgagcucc

SEQ ID NO: 3950256 - RNA, 17 nt, Human herpesvirus 1
gcggcucaacgagcucc

SEQ ID NO: 3950257 - RNA, 21 nt, Human herpesvirus 1
gcggcucaacgagcuccuggc

SEQ ID NO: 3950258 - RNA, 23 nt, Human herpesvirus 1
gcgggaacaccuccgcgagcaga

SEQ ID NO: 3950259 - RNA, 20 nt, Human herpesvirus 1
gcgggacccgacaggcgacc

SEQ ID NO: 3950260 - RNA, 15 nt, Human herpesvirus 1
gcgggauccucggcc

SEQ ID NO: 3950261 - RNA, 19 nt, Human herpesvirus 1
gcgggccaacuaggagaca

SEQ ID NO: 3950262 - RNA, 19 nt, Human herpesvirus 1
gcgggccucgugggcacuu

SEQ ID NO: 3950263 - RNA, 16 nt, Human herpesvirus 1
gcgggcgacgcacaca

SEQ ID NO: 3950264 - RNA, 20 nt, Human herpesvirus 1
gcggggcggggaaugugugu

SEQ ID NO: 3950265 - RNA, 23 nt, Human herpesvirus 1
gcgggggauggggagagcccaca

SEQ ID NO: 3950266 - RNA, 13 nt, Human herpesvirus 1
gcgggggcgccgg

SEQ ID NO: 3950267 - RNA, 13 nt, Human herpesvirus 1
gcggggggugggu

SEQ ID NO: 3950268 - RNA, 19 nt, Human herpesvirus 1
gcgggguuacgcgggcccc

SEQ ID NO: 3950269 - RNA, 19 nt, Human herpesvirus 1
gcgggguuauaggccacgc

SEQ ID NO: 3950270 - RNA, 14 nt, Human herpesvirus 1
gcggguccagaggg

SEQ ID NO: 3950271 - RNA, 15 nt, Human herpesvirus 1
gcgguccugacggcc

SEQ ID NO: 3950272 - RNA, 16 nt, Human herpesvirus 1
gcgguccugacggcca

SEQ ID NO: 3950273 - RNA, 19 nt, Human herpesvirus 1
gcggugaacgaagcggcca

SEQ ID NO: 3950274 - RNA, 14 nt, Human herpesvirus 1
gcggugccugacgc

SEQ ID NO: 3950275 - RNA, 16 nt, Human herpesvirus 1
gcguagagcuguggca

SEQ ID NO: 3950276 - RNA, 16 nt, Human herpesvirus 1
gcgucagucccgacac

SEQ ID NO: 3950277 - RNA, 18 nt, Human herpesvirus 1
gcgucgccccgugucugu

SEQ ID NO: 3950278 - RNA, 23 nt, Human herpesvirus 1
gcgucgcgacagaacugcguuug

SEQ ID NO: 3950279 - RNA, 18 nt, Human herpesvirus 1
gcgucggugauccccaac

SEQ ID NO: 3950280 - RNA, 13 nt, Human herpesvirus 1
gcguggaccuggg

SEQ ID NO: 3950281 - RNA, 13 nt, Human herpesvirus 1
gcgugggccgcgc

SEQ ID NO: 3950282 - RNA, 16 nt, Human herpesvirus 1
gcguggugcgagcugc

SEQ ID NO: 3950283 - RNA, 18 nt, Human herpesvirus 1
gcguguaccacauccagg

SEQ ID NO: 3950284 - RNA, 19 nt, Human herpesvirus 1
gcguguuccccgggagccc

SEQ ID NO: 3950285 - RNA, 18 nt, Human herpesvirus 1
gcguuaaccgcacccccc

SEQ ID NO: 3950286 - RNA, 18 nt, Human herpesvirus 1
gcguuugcacaacacaaa

SEQ ID NO: 3950287 - RNA, 19 nt, Human herpesvirus 1
gcuaucuccugggggcacc

SEQ ID NO: 3950288 - RNA, 13 nt, Human herpesvirus 1
gcucacgaccccc

SEQ ID NO: 3950289 - RNA, 14 nt, Human herpesvirus 1
gcucacgaccccca

SEQ ID NO: 3950290 - RNA, 11 nt, Human herpesvirus 1
gcucagccaga

SEQ ID NO: 3950291 - RNA, 21 nt, Human herpesvirus 1
gcuccagucccggcccggcgg

SEQ ID NO: 3950292 - RNA, 19 nt, Human herpesvirus 1
gcuccgaguacggcggcuc

SEQ ID NO: 3950293 - RNA, 21 nt, Human herpesvirus 1
gcuccgcaacggggcgccguc

SEQ ID NO: 3950294 - RNA, 19 nt, Human herpesvirus 1
gcuccggggaucugguccg

SEQ ID NO: 3950295 - RNA, 20 nt, Human herpesvirus 1
gcuccugauguggcugcucc

SEQ ID NO: 3950296 - RNA, 23 nt, Human herpesvirus 1
gcuccuguaaguacgcccucccg

SEQ ID NO: 3950297 - RNA, 22 nt, Human herpesvirus 1
gcuccuuagcgcggccgugggc

SEQ ID NO: 3950298 - RNA, 19 nt, Human herpesvirus 1
gcucgccagcgacccgcac

SEQ ID NO: 3950299 - RNA, 17 nt, Human herpesvirus 1
ccaacgucgccgcccug

SEQ ID NO: 3950300 - RNA, 18 nt, Human herpesvirus 1
ccaacgucuccuccacca

SEQ ID NO: 3950301 - RNA, 11 nt, Human herpesvirus 1
ccaagccggga

SEQ ID NO: 3950302 - RNA, 19 nt, Human herpesvirus 1
ccaagcuagccgaggcccg

SEQ ID NO: 3950303 - RNA, 20 nt, Human herpesvirus 1
ccaaggccccauacacgagc

SEQ ID NO: 3950304 - RNA, 15 nt, Human herpesvirus 1
ccaaggucaccgaca

SEQ ID NO: 3950305 - RNA, 21 nt, Human herpesvirus 1
ccaaguacgcuuucgacccca

SEQ ID NO: 3950306 - RNA, 16 nt, Human herpesvirus 1
ccaaguucaccguggc

SEQ ID NO: 3950307 - RNA, 15 nt, Human herpesvirus 1
ccaaugcccucccug

SEQ ID NO: 3950308 - RNA, 16 nt, Human herpesvirus 1
ccaaugggccgggccg

SEQ ID NO: 3950309 - RNA, 13 nt, Human herpesvirus 1
ccacaaaaugcaa

SEQ ID NO: 3950310 - RNA, 23 nt, Human herpesvirus 1
ccacaccaccuacuacgaugggg

SEQ ID NO: 3950311 - RNA, 17 nt, Human herpesvirus 1
ccacaugaagccacugu

SEQ ID NO: 3950312 - RNA, 18 nt, Human herpesvirus 1
ccaccacccggccggugg

SEQ ID NO: 3950313 - RNA, 14 nt, Human herpesvirus 1
ccaccauggccccc

SEQ ID NO: 3950314 - RNA, 15 nt, Human herpesvirus 1
ccacccaggcgcugg

SEQ ID NO: 3950315 - RNA, 17 nt, Human herpesvirus 1
ccacccaggcgcugggc

SEQ ID NO: 3950316 - RNA, 18 nt, Human herpesvirus 1
ccaccgcgcuccucccgc

SEQ ID NO: 3950317 - RNA, 12 nt, Human herpesvirus 1
ccaccgggccca

SEQ ID NO: 3950318 - RNA, 21 nt, Human herpesvirus 1
ccaccuucaccaccaaccuga

SEQ ID NO: 3950319 - RNA, 17 nt, Human herpesvirus 1
ccacgagaucaaggaca

SEQ ID NO: 3950320 - RNA, 17 nt, Human herpesvirus 1
ccacgaugaccgccccc

SEQ ID NO: 3950321 - RNA, 13 nt, Human herpesvirus 1
ccacgccacccug

SEQ ID NO: 3950322 - RNA, 13 nt, Human herpesvirus 1
ccacgcucucccc

SEQ ID NO: 3950323 - RNA, 22 nt, Human herpesvirus 1
ccacgcucuccccugcugccau

SEQ ID NO: 3950324 - RNA, 14 nt, Human herpesvirus 1
ccacggccacuggc

SEQ ID NO: 3950325 - RNA, 19 nt, Human herpesvirus 1
ccacggcgccgaccacccg

SEQ ID NO: 3950326 - RNA, 14 nt, Human herpesvirus 1
ccacgguaggccca

SEQ ID NO: 3950327 - RNA, 22 nt, Human herpesvirus 1
ccacgucgaccgcgcccucgcc

SEQ ID NO: 3950328 - RNA, 17 nt, Human herpesvirus 1
ccacuacaccagccaau

SEQ ID NO: 3950329 - RNA, 13 nt, Human herpesvirus 1
ccacuggccggga

SEQ ID NO: 3950330 - RNA, 21 nt, Human herpesvirus 1
ccagagguguucacgcaccuc

SEQ ID NO: 3950331 - RNA, 15 nt, Human herpesvirus 1
ccagauaauccagau

SEQ ID NO: 3950332 - RNA, 18 nt, Human herpesvirus 1
ccagcagacgcugcuccg

SEQ ID NO: 3950333 - RNA, 17 nt, Human herpesvirus 1
ccagccguccucgcacc

SEQ ID NO: 3950334 - RNA, 17 nt, Human herpesvirus 1
ccagcgcggcggggccc

SEQ ID NO: 3950335 - RNA, 22 nt, Human herpesvirus 1
ccagcggcacgaccggcuccau

SEQ ID NO: 3950336 - RNA, 21 nt, Human herpesvirus 1
ccagcguaaccuccgggggcg

SEQ ID NO: 3950337 - RNA, 16 nt, Human herpesvirus 1
ccagcguccgccgagu

SEQ ID NO: 3950338 - RNA, 15 nt, Human herpesvirus 1
ccagcuuuccgcuga

SEQ ID NO: 3950339 - RNA, 20 nt, Human herpesvirus 1
ccaggaaauccguggccccg

SEQ ID NO: 3950340 - RNA, 19 nt, Human herpesvirus 1
ccaggcccgccgccacugu

SEQ ID NO: 3950341 - RNA, 14 nt, Human herpesvirus 1
ccaggcgcugggcg

SEQ ID NO: 3950342 - RNA, 18 nt, Human herpesvirus 1
ccagggaccuccuggacu

SEQ ID NO: 3950343 - RNA, 19 nt, Human herpesvirus 1
ccagggagaaaccccagca

SEQ ID NO: 3950344 - RNA, 21 nt, Human herpesvirus 1
ccaggguaccgcgugacccca

SEQ ID NO: 3950345 - RNA, 22 nt, Human herpesvirus 1
ccaguccaguuaucgcggcuuc

SEQ ID NO: 3950346 - RNA, 19 nt, Human herpesvirus 1
ccaguccccgggcccagcc

SEQ ID NO: 3950347 - RNA, 19 nt, Human herpesvirus 1
ccaucaccccgcaauuugc

SEQ ID NO: 3950348 - RNA, 23 nt, Human herpesvirus 1
ccaucgagccaacgcccugacca

SEQ ID NO: 3950349 - RNA, 20 nt, Human herpesvirus 1
ccaucgccccuggcgcgcga

SEQ ID NO: 3950350 - RNA, 21 nt, Human herpesvirus 1
ccaucgguccccucugggccc

SEQ ID NO: 3950351 - RNA, 22 nt, Human herpesvirus 1
ccaucgguccccucugggcccg

SEQ ID NO: 3950352 - RNA, 19 nt, Human herpesvirus 1
ccaucuacguugcggggcg

SEQ ID NO: 3950353 - RNA, 20 nt, Human herpesvirus 1
ccaucugggauggcuccugg

SEQ ID NO: 3950354 - RNA, 16 nt, Human herpesvirus 1
ccauggaccccagcga

SEQ ID NO: 3950355 - RNA, 21 nt, Human herpesvirus 1
ccauggagcacgagcaggcgg

SEQ ID NO: 3950356 - RNA, 15 nt, Human herpesvirus 1
cccaaaacacacgga

SEQ ID NO: 3950357 - RNA, 16 nt, Human herpesvirus 1
cccaacccacacgcac

SEQ ID NO: 3950358 - RNA, 14 nt, Human herpesvirus 1
cccaaccccaacuc

SEQ ID NO: 3950359 - RNA, 22 nt, Human herpesvirus 1
cccaacucucgcaccaucccgg

SEQ ID NO: 3950360 - RNA, 13 nt, Human herpesvirus 1
cccaagccgcccc

SEQ ID NO: 3950361 - RNA, 16 nt, Human herpesvirus 1
cccaauccgacgggga

SEQ ID NO: 3950362 - RNA, 18 nt, Human herpesvirus 1
cccaccaacgucuccucc

SEQ ID NO: 3950363 - RNA, 21 nt, Human herpesvirus 1
cccaccggaagcccaacccac

SEQ ID NO: 3950364 - RNA, 17 nt, Human herpesvirus 1
cccacgaucaccgcggg

SEQ ID NO: 3950365 - RNA, 15 nt, Human herpesvirus 1
cccacgucgucucgg

SEQ ID NO: 3950366 - RNA, 13 nt, Human herpesvirus 1
cccagcaaggcgu

SEQ ID NO: 3950367 - RNA, 19 nt, Human herpesvirus 1
cccagcauguccgccggga

SEQ ID NO: 3950368 - RNA, 14 nt, Human herpesvirus 1
cccagcgaccccac

SEQ ID NO: 3950369 - RNA, 15 nt, Human herpesvirus 1
cccagcggcacgacc

SEQ ID NO: 3950370 - RNA, 22 nt, Human herpesvirus 1
cccaguccccgggcccagccuu

SEQ ID NO: 3950371 - RNA, 15 nt, Human herpesvirus 1
cccaucagccucguc

SEQ ID NO: 3950372 - RNA, 21 nt, Human herpesvirus 1
cccauccgaacgcagccccgc

SEQ ID NO: 3950373 - RNA, 18 nt, Human herpesvirus 1
cccaucuaaugccacgcg

SEQ ID NO: 3950374 - RNA, 14 nt, Human herpesvirus 1
cccaugggucccaa

SEQ ID NO: 3950375 - RNA, 14 nt, Human herpesvirus 1
ccccaaccccuucc

SEQ ID NO: 3950376 - RNA, 14 nt, Human herpesvirus 1
ccccaaggcgcugc

SEQ ID NO: 3950377 - RNA, 14 nt, Human herpesvirus 1
ccccaccccggagg

SEQ ID NO: 3950378 - RNA, 15 nt, Human herpesvirus 1
ccccacgacacccac

SEQ ID NO: 3950379 - RNA, 18 nt, Human herpesvirus 1
ccccacgaugaccgcccc

SEQ ID NO: 3950380 - RNA, 22 nt, Human herpesvirus 1
ccccacgcccccgccgcccggg

SEQ ID NO: 3950381 - RNA, 23 nt, Human herpesvirus 1
ccccacgugaucagcacgccacc

SEQ ID NO: 3950382 - RNA, 21 nt, Human herpesvirus 1
ccccagagguguucacgcacc

SEQ ID NO: 3950383 - RNA, 14 nt, Human herpesvirus 1
ccccagccuucacg

SEQ ID NO: 3950384 - RNA, 18 nt, Human herpesvirus 1
ccccagggaccuccugga

SEQ ID NO: 3950385 - RNA, 12 nt, Human herpesvirus 1
ccccccagccuc

SEQ ID NO: 3950386 - RNA, 11 nt, Human herpesvirus 1
ccccccccuuc

SEQ ID NO: 3950387 - RNA, 12 nt, Human herpesvirus 1
ccccccgcgcuc

SEQ ID NO: 3950388 - RNA, 13 nt, Human herpesvirus 1
cccccgcccgggu

SEQ ID NO: 3950389 - RNA, 19 nt, Human herpesvirus 1
cccccggcauggcgcagcu

SEQ ID NO: 3950390 - RNA, 20 nt, Human herpesvirus 1
cccccggguuuucccacgcc

SEQ ID NO: 3950391 - RNA, 20 nt, Human herpesvirus 1
cccccuguuugucgacgaga

SEQ ID NO: 3950392 - RNA, 15 nt, Human herpesvirus 1
ccccgacccucccau

SEQ ID NO: 3950393 - RNA, 15 nt, Human herpesvirus 1
ccccgcugcggccac

SEQ ID NO: 3950394 - RNA, 15 nt, Human herpesvirus 1
ccccggacccgggcc

SEQ ID NO: 3950395 - RNA, 16 nt, Human herpesvirus 1
ccccggacgacauggc

SEQ ID NO: 3950396 - RNA, 22 nt, Human herpesvirus 1
ccccggcauggcgcagcuggga

SEQ ID NO: 3950397 - RNA, 12 nt, Human herpesvirus 1
ccccggccaccu

SEQ ID NO: 3950398 - RNA, 17 nt, Human herpesvirus 1
ccccggucuccccggga

SEQ ID NO: 3950399 - RNA, 23 nt, Human herpesvirus 1
ccccgucuggguuuuccccuccc

SEQ ID NO: 3950400 - RNA, 14 nt, Human herpesvirus 1
ccccuagccccgcc

SEQ ID NO: 3950401 - RNA, 18 nt, Human herpesvirus 1
ccccucgaccaccauccc

SEQ ID NO: 3950402 - RNA, 17 nt, Human herpesvirus 1
ccccucgccccauacuc

SEQ ID NO: 3950403 - RNA, 18 nt, Human herpesvirus 1
ccccucugggcccgccug

SEQ ID NO: 3950404 - RNA, 13 nt, Human herpesvirus 1
ccccuggcgcgcg

SEQ ID NO: 3950405 - RNA, 13 nt, Human herpesvirus 1
cccgaagccugcu

SEQ ID NO: 3950406 - RNA, 17 nt, Human herpesvirus 1
cccgacaccaccagcug

SEQ ID NO: 3950407 - RNA, 17 nt, Human herpesvirus 1
cccgacagaccuccccg

SEQ ID NO: 3950408 - RNA, 22 nt, Human herpesvirus 1
cccgaccgcguguacgggcugu

SEQ ID NO: 3950409 - RNA, 16 nt, Human herpesvirus 1
cccgaggccccacguc

SEQ ID NO: 3950410 - RNA, 17 nt, Human herpesvirus 1
cccgaucccaacaacuc

SEQ ID NO: 3950411 - RNA, 18 nt, Human herpesvirus 1
cccgcaaacaggagcugu

SEQ ID NO: 3950412 - RNA, 19 nt, Human herpesvirus 1
cccgcaacgcgcuggggcu

SEQ ID NO: 3950413 - RNA, 16 nt, Human herpesvirus 1
cccgcaauuugcaccc

SEQ ID NO: 3950414 - RNA, 18 nt, Human herpesvirus 1
cccgcagucccgggggcu

SEQ ID NO: 3950415 - RNA, 16 nt, Human herpesvirus 1
cccgcauaucccaccc

SEQ ID NO: 3950416 - RNA, 19 nt, Human herpesvirus 1
cccgcaucccccgucuggg

SEQ ID NO: 3950417 - RNA, 13 nt, Human herpesvirus 1
cccgcccccgccg

SEQ ID NO: 3950418 - RNA, 18 nt, Human herpesvirus 1
cccgcccgaccgcgugua

SEQ ID NO: 3950419 - RNA, 18 nt, Human herpesvirus 1
cccgccgcaaagccaccc

SEQ ID NO: 3950420 - RNA, 19 nt, Human herpesvirus 1
cccgccgcaaagccaccca

SEQ ID NO: 3950421 - RNA, 17 nt, Human herpesvirus 1
cccgccgcccggggcca

SEQ ID NO: 3950422 - RNA, 17 nt, Human herpesvirus 1
cccgccguugagccccu

SEQ ID NO: 3950423 - RNA, 13 nt, Human herpesvirus 1
cccgcgacgccau

SEQ ID NO: 3950424 - RNA, 16 nt, Human herpesvirus 1
cccgcgcucgcgagua

SEQ ID NO: 3950425 - RNA, 15 nt, Human herpesvirus 1
cccggaggcguuccg

SEQ ID NO: 3950426 - RNA, 23 nt, Human herpesvirus 1
cccggagggcugccagaccucaa

SEQ ID NO: 3950427 - RNA, 20 nt, Human herpesvirus 1
cccggcggccccuggcgccg

SEQ ID NO: 3950428 - RNA, 12 nt, Human herpesvirus 1
cccggcucuccg

SEQ ID NO: 3950429 - RNA, 21 nt, Human herpesvirus 1
cccgggacaccccccaugcgg

SEQ ID NO: 3950430 - RNA, 17 nt, Human herpesvirus 1
cccgggagcuccgcacc

SEQ ID NO: 3950431 - RNA, 17 nt, Human herpesvirus 1
cccgggccgcaccgggc

SEQ ID NO: 3950432 - RNA, 16 nt, Human herpesvirus 1
cccguccgcaucgauc

SEQ ID NO: 3950433 - RNA, 17 nt, Human herpesvirus 1
cccguccucgcccgcca

SEQ ID NO: 3950434 - RNA, 16 nt, Human herpesvirus 1
cccgucgaagcugaug

SEQ ID NO: 3950435 - RNA, 15 nt, Human herpesvirus 1
cccuaaccaggccuc

SEQ ID NO: 3950436 - RNA, 15 nt, Human herpesvirus 1
cccuaaggcccggcu

SEQ ID NO: 3950437 - RNA, 13 nt, Human herpesvirus 1
cccuacaaccuga

SEQ ID NO: 3950438 - RNA, 17 nt, Human herpesvirus 1
cccuacaaccugaccau

SEQ ID NO: 3950439 - RNA, 17 nt, Human herpesvirus 1
cccuacucucccuccag

SEQ ID NO: 3950440 - RNA, 14 nt, Human herpesvirus 1
cccuagaggcuggu

SEQ ID NO: 3950441 - RNA, 18 nt, Human herpesvirus 1
cccuauuuucccccccgg

SEQ ID NO: 3950442 - RNA, 15 nt, Human herpesvirus 1
cccucaaccccggcg

SEQ ID NO: 3950443 - RNA, 15 nt, Human herpesvirus 1
cccuccccccgcccc

SEQ ID NO: 3950444 - RNA, 20 nt, Human herpesvirus 1
cccucccccuccgcauccca

SEQ ID NO: 3950445 - RNA, 16 nt, Human herpesvirus 1
cccuccgcaucccagg

SEQ ID NO: 3950446 - RNA, 19 nt, Human herpesvirus 1
cccuccgcaucccaggauc

SEQ ID NO: 3950447 - RNA, 19 nt, Human herpesvirus 1
cccuccgcuggggccccca

SEQ ID NO: 3950448 - RNA, 22 nt, Human herpesvirus 1
cccuccgcuggggcccccaggg

SEQ ID NO: 3950449 - RNA, 15 nt, Human herpesvirus 1
cccucgaccaccauc

SEQ ID NO: 3950450 - RNA, 13 nt, Human herpesvirus 1
cccucgucccccu

SEQ ID NO: 3950451 - RNA, 12 nt, Human herpesvirus 1
cccucucuuccc

SEQ ID NO: 3950452 - RNA, 17 nt, Human herpesvirus 1
cccucucuucccucagg

SEQ ID NO: 3950453 - RNA, 23 nt, Human herpesvirus 1
cccucucuucucucccgggccgc

SEQ ID NO: 3950454 - RNA, 13 nt, Human herpesvirus 1
cccucugggcccg

SEQ ID NO: 3950455 - RNA, 16 nt, Human herpesvirus 1
cccugaucccccgcgc

SEQ ID NO: 3950456 - RNA, 19 nt, Human herpesvirus 1
cccugcgguccggagccgc

SEQ ID NO: 3950457 - RNA, 13 nt, Human herpesvirus 1
cccugcgucgccc

SEQ ID NO: 3950458 - RNA, 15 nt, Human herpesvirus 1
cccugcugcccccgg

SEQ ID NO: 3950459 - RNA, 17 nt, Human herpesvirus 1
cccugcugcccccggag

SEQ ID NO: 3950460 - RNA, 19 nt, Human herpesvirus 1
cccuggacgugggccucac

SEQ ID NO: 3950461 - RNA, 16 nt, Human herpesvirus 1
cccugggcccuggccg

SEQ ID NO: 3950462 - RNA, 19 nt, Human herpesvirus 1
cccuguggaacgaggcccg

SEQ ID NO: 3950463 - RNA, 16 nt, Human herpesvirus 1
cccuguucaaccccag

SEQ ID NO: 3950464 - RNA, 19 nt, Human herpesvirus 1
cccuguuugucgccuggcu

SEQ ID NO: 3950465 - RNA, 15 nt, Human herpesvirus 1
cccuuccccgcuguc

SEQ ID NO: 3950466 - RNA, 16 nt, Human herpesvirus 1
ccgaacagcucgcgga

SEQ ID NO: 3950467 - RNA, 12 nt, Human herpesvirus 1
ccgaacccaggc

SEQ ID NO: 3950468 - RNA, 16 nt, Human herpesvirus 1
ccgaacgacacacggc

SEQ ID NO: 3950469 - RNA, 18 nt, Human herpesvirus 1
ccgaacugggcgaccgcc

SEQ ID NO: 3950470 - RNA, 14 nt, Human herpesvirus 1
ccgaagcccagcgu

SEQ ID NO: 3950471 - RNA, 14 nt, Human herpesvirus 1
ccgaagccccggcc

SEQ ID NO: 3950472 - RNA, 13 nt, Human herpesvirus 1
ccgacagaccucc

SEQ ID NO: 3950473 - RNA, 15 nt, Human herpesvirus 1
ccgacagggccgugc

SEQ ID NO: 3950474 - RNA, 17 nt, Human herpesvirus 1
ccgacaucaccaccguc

SEQ ID NO: 3950475 - RNA, 14 nt, Human herpesvirus 1
ccgacauggucaug

SEQ ID NO: 3950476 - RNA, 14 nt, Human herpesvirus 1
ccgacauuaaccac

SEQ ID NO: 3950477 - RNA, 14 nt, Human herpesvirus 1
ccgaccacacaccc

SEQ ID NO: 3950478 - RNA, 16 nt, Human herpesvirus 1
ccgaccacacaccccc

SEQ ID NO: 3950479 - RNA, 18 nt, Human herpesvirus 1
ccgacccccauggagcac

SEQ ID NO: 3950480 - RNA, 18 nt, Human herpesvirus 1
ccgacgaacgcggacccc

SEQ ID NO: 3950481 - RNA, 13 nt, Human herpesvirus 1
ccgacggacagcc

SEQ ID NO: 3950482 - RNA, 18 nt, Human herpesvirus 1
ccgacuccccgccuccgg

SEQ ID NO: 3950483 - RNA, 17 nt, Human herpesvirus 1
ccgagacccccaacgcc

SEQ ID NO: 3950484 - RNA, 19 nt, Human herpesvirus 1
ccgagucuucggggcccgg

SEQ ID NO: 3950485 - RNA, 17 nt, Human herpesvirus 1
ccgaguucccccggcac

SEQ ID NO: 3950486 - RNA, 20 nt, Human herpesvirus 1
ccgaguucccccggcacgcc

SEQ ID NO: 3950487 - RNA, 16 nt, Human herpesvirus 1
ccgaucccaggcgccg

SEQ ID NO: 3950488 - RNA, 23 nt, Human herpesvirus 1
ccgaucccaggcgccgacggaca

SEQ ID NO: 3950489 - RNA, 19 nt, Human herpesvirus 1
ccgaugcggcggcgcugca

SEQ ID NO: 3950490 - RNA, 16 nt, Human herpesvirus 1
ccgauggcccuccagg

SEQ ID NO: 3950491 - RNA, 16 nt, Human herpesvirus 1
ccgauggccgucccgc

SEQ ID NO: 3950492 - RNA, 12 nt, Human herpesvirus 1
ccgcaacaccaa

SEQ ID NO: 3950493 - RNA, 20 nt, Human herpesvirus 1
ccgcaaccagcugcacgacc

SEQ ID NO: 3950494 - RNA, 18 nt, Human herpesvirus 1
ccgcaacuucccacccgg

SEQ ID NO: 3950495 - RNA, 16 nt, Human herpesvirus 1
ccgcaagccccuagcc

SEQ ID NO: 3950496 - RNA, 15 nt, Human herpesvirus 1
ccgcaagcuaugcag

SEQ ID NO: 3950497 - RNA, 16 nt, Human herpesvirus 1
ccgcaauuugcaccca

SEQ ID NO: 3950498 - RNA, 17 nt, Human herpesvirus 1
ccgcaauuugcacccag

SEQ ID NO: 3950499 - RNA, 15 nt, Human herpesvirus 1
ccgcaccaagccgcu

SEQ ID NO: 3950500 - RNA, 15 nt, Human herpesvirus 1
ccgcaccgggccccc

SEQ ID NO: 3950501 - RNA, 14 nt, Human herpesvirus 1
ccgcagcaccucua

SEQ ID NO: 3950502 - RNA, 12 nt, Human herpesvirus 1
ccgcagccuggu

SEQ ID NO: 3950503 - RNA, 17 nt, Human herpesvirus 1
ccgcauaucccacccug

SEQ ID NO: 3950504 - RNA, 21 nt, Human herpesvirus 1
ccgcauaucccacccuggagc

SEQ ID NO: 3950505 - RNA, 21 nt, Human herpesvirus 1
ccgccagcgcggcggggcccg

SEQ ID NO: 3950506 - RNA, 14 nt, Human herpesvirus 1
ccgcccaacucucg

SEQ ID NO: 3950507 - RNA, 21 nt, Human herpesvirus 1
ccgcccaacucucgcaccauc

SEQ ID NO: 3950508 - RNA, 12 nt, Human herpesvirus 1
ccgcccccggca

SEQ ID NO: 3950509 - RNA, 13 nt, Human herpesvirus 1
ccgcccccggcau

SEQ ID NO: 3950510 - RNA, 19 nt, Human herpesvirus 1
ccgcccggggccagcgcca

SEQ ID NO: 3950511 - RNA, 14 nt, Human herpesvirus 1
ccgcccuggccgcg

SEQ ID NO: 3950512 - RNA, 13 nt, Human herpesvirus 1
ccgccgcccgggg

SEQ ID NO: 3950513 - RNA, 15 nt, Human herpesvirus 1
ccgccgcccggggcc

SEQ ID NO: 3950514 - RNA, 18 nt, Human herpesvirus 1
ccgccggcaugcacccca

SEQ ID NO: 3950515 - RNA, 14 nt, Human herpesvirus 1
ccgccuagccgcag

SEQ ID NO: 3950516 - RNA, 20 nt, Human herpesvirus 1
ccgccugucgcacccacagc

SEQ ID NO: 3950517 - RNA, 20 nt, Human herpesvirus 1
ccgcgaacggcacgcccccu

SEQ ID NO: 3950518 - RNA, 13 nt, Human herpesvirus 1
ccgcgacccgcac

SEQ ID NO: 3950519 - RNA, 14 nt, Human herpesvirus 1
ccgcgacccuccgg

SEQ ID NO: 3950520 - RNA, 21 nt, Human herpesvirus 1
ccgcgacgccuuaccaucccc

SEQ ID NO: 3950521 - RNA, 18 nt, Human herpesvirus 1
ccgcgcauauccgggggc

SEQ ID NO: 3950522 - RNA, 11 nt, Human herpesvirus 1
ccgcgccaggc

SEQ ID NO: 3950523 - RNA, 13 nt, Human herpesvirus 1
ccgcgccucccgg

SEQ ID NO: 3950524 - RNA, 13 nt, Human herpesvirus 1
ccgcggccugggu

SEQ ID NO: 3950525 - RNA, 16 nt, Human herpesvirus 1
ccgcggucaucacccg

SEQ ID NO: 3950526 - RNA, 15 nt, Human herpesvirus 1
ccgcggugggcugga

SEQ ID NO: 3950527 - RNA, 14 nt, Human herpesvirus 1
ccgcguacgaggac

SEQ ID NO: 3950528 - RNA, 18 nt, Human herpesvirus 1
ccgcguggaucggcgcca

SEQ ID NO: 3950529 - RNA, 21 nt, Human herpesvirus 1
ccgcgugggugaugucggguc

SEQ ID NO: 3950530 - RNA, 20 nt, Human herpesvirus 1
ccgcguguuccccgggagcc

SEQ ID NO: 3950531 - RNA, 22 nt, Human herpesvirus 1
ccgcguguuccccgggagcccc

SEQ ID NO: 3950532 - RNA, 15 nt, Human herpesvirus 1
ccgcguuuggccugc

SEQ ID NO: 3950533 - RNA, 21 nt, Human herpesvirus 1
ccgcguuuggccugcggcgca

SEQ ID NO: 3950534 - RNA, 16 nt, Human herpesvirus 1
ccgcuaaaagaccgca

SEQ ID NO: 3950535 - RNA, 17 nt, Human herpesvirus 1
ccgcuaucuccuggggg

SEQ ID NO: 3950536 - RNA, 17 nt, Human herpesvirus 1
ccgcugacccccaccgc

SEQ ID NO: 3950537 - RNA, 20 nt, Human herpesvirus 1
ccgcugcgcauccccccguc

SEQ ID NO: 3950538 - RNA, 23 nt, Human herpesvirus 1
ccgcuggcuggaaaccgagcuug

SEQ ID NO: 3950539 - RNA, 14 nt, Human herpesvirus 1
ccgcuuccaucgcc

SEQ ID NO: 3950540 - RNA, 19 nt, Human herpesvirus 1
ccggaaccugcucacgacc

SEQ ID NO: 3950541 - RNA, 18 nt, Human herpesvirus 1
ccggaccccacgcacccc

SEQ ID NO: 3950542 - RNA, 15 nt, Human herpesvirus 1
ccggacccgggccgu

SEQ ID NO: 3950543 - RNA, 23 nt, Human herpesvirus 1
ccggagccgggcgcgugcugcgc

SEQ ID NO: 3950544 - RNA, 15 nt, Human herpesvirus 1
ccggagcgugacgca

SEQ ID NO: 3950545 - RNA, 16 nt, Human herpesvirus 1
ccggaucgcgcucguc

SEQ ID NO: 3950546 - RNA, 17 nt, Human herpesvirus 1
ccggcaccaacaacgac

SEQ ID NO: 3950547 - RNA, 12 nt, Human herpesvirus 1
ccggcacggacc

SEQ ID NO: 3950548 - RNA, 13 nt, Human herpesvirus 1
ccggccgcaccca

SEQ ID NO: 3950549 - RNA, 11 nt, Human herpesvirus 1
ccggccugggc

SEQ ID NO: 3950550 - RNA, 18 nt, Human herpesvirus 1
ccggcgcggugggcggca

SEQ ID NO: 3950551 - RNA, 15 nt, Human herpesvirus 1
ccggcuacaggggcc

SEQ ID NO: 3950552 - RNA, 18 nt, Human herpesvirus 1
ccgggacgaccacgagac

SEQ ID NO: 3950553 - RNA, 14 nt, Human herpesvirus 1
ccgggacugggugg

SEQ ID NO: 3950554 - RNA, 23 nt, Human herpesvirus 1
ccgggaggggucgcacaccgaac

SEQ ID NO: 3950555 - RNA, 16 nt, Human herpesvirus 1
ccgggccacggcgccg

SEQ ID NO: 3950556 - RNA, 14 nt, Human herpesvirus 1
ccgggccgcccacu

SEQ ID NO: 3950557 - RNA, 19 nt, Human herpesvirus 1
ccgggccguugcccgggcc

SEQ ID NO: 3950558 - RNA, 19 nt, Human herpesvirus 1
ccgggcgcaauugcggcca

SEQ ID NO: 3950559 - RNA, 18 nt, Human herpesvirus 1
ccgggcgcguccccggcc

SEQ ID NO: 3950560 - RNA, 18 nt, Human herpesvirus 1
ccggggcccggcccugcu

SEQ ID NO: 3950561 - RNA, 14 nt, Human herpesvirus 1
ccggggcucagcca

SEQ ID NO: 3950562 - RNA, 16 nt, Human herpesvirus 1
ccggggcuggcacacc

SEQ ID NO: 3950563 - RNA, 15 nt, Human herpesvirus 1
ccggggggcggaacg

SEQ ID NO: 3950564 - RNA, 16 nt, Human herpesvirus 1
ccgguaugccgcggcc

SEQ ID NO: 3950565 - RNA, 17 nt, Human herpesvirus 1
ccgguauuauuuaccua

SEQ ID NO: 3950566 - RNA, 15 nt, Human herpesvirus 1
ccgguccuggaccag

SEQ ID NO: 3950567 - RNA, 15 nt, Human herpesvirus 1
ccggugaacgccucc

SEQ ID NO: 3950568 - RNA, 18 nt, Human herpesvirus 1
ccggugguccguguggag

SEQ ID NO: 3950569 - RNA, 14 nt, Human herpesvirus 1
ccgguucucccugu

SEQ ID NO: 3950570 - RNA, 18 nt, Human herpesvirus 1
ccgguuggccgcgcggca

SEQ ID NO: 3950571 - RNA, 20 nt, Human herpesvirus 1
ccguacaaguucaaggccac

SEQ ID NO: 3950572 - RNA, 14 nt, Human herpesvirus 1
ccgucccacgcucu

SEQ ID NO: 3950573 - RNA, 20 nt, Human herpesvirus 1
ccguccccugccccccccac

SEQ ID NO: 3950574 - RNA, 21 nt, Human herpesvirus 1
ccguccccuucgaggagguga

SEQ ID NO: 3950575 - RNA, 20 nt, Human herpesvirus 1
ccguccgcaucgauccggag

SEQ ID NO: 3950576 - RNA, 21 nt, Human herpesvirus 1
ccgucgcacgcguccagucgg

SEQ ID NO: 3950577 - RNA, 20 nt, Human herpesvirus 1
ccgucgccgcgggccacgcc

SEQ ID NO: 3950578 - RNA, 18 nt, Human herpesvirus 1
ccgucgcuagaccacgcc

SEQ ID NO: 3950579 - RNA, 15 nt, Human herpesvirus 1
ccgucggaggccccc

SEQ ID NO: 3950580 - RNA, 23 nt, Human herpesvirus 1
ccgucuggguuuuccccucccgu

SEQ ID NO: 3950581 - RNA, 23 nt, Human herpesvirus 1
ccgugacuaagcgucccugggcc

SEQ ID NO: 3950582 - RNA, 19 nt, Human herpesvirus 1
ccgugauccuuaggggccg

SEQ ID NO: 3950583 - RNA, 18 nt, Human herpesvirus 1
ccgugcacacgacggccu

SEQ ID NO: 3950584 - RNA, 13 nt, Human herpesvirus 1
ccguggaccccac

SEQ ID NO: 3950585 - RNA, 20 nt, Human herpesvirus 1
ccgugggcgacugcgacccc

SEQ ID NO: 3950586 - RNA, 21 nt, Human herpesvirus 1
ccguggggacgguggcgccgc

SEQ ID NO: 3950587 - RNA, 10 nt, Human herpesvirus 1
ccgugucuau

SEQ ID NO: 3950588 - RNA, 13 nt, Human herpesvirus 1
ccguuccagcccc

SEQ ID NO: 3950589 - RNA, 21 nt, Human herpesvirus 1
ccguugcccgggccuccucaa

SEQ ID NO: 3950590 - RNA, 15 nt, Human herpesvirus 1
ccguuucuccgcccg

SEQ ID NO: 3950591 - RNA, 20 nt, Human herpesvirus 1
ccuaaacgcaccgucggagg

SEQ ID NO: 3950592 - RNA, 18 nt, Human herpesvirus 1
ccucacccacgccggcac

SEQ ID NO: 3950593 - RNA, 17 nt, Human herpesvirus 1
ccucacguucgcacgca

SEQ ID NO: 3950594 - RNA, 16 nt, Human herpesvirus 1
ccucagagacaacgcg

SEQ ID NO: 3950595 - RNA, 23 nt, Human herpesvirus 1
ccuccaggcugucgacgcccccu

SEQ ID NO: 3950596 - RNA, 15 nt, Human herpesvirus 1
ccuccccgcacagau

SEQ ID NO: 3950597 - RNA, 18 nt, Human herpesvirus 1
ccuccccgcgcaugcucu

SEQ ID NO: 3950598 - RNA, 13 nt, Human herpesvirus 1
ccucccgccaccc

SEQ ID NO: 3950599 - RNA, 15 nt, Human herpesvirus 1
ccucccugacggcca

SEQ ID NO: 3950600 - RNA, 20 nt, Human herpesvirus 1
ccucccugacggccaucgcc

SEQ ID NO: 3950601 - RNA, 15 nt, Human herpesvirus 1
ccuccgaagacgucc

SEQ ID NO: 3950602 - RNA, 16 nt, Human herpesvirus 1
ccuccgcaucccagga

SEQ ID NO: 3950603 - RNA, 23 nt, Human herpesvirus 1
ccuccgcgccaggcccgccgcca

SEQ ID NO: 3950604 - RNA, 23 nt, Human herpesvirus 1
ccuccggagcgugacgcaccccc

SEQ ID NO: 3950605 - RNA, 17 nt, Human herpesvirus 1
ccucgaugacgucccgg

SEQ ID NO: 3950606 - RNA, 12 nt, Human herpesvirus 1
ccucgcaccagc

SEQ ID NO: 3950607 - RNA, 18 nt, Human herpesvirus 1
ccucgcgccacacucacc

SEQ ID NO: 3950608 - RNA, 13 nt, Human herpesvirus 1
ccucgcgcggcga

SEQ ID NO: 3950609 - RNA, 14 nt, Human herpesvirus 1
ccucgcgggccucg

SEQ ID NO: 3950610 - RNA, 16 nt, Human herpesvirus 1
ccucggccaccguggg

SEQ ID NO: 3950611 - RNA, 23 nt, Human herpesvirus 1
ccucggcccgcgaacggcacgcc

SEQ ID NO: 3950612 - RNA, 14 nt, Human herpesvirus 1
ccucguggccccga

SEQ ID NO: 3950613 - RNA, 15 nt, Human herpesvirus 1
ccucucuucccucag

SEQ ID NO: 3950614 - RNA, 16 nt, Human herpesvirus 1
ccucucuucucucccg

SEQ ID NO: 3950615 - RNA, 16 nt, Human herpesvirus 1
ccucuggacuggacca

SEQ ID NO: 3950616 - RNA, 19 nt, Human herpesvirus 1
ccucugggcccgccuggau

SEQ ID NO: 3950617 - RNA, 17 nt, Human herpesvirus 1
ccucuucuccccuuccc

SEQ ID NO: 3950618 - RNA, 18 nt, Human herpesvirus 1
ccucuucuccccuucccu

SEQ ID NO: 3950619 - RNA, 21 nt, Human herpesvirus 1
ccugacgcgccgcgggccccc

SEQ ID NO: 3950620 - RNA, 23 nt, Human herpesvirus 1
ccugagacaagagcgcucccccg

SEQ ID NO: 3950621 - RNA, 12 nt, Human herpesvirus 1
ccugauggagcc

SEQ ID NO: 3950622 - RNA, 13 nt, Human herpesvirus 1
ccugauggagccu

SEQ ID NO: 3950623 - RNA, 13 nt, Human herpesvirus 1
ccugccccgccac

SEQ ID NO: 3950624 - RNA, 21 nt, Human herpesvirus 1
ccugcgguccggagccgcgcg

SEQ ID NO: 3950625 - RNA, 20 nt, Human herpesvirus 1
ccugcuacagccgcccccug

SEQ ID NO: 3950626 - RNA, 17 nt, Human herpesvirus 1
ccugcucacgaccccca

SEQ ID NO: 3950627 - RNA, 21 nt, Human herpesvirus 1
ccuggauucgcuggaccucac

SEQ ID NO: 3950628 - RNA, 19 nt, Human herpesvirus 1
ccuggcggacggcggccau

SEQ ID NO: 3950629 - RNA, 15 nt, Human herpesvirus 1
ccuggcugacccacg

SEQ ID NO: 3950630 - RNA, 14 nt, Human herpesvirus 1
ccugggccccggga

SEQ ID NO: 3950631 - RNA, 15 nt, Human herpesvirus 1
ccugggcccuggccg

SEQ ID NO: 3950632 - RNA, 17 nt, Human herpesvirus 1
ccuggugcucgugggcc

SEQ ID NO: 3950633 - RNA, 17 nt, Human herpesvirus 1
ccugguuguccguggcc

SEQ ID NO: 3950634 - RNA, 13 nt, Human herpesvirus 1
ccugucgcaccca

SEQ ID NO: 3950635 - RNA, 15 nt, Human herpesvirus 1
ccuguggcccuggcg

SEQ ID NO: 3950636 - RNA, 17 nt, Human herpesvirus 1
ccuuaaccgcuggcugg

SEQ ID NO: 3950637 - RNA, 22 nt, Human herpesvirus 1
ccuuacgcuaaucccccggcuc

SEQ ID NO: 3950638 - RNA, 13 nt, Human herpesvirus 1
ccuuagcgcggcc

SEQ ID NO: 3950639 - RNA, 22 nt, Human herpesvirus 1
ccuucaucgaccucaacaucac

SEQ ID NO: 3950640 - RNA, 21 nt, Human herpesvirus 1
ccuucgacguggaggaaggcg

SEQ ID NO: 3950641 - RNA, 16 nt, Human herpesvirus 1
ccuucgcaacaccucc

SEQ ID NO: 3950642 - RNA, 19 nt, Human herpesvirus 1
ccuucuugucgucucucuu

SEQ ID NO: 3950643 - RNA, 15 nt, Human herpesvirus 1
ccuugcggcagcgcu

SEQ ID NO: 3950644 - RNA, 18 nt, Human herpesvirus 1
ccuuggucuggcccacgc

SEQ ID NO: 3950645 - RNA, 17 nt, Human herpesvirus 1
ccuuugacggcgcggcc

SEQ ID NO: 3950646 - RNA, 18 nt, Human herpesvirus 1
cgaaaucguggcgcggcu

SEQ ID NO: 3950647 - RNA, 20 nt, Human herpesvirus 1
cgaacaaacgacccaccaau

SEQ ID NO: 3950648 - RNA, 21 nt, Human herpesvirus 1
cgaacacggggacggcggggc

SEQ ID NO: 3950649 - RNA, 15 nt, Human herpesvirus 1
cgaacgcggaccccc

SEQ ID NO: 3950650 - RNA, 18 nt, Human herpesvirus 1
cgaagacaccccccacca

SEQ ID NO: 3950651 - RNA, 12 nt, Human herpesvirus 1
cgaagcccagcg

SEQ ID NO: 3950652 - RNA, 13 nt, Human herpesvirus 1
cgaagccccggcc

SEQ ID NO: 3950653 - RNA, 12 nt, Human herpesvirus 1
cgaaggcugccg

SEQ ID NO: 3950654 - RNA, 23 nt, Human herpesvirus 1
cgaaugcagcgccggccuccccg

SEQ ID NO: 3950655 - RNA, 15 nt, Human herpesvirus 1
cgacaacgagccccc

SEQ ID NO: 3950656 - RNA, 19 nt, Human herpesvirus 1
cgacacugaaaugcccccc

SEQ ID NO: 3950657 - RNA, 12 nt, Human herpesvirus 1
cgacagaccucc

SEQ ID NO: 3950658 - RNA, 16 nt, Human herpesvirus 1
cgacagaccuccccgc

SEQ ID NO: 3950659 - RNA, 15 nt, Human herpesvirus 1
cgaccaacuaccccg

SEQ ID NO: 3950660 - RNA, 17 nt, Human herpesvirus 1
cgacccccuuguauguc

SEQ ID NO: 3950661 - RNA, 22 nt, Human herpesvirus 1
cgacccccuuguauguccccaa

SEQ ID NO: 3950662 - RNA, 15 nt, Human herpesvirus 1
cgaccgacagcacuc

SEQ ID NO: 3950663 - RNA, 16 nt, Human herpesvirus 1
cgaccgccagccgcgg

SEQ ID NO: 3950664 - RNA, 15 nt, Human herpesvirus 1
cgaccggcacccggc

SEQ ID NO: 3950665 - RNA, 18 nt, Human herpesvirus 1
cgaccucggcgccucugg

SEQ ID NO: 3950666 - RNA, 14 nt, Human herpesvirus 1
cgaccuggggcgcg

SEQ ID NO: 3950667 - RNA, 13 nt, Human herpesvirus 1
cgaccuguugaug

SEQ ID NO: 3950668 - RNA, 23 nt, Human herpesvirus 1
cgacgccuuaccaucccccggcc

SEQ ID NO: 3950669 - RNA, 17 nt, Human herpesvirus 1
cgacggcgucucccggg

SEQ ID NO: 3950670 - RNA, 15 nt, Human herpesvirus 1
cgacguccugggcca

SEQ ID NO: 3950671 - RNA, 12 nt, Human herpesvirus 1
cgacgucugucg

SEQ ID NO: 3950672 - RNA, 21 nt, Human herpesvirus 1
cgacuugccccccuccccgca

SEQ ID NO: 3950673 - RNA, 12 nt, Human herpesvirus 1
cgagaugagcca

SEQ ID NO: 3950674 - RNA, 20 nt, Human herpesvirus 1
cgagcucccagagaccccag

SEQ ID NO: 3950675 - RNA, 22 nt, Human herpesvirus 1
cgaggacaccccucguggcccc

SEQ ID NO: 3950676 - RNA, 16 nt, Human herpesvirus 1
cgaggaggugaucgac

SEQ ID NO: 3950677 - RNA, 16 nt, Human herpesvirus 1
cgaggauaaccugggg

SEQ ID NO: 3950678 - RNA, 13 nt, Human herpesvirus 1
cgaggcggccacg

SEQ ID NO: 3950679 - RNA, 13 nt, Human herpesvirus 1
cgagggccgggcc

SEQ ID NO: 3950680 - RNA, 23 nt, Human herpesvirus 1
cgaggggaugggcgaccuggggc

SEQ ID NO: 3950681 - RNA, 18 nt, Human herpesvirus 1
cgaguucccccggcacgc

SEQ ID NO: 3950682 - RNA, 18 nt, Human herpesvirus 1
cgaucccccgcccccggc

SEQ ID NO: 3950683 - RNA, 18 nt, Human herpesvirus 1
cgaucccgaacgacacac

SEQ ID NO: 3950684 - RNA, 18 nt, Human herpesvirus 1
cgaucugugagugucgcg

SEQ ID NO: 3950685 - RNA, 21 nt, Human herpesvirus 1
cgauucuuuuaucccacgcgu

SEQ ID NO: 3950686 - RNA, 17 nt, Human herpesvirus 1
cgcaaagccacccacgc

SEQ ID NO: 3950687 - RNA, 22 nt, Human herpesvirus 1
cgcaacaaccuggagaccaccg

SEQ ID NO: 3950688 - RNA, 17 nt, Human herpesvirus 1
cgcaaccagcugcacga

SEQ ID NO: 3950689 - RNA, 17 nt, Human herpesvirus 1
cgcaacuucccacccgg

SEQ ID NO: 3950690 - RNA, 18 nt, Human herpesvirus 1
cgcaacuucccacccgga

SEQ ID NO: 3950691 - RNA, 16 nt, Human herpesvirus 1
cgcaccaucccggguu

SEQ ID NO: 3950692 - RNA, 13 nt, Human herpesvirus 1
cgcaccgggcccc

SEQ ID NO: 3950693 - RNA, 22 nt, Human herpesvirus 1
cgcaccucgaggacacccgcgc

SEQ ID NO: 3950694 - RNA, 22 nt, Human herpesvirus 1
cgcacgcauacgggcggccacc

SEQ ID NO: 3950695 - RNA, 23 nt, Human herpesvirus 1
cgcacgcauacgggcggccaccc

SEQ ID NO: 3950696 - RNA, 21 nt, Human herpesvirus 1
cgcacgcucccaucgcgggcg

SEQ ID NO: 3950697 - RNA, 23 nt, Human herpesvirus 1
cgcacgcucccaucgcgggcgcc

SEQ ID NO: 3950698 - RNA, 22 nt, Human herpesvirus 1
cgcagacgaaaagccccgggcc

SEQ ID NO: 3950699 - RNA, 14 nt, Human herpesvirus 1
cgcagccccgcugg

SEQ ID NO: 3950700 - RNA, 21 nt, Human herpesvirus 1
cgcagccuauguucgcgggcg

SEQ ID NO: 3950701 - RNA, 16 nt, Human herpesvirus 1
cgcagccuucucccgg

SEQ ID NO: 3950702 - RNA, 14 nt, Human herpesvirus 1
cgcagcugggaccc

SEQ ID NO: 3950703 - RNA, 22 nt, Human herpesvirus 1
cgcaggugugguucggccaccg

SEQ ID NO: 3950704 - RNA, 23 nt, Human herpesvirus 1
cgcauauauacgcuuggagccag

SEQ ID NO: 3950705 - RNA, 16 nt, Human herpesvirus 1
cgcaucaagaccaccu

SEQ ID NO: 3950706 - RNA, 20 nt, Human herpesvirus 1
cgcaugaucuccggaccccc

SEQ ID NO: 3950707 - RNA, 16 nt, Human herpesvirus 1
cgccacaacagcccug

SEQ ID NO: 3950708 - RNA, 20 nt, Human herpesvirus 1
cgccacccgaaccaccacug

SEQ ID NO: 3950709 - RNA, 22 nt, Human herpesvirus 1
cgccagccuguuuguccugggg

SEQ ID NO: 3950710 - RNA, 17 nt, Human herpesvirus 1
cgccagcgcggcggggc

SEQ ID NO: 3950711 - RNA, 14 nt, Human herpesvirus 1
cgccaucaaccccg

SEQ ID NO: 3950712 - RNA, 20 nt, Human herpesvirus 1
cgcccaaugggccgggccgc

SEQ ID NO: 3950713 - RNA, 15 nt, Human herpesvirus 1
cgcccaccuccuggc

SEQ ID NO: 3950714 - RNA, 14 nt, Human herpesvirus 1
cgcccagacgcccu

SEQ ID NO: 3950715 - RNA, 20 nt, Human herpesvirus 1
cgcccagcucauucaccccg

SEQ ID NO: 3950716 - RNA, 19 nt, Human herpesvirus 1
cgccccccaaaccaugucc

SEQ ID NO: 3950717 - RNA, 14 nt, Human herpesvirus 1
cgccccccccccgu

SEQ ID NO: 3950718 - RNA, 21 nt, Human herpesvirus 1
cgccccccguggaccccacga

SEQ ID NO: 3950719 - RNA, 13 nt, Human herpesvirus 1
cgccccgauggcc

SEQ ID NO: 3950720 - RNA, 21 nt, Human herpesvirus 1
cgccccgugucugugggccaa

SEQ ID NO: 3950721 - RNA, 15 nt, Human herpesvirus 1
cgcccgaccacacac

SEQ ID NO: 3950722 - RNA, 23 nt, Human herpesvirus 1
cgcccgauuuacagcccccagau

SEQ ID NO: 3950723 - RNA, 14 nt, Human herpesvirus 1
cgcccgccccugcg

SEQ ID NO: 3950724 - RNA, 19 nt, Human herpesvirus 1
cgcccgcgacgccauggac

SEQ ID NO: 3950725 - RNA, 15 nt, Human herpesvirus 1
cgcccggcggaccca

SEQ ID NO: 3950726 - RNA, 17 nt, Human herpesvirus 1
cgcccggguccccgcgg

SEQ ID NO: 3950727 - RNA, 13 nt, Human herpesvirus 1
cgcccgucucugc

SEQ ID NO: 3950728 - RNA, 16 nt, Human herpesvirus 1
cgcccuuccccacggg

SEQ ID NO: 3950729 - RNA, 13 nt, Human herpesvirus 1
cgccgacacgcgg

SEQ ID NO: 3950730 - RNA, 22 nt, Human herpesvirus 1
cgccgagccccccgcugcggcc

SEQ ID NO: 3950731 - RNA, 13 nt, Human herpesvirus 1
cgccgccacacuc

SEQ ID NO: 3950732 - RNA, 19 nt, Human herpesvirus 1
cgccgcgacccgcacgagc

SEQ ID NO: 3950733 - RNA, 19 nt, Human herpesvirus 1
cgccgcgagauggccgccc

SEQ ID NO: 3950734 - RNA, 17 nt, Human herpesvirus 1
cgccgcgaguacguggc

SEQ ID NO: 3950735 - RNA, 15 nt, Human herpesvirus 1
cgccgcgccccgccg

SEQ ID NO: 3950736 - RNA, 21 nt, Human herpesvirus 1
cgccgcggaucgggccuuggu

SEQ ID NO: 3950737 - RNA, 21 nt, Human herpesvirus 1
cgccggcggucgcgcuccucu

SEQ ID NO: 3950738 - RNA, 13 nt, Human herpesvirus 1
cgccggggaccgc

SEQ ID NO: 3950739 - RNA, 19 nt, Human herpesvirus 1
cgccggggaccgcagccug

SEQ ID NO: 3950740 - RNA, 13 nt, Human herpesvirus 1
cgccggggcucuc

SEQ ID NO: 3950741 - RNA, 22 nt, Human herpesvirus 1
cgccggguagcguacggaccgc

SEQ ID NO: 3950742 - RNA, 18 nt, Human herpesvirus 1
cgccggguggcacgggcc

SEQ ID NO: 3950743 - RNA, 17 nt, Human herpesvirus 1
cgccgguuccucccgcu

SEQ ID NO: 3950744 - RNA, 16 nt, Human herpesvirus 1
cgccguugagccccuc

SEQ ID NO: 3950745 - RNA, 17 nt, Human herpesvirus 1
cgccuaccggccccugg

SEQ ID NO: 3950746 - RNA, 15 nt, Human herpesvirus 1
cgccucagggccucc

SEQ ID NO: 3950747 - RNA, 15 nt, Human herpesvirus 1
cgccucccccugagc

SEQ ID NO: 3950748 - RNA, 19 nt, Human herpesvirus 1
cgccucccccugagccgcu

SEQ ID NO: 3950749 - RNA, 12 nt, Human herpesvirus 1
cgccuccgcccg

SEQ ID NO: 3950750 - RNA, 14 nt, Human herpesvirus 1
cgccucggagccga

SEQ ID NO: 3950751 - RNA, 16 nt, Human herpesvirus 1
cgccucggucacccca

SEQ ID NO: 3950752 - RNA, 20 nt, Human herpesvirus 1
cgccucucgcugcuggcgga

SEQ ID NO: 3950753 - RNA, 13 nt, Human herpesvirus 1
cgccugccccgcc

SEQ ID NO: 3950754 - RNA, 19 nt, Human herpesvirus 1
cgccugcggcgaccucggc

SEQ ID NO: 3950755 - RNA, 18 nt, Human herpesvirus 1
cgccugguugcggcccgc

SEQ ID NO: 3950756 - RNA, 22 nt, Human herpesvirus 1
cgcgaagacccccccggagccg

SEQ ID NO: 3950757 - RNA, 21 nt, Human herpesvirus 1
cgcgaccaccccaaauacagc

SEQ ID NO: 3950758 - RNA, 17 nt, Human herpesvirus 1
cgcgacccgcacgagcc

SEQ ID NO: 3950759 - RNA, 16 nt, Human herpesvirus 1
cgcgagcaccugcggg

SEQ ID NO: 3950760 - RNA, 15 nt, Human herpesvirus 1
cgcgagcgaggcccc

SEQ ID NO: 3950761 - RNA, 15 nt, Human herpesvirus 1
gcaggcgccuccggg

SEQ ID NO: 3950762 - RNA, 12 nt, Human herpesvirus 1
gcagggcccgcc

SEQ ID NO: 3950763 - RNA, 22 nt, Human herpesvirus 1
gcaggugugguucggccaccgc

SEQ ID NO: 3950764 - RNA, 18 nt, Human herpesvirus 1
gcagucccugaguuggga

SEQ ID NO: 3950765 - RNA, 13 nt, Human herpesvirus 1
gcagucuccuggc

SEQ ID NO: 3950766 - RNA, 15 nt, Human herpesvirus 1
gcagucuccuggcag

SEQ ID NO: 3950767 - RNA, 16 nt, Human herpesvirus 1
gcauacgccuccccca

SEQ ID NO: 3950768 - RNA, 16 nt, Human herpesvirus 1
gcauacgcucgggccc

SEQ ID NO: 3950769 - RNA, 23 nt, Human herpesvirus 1
gcauaucccacccuggagcucaa

SEQ ID NO: 3950770 - RNA, 23 nt, Human herpesvirus 1
gcauccacccuccgcuggggccc

SEQ ID NO: 3950771 - RNA, 22 nt, Human herpesvirus 1
gcauccagggagaaaccccagc

SEQ ID NO: 3950772 - RNA, 11 nt, Human herpesvirus 1
gcaucccagga

SEQ ID NO: 3950773 - RNA, 20 nt, Human herpesvirus 1
gcauccccccgucagccugc

SEQ ID NO: 3950774 - RNA, 14 nt, Human herpesvirus 1
gcaucccccgccuu

SEQ ID NO: 3950775 - RNA, 17 nt, Human herpesvirus 1
gcaucccccgucugggu

SEQ ID NO: 3950776 - RNA, 18 nt, Human herpesvirus 1
gcaucccccgucuggguu

SEQ ID NO: 3950777 - RNA, 19 nt, Human herpesvirus 1
gcaucccccgucuggguuu

SEQ ID NO: 3950778 - RNA, 23 nt, Human herpesvirus 1
gcauccgggaccugaaccccagc

SEQ ID NO: 3950779 - RNA, 22 nt, Human herpesvirus 1
gcauccgucgggaggccacaga

SEQ ID NO: 3950780 - RNA, 20 nt, Human herpesvirus 1
gcaucgaacgcacaccccca

SEQ ID NO: 3950781 - RNA, 16 nt, Human herpesvirus 1
gcaucuucgcccgcag

SEQ ID NO: 3950782 - RNA, 21 nt, Human herpesvirus 1
gcaugaucuccggacccccgc

SEQ ID NO: 3950783 - RNA, 15 nt, Human herpesvirus 1
gcauggcgcagcugg

SEQ ID NO: 3950784 - RNA, 13 nt, Human herpesvirus 1
gcauucgggccug

SEQ ID NO: 3950785 - RNA, 17 nt, Human herpesvirus 1
gccaaacgccagccugu

SEQ ID NO: 3950786 - RNA, 12 nt, Human herpesvirus 1
gccaaauuuaug

SEQ ID NO: 3950787 - RNA, 16 nt, Human herpesvirus 1
gccaacaauccccagg

SEQ ID NO: 3950788 - RNA, 18 nt, Human herpesvirus 1
gccaacaauccccaggac

SEQ ID NO: 3950789 - RNA, 16 nt, Human herpesvirus 1
gccaacgcccugacca

SEQ ID NO: 3950790 - RNA, 15 nt, Human herpesvirus 1
gccaacgccgcgacc

SEQ ID NO: 3950791 - RNA, 16 nt, Human herpesvirus 1
gccaagauggcccagu

SEQ ID NO: 3950792 - RNA, 19 nt, Human herpesvirus 1
gccaauccgugucggggag

SEQ ID NO: 3950793 - RNA, 23 nt, Human herpesvirus 1
gccaaugcccucccugacggcca

SEQ ID NO: 3950794 - RNA, 15 nt, Human herpesvirus 1
gccacaacagcccug

SEQ ID NO: 3950795 - RNA, 12 nt, Human herpesvirus 1
gccacacccgcg

SEQ ID NO: 3950796 - RNA, 21 nt, Human herpesvirus 1
gccacacucaaaaagccccaa

SEQ ID NO: 3950797 - RNA, 20 nt, Human herpesvirus 1
gccacaggaauaccagaaua

SEQ ID NO: 3950798 - RNA, 15 nt, Human herpesvirus 1
gccacccgaaccacc

SEQ ID NO: 3950799 - RNA, 23 nt, Human herpesvirus 1
gccaccugcgcggguugcugcgc

SEQ ID NO: 3950800 - RNA, 16 nt, Human herpesvirus 1
gccagaacucgccccg

SEQ ID NO: 3950801 - RNA, 22 nt, Human herpesvirus 1
gccagaucuacugcugggccau

SEQ ID NO: 3950802 - RNA, 19 nt, Human herpesvirus 1
gccagcagacgcugcuccg

SEQ ID NO: 3950803 - RNA, 19 nt, Human herpesvirus 1
gccaggggcauccgggacc

SEQ ID NO: 3950804 - RNA, 17 nt, Human herpesvirus 1
gccaguccgcugcaccg

SEQ ID NO: 3950805 - RNA, 14 nt, Human herpesvirus 1
gccaucaaccccgc

SEQ ID NO: 3950806 - RNA, 13 nt, Human herpesvirus 1
gccauccccgcgu

SEQ ID NO: 3950807 - RNA, 15 nt, Human herpesvirus 1
gccaucgagccaacg

SEQ ID NO: 3950808 - RNA, 23 nt, Human herpesvirus 1
gccaugcgccagggcgcccccgc

SEQ ID NO: 3950809 - RNA, 17 nt, Human herpesvirus 1
gccaugcuggcggacgg

SEQ ID NO: 3950810 - RNA, 19 nt, Human herpesvirus 1
gccauguuugcgggccugg

SEQ ID NO: 3950811 - RNA, 20 nt, Human herpesvirus 1
gccauguuugcgggccuggg

SEQ ID NO: 3950812 - RNA, 11 nt, Human herpesvirus 1
gcccacccccc

SEQ ID NO: 3950813 - RNA, 16 nt, Human herpesvirus 1
gcccacccuggcgcca

SEQ ID NO: 3950814 - RNA, 19 nt, Human herpesvirus 1
gcccacgaucaccgcggga

SEQ ID NO: 3950815 - RNA, 20 nt, Human herpesvirus 1
gcccacuacaccagccaauc

SEQ ID NO: 3950816 - RNA, 20 nt, Human herpesvirus 1
gcccagaccccuucucccca

SEQ ID NO: 3950817 - RNA, 22 nt, Human herpesvirus 1
gcccauuuacguggcuggguuu

SEQ ID NO: 3950818 - RNA, 19 nt, Human herpesvirus 1
gccccaccccccgacgcca

SEQ ID NO: 3950819 - RNA, 19 nt, Human herpesvirus 1
gcccccaacaugacccaga

SEQ ID NO: 3950820 - RNA, 16 nt, Human herpesvirus 1
gcccccagaugcccac

SEQ ID NO: 3950821 - RNA, 16 nt, Human herpesvirus 1
gcccccagcugggccc

SEQ ID NO: 3950822 - RNA, 14 nt, Human herpesvirus 1
gccccccagccucc

SEQ ID NO: 3950823 - RNA, 15 nt, Human herpesvirus 1
gccccccagccuccc

SEQ ID NO: 3950824 - RNA, 17 nt, Human herpesvirus 1
gccccccgcugcggcca

SEQ ID NO: 3950825 - RNA, 19 nt, Human herpesvirus 1
gccccccguguuugugggg

SEQ ID NO: 3950826 - RNA, 20 nt, Human herpesvirus 1
gccccccuggcgagcccaga

SEQ ID NO: 3950827 - RNA, 15 nt, Human herpesvirus 1
gcccccgaggccagc

SEQ ID NO: 3950828 - RNA, 17 nt, Human herpesvirus 1
gcccccgaggccagcau

SEQ ID NO: 3950829 - RNA, 19 nt, Human herpesvirus 1
gcccccgccccucccccga

SEQ ID NO: 3950830 - RNA, 16 nt, Human herpesvirus 1
gcccccgcuuccggau

SEQ ID NO: 3950831 - RNA, 19 nt, Human herpesvirus 1
gcccccuuuguccccgccg

SEQ ID NO: 3950832 - RNA, 12 nt, Human herpesvirus 1
gccccgaccccc

SEQ ID NO: 3950833 - RNA, 15 nt, Human herpesvirus 1
gccccgacccccuug

SEQ ID NO: 3950834 - RNA, 22 nt, Human herpesvirus 1
gccccgcccccuuuguccccgc

SEQ ID NO: 3950835 - RNA, 17 nt, Human herpesvirus 1
gccccggaagaccccga

SEQ ID NO: 3950836 - RNA, 19 nt, Human herpesvirus 1
gccccggaccccacgcacc

SEQ ID NO: 3950837 - RNA, 14 nt, Human herpesvirus 1
gccccggcccccaa

SEQ ID NO: 3950838 - RNA, 16 nt, Human herpesvirus 1
gccccggccgccuggu

SEQ ID NO: 3950839 - RNA, 11 nt, Human herpesvirus 1
gccccgggccg

SEQ ID NO: 3950840 - RNA, 17 nt, Human herpesvirus 1
gccccgugucugugggc

SEQ ID NO: 3950841 - RNA, 16 nt, Human herpesvirus 1
gccccuaaccaggccu

SEQ ID NO: 3950842 - RNA, 18 nt, Human herpesvirus 1
gccccuaaccaggccucc

SEQ ID NO: 3950843 - RNA, 22 nt, Human herpesvirus 1
gccccuaaccaggccuccaccc

SEQ ID NO: 3950844 - RNA, 15 nt, Human herpesvirus 1
gccccuguggcccug

SEQ ID NO: 3950845 - RNA, 20 nt, Human herpesvirus 1
gcccgacagaccuccccgcg

SEQ ID NO: 3950846 - RNA, 17 nt, Human herpesvirus 1
gcccgaccacacacccc

SEQ ID NO: 3950847 - RNA, 19 nt, Human herpesvirus 1
gcccgaccacacacccccc

SEQ ID NO: 3950848 - RNA, 11 nt, Human herpesvirus 1
gcccgcccccc

SEQ ID NO: 3950849 - RNA, 14 nt, Human herpesvirus 1
gcccgccccucgcc

SEQ ID NO: 3950850 - RNA, 15 nt, Human herpesvirus 1
gcccgccccucgcca

SEQ ID NO: 3950851 - RNA, 15 nt, Human herpesvirus 1
gcccggaggcgcccg

SEQ ID NO: 3950852 - RNA, 18 nt, Human herpesvirus 1
gcccgggccacggcgccg

SEQ ID NO: 3950853 - RNA, 21 nt, Human herpesvirus 1
gcccgggggacucacuaccca

SEQ ID NO: 3950854 - RNA, 22 nt, Human herpesvirus 1
gcccguugcagggccuggugcu

SEQ ID NO: 3950855 - RNA, 14 nt, Human herpesvirus 1
gcccuaaccccacc

SEQ ID NO: 3950856 - RNA, 21 nt, Human herpesvirus 1
gcccuaaccccaccccugugc

SEQ ID NO: 3950857 - RNA, 17 nt, Human herpesvirus 1
gcccucccugacggcca

SEQ ID NO: 3950858 - RNA, 22 nt, Human herpesvirus 1
gcccucuuggaggaccccgugg

SEQ ID NO: 3950859 - RNA, 15 nt, Human herpesvirus 1
gcccucuuuuucuuu

SEQ ID NO: 3950860 - RNA, 16 nt, Human herpesvirus 1
gcccugagcgcccucc

SEQ ID NO: 3950861 - RNA, 14 nt, Human herpesvirus 1
gcccugaugcagga

SEQ ID NO: 3950862 - RNA, 15 nt, Human herpesvirus 1
gcccugaugcaggau

SEQ ID NO: 3950863 - RNA, 15 nt, Human herpesvirus 1
gcccuggccgaggac

SEQ ID NO: 3950864 - RNA, 18 nt, Human herpesvirus 1
gcccugguguuucugggg

SEQ ID NO: 3950865 - RNA, 19 nt, Human herpesvirus 1
gccgaccgcuucaagcagg

SEQ ID NO: 3950866 - RNA, 13 nt, Human herpesvirus 1
gccgacggcccga

SEQ ID NO: 3950867 - RNA, 22 nt, Human herpesvirus 1
gccgagcucaaaucgcauccga

SEQ ID NO: 3950868 - RNA, 22 nt, Human herpesvirus 1
gccgagucuucggggcccggcc

SEQ ID NO: 3950869 - RNA, 15 nt, Human herpesvirus 1
gccgaucccucgcga

SEQ ID NO: 3950870 - RNA, 14 nt, Human herpesvirus 1
gccgcaccgggccc

SEQ ID NO: 3950871 - RNA, 21 nt, Human herpesvirus 1
gccgccaccguggccggccug

SEQ ID NO: 3950872 - RNA, 16 nt, Human herpesvirus 1
gccgccccagcaccga

SEQ ID NO: 3950873 - RNA, 20 nt, Human herpesvirus 1
gccgcccggggccagcgcca

SEQ ID NO: 3950874 - RNA, 19 nt, Human herpesvirus 1
gccgccgaagggacucugg

SEQ ID NO: 3950875 - RNA, 16 nt, Human herpesvirus 1
gccgccgcgccccgcc

SEQ ID NO: 3950876 - RNA, 15 nt, Human herpesvirus 1
gccgccugguccccc

SEQ ID NO: 3950877 - RNA, 17 nt, Human herpesvirus 1
gccgccuggucccccgg

SEQ ID NO: 3950878 - RNA, 17 nt, Human herpesvirus 1
gccgcgcggacgacggc

SEQ ID NO: 3950879 - RNA, 15 nt, Human herpesvirus 1
gccgcgcggaggcgu

SEQ ID NO: 3950880 - RNA, 15 nt, Human herpesvirus 1
gccgcggcucccggc

SEQ ID NO: 3950881 - RNA, 13 nt, Human herpesvirus 1
gccgcgggccacg

SEQ ID NO: 3950882 - RNA, 13 nt, Human herpesvirus 1
gccgcgggccccc

SEQ ID NO: 3950883 - RNA, 15 nt, Human herpesvirus 1
gccgcgguacagauc

SEQ ID NO: 3950884 - RNA, 21 nt, Human herpesvirus 1
gccgcuggcaacucgccccac

SEQ ID NO: 3950885 - RNA, 16 nt, Human herpesvirus 1
gccggacgacgugguc

SEQ ID NO: 3950886 - RNA, 16 nt, Human herpesvirus 1
gccggcaugcacccca

SEQ ID NO: 3950887 - RNA, 18 nt, Human herpesvirus 1
gccggcaugcaccccaga

SEQ ID NO: 3950888 - RNA, 11 nt, Human herpesvirus 1
gccggccuggc

SEQ ID NO: 3950889 - RNA, 22 nt, Human herpesvirus 1
gccggcguuucugaccugcacc

SEQ ID NO: 3950890 - RNA, 17 nt, Human herpesvirus 1
gccggggagggcagggc

SEQ ID NO: 3950891 - RNA, 23 nt, Human herpesvirus 1
gccgguauggggcaugaucagac

SEQ ID NO: 3950892 - RNA, 22 nt, Human herpesvirus 1
gccgguugcgguucguucugga

SEQ ID NO: 3950893 - RNA, 18 nt, Human herpesvirus 1
gccguccucgcaccagcc

SEQ ID NO: 3950894 - RNA, 21 nt, Human herpesvirus 1
gccgucgcuccacuacgaguc

SEQ ID NO: 3950895 - RNA, 19 nt, Human herpesvirus 1
gccgucgggcgucccacac

SEQ ID NO: 3950896 - RNA, 16 nt, Human herpesvirus 1
gccgugauuccucucc

SEQ ID NO: 3950897 - RNA, 17 nt, Human herpesvirus 1
gccgugauuccucuccg

SEQ ID NO: 3950898 - RNA, 20 nt, Human herpesvirus 1
gccuacacucgacccccgcg

SEQ ID NO: 3950899 - RNA, 16 nt, Human herpesvirus 1
gccuagccgcagcaaa

SEQ ID NO: 3950900 - RNA, 16 nt, Human herpesvirus 1
gccucaacauaccccg

SEQ ID NO: 3950901 - RNA, 12 nt, Human herpesvirus 1
gccucacccacg

SEQ ID NO: 3950902 - RNA, 14 nt, Human herpesvirus 1
gccucaccugacca

SEQ ID NO: 3950903 - RNA, 19 nt, Human herpesvirus 1
aguucaccguggccuggga

SEQ ID NO: 3950904 - RNA, 21 nt, Human herpesvirus 1
aguucaccguggccugggacu

SEQ ID NO: 3950905 - RNA, 14 nt, Human herpesvirus 1
aguuuccacccccc

SEQ ID NO: 3950906 - RNA, 19 nt, Human herpesvirus 1
aguuuguggacccaaagcc

SEQ ID NO: 3950907 - RNA, 19 nt, Human herpesvirus 1
auaaauuuuacaaacagau

SEQ ID NO: 3950908 - RNA, 23 nt, Human herpesvirus 1
auaaccgaccgcagucccugagu

SEQ ID NO: 3950909 - RNA, 13 nt, Human herpesvirus 1
auaacgcacugaa

SEQ ID NO: 3950910 - RNA, 22 nt, Human herpesvirus 1
auaagcuugccguuaagaccau

SEQ ID NO: 3950911 - RNA, 13 nt, Human herpesvirus 1
auaaggccuggga

SEQ ID NO: 3950912 - RNA, 18 nt, Human herpesvirus 1
auacagcauggcgccaca

SEQ ID NO: 3950913 - RNA, 12 nt, Human herpesvirus 1
auagagcugcuc

SEQ ID NO: 3950914 - RNA, 15 nt, Human herpesvirus 1
aucaccccgcaauuu

SEQ ID NO: 3950915 - RNA, 17 nt, Human herpesvirus 1
aucacggcaaggagcgc

SEQ ID NO: 3950916 - RNA, 20 nt, Human herpesvirus 1
auccacgguggagguucugu

SEQ ID NO: 3950917 - RNA, 11 nt, Human herpesvirus 1
auccccgcucc

SEQ ID NO: 3950918 - RNA, 18 nt, Human herpesvirus 1
auccccgcucccucgacc

SEQ ID NO: 3950919 - RNA, 14 nt, Human herpesvirus 1
aucccgaggcccca

SEQ ID NO: 3950920 - RNA, 19 nt, Human herpesvirus 1
aucccggguuaauguaaau

SEQ ID NO: 3950921 - RNA, 14 nt, Human herpesvirus 1
aucgccugucuccu

SEQ ID NO: 3950922 - RNA, 18 nt, Human herpesvirus 1
aucgcgguagcccggccg

SEQ ID NO: 3950923 - RNA, 19 nt, Human herpesvirus 1
aucguccaucaccacgccc

SEQ ID NO: 3950924 - RNA, 14 nt, Human herpesvirus 1
aucgucgaggaggu

SEQ ID NO: 3950925 - RNA, 14 nt, Human herpesvirus 1
aucuccggaccccc

SEQ ID NO: 3950926 - RNA, 17 nt, Human herpesvirus 1
augaccgcccgccccuc

SEQ ID NO: 3950927 - RNA, 13 nt, Human herpesvirus 1
augagccagaccc

SEQ ID NO: 3950928 - RNA, 20 nt, Human herpesvirus 1
augcagcgccggccuccccg

SEQ ID NO: 3950929 - RNA, 23 nt, Human herpesvirus 1
augccaaguauuggacuggagga

SEQ ID NO: 3950930 - RNA, 14 nt, Human herpesvirus 1
augccccccuggcg

SEQ ID NO: 3950931 - RNA, 15 nt, Human herpesvirus 1
augccccccuggcga

SEQ ID NO: 3950932 - RNA, 21 nt, Human herpesvirus 1
augccccccuggcgagcccag

SEQ ID NO: 3950933 - RNA, 15 nt, Human herpesvirus 1
cacgccgccucggcc

SEQ ID NO: 3950934 - RNA, 22 nt, Human herpesvirus 1
cacgccuggggucgcggccgcg

SEQ ID NO: 3950935 - RNA, 11 nt, Human herpesvirus 1
cacgcgccgcc

SEQ ID NO: 3950936 - RNA, 17 nt, Human herpesvirus 1
cacgcgcgacgggcagu

SEQ ID NO: 3950937 - RNA, 23 nt, Human herpesvirus 1
cacgcgcggcugguccacaccca

SEQ ID NO: 3950938 - RNA, 17 nt, Human herpesvirus 1
cacggaacacaaggcca

SEQ ID NO: 3950939 - RNA, 18 nt, Human herpesvirus 1
cacggcgaaugcagcgcc

SEQ ID NO: 3950940 - RNA, 15 nt, Human herpesvirus 1
cacggcguggagcaa

SEQ ID NO: 3950941 - RNA, 18 nt, Human herpesvirus 1
cacggcuaccuggcccca

SEQ ID NO: 3950942 - RNA, 15 nt, Human herpesvirus 1
cacuccggcgccgcc

SEQ ID NO: 3950943 - RNA, 14 nt, Human herpesvirus 1
cacugccucccccg

SEQ ID NO: 3950944 - RNA, 19 nt, Human herpesvirus 1
cacuggccgggagcaccac

SEQ ID NO: 3950945 - RNA, 21 nt, Human herpesvirus 1
cagacauuccgcuaucuccug

SEQ ID NO: 3950946 - RNA, 17 nt, Human herpesvirus 1
cagacccaacccccggc

SEQ ID NO: 3950947 - RNA, 18 nt, Human herpesvirus 1
cagacccaacccccggcc

SEQ ID NO: 3950948 - RNA, 16 nt, Human herpesvirus 1
cagacgagcgcgcuug

SEQ ID NO: 3950949 - RNA, 15 nt, Human herpesvirus 1
cagacgcgggcgacg

SEQ ID NO: 3950950 - RNA, 22 nt, Human herpesvirus 1
cagacgguggugcccagcggcc

SEQ ID NO: 3950951 - RNA, 14 nt, Human herpesvirus 1
cagacucucgguga

SEQ ID NO: 3950952 - RNA, 15 nt, Human herpesvirus 1
cagauagccaucccc

SEQ ID NO: 3950953 - RNA, 19 nt, Human herpesvirus 1
cagauuccaaagugccccg

SEQ ID NO: 3950954 - RNA, 21 nt, Human herpesvirus 1
cagcaccuucaucgaccucaa

SEQ ID NO: 3950955 - RNA, 13 nt, Human herpesvirus 1
cagcagcucccca

SEQ ID NO: 3950956 - RNA, 15 nt, Human herpesvirus 1
cagcagguccgcggu

SEQ ID NO: 3950957 - RNA, 20 nt, Human herpesvirus 1
ggaggagccccugcccgaca

SEQ ID NO: 3950958 - RNA, 15 nt, Human herpesvirus 1
ggaggccacagaaac

SEQ ID NO: 3950959 - RNA, 20 nt, Human herpesvirus 1
ggagggcguaacguuccgcc

SEQ ID NO: 3950960 - RNA, 21 nt, Human herpesvirus 1
ggaggggaaaagugaaagaca

SEQ ID NO: 3950961 - RNA, 21 nt, Human herpesvirus 1
ggaggggggggucgggcgcug

SEQ ID NO: 3950962 - RNA, 17 nt, Human herpesvirus 1
ggagguuccggaggcgc

SEQ ID NO: 3950963 - RNA, 21 nt, Human herpesvirus 1
ggaguacgcguacucccacca

SEQ ID NO: 3950964 - RNA, 15 nt, Human herpesvirus 1
ggagucccgaggacg

SEQ ID NO: 3950965 - RNA, 22 nt, Human herpesvirus 1
ggauccgacccccauggagcac

SEQ ID NO: 3950966 - RNA, 16 nt, Human herpesvirus 1
ggauccucggccagcu

SEQ ID NO: 3950967 - RNA, 16 nt, Human herpesvirus 1
ggaucggcgccaugcu

SEQ ID NO: 3950968 - RNA, 19 nt, Human herpesvirus 1
ggaucugguccgccgcgag

SEQ ID NO: 3950969 - RNA, 20 nt, Human herpesvirus 1
ggaucuuagccuccccgggc

SEQ ID NO: 3950970 - RNA, 16 nt, Human herpesvirus 1
ggaugggcgaccuggg

SEQ ID NO: 3950971 - RNA, 11 nt, Human herpesvirus 1
ggauggggaga

SEQ ID NO: 3950972 - RNA, 15 nt, Human herpesvirus 1
ggauggggagagccc

SEQ ID NO: 3950973 - RNA, 11 nt, Human herpesvirus 1
ggauggggccc

SEQ ID NO: 3950974 - RNA, 12 nt, Human herpesvirus 1
ggcacccacgcc

SEQ ID NO: 3950975 - RNA, 16 nt, Human herpesvirus 1
ggcacguacacgggug

SEQ ID NO: 3950976 - RNA, 14 nt, Human herpesvirus 1
ggcagcccggaggc

SEQ ID NO: 3950977 - RNA, 22 nt, Human herpesvirus 1
ggcagucuccuggcagcccugg

SEQ ID NO: 3950978 - RNA, 15 nt, Human herpesvirus 1
ggcaugcaccccaga

SEQ ID NO: 3950979 - RNA, 23 nt, Human herpesvirus 1
ggcaugcaccccagagguguuca

SEQ ID NO: 3950980 - RNA, 17 nt, Human herpesvirus 1
ggccaagcuagccgagg

SEQ ID NO: 3950981 - RNA, 15 nt, Human herpesvirus 1
ggccacccccccgga

SEQ ID NO: 3950982 - RNA, 16 nt, Human herpesvirus 1
ggccacccccccggag

SEQ ID NO: 3950983 - RNA, 21 nt, Human herpesvirus 1
ggccacucacgcauccccagu

SEQ ID NO: 3950984 - RNA, 23 nt, Human herpesvirus 1
ggccaucgguccccucugggccc

SEQ ID NO: 3950985 - RNA, 19 nt, Human herpesvirus 1
ggccauggacagcgaccug

SEQ ID NO: 3950986 - RNA, 16 nt, Human herpesvirus 1
ggccauggcccgccuc

SEQ ID NO: 3950987 - RNA, 22 nt, Human herpesvirus 1
ggcccagcauguccgccgggac

SEQ ID NO: 3950988 - RNA, 19 nt, Human herpesvirus 1
ggccccacggucagucugg

SEQ ID NO: 3950989 - RNA, 21 nt, Human herpesvirus 1
ggccccaguccccaagacccc

SEQ ID NO: 3950990 - RNA, 13 nt, Human herpesvirus 1
ggcccccaggguc

SEQ ID NO: 3950991 - RNA, 18 nt, Human herpesvirus 1
ggccccgcgucuggcccc

SEQ ID NO: 3950992 - RNA, 18 nt, Human herpesvirus 1
ggccccggcaccacgggu

SEQ ID NO: 3950993 - RNA, 14 nt, Human herpesvirus 1
ggccccugggcccc

SEQ ID NO: 3950994 - RNA, 17 nt, Human herpesvirus 1
ggcccgcguuuggccug

SEQ ID NO: 3950995 - RNA, 19 nt, Human herpesvirus 1
ggcccggaacgggaggcca

SEQ ID NO: 3950996 - RNA, 18 nt, Human herpesvirus 1
ggcccggcuagacccacg

SEQ ID NO: 3950997 - RNA, 17 nt, Human herpesvirus 1
ggcccgggccacggcgc

SEQ ID NO: 3950998 - RNA, 14 nt, Human herpesvirus 1
ggcccggggccugc

SEQ ID NO: 3950999 - RNA, 23 nt, Human herpesvirus 1
ggcccgggggggcaucgcgcggg

SEQ ID NO: 3951000 - RNA, 15 nt, Human herpesvirus 1
ggcccgucgugucuu

SEQ ID NO: 3951001 - RNA, 14 nt, Human herpesvirus 1
ggcccuaaccccac

SEQ ID NO: 3951002 - RNA, 19 nt, Human herpesvirus 1
ggcccuaaccccaccccug

SEQ ID NO: 3951003 - RNA, 20 nt, Human herpesvirus 1
ggcccugccacuccggcgcc

SEQ ID NO: 3951004 - RNA, 16 nt, Human herpesvirus 1
ggcccuguaugacagc

SEQ ID NO: 3951005 - RNA, 15 nt, Human herpesvirus 1
ggccgccacccaggc

SEQ ID NO: 3951006 - RNA, 19 nt, Human herpesvirus 1
ggccgccacgcgcccgagu

SEQ ID NO: 3951007 - RNA, 18 nt, Human herpesvirus 1
ggccgccgacgaccuggu

SEQ ID NO: 3951008 - RNA, 17 nt, Human herpesvirus 1
ggccgcgguggacagcc

SEQ ID NO: 3951009 - RNA, 16 nt, Human herpesvirus 1
ggccgggcgacccaga

SEQ ID NO: 3951010 - RNA, 18 nt, Human herpesvirus 1
ggccgucccggggcaggc

SEQ ID NO: 3951011 - RNA, 22 nt, Human herpesvirus 1
ggccgugauuccucuccgcggu

SEQ ID NO: 3951012 - RNA, 20 nt, Human herpesvirus 1
ggccgugcacacgacggccu

SEQ ID NO: 3951013 - RNA, 14 nt, Human herpesvirus 1
ggccguggacggca

SEQ ID NO: 3951014 - RNA, 13 nt, Human herpesvirus 1
ggccgugugacac

SEQ ID NO: 3951015 - RNA, 18 nt, Human herpesvirus 1
ggccuaauuguccgcgca

SEQ ID NO: 3951016 - RNA, 14 nt, Human herpesvirus 1
ggccuccacccccu

SEQ ID NO: 3951017 - RNA, 23 nt, Human herpesvirus 1
ggccucgaugacgucccggcucu

SEQ ID NO: 3951018 - RNA, 15 nt, Human herpesvirus 1
ggccucuccggccug

SEQ ID NO: 3951019 - RNA, 20 nt, Human herpesvirus 1
ggccugccugcggcucgucg

SEQ ID NO: 3951020 - RNA, 15 nt, Human herpesvirus 1
ggccugggccgcgag

SEQ ID NO: 3951021 - RNA, 22 nt, Human herpesvirus 1
ggccuuguuccgcuucccggua

SEQ ID NO: 3951022 - RNA, 16 nt, Human herpesvirus 1
ggccuuuuacgagguc

SEQ ID NO: 3951023 - RNA, 15 nt, Human herpesvirus 1
ggcgaccgccagccg

SEQ ID NO: 3951024 - RNA, 21 nt, Human herpesvirus 1
ggcgaccucggcgccucugga

SEQ ID NO: 3951025 - RNA, 19 nt, Human herpesvirus 1
ggcgacgccgugggcaaug

SEQ ID NO: 3951026 - RNA, 14 nt, Human herpesvirus 1
ggcgacgugauggc

SEQ ID NO: 3951027 - RNA, 16 nt, Human herpesvirus 1
ggcgagcccagacccc

SEQ ID NO: 3951028 - RNA, 17 nt, Human herpesvirus 1
ggcgaggccggcgccga

SEQ ID NO: 3951029 - RNA, 17 nt, Human herpesvirus 1
ggcgcaauugcggccac

SEQ ID NO: 3951030 - RNA, 22 nt, Human herpesvirus 1
ggcgcauaaagggccggugguc

SEQ ID NO: 3951031 - RNA, 17 nt, Human herpesvirus 1
ggcgccacaccacgcca

SEQ ID NO: 3951032 - RNA, 18 nt, Human herpesvirus 1
ggcgccacaccacgccac

SEQ ID NO: 3951033 - RNA, 20 nt, Human herpesvirus 1
ggcgccagcguaaccuccgg

SEQ ID NO: 3951034 - RNA, 12 nt, Human herpesvirus 1
ggcgccccggcc

SEQ ID NO: 3951035 - RNA, 18 nt, Human herpesvirus 1
ggcgccgcccgccccugg

SEQ ID NO: 3951036 - RNA, 13 nt, Human herpesvirus 1
ggcgcggggcccc

SEQ ID NO: 3951037 - RNA, 23 nt, Human herpesvirus 1
ggcgcguguacugcggucugucu

SEQ ID NO: 3951038 - RNA, 21 nt, Human herpesvirus 1
ggcgcuacgaccggugcguug

SEQ ID NO: 3951039 - RNA, 16 nt, Human herpesvirus 1
ggcgcuugcgcaccug

SEQ ID NO: 3951040 - RNA, 19 nt, Human herpesvirus 1
ggcggacccccggaggcgc

SEQ ID NO: 3951041 - RNA, 12 nt, Human herpesvirus 1
ggcggaccuggc

SEQ ID NO: 3951042 - RNA, 20 nt, Human herpesvirus 1
ggcggauuuggggcgcuccu

SEQ ID NO: 3951043 - RNA, 21 nt, Human herpesvirus 1
ggcggauuuggggcgcuccug

SEQ ID NO: 3951044 - RNA, 14 nt, Human herpesvirus 1
ggcggcagcccgga

SEQ ID NO: 3951045 - RNA, 16 nt, Human herpesvirus 1
ggcggccccggccgcc

SEQ ID NO: 3951046 - RNA, 17 nt, Human herpesvirus 1
ggcggcgcuggcggcca

SEQ ID NO: 3951047 - RNA, 14 nt, Human herpesvirus 1
ggcggcgugugggg

SEQ ID NO: 3951048 - RNA, 23 nt, Human herpesvirus 1
ggcgggacucugggcguggugcg

SEQ ID NO: 3951049 - RNA, 20 nt, Human herpesvirus 1
ggcggggccuuggcggccgc

SEQ ID NO: 3951050 - RNA, 17 nt, Human herpesvirus 1
ggcgggggauggggaga

SEQ ID NO: 3951051 - RNA, 10 nt, Human herpesvirus 1
ggcgguggua

SEQ ID NO: 3951052 - RNA, 20 nt, Human herpesvirus 1
ggcgucuccucugggggcga

SEQ ID NO: 3951053 - RNA, 15 nt, Human herpesvirus 1
ggcgucugggccacc

SEQ ID NO: 3951054 - RNA, 19 nt, Human herpesvirus 1
ggcuuccgacgccccccgu

SEQ ID NO: 3951055 - RNA, 16 nt, Human herpesvirus 1
gggaccugaaccccag

SEQ ID NO: 3951056 - RNA, 15 nt, Human herpesvirus 1
gggagaaaccccagc

SEQ ID NO: 3951057 - RNA, 18 nt, Human herpesvirus 1
gggagaacaacgagcugc

SEQ ID NO: 3951058 - RNA, 14 nt, Human herpesvirus 1
gggagccccggguu

SEQ ID NO: 3951059 - RNA, 16 nt, Human herpesvirus 1
gggagcgcucuugucu

SEQ ID NO: 3951060 - RNA, 13 nt, Human herpesvirus 1
gggaugcugcccc

SEQ ID NO: 3951061 - RNA, 21 nt, Human herpesvirus 1
gggccccgggacaccccccau

SEQ ID NO: 3951062 - RNA, 13 nt, Human herpesvirus 1
gggcccgccugga

SEQ ID NO: 3951063 - RNA, 15 nt, Human herpesvirus 1
gggccgggccccaua

SEQ ID NO: 3951064 - RNA, 22 nt, Human herpesvirus 1
gggccgugcgauggacaccgca

SEQ ID NO: 3951065 - RNA, 19 nt, Human herpesvirus 1
gggccguuucccaccccca

SEQ ID NO: 3951066 - RNA, 16 nt, Human herpesvirus 1
gggccuugccgugguc

SEQ ID NO: 3951067 - RNA, 20 nt, Human herpesvirus 1
gggcgccucggucaccccaa

SEQ ID NO: 3951068 - RNA, 16 nt, Human herpesvirus 1
gggcgcggcgcgacaa

SEQ ID NO: 3951069 - RNA, 20 nt, Human herpesvirus 1
gggcgcuuggcaugcgcggg

SEQ ID NO: 3951070 - RNA, 17 nt, Human herpesvirus 1
gggcgcuuggucgggag

SEQ ID NO: 3951071 - RNA, 21 nt, Human herpesvirus 1
gggcgggggauggggagagcc

SEQ ID NO: 3951072 - RNA, 15 nt, Human herpesvirus 1
gugguauuccugccg

SEQ ID NO: 3951073 - RNA, 16 nt, Human herpesvirus 1
gugguccgccuagccg

SEQ ID NO: 3951074 - RNA, 16 nt, Human herpesvirus 1
guggucucuggccgcg

SEQ ID NO: 3951075 - RNA, 19 nt, Human herpesvirus 1
guguaugucuggugugugg

SEQ ID NO: 3951076 - RNA, 21 nt, Human herpesvirus 1
guuaacugucuggagacccua

SEQ ID NO: 3951077 - RNA, 15 nt, Human herpesvirus 1
guuacucggcccccg

SEQ ID NO: 3951078 - RNA, 13 nt, Human herpesvirus 1
guuauaggccacg

SEQ ID NO: 3951079 - RNA, 13 nt, Human herpesvirus 1
guucaaccccagg

SEQ ID NO: 3951080 - RNA, 18 nt, Human herpesvirus 1
guuccgggaugccgugcc

SEQ ID NO: 3951081 - RNA, 14 nt, Human herpesvirus 1
guuccguuuggaaa

SEQ ID NO: 3951082 - RNA, 13 nt, Human herpesvirus 1
guucggggccgcc

SEQ ID NO: 3951083 - RNA, 14 nt, Human herpesvirus 1
guucugcugcaccg

SEQ ID NO: 3951084 - RNA, 14 nt, Human herpesvirus 1
guugcagggccugg

SEQ ID NO: 3951085 - RNA, 14 nt, Human herpesvirus 1
guuggcccccgccu

SEQ ID NO: 3951086 - RNA, 14 nt, Human herpesvirus 1
guuucagauagagc

SEQ ID NO: 3951087 - RNA, 14 nt, Human herpesvirus 1
guuugcccauaaua

SEQ ID NO: 3951088 - RNA, 21 nt, Human herpesvirus 1
guuugggagagccggccccgg

SEQ ID NO: 3951089 - RNA, 16 nt, Human herpesvirus 1
uaaagccgccacccuc

SEQ ID NO: 3951090 - RNA, 14 nt, Human herpesvirus 1
uaaauuauugcuac

SEQ ID NO: 3951091 - RNA, 17 nt, Human herpesvirus 1
uaacaaccacccgcacc

SEQ ID NO: 3951092 - RNA, 23 nt, Human herpesvirus 1
uaaccgcaccccccucguccccc

SEQ ID NO: 3951093 - RNA, 17 nt, Human herpesvirus 1
uaaccgcgagcgccgcu

SEQ ID NO: 3951094 - RNA, 22 nt, Human herpesvirus 1
uaagcgucccugggcccuggcc

SEQ ID NO: 3951095 - RNA, 16 nt, Human herpesvirus 1
uacaaccccucgcggg

SEQ ID NO: 3951096 - RNA, 22 nt, Human herpesvirus 1
uacacucgcgcguguacaacau

SEQ ID NO: 3951097 - RNA, 12 nt, Human herpesvirus 1
uacauggcccug

SEQ ID NO: 3951098 - RNA, 18 nt, Human herpesvirus 1
uaccccaguccccgggcc

SEQ ID NO: 3951099 - RNA, 18 nt, Human herpesvirus 1
uaccggaaggaacccgcg

SEQ ID NO: 3951100 - RNA, 16 nt, Human herpesvirus 1
uacgcggggcuguacu

SEQ ID NO: 3951101 - RNA, 18 nt, Human herpesvirus 1
uacgcuaaucccccggcu

SEQ ID NO: 3951102 - RNA, 16 nt, Human herpesvirus 1
uacgcuuggagccagc

SEQ ID NO: 3951103 - RNA, 12 nt, Human herpesvirus 1
uacggcggcucc

SEQ ID NO: 3951104 - RNA, 17 nt, Human herpesvirus 1
uacgggcuguuccgcca

SEQ ID NO: 3951105 - RNA, 14 nt, Human herpesvirus 1
uacucgacccacug

SEQ ID NO: 3951106 - RNA, 12 nt, Human herpesvirus 1
uagagacagccg

SEQ ID NO: 3951107 - RNA, 14 nt, Human herpesvirus 1
uagccuccccgggc

SEQ ID NO: 3951108 - RNA, 15 nt, Human herpesvirus 1
uagccuccccgggcc

SEQ ID NO: 3951109 - RNA, 12 nt, Human herpesvirus 1
uagcgggggacg

SEQ ID NO: 3951110 - RNA, 20 nt, Human herpesvirus 1
uaggagacaccuuggcccug

SEQ ID NO: 3951111 - RNA, 18 nt, Human herpesvirus 1
uagucccaucccccgauc

SEQ ID NO: 3951112 - RNA, 21 nt, Human herpesvirus 1
uauagccuaugccacgccagg

SEQ ID NO: 3951113 - RNA, 23 nt, Human herpesvirus 1
uaucuccugggggcacccacgcc

SEQ ID NO: 3951114 - RNA, 13 nt, Human herpesvirus 1
ucaacauaccccg

SEQ ID NO: 3951115 - RNA, 19 nt, Human herpesvirus 1
ucaacgauauguugggccg

SEQ ID NO: 3951116 - RNA, 20 nt, Human herpesvirus 1
ucaaggacagcggccugcug

SEQ ID NO: 3951117 - RNA, 17 nt, Human herpesvirus 1
ucaaggugggccagccg

SEQ ID NO: 3951118 - RNA, 12 nt, Human herpesvirus 1
ucaaucuggccc

SEQ ID NO: 3951119 - RNA, 14 nt, Human herpesvirus 1
ucacagccccgcau

SEQ ID NO: 3951120 - RNA, 20 nt, Human herpesvirus 1
ucaccaccaaggcccgggcc

SEQ ID NO: 3951121 - RNA, 20 nt, Human herpesvirus 1
ucaccgggacgaccacgaga

SEQ ID NO: 3951122 - RNA, 17 nt, Human herpesvirus 1
ucaccgguuuccgcgac

SEQ ID NO: 3951123 - RNA, 15 nt, Human herpesvirus 1
ucacgcacgccaaug

SEQ ID NO: 3951124 - RNA, 22 nt, Human herpesvirus 1
ucacgcgggaggccgcccagcu

SEQ ID NO: 3951125 - RNA, 16 nt, Human herpesvirus 1
ucacggcuaccuggcc

SEQ ID NO: 3951126 - RNA, 21 nt, Human herpesvirus 1
ucacggcuaccuggccccagu

SEQ ID NO: 3951127 - RNA, 15 nt, Human herpesvirus 1
ucagccgggacgagg

SEQ ID NO: 3951128 - RNA, 16 nt, Human herpesvirus 1
ucauagugggccucca

SEQ ID NO: 3951129 - RNA, 14 nt, Human herpesvirus 1
ucaucagccgggac

SEQ ID NO: 3951130 - RNA, 14 nt, Human herpesvirus 1
ucauccacaccuua

SEQ ID NO: 3951131 - RNA, 12 nt, Human herpesvirus 1
ucaucccacccc

SEQ ID NO: 3951132 - RNA, 20 nt, Human herpesvirus 1
ucaucgaccucaacaucacc

SEQ ID NO: 3951133 - RNA, 20 nt, Human herpesvirus 1
ucaugcgcaagcgccgcaac

SEQ ID NO: 3951134 - RNA, 21 nt, Human herpesvirus 1
uccaccacccaaccccaacuc

SEQ ID NO: 3951135 - RNA, 13 nt, Human herpesvirus 1
uccacggccaagu

SEQ ID NO: 3951136 - RNA, 17 nt, Human herpesvirus 1
uccagagggcaacgcgg

SEQ ID NO: 3951137 - RNA, 13 nt, Human herpesvirus 1
uccagcacacccc

SEQ ID NO: 3951138 - RNA, 18 nt, Human herpesvirus 1
uccagccuccccuccagg

SEQ ID NO: 3951139 - RNA, 19 nt, Human herpesvirus 1
uccagccuccccuccaggu

SEQ ID NO: 3951140 - RNA, 22 nt, Human herpesvirus 1
uccaggcugucgacgcccccuc

SEQ ID NO: 3951141 - RNA, 20 nt, Human herpesvirus 1
uccagggagaaaccccagca

SEQ ID NO: 3951142 - RNA, 19 nt, Human herpesvirus 1
uccagggggaugcuagccu

SEQ ID NO: 3951143 - RNA, 16 nt, Human herpesvirus 1
ucccagcggcacgacc

SEQ ID NO: 3951144 - RNA, 10 nt, Human herpesvirus 1
ucccaggacu

SEQ ID NO: 3951145 - RNA, 17 nt, Human herpesvirus 1
ucccaggaucacaccgg

SEQ ID NO: 3951146 - RNA, 11 nt, Human herpesvirus 1
ucccagggagc

SEQ ID NO: 3951147 - RNA, 17 nt, Human herpesvirus 1
uccccaaaauaaaagac

SEQ ID NO: 3951148 - RNA, 13 nt, Human herpesvirus 1
ucccccccaucac

SEQ ID NO: 3951149 - RNA, 15 nt, Human herpesvirus 1
ucccccgaccucgcc

SEQ ID NO: 3951150 - RNA, 18 nt, Human herpesvirus 1
ucccccgucuggguuuuc

SEQ ID NO: 3951151 - RNA, 21 nt, Human herpesvirus 1
ucccccuccgcaucccaggau

SEQ ID NO: 3951152 - RNA, 20 nt, Human herpesvirus 1
uccccgaggaccccgugggc

SEQ ID NO: 3951153 - RNA, 13 nt, Human herpesvirus 1
uccccuucccucc

SEQ ID NO: 3951154 - RNA, 21 nt, Human herpesvirus 1
uccccuucccucccccuccgc

SEQ ID NO: 3951155 - RNA, 14 nt, Human herpesvirus 1
ucccgaaccaggcc

SEQ ID NO: 3951156 - RNA, 22 nt, Human herpesvirus 1
ucccgacaccaccagcuggcau

SEQ ID NO: 3951157 - RNA, 23 nt, Human herpesvirus 1
ucccgccaacacccccuuccccc

SEQ ID NO: 3951158 - RNA, 20 nt, Human herpesvirus 1
ucccgcccaccggaagccca

SEQ ID NO: 3951159 - RNA, 24 nt, Human herpesvirus 1
ucccgcugcgcauccccccgucag

SEQ ID NO: 3951160 - RNA, 17 nt, Human herpesvirus 1
ucccucccccuccgcau

SEQ ID NO: 3951161 - RNA, 16 nt, Human herpesvirus 1
ucccugucgccuccca

SEQ ID NO: 3951162 - RNA, 17 nt, Human herpesvirus 1
ucccugucgccucccaa

SEQ ID NO: 3951163 - RNA, 20 nt, Human herpesvirus 1
ucccuguuugucgccuggcu

SEQ ID NO: 3951164 - RNA, 16 nt, Human herpesvirus 1
uccgagggccgggccc

SEQ ID NO: 3951165 - RNA, 21 nt, Human herpesvirus 1
uccgcaagccccuagccccgc

SEQ ID NO: 3951166 - RNA, 23 nt, Human herpesvirus 1
uccgccaacgcacuguggcucuc

SEQ ID NO: 3951167 - RNA, 18 nt, Human herpesvirus 1
uccgcccgugcugccguc

SEQ ID NO: 3951168 - RNA, 21 nt, Human herpesvirus 1
uccgccgagucuucggggccc

SEQ ID NO: 3951169 - RNA, 21 nt, Human herpesvirus 1
uccgccuggccugcgaggugc

SEQ ID NO: 3951170 - RNA, 19 nt, Human herpesvirus 1
uccgcgacccaccgggccc

SEQ ID NO: 3951171 - RNA, 21 nt, Human herpesvirus 1
uccgcggggccucccccggac

SEQ ID NO: 3951172 - RNA, 23 nt, Human herpesvirus 1
uccgcuuccaucgccccuggcgc

SEQ ID NO: 3951173 - RNA, 19 nt, Human herpesvirus 1
uccggagaucuauaaggcc

SEQ ID NO: 3951174 - RNA, 19 nt, Human herpesvirus 1
uccggcacggacccaaaau

SEQ ID NO: 3951175 - RNA, 19 nt, Human herpesvirus 1
uccggccucgaugacgucc

SEQ ID NO: 3951176 - RNA, 18 nt, Human herpesvirus 1
uccggcgcguguaccaca

SEQ ID NO: 3951177 - RNA, 17 nt, Human herpesvirus 1
uccggcgggagccaccc

SEQ ID NO: 3951178 - RNA, 16 nt, Human herpesvirus 1
uccgggagggcgucgc

SEQ ID NO: 3951179 - RNA, 22 nt, Human herpesvirus 1
uccgguccuggaccagcugacc

SEQ ID NO: 3951180 - RNA, 14 nt, Human herpesvirus 1
uccguggccccggc

SEQ ID NO: 3951181 - RNA, 16 nt, Human herpesvirus 1
uccucgcaccagcccu

SEQ ID NO: 3951182 - RNA, 14 nt, Human herpesvirus 1
uccucguggccguu

SEQ ID NO: 3951183 - RNA, 15 nt, Human herpesvirus 1
uccuggaccagcuga

SEQ ID NO: 3951184 - RNA, 18 nt, Human herpesvirus 1
uccugggccaccugacgc

SEQ ID NO: 3951185 - RNA, 12 nt, Human herpesvirus 1
uccugucccugc

SEQ ID NO: 3951186 - RNA, 18 nt, Human herpesvirus 1
ucgaaacuuaacacacca

SEQ ID NO: 3951187 - RNA, 19 nt, Human herpesvirus 1
uggaucuuagccuccccgg

SEQ ID NO: 3951188 - RNA, 16 nt, Human herpesvirus 1
uggcccccggacccgg

SEQ ID NO: 3951189 - RNA, 20 nt, Human herpesvirus 1
uggcccccggacccgggccg

SEQ ID NO: 3951190 - RNA, 15 nt, Human herpesvirus 1
uggcccuggcucccg

SEQ ID NO: 3951191 - RNA, 20 nt, Human herpesvirus 1
uggccgacaacugccugacc

SEQ ID NO: 3951192 - RNA, 21 nt, Human herpesvirus 1
uggccgcucccaaccgcgacc

SEQ ID NO: 3951193 - RNA, 15 nt, Human herpesvirus 1
uggccggggagggca

SEQ ID NO: 3951194 - RNA, 17 nt, Human herpesvirus 1
accacgccccuuucccc

SEQ ID NO: 3951195 - RNA, 20 nt, Human herpesvirus 1
accacgcccgaccacacacc

SEQ ID NO: 3951196 - RNA, 21 nt, Human herpesvirus 1
accacguacggcucgcggguc

SEQ ID NO: 3951197 - RNA, 21 nt, Human herpesvirus 1
accacguuucggcguguguuu

SEQ ID NO: 3951198 - RNA, 19 nt, Human herpesvirus 1
accacugcacucccugccg

SEQ ID NO: 3951199 - RNA, 13 nt, Human herpesvirus 1
accagguccccca

SEQ ID NO: 3951200 - RNA, 20 nt, Human herpesvirus 1
accaggucccccacaccacc

SEQ ID NO: 3951201 - RNA, 20 nt, Human herpesvirus 1
accauggccccccgcgucca

SEQ ID NO: 3951202 - RNA, 12 nt, Human herpesvirus 1
acccaaccccaa

SEQ ID NO: 3951203 - RNA, 15 nt, Human herpesvirus 1
acccaagccgggacu

SEQ ID NO: 3951204 - RNA, 16 nt, Human herpesvirus 1
acccacccaccaagac

SEQ ID NO: 3951205 - RNA, 17 nt, Human herpesvirus 1
acccagaccccgggcgc

SEQ ID NO: 3951206 - RNA, 18 nt, Human herpesvirus 1
acccagaccggcaccacc

SEQ ID NO: 3951207 - RNA, 19 nt, Human herpesvirus 1
acccagccuuuaacuacau

SEQ ID NO: 3951208 - RNA, 19 nt, Human herpesvirus 1
acccaguggcuccgggcca

SEQ ID NO: 3951209 - RNA, 14 nt, Human herpesvirus 1
accccaacgccucc

SEQ ID NO: 3951210 - RNA, 16 nt, Human herpesvirus 1
accccaacuccagacc

SEQ ID NO: 3951211 - RNA, 15 nt, Human herpesvirus 1
accccacgacaccca

SEQ ID NO: 3951212 - RNA, 14 nt, Human herpesvirus 1
accccagggaccuc

SEQ ID NO: 3951213 - RNA, 20 nt, Human herpesvirus 1
acccccaucuaaugccacgc

SEQ ID NO: 3951214 - RNA, 23 nt, Human herpesvirus 1
accccccaccauuaucgggccgc

SEQ ID NO: 3951215 - RNA, 19 nt, Human herpesvirus 1
acccccgaguucccccggg

SEQ ID NO: 3951216 - RNA, 11 nt, Human herpesvirus 1
acccccggccc

SEQ ID NO: 3951217 - RNA, 18 nt, Human herpesvirus 1
acccccgggcuacacggc

SEQ ID NO: 3951218 - RNA, 21 nt, Human herpesvirus 1
acccccucgaccaccaccucc

SEQ ID NO: 3951219 - RNA, 17 nt, Human herpesvirus 1
accccgaagccccggcc

SEQ ID NO: 3951220 - RNA, 23 nt, Human herpesvirus 1
accccgagaaccuagggaaccca

SEQ ID NO: 3951221 - RNA, 18 nt, Human herpesvirus 1
accccgcaauuugcaccc

SEQ ID NO: 3951222 - RNA, 21 nt, Human herpesvirus 1
accccgcaauuugcacccagc

SEQ ID NO: 3951223 - RNA, 19 nt, Human herpesvirus 1
accccgcuccugugcaccc

SEQ ID NO: 3951224 - RNA, 21 nt, Human herpesvirus 1
accccggagggcugccagacc

SEQ ID NO: 3951225 - RNA, 20 nt, Human herpesvirus 1
accccggggcucagccagac

SEQ ID NO: 3951226 - RNA, 19 nt, Human herpesvirus 1
accccggucucccagggag

SEQ ID NO: 3951227 - RNA, 22 nt, Human herpesvirus 1
accccgugggcgacugcgaccc

SEQ ID NO: 3951228 - RNA, 22 nt, Human herpesvirus 1
accccucguggccccgacagcc

SEQ ID NO: 3951229 - RNA, 21 nt, Human herpesvirus 1
accccuuuggggcgcuggccg

SEQ ID NO: 3951230 - RNA, 20 nt, Human herpesvirus 1
acccgacaacagcccccggg

SEQ ID NO: 3951231 - RNA, 21 nt, Human herpesvirus 1
acccgcaacgcgcuggggcug

SEQ ID NO: 3951232 - RNA, 13 nt, Human herpesvirus 1
acccgccacgaga

SEQ ID NO: 3951233 - RNA, 15 nt, Human herpesvirus 1
acccgccccuccauc

SEQ ID NO: 3951234 - RNA, 20 nt, Human herpesvirus 1
acccgggccguuucccaccc

SEQ ID NO: 3951235 - RNA, 16 nt, Human herpesvirus 1
acccguguuugcccau

SEQ ID NO: 3951236 - RNA, 19 nt, Human herpesvirus 1
acccuaugguacacacggg

SEQ ID NO: 3951237 - RNA, 17 nt, Human herpesvirus 1
acccucucuucucuccc

SEQ ID NO: 3951238 - RNA, 14 nt, Human herpesvirus 1
acccugcugccccc

SEQ ID NO: 3951239 - RNA, 23 nt, Human herpesvirus 1
accgaagaggugcugccgccgcg

SEQ ID NO: 3951240 - RNA, 20 nt, Human herpesvirus 1
accgaccgcagucccugagu

SEQ ID NO: 3951241 - RNA, 22 nt, Human herpesvirus 1
accgcagacgaaaagccccggg

SEQ ID NO: 3951242 - RNA, 13 nt, Human herpesvirus 1
accgcagucccug

SEQ ID NO: 3951243 - RNA, 16 nt, Human herpesvirus 1
accgcagucccugagu

SEQ ID NO: 3951244 - RNA, 15 nt, Human herpesvirus 1
accgcaucuucgccc

SEQ ID NO: 3951245 - RNA, 19 nt, Human herpesvirus 1
accgccaacaauccccagg

SEQ ID NO: 3951246 - RNA, 15 nt, Human herpesvirus 1
accgcgcccucgcca

SEQ ID NO: 3951247 - RNA, 22 nt, Human herpesvirus 1
accgcguguuccccgggagccc

SEQ ID NO: 3951248 - RNA, 15 nt, Human herpesvirus 1
accggaaggaacccg

SEQ ID NO: 3951249 - RNA, 12 nt, Human herpesvirus 1
accgguccccgg

SEQ ID NO: 3951250 - RNA, 15 nt, Human herpesvirus 1
accguggccggccug

SEQ ID NO: 3951251 - RNA, 16 nt, Human herpesvirus 1
accucaacaucaccau

SEQ ID NO: 3951252 - RNA, 16 nt, Human herpesvirus 1
accuccacccccucga

SEQ ID NO: 3951253 - RNA, 16 nt, Human herpesvirus 1
accucccagugucccg

SEQ ID NO: 3951254 - RNA, 19 nt, Human herpesvirus 1
accuccuccgacgcccagc

SEQ ID NO: 3951255 - RNA, 18 nt, Human herpesvirus 1
accucggcgggcacgcca

SEQ ID NO: 3951256 - RNA, 12 nt, Human herpesvirus 1
accugcaccacc

SEQ ID NO: 3951257 - RNA, 20 nt, Human herpesvirus 1
accugcgcggguugcugcgc

SEQ ID NO: 3951258 - RNA, 21 nt, Human herpesvirus 1
accugcucacgacccccaagu

SEQ ID NO: 3951259 - RNA, 18 nt, Human herpesvirus 1
accugggggacugcaucg

SEQ ID NO: 3951260 - RNA, 17 nt, Human herpesvirus 1
acgacccgaagcugcuc

SEQ ID NO: 3951261 - RNA, 18 nt, Human herpesvirus 1
acgacgacgacgcccgcc

SEQ ID NO: 3951262 - RNA, 14 nt, Human herpesvirus 1
acgacgcccgccgc

SEQ ID NO: 3951263 - RNA, 13 nt, Human herpesvirus 1
acgacggccucgu

SEQ ID NO: 3951264 - RNA, 19 nt, Human herpesvirus 1
acgacggcggcgaggccgg

SEQ ID NO: 3951265 - RNA, 17 nt, Human herpesvirus 1
acgagcccccgccccuc

SEQ ID NO: 3951266 - RNA, 13 nt, Human herpesvirus 1
acgaggacgacga

SEQ ID NO: 3951267 - RNA, 15 nt, Human herpesvirus 1
acgaguccauccugc

SEQ ID NO: 3951268 - RNA, 17 nt, Human herpesvirus 1
acgcaaaaccaggccga

SEQ ID NO: 3951269 - RNA, 22 nt, Human herpesvirus 1
acgcacaugggggaggugcccc

SEQ ID NO: 3951270 - RNA, 13 nt, Human herpesvirus 1
acgcaccccccgc

SEQ ID NO: 3951271 - RNA, 15 nt, Human herpesvirus 1
acgcccagcagcucc

SEQ ID NO: 3951272 - RNA, 12 nt, Human herpesvirus 1
acgcccccgccg

SEQ ID NO: 3951273 - RNA, 21 nt, Human herpesvirus 1
acgcccccgccgcccggggcc

SEQ ID NO: 3951274 - RNA, 14 nt, Human herpesvirus 1
acgccccuuucccc

SEQ ID NO: 3951275 - RNA, 15 nt, Human herpesvirus 1
acgccgccucggccc

SEQ ID NO: 3951276 - RNA, 19 nt, Human herpesvirus 1
acgccguggcgccccggcc

SEQ ID NO: 3951277 - RNA, 17 nt, Human herpesvirus 1
acgccucccccugagcc

SEQ ID NO: 3951278 - RNA, 23 nt, Human herpesvirus 1
acgccuccgcccgugcugccguc

SEQ ID NO: 3951279 - RNA, 14 nt, Human herpesvirus 1
acgcgaaggacgcc

SEQ ID NO: 3951280 - RNA, 19 nt, Human herpesvirus 1
acgcgccaaacgccagccu

SEQ ID NO: 3951281 - RNA, 13 nt, Human herpesvirus 1
acgcgcggcuggu

SEQ ID NO: 3951282 - RNA, 15 nt, Human herpesvirus 1
acgcgggaggccgcc

SEQ ID NO: 3951283 - RNA, 17 nt, Human herpesvirus 1
acgcuaaucccccggcu

SEQ ID NO: 3951284 - RNA, 19 nt, Human herpesvirus 1
acggacccaaaauaauaaa

SEQ ID NO: 3951285 - RNA, 11 nt, Human herpesvirus 1
acggcaaggag

SEQ ID NO: 3951286 - RNA, 14 nt, Human herpesvirus 1
acggcacgcccccu

SEQ ID NO: 3951287 - RNA, 19 nt, Human herpesvirus 1
acggcauucgggccugccu

SEQ ID NO: 3951288 - RNA, 24 nt, Human herpesvirus 1
acggcauucgggccugccugcggc

SEQ ID NO: 3951289 - RNA, 16 nt, Human herpesvirus 1
acggccacuggccggg

SEQ ID NO: 3951290 - RNA, 18 nt, Human herpesvirus 1
acggccacuggccgggag

SEQ ID NO: 3951291 - RNA, 16 nt, Human herpesvirus 1
acggccguugucuccc

SEQ ID NO: 3951292 - RNA, 17 nt, Human herpesvirus 1
acggcgaaugcagcgcc

SEQ ID NO: 3951293 - RNA, 22 nt, Human herpesvirus 1
acgggcggccacccccccggag

SEQ ID NO: 3951294 - RNA, 20 nt, Human herpesvirus 1
acgggcuguuccgccaggcg

SEQ ID NO: 3951295 - RNA, 19 nt, Human herpesvirus 1
acggggaccgggacugggu

SEQ ID NO: 3951296 - RNA, 22 nt, Human herpesvirus 1
acggggauggucggggcguccc

SEQ ID NO: 3951297 - RNA, 23 nt, Human herpesvirus 1
acgggggcccugccacuccggcg

SEQ ID NO: 3951298 - RNA, 16 nt, Human herpesvirus 1
acggguguggggaccc

SEQ ID NO: 3951299 - RNA, 20 nt, Human herpesvirus 1
acgguacauggcccuggugu

SEQ ID NO: 3951300 - RNA, 15 nt, Human herpesvirus 1
acggucacccugcug

SEQ ID NO: 3951301 - RNA, 16 nt, Human herpesvirus 1
acgucaugcggcugca

SEQ ID NO: 3951302 - RNA, 12 nt, Human herpesvirus 1
acguccuuuggg

SEQ ID NO: 3951303 - RNA, 16 nt, Human herpesvirus 1
acgugcacagccuggc

SEQ ID NO: 3951304 - RNA, 16 nt, Human herpesvirus 1
acgugcgauucagcgc

SEQ ID NO: 3951305 - RNA, 21 nt, Human herpesvirus 1
acgugcgcaacaaccuggaga

SEQ ID NO: 3951306 - RNA, 17 nt, Human herpesvirus 1
acgugcugcugcggccc

SEQ ID NO: 3951307 - RNA, 17 nt, Human herpesvirus 1
acuaagcgucccugggc

SEQ ID NO: 3951308 - RNA, 22 nt, Human herpesvirus 1
cggcacgccuggggucgcggcc

SEQ ID NO: 3951309 - RNA, 16 nt, Human herpesvirus 1
cggcacuuucugacgc

SEQ ID NO: 3951310 - RNA, 13 nt, Human herpesvirus 1
ggacgggguuccc

SEQ ID NO: 3951311 - RNA, 20 nt, Human herpesvirus 1
ggacugguuggaagcgcggg

SEQ ID NO: 3951312 - RNA, 15 nt, Human herpesvirus 1
ggagacagcgccugc

SEQ ID NO: 3951313 - RNA, 20 nt, Human herpesvirus 1
ggagagacgauggcaggagc

SEQ ID NO: 3951314 - RNA, 14 nt, Human herpesvirus 1
ggagagcccacaug

SEQ ID NO: 3951315 - RNA, 17 nt, Human herpesvirus 1
ggagagccggccccggc

SEQ ID NO: 3951316 - RNA, 13 nt, Human herpesvirus 1
ggagcccgcccuu

SEQ ID NO: 3951317 - RNA, 15 nt, Human herpesvirus 1
ggagccugagcuggc

SEQ ID NO: 3951318 - RNA, 15 nt, Human herpesvirus 1
ggagcucccgggagc

SEQ ID NO: 3951319 - RNA, 17 nt, Human herpesvirus 1
ggaggaaacccccgacc

SEQ ID NO: 3951320 - RNA, 18 nt, Human herpesvirus 1
ggaggccgcaucgaacgc

SEQ ID NO: 3951321 - RNA, 16 nt, Human herpesvirus 1
ggaggcgccgcgcgga

SEQ ID NO: 3951322 - RNA, 22 nt, Human herpesvirus 1
ggagggcgccucggucacccca

SEQ ID NO: 3951323 - RNA, 15 nt, Human herpesvirus 1
ggagggcggccagcc

SEQ ID NO: 3951324 - RNA, 12 nt, Human herpesvirus 1
ggaggggcuccu

SEQ ID NO: 3951325 - RNA, 23 nt, Human herpesvirus 1
ggaggugcuucuguuuggcgccc

SEQ ID NO: 3951326 - RNA, 21 nt, Human herpesvirus 1
ggauacacaaacuuccccccc

SEQ ID NO: 3951327 - RNA, 14 nt, Human herpesvirus 1
ggauccgaccccca

SEQ ID NO: 3951328 - RNA, 18 nt, Human herpesvirus 1
ggaucugguccgccgcga

SEQ ID NO: 3951329 - RNA, 15 nt, Human herpesvirus 1
ggaugcugccccgcu

SEQ ID NO: 3951330 - RNA, 20 nt, Human herpesvirus 1
ggauggagagcgaaggcugc

SEQ ID NO: 3951331 - RNA, 15 nt, Human herpesvirus 1
ggauuuggguugggg

SEQ ID NO: 3951332 - RNA, 23 nt, Human herpesvirus 1
ggcacaccgguccccggaggcgu

SEQ ID NO: 3951333 - RNA, 13 nt, Human herpesvirus 1
ggcacggacccaa

SEQ ID NO: 3951334 - RNA, 12 nt, Human herpesvirus 1
ggcagcuggggg

SEQ ID NO: 3951335 - RNA, 18 nt, Human herpesvirus 1
ggcagugaggguggcaug

SEQ ID NO: 3951336 - RNA, 23 nt, Human herpesvirus 1
ggccagaucuacugcugggccau

SEQ ID NO: 3951337 - RNA, 22 nt, Human herpesvirus 1
ggccaucgguccccucugggcc

SEQ ID NO: 3951338 - RNA, 20 nt, Human herpesvirus 1
ggcccagcauguccgccggg

SEQ ID NO: 3951339 - RNA, 11 nt, Human herpesvirus 1
ggccccacggu

SEQ ID NO: 3951340 - RNA, 13 nt, Human herpesvirus 1
ggccccacgguca

SEQ ID NO: 3951341 - RNA, 21 nt, Human herpesvirus 1
ggccccccgcguccaaaccca

SEQ ID NO: 3951342 - RNA, 14 nt, Human herpesvirus 1
ggcccccgcccccg

SEQ ID NO: 3951343 - RNA, 18 nt, Human herpesvirus 1
ggccccuggcgccgccug

SEQ ID NO: 3951344 - RNA, 20 nt, Human herpesvirus 1
ggcccgcgucgggauccaca

SEQ ID NO: 3951345 - RNA, 14 nt, Human herpesvirus 1
ggcccggaggaggc

SEQ ID NO: 3951346 - RNA, 16 nt, Human herpesvirus 1
ggcccggccaaccagc

SEQ ID NO: 3951347 - RNA, 13 nt, Human herpesvirus 1
ggcccggccaggc

SEQ ID NO: 3951348 - RNA, 17 nt, Human herpesvirus 1
ggcccggcuagacccac

SEQ ID NO: 3951349 - RNA, 20 nt, Human herpesvirus 1
ggcccgggccacggcgccga

SEQ ID NO: 3951350 - RNA, 15 nt, Human herpesvirus 1
ggcccuccaggcugu

SEQ ID NO: 3951351 - RNA, 19 nt, Human herpesvirus 1
ggcccucuuggaggacccc

SEQ ID NO: 3951352 - RNA, 16 nt, Human herpesvirus 1
ggcccugccacuccgg

SEQ ID NO: 3951353 - RNA, 16 nt, Human herpesvirus 1
ggcccugcugcugccg

SEQ ID NO: 3951354 - RNA, 14 nt, Human herpesvirus 1
ggcccuggcucccg

SEQ ID NO: 3951355 - RNA, 18 nt, Human herpesvirus 1
ggcccuguacagcucgcg

SEQ ID NO: 3951356 - RNA, 14 nt, Human herpesvirus 1
ggccgaagccacgc

SEQ ID NO: 3951357 - RNA, 13 nt, Human herpesvirus 1
ggccgacgacgac

SEQ ID NO: 3951358 - RNA, 19 nt, Human herpesvirus 1
ggccgcaggacccagcaag

SEQ ID NO: 3951359 - RNA, 21 nt, Human herpesvirus 1
ggccgccaccauccucaagca

SEQ ID NO: 3951360 - RNA, 22 nt, Human herpesvirus 1
ggccgccagcgcggcggggccc

SEQ ID NO: 3951361 - RNA, 19 nt, Human herpesvirus 1
ggccgcccacuucccggua

SEQ ID NO: 3951362 - RNA, 17 nt, Human herpesvirus 1
ggccgcgcggcaacaca

SEQ ID NO: 3951363 - RNA, 16 nt, Human herpesvirus 1
ggccggcgggugagcg

SEQ ID NO: 3951364 - RNA, 19 nt, Human herpesvirus 1
ggccggggagggcagggcc

SEQ ID NO: 3951365 - RNA, 14 nt, Human herpesvirus 1
ggccguggcggcca

SEQ ID NO: 3951366 - RNA, 18 nt, Human herpesvirus 1
ggccguuucuccgcccga

SEQ ID NO: 3951367 - RNA, 19 nt, Human herpesvirus 1
ggccuccacccccucgacc

SEQ ID NO: 3951368 - RNA, 23 nt, Human herpesvirus 1
ggccuccacccccucgaccacca

SEQ ID NO: 3951369 - RNA, 14 nt, Human herpesvirus 1
ggccucccccggac

SEQ ID NO: 3951370 - RNA, 16 nt, Human herpesvirus 1
ggccucucacacagca

SEQ ID NO: 3951371 - RNA, 13 nt, Human herpesvirus 1
ggccuggcggcgg

SEQ ID NO: 3951372 - RNA, 16 nt, Human herpesvirus 1
ggccuggucagaggcc

SEQ ID NO: 3951373 - RNA, 11 nt, Human herpesvirus 1
ggccugguggc

SEQ ID NO: 3951374 - RNA, 22 nt, Human herpesvirus 1
ggccuucuuucgaaccgugguc

SEQ ID NO: 3951375 - RNA, 18 nt, Human herpesvirus 1
ggccuuggcggccgccca

SEQ ID NO: 3951376 - RNA, 13 nt, Human herpesvirus 1
ggcgaccgccggc

SEQ ID NO: 3951377 - RNA, 17 nt, Human herpesvirus 1
ggcgaccgccggcgagg

SEQ ID NO: 3951378 - RNA, 17 nt, Human herpesvirus 1
ggcgacggcgucucccg

SEQ ID NO: 3951379 - RNA, 16 nt, Human herpesvirus 1
ggcgccaaagcugcug

SEQ ID NO: 3951380 - RNA, 15 nt, Human herpesvirus 1
ggcgccugccccgcc

SEQ ID NO: 3951381 - RNA, 17 nt, Human herpesvirus 1
ggcgccugccccgccac

SEQ ID NO: 3951382 - RNA, 20 nt, Human herpesvirus 1
ggcgccugccccgccaccca

SEQ ID NO: 3951383 - RNA, 16 nt, Human herpesvirus 1
ggcgccugugugucuu

SEQ ID NO: 3951384 - RNA, 14 nt, Human herpesvirus 1
ggcgcgcccucuuc

SEQ ID NO: 3951385 - RNA, 19 nt, Human herpesvirus 1
ggcgcgcgaaaucguggcg

SEQ ID NO: 3951386 - RNA, 14 nt, Human herpesvirus 1
ggcgcggugccuga

SEQ ID NO: 3951387 - RNA, 20 nt, Human herpesvirus 1
ggcgcguccccggcccggag

SEQ ID NO: 3951388 - RNA, 19 nt, Human herpesvirus 1
ggcgcuacuucaccuucgg

SEQ ID NO: 3951389 - RNA, 14 nt, Human herpesvirus 1
ggcgcuuaccgcca

SEQ ID NO: 3951390 - RNA, 13 nt, Human herpesvirus 1
ggcgcuuggcaug

SEQ ID NO: 3951391 - RNA, 13 nt, Human herpesvirus 1
ggcggaccuggcg

SEQ ID NO: 3951392 - RNA, 18 nt, Human herpesvirus 1
ggcggccaacgacuuccu

SEQ ID NO: 3951393 - RNA, 13 nt, Human herpesvirus 1
ggcggccccggcc

SEQ ID NO: 3951394 - RNA, 23 nt, Human herpesvirus 1
ggcggcgacgugcccccuccucg

SEQ ID NO: 3951395 - RNA, 23 nt, Human herpesvirus 1
ggcggcgugugggggugccccaa

SEQ ID NO: 3951396 - RNA, 12 nt, Human herpesvirus 1
ggcgggacucug

SEQ ID NO: 3951397 - RNA, 20 nt, Human herpesvirus 1
ggcgggccuaccggacccgu

SEQ ID NO: 3951398 - RNA, 16 nt, Human herpesvirus 1
ggcgguucgccgccac

SEQ ID NO: 3951399 - RNA, 19 nt, Human herpesvirus 1
ggcguagagcuguggcacu

SEQ ID NO: 3951400 - RNA, 18 nt, Human herpesvirus 1
ggcguccuggaugcugug

SEQ ID NO: 3951401 - RNA, 21 nt, Human herpesvirus 1
ggcgucuccucugggggcgac

SEQ ID NO: 3951402 - RNA, 18 nt, Human herpesvirus 1
ggcgucucgccggacgac

SEQ ID NO: 3951403 - RNA, 23 nt, Human herpesvirus 1
ggcguuauucccaaacagggccu

SEQ ID NO: 3951404 - RNA, 23 nt, Human herpesvirus 1
ggcucaagaucuuucggugucua

SEQ ID NO: 3951405 - RNA, 18 nt, Human herpesvirus 1
ggcucccggcccgggccc

SEQ ID NO: 3951406 - RNA, 22 nt, Human herpesvirus 1
ggcuccggggggcuuccggccu

SEQ ID NO: 3951407 - RNA, 16 nt, Human herpesvirus 1
ggcucgucuuggccac

SEQ ID NO: 3951408 - RNA, 19 nt, Human herpesvirus 1
ggcucucggggccgcagga

SEQ ID NO: 3951409 - RNA, 22 nt, Human herpesvirus 1
ggcugccaaacagcuggccgcc

SEQ ID NO: 3951410 - RNA, 22 nt, Human herpesvirus 1
ggcugccgccagguugggggcc

SEQ ID NO: 3951411 - RNA, 18 nt, Human herpesvirus 1
ggcugguccacacccagu

SEQ ID NO: 3951412 - RNA, 18 nt, Human herpesvirus 1
ggcuggucccgcuggugu

SEQ ID NO: 3951413 - RNA, 22 nt, Human herpesvirus 1
ggcugucgacgcccccucccug

SEQ ID NO: 3951414 - RNA, 17 nt, Human herpesvirus 1
ggcuguuccgccaggcg

SEQ ID NO: 3951415 - RNA, 17 nt, Human herpesvirus 1
ggcuuccgacgcccccc

SEQ ID NO: 3951416 - RNA, 21 nt, Human herpesvirus 1
ggcuuuuguugcugcgcggcg

SEQ ID NO: 3951417 - RNA, 17 nt, Human herpesvirus 1
gggaaaagugaaagaca

SEQ ID NO: 3951418 - RNA, 16 nt, Human herpesvirus 1
gggaccagguccccca

SEQ ID NO: 3951419 - RNA, 15 nt, Human herpesvirus 1
gggaccgcagccugg

SEQ ID NO: 3951420 - RNA, 13 nt, Human herpesvirus 1
gggaccuccugga

SEQ ID NO: 3951421 - RNA, 20 nt, Human herpesvirus 1
gggagccccggucuccccgg

SEQ ID NO: 3951422 - RNA, 23 nt, Human herpesvirus 1
gggaggggggggucgggcgcugg

SEQ ID NO: 3951423 - RNA, 16 nt, Human herpesvirus 1
gggauccgacccccau

SEQ ID NO: 3951424 - RNA, 22 nt, Human herpesvirus 1
gggcacgccaagcccccgcccg

SEQ ID NO: 3951425 - RNA, 18 nt, Human herpesvirus 1
caggccuggucagaggcc

SEQ ID NO: 3951426 - RNA, 16 nt, Human herpesvirus 1
caggcgaccgccggcg

SEQ ID NO: 3951427 - RNA, 15 nt, Human herpesvirus 1
cagggagccccgguc

SEQ ID NO: 3951428 - RNA, 19 nt, Human herpesvirus 1
cagggccuccgaccccaga

SEQ ID NO: 3951429 - RNA, 17 nt, Human herpesvirus 1
cagggccucgcugacca

SEQ ID NO: 3951430 - RNA, 22 nt, Human herpesvirus 1
cagggcgggccgccucgggggc

SEQ ID NO: 3951431 - RNA, 20 nt, Human herpesvirus 1
caggggccauguugggccgc

SEQ ID NO: 3951432 - RNA, 16 nt, Human herpesvirus 1
cagggggaugcuagcc

SEQ ID NO: 3951433 - RNA, 19 nt, Human herpesvirus 1
caggucccccacaccaccu

SEQ ID NO: 3951434 - RNA, 21 nt, Human herpesvirus 1
caggugacgccuucgaggguc

SEQ ID NO: 3951435 - RNA, 22 nt, Human herpesvirus 1
caguacauguucuuuaugcgcc

SEQ ID NO: 3951436 - RNA, 19 nt, Human herpesvirus 1
cagucccugaguugggaau

SEQ ID NO: 3951437 - RNA, 18 nt, Human herpesvirus 1
cagucgcccgaagacacc

SEQ ID NO: 3951438 - RNA, 15 nt, Human herpesvirus 1
caguggcuccgggcc

SEQ ID NO: 3951439 - RNA, 20 nt, Human herpesvirus 1
caguugggccgggcgaccca

SEQ ID NO: 3951440 - RNA, 21 nt, Human herpesvirus 1
cauaaccgaccgcagucccug

SEQ ID NO: 3951441 - RNA, 16 nt, Human herpesvirus 1
cauacacagccaccca

SEQ ID NO: 3951442 - RNA, 15 nt, Human herpesvirus 1
cauaccgaccacacc

SEQ ID NO: 3951443 - RNA, 22 nt, Human herpesvirus 1
cauagccgccgaagggacucug

SEQ ID NO: 3951444 - RNA, 14 nt, Human herpesvirus 1
cauccaccacccgg

SEQ ID NO: 3951445 - RNA, 15 nt, Human herpesvirus 1
cauccagcuggugcu

SEQ ID NO: 3951446 - RNA, 13 nt, Human herpesvirus 1
cauccagggagaa

SEQ ID NO: 3951447 - RNA, 18 nt, Human herpesvirus 1
cauccccgcuccccaagc

SEQ ID NO: 3951448 - RNA, 15 nt, Human herpesvirus 1
cauccgaacgcagcc

SEQ ID NO: 3951449 - RNA, 15 nt, Human herpesvirus 1
cauccgagcaccccc

SEQ ID NO: 3951450 - RNA, 21 nt, Human herpesvirus 1
cauccgggaagacgaccagcc

SEQ ID NO: 3951451 - RNA, 15 nt, Human herpesvirus 1
caucgacacgcgcgu

SEQ ID NO: 3951452 - RNA, 18 nt, Human herpesvirus 1
caucgaccacgcccuucc

SEQ ID NO: 3951453 - RNA, 12 nt, Human herpesvirus 1
caucgccccugg

SEQ ID NO: 3951454 - RNA, 15 nt, Human herpesvirus 1
caucgccucggccac

SEQ ID NO: 3951455 - RNA, 13 nt, Human herpesvirus 1
caucgcgccccuc

SEQ ID NO: 3951456 - RNA, 22 nt, Human herpesvirus 1
caucggacccccccucgcgcca

SEQ ID NO: 3951457 - RNA, 19 nt, Human herpesvirus 1
caucuuuuuugccgccucg

SEQ ID NO: 3951458 - RNA, 16 nt, Human herpesvirus 1
caugccucugcgggca

SEQ ID NO: 3951459 - RNA, 17 nt, Human herpesvirus 1
caugcgcaagcgccgca

SEQ ID NO: 3951460 - RNA, 13 nt, Human herpesvirus 1
caugcggcugcag

SEQ ID NO: 3951461 - RNA, 10 nt, Human herpesvirus 1
caugcgggcu

SEQ ID NO: 3951462 - RNA, 12 nt, Human herpesvirus 1
caugcuggagga

SEQ ID NO: 3951463 - RNA, 16 nt, Human herpesvirus 1
cauggauaacaaccac

SEQ ID NO: 3951464 - RNA, 15 nt, Human herpesvirus 1
cauuaaccaccugcg

SEQ ID NO: 3951465 - RNA, 14 nt, Human herpesvirus 1
cauugguguauguu

SEQ ID NO: 3951466 - RNA, 22 nt, Human herpesvirus 1
ccaaagcugcuggcgcgcaccc

SEQ ID NO: 3951467 - RNA, 22 nt, Human herpesvirus 1
ccaaagugccccgaccccgaga

SEQ ID NO: 3951468 - RNA, 19 nt, Human herpesvirus 1
ccaaccgcgacccuccggg

SEQ ID NO: 3951469 - RNA, 14 nt, Human herpesvirus 1
ccaacgcccugacc

SEQ ID NO: 3951470 - RNA, 16 nt, Human herpesvirus 1
ccaacgccuccccugu

SEQ ID NO: 3951471 - RNA, 21 nt, Human herpesvirus 1
ccaacgucgccgcccugagcg

SEQ ID NO: 3951472 - RNA, 23 nt, Human herpesvirus 1
ccaagauggcccaguguacccug

SEQ ID NO: 3951473 - RNA, 17 nt, Human herpesvirus 1
ccaagggggaggggcca

SEQ ID NO: 3951474 - RNA, 15 nt, Human herpesvirus 1
ccaaguacgccgcca

SEQ ID NO: 3951475 - RNA, 18 nt, Human herpesvirus 1
ccaauaaagaucgcggua

SEQ ID NO: 3951476 - RNA, 16 nt, Human herpesvirus 1
ccaaugcccucccuga

SEQ ID NO: 3951477 - RNA, 19 nt, Human herpesvirus 1
ccacaacauccgcggcuuc

SEQ ID NO: 3951478 - RNA, 12 nt, Human herpesvirus 1
ccacacagccgg

SEQ ID NO: 3951479 - RNA, 20 nt, Human herpesvirus 1
ccacacccaguggcuccggg

SEQ ID NO: 3951480 - RNA, 14 nt, Human herpesvirus 1
ccaccaccuccacc

SEQ ID NO: 3951481 - RNA, 22 nt, Human herpesvirus 1
ccacccaggugacgccuucgag

SEQ ID NO: 3951482 - RNA, 17 nt, Human herpesvirus 1
ccacccaguuuccaccc

SEQ ID NO: 3951483 - RNA, 18 nt, Human herpesvirus 1
ccacccccucgaccacca

SEQ ID NO: 3951484 - RNA, 21 nt, Human herpesvirus 1
ccacccggagcuuucuuccgg

SEQ ID NO: 3951485 - RNA, 14 nt, Human herpesvirus 1
ccaccgacucuccc

SEQ ID NO: 3951486 - RNA, 15 nt, Human herpesvirus 1
ccaccgccccccugu

SEQ ID NO: 3951487 - RNA, 12 nt, Human herpesvirus 1
ccaccgcugggc

SEQ ID NO: 3951488 - RNA, 17 nt, Human herpesvirus 1
ccaccgggaagcagggc

SEQ ID NO: 3951489 - RNA, 20 nt, Human herpesvirus 1
ccaccgugggccggcgggug

SEQ ID NO: 3951490 - RNA, 19 nt, Human herpesvirus 1
ccaccguugcccgggccgu

SEQ ID NO: 3951491 - RNA, 21 nt, Human herpesvirus 1
ccaccuacuacgaugggggcg

SEQ ID NO: 3951492 - RNA, 13 nt, Human herpesvirus 1
ccaccuccacccc

SEQ ID NO: 3951493 - RNA, 17 nt, Human herpesvirus 1
ccaccugcgcucccuca

SEQ ID NO: 3951494 - RNA, 23 nt, Human herpesvirus 1
ccaccuuccguccccugcccccc

SEQ ID NO: 3951495 - RNA, 22 nt, Human herpesvirus 1
ccacgacaaccccggucuccca

SEQ ID NO: 3951496 - RNA, 19 nt, Human herpesvirus 1
ccacgacccgacucaccuc

SEQ ID NO: 3951497 - RNA, 11 nt, Human herpesvirus 1
ccacgccaggg

SEQ ID NO: 3951498 - RNA, 17 nt, Human herpesvirus 1
ccacgcccccgccgccc

SEQ ID NO: 3951499 - RNA, 19 nt, Human herpesvirus 1
ccacgcccgaccacacacc

SEQ ID NO: 3951500 - RNA, 16 nt, Human herpesvirus 1
ccacgggggggugggg

SEQ ID NO: 3951501 - RNA, 16 nt, Human herpesvirus 1
ccacuacaccagccaa

SEQ ID NO: 3951502 - RNA, 19 nt, Human herpesvirus 1
ccacuccuccccgcgccgu

SEQ ID NO: 3951503 - RNA, 16 nt, Human herpesvirus 1
ccacugcacucccugc

SEQ ID NO: 3951504 - RNA, 12 nt, Human herpesvirus 1
ccacuguuuucc

SEQ ID NO: 3951505 - RNA, 20 nt, Human herpesvirus 1
ccagaauaaugaccaccaca

SEQ ID NO: 3951506 - RNA, 18 nt, Human herpesvirus 1
ccagaccgaagaggugcu

SEQ ID NO: 3951507 - RNA, 13 nt, Human herpesvirus 1
ccagagaccccag

SEQ ID NO: 3951508 - RNA, 19 nt, Human herpesvirus 1
ccagaggcgcgcgcaccuc

SEQ ID NO: 3951509 - RNA, 15 nt, Human herpesvirus 1
ccagcagacgcugcu

SEQ ID NO: 3951510 - RNA, 15 nt, Human herpesvirus 1
ccagccccccagccu

SEQ ID NO: 3951511 - RNA, 14 nt, Human herpesvirus 1
ccagcccucucccc

SEQ ID NO: 3951512 - RNA, 20 nt, Human herpesvirus 1
ccagcccucucccccgcucu

SEQ ID NO: 3951513 - RNA, 20 nt, Human herpesvirus 1
ccagccuguuuguccugggg

SEQ ID NO: 3951514 - RNA, 21 nt, Human herpesvirus 1
ccagccuucacgugcugcugc

SEQ ID NO: 3951515 - RNA, 16 nt, Human herpesvirus 1
ccagcgcggcggggcc

SEQ ID NO: 3951516 - RNA, 12 nt, Human herpesvirus 1
ccagcugggccc

SEQ ID NO: 3951517 - RNA, 15 nt, Human herpesvirus 1
ccaggaucacaccgg

SEQ ID NO: 3951518 - RNA, 13 nt, Human herpesvirus 1
ccaggccuccacc

SEQ ID NO: 3951519 - RNA, 23 nt, Human herpesvirus 1
ccaggcggcguuaaccgcacccc

SEQ ID NO: 3951520 - RNA, 13 nt, Human herpesvirus 1
ccagggagccccg

SEQ ID NO: 3951521 - RNA, 21 nt, Human herpesvirus 1
ccagggcgaggugcgguuggg

SEQ ID NO: 3951522 - RNA, 13 nt, Human herpesvirus 1
ccagggcggggcu

SEQ ID NO: 3951523 - RNA, 19 nt, Human herpesvirus 1
ccagggggaugcuagccug

SEQ ID NO: 3951524 - RNA, 18 nt, Human herpesvirus 1
ccagguugggggccguga

SEQ ID NO: 3951525 - RNA, 16 nt, Human herpesvirus 1
ccauaaggucauccga

SEQ ID NO: 3951526 - RNA, 16 nt, Human herpesvirus 1
ccauaucgcuucccga

SEQ ID NO: 3951527 - RNA, 18 nt, Human herpesvirus 1
ccaucaccccgcaauuug

SEQ ID NO: 3951528 - RNA, 12 nt, Human herpesvirus 1
ccaucagccucg

SEQ ID NO: 3951529 - RNA, 16 nt, Human herpesvirus 1
ccauccccgcucccca

SEQ ID NO: 3951530 - RNA, 23 nt, Human herpesvirus 1
ccaucccggguuaauguaaauaa

SEQ ID NO: 3951531 - RNA, 21 nt, Human herpesvirus 1
ccauccgaacgcagccccgcu

SEQ ID NO: 3951532 - RNA, 16 nt, Human herpesvirus 1
ccauccugcggcucgu

SEQ ID NO: 3951533 - RNA, 23 nt, Human herpesvirus 1
ccaucgaguucgccaggcugcag

SEQ ID NO: 3951534 - RNA, 22 nt, Human herpesvirus 1
ccaucgccucggccaccguggg

SEQ ID NO: 3951535 - RNA, 14 nt, Human herpesvirus 1
ccaucuaaugccac

SEQ ID NO: 3951536 - RNA, 13 nt, Human herpesvirus 1
ccauggaccccag

SEQ ID NO: 3951537 - RNA, 15 nt, Human herpesvirus 1
ccauggaccgcaucu

SEQ ID NO: 3951538 - RNA, 17 nt, Human herpesvirus 1
ccauggcgggacugggc

SEQ ID NO: 3951539 - RNA, 19 nt, Human herpesvirus 1
ccauguuugcgggccuggg

SEQ ID NO: 3951540 - RNA, 17 nt, Human herpesvirus 1
ccgguauggggggggcu

SEQ ID NO: 3951541 - RNA, 15 nt, Human herpesvirus 1
ccggucggcgggccc

SEQ ID NO: 3951542 - RNA, 23 nt, Human herpesvirus 1
ccggucucccagggagccccggu

SEQ ID NO: 3951543 - RNA, 18 nt, Human herpesvirus 1
ccggucuccccgggagcc

SEQ ID NO: 3951544 - RNA, 23 nt, Human herpesvirus 1
ccggugaacgccuccgcccgugc

SEQ ID NO: 3951545 - RNA, 23 nt, Human herpesvirus 1
ccgguuccucccgcucggcggca

SEQ ID NO: 3951546 - RNA, 16 nt, Human herpesvirus 1
ccgguucguauccaca

SEQ ID NO: 3951547 - RNA, 20 nt, Human herpesvirus 1
ccguaaacgccgagcugcga

SEQ ID NO: 3951548 - RNA, 13 nt, Human herpesvirus 1
ccguccgaaccca

SEQ ID NO: 3951549 - RNA, 18 nt, Human herpesvirus 1
ccguccucgcaccagccc

SEQ ID NO: 3951550 - RNA, 18 nt, Human herpesvirus 1
ccgucgggaggccacaga

SEQ ID NO: 3951551 - RNA, 17 nt, Human herpesvirus 1
ccgucguauccacggug

SEQ ID NO: 3951552 - RNA, 16 nt, Human herpesvirus 1
ccguggccccacgguc

SEQ ID NO: 3951553 - RNA, 12 nt, Human herpesvirus 1
ccguggccccgg

SEQ ID NO: 3951554 - RNA, 18 nt, Human herpesvirus 1
ccguggccgacaacugcc

SEQ ID NO: 3951555 - RNA, 16 nt, Human herpesvirus 1
ccguggcgccccggcc

SEQ ID NO: 3951556 - RNA, 19 nt, Human herpesvirus 1
ccguggcgccccggccccu

SEQ ID NO: 3951557 - RNA, 22 nt, Human herpesvirus 1
ccguggggacgguggcgccgca

SEQ ID NO: 3951558 - RNA, 16 nt, Human herpesvirus 1
ccgugguccuguggag

SEQ ID NO: 3951559 - RNA, 16 nt, Human herpesvirus 1
ccgugucugugggcca

SEQ ID NO: 3951560 - RNA, 16 nt, Human herpesvirus 1
ccguguucgagggcca

SEQ ID NO: 3951561 - RNA, 17 nt, Human herpesvirus 1
ccguguuggagcgcgcc

SEQ ID NO: 3951562 - RNA, 15 nt, Human herpesvirus 1
ccguuaaccccccac

SEQ ID NO: 3951563 - RNA, 15 nt, Human herpesvirus 1
ccguuggcccccgcc

SEQ ID NO: 3951564 - RNA, 20 nt, Human herpesvirus 1
ccuaaccaggccuccacccc

SEQ ID NO: 3951565 - RNA, 14 nt, Human herpesvirus 1
ccuaccccaguccc

SEQ ID NO: 3951566 - RNA, 16 nt, Human herpesvirus 1
ccuaccggccccuggg

SEQ ID NO: 3951567 - RNA, 21 nt, Human herpesvirus 1
ccuaucgcucgaccucuccac

SEQ ID NO: 3951568 - RNA, 20 nt, Human herpesvirus 1
ccuaugguacacacgggugc

SEQ ID NO: 3951569 - RNA, 16 nt, Human herpesvirus 1
ccucaagcaggccauc

SEQ ID NO: 3951570 - RNA, 20 nt, Human herpesvirus 1
ccucacagggcgggccgccu

SEQ ID NO: 3951571 - RNA, 16 nt, Human herpesvirus 1
ccucauguccaccgac

SEQ ID NO: 3951572 - RNA, 11 nt, Human herpesvirus 1
ccuccccccgc

SEQ ID NO: 3951573 - RNA, 19 nt, Human herpesvirus 1
ccucccccgcccuggacac

SEQ ID NO: 3951574 - RNA, 18 nt, Human herpesvirus 1
ccucccccguagaucucu

SEQ ID NO: 3951575 - RNA, 12 nt, Human herpesvirus 1
ccucccccuccg

SEQ ID NO: 3951576 - RNA, 14 nt, Human herpesvirus 1
ccuccccgcacaga

SEQ ID NO: 3951577 - RNA, 22 nt, Human herpesvirus 1
ccucccgcucggcggcagcccg

SEQ ID NO: 3951578 - RNA, 14 nt, Human herpesvirus 1
ccuccgaggagauc

SEQ ID NO: 3951579 - RNA, 19 nt, Human herpesvirus 1
ccuccgcaucccaggauca

SEQ ID NO: 3951580 - RNA, 13 nt, Human herpesvirus 1
ccuccgcgccagg

SEQ ID NO: 3951581 - RNA, 14 nt, Human herpesvirus 1
ccucgaccaccacc

SEQ ID NO: 3951582 - RNA, 17 nt, Human herpesvirus 1
ccucgaccaccaccucc

SEQ ID NO: 3951583 - RNA, 13 nt, Human herpesvirus 1
ccucgaggacacc

SEQ ID NO: 3951584 - RNA, 17 nt, Human herpesvirus 1
ccucgcacauccucacc

SEQ ID NO: 3951585 - RNA, 16 nt, Human herpesvirus 1
ccucgccacgucgacc

SEQ ID NO: 3951586 - RNA, 18 nt, Human herpesvirus 1
ccucgcccgccaucgagc

SEQ ID NO: 3951587 - RNA, 15 nt, Human herpesvirus 1
ccucucacacagcau

SEQ ID NO: 3951588 - RNA, 21 nt, Human herpesvirus 1
ccucuccgcggugucugggaa

SEQ ID NO: 3951589 - RNA, 19 nt, Human herpesvirus 1
ccucucuucccucagguca

SEQ ID NO: 3951590 - RNA, 22 nt, Human herpesvirus 1
ccugaccaacgacggcccgacc

SEQ ID NO: 3951591 - RNA, 21 nt, Human herpesvirus 1
ccugagcccggcggcgcuggc

SEQ ID NO: 3951592 - RNA, 20 nt, Human herpesvirus 1
ccugagcgcccuccugacca

SEQ ID NO: 3951593 - RNA, 18 nt, Human herpesvirus 1
ccugaucauuacccccgu

SEQ ID NO: 3951594 - RNA, 18 nt, Human herpesvirus 1
ccugaugcacgcccccgc

SEQ ID NO: 3951595 - RNA, 18 nt, Human herpesvirus 1
ccugauguggcugcuccg

SEQ ID NO: 3951596 - RNA, 21 nt, Human herpesvirus 1
ccugcaccacccccgccgucc

SEQ ID NO: 3951597 - RNA, 22 nt, Human herpesvirus 1
ccugccccgccacccaguuucc

SEQ ID NO: 3951598 - RNA, 13 nt, Human herpesvirus 1
ccugccgcgcgga

SEQ ID NO: 3951599 - RNA, 13 nt, Human herpesvirus 1
ccugcgcgacgcc

SEQ ID NO: 3951600 - RNA, 13 nt, Human herpesvirus 1
ccugcggcuggcg

SEQ ID NO: 3951601 - RNA, 18 nt, Human herpesvirus 1
ccugcuccggcggggccu

SEQ ID NO: 3951602 - RNA, 21 nt, Human herpesvirus 1
ccugcucgggcaggugcagac

SEQ ID NO: 3951603 - RNA, 22 nt, Human herpesvirus 1
ccugcucgggcaggugcagacc

SEQ ID NO: 3951604 - RNA, 20 nt, Human herpesvirus 1
ccugcugcaggccccccgcc

SEQ ID NO: 3951605 - RNA, 14 nt, Human herpesvirus 1
ccuggaccagcuga

SEQ ID NO: 3951606 - RNA, 14 nt, Human herpesvirus 1
ccuggaugcugugg

SEQ ID NO: 3951607 - RNA, 13 nt, Human herpesvirus 1
ccuggcgccgccu

SEQ ID NO: 3951608 - RNA, 17 nt, Human herpesvirus 1
ccuggcggacggcggcc

SEQ ID NO: 3951609 - RNA, 13 nt, Human herpesvirus 1
ccuggcugaccca

SEQ ID NO: 3951610 - RNA, 22 nt, Human herpesvirus 1
ccugggauccgacccccaugga

SEQ ID NO: 3951611 - RNA, 13 nt, Human herpesvirus 1
ccugggccaccug

SEQ ID NO: 3951612 - RNA, 15 nt, Human herpesvirus 1
ccuggggucgcucug

SEQ ID NO: 3951613 - RNA, 14 nt, Human herpesvirus 1
ccugggucagcucc

SEQ ID NO: 3951614 - RNA, 16 nt, Human herpesvirus 1
ccuggguguguuuauu

SEQ ID NO: 3951615 - RNA, 22 nt, Human herpesvirus 1
ccuggguuggcgucgggaccau

SEQ ID NO: 3951616 - RNA, 14 nt, Human herpesvirus 1
ccuggucagaggcc

SEQ ID NO: 3951617 - RNA, 18 nt, Human herpesvirus 1
ccugucggccgccgacga

SEQ ID NO: 3951618 - RNA, 23 nt, Human herpesvirus 1
ccuguugguauagguccacggcc

SEQ ID NO: 3951619 - RNA, 15 nt, Human herpesvirus 1
ccuguuugucgccug

SEQ ID NO: 3951620 - RNA, 17 nt, Human herpesvirus 1
ccuguuugucgccuggc

SEQ ID NO: 3951621 - RNA, 20 nt, Human herpesvirus 1
ccuuauccacaugaagccac

SEQ ID NO: 3951622 - RNA, 16 nt, Human herpesvirus 1
ccuucauguccaaccc

SEQ ID NO: 3951623 - RNA, 14 nt, Human herpesvirus 1
ccuuccccacggga

SEQ ID NO: 3951624 - RNA, 16 nt, Human herpesvirus 1
ccuucccccucccccc

SEQ ID NO: 3951625 - RNA, 13 nt, Human herpesvirus 1
ccuugccccggcc

SEQ ID NO: 3951626 - RNA, 11 nt, Human herpesvirus 1
ccuugccgugg

SEQ ID NO: 3951627 - RNA, 17 nt, Human herpesvirus 1
ccuugcggcagcgcucc

SEQ ID NO: 3951628 - RNA, 14 nt, Human herpesvirus 1
ccuuggcggccgcc

SEQ ID NO: 3951629 - RNA, 16 nt, Human herpesvirus 1
ccuuggucgaucccga

SEQ ID NO: 3951630 - RNA, 19 nt, Human herpesvirus 1
ccuugguuccgacgccuca

SEQ ID NO: 3951631 - RNA, 22 nt, Human herpesvirus 1
ccuugguuccgacgccucaaca

SEQ ID NO: 3951632 - RNA, 14 nt, Human herpesvirus 1
ccuugugugucaau

SEQ ID NO: 3951633 - RNA, 15 nt, Human herpesvirus 1
ccuuucccccuguuu

SEQ ID NO: 3951634 - RNA, 14 nt, Human herpesvirus 1
ccuuuucgccgccc

SEQ ID NO: 3951635 - RNA, 15 nt, Human herpesvirus 1
cgaacgggggcccug

SEQ ID NO: 3951636 - RNA, 20 nt, Human herpesvirus 1
cgaagcggccauggcccgcc

SEQ ID NO: 3951637 - RNA, 21 nt, Human herpesvirus 1
cgacaaccccggucucccagg

SEQ ID NO: 3951638 - RNA, 14 nt, Human herpesvirus 1
cgacaccaccagcu

SEQ ID NO: 3951639 - RNA, 15 nt, Human herpesvirus 1
cgacaccaccagcug

SEQ ID NO: 3951640 - RNA, 14 nt, Human herpesvirus 1
cgacaccgcccucg

SEQ ID NO: 3951641 - RNA, 19 nt, Human herpesvirus 1
cgacagcacucacagcccc

SEQ ID NO: 3951642 - RNA, 13 nt, Human herpesvirus 1
cgaccaccaccuc

SEQ ID NO: 3951643 - RNA, 15 nt, Human herpesvirus 1
cgaccaccauccccg

SEQ ID NO: 3951644 - RNA, 15 nt, Human herpesvirus 1
cgaccaucacccgag

SEQ ID NO: 3951645 - RNA, 15 nt, Human herpesvirus 1
cgacccaccaauaaa

SEQ ID NO: 3951646 - RNA, 21 nt, Human herpesvirus 1
cgacccccuuguaugucccca

SEQ ID NO: 3951647 - RNA, 15 nt, Human herpesvirus 1
cgacccgaagcugcu

SEQ ID NO: 3951648 - RNA, 16 nt, Human herpesvirus 1
cgacccugaucccccg

SEQ ID NO: 3951649 - RNA, 19 nt, Human herpesvirus 1
cgaccgcaacuucccaccc

SEQ ID NO: 3951650 - RNA, 15 nt, Human herpesvirus 1
cgaccgcagucccug

SEQ ID NO: 3951651 - RNA, 17 nt, Human herpesvirus 1
cgaccgccggcggcgac

SEQ ID NO: 3951652 - RNA, 17 nt, Human herpesvirus 1
cgaccuguugauggccu

SEQ ID NO: 3951653 - RNA, 12 nt, Human herpesvirus 1
cgacgaccuggg

SEQ ID NO: 3951654 - RNA, 11 nt, Human herpesvirus 1
cgacgccucaa

SEQ ID NO: 3951655 - RNA, 16 nt, Human herpesvirus 1
cgacggcggaccuggc

SEQ ID NO: 3951656 - RNA, 15 nt, Human herpesvirus 1
ucccacacucucugg

SEQ ID NO: 3951657 - RNA, 19 nt, Human herpesvirus 1
ucccacacucucugggcgg

SEQ ID NO: 3951658 - RNA, 19 nt, Human herpesvirus 1
ucccaccaaacuggcacau

SEQ ID NO: 3951659 - RNA, 22 nt, Human herpesvirus 1
ucccaccgccaucagccuuacc

SEQ ID NO: 3951660 - RNA, 19 nt, Human herpesvirus 1
ucccacgcucuccccugcu

SEQ ID NO: 3951661 - RNA, 17 nt, Human herpesvirus 1
ucccacggccucgccag

SEQ ID NO: 3951662 - RNA, 16 nt, Human herpesvirus 1
ucccagagaccccagg

SEQ ID NO: 3951663 - RNA, 17 nt, Human herpesvirus 1
ucccagagaccccaggg

SEQ ID NO: 3951664 - RNA, 22 nt, Human herpesvirus 1
ucccagcggcacgaccggcucc

SEQ ID NO: 3951665 - RNA, 16 nt, Human herpesvirus 1
ucccagggagccccgg

SEQ ID NO: 3951666 - RNA, 19 nt, Human herpesvirus 1
ucccaucccccgaucccaa

SEQ ID NO: 3951667 - RNA, 18 nt, Human herpesvirus 1
uccccaaaauaaaagacc

SEQ ID NO: 3951668 - RNA, 20 nt, Human herpesvirus 1
uccccccgucagccugccuc

SEQ ID NO: 3951669 - RNA, 19 nt, Human herpesvirus 1
ucccccuccgcaucccagg

SEQ ID NO: 3951670 - RNA, 23 nt, Human herpesvirus 1
uccccgauggcccuccaggcugu

SEQ ID NO: 3951671 - RNA, 13 nt, Human herpesvirus 1
uccccgcacagau

SEQ ID NO: 3951672 - RNA, 19 nt, Human herpesvirus 1
uccccgcgccguuggcccc

SEQ ID NO: 3951673 - RNA, 15 nt, Human herpesvirus 1
uccccgggagccccg

SEQ ID NO: 3951674 - RNA, 16 nt, Human herpesvirus 1
uccccgggagccccgg

SEQ ID NO: 3951675 - RNA, 15 nt, Human herpesvirus 1
uccccgggcccagcc

SEQ ID NO: 3951676 - RNA, 19 nt, Human herpesvirus 1
ucccgauaaaaagcgcccc

SEQ ID NO: 3951677 - RNA, 20 nt, Human herpesvirus 1
ucccgcaauuucaccgcccc

SEQ ID NO: 3951678 - RNA, 21 nt, Human herpesvirus 1
ucccgccaacacccccuuccc

SEQ ID NO: 3951679 - RNA, 17 nt, Human herpesvirus 1
ucccgcccaccgcuggg

SEQ ID NO: 3951680 - RNA, 16 nt, Human herpesvirus 1
ucccggguuaauguaa

SEQ ID NO: 3951681 - RNA, 15 nt, Human herpesvirus 1
ucccuaaggcccggc

SEQ ID NO: 3951682 - RNA, 19 nt, Human herpesvirus 1
ucccucauuuuacaauaaa

SEQ ID NO: 3951683 - RNA, 15 nt, Human herpesvirus 1
ucccucccccuccgc

SEQ ID NO: 3951684 - RNA, 20 nt, Human herpesvirus 1
ucccucccccuccgcauccc

SEQ ID NO: 3951685 - RNA, 17 nt, Human herpesvirus 1
ucccucgaccaccaucc

SEQ ID NO: 3951686 - RNA, 12 nt, Human herpesvirus 1
ucccugggcccu

SEQ ID NO: 3951687 - RNA, 16 nt, Human herpesvirus 1
ucccugggcccuggcc

SEQ ID NO: 3951688 - RNA, 14 nt, Human herpesvirus 1
uccgaaagccacca

SEQ ID NO: 3951689 - RNA, 16 nt, Human herpesvirus 1
uccgaacgcagccccg

SEQ ID NO: 3951690 - RNA, 18 nt, Human herpesvirus 1
uccgaacgcagccccgcu

SEQ ID NO: 3951691 - RNA, 14 nt, Human herpesvirus 1
uccgacgccccccg

SEQ ID NO: 3951692 - RNA, 17 nt, Human herpesvirus 1
uccgagcacccccccca

SEQ ID NO: 3951693 - RNA, 17 nt, Human herpesvirus 1
uccgaguucccccggca

SEQ ID NO: 3951694 - RNA, 16 nt, Human herpesvirus 1
uccgcccgugcugccg

SEQ ID NO: 3951695 - RNA, 17 nt, Human herpesvirus 1
uccgccugucgcaccca

SEQ ID NO: 3951696 - RNA, 18 nt, Human herpesvirus 1
uccgccugucgcacccac

SEQ ID NO: 3951697 - RNA, 12 nt, Human herpesvirus 1
uccgcgccccuc

SEQ ID NO: 3951698 - RNA, 13 nt, Human herpesvirus 1
uccgcgccccucu

SEQ ID NO: 3951699 - RNA, 16 nt, Human herpesvirus 1
uccgcuaucuccuggg

SEQ ID NO: 3951700 - RNA, 12 nt, Human herpesvirus 1
uccgcuggggcc

SEQ ID NO: 3951701 - RNA, 16 nt, Human herpesvirus 1
uccgcuggggccccca

SEQ ID NO: 3951702 - RNA, 17 nt, Human herpesvirus 1
uccggagacauggcccc

SEQ ID NO: 3951703 - RNA, 18 nt, Human herpesvirus 1
uccggagacauggccccc

SEQ ID NO: 3951704 - RNA, 21 nt, Human herpesvirus 1
uccggaggcgccgcgcggacg

SEQ ID NO: 3951705 - RNA, 15 nt, Human herpesvirus 1
uccgggaugggcuac

SEQ ID NO: 3951706 - RNA, 19 nt, Human herpesvirus 1
uccggggggcuuccggccu

SEQ ID NO: 3951707 - RNA, 17 nt, Human herpesvirus 1
uccgucuucggccccgc

SEQ ID NO: 3951708 - RNA, 15 nt, Human herpesvirus 1
uccgugucggggagg

SEQ ID NO: 3951709 - RNA, 14 nt, Human herpesvirus 1
uccuaacccagacc

SEQ ID NO: 3951710 - RNA, 15 nt, Human herpesvirus 1
uccucacugccuccc

SEQ ID NO: 3951711 - RNA, 15 nt, Human herpesvirus 1
uccugcgccccgccg

SEQ ID NO: 3951712 - RNA, 22 nt, Human herpesvirus 1
uccuggaacgaggccgcagccu

SEQ ID NO: 3951713 - RNA, 15 nt, Human herpesvirus 1
uccuucuugucgucu

SEQ ID NO: 3951714 - RNA, 17 nt, Human herpesvirus 1
uccuucuugucgucucu

SEQ ID NO: 3951715 - RNA, 23 nt, Human herpesvirus 1
ucgaccaccauccccgcucccca

SEQ ID NO: 3951716 - RNA, 20 nt, Human herpesvirus 1
ucgacccgcaacgcgcuggg

SEQ ID NO: 3951717 - RNA, 19 nt, Human herpesvirus 1
ucgagccaacgcccugacc

SEQ ID NO: 3951718 - RNA, 15 nt, Human herpesvirus 1
ucgaggugucucgca

SEQ ID NO: 3951719 - RNA, 20 nt, Human herpesvirus 1
ucgauccaggacgccgcgac

SEQ ID NO: 3951720 - RNA, 18 nt, Human herpesvirus 1
ucgaugacgucccggcuc

SEQ ID NO: 3951721 - RNA, 20 nt, Human herpesvirus 1
ucgcacgcguccagucggca

SEQ ID NO: 3951722 - RNA, 21 nt, Human herpesvirus 1
ucgcccagacgcccuccgagg

SEQ ID NO: 3951723 - RNA, 13 nt, Human herpesvirus 1
ucgccccaguggc

SEQ ID NO: 3951724 - RNA, 15 nt, Human herpesvirus 1
ucgccgacaucgaca

SEQ ID NO: 3951725 - RNA, 12 nt, Human herpesvirus 1
ucgccgcuccgu

SEQ ID NO: 3951726 - RNA, 14 nt, Human herpesvirus 1
ucgccugcccccug

SEQ ID NO: 3951727 - RNA, 18 nt, Human herpesvirus 1
ucgcgauuuccgacgaac

SEQ ID NO: 3951728 - RNA, 23 nt, Human herpesvirus 1
ucgcggcuucgcgguggcggucc

SEQ ID NO: 3951729 - RNA, 17 nt, Human herpesvirus 1
ucgcguggugcgagcug

SEQ ID NO: 3951730 - RNA, 16 nt, Human herpesvirus 1
ucgcuagaccacgccc

SEQ ID NO: 3951731 - RNA, 12 nt, Human herpesvirus 1
ucggaggccccc

SEQ ID NO: 3951732 - RNA, 14 nt, Human herpesvirus 1
ucggaggcccccca

SEQ ID NO: 3951733 - RNA, 17 nt, Human herpesvirus 1
ucggccgccacccaggc

SEQ ID NO: 3951734 - RNA, 15 nt, Human herpesvirus 1
ucggccgccgacgac

SEQ ID NO: 3951735 - RNA, 17 nt, Human herpesvirus 1
ucggccgucccggggca

SEQ ID NO: 3951736 - RNA, 19 nt, Human herpesvirus 1
ucggccgucccggggcagg

SEQ ID NO: 3951737 - RNA, 12 nt, Human herpesvirus 1
ucgggaggccac

SEQ ID NO: 3951738 - RNA, 14 nt, Human herpesvirus 1
ucgggaugcugccc

SEQ ID NO: 3951739 - RNA, 20 nt, Human herpesvirus 1
ucgggccugccugcggcucg

SEQ ID NO: 3951740 - RNA, 19 nt, Human herpesvirus 1
ucggggagcuucgcuuugu

SEQ ID NO: 3951741 - RNA, 15 nt, Human herpesvirus 1
ucgggugugcaccuu

SEQ ID NO: 3951742 - RNA, 17 nt, Human herpesvirus 1
ucgguccacggccaagu

SEQ ID NO: 3951743 - RNA, 13 nt, Human herpesvirus 1
ucggucugcacca

SEQ ID NO: 3951744 - RNA, 22 nt, Human herpesvirus 1
ucggugccaguccgcugcaccg

SEQ ID NO: 3951745 - RNA, 20 nt, Human herpesvirus 1
ucggugcgucugggcccgac

SEQ ID NO: 3951746 - RNA, 18 nt, Human herpesvirus 1
ucguacgcaugggccgcc

SEQ ID NO: 3951747 - RNA, 15 nt, Human herpesvirus 1
ucguccggcgcgcgu

SEQ ID NO: 3951748 - RNA, 14 nt, Human herpesvirus 1
ucgucucucuuccc

SEQ ID NO: 3951749 - RNA, 15 nt, Human herpesvirus 1
ucgucucucuucccc

SEQ ID NO: 3951750 - RNA, 15 nt, Human herpesvirus 1
ucuaaugccacgcga

SEQ ID NO: 3951751 - RNA, 21 nt, Human herpesvirus 1
ucuacccucuggacgcccggg

SEQ ID NO: 3951752 - RNA, 16 nt, Human herpesvirus 1
ucuacugcugggccau

SEQ ID NO: 3951753 - RNA, 17 nt, Human herpesvirus 1
ucuagccucguggggcu

SEQ ID NO: 3951754 - RNA, 15 nt, Human herpesvirus 1
ucuauaucucugggc

SEQ ID NO: 3951755 - RNA, 22 nt, Human herpesvirus 1
ucucccaccgccaucagccuua

SEQ ID NO: 3951756 - RNA, 13 nt, Human herpesvirus 1
ucuccccugcugc

SEQ ID NO: 3951757 - RNA, 16 nt, Human herpesvirus 1
ucucccgaaccaggcc

SEQ ID NO: 3951758 - RNA, 12 nt, Human herpesvirus 1
ucucccuguuca

SEQ ID NO: 3951759 - RNA, 17 nt, Human herpesvirus 1
ucuccucuucuccccuu

SEQ ID NO: 3951760 - RNA, 19 nt, Human herpesvirus 1
ucuccucuucuccccuucc

SEQ ID NO: 3951761 - RNA, 18 nt, Human herpesvirus 1
ucucucccgggccgcccc

SEQ ID NO: 3951762 - RNA, 24 nt, Human herpesvirus 1
ucugaccugcaccgaucgcagcgu

SEQ ID NO: 3951763 - RNA, 19 nt, Human herpesvirus 1
ucugcggccggcgggacuc

SEQ ID NO: 3951764 - RNA, 20 nt, Human herpesvirus 1
ucugcuccgcaacggggcgc

SEQ ID NO: 3951765 - RNA, 14 nt, Human herpesvirus 1
ucuggacuggacca

SEQ ID NO: 3951766 - RNA, 22 nt, Human herpesvirus 1
ucugggauggcuccuggccagg

SEQ ID NO: 3951767 - RNA, 19 nt, Human herpesvirus 1
ucugggccaccgacagccu

SEQ ID NO: 3951768 - RNA, 12 nt, Human herpesvirus 1
ucugggcgggcc

SEQ ID NO: 3951769 - RNA, 18 nt, Human herpesvirus 1
ucugucgguccacggcca

SEQ ID NO: 3951770 - RNA, 18 nt, Human herpesvirus 1
ucugucucgucuccucuu

SEQ ID NO: 3951771 - RNA, 11 nt, Human herpesvirus 1
acaaacacaaa

SEQ ID NO: 3951772 - RNA, 19 nt, Human herpesvirus 1
acaaacgacccaccaauaa

SEQ ID NO: 3951773 - RNA, 21 nt, Human herpesvirus 1
acaaccccggucucccaggga

SEQ ID NO: 3951774 - RNA, 22 nt, Human herpesvirus 1
acaaccccggucucccagggag

SEQ ID NO: 3951775 - RNA, 18 nt, Human herpesvirus 1
acaacccuacaaccugac

SEQ ID NO: 3951776 - RNA, 21 nt, Human herpesvirus 1
acaacgaccaggcgcgccgcg

SEQ ID NO: 3951777 - RNA, 23 nt, Human herpesvirus 1
acaacgaguaucugcgggccgcg

SEQ ID NO: 3951778 - RNA, 21 nt, Human herpesvirus 1
acaacgccagccugcggccgg

SEQ ID NO: 3951779 - RNA, 18 nt, Human herpesvirus 1
acaagucucugggggccu

SEQ ID NO: 3951780 - RNA, 12 nt, Human herpesvirus 1
acacaaggccaa

SEQ ID NO: 3951781 - RNA, 13 nt, Human herpesvirus 1
acaccaccagcug

SEQ ID NO: 3951782 - RNA, 16 nt, Human herpesvirus 1
acacccccgugacuca

SEQ ID NO: 3951783 - RNA, 18 nt, Human herpesvirus 1
acacgagcacccugcugc

SEQ ID NO: 3951784 - RNA, 21 nt, Human herpesvirus 1
acacgagcacccugcugcccc

SEQ ID NO: 3951785 - RNA, 14 nt, Human herpesvirus 1
acacggagcugcuc

SEQ ID NO: 3951786 - RNA, 14 nt, Human herpesvirus 1
acacgggcaccaca

SEQ ID NO: 3951787 - RNA, 13 nt, Human herpesvirus 1
acacgggcuaccc

SEQ ID NO: 3951788 - RNA, 14 nt, Human herpesvirus 1
acacucgacccccg

SEQ ID NO: 3951789 - RNA, 14 nt, Human herpesvirus 1
acacugaaaugccc

SEQ ID NO: 3951790 - RNA, 23 nt, Human herpesvirus 1
acagaugucaacgccgcuaccga

SEQ ID NO: 3951791 - RNA, 14 nt, Human herpesvirus 1
acagcgaccugggg

SEQ ID NO: 3951792 - RNA, 13 nt, Human herpesvirus 1
acagcggccugcu

SEQ ID NO: 3951793 - RNA, 22 nt, Human herpesvirus 1
acagcuggccgccgucgcacgc

SEQ ID NO: 3951794 - RNA, 21 nt, Human herpesvirus 1
acagggcgggccgccucgggg

SEQ ID NO: 3951795 - RNA, 19 nt, Human herpesvirus 1
acauucuccacuacuacgu

SEQ ID NO: 3951796 - RNA, 22 nt, Human herpesvirus 1
accaagagacgucgccccugug

SEQ ID NO: 3951797 - RNA, 13 nt, Human herpesvirus 1
accacacaccagc

SEQ ID NO: 3951798 - RNA, 13 nt, Human herpesvirus 1
accaccaaggccc

SEQ ID NO: 3951799 - RNA, 18 nt, Human herpesvirus 1
accaccaaggcccgggcc

SEQ ID NO: 3951800 - RNA, 11 nt, Human herpesvirus 1
accaccagcug

SEQ ID NO: 3951801 - RNA, 22 nt, Human herpesvirus 1
gcccccggcauggcgcagcugg

SEQ ID NO: 3951802 - RNA, 13 nt, Human herpesvirus 1
gccccgacccccu

SEQ ID NO: 3951803 - RNA, 20 nt, Human herpesvirus 1
gccccgauggcccuggacgc

SEQ ID NO: 3951804 - RNA, 23 nt, Human herpesvirus 1
gccccgcauaucccacccuggag

SEQ ID NO: 3951805 - RNA, 15 nt, Human herpesvirus 1
gccccgccacccagu

SEQ ID NO: 3951806 - RNA, 21 nt, Human herpesvirus 1
gccccgcuucauccccgagaa

SEQ ID NO: 3951807 - RNA, 14 nt, Human herpesvirus 1
gccccggaagaccc

SEQ ID NO: 3951808 - RNA, 19 nt, Human herpesvirus 1
gccccggaagaccccgagg

SEQ ID NO: 3951809 - RNA, 23 nt, Human herpesvirus 1
gccccggagggagaacccgacca

SEQ ID NO: 3951810 - RNA, 19 nt, Human herpesvirus 1
gccccggccgcccuucccg

SEQ ID NO: 3951811 - RNA, 18 nt, Human herpesvirus 1
gccccgggacacccccca

SEQ ID NO: 3951812 - RNA, 19 nt, Human herpesvirus 1
gccccuaaccaggccucca

SEQ ID NO: 3951813 - RNA, 20 nt, Human herpesvirus 1
gccccuaaccaggccuccac

SEQ ID NO: 3951814 - RNA, 16 nt, Human herpesvirus 1
gccccugggccccggg

SEQ ID NO: 3951815 - RNA, 14 nt, Human herpesvirus 1
gccccuguggcccu

SEQ ID NO: 3951816 - RNA, 14 nt, Human herpesvirus 1
gccccuuucccccu

SEQ ID NO: 3951817 - RNA, 18 nt, Human herpesvirus 1
gcccgaagacacccccca

SEQ ID NO: 3951818 - RNA, 18 nt, Human herpesvirus 1
gcccgauuuacagccccc

SEQ ID NO: 3951819 - RNA, 17 nt, Human herpesvirus 1
gcccgcaaacaggagcu

SEQ ID NO: 3951820 - RNA, 22 nt, Human herpesvirus 1
gcccgcaagggggggggggcau

SEQ ID NO: 3951821 - RNA, 15 nt, Human herpesvirus 1
gcccgcccuguaccg

SEQ ID NO: 3951822 - RNA, 18 nt, Human herpesvirus 1
gcccggaacgggaggcca

SEQ ID NO: 3951823 - RNA, 22 nt, Human herpesvirus 1
gcccggccaaccagcguccgcc

SEQ ID NO: 3951824 - RNA, 20 nt, Human herpesvirus 1
gcccggcccugcugcugccg

SEQ ID NO: 3951825 - RNA, 20 nt, Human herpesvirus 1
gcccgggccacggcgccgac

SEQ ID NO: 3951826 - RNA, 13 nt, Human herpesvirus 1
gcccggggccugc

SEQ ID NO: 3951827 - RNA, 14 nt, Human herpesvirus 1
gcccgggggccugg

SEQ ID NO: 3951828 - RNA, 13 nt, Human herpesvirus 1
gcccggguccccg

SEQ ID NO: 3951829 - RNA, 17 nt, Human herpesvirus 1
gcccguccucgcccgcc

SEQ ID NO: 3951830 - RNA, 22 nt, Human herpesvirus 1
gcccgucuuuaaccucccccgg

SEQ ID NO: 3951831 - RNA, 22 nt, Human herpesvirus 1
gcccgugauccuuaggggccgu

SEQ ID NO: 3951832 - RNA, 16 nt, Human herpesvirus 1
gcccguuaacccccca

SEQ ID NO: 3951833 - RNA, 21 nt, Human herpesvirus 1
gcccguugcagggccuggugc

SEQ ID NO: 3951834 - RNA, 23 nt, Human herpesvirus 1
gcccuaaccccaccccugugcua

SEQ ID NO: 3951835 - RNA, 19 nt, Human herpesvirus 1
gcccuccccccgcccccgg

SEQ ID NO: 3951836 - RNA, 17 nt, Human herpesvirus 1
gcccucgccacacccgc

SEQ ID NO: 3951837 - RNA, 21 nt, Human herpesvirus 1
gcccucgcgggccucgugggc

SEQ ID NO: 3951838 - RNA, 20 nt, Human herpesvirus 1
gcccugaccaacgacggccc

SEQ ID NO: 3951839 - RNA, 22 nt, Human herpesvirus 1
gcccugagcgcccuccugacca

SEQ ID NO: 3951840 - RNA, 21 nt, Human herpesvirus 1
gcccugccacuccggcgccgc

SEQ ID NO: 3951841 - RNA, 14 nt, Human herpesvirus 1
gccgcaaccagcug

SEQ ID NO: 3951842 - RNA, 19 nt, Human herpesvirus 1
gccgcaguacuaccuggcc

SEQ ID NO: 3951843 - RNA, 12 nt, Human herpesvirus 1
gccgccacgcgc

SEQ ID NO: 3951844 - RNA, 21 nt, Human herpesvirus 1
gccgccagcgcggcggggccc

SEQ ID NO: 3951845 - RNA, 13 nt, Human herpesvirus 1
gccgcccagcuca

SEQ ID NO: 3951846 - RNA, 14 nt, Human herpesvirus 1
gccgcccggggcca

SEQ ID NO: 3951847 - RNA, 21 nt, Human herpesvirus 1
gccgcccugagcgcccuccug

SEQ ID NO: 3951848 - RNA, 21 nt, Human herpesvirus 1
gccgccgaagggacucuggcg

SEQ ID NO: 3951849 - RNA, 15 nt, Human herpesvirus 1
gccgccgcgccccgc

SEQ ID NO: 3951850 - RNA, 18 nt, Human herpesvirus 1
gccgccucacgcccgcaa

SEQ ID NO: 3951851 - RNA, 16 nt, Human herpesvirus 1
gccgccucggcccgcg

SEQ ID NO: 3951852 - RNA, 22 nt, Human herpesvirus 1
gccgcgacccaggcggcgaacg

SEQ ID NO: 3951853 - RNA, 22 nt, Human herpesvirus 1
gccgcgcccacuacaccagcca

SEQ ID NO: 3951854 - RNA, 13 nt, Human herpesvirus 1
gccgcgcggacga

SEQ ID NO: 3951855 - RNA, 15 nt, Human herpesvirus 1
gccgcggaucgggcc

SEQ ID NO: 3951856 - RNA, 20 nt, Human herpesvirus 1
gccgcggguauagaucgacg

SEQ ID NO: 3951857 - RNA, 14 nt, Human herpesvirus 1
gccgcugaccccca

SEQ ID NO: 3951858 - RNA, 15 nt, Human herpesvirus 1
gccggcaacugacgc

SEQ ID NO: 3951859 - RNA, 20 nt, Human herpesvirus 1
gccggcacguaccugcggcu

SEQ ID NO: 3951860 - RNA, 21 nt, Human herpesvirus 1
gccggcguuucugaccugcac

SEQ ID NO: 3951861 - RNA, 23 nt, Human herpesvirus 1
gccggcguuucugaccugcaccg

SEQ ID NO: 3951862 - RNA, 13 nt, Human herpesvirus 1
gccgggagcacca

SEQ ID NO: 3951863 - RNA, 15 nt, Human herpesvirus 1
gccgggagcaccaca

SEQ ID NO: 3951864 - RNA, 16 nt, Human herpesvirus 1
gccgggcgacccagau

SEQ ID NO: 3951865 - RNA, 19 nt, Human herpesvirus 1
gccggggaccgcagccugg

SEQ ID NO: 3951866 - RNA, 20 nt, Human herpesvirus 1
gccggggaccgcagccuggu

SEQ ID NO: 3951867 - RNA, 21 nt, Human herpesvirus 1
gccguggcgccccggccccuc

SEQ ID NO: 3951868 - RNA, 19 nt, Human herpesvirus 1
gccuacacucgacccccgc

SEQ ID NO: 3951869 - RNA, 16 nt, Human herpesvirus 1
gccucccaacccccua

SEQ ID NO: 3951870 - RNA, 22 nt, Human herpesvirus 1
gccucccaacccccuaagaccc

SEQ ID NO: 3951871 - RNA, 13 nt, Human herpesvirus 1
gccucccccugag

SEQ ID NO: 3951872 - RNA, 18 nt, Human herpesvirus 1
gccucccccugagccgcu

SEQ ID NO: 3951873 - RNA, 15 nt, Human herpesvirus 1
gccuccgaccccaga

SEQ ID NO: 3951874 - RNA, 20 nt, Human herpesvirus 1
gccucgaugacgucccggcu

SEQ ID NO: 3951875 - RNA, 18 nt, Human herpesvirus 1
gccucggcccgcgaacgg

SEQ ID NO: 3951876 - RNA, 16 nt, Human herpesvirus 1
gccucgggggcgggac

SEQ ID NO: 3951877 - RNA, 12 nt, Human herpesvirus 1
gccucucccccc

SEQ ID NO: 3951878 - RNA, 15 nt, Human herpesvirus 1
gccucucgcugcugg

SEQ ID NO: 3951879 - RNA, 15 nt, Human herpesvirus 1
gccugacgcgccgcg

SEQ ID NO: 3951880 - RNA, 14 nt, Human herpesvirus 1
gccugccgccucac

SEQ ID NO: 3951881 - RNA, 20 nt, Human herpesvirus 1
gccugccucuccccccaggc

SEQ ID NO: 3951882 - RNA, 14 nt, Human herpesvirus 1
gccugccugcggcu

SEQ ID NO: 3951883 - RNA, 11 nt, Human herpesvirus 1
gccuggaggac

SEQ ID NO: 3951884 - RNA, 21 nt, Human herpesvirus 1
gccugggucuuccgcggagcu

SEQ ID NO: 3951885 - RNA, 19 nt, Human herpesvirus 1
gccuguguccgcuucucuu

SEQ ID NO: 3951886 - RNA, 17 nt, Human herpesvirus 1
gccuucacgugcugcug

SEQ ID NO: 3951887 - RNA, 19 nt, Human herpesvirus 1
gccuucacgugcugcugcg

SEQ ID NO: 3951888 - RNA, 14 nt, Human herpesvirus 1
gccuuuaacuacau

SEQ ID NO: 3951889 - RNA, 12 nt, Human herpesvirus 1
gccuuucccccc

SEQ ID NO: 3951890 - RNA, 18 nt, Human herpesvirus 1
gcgaagacccccccggag

SEQ ID NO: 3951891 - RNA, 18 nt, Human herpesvirus 1
gcgacaacgagcccccgc

SEQ ID NO: 3951892 - RNA, 20 nt, Human herpesvirus 1
gcgacaacgcgggcguuccc

SEQ ID NO: 3951893 - RNA, 13 nt, Human herpesvirus 1
gcgacccuccggg

SEQ ID NO: 3951894 - RNA, 23 nt, Human herpesvirus 1
gcgaccgcaacuucccacccgga

SEQ ID NO: 3951895 - RNA, 20 nt, Human herpesvirus 1
gcgaccgccggcgaggugga

SEQ ID NO: 3951896 - RNA, 20 nt, Human herpesvirus 1
gcgaccgucgccgcgggcca

SEQ ID NO: 3951897 - RNA, 22 nt, Human herpesvirus 1
gcgagcucccagagaccccagg

SEQ ID NO: 3951898 - RNA, 19 nt, Human herpesvirus 1
gcgaguccugcgccccgcc

SEQ ID NO: 3951899 - RNA, 17 nt, Human herpesvirus 1
gcgcaagcgccgcaaca

SEQ ID NO: 3951900 - RNA, 15 nt, Human herpesvirus 1
gcgcaauugcggcca

SEQ ID NO: 3951901 - RNA, 18 nt, Human herpesvirus 1
gcgcauacgccuccccca

SEQ ID NO: 3951902 - RNA, 23 nt, Human herpesvirus 1
gcgcaucuucggcgggugucugc

SEQ ID NO: 3951903 - RNA, 18 nt, Human herpesvirus 1
gcgccaaacgccagccug

SEQ ID NO: 3951904 - RNA, 21 nt, Human herpesvirus 1
gcgccaggucggcgaccgcca

SEQ ID NO: 3951905 - RNA, 19 nt, Human herpesvirus 1
gcgccaugcuggcggacgg

SEQ ID NO: 3951906 - RNA, 17 nt, Human herpesvirus 1
gcgccauggcgggacug

SEQ ID NO: 3951907 - RNA, 17 nt, Human herpesvirus 1
gcgcccacuacaccagc

SEQ ID NO: 3951908 - RNA, 12 nt, Human herpesvirus 1
gcgccccccaaa

SEQ ID NO: 3951909 - RNA, 12 nt, Human herpesvirus 1
gcgcccccgccc

SEQ ID NO: 3951910 - RNA, 11 nt, Human herpesvirus 1
gcgccccgaug

SEQ ID NO: 3951911 - RNA, 20 nt, Human herpesvirus 1
gcgccccggccccucauggg

SEQ ID NO: 3951912 - RNA, 12 nt, Human herpesvirus 1
gcgccgaccacc

SEQ ID NO: 3951913 - RNA, 19 nt, Human herpesvirus 1
gcgccgcaaaucccaccaa

SEQ ID NO: 3951914 - RNA, 20 nt, Human herpesvirus 1
gcgccguuggcccccgccuc

SEQ ID NO: 3951915 - RNA, 14 nt, Human herpesvirus 1
gcgccuagccaacc

SEQ ID NO: 3951916 - RNA, 20 nt, Human herpesvirus 1
gcgccuagccaaccuguggc

SEQ ID NO: 3951917 - RNA, 16 nt, Human herpesvirus 1
cccucccccuccgcau

SEQ ID NO: 3951918 - RNA, 22 nt, Human herpesvirus 1
cccucccgcugcgcaucccccc

SEQ ID NO: 3951919 - RNA, 13 nt, Human herpesvirus 1
cccucccgucacc

SEQ ID NO: 3951920 - RNA, 15 nt, Human herpesvirus 1
cccuccgcuggggcc

SEQ ID NO: 3951921 - RNA, 13 nt, Human herpesvirus 1
cccucgccacguc

SEQ ID NO: 3951922 - RNA, 19 nt, Human herpesvirus 1
cccucucuucccucagguc

SEQ ID NO: 3951923 - RNA, 21 nt, Human herpesvirus 1
cccucuuuuucuuuaaccgcg

SEQ ID NO: 3951924 - RNA, 18 nt, Human herpesvirus 1
cccugaccccgcuccugu

SEQ ID NO: 3951925 - RNA, 22 nt, Human herpesvirus 1
cccugcugcaggccccccgccg

SEQ ID NO: 3951926 - RNA, 12 nt, Human herpesvirus 1
cccuggccgugg

SEQ ID NO: 3951927 - RNA, 13 nt, Human herpesvirus 1
cccuggcgccgcc

SEQ ID NO: 3951928 - RNA, 17 nt, Human herpesvirus 1
cccuggcgccgccuggu

SEQ ID NO: 3951929 - RNA, 17 nt, Human herpesvirus 1
cccuggcggacggcggc

SEQ ID NO: 3951930 - RNA, 16 nt, Human herpesvirus 1
cccuguuugucgacga

SEQ ID NO: 3951931 - RNA, 22 nt, Human herpesvirus 1
cccuguuugucgccuggcuggc

SEQ ID NO: 3951932 - RNA, 16 nt, Human herpesvirus 1
cccuucccucccccuc

SEQ ID NO: 3951933 - RNA, 17 nt, Human herpesvirus 1
ccgaacccggcccgggg

SEQ ID NO: 3951934 - RNA, 14 nt, Human herpesvirus 1
ccgacaccaccagc

SEQ ID NO: 3951935 - RNA, 15 nt, Human herpesvirus 1
ccgacagcacucaca

SEQ ID NO: 3951936 - RNA, 13 nt, Human herpesvirus 1
ccgaccggguccc

SEQ ID NO: 3951937 - RNA, 12 nt, Human herpesvirus 1
ccgacgccucaa

SEQ ID NO: 3951938 - RNA, 15 nt, Human herpesvirus 1
ccgacguggcgcacg

SEQ ID NO: 3951939 - RNA, 14 nt, Human herpesvirus 1
ccgacuccccggac

SEQ ID NO: 3951940 - RNA, 18 nt, Human herpesvirus 1
ccgagccccccgcugcgg

SEQ ID NO: 3951941 - RNA, 21 nt, Human herpesvirus 1
ccgagccccccgcugcggcca

SEQ ID NO: 3951942 - RNA, 17 nt, Human herpesvirus 1
ccgagcuaugggccucu

SEQ ID NO: 3951943 - RNA, 19 nt, Human herpesvirus 1
ccgaggcgauuagccagca

SEQ ID NO: 3951944 - RNA, 16 nt, Human herpesvirus 1
ccgaggcggccugggu

SEQ ID NO: 3951945 - RNA, 15 nt, Human herpesvirus 1
ccgagggccgggccc

SEQ ID NO: 3951946 - RNA, 13 nt, Human herpesvirus 1
ccgaggggccaag

SEQ ID NO: 3951947 - RNA, 18 nt, Human herpesvirus 1
ccgaucccaacuccucag

SEQ ID NO: 3951948 - RNA, 21 nt, Human herpesvirus 1
ccgcaacgcgcuggggcugcc

SEQ ID NO: 3951949 - RNA, 16 nt, Human herpesvirus 1
ccgcaacuucccaccc

SEQ ID NO: 3951950 - RNA, 19 nt, Human herpesvirus 1
ccgcaauuugcacccagcc

SEQ ID NO: 3951951 - RNA, 23 nt, Human herpesvirus 1
ccgcagucccugaguugggaaua

SEQ ID NO: 3951952 - RNA, 22 nt, Human herpesvirus 1
ccgcauccacccuccgcugggg

SEQ ID NO: 3951953 - RNA, 14 nt, Human herpesvirus 1
ccgcaucccaggau

SEQ ID NO: 3951954 - RNA, 19 nt, Human herpesvirus 1
ccgccaaauaaagccacug

SEQ ID NO: 3951955 - RNA, 23 nt, Human herpesvirus 1
ccgccauguuugcgggccugggc

SEQ ID NO: 3951956 - RNA, 12 nt, Human herpesvirus 1
ccgccccacccc

SEQ ID NO: 3951957 - RNA, 17 nt, Human herpesvirus 1
ccgcccccaacaggugg

SEQ ID NO: 3951958 - RNA, 21 nt, Human herpesvirus 1
ccgcccccagcugggcccgga

SEQ ID NO: 3951959 - RNA, 21 nt, Human herpesvirus 1
ccgcccucacagggcgggccg

SEQ ID NO: 3951960 - RNA, 12 nt, Human herpesvirus 1
ccgccggcggcg

SEQ ID NO: 3951961 - RNA, 16 nt, Human herpesvirus 1
ccgccugucgcucguc

SEQ ID NO: 3951962 - RNA, 14 nt, Human herpesvirus 1
ccgccuuccggacc

SEQ ID NO: 3951963 - RNA, 22 nt, Human herpesvirus 1
ccgcgacccaccgggcccggcc

SEQ ID NO: 3951964 - RNA, 13 nt, Human herpesvirus 1
ccgcgacccggac

SEQ ID NO: 3951965 - RNA, 20 nt, Human herpesvirus 1
ccgcgacccggacgccgauc

SEQ ID NO: 3951966 - RNA, 22 nt, Human herpesvirus 1
ccgcgagcgccgcuacugcgcg

SEQ ID NO: 3951967 - RNA, 23 nt, Human herpesvirus 1
ccgcgauuccgagggccgggccc

SEQ ID NO: 3951968 - RNA, 14 nt, Human herpesvirus 1
ccgcgcccucgcca

SEQ ID NO: 3951969 - RNA, 21 nt, Human herpesvirus 1
ccgcgccgcugcccgacccgg

SEQ ID NO: 3951970 - RNA, 19 nt, Human herpesvirus 1
ccgcgcggacggcgcgggg

SEQ ID NO: 3951971 - RNA, 18 nt, Human herpesvirus 1
ccgcgcuccucccgccac

SEQ ID NO: 3951972 - RNA, 14 nt, Human herpesvirus 1
ccgcggaucgggcc

SEQ ID NO: 3951973 - RNA, 16 nt, Human herpesvirus 1
ccgcggaucugcuccg

SEQ ID NO: 3951974 - RNA, 19 nt, Human herpesvirus 1
ccgcgggcccccggccgcc

SEQ ID NO: 3951975 - RNA, 16 nt, Human herpesvirus 1
ccgcguccaaacccac

SEQ ID NO: 3951976 - RNA, 15 nt, Human herpesvirus 1
ccgcgucuggccccg

SEQ ID NO: 3951977 - RNA, 15 nt, Human herpesvirus 1
ccgcucgguggcucc

SEQ ID NO: 3951978 - RNA, 14 nt, Human herpesvirus 1
ccgcuggggccccc

SEQ ID NO: 3951979 - RNA, 18 nt, Human herpesvirus 1
ccgcuuuauaggccggga

SEQ ID NO: 3951980 - RNA, 11 nt, Human herpesvirus 1
ccggaaggaac

SEQ ID NO: 3951981 - RNA, 18 nt, Human herpesvirus 1
ccggacccguuccagccc

SEQ ID NO: 3951982 - RNA, 24 nt, Human herpesvirus 1
ccggacgacgugguccgcggggcc

SEQ ID NO: 3951983 - RNA, 14 nt, Human herpesvirus 1
ccggacgcgcggcg

SEQ ID NO: 3951984 - RNA, 21 nt, Human herpesvirus 1
ccggaggcgccgcgcggacgg

SEQ ID NO: 3951985 - RNA, 19 nt, Human herpesvirus 1
ccggaggcgccugccccgc

SEQ ID NO: 3951986 - RNA, 12 nt, Human herpesvirus 1
ccggaggugggg

SEQ ID NO: 3951987 - RNA, 15 nt, Human herpesvirus 1
ccggcacgccugggg

SEQ ID NO: 3951988 - RNA, 18 nt, Human herpesvirus 1
ccggcccauugggcggga

SEQ ID NO: 3951989 - RNA, 21 nt, Human herpesvirus 1
ccggccccugggccccgggac

SEQ ID NO: 3951990 - RNA, 16 nt, Human herpesvirus 1
ccggcccuaaccccac

SEQ ID NO: 3951991 - RNA, 22 nt, Human herpesvirus 1
ccggcccuaaccccaccccugu

SEQ ID NO: 3951992 - RNA, 17 nt, Human herpesvirus 1
ccggccuggcggcggcc

SEQ ID NO: 3951993 - RNA, 17 nt, Human herpesvirus 1
ccggccugggggccguc

SEQ ID NO: 3951994 - RNA, 13 nt, Human herpesvirus 1
ccggcgccgcccg

SEQ ID NO: 3951995 - RNA, 15 nt, Human herpesvirus 1
ccggcggacccaagc

SEQ ID NO: 3951996 - RNA, 16 nt, Human herpesvirus 1
ccggcggacccaagcc

SEQ ID NO: 3951997 - RNA, 16 nt, Human herpesvirus 1
ccggcggacccccgga

SEQ ID NO: 3951998 - RNA, 23 nt, Human herpesvirus 1
ccggcgggguuauaggccacgca

SEQ ID NO: 3951999 - RNA, 13 nt, Human herpesvirus 1
ccggcggucgcgc

SEQ ID NO: 3952000 - RNA, 19 nt, Human herpesvirus 1
ccggcggucgcgcuccucu

SEQ ID NO: 3952001 - RNA, 16 nt, Human herpesvirus 1
ccgggaagcagggccc

SEQ ID NO: 3952002 - RNA, 15 nt, Human herpesvirus 1
ccgggacgaggccgu

SEQ ID NO: 3952003 - RNA, 16 nt, Human herpesvirus 1
ccgggacuccgcggac

SEQ ID NO: 3952004 - RNA, 15 nt, Human herpesvirus 1
ccgggagccccggac

SEQ ID NO: 3952005 - RNA, 14 nt, Human herpesvirus 1
ccgggcgaugagcc

SEQ ID NO: 3952006 - RNA, 14 nt, Human herpesvirus 1
ccgggcgcgucccc

SEQ ID NO: 3952007 - RNA, 16 nt, Human herpesvirus 1
ccgggcgcuuggcaug

SEQ ID NO: 3952008 - RNA, 17 nt, Human herpesvirus 1
ccgggcgcuuggcaugc

SEQ ID NO: 3952009 - RNA, 16 nt, Human herpesvirus 1
ccggggaucugguccg

SEQ ID NO: 3952010 - RNA, 13 nt, Human herpesvirus 1
ccgggggccuggu

SEQ ID NO: 3952011 - RNA, 21 nt, Human herpesvirus 1
ccggguacggcgucugggcca

SEQ ID NO: 3952012 - RNA, 13 nt, Human herpesvirus 1
ccgggucccuccu

SEQ ID NO: 3952013 - RNA, 15 nt, Human herpesvirus 1
ccgggucuguugggg

SEQ ID NO: 3952014 - RNA, 15 nt, Human herpesvirus 1
ccggguuccgcgacc

SEQ ID NO: 3952015 - RNA, 20 nt, Human herpesvirus 1
ccggucaacgaggguugggg

SEQ ID NO: 3952016 - RNA, 13 nt, Human herpesvirus 1
ccggucucccagg

SEQ ID NO: 3952017 - RNA, 12 nt, Human herpesvirus 1
ccguccccugcc

SEQ ID NO: 3952018 - RNA, 20 nt, Human herpesvirus 1
ccgucccguagucccauccc

SEQ ID NO: 3952019 - RNA, 14 nt, Human herpesvirus 1
ccgucgaagcugau

SEQ ID NO: 3952020 - RNA, 22 nt, Human herpesvirus 1
ccgucgauccaggacgccgcga

SEQ ID NO: 3952021 - RNA, 20 nt, Human herpesvirus 1
ccgucgcacgcguccagucg

SEQ ID NO: 3952022 - RNA, 22 nt, Human herpesvirus 1
ccgucgcccgauuuacagcccc

SEQ ID NO: 3952023 - RNA, 15 nt, Human herpesvirus 1
ccgucgccgcgggcc

SEQ ID NO: 3952024 - RNA, 17 nt, Human herpesvirus 1
ccgucuggguuuucccc

SEQ ID NO: 3952025 - RNA, 14 nt, Human herpesvirus 1
ccgugcaccguggg

SEQ ID NO: 3952026 - RNA, 15 nt, Human herpesvirus 1
ccguggccccggccc

SEQ ID NO: 3952027 - RNA, 21 nt, Human herpesvirus 1
ccguggccgacaacugccuga

SEQ ID NO: 3952028 - RNA, 18 nt, Human herpesvirus 1
ccguggccggccugcgcg

SEQ ID NO: 3952029 - RNA, 13 nt, Human herpesvirus 1
ccguugcccgggc

SEQ ID NO: 3952030 - RNA, 19 nt, Human herpesvirus 1
ccguugcccgggccuccuc

SEQ ID NO: 3952031 - RNA, 15 nt, Human herpesvirus 1
ccguuucgggcggca

SEQ ID NO: 3952032 - RNA, 17 nt, Human herpesvirus 1
gagcgcccuccugacca

SEQ ID NO: 3952033 - RNA, 18 nt, Human herpesvirus 1
gagcgcgcuuguccccga

SEQ ID NO: 3952034 - RNA, 18 nt, Human herpesvirus 1
gagcggcaccaccggggc

SEQ ID NO: 3952035 - RNA, 17 nt, Human herpesvirus 1
gagcguuucugucggac

SEQ ID NO: 3952036 - RNA, 19 nt, Human herpesvirus 1
gagcucaucgcgacccugu

SEQ ID NO: 3952037 - RNA, 12 nt, Human herpesvirus 1
gaggaucacgag

SEQ ID NO: 3952038 - RNA, 19 nt, Human herpesvirus 1
gaggcaguuaacugucugg

SEQ ID NO: 3952039 - RNA, 18 nt, Human herpesvirus 1
gaggccacguguagccug

SEQ ID NO: 3952040 - RNA, 16 nt, Human herpesvirus 1
gaggcgccugccccgc

SEQ ID NO: 3952041 - RNA, 15 nt, Human herpesvirus 1
gaggggggagauggg

SEQ ID NO: 3952042 - RNA, 23 nt, Human herpesvirus 1
gaggugcuucuguuuggcgcccc

SEQ ID NO: 3952043 - RNA, 21 nt, Human herpesvirus 1
gaguacccgcucucgcgcgug

SEQ ID NO: 3952044 - RNA, 20 nt, Human herpesvirus 1
gauagagucgacgaccuggg

SEQ ID NO: 3952045 - RNA, 16 nt, Human herpesvirus 1
gaucccaacaacuccc

SEQ ID NO: 3952046 - RNA, 14 nt, Human herpesvirus 1
gaucccccgcgcgg

SEQ ID NO: 3952047 - RNA, 20 nt, Human herpesvirus 1
gaucccccgcgcggcugcca

SEQ ID NO: 3952048 - RNA, 21 nt, Human herpesvirus 1
gaucccccgcgcggcugccaa

SEQ ID NO: 3952049 - RNA, 12 nt, Human herpesvirus 1
gauccggcggga

SEQ ID NO: 3952050 - RNA, 18 nt, Human herpesvirus 1
ccagaucuacugcugggc

SEQ ID NO: 3952051 - RNA, 19 nt, Human herpesvirus 1
ccagaucuacugcugggcc

SEQ ID NO: 3952052 - RNA, 24 nt, Human herpesvirus 1
ccagaucuacugcugggccaugga

SEQ ID NO: 3952053 - RNA, 20 nt, Human herpesvirus 1
ccagccccagaaaccccgga

SEQ ID NO: 3952054 - RNA, 19 nt, Human herpesvirus 1
ccagccuguuuguccuggg

SEQ ID NO: 3952055 - RNA, 18 nt, Human herpesvirus 1
ccagcgcagaggcggcca

SEQ ID NO: 3952056 - RNA, 15 nt, Human herpesvirus 1
ccagcuaugggcccu

SEQ ID NO: 3952057 - RNA, 19 nt, Human herpesvirus 1
ccaggaaauccguggcccc

SEQ ID NO: 3952058 - RNA, 19 nt, Human herpesvirus 1
ccaggaucacaccggucaa

SEQ ID NO: 3952059 - RNA, 14 nt, Human herpesvirus 1
ccaggccuccaccc

SEQ ID NO: 3952060 - RNA, 15 nt, Human herpesvirus 1
ccaggcgcgccgcga

SEQ ID NO: 3952061 - RNA, 18 nt, Human herpesvirus 1
ccagggagaaaccccagc

SEQ ID NO: 3952062 - RNA, 12 nt, Human herpesvirus 1
ccagggagcccc

SEQ ID NO: 3952063 - RNA, 23 nt, Human herpesvirus 1
ccagggcacccaaggggccgugc

SEQ ID NO: 3952064 - RNA, 16 nt, Human herpesvirus 1
ccagggcggggcucag

SEQ ID NO: 3952065 - RNA, 18 nt, Human herpesvirus 1
ccaggucggcgaccgcca

SEQ ID NO: 3952066 - RNA, 22 nt, Human herpesvirus 1
ccaggucggcgaccgccagccg

SEQ ID NO: 3952067 - RNA, 20 nt, Human herpesvirus 1
ccaguggcuccgggccaacc

SEQ ID NO: 3952068 - RNA, 21 nt, Human herpesvirus 1
ccaguggcuccgggccaacca

SEQ ID NO: 3952069 - RNA, 17 nt, Human herpesvirus 1
ccaguugagccgcgcca

SEQ ID NO: 3952070 - RNA, 21 nt, Human herpesvirus 1
ccaucaccccgcaauuugcac

SEQ ID NO: 3952071 - RNA, 14 nt, Human herpesvirus 1
ccaucccccgaucc

SEQ ID NO: 3952072 - RNA, 18 nt, Human herpesvirus 1
ccauccgaacgcagcccc

SEQ ID NO: 3952073 - RNA, 20 nt, Human herpesvirus 1
ccauccugcggcucguggcg

SEQ ID NO: 3952074 - RNA, 22 nt, Human herpesvirus 1
ccaucgaguucgccaggcugca

SEQ ID NO: 3952075 - RNA, 20 nt, Human herpesvirus 1
ccaucgccucggccaccgug

SEQ ID NO: 3952076 - RNA, 13 nt, Human herpesvirus 1
ccaucgguccccu

SEQ ID NO: 3952077 - RNA, 17 nt, Human herpesvirus 1
ccaucugggauggcucc

SEQ ID NO: 3952078 - RNA, 19 nt, Human herpesvirus 1
ccauggacagcgaccuggg

SEQ ID NO: 3952079 - RNA, 20 nt, Human herpesvirus 1
ccauggacagcgaccugggg

SEQ ID NO: 3952080 - RNA, 16 nt, Human herpesvirus 1
ccauguccggcagggg

SEQ ID NO: 3952081 - RNA, 20 nt, Human herpesvirus 1
ccauguuugcgggccugggc

SEQ ID NO: 3952082 - RNA, 18 nt, Human herpesvirus 1
cccaacaacucccccgcg

SEQ ID NO: 3952083 - RNA, 17 nt, Human herpesvirus 1
cccaacccccggcccca

SEQ ID NO: 3952084 - RNA, 20 nt, Human herpesvirus 1
cccaacccccuaagacccac

SEQ ID NO: 3952085 - RNA, 17 nt, Human herpesvirus 1
cccaacuccagaccacc

SEQ ID NO: 3952086 - RNA, 14 nt, Human herpesvirus 1
cccaacuccucagc

SEQ ID NO: 3952087 - RNA, 22 nt, Human herpesvirus 1
cccaauaaacguauaucgcuac

SEQ ID NO: 3952088 - RNA, 17 nt, Human herpesvirus 1
cccacacagcccucccg

SEQ ID NO: 3952089 - RNA, 18 nt, Human herpesvirus 1
cccaccccccgacgccag

SEQ ID NO: 3952090 - RNA, 17 nt, Human herpesvirus 1
cccaccgacacaugcac

SEQ ID NO: 3952091 - RNA, 18 nt, Human herpesvirus 1
cccaccguugcccgggcc

SEQ ID NO: 3952092 - RNA, 14 nt, Human herpesvirus 1
cccacgcucucccc

SEQ ID NO: 3952093 - RNA, 18 nt, Human herpesvirus 1
cccacuacaccagccaau

SEQ ID NO: 3952094 - RNA, 19 nt, Human herpesvirus 1
cccacuacaccagccaauc

SEQ ID NO: 3952095 - RNA, 13 nt, Human herpesvirus 1
cccagaccccggg

SEQ ID NO: 3952096 - RNA, 13 nt, Human herpesvirus 1
cccagaugcccac

SEQ ID NO: 3952097 - RNA, 16 nt, Human herpesvirus 1
cccagaugcccacggg

SEQ ID NO: 3952098 - RNA, 18 nt, Human herpesvirus 1
cccagauuguccgcgggg

SEQ ID NO: 3952099 - RNA, 12 nt, Human herpesvirus 1
cccagcaccgac

SEQ ID NO: 3952100 - RNA, 15 nt, Human herpesvirus 1
cccagcagcucccca

SEQ ID NO: 3952101 - RNA, 16 nt, Human herpesvirus 1
cccaggaucacaccgg

SEQ ID NO: 3952102 - RNA, 20 nt, Human herpesvirus 1
cccaggcggcgaacgggggc

SEQ ID NO: 3952103 - RNA, 13 nt, Human herpesvirus 1
cccaguccccggg

SEQ ID NO: 3952104 - RNA, 18 nt, Human herpesvirus 1
cccaguccccgggcccag

SEQ ID NO: 3952105 - RNA, 23 nt, Human herpesvirus 1
cccaucccgaggccccacgucgg

SEQ ID NO: 3952106 - RNA, 19 nt, Human herpesvirus 1
cccauccggugguccgugu

SEQ ID NO: 3952107 - RNA, 15 nt, Human herpesvirus 1
cccaucuaaugccac

SEQ ID NO: 3952108 - RNA, 12 nt, Human herpesvirus 1
ccccaaggaggg

SEQ ID NO: 3952109 - RNA, 14 nt, Human herpesvirus 1
ccccaccccugugc

SEQ ID NO: 3952110 - RNA, 21 nt, Human herpesvirus 1
ccccaguggguuuugcggacc

SEQ ID NO: 3952111 - RNA, 19 nt, Human herpesvirus 1
ccccaugcgggcucggcuc

SEQ ID NO: 3952112 - RNA, 19 nt, Human herpesvirus 1
cccccauaagguccguccg

SEQ ID NO: 3952113 - RNA, 21 nt, Human herpesvirus 1
cccccaucuaaugccacgcga

SEQ ID NO: 3952114 - RNA, 13 nt, Human herpesvirus 1
cccccccaagcgc

SEQ ID NO: 3952115 - RNA, 13 nt, Human herpesvirus 1
cccccccucgcgc

SEQ ID NO: 3952116 - RNA, 20 nt, Human herpesvirus 1
cccccggugccaauaaaccc

SEQ ID NO: 3952117 - RNA, 20 nt, Human herpesvirus 1
cccccgucgaagcugauguc

SEQ ID NO: 3952118 - RNA, 13 nt, Human herpesvirus 1
cccccuccgcgcc

SEQ ID NO: 3952119 - RNA, 22 nt, Human herpesvirus 1
cccccucuaucccgcccaccgc

SEQ ID NO: 3952120 - RNA, 11 nt, Human herpesvirus 1
cccccuggccu

SEQ ID NO: 3952121 - RNA, 14 nt, Human herpesvirus 1
ccccgacaugaccg

SEQ ID NO: 3952122 - RNA, 19 nt, Human herpesvirus 1
ccccgaggauucggcccuc

SEQ ID NO: 3952123 - RNA, 12 nt, Human herpesvirus 1
ccccgccaccca

SEQ ID NO: 3952124 - RNA, 21 nt, Human herpesvirus 1
ccccgcgagguccgaagacuc

SEQ ID NO: 3952125 - RNA, 14 nt, Human herpesvirus 1
ccccgcucccucga

SEQ ID NO: 3952126 - RNA, 16 nt, Human herpesvirus 1
ccccgcuucauccccg

SEQ ID NO: 3952127 - RNA, 20 nt, Human herpesvirus 1
ccccggaggcguuccgggca

SEQ ID NO: 3952128 - RNA, 16 nt, Human herpesvirus 1
ccccggagggcugcca

SEQ ID NO: 3952129 - RNA, 16 nt, Human herpesvirus 1
ccccggaggggcuccu

SEQ ID NO: 3952130 - RNA, 20 nt, Human herpesvirus 1
ccccggauaugcgcgggguu

SEQ ID NO: 3952131 - RNA, 19 nt, Human herpesvirus 1
ccccggauggggcccgggu

SEQ ID NO: 3952132 - RNA, 12 nt, Human herpesvirus 1
ccccggccccca

SEQ ID NO: 3952133 - RNA, 14 nt, Human herpesvirus 1
ccccggggcgggug

SEQ ID NO: 3952134 - RNA, 16 nt, Human herpesvirus 1
ccccggggcucagcca

SEQ ID NO: 3952135 - RNA, 15 nt, Human herpesvirus 1
ccccggucucccagg

SEQ ID NO: 3952136 - RNA, 22 nt, Human herpesvirus 1
ccccguccccuucgaggaggug

SEQ ID NO: 3952137 - RNA, 16 nt, Human herpesvirus 1
ccccucguucugcugc

SEQ ID NO: 3952138 - RNA, 13 nt, Human herpesvirus 1
ccccugagccgcu

SEQ ID NO: 3952139 - RNA, 21 nt, Human herpesvirus 1
ccccuucuccccacaacaugg

SEQ ID NO: 3952140 - RNA, 12 nt, Human herpesvirus 1
cccgaaccaggc

SEQ ID NO: 3952141 - RNA, 14 nt, Human herpesvirus 1
cccgagaccagucg

SEQ ID NO: 3952142 - RNA, 21 nt, Human herpesvirus 1
cccgcacagaugggacgccau

SEQ ID NO: 3952143 - RNA, 12 nt, Human herpesvirus 1
cccgcccaccgg

SEQ ID NO: 3952144 - RNA, 16 nt, Human herpesvirus 1
cccgcccggguccccg

SEQ ID NO: 3952145 - RNA, 14 nt, Human herpesvirus 1
cccgcgacccggac

SEQ ID NO: 3952146 - RNA, 16 nt, Human herpesvirus 1
cccgcgcaugcucugg

SEQ ID NO: 3952147 - RNA, 17 nt, Human herpesvirus 1
cccgcgcgggggcgccg

SEQ ID NO: 3952148 - RNA, 15 nt, Human herpesvirus 1
cccgcgcuaugacgg

SEQ ID NO: 3952149 - RNA, 21 nt, Human herpesvirus 1
cccgcgcuaugacggcaauaa

SEQ ID NO: 3952150 - RNA, 22 nt, Human herpesvirus 1
cccgcggaaacguucgcgcgcc

SEQ ID NO: 3952151 - RNA, 15 nt, Human herpesvirus 1
cccgcguccacccgg

SEQ ID NO: 3952152 - RNA, 23 nt, Human herpesvirus 1
cccgcgucgggauccacaccgcg

SEQ ID NO: 3952153 - RNA, 18 nt, Human herpesvirus 1
cccgcgugcaacgcggga

SEQ ID NO: 3952154 - RNA, 14 nt, Human herpesvirus 1
cccgcucucgcgcg

SEQ ID NO: 3952155 - RNA, 21 nt, Human herpesvirus 1
cccgcugcgcauccccccguc

SEQ ID NO: 3952156 - RNA, 18 nt, Human herpesvirus 1
cccggccaccccgaacaa

SEQ ID NO: 3952157 - RNA, 21 nt, Human herpesvirus 1
cccggcccggaggaggcucuc

SEQ ID NO: 3952158 - RNA, 14 nt, Human herpesvirus 1
cccggcccugcugc

SEQ ID NO: 3952159 - RNA, 19 nt, Human herpesvirus 1
cccggcccugcugcugccg

SEQ ID NO: 3952160 - RNA, 15 nt, Human herpesvirus 1
cccggcuagacccac

SEQ ID NO: 3952161 - RNA, 18 nt, Human herpesvirus 1
cccggcuagacccacggg

SEQ ID NO: 3952162 - RNA, 17 nt, Human herpesvirus 1
cccgggccacggcgccg

SEQ ID NO: 3952163 - RNA, 19 nt, Human herpesvirus 1
cccgggcgcgcccucuucu

SEQ ID NO: 3952164 - RNA, 21 nt, Human herpesvirus 1
cccggguacgaccaucacccg

SEQ ID NO: 3952165 - RNA, 14 nt, Human herpesvirus 1
cccggucgccgagc

SEQ ID NO: 3952166 - RNA, 20 nt, Human herpesvirus 1
cccguccgaagaucgcgugu

SEQ ID NO: 3952167 - RNA, 19 nt, Human herpesvirus 1
ugucggggaggggaaaagu

SEQ ID NO: 3952168 - RNA, 17 nt, Human herpesvirus 1
ugugccaucgcgccccc

SEQ ID NO: 3952169 - RNA, 22 nt, Human herpesvirus 1
uguggggacccggcccuaaccc

SEQ ID NO: 3952170 - RNA, 13 nt, Human herpesvirus 1
uguguuucagaua

SEQ ID NO: 3952171 - RNA, 13 nt, Human herpesvirus 1
uguucacaggggg

SEQ ID NO: 3952172 - RNA, 16 nt, Human herpesvirus 1
uguuuucguggacucg

SEQ ID NO: 3952173 - RNA, 14 nt, Human herpesvirus 1
uuaacuacauuaaa

SEQ ID NO: 3952174 - RNA, 12 nt, Human herpesvirus 1
uuaauguaaaua

SEQ ID NO: 3952175 - RNA, 18 nt, Human herpesvirus 1
uuccagccccccagccuc

SEQ ID NO: 3952176 - RNA, 15 nt, Human herpesvirus 1
uuccaggucccaccu

SEQ ID NO: 3952177 - RNA, 12 nt, Human herpesvirus 1
uucccacgcuuc

SEQ ID NO: 3952178 - RNA, 15 nt, Human herpesvirus 1
uucccccccaucacc

SEQ ID NO: 3952179 - RNA, 15 nt, Human herpesvirus 1
uuccgguaugggggg

SEQ ID NO: 3952180 - RNA, 16 nt, Human herpesvirus 1
uucguggaaccaugac

SEQ ID NO: 3952181 - RNA, 20 nt, Human herpesvirus 1
uucugaucgcguaccagccc

SEQ ID NO: 3952182 - RNA, 12 nt, Human herpesvirus 1
uucuguggccuc

SEQ ID NO: 3952183 - RNA, 14 nt, Human herpesvirus 1
uugagccccucgcc

SEQ ID NO: 3952184 - RNA, 12 nt, Human herpesvirus 1
uugcccgggccg

SEQ ID NO: 3952185 - RNA, 18 nt, Human herpesvirus 1
uugccgugguccugugga

SEQ ID NO: 3952186 - RNA, 18 nt, Human herpesvirus 1
uugcggccacgggcugcg

SEQ ID NO: 3952187 - RNA, 21 nt, Human herpesvirus 1
uuggcccccggacccgggccg

SEQ ID NO: 3952188 - RNA, 22 nt, Human herpesvirus 1
uuggccggggagggcagggccg

SEQ ID NO: 3952189 - RNA, 18 nt, Human herpesvirus 1
uugggcgggaggaagcca

SEQ ID NO: 3952190 - RNA, 23 nt, Human herpesvirus 1
uuguauguccccaaaauaaaaga

SEQ ID NO: 3952191 - RNA, 21 nt, Human herpesvirus 1
uugucugcguauuccagggcg

SEQ ID NO: 3952192 - RNA, 22 nt, Human herpesvirus 1
uuucggugucuaacgguccuca

SEQ ID NO: 3952193 - RNA, 14 nt, Human herpesvirus 1
uuugcccauaauaa

SEQ ID NO: 3952194 - RNA, 15 nt, Human herpesvirus 1
uuuucgagugucgca

SEQ ID NO: 3952195 - RNA, 15 nt, Human herpesvirus 1
uuuuguuugucguca

SEQ ID NO: 3952196 - RNA, 19 nt, Human herpesvirus 1
ucaccaugcagcgccggac

SEQ ID NO: 3952197 - RNA, 17 nt, Human herpesvirus 1
ucacccacgccggcacc

SEQ ID NO: 3952198 - RNA, 17 nt, Human herpesvirus 1
ucaccccgcaauuugca

SEQ ID NO: 3952199 - RNA, 18 nt, Human herpesvirus 1
ucaccccgcaauuugcac

SEQ ID NO: 3952200 - RNA, 16 nt, Human herpesvirus 1
ucaccggcggaccccc

SEQ ID NO: 3952201 - RNA, 18 nt, Human herpesvirus 1
ucaccggugcgcccccca

SEQ ID NO: 3952202 - RNA, 13 nt, Human herpesvirus 1
ucaccguggccug

SEQ ID NO: 3952203 - RNA, 14 nt, Human herpesvirus 1
ucaccguggccugg

SEQ ID NO: 3952204 - RNA, 16 nt, Human herpesvirus 1
ucacgagcugacccug

SEQ ID NO: 3952205 - RNA, 21 nt, Human herpesvirus 1
ucacggugaccgcgugcccac

SEQ ID NO: 3952206 - RNA, 20 nt, Human herpesvirus 1
ucagagacaacgcgacaggc

SEQ ID NO: 3952207 - RNA, 16 nt, Human herpesvirus 1
ucagccugccucuccc

SEQ ID NO: 3952208 - RNA, 16 nt, Human herpesvirus 1
ucagcgacguccuggg

SEQ ID NO: 3952209 - RNA, 19 nt, Human herpesvirus 1
ucagcgacguccugggcca

SEQ ID NO: 3952210 - RNA, 19 nt, Human herpesvirus 1
ucagcuguggacccgagcu

SEQ ID NO: 3952211 - RNA, 12 nt, Human herpesvirus 1
ucagggcggcgg

SEQ ID NO: 3952212 - RNA, 22 nt, Human herpesvirus 1
ucagggcucuacccucuggacg

SEQ ID NO: 3952213 - RNA, 16 nt, Human herpesvirus 1
ucauccacaccuuauc

SEQ ID NO: 3952214 - RNA, 12 nt, Human herpesvirus 1
ucauccacgccg

SEQ ID NO: 3952215 - RNA, 22 nt, Human herpesvirus 1
ucaucgggggaguugugaucau

SEQ ID NO: 3952216 - RNA, 21 nt, Human herpesvirus 1
uccacacccaguggcuccggg

SEQ ID NO: 3952217 - RNA, 15 nt, Human herpesvirus 1
uccacaccugcacca

SEQ ID NO: 3952218 - RNA, 17 nt, Human herpesvirus 1
uccaccaaagucucugu

SEQ ID NO: 3952219 - RNA, 15 nt, Human herpesvirus 1
uccaccccccauguc

SEQ ID NO: 3952220 - RNA, 18 nt, Human herpesvirus 1
uccacgaacccagcgacc

SEQ ID NO: 3952221 - RNA, 20 nt, Human herpesvirus 1
uccacgaacccagcgaccuc

SEQ ID NO: 3952222 - RNA, 14 nt, Human herpesvirus 1
uccacgacaacccc

SEQ ID NO: 3952223 - RNA, 19 nt, Human herpesvirus 1
uccacggccaaguacgugc

SEQ ID NO: 3952224 - RNA, 20 nt, Human herpesvirus 1
uccacggccacuggccggga

SEQ ID NO: 3952225 - RNA, 17 nt, Human herpesvirus 1
uccaugcagugcauggc

SEQ ID NO: 3952226 - RNA, 18 nt, Human herpesvirus 1
ucccaccaacgucuccuc

SEQ ID NO: 3952227 - RNA, 18 nt, Human herpesvirus 1
ucccacgcucuccccugc

SEQ ID NO: 3952228 - RNA, 16 nt, Human herpesvirus 1
ucccauuaucccauuc

SEQ ID NO: 3952229 - RNA, 20 nt, Human herpesvirus 1
uccccaagcaucgaccacgc

SEQ ID NO: 3952230 - RNA, 17 nt, Human herpesvirus 1
ucccccaagggggaggg

SEQ ID NO: 3952231 - RNA, 16 nt, Human herpesvirus 1
ucccccacaccaccua

SEQ ID NO: 3952232 - RNA, 18 nt, Human herpesvirus 1
uccccgauggcccuccag

SEQ ID NO: 3952233 - RNA, 12 nt, Human herpesvirus 1
uccccggcccgg

SEQ ID NO: 3952234 - RNA, 17 nt, Human herpesvirus 1
uccccuucccucccccu

SEQ ID NO: 3952235 - RNA, 13 nt, Human herpesvirus 1
uccccuuccucgc

SEQ ID NO: 3952236 - RNA, 17 nt, Human herpesvirus 1
ucccgacaccaccagcu

SEQ ID NO: 3952237 - RNA, 19 nt, Human herpesvirus 1
ucccgacaccaccagcugg

SEQ ID NO: 3952238 - RNA, 19 nt, Human herpesvirus 1
ucccgaccuccggucccga

SEQ ID NO: 3952239 - RNA, 19 nt, Human herpesvirus 1
ucccgcccaccgcugggcg

SEQ ID NO: 3952240 - RNA, 23 nt, Human herpesvirus 1
ucccgccuuccggaccugcucuc

SEQ ID NO: 3952241 - RNA, 22 nt, Human herpesvirus 1
ucccggcccguaacgucgcggg

SEQ ID NO: 3952242 - RNA, 12 nt, Human herpesvirus 1
ucccggcgccgg

SEQ ID NO: 3952243 - RNA, 22 nt, Human herpesvirus 1
ucccggcgggguuauaggccac

SEQ ID NO: 3952244 - RNA, 22 nt, Human herpesvirus 1
ucccgguaugguaauuagaaac

SEQ ID NO: 3952245 - RNA, 16 nt, Human herpesvirus 1
ucccguagucccaucc

SEQ ID NO: 3952246 - RNA, 19 nt, Human herpesvirus 1
ucccucccccuccgcaucc

SEQ ID NO: 3952247 - RNA, 17 nt, Human herpesvirus 1
uccgcaagccccuagcc

SEQ ID NO: 3952248 - RNA, 20 nt, Human herpesvirus 1
uccgcaccaagccgcucucc

SEQ ID NO: 3952249 - RNA, 15 nt, Human herpesvirus 1
uccgcaucccaggau

SEQ ID NO: 3952250 - RNA, 22 nt, Human herpesvirus 1
uccgccggcaacugacgcuggc

SEQ ID NO: 3952251 - RNA, 13 nt, Human herpesvirus 1
uccgcgccaggcc

SEQ ID NO: 3952252 - RNA, 22 nt, Human herpesvirus 1
uccgcgccccccgacccuccca

SEQ ID NO: 3952253 - RNA, 22 nt, Human herpesvirus 1
uccggaaacaacccuacaaccu

SEQ ID NO: 3952254 - RNA, 14 nt, Human herpesvirus 1
uccggaggcgccgc

SEQ ID NO: 3952255 - RNA, 19 nt, Human herpesvirus 1
uccggcaauucccgcggcc

SEQ ID NO: 3952256 - RNA, 22 nt, Human herpesvirus 1
uccggcagggggaugggggggc

SEQ ID NO: 3952257 - RNA, 13 nt, Human herpesvirus 1
uccggccugggcc

SEQ ID NO: 3952258 - RNA, 21 nt, Human herpesvirus 1
ggcgacccugaucccccgcgc

SEQ ID NO: 3952259 - RNA, 18 nt, Human herpesvirus 1
ggcgaccgccggcggcga

SEQ ID NO: 3952260 - RNA, 22 nt, Human herpesvirus 1
ggcgcccaccccgugugccgcg

SEQ ID NO: 3952261 - RNA, 12 nt, Human herpesvirus 1
ggcgccgcgaga

SEQ ID NO: 3952262 - RNA, 16 nt, Human herpesvirus 1
ggcgcgcuucuacccg

SEQ ID NO: 3952263 - RNA, 14 nt, Human herpesvirus 1
ggcgcggcucgugg

SEQ ID NO: 3952264 - RNA, 18 nt, Human herpesvirus 1
ggcgcuggguggucucug

SEQ ID NO: 3952265 - RNA, 16 nt, Human herpesvirus 1
ggcggaaaccguaacg

SEQ ID NO: 3952266 - RNA, 20 nt, Human herpesvirus 1
ggcggacccccggaggcgcc

SEQ ID NO: 3952267 - RNA, 23 nt, Human herpesvirus 1
ggcggacccccggaggcgccugc

SEQ ID NO: 3952268 - RNA, 16 nt, Human herpesvirus 1
ggcggauuuggggcgc

SEQ ID NO: 3952269 - RNA, 20 nt, Human herpesvirus 1
ggcggcgacuuugacgaggc

SEQ ID NO: 3952270 - RNA, 14 nt, Human herpesvirus 1
ggcgggacuggcca

SEQ ID NO: 3952271 - RNA, 13 nt, Human herpesvirus 1
ggcgggagccacc

SEQ ID NO: 3952272 - RNA, 22 nt, Human herpesvirus 1
ggcgggcccgcgggaggccgcc

SEQ ID NO: 3952273 - RNA, 21 nt, Human herpesvirus 1
ggcgggcuccagucccggccc

SEQ ID NO: 3952274 - RNA, 18 nt, Human herpesvirus 1
ggcgggguuauaggccac

SEQ ID NO: 3952275 - RNA, 14 nt, Human herpesvirus 1
ggcgggugggccuu

SEQ ID NO: 3952276 - RNA, 16 nt, Human herpesvirus 1
ggcgguaacaggcgcg

SEQ ID NO: 3952277 - RNA, 21 nt, Human herpesvirus 1
ggcggucagcgagacgaccuc

SEQ ID NO: 3952278 - RNA, 17 nt, Human herpesvirus 1
ggcgguccugacggcca

SEQ ID NO: 3952279 - RNA, 21 nt, Human herpesvirus 1
ggcguaccaaacaaacaaacc

SEQ ID NO: 3952280 - RNA, 18 nt, Human herpesvirus 1
ggcguaccgaaggcgcuu

SEQ ID NO: 3952281 - RNA, 22 nt, Human herpesvirus 1
ggcgucaccaugcagcgccgga

SEQ ID NO: 3952282 - RNA, 14 nt, Human herpesvirus 1
ggcguccuggaugc

SEQ ID NO: 3952283 - RNA, 19 nt, Human herpesvirus 1
ggcgucugggccaccgaca

SEQ ID NO: 3952284 - RNA, 22 nt, Human herpesvirus 1
ggcguugggguggaucuuagcc

SEQ ID NO: 3952285 - RNA, 13 nt, Human herpesvirus 1
ggcugccgugagg

SEQ ID NO: 3952286 - RNA, 14 nt, Human herpesvirus 1
ggcugggcuuccga

SEQ ID NO: 3952287 - RNA, 20 nt, Human herpesvirus 1
ggcuguagcgccccggcgac

SEQ ID NO: 3952288 - RNA, 21 nt, Human herpesvirus 1
ggcuucggccguuucuccgcc

SEQ ID NO: 3952289 - RNA, 12 nt, Human herpesvirus 1
gggaacccagag

SEQ ID NO: 3952290 - RNA, 23 nt, Human herpesvirus 1
gggacgcgcaccuguuccgccug

SEQ ID NO: 3952291 - RNA, 13 nt, Human herpesvirus 1
gggacuggccaau

SEQ ID NO: 3952292 - RNA, 11 nt, Human herpesvirus 1
gggacugggca

SEQ ID NO: 3952293 - RNA, 15 nt, Human herpesvirus 1
gggagagcccacaug

SEQ ID NO: 3952294 - RNA, 19 nt, Human herpesvirus 1
gggagcggugacgaacgcg

SEQ ID NO: 3952295 - RNA, 12 nt, Human herpesvirus 1
gggaggccacag

SEQ ID NO: 3952296 - RNA, 20 nt, Human herpesvirus 1
gggaggccgcaucgaacgca

SEQ ID NO: 3952297 - RNA, 15 nt, Human herpesvirus 1
gggagggcagggccg

SEQ ID NO: 3952298 - RNA, 13 nt, Human herpesvirus 1
gggcaggugcaga

SEQ ID NO: 3952299 - RNA, 20 nt, Human herpesvirus 1
gggcaucucgcgccccgaug

SEQ ID NO: 3952300 - RNA, 23 nt, Human herpesvirus 1
gggccaauaucgcuagagacagc

SEQ ID NO: 3952301 - RNA, 20 nt, Human herpesvirus 1
gggccauguugggccgccac

SEQ ID NO: 3952302 - RNA, 19 nt, Human herpesvirus 1
gggccccauaaaacccaag

SEQ ID NO: 3952303 - RNA, 18 nt, Human herpesvirus 1
gggcccccgcccccgccg

SEQ ID NO: 3952304 - RNA, 17 nt, Human herpesvirus 1
gggccccggggagacag

SEQ ID NO: 3952305 - RNA, 18 nt, Human herpesvirus 1
gggccccggggagacagc

SEQ ID NO: 3952306 - RNA, 14 nt, Human herpesvirus 1
gggcccgcgucggg

SEQ ID NO: 3952307 - RNA, 22 nt, Human herpesvirus 1
gggccggcgggugagcgcgcgg

SEQ ID NO: 3952308 - RNA, 13 nt, Human herpesvirus 1
gggccgggccgcc

SEQ ID NO: 3952309 - RNA, 19 nt, Human herpesvirus 1
gggccggggacggcgaaca

SEQ ID NO: 3952310 - RNA, 17 nt, Human herpesvirus 1
gggccuggugcucgugg

SEQ ID NO: 3952311 - RNA, 23 nt, Human herpesvirus 1
gggccuucuuucgaaccgugguc

SEQ ID NO: 3952312 - RNA, 16 nt, Human herpesvirus 1
gggccuuggcggccgc

SEQ ID NO: 3952313 - RNA, 16 nt, Human herpesvirus 1
gggcgccacgguggug

SEQ ID NO: 3952314 - RNA, 14 nt, Human herpesvirus 1
gggcgccggugguu

SEQ ID NO: 3952315 - RNA, 19 nt, Human herpesvirus 1
gggcggccucuccggccug

SEQ ID NO: 3952316 - RNA, 22 nt, Human herpesvirus 1
gggcggggacggggaggcgggc

SEQ ID NO: 3952317 - RNA, 19 nt, Human herpesvirus 1
gggcugccgccagguuggg

SEQ ID NO: 3952318 - RNA, 14 nt, Human herpesvirus 1
ggggauggggagag

SEQ ID NO: 3952319 - RNA, 19 nt, Human herpesvirus 1
ggggauggggagagcccac

SEQ ID NO: 3952320 - RNA, 14 nt, Human herpesvirus 1
ggggccagcgccaa

SEQ ID NO: 3952321 - RNA, 12 nt, Human herpesvirus 1
ggggccguggcg

SEQ ID NO: 3952322 - RNA, 20 nt, Human herpesvirus 1
ggggccuccgaagacguccg

SEQ ID NO: 3952323 - RNA, 15 nt, Human herpesvirus 1
ggggccuuggggccc

SEQ ID NO: 3952324 - RNA, 20 nt, Human herpesvirus 1
ggggcgggugggccuugccg

SEQ ID NO: 3952325 - RNA, 21 nt, Human herpesvirus 1
ggggcuguacucgacccacug

SEQ ID NO: 3952326 - RNA, 14 nt, Human herpesvirus 1
gggggauggggaga

SEQ ID NO: 3952327 - RNA, 15 nt, Human herpesvirus 1
gggggcauuucagug

SEQ ID NO: 3952328 - RNA, 20 nt, Human herpesvirus 1
cggggccugcuacagccgcc

SEQ ID NO: 3952329 - RNA, 16 nt, Human herpesvirus 1
cggggccuuggcggcc

SEQ ID NO: 3952330 - RNA, 22 nt, Human herpesvirus 1
cggggccuuuucgccgcccucg

SEQ ID NO: 3952331 - RNA, 18 nt, Human herpesvirus 1
cgggggacucacuaccca

SEQ ID NO: 3952332 - RNA, 19 nt, Human herpesvirus 1
cgggggauggggagagccc

SEQ ID NO: 3952333 - RNA, 13 nt, Human herpesvirus 1
cgggucccgaccg

SEQ ID NO: 3952334 - RNA, 21 nt, Human herpesvirus 1
cgggucuuuuguguuggcccu

SEQ ID NO: 3952335 - RNA, 17 nt, Human herpesvirus 1
cggguguggggacccgc

SEQ ID NO: 3952336 - RNA, 16 nt, Human herpesvirus 1
cgguagcgggggacgc

SEQ ID NO: 3952337 - RNA, 19 nt, Human herpesvirus 1
cgguaugccgcggccaugg

SEQ ID NO: 3952338 - RNA, 15 nt, Human herpesvirus 1
cggucaccccaaucc

SEQ ID NO: 3952339 - RNA, 17 nt, Human herpesvirus 1
cgguccggagccgcgcg

SEQ ID NO: 3952340 - RNA, 15 nt, Human herpesvirus 1
cgguccugacggcca

SEQ ID NO: 3952341 - RNA, 16 nt, Human herpesvirus 1
cgguccuggaccagcu

SEQ ID NO: 3952342 - RNA, 14 nt, Human herpesvirus 1
cggucgggcggaga

SEQ ID NO: 3952343 - RNA, 22 nt, Human herpesvirus 1
cggucuccccgggagccccgga

SEQ ID NO: 3952344 - RNA, 19 nt, Human herpesvirus 1
cggugacgcgccaaacgcc

SEQ ID NO: 3952345 - RNA, 17 nt, Human herpesvirus 1
cggugauguucgggcgg

SEQ ID NO: 3952346 - RNA, 18 nt, Human herpesvirus 1
cgguggugcccagcggcc

SEQ ID NO: 3952347 - RNA, 18 nt, Human herpesvirus 1
cggugucugggaauagag

SEQ ID NO: 3952348 - RNA, 17 nt, Human herpesvirus 1
cguaaacgccgagcugc

SEQ ID NO: 3952349 - RNA, 14 nt, Human herpesvirus 1
cguaaacggcgggc

SEQ ID NO: 3952350 - RNA, 18 nt, Human herpesvirus 1
cguacaaguucaaggcca

SEQ ID NO: 3952351 - RNA, 13 nt, Human herpesvirus 1
cguacugcccauu

SEQ ID NO: 3952352 - RNA, 18 nt, Human herpesvirus 1
cguagagcuguggcacua

SEQ ID NO: 3952353 - RNA, 13 nt, Human herpesvirus 1
cgucaaaaguugu

SEQ ID NO: 3952354 - RNA, 22 nt, Human herpesvirus 1
cgucacgcacgccaaugcccuc

SEQ ID NO: 3952355 - RNA, 22 nt, Human herpesvirus 1
cgucagcgaggauaaccugggg

SEQ ID NO: 3952356 - RNA, 18 nt, Human herpesvirus 1
cgucauagugggccucca

SEQ ID NO: 3952357 - RNA, 23 nt, Human herpesvirus 1
cguccauucucccgaaccaggcc

SEQ ID NO: 3952358 - RNA, 16 nt, Human herpesvirus 1
cgucccacgcucuccc

SEQ ID NO: 3952359 - RNA, 14 nt, Human herpesvirus 1
cguccccuggggcg

SEQ ID NO: 3952360 - RNA, 18 nt, Human herpesvirus 1
cguccccuuacaguucca

SEQ ID NO: 3952361 - RNA, 16 nt, Human herpesvirus 1
cgucccggcucuccga

SEQ ID NO: 3952362 - RNA, 15 nt, Human herpesvirus 1
cgucgcacgcgucca

SEQ ID NO: 3952363 - RNA, 17 nt, Human herpesvirus 1
cgucgcuagaccacgcc

SEQ ID NO: 3952364 - RNA, 20 nt, Human herpesvirus 1
cgucgcuagaccacgccccu

SEQ ID NO: 3952365 - RNA, 12 nt, Human herpesvirus 1
cgucgggaggcc

SEQ ID NO: 3952366 - RNA, 15 nt, Human herpesvirus 1
cgucgggccucccgg

SEQ ID NO: 3952367 - RNA, 16 nt, Human herpesvirus 1
cgucgggccucccgga

SEQ ID NO: 3952368 - RNA, 20 nt, Human herpesvirus 1
cgucggucugcaccaugacc

SEQ ID NO: 3952369 - RNA, 17 nt, Human herpesvirus 1
cgucuccucuucucccc

SEQ ID NO: 3952370 - RNA, 22 nt, Human herpesvirus 1
cgucuucggccccgcgucuggc

SEQ ID NO: 3952371 - RNA, 16 nt, Human herpesvirus 1
cgugauuccucuccgc

SEQ ID NO: 3952372 - RNA, 13 nt, Human herpesvirus 1
cgugcaccguggg

SEQ ID NO: 3952373 - RNA, 20 nt, Human herpesvirus 1
cguggagcaaaacgccuccc

SEQ ID NO: 3952374 - RNA, 13 nt, Human herpesvirus 1
cguggagcaggaa

SEQ ID NO: 3952375 - RNA, 15 nt, Human herpesvirus 1
cguggugcgagcugc

SEQ ID NO: 3952376 - RNA, 18 nt, Human herpesvirus 1
cguggugcgucgggccuc

SEQ ID NO: 3952377 - RNA, 19 nt, Human herpesvirus 1
cguguacugcggucugucu

SEQ ID NO: 3952378 - RNA, 20 nt, Human herpesvirus 1
cgugugccugccguccgaac

SEQ ID NO: 3952379 - RNA, 14 nt, Human herpesvirus 1
cguguucagggcga

SEQ ID NO: 3952380 - RNA, 15 nt, Human herpesvirus 1
cguguuugcccauaa

SEQ ID NO: 3952381 - RNA, 18 nt, Human herpesvirus 1
cguuccuucccccucccc

SEQ ID NO: 3952382 - RNA, 22 nt, Human herpesvirus 1
cguuccuucccccuccccccgc

SEQ ID NO: 3952383 - RNA, 17 nt, Human herpesvirus 1
cguuucuccgcccgacc

SEQ ID NO: 3952384 - RNA, 22 nt, Human herpesvirus 1
cguuuggguguggggacccggc

SEQ ID NO: 3952385 - RNA, 21 nt, Human herpesvirus 1
cuaaacgcaccgucggaggcc

SEQ ID NO: 3952386 - RNA, 14 nt, Human herpesvirus 1
cuaagaaauuccaa

SEQ ID NO: 3952387 - RNA, 20 nt, Human herpesvirus 1
cuaaggcccggcuagaccca

SEQ ID NO: 3952388 - RNA, 17 nt, Human herpesvirus 1
cuacaacaagucucugg

SEQ ID NO: 3952389 - RNA, 20 nt, Human herpesvirus 1
cuacacccuugugugucaau

SEQ ID NO: 3952390 - RNA, 13 nt, Human herpesvirus 1
cuaccccauggga

SEQ ID NO: 3952391 - RNA, 14 nt, Human herpesvirus 1
cuaccggccccugg

SEQ ID NO: 3952392 - RNA, 18 nt, Human herpesvirus 1
cuaccuaggcaucggggg

SEQ ID NO: 3952393 - RNA, 14 nt, Human herpesvirus 1
cuacgcgccggccg

SEQ ID NO: 3952394 - RNA, 19 nt, Human herpesvirus 1
cuagccgaucccucgcgag

SEQ ID NO: 3952395 - RNA, 21 nt, Human herpesvirus 1
cuagcucgcggagggcggcca

SEQ ID NO: 3952396 - RNA, 14 nt, Human herpesvirus 1
cuaggagacaccuu

SEQ ID NO: 3952397 - RNA, 13 nt, Human herpesvirus 1
cuagggaacccag

SEQ ID NO: 3952398 - RNA, 15 nt, Human herpesvirus 1
cuaucgcucgaccuc

SEQ ID NO: 3952399 - RNA, 21 nt, Human herpesvirus 1
cuauggcgccugacgcgccgc

SEQ ID NO: 3952400 - RNA, 19 nt, Human herpesvirus 1
cucaacaucaccaugcugg

SEQ ID NO: 3952401 - RNA, 21 nt, Human herpesvirus 1
cucaaguacaaccccucgcgg

SEQ ID NO: 3952402 - RNA, 17 nt, Human herpesvirus 1
cucacgcccgcaaacag

SEQ ID NO: 3952403 - RNA, 19 nt, Human herpesvirus 1
cucagcaacacgcucgcgg

SEQ ID NO: 3952404 - RNA, 16 nt, Human herpesvirus 1
cucauuuuacaauaaa

SEQ ID NO: 3952405 - RNA, 14 nt, Human herpesvirus 1
cuccacccccucga

SEQ ID NO: 3952406 - RNA, 14 nt, Human herpesvirus 1
cuccagccuccccu

SEQ ID NO: 3952407 - RNA, 22 nt, Human herpesvirus 1
cucccaacccccuaagacccac

SEQ ID NO: 3952408 - RNA, 22 nt, Human herpesvirus 1
cucccaaccgcgacccuccggg

SEQ ID NO: 3952409 - RNA, 13 nt, Human herpesvirus 1
cucccagggagcc

SEQ ID NO: 3952410 - RNA, 12 nt, Human herpesvirus 1
cuccccagcggc

SEQ ID NO: 3952411 - RNA, 18 nt, Human herpesvirus 1
cucccccaccgcccacag

SEQ ID NO: 3952412 - RNA, 15 nt, Human herpesvirus 1
cuccccgccgcggcc

SEQ ID NO: 3952413 - RNA, 15 nt, Human herpesvirus 1
cuccccgggagcccc

SEQ ID NO: 3952414 - RNA, 14 nt, Human herpesvirus 1
cucccgacaccacc

SEQ ID NO: 3952415 - RNA, 19 nt, Human herpesvirus 1
cucccggaagagccugccg

SEQ ID NO: 3952416 - RNA, 16 nt, Human herpesvirus 1
cucccggcccguaacg

SEQ ID NO: 3952417 - RNA, 15 nt, Human herpesvirus 1
cucccugacggccau

SEQ ID NO: 3952418 - RNA, 17 nt, Human herpesvirus 1
cuccgcuggggccccca

SEQ ID NO: 3952419 - RNA, 12 nt, Human herpesvirus 1
cuccggaccccc

SEQ ID NO: 3952420 - RNA, 20 nt, Human herpesvirus 1
cuccggagagacgauggcag

SEQ ID NO: 3952421 - RNA, 21 nt, Human herpesvirus 1
cuccggggggcuuccggccug

SEQ ID NO: 3952422 - RNA, 23 nt, Human herpesvirus 1
cuccuggccuacgucuccgugcu

SEQ ID NO: 3952423 - RNA, 18 nt, Human herpesvirus 1
cuccugggggcacccacg

SEQ ID NO: 3952424 - RNA, 16 nt, Human herpesvirus 1
cucgagaugggccagg

SEQ ID NO: 3952425 - RNA, 22 nt, Human herpesvirus 1
cucgaugacgucccggcucucc

SEQ ID NO: 3952426 - RNA, 22 nt, Human herpesvirus 1
cucgaugcgcaucagcucgcgg

SEQ ID NO: 3952427 - RNA, 18 nt, Human herpesvirus 1
cucgccacgucgaccgcg

SEQ ID NO: 3952428 - RNA, 13 nt, Human herpesvirus 1
gccauggagcgca

SEQ ID NO: 3952429 - RNA, 18 nt, Human herpesvirus 1
gcccaaugggccgggccg

SEQ ID NO: 3952430 - RNA, 19 nt, Human herpesvirus 1
gcccaaugggccgggccgc

SEQ ID NO: 3952431 - RNA, 19 nt, Human herpesvirus 1
gcccacacaacgcuccgcc

SEQ ID NO: 3952432 - RNA, 18 nt, Human herpesvirus 1
gcccacaugcggaaagca

SEQ ID NO: 3952433 - RNA, 21 nt, Human herpesvirus 1
gcccacccacuccuccccgcg

SEQ ID NO: 3952434 - RNA, 15 nt, Human herpesvirus 1
gcccaccccccacgg

SEQ ID NO: 3952435 - RNA, 16 nt, Human herpesvirus 1
gcccaccgcugggcgc

SEQ ID NO: 3952436 - RNA, 23 nt, Human herpesvirus 1
gcccaccggaagcccaacccaca

SEQ ID NO: 3952437 - RNA, 22 nt, Human herpesvirus 1
gcccagcgcagaggcggccaga

SEQ ID NO: 3952438 - RNA, 16 nt, Human herpesvirus 1
gcccaguguacccugg

SEQ ID NO: 3952439 - RNA, 16 nt, Human herpesvirus 1
gcccauaucugcuacg

SEQ ID NO: 3952440 - RNA, 20 nt, Human herpesvirus 1
gcccauuuacguggcugggu

SEQ ID NO: 3952441 - RNA, 16 nt, Human herpesvirus 1
gccccauacacgagca

SEQ ID NO: 3952442 - RNA, 17 nt, Human herpesvirus 1
gccccaucccgaggccc

SEQ ID NO: 3952443 - RNA, 19 nt, Human herpesvirus 1
gcccccagaugcccacggg

SEQ ID NO: 3952444 - RNA, 13 nt, Human herpesvirus 1
gcccccagggucc

SEQ ID NO: 3952445 - RNA, 12 nt, Human herpesvirus 1
gccccccagccu

SEQ ID NO: 3952446 - RNA, 15 nt, Human herpesvirus 1
gccccccccacccca

SEQ ID NO: 3952447 - RNA, 12 nt, Human herpesvirus 1
gcccccccgcgc

SEQ ID NO: 3952448 - RNA, 20 nt, Human herpesvirus 1
gccccccguggaccccacga

SEQ ID NO: 3952449 - RNA, 16 nt, Human herpesvirus 1
gcccccgaggccagca

SEQ ID NO: 3952450 - RNA, 20 nt, Human herpesvirus 1
gcccccgccgcccggggcca

SEQ ID NO: 3952451 - RNA, 21 nt, Human herpesvirus 1
gcccccgccguugagccccuc

SEQ ID NO: 3952452 - RNA, 14 nt, Human herpesvirus 1
cggucauccacgcc

SEQ ID NO: 3952453 - RNA, 11 nt, Human herpesvirus 1
cgguccugacg

SEQ ID NO: 3952454 - RNA, 18 nt, Human herpesvirus 1
cggucggcaaggugguga

SEQ ID NO: 3952455 - RNA, 18 nt, Human herpesvirus 1
cggucuccccgggagccc

SEQ ID NO: 3952456 - RNA, 17 nt, Human herpesvirus 1
cggugacgccgacgagg

SEQ ID NO: 3952457 - RNA, 14 nt, Human herpesvirus 1
cggugccuuucccc

SEQ ID NO: 3952458 - RNA, 23 nt, Human herpesvirus 1
cgguuccucccgcucggcggcag

SEQ ID NO: 3952459 - RNA, 20 nt, Human herpesvirus 1
cguaacgucgcgggacccga

SEQ ID NO: 3952460 - RNA, 19 nt, Human herpesvirus 1
cguacggccucgugcucgu

SEQ ID NO: 3952461 - RNA, 17 nt, Human herpesvirus 1
cguacucccaccagcug

SEQ ID NO: 3952462 - RNA, 17 nt, Human herpesvirus 1
cgucaccaugcagcgcc

SEQ ID NO: 3952463 - RNA, 17 nt, Human herpesvirus 1
cguccaaacccaccgac

SEQ ID NO: 3952464 - RNA, 19 nt, Human herpesvirus 1
cguccgcgccccucuggcc

SEQ ID NO: 3952465 - RNA, 16 nt, Human herpesvirus 1
cguccucgcaccagcc

SEQ ID NO: 3952466 - RNA, 21 nt, Human herpesvirus 1
cguccuuugggcgggaggaag

SEQ ID NO: 3952467 - RNA, 20 nt, Human herpesvirus 1
cgucgcccuccaccaacgcc

SEQ ID NO: 3952468 - RNA, 15 nt, Human herpesvirus 1
cgucgccgcgggcca

SEQ ID NO: 3952469 - RNA, 19 nt, Human herpesvirus 1
cgucgccgcgggccacgcc

SEQ ID NO: 3952470 - RNA, 18 nt, Human herpesvirus 1
cgucgccuggcugaccca

SEQ ID NO: 3952471 - RNA, 14 nt, Human herpesvirus 1
cgucguucgggcgg

SEQ ID NO: 3952472 - RNA, 19 nt, Human herpesvirus 1
cgucucugcuacgccgcug

SEQ ID NO: 3952473 - RNA, 16 nt, Human herpesvirus 1
cgucugggccaccgac

SEQ ID NO: 3952474 - RNA, 16 nt, Human herpesvirus 1
cgucuuuaaccucccc

SEQ ID NO: 3952475 - RNA, 14 nt, Human herpesvirus 1
cgugaccccaggga

SEQ ID NO: 3952476 - RNA, 23 nt, Human herpesvirus 1
cgugcccauuuacguggcugggu

SEQ ID NO: 3952477 - RNA, 17 nt, Human herpesvirus 1
cgugccguuguucccau

SEQ ID NO: 3952478 - RNA, 21 nt, Human herpesvirus 1
cgugcgccuggauucgcugga

SEQ ID NO: 3952479 - RNA, 14 nt, Human herpesvirus 1
cgugcgcucgcucu

SEQ ID NO: 3952480 - RNA, 15 nt, Human herpesvirus 1
cgugcguagcauacc

SEQ ID NO: 3952481 - RNA, 16 nt, Human herpesvirus 1
cgugcuccugugagcu

SEQ ID NO: 3952482 - RNA, 22 nt, Human herpesvirus 1
cguggaccccacgacacccacc

SEQ ID NO: 3952483 - RNA, 16 nt, Human herpesvirus 1
cguggagcaaaacgcc

SEQ ID NO: 3952484 - RNA, 21 nt, Human herpesvirus 1
cguggagcgcaucaagaccac

SEQ ID NO: 3952485 - RNA, 16 nt, Human herpesvirus 1
cguggcggccccugau

SEQ ID NO: 3952486 - RNA, 17 nt, Human herpesvirus 1
cgugggccucacccacg

SEQ ID NO: 3952487 - RNA, 23 nt, Human herpesvirus 1
cgugggcgacugcgaccccagcc

SEQ ID NO: 3952488 - RNA, 13 nt, Human herpesvirus 1
cguguuugcccau

SEQ ID NO: 3952489 - RNA, 15 nt, Human herpesvirus 1
cguguuuguggggag

SEQ ID NO: 3952490 - RNA, 20 nt, Human herpesvirus 1
cguuccagccccccagccuc

SEQ ID NO: 3952491 - RNA, 22 nt, Human herpesvirus 1
cguuccucacugccucccccgc

SEQ ID NO: 3952492 - RNA, 19 nt, Human herpesvirus 1
cguucuccggggcccggcc

SEQ ID NO: 3952493 - RNA, 12 nt, Human herpesvirus 1
cguucugcugca

SEQ ID NO: 3952494 - RNA, 19 nt, Human herpesvirus 1
cguugagccccucgcccgu

SEQ ID NO: 3952495 - RNA, 16 nt, Human herpesvirus 1
cguugcagggccuggu

SEQ ID NO: 3952496 - RNA, 17 nt, Human herpesvirus 1
cguugcagggccuggug

SEQ ID NO: 3952497 - RNA, 15 nt, Human herpesvirus 1
cguugcccgggccgu

SEQ ID NO: 3952498 - RNA, 19 nt, Human herpesvirus 1
cuaacagucuuccgcugac

SEQ ID NO: 3952499 - RNA, 19 nt, Human herpesvirus 1
cuaagcgucccugggcccu

SEQ ID NO: 3952500 - RNA, 14 nt, Human herpesvirus 1
cuaaucccccggcu

SEQ ID NO: 3952501 - RNA, 22 nt, Human herpesvirus 1
cuacaacaacuaccucggcggg

SEQ ID NO: 3952502 - RNA, 19 nt, Human herpesvirus 1
cuaccgcuuuauaggccgg

SEQ ID NO: 3952503 - RNA, 17 nt, Human herpesvirus 1
cuacgccguguuggagc

SEQ ID NO: 3952504 - RNA, 22 nt, Human herpesvirus 1
cuagccaaccuguggcagaccg

SEQ ID NO: 3952505 - RNA, 22 nt, Human herpesvirus 1
cuagcucgcggagggcggccag

SEQ ID NO: 3952506 - RNA, 14 nt, Human herpesvirus 1
cuauaaagccgcca

SEQ ID NO: 3952507 - RNA, 16 nt, Human herpesvirus 1
cuauaagacucucccc

SEQ ID NO: 3952508 - RNA, 23 nt, Human herpesvirus 1
cuaucuccugggggcacccacgc

SEQ ID NO: 3952509 - RNA, 19 nt, Human herpesvirus 1
cucaagauggccgacccca

SEQ ID NO: 3952510 - RNA, 16 nt, Human herpesvirus 1
cucacccacgccggca

SEQ ID NO: 3952511 - RNA, 17 nt, Human herpesvirus 1
cucaccggcggaccccc

SEQ ID NO: 3952512 - RNA, 23 nt, Human herpesvirus 1
cucagagacaacgcgacaggcca

SEQ ID NO: 3952513 - RNA, 20 nt, Human herpesvirus 1
cucagggccuccgaccccag

SEQ ID NO: 3952514 - RNA, 16 nt, Human herpesvirus 1
cucaugauccucaucg

SEQ ID NO: 3952515 - RNA, 13 nt, Human herpesvirus 1
cuccaccacccaa

SEQ ID NO: 3952516 - RNA, 22 nt, Human herpesvirus 1
cuccacuacuacguggagcagg

SEQ ID NO: 3952517 - RNA, 21 nt, Human herpesvirus 1
cucccaaccgcgacccuccgg

SEQ ID NO: 3952518 - RNA, 15 nt, Human herpesvirus 1
cucccagagacccca

SEQ ID NO: 3952519 - RNA, 15 nt, Human herpesvirus 1
cucccagggagcccc

SEQ ID NO: 3952520 - RNA, 18 nt, Human herpesvirus 1
cuccccccaggccuacca

SEQ ID NO: 3952521 - RNA, 20 nt, Human herpesvirus 1
cucccccguagaucucugua

SEQ ID NO: 3952522 - RNA, 13 nt, Human herpesvirus 1
cuccccgggagcc

SEQ ID NO: 3952523 - RNA, 18 nt, Human herpesvirus 1
cuccccgggagccccgga

SEQ ID NO: 3952524 - RNA, 12 nt, Human herpesvirus 1
cuccccuucccu

SEQ ID NO: 3952525 - RNA, 15 nt, Human herpesvirus 1
cucccucgaccacca

SEQ ID NO: 3952526 - RNA, 15 nt, Human herpesvirus 1
cucccugcggcuggc

SEQ ID NO: 3952527 - RNA, 13 nt, Human herpesvirus 1
cuccgaguacggc

SEQ ID NO: 3952528 - RNA, 15 nt, Human herpesvirus 1
cuccgcccccaaccc

SEQ ID NO: 3952529 - RNA, 18 nt, Human herpesvirus 1
cuccgcgccaggcccgcc

SEQ ID NO: 3952530 - RNA, 13 nt, Human herpesvirus 1
cuccggccgcggu

SEQ ID NO: 3952531 - RNA, 12 nt, Human herpesvirus 1
cuccggcgccgc

SEQ ID NO: 3952532 - RNA, 22 nt, Human herpesvirus 1
cuccuacaacaagucucugggg

SEQ ID NO: 3952533 - RNA, 13 nt, Human herpesvirus 1
cuccuccaccacc

SEQ ID NO: 3952534 - RNA, 15 nt, Human herpesvirus 1
cuccuccaccaccca

SEQ ID NO: 3952535 - RNA, 13 nt, Human herpesvirus 1
cuccucuucuccc

SEQ ID NO: 3952536 - RNA, 16 nt, Human herpesvirus 1
cuccucuucuccccuu

SEQ ID NO: 3952537 - RNA, 22 nt, Human herpesvirus 1
cuccuggacuuugagcuugccu

SEQ ID NO: 3952538 - RNA, 14 nt, Human herpesvirus 1
cuccuggcagcccu

SEQ ID NO: 3952539 - RNA, 20 nt, Human herpesvirus 1
cuccugggggcacccacgcc

SEQ ID NO: 3952540 - RNA, 11 nt, Human herpesvirus 1
cuccuuagcac

SEQ ID NO: 3952541 - RNA, 12 nt, Human herpesvirus 1
cucgaccaccau

SEQ ID NO: 3952542 - RNA, 14 nt, Human herpesvirus 1
cucgaucggccacg

SEQ ID NO: 3952543 - RNA, 16 nt, Human herpesvirus 1
cucgaucggccacggg

SEQ ID NO: 3952544 - RNA, 17 nt, Human herpesvirus 1
cucgccagcgacccgca

SEQ ID NO: 3952545 - RNA, 14 nt, Human herpesvirus 1
cucgcccacccacu

SEQ ID NO: 3952546 - RNA, 14 nt, Human herpesvirus 1
cucgcggcccgggg

SEQ ID NO: 3952547 - RNA, 15 nt, Human herpesvirus 1
cucgcuuugccggga

SEQ ID NO: 3952548 - RNA, 13 nt, Human herpesvirus 1
cucggggagcuuc

SEQ ID NO: 3952549 - RNA, 20 nt, Human herpesvirus 1
cucgucuccucuucuccccu

SEQ ID NO: 3952550 - RNA, 13 nt, Human herpesvirus 1
cucgugugguaca

SEQ ID NO: 3952551 - RNA, 19 nt, Human herpesvirus 1
cucguuccucacugccucc

SEQ ID NO: 3952552 - RNA, 14 nt, Human herpesvirus 1
cucucaagauggcc

SEQ ID NO: 3952553 - RNA, 16 nt, Human herpesvirus 1
cucuccccccaggccu

SEQ ID NO: 3952554 - RNA, 14 nt, Human herpesvirus 1
cucucggugccccu

SEQ ID NO: 3952555 - RNA, 18 nt, Human herpesvirus 1
cucuggacgcccgggcgc

SEQ ID NO: 3952556 - RNA, 18 nt, Human herpesvirus 1
cucuggccgcgcccacua

SEQ ID NO: 3952557 - RNA, 15 nt, Human herpesvirus 1
cucugggcgggccgu

SEQ ID NO: 3952558 - RNA, 17 nt, Human herpesvirus 1
cucuggggucccugucg

SEQ ID NO: 3952559 - RNA, 16 nt, Human herpesvirus 1
cucugggucugugcca

SEQ ID NO: 3952560 - RNA, 23 nt, Human herpesvirus 1
cucuucuccccuucccucccccu

SEQ ID NO: 3952561 - RNA, 22 nt, Human herpesvirus 1
cugaucauuacccccguccgca

SEQ ID NO: 3952562 - RNA, 16 nt, Human herpesvirus 1
cugcaccgaucgcagc

SEQ ID NO: 3952563 - RNA, 20 nt, Human herpesvirus 1
cugcaccgaucgcagcgucc

SEQ ID NO: 3952564 - RNA, 16 nt, Human herpesvirus 1
cugcacgaccugcgcu

SEQ ID NO: 3952565 - RNA, 13 nt, Human herpesvirus 1
cugcaucggcaag

SEQ ID NO: 3952566 - RNA, 19 nt, Human herpesvirus 1
cugccccgcuucauccccg

SEQ ID NO: 3952567 - RNA, 14 nt, Human herpesvirus 1
cugccucccccgcc

SEQ ID NO: 3952568 - RNA, 18 nt, Human herpesvirus 1
cugccucuccccccaggc

SEQ ID NO: 3952569 - RNA, 20 nt, Human herpesvirus 1
cugcgaccccagccuucacg

SEQ ID NO: 3952570 - RNA, 17 nt, Human herpesvirus 1
cugcgaguccugcgccc

SEQ ID NO: 3952571 - RNA, 15 nt, Human herpesvirus 1
cugcgccuugggccc

SEQ ID NO: 3952572 - RNA, 16 nt, Human herpesvirus 1
cugcgcgagcaccugc

SEQ ID NO: 3952573 - RNA, 20 nt, Human herpesvirus 1
cugcggcccacccuggcgcc

SEQ ID NO: 3952574 - RNA, 19 nt, Human herpesvirus 1
cugcguucaucggaccccc

SEQ ID NO: 3952575 - RNA, 15 nt, Human herpesvirus 1
cugcuacgccgcuga

SEQ ID NO: 3952576 - RNA, 19 nt, Human herpesvirus 1
cugcucagcgccaagguca

SEQ ID NO: 3952577 - RNA, 14 nt, Human herpesvirus 1
cugcuccgccuggc

SEQ ID NO: 3952578 - RNA, 20 nt, Human herpesvirus 1
cugcugcccccggagcuguc

SEQ ID NO: 3952579 - RNA, 21 nt, Human herpesvirus 1
cugcugcccccggagcugucc

SEQ ID NO: 3952580 - RNA, 16 nt, Human herpesvirus 1
cuggaaguaccugcag

SEQ ID NO: 3952581 - RNA, 15 nt, Human herpesvirus 1
cuggaccgggguccc

SEQ ID NO: 3952582 - RNA, 22 nt, Human herpesvirus 1
cuggaccggggucccagcggca

SEQ ID NO: 3952583 - RNA, 17 nt, Human herpesvirus 1
cuggcaacucgccccac

SEQ ID NO: 3952584 - RNA, 18 nt, Human herpesvirus 1
cuggccaaucggcggccg

SEQ ID NO: 3952585 - RNA, 12 nt, Human herpesvirus 1
cuggccccggcg

SEQ ID NO: 3952586 - RNA, 18 nt, Human herpesvirus 1
cuggcccgcgccccaccc

SEQ ID NO: 3952587 - RNA, 21 nt, Human herpesvirus 1
cuggccggccuggcggcggcc

SEQ ID NO: 3952588 - RNA, 14 nt, Human herpesvirus 1
cuggccgggagcac

SEQ ID NO: 3952589 - RNA, 17 nt, Human herpesvirus 1
cuggcgagcccagaccc

SEQ ID NO: 3952590 - RNA, 14 nt, Human herpesvirus 1
cuggcugacccacg

SEQ ID NO: 3952591 - RNA, 23 nt, Human herpesvirus 1
cuggcuggccgcucgguggcucc

SEQ ID NO: 3952592 - RNA, 22 nt, Human herpesvirus 1
cugggaacggacacgcggggac

SEQ ID NO: 3952593 - RNA, 17 nt, Human herpesvirus 1
cugggauggcuccuggc

SEQ ID NO: 3952594 - RNA, 19 nt, Human herpesvirus 1
cugggccaccugacgcgcc

SEQ ID NO: 3952595 - RNA, 13 nt, Human herpesvirus 1
cuggggagcugua

SEQ ID NO: 3952596 - RNA, 19 nt, Human herpesvirus 1
cugggucugugccaccagc

SEQ ID NO: 3952597 - RNA, 20 nt, Human herpesvirus 1
cugggugccaaagcgcccgu

SEQ ID NO: 3952598 - RNA, 13 nt, Human herpesvirus 1
cuggguggucucu

SEQ ID NO: 3952599 - RNA, 22 nt, Human herpesvirus 1
cuggguggucucuggccgcgcc

SEQ ID NO: 3952600 - RNA, 15 nt, Human herpesvirus 1
cuggguucuccugga

SEQ ID NO: 3952601 - RNA, 18 nt, Human herpesvirus 1
cuguagcgccccggcgac

SEQ ID NO: 3952602 - RNA, 15 nt, Human herpesvirus 1
cugucccgcgugcaa

SEQ ID NO: 3952603 - RNA, 21 nt, Human herpesvirus 1
cuguccgagacccccaacgcc

SEQ ID NO: 3952604 - RNA, 23 nt, Human herpesvirus 1
cugucgggcggauuuggggcgcu

SEQ ID NO: 3952605 - RNA, 17 nt, Human herpesvirus 1
cugucgguccacggcca

SEQ ID NO: 3952606 - RNA, 16 nt, Human herpesvirus 1
cugucucgucuccucu

SEQ ID NO: 3952607 - RNA, 16 nt, Human herpesvirus 1
cugucuuggggcccac

SEQ ID NO: 3952608 - RNA, 19 nt, Human herpesvirus 1
cuguggaacgaggcccgca

SEQ ID NO: 3952609 - RNA, 12 nt, Human herpesvirus 1
cuguggcccugg

SEQ ID NO: 3952610 - RNA, 14 nt, Human herpesvirus 1
cuguggccucccga

SEQ ID NO: 3952611 - RNA, 22 nt, Human herpesvirus 1
cugugguguuuuuggcaucaug

SEQ ID NO: 3952612 - RNA, 20 nt, Human herpesvirus 1
cuguucaaccccagggaccu

SEQ ID NO: 3952613 - RNA, 19 nt, Human herpesvirus 1
cuuaaccgcccaccuccug

SEQ ID NO: 3952614 - RNA, 20 nt, Human herpesvirus 1
cuuaaccgcccaccuccugg

SEQ ID NO: 3952615 - RNA, 19 nt, Human herpesvirus 1
cuuaauaaauuuuacaaac

SEQ ID NO: 3952616 - RNA, 16 nt, Human herpesvirus 1
cuuaccgccacaggaa

SEQ ID NO: 3952617 - RNA, 15 nt, Human herpesvirus 1
cuucaucgaccucaa

SEQ ID NO: 3952618 - RNA, 14 nt, Human herpesvirus 1
cuucccccccauca

SEQ ID NO: 3952619 - RNA, 17 nt, Human herpesvirus 1
cuucccccccaucaccc

SEQ ID NO: 3952620 - RNA, 17 nt, Human herpesvirus 1
cuuccggaccugcucuc

SEQ ID NO: 3952621 - RNA, 22 nt, Human herpesvirus 1
cuucgcuuuccugucggccgcc

SEQ ID NO: 3952622 - RNA, 19 nt, Human herpesvirus 1
cuucgcuuugugggggacc

SEQ ID NO: 3952623 - RNA, 23 nt, Human herpesvirus 1
cuucggccccgcgucuggccccg

SEQ ID NO: 3952624 - RNA, 15 nt, Human herpesvirus 1
cuucggggcccggcc

SEQ ID NO: 3952625 - RNA, 13 nt, Human herpesvirus 1
cuucggugccagu

SEQ ID NO: 3952626 - RNA, 15 nt, Human herpesvirus 1
cuugaggggggagau

SEQ ID NO: 3952627 - RNA, 23 nt, Human herpesvirus 1
cuugaggggggagaugggacccg

SEQ ID NO: 3952628 - RNA, 13 nt, Human herpesvirus 1
cuuggcggccgcc

SEQ ID NO: 3952629 - RNA, 18 nt, Human herpesvirus 1
cuuggcggccgcccaacu

SEQ ID NO: 3952630 - RNA, 16 nt, Human herpesvirus 1
cuugguucggggccgc

SEQ ID NO: 3952631 - RNA, 16 nt, Human herpesvirus 1
cuuuaaaaagcagggg

SEQ ID NO: 3952632 - RNA, 23 nt, Human herpesvirus 1
cuuuaagcgcugcugcggccagu

SEQ ID NO: 3952633 - RNA, 13 nt, Human herpesvirus 1
cuuuccccaugcg

SEQ ID NO: 3952634 - RNA, 15 nt, Human herpesvirus 1
gaaaagugaaagaca

SEQ ID NO: 3952635 - RNA, 23 nt, Human herpesvirus 1
gaaacuguccugucuuggggccc

SEQ ID NO: 3952636 - RNA, 18 nt, Human herpesvirus 1
gaaacuuaacacaccaaa

SEQ ID NO: 3952637 - RNA, 13 nt, Human herpesvirus 1
gaaagcaagaaca

SEQ ID NO: 3952638 - RNA, 14 nt, Human herpesvirus 1
gaaagcaagaacaa

SEQ ID NO: 3952639 - RNA, 19 nt, Human herpesvirus 1
gaaagcaagaacaauaaag

SEQ ID NO: 3952640 - RNA, 21 nt, Human herpesvirus 1
gaaagcaagaacaauaaaggc

SEQ ID NO: 3952641 - RNA, 15 nt, Human herpesvirus 1
gaacaacaugggccu

SEQ ID NO: 3952642 - RNA, 16 nt, Human herpesvirus 1
gaacacaaggccaaga

SEQ ID NO: 3952643 - RNA, 18 nt, Human herpesvirus 1
gaacaccuucuuugcccu

SEQ ID NO: 3952644 - RNA, 20 nt, Human herpesvirus 1
gaacccccaucuaaugccac

SEQ ID NO: 3952645 - RNA, 21 nt, Human herpesvirus 1
gaacccgcgcuaugacggcaa

SEQ ID NO: 3952646 - RNA, 13 nt, Human herpesvirus 1
gaacgacugggcc

SEQ ID NO: 3952647 - RNA, 20 nt, Human herpesvirus 1
gaacggacacgcggggacac

SEQ ID NO: 3952648 - RNA, 14 nt, Human herpesvirus 1
gaacgggggcccug

SEQ ID NO: 3952649 - RNA, 12 nt, Human herpesvirus 1
gaagagccugcc

SEQ ID NO: 3952650 - RNA, 17 nt, Human herpesvirus 1
gaaggcccuguacccgc

SEQ ID NO: 3952651 - RNA, 15 nt, Human herpesvirus 1
gaagggcacgagcgc

SEQ ID NO: 3952652 - RNA, 19 nt, Human herpesvirus 1
gaauaaaccgguauuauuu

SEQ ID NO: 3952653 - RNA, 18 nt, Human herpesvirus 1
gaaucccccaagggggag

SEQ ID NO: 3952654 - RNA, 14 nt, Human herpesvirus 1
gacacaaaugccca

SEQ ID NO: 3952655 - RNA, 15 nt, Human herpesvirus 1
gacacaaaugcccac

SEQ ID NO: 3952656 - RNA, 22 nt, Human herpesvirus 1
gacacccuaccccaguccccgg

SEQ ID NO: 3952657 - RNA, 16 nt, Human herpesvirus 1
gacacgcgcguccuuc

SEQ ID NO: 3952658 - RNA, 19 nt, Human herpesvirus 1
gacacuggguucuccugga

SEQ ID NO: 3952659 - RNA, 20 nt, Human herpesvirus 1
gacagaccuccccgcgcaug

SEQ ID NO: 3952660 - RNA, 21 nt, Human herpesvirus 1
gacagccaggagcguuucugu

SEQ ID NO: 3952661 - RNA, 14 nt, Human herpesvirus 1
gacagggccgugcc

SEQ ID NO: 3952662 - RNA, 23 nt, Human herpesvirus 1
gaccacaccgacgaaucccccaa

SEQ ID NO: 3952663 - RNA, 21 nt, Human herpesvirus 1
gaccacgcccuuccccacggg

SEQ ID NO: 3952664 - RNA, 13 nt, Human herpesvirus 1
gaccagauggaag

SEQ ID NO: 3952665 - RNA, 16 nt, Human herpesvirus 1
gaccaggcgcgccgcg

SEQ ID NO: 3952666 - RNA, 19 nt, Human herpesvirus 1
gaccaguuuugcgaggagc

SEQ ID NO: 3952667 - RNA, 14 nt, Human herpesvirus 1
gacccaacccccgg

SEQ ID NO: 3952668 - RNA, 19 nt, Human herpesvirus 1
gacccagaccggcaccacc

SEQ ID NO: 3952669 - RNA, 18 nt, Human herpesvirus 1
gaccccauggaccccagc

SEQ ID NO: 3952670 - RNA, 21 nt, Human herpesvirus 1
gacccccaacgccacgcagcc

SEQ ID NO: 3952671 - RNA, 13 nt, Human herpesvirus 1
gacccccuuguau

SEQ ID NO: 3952672 - RNA, 13 nt, Human herpesvirus 1
gaccccuucuccc

SEQ ID NO: 3952673 - RNA, 11 nt, Human herpesvirus 1
gacccgacuca

SEQ ID NO: 3952674 - RNA, 22 nt, Human herpesvirus 1
gacccgcacgagccggggcugg

SEQ ID NO: 3952675 - RNA, 18 nt, Human herpesvirus 1
gacccgccccggagggag

SEQ ID NO: 3952676 - RNA, 12 nt, Human herpesvirus 1
gacccucuccgg

SEQ ID NO: 3952677 - RNA, 21 nt, Human herpesvirus 1
gacccucucuucucucccggg

SEQ ID NO: 3952678 - RNA, 14 nt, Human herpesvirus 1
gaccgacaccccca

SEQ ID NO: 3952679 - RNA, 12 nt, Human herpesvirus 1
gaccgcagccug

SEQ ID NO: 3952680 - RNA, 23 nt, Human herpesvirus 1
gaccggauggaggagccccugcc

SEQ ID NO: 3952681 - RNA, 18 nt, Human herpesvirus 1
gaccggcaagcggagcgg

SEQ ID NO: 3952682 - RNA, 15 nt, Human herpesvirus 1
gaccggcaccaccga

SEQ ID NO: 3952683 - RNA, 14 nt, Human herpesvirus 1
gaccggcggguccc

SEQ ID NO: 3952684 - RNA, 23 nt, Human herpesvirus 1
gaccugcaccgaucgcagcgucc

SEQ ID NO: 3952685 - RNA, 10 nt, Human herpesvirus 1
gaccuggggu

SEQ ID NO: 3952686 - RNA, 17 nt, Human herpesvirus 1
gaccuggggucgcucug

SEQ ID NO: 3952687 - RNA, 22 nt, Human herpesvirus 1
gaccuguugauggccugugcuu

SEQ ID NO: 3952688 - RNA, 14 nt, Human herpesvirus 1
gaccuugccccggc

SEQ ID NO: 3952689 - RNA, 16 nt, Human herpesvirus 1
gacgaaaagccccggg

SEQ ID NO: 3952690 - RNA, 16 nt, Human herpesvirus 1
gacgacauggccagcg

SEQ ID NO: 3952691 - RNA, 18 nt, Human herpesvirus 1
gacgccccccguggaccc

SEQ ID NO: 3952692 - RNA, 19 nt, Human herpesvirus 1
gacgcccccucccuguuug

SEQ ID NO: 3952693 - RNA, 12 nt, Human herpesvirus 1
gacgcccgggcg

SEQ ID NO: 3952694 - RNA, 14 nt, Human herpesvirus 1
gacgcguggcggcc

SEQ ID NO: 3952695 - RNA, 23 nt, Human herpesvirus 1
gacggaccuuggucuggcccacg

SEQ ID NO: 3952696 - RNA, 19 nt, Human herpesvirus 1
gacggcauucgggccugcc

SEQ ID NO: 3952697 - RNA, 19 nt, Human herpesvirus 1
gacggcgcggggcccccgc

SEQ ID NO: 3952698 - RNA, 13 nt, Human herpesvirus 1
gacggcggggcag

SEQ ID NO: 3952699 - RNA, 14 nt, Human herpesvirus 1
gacggcggggcaga

SEQ ID NO: 3952700 - RNA, 16 nt, Human herpesvirus 1
gacggguacgugaacg

SEQ ID NO: 3952701 - RNA, 23 nt, Human herpesvirus 1
gacgucccggcucuccgauccca

SEQ ID NO: 3952702 - RNA, 14 nt, Human herpesvirus 1
gacguccugggcca

SEQ ID NO: 3952703 - RNA, 22 nt, Human herpesvirus 1
gacguuaucucgguggaggcgc

SEQ ID NO: 3952704 - RNA, 22 nt, Human herpesvirus 1
gacguuuaucggcaggcaccgc

SEQ ID NO: 3952705 - RNA, 22 nt, Human herpesvirus 1
gacucaagcacacacgggggag

SEQ ID NO: 3952706 - RNA, 21 nt, Human herpesvirus 1
gacucaccucaaagggacgac

SEQ ID NO: 3952707 - RNA, 23 nt, Human herpesvirus 1
gacucucccccaccgcccacaga

SEQ ID NO: 3952708 - RNA, 14 nt, Human herpesvirus 1
gacugcaucggcaa

SEQ ID NO: 3952709 - RNA, 15 nt, Human herpesvirus 1
gagcaccacauaacc

SEQ ID NO: 3952710 - RNA, 15 nt, Human herpesvirus 1
gagcaccccccccaa

SEQ ID NO: 3952711 - RNA, 15 nt, Human herpesvirus 1
gagccccggucuccc

SEQ ID NO: 3952712 - RNA, 18 nt, Human herpesvirus 1
gagccccggucuccccgg

SEQ ID NO: 3952713 - RNA, 22 nt, Human herpesvirus 1
gagcccgcuggggcggcugggc

SEQ ID NO: 3952714 - RNA, 14 nt, Human herpesvirus 1
gagccgcgcggcca

SEQ ID NO: 3952715 - RNA, 13 nt, Human herpesvirus 1
gagccgcuuuccu

SEQ ID NO: 3952716 - RNA, 23 nt, Human herpesvirus 1
gagccgggcgcgugcugcgccuu

SEQ ID NO: 3952717 - RNA, 14 nt, Human herpesvirus 1
gagcgcaguccacg

SEQ ID NO: 3952718 - RNA, 14 nt, Human herpesvirus 1
gagcgcccuccuga

SEQ ID NO: 3952719 - RNA, 18 nt, Human herpesvirus 1
gagcgcgauccggccggg

SEQ ID NO: 3952720 - RNA, 17 nt, Human herpesvirus 1
gagcggggccguggcgg

SEQ ID NO: 3952721 - RNA, 16 nt, Human herpesvirus 1
gagcuccgcaccaagc

SEQ ID NO: 3952722 - RNA, 13 nt, Human herpesvirus 1
gaggaaacccccg

SEQ ID NO: 3952723 - RNA, 22 nt, Human herpesvirus 1
gaggacaccccucguggccccg

SEQ ID NO: 3952724 - RNA, 13 nt, Human herpesvirus 1
gaggagcccgccc

SEQ ID NO: 3952725 - RNA, 14 nt, Human herpesvirus 1
gaggcccacgccuc

SEQ ID NO: 3952726 - RNA, 14 nt, Human herpesvirus 1
gagggccgggcccc

SEQ ID NO: 3952727 - RNA, 12 nt, Human herpesvirus 1
gaggggggagau

SEQ ID NO: 3952728 - RNA, 19 nt, Human herpesvirus 1
gagggugguucccccccgu

SEQ ID NO: 3952729 - RNA, 19 nt, Human herpesvirus 1
gaggucguuuucaugcccg

SEQ ID NO: 3952730 - RNA, 15 nt, Human herpesvirus 1
gagguggagcugccc

SEQ ID NO: 3952731 - RNA, 18 nt, Human herpesvirus 1
gaguccugcgccccgccg

SEQ ID NO: 3952732 - RNA, 15 nt, Human herpesvirus 1
gaucauuacccccgu

SEQ ID NO: 3952733 - RNA, 17 nt, Human herpesvirus 1
gaucccaacgaccccgc

SEQ ID NO: 3952734 - RNA, 13 nt, Human herpesvirus 1
gaucccaggcgcc

SEQ ID NO: 3952735 - RNA, 21 nt, Human herpesvirus 1
gauccgacauguccgugccgc

SEQ ID NO: 3952736 - RNA, 22 nt, Human herpesvirus 1
gaucgccugucuccucguggcc

SEQ ID NO: 3952737 - RNA, 20 nt, Human herpesvirus 1
gaugacgucccggcucuccg

SEQ ID NO: 3952738 - RNA, 14 nt, Human herpesvirus 1
gaugagccagaccc

SEQ ID NO: 3952739 - RNA, 13 nt, Human herpesvirus 1
gaugccagccagg

SEQ ID NO: 3952740 - RNA, 16 nt, Human herpesvirus 1
gauggaggagccccug

SEQ ID NO: 3952741 - RNA, 21 nt, Human herpesvirus 1
gauggcacaccgguccccgga

SEQ ID NO: 3952742 - RNA, 22 nt, Human herpesvirus 1
gauggccauagccgccgaaggg

SEQ ID NO: 3952743 - RNA, 14 nt, Human herpesvirus 1
gauggccugugcuu

SEQ ID NO: 3952744 - RNA, 22 nt, Human herpesvirus 1
gauggggagagcccacaugcgg

SEQ ID NO: 3952745 - RNA, 13 nt, Human herpesvirus 1
gaugggggggcaa

SEQ ID NO: 3952746 - RNA, 11 nt, Human herpesvirus 1
gauuuggguug

SEQ ID NO: 3952747 - RNA, 13 nt, Human herpesvirus 1
gcaaacaggagcu

SEQ ID NO: 3952748 - RNA, 13 nt, Human herpesvirus 1
gcaacaaccugga

SEQ ID NO: 3952749 - RNA, 20 nt, Human herpesvirus 1
gcaacgcgcuggggcugccg

SEQ ID NO: 3952750 - RNA, 20 nt, Human herpesvirus 1
gcaacggcgggagcuggguu

SEQ ID NO: 3952751 - RNA, 16 nt, Human herpesvirus 1
gcaagaccaggccugg

SEQ ID NO: 3952752 - RNA, 23 nt, Human herpesvirus 1
gcaauuucaccgccccagcaccg

SEQ ID NO: 3952753 - RNA, 21 nt, Human herpesvirus 1
gcaauuuguacccuuaauaaa

SEQ ID NO: 3952754 - RNA, 17 nt, Human herpesvirus 1
gcacagaugggacgcca

SEQ ID NO: 3952755 - RNA, 21 nt, Human herpesvirus 1
gcaccacauaaccgaccgcag

SEQ ID NO: 3952756 - RNA, 14 nt, Human herpesvirus 1
gcaccaucccgggu

SEQ ID NO: 3952757 - RNA, 23 nt, Human herpesvirus 1
gcaccaugaccaaguggcaggag

SEQ ID NO: 3952758 - RNA, 12 nt, Human herpesvirus 1
gcaccccagagg

SEQ ID NO: 3952759 - RNA, 23 nt, Human herpesvirus 1
gcaccgagccaagggcuccugua

SEQ ID NO: 3952760 - RNA, 20 nt, Human herpesvirus 1
gcaccgucggaggcccccca

SEQ ID NO: 3952761 - RNA, 22 nt, Human herpesvirus 1
gcaccgucggaggccccccaga

SEQ ID NO: 3952762 - RNA, 18 nt, Human herpesvirus 1
gcaccuccccagcggcca

SEQ ID NO: 3952763 - RNA, 15 nt, Human herpesvirus 1
gcacgagccggggcu

SEQ ID NO: 3952764 - RNA, 12 nt, Human herpesvirus 1
gcacgcgccgcc

SEQ ID NO: 3952765 - RNA, 19 nt, Human herpesvirus 1
gcagaccggcaagcggagc

SEQ ID NO: 3952766 - RNA, 23 nt, Human herpesvirus 1
gcagacgaaaagccccgggccgc

SEQ ID NO: 3952767 - RNA, 19 nt, Human herpesvirus 1
gcagacgguggugcccagc

SEQ ID NO: 3952768 - RNA, 14 nt, Human herpesvirus 1
gcagagcaacccca

SEQ ID NO: 3952769 - RNA, 15 nt, Human herpesvirus 1
gcagaggcggccaga

SEQ ID NO: 3952770 - RNA, 12 nt, Human herpesvirus 1
gcagaugcagag

SEQ ID NO: 3952771 - RNA, 17 nt, Human herpesvirus 1
gcagccgaugccccggg

SEQ ID NO: 3952772 - RNA, 20 nt, Human herpesvirus 1
gcagccggaaugaggagcuc

SEQ ID NO: 3952773 - RNA, 19 nt, Human herpesvirus 1
gcagccuggucgaggcggc

SEQ ID NO: 3952774 - RNA, 21 nt, Human herpesvirus 1
gcagccuucucccggugccuu

SEQ ID NO: 3952775 - RNA, 16 nt, Human herpesvirus 1
gcagcgccggccuccc

SEQ ID NO: 3952776 - RNA, 13 nt, Human herpesvirus 1
gcaggauggagag

SEQ ID NO: 3952777 - RNA, 15 nt, Human herpesvirus 1
gcaggccccccgccg

SEQ ID NO: 3952778 - RNA, 19 nt, Human herpesvirus 1
gcaggcgcugucuccccgg

SEQ ID NO: 3952779 - RNA, 14 nt, Human herpesvirus 1
gcagucccugaguu

SEQ ID NO: 3952780 - RNA, 20 nt, Human herpesvirus 1
gcauacgccucccccacauc

SEQ ID NO: 3952781 - RNA, 21 nt, Human herpesvirus 1
gcauacgggcggccacccccc

SEQ ID NO: 3952782 - RNA, 17 nt, Human herpesvirus 1
gcauauccgggggcacg

SEQ ID NO: 3952783 - RNA, 17 nt, Human herpesvirus 1
gcaucaaaagcccgaua

SEQ ID NO: 3952784 - RNA, 12 nt, Human herpesvirus 1
gcaucccaggau

SEQ ID NO: 3952785 - RNA, 17 nt, Human herpesvirus 1
gcauccgagcacccccc

SEQ ID NO: 3952786 - RNA, 12 nt, Human herpesvirus 1
gccaaccaagag

SEQ ID NO: 3952787 - RNA, 14 nt, Human herpesvirus 1
gccaaccugauccg

SEQ ID NO: 3952788 - RNA, 19 nt, Human herpesvirus 1
gccacacucaaaaagcccc

SEQ ID NO: 3952789 - RNA, 13 nt, Human herpesvirus 1
gccacccccccgg

SEQ ID NO: 3952790 - RNA, 23 nt, Human herpesvirus 1
gccacgagaucaaggacagcggc

SEQ ID NO: 3952791 - RNA, 18 nt, Human herpesvirus 1
gccacgcaaaaccaggcc

SEQ ID NO: 3952792 - RNA, 13 nt, Human herpesvirus 1
gccacgccagggc

SEQ ID NO: 3952793 - RNA, 16 nt, Human herpesvirus 1
gccacggcgccgacca

SEQ ID NO: 3952794 - RNA, 19 nt, Human herpesvirus 1
gccacguaucugacggccg

SEQ ID NO: 3952795 - RNA, 18 nt, Human herpesvirus 1
gccagacccaacccccgg

SEQ ID NO: 3952796 - RNA, 23 nt, Human herpesvirus 1
gccagaucuacugcugggccaug

SEQ ID NO: 3952797 - RNA, 17 nt, Human herpesvirus 1
gccagccugcggccgga

SEQ ID NO: 3952798 - RNA, 22 nt, Human herpesvirus 1
gccaguccgcugcaccgaugua

SEQ ID NO: 3952799 - RNA, 14 nt, Human herpesvirus 1
gccaucccguggau

SEQ ID NO: 3952800 - RNA, 23 nt, Human herpesvirus 1
gccaucgcguggugcgagcugca

SEQ ID NO: 3952801 - RNA, 13 nt, Human herpesvirus 1
gcccaacccacac

SEQ ID NO: 3952802 - RNA, 19 nt, Human herpesvirus 1
gcccaacucucgcaccauc

SEQ ID NO: 3952803 - RNA, 20 nt, Human herpesvirus 1
gcccacaugcggaaagcaag

SEQ ID NO: 3952804 - RNA, 17 nt, Human herpesvirus 1
gcccaccgcugggcgcu

SEQ ID NO: 3952805 - RNA, 18 nt, Human herpesvirus 1
gcccaccggaagcccaac

SEQ ID NO: 3952806 - RNA, 14 nt, Human herpesvirus 1
gcccaccuccuggc

SEQ ID NO: 3952807 - RNA, 15 nt, Human herpesvirus 1
gcccacgccucgggc

SEQ ID NO: 3952808 - RNA, 17 nt, Human herpesvirus 1
gcccacgucgccccgcc

SEQ ID NO: 3952809 - RNA, 15 nt, Human herpesvirus 1
gcccacuacaccagc

SEQ ID NO: 3952810 - RNA, 16 nt, Human herpesvirus 1
gcccacuacaccagcc

SEQ ID NO: 3952811 - RNA, 18 nt, Human herpesvirus 1
gcccacuacaccagccaa

SEQ ID NO: 3952812 - RNA, 19 nt, Human herpesvirus 1
gcccacuacaccagccaau

SEQ ID NO: 3952813 - RNA, 14 nt, Human herpesvirus 1
gcccacuucccccc

SEQ ID NO: 3952814 - RNA, 16 nt, Human herpesvirus 1
gcccagcagcucccca

SEQ ID NO: 3952815 - RNA, 20 nt, Human herpesvirus 1
gcccagcgcagaggcggcca

SEQ ID NO: 3952816 - RNA, 18 nt, Human herpesvirus 1
gcccagcggccuggacgu

SEQ ID NO: 3952817 - RNA, 19 nt, Human herpesvirus 1
gccccacacagcccucccg

SEQ ID NO: 3952818 - RNA, 14 nt, Human herpesvirus 1
gccccagaaacccc

SEQ ID NO: 3952819 - RNA, 16 nt, Human herpesvirus 1
gccccaguccccaaga

SEQ ID NO: 3952820 - RNA, 19 nt, Human herpesvirus 1
gccccauaaaacccaagcc

SEQ ID NO: 3952821 - RNA, 13 nt, Human herpesvirus 1
gccccauacacga

SEQ ID NO: 3952822 - RNA, 20 nt, Human herpesvirus 1
gccccauacacgagcacccu

SEQ ID NO: 3952823 - RNA, 23 nt, Human herpesvirus 1
gccccauacacgagcacccugcu

SEQ ID NO: 3952824 - RNA, 19 nt, Human herpesvirus 1
gcccccggacccgggccgu

SEQ ID NO: 3952825 - RNA, 23 nt, Human herpesvirus 1
gccccgacgcacccccccaacgg

SEQ ID NO: 3952826 - RNA, 22 nt, Human herpesvirus 1
gccccgaugcggcggcgcugca

SEQ ID NO: 3952827 - RNA, 22 nt, Human herpesvirus 1
gccccgcauaucccacccugga

SEQ ID NO: 3952828 - RNA, 13 nt, Human herpesvirus 1
gccccgccaccca

SEQ ID NO: 3952829 - RNA, 16 nt, Human herpesvirus 1
gccccggcccccaaua

SEQ ID NO: 3952830 - RNA, 18 nt, Human herpesvirus 1
gccccgggccgcgucgcc

SEQ ID NO: 3952831 - RNA, 20 nt, Human herpesvirus 1
gccccggggagacagcgccu

SEQ ID NO: 3952832 - RNA, 21 nt, Human herpesvirus 1
gccccggguuccgcgaccacc

SEQ ID NO: 3952833 - RNA, 18 nt, Human herpesvirus 1
gccccggucuccccggga

SEQ ID NO: 3952834 - RNA, 21 nt, Human herpesvirus 1
gccccguacaaguucaaggcc

SEQ ID NO: 3952835 - RNA, 15 nt, Human herpesvirus 1
gccccuggcgccgcc

SEQ ID NO: 3952836 - RNA, 18 nt, Human herpesvirus 1
gccccuggcgccgccugg

SEQ ID NO: 3952837 - RNA, 17 nt, Human herpesvirus 1
gccccuguggcccuggc

SEQ ID NO: 3952838 - RNA, 16 nt, Human herpesvirus 1
gcccgaagacaccccc

SEQ ID NO: 3952839 - RNA, 16 nt, Human herpesvirus 1
gcccgaccacacaccc

SEQ ID NO: 3952840 - RNA, 20 nt, Human herpesvirus 1
gcccgaccacacacccccca

SEQ ID NO: 3952841 - RNA, 19 nt, Human herpesvirus 1
gcccgauuuacagccccca

SEQ ID NO: 3952842 - RNA, 20 nt, Human herpesvirus 1
gcccgauuuacagcccccag

SEQ ID NO: 3952843 - RNA, 21 nt, Human herpesvirus 1
gcccgauuuacagcccccaga

SEQ ID NO: 3952844 - RNA, 18 nt, Human herpesvirus 1
gcccgcaaacaggagcug

SEQ ID NO: 3952845 - RNA, 17 nt, Human herpesvirus 1
gcccgcgggaggccgcc

SEQ ID NO: 3952846 - RNA, 18 nt, Human herpesvirus 1
gcccgcgggaggccgccc

SEQ ID NO: 3952847 - RNA, 13 nt, Human herpesvirus 1
gcccgcuggggcg

SEQ ID NO: 3952848 - RNA, 18 nt, Human herpesvirus 1
gcccggaggcgcccgcgg

SEQ ID NO: 3952849 - RNA, 23 nt, Human herpesvirus 1
gcccgggcaaguaugccccccug

SEQ ID NO: 3952850 - RNA, 22 nt, Human herpesvirus 1
gcccgggcgcuugcgcaccugg

SEQ ID NO: 3952851 - RNA, 16 nt, Human herpesvirus 1
gcccggggccagcgcc

SEQ ID NO: 3952852 - RNA, 13 nt, Human herpesvirus 1
gcccgugcugccg

SEQ ID NO: 3952853 - RNA, 20 nt, Human herpesvirus 1
gcccucacagggcgggccgc

SEQ ID NO: 3952854 - RNA, 13 nt, Human herpesvirus 1
gcccuccugacca

SEQ ID NO: 3952855 - RNA, 11 nt, Human herpesvirus 1
gcccucucccc

SEQ ID NO: 3952856 - RNA, 20 nt, Human herpesvirus 1
gcccucuuggaggaccccgu

SEQ ID NO: 3952857 - RNA, 22 nt, Human herpesvirus 1
gcccugagacaagagcgcuccc

SEQ ID NO: 3952858 - RNA, 14 nt, Human herpesvirus 1
gcccugcugcugcc

SEQ ID NO: 3952859 - RNA, 22 nt, Human herpesvirus 1
gcccuggccgcggaucugcucc

SEQ ID NO: 3952860 - RNA, 15 nt, Human herpesvirus 1
gccgacggcccgaag

SEQ ID NO: 3952861 - RNA, 19 nt, Human herpesvirus 1
gccgacucccggcuugccg

SEQ ID NO: 3952862 - RNA, 16 nt, Human herpesvirus 1
gccgcccccuggucag

SEQ ID NO: 3952863 - RNA, 14 nt, Human herpesvirus 1
gccgccgcggacgc

SEQ ID NO: 3952864 - RNA, 12 nt, Human herpesvirus 1
gccgcgccccgc

SEQ ID NO: 3952865 - RNA, 21 nt, Human herpesvirus 1
gccgcgccccgccggcgacaa

SEQ ID NO: 3952866 - RNA, 14 nt, Human herpesvirus 1
gccgcgcguccccc

SEQ ID NO: 3952867 - RNA, 14 nt, Human herpesvirus 1
gccgcggccugggu

SEQ ID NO: 3952868 - RNA, 14 nt, Human herpesvirus 1
gccgcgggccacgc

SEQ ID NO: 3952869 - RNA, 18 nt, Human herpesvirus 1
gccgcuaccgacgcuccc

SEQ ID NO: 3952870 - RNA, 16 nt, Human herpesvirus 1
gccgcucgguggcucc

SEQ ID NO: 3952871 - RNA, 23 nt, Human herpesvirus 1
gccgcuguggccucaccugacca

SEQ ID NO: 3952872 - RNA, 17 nt, Human herpesvirus 1
gccggaacgcaccgagg

SEQ ID NO: 3952873 - RNA, 17 nt, Human herpesvirus 1
gccgggagcgccaggac

SEQ ID NO: 3952874 - RNA, 18 nt, Human herpesvirus 1
gccgggccgcccacuucc

SEQ ID NO: 3952875 - RNA, 18 nt, Human herpesvirus 1
gccggucggcgggcccgc

SEQ ID NO: 3952876 - RNA, 20 nt, Human herpesvirus 1
gccgguuccucccgcucggc

SEQ ID NO: 3952877 - RNA, 15 nt, Human herpesvirus 1
gccguccgaacccag

SEQ ID NO: 3952878 - RNA, 22 nt, Human herpesvirus 1
gccguccucgcaccagcccuug

SEQ ID NO: 3952879 - RNA, 18 nt, Human herpesvirus 1
gccgucuuucuccccaac

SEQ ID NO: 3952880 - RNA, 17 nt, Human herpesvirus 1
gccgugcuccugugagc

SEQ ID NO: 3952881 - RNA, 15 nt, Human herpesvirus 1
gccguuggcccccgc

SEQ ID NO: 3952882 - RNA, 18 nt, Human herpesvirus 1
gccuaccggccccugggc

SEQ ID NO: 3952883 - RNA, 17 nt, Human herpesvirus 1
gccuacuacucggaaag

SEQ ID NO: 3952884 - RNA, 15 nt, Human herpesvirus 1
gccucccccugagcc

SEQ ID NO: 3952885 - RNA, 24 nt, Human herpesvirus 1
gccucccggggggucggcaggcga

SEQ ID NO: 3952886 - RNA, 20 nt, Human herpesvirus 1
gccuccgcccgugcugccgu

SEQ ID NO: 3952887 - RNA, 17 nt, Human herpesvirus 1
gccucggagccgagcuc

SEQ ID NO: 3952888 - RNA, 15 nt, Human herpesvirus 1
gccucgggggcggga

SEQ ID NO: 3952889 - RNA, 13 nt, Human herpesvirus 1
gccucgugggcac

SEQ ID NO: 3952890 - RNA, 18 nt, Human herpesvirus 1
gccucguggggcuggacg

SEQ ID NO: 3952891 - RNA, 21 nt, Human herpesvirus 1
gccugacccucuccgggaugg

SEQ ID NO: 3952892 - RNA, 21 nt, Human herpesvirus 1
gccugacgccugccaaccuga

SEQ ID NO: 3952893 - RNA, 16 nt, Human herpesvirus 1
gccugccucucccccc

SEQ ID NO: 3952894 - RNA, 21 nt, Human herpesvirus 1
gccugccucuccccccaggcc

SEQ ID NO: 3952895 - RNA, 14 nt, Human herpesvirus 1
gccugcggcgcacc

SEQ ID NO: 3952896 - RNA, 15 nt, Human herpesvirus 1
gccuggaucccaacg

SEQ ID NO: 3952897 - RNA, 22 nt, Human herpesvirus 1
gccuggaucccaacgaccccgc

SEQ ID NO: 3952898 - RNA, 13 nt, Human herpesvirus 1
gccuggccugcga

SEQ ID NO: 3952899 - RNA, 19 nt, Human herpesvirus 1
gccuggcugacccacgcgg

SEQ ID NO: 3952900 - RNA, 20 nt, Human herpesvirus 1
gccuggucagaggcccacgc

SEQ ID NO: 3952901 - RNA, 20 nt, Human herpesvirus 1
gccuucccccggccaccucg

SEQ ID NO: 3952902 - RNA, 13 nt, Human herpesvirus 1
gccuucucccggu

SEQ ID NO: 3952903 - RNA, 12 nt, Human herpesvirus 1
gcgaacccccgu

SEQ ID NO: 3952904 - RNA, 16 nt, Human herpesvirus 1
gcgaagacgaggcggc

SEQ ID NO: 3952905 - RNA, 13 nt, Human herpesvirus 1
gcgaaggcugccg

SEQ ID NO: 3952906 - RNA, 14 nt, Human herpesvirus 1
gcgaccaccccaaa

SEQ ID NO: 3952907 - RNA, 19 nt, Human herpesvirus 1
gcgaccccagccuucacgu

SEQ ID NO: 3952908 - RNA, 14 nt, Human herpesvirus 1
gcgacccuccggga

SEQ ID NO: 3952909 - RNA, 20 nt, Human herpesvirus 1
gcgaccucggcgccucugga

SEQ ID NO: 3952910 - RNA, 18 nt, Human herpesvirus 1
gcgacggcgucucccggg

SEQ ID NO: 3952911 - RNA, 21 nt, Human herpesvirus 1
gcgagauuuuucuguaucuga

SEQ ID NO: 3952912 - RNA, 17 nt, Human herpesvirus 1
gcgagcaccugcgggac

SEQ ID NO: 3952913 - RNA, 16 nt, Human herpesvirus 1
gcgagcucccagagac

SEQ ID NO: 3952914 - RNA, 15 nt, Human herpesvirus 1
gcgagcucccugcgg

SEQ ID NO: 3952915 - RNA, 17 nt, Human herpesvirus 1
gcgaggagggcggcgac

SEQ ID NO: 3952916 - RNA, 14 nt, Human herpesvirus 1
gcgcaacaaccugg

SEQ ID NO: 3952917 - RNA, 21 nt, Human herpesvirus 1
gcgcaccuccuccgacgccca

SEQ ID NO: 3952918 - RNA, 16 nt, Human herpesvirus 1
gcgcaccuguuccgcc

SEQ ID NO: 3952919 - RNA, 15 nt, Human herpesvirus 1
gcgcagaggcggcca

SEQ ID NO: 3952920 - RNA, 21 nt, Human herpesvirus 1
gcgcagcugggaccccggcgg

SEQ ID NO: 3952921 - RNA, 17 nt, Human herpesvirus 1
gcgcaguccacgggggg

SEQ ID NO: 3952922 - RNA, 15 nt, Human herpesvirus 1
gcgcaucagcucgcg

SEQ ID NO: 3952923 - RNA, 22 nt, Human herpesvirus 1
gcgccaggcccgccgccacugu

SEQ ID NO: 3952924 - RNA, 18 nt, Human herpesvirus 1
gcgccaucuggaccgggg

SEQ ID NO: 3952925 - RNA, 20 nt, Human herpesvirus 1
gcgcccgucggucugcacca

SEQ ID NO: 3952926 - RNA, 22 nt, Human herpesvirus 1
gcgccggguggcgccugugugu

SEQ ID NO: 3952927 - RNA, 15 nt, Human herpesvirus 1
gcgccggucgucacg

SEQ ID NO: 3952928 - RNA, 14 nt, Human herpesvirus 1
gcgccggugguucg

SEQ ID NO: 3952929 - RNA, 14 nt, Human herpesvirus 1
gcgccucuggacug

SEQ ID NO: 3952930 - RNA, 14 nt, Human herpesvirus 1
gcgcgaugcgaucg

SEQ ID NO: 3952931 - RNA, 19 nt, Human herpesvirus 1
gcgcgcugcucagcgccaa

SEQ ID NO: 3952932 - RNA, 19 nt, Human herpesvirus 1
gcgcgcuuguccccgaaca

SEQ ID NO: 3952933 - RNA, 19 nt, Human herpesvirus 1
gcgcggaugcucggcgacg

SEQ ID NO: 3952934 - RNA, 12 nt, Human herpesvirus 1
gcgcggccgugg

SEQ ID NO: 3952935 - RNA, 12 nt, Human herpesvirus 1
gcgcggcugcca

SEQ ID NO: 3952936 - RNA, 19 nt, Human herpesvirus 1
gcgcguaucugguccccgc

SEQ ID NO: 3952937 - RNA, 19 nt, Human herpesvirus 1
gcgcguccccggcccggag

SEQ ID NO: 3952938 - RNA, 22 nt, Human herpesvirus 1
gcgcgugcuguugggcgggacg

SEQ ID NO: 3952939 - RNA, 15 nt, Human herpesvirus 1
gcgcucaaccaccgc

SEQ ID NO: 3952940 - RNA, 21 nt, Human herpesvirus 1
gcgcucgcucucggugccccu

SEQ ID NO: 3952941 - RNA, 13 nt, Human herpesvirus 1
gcgcugcccuccc

SEQ ID NO: 3952942 - RNA, 19 nt, Human herpesvirus 1
gcgcuggguggucucuggc

SEQ ID NO: 3952943 - RNA, 16 nt, Human herpesvirus 1
gcggagaacaccgaug

SEQ ID NO: 3952944 - RNA, 15 nt, Human herpesvirus 1
gcggagcucccggga

SEQ ID NO: 3952945 - RNA, 22 nt, Human herpesvirus 1
gcggagcuguacgugcgggaac

SEQ ID NO: 3952946 - RNA, 13 nt, Human herpesvirus 1
gcggcagcgcucc

SEQ ID NO: 3952947 - RNA, 14 nt, Human herpesvirus 1
gcggcagucuccug

SEQ ID NO: 3952948 - RNA, 22 nt, Human herpesvirus 1
gcggcauaacuccgaccggcgg

SEQ ID NO: 3952949 - RNA, 15 nt, Human herpesvirus 1
gcggcccacccuggc

SEQ ID NO: 3952950 - RNA, 19 nt, Human herpesvirus 1
gcggccccagcccucuccc

SEQ ID NO: 3952951 - RNA, 19 nt, Human herpesvirus 1
gcggccuggacguccccga

SEQ ID NO: 3952952 - RNA, 22 nt, Human herpesvirus 1
gcggccuggguuggcgucggga

SEQ ID NO: 3952953 - RNA, 22 nt, Human herpesvirus 1
gcggcgaacgggggcccugcca

SEQ ID NO: 3952954 - RNA, 23 nt, Human herpesvirus 1
gcggcgaccucggcgccucugga

SEQ ID NO: 3952955 - RNA, 14 nt, Human herpesvirus 1
gcggcgaggccggc

SEQ ID NO: 3952956 - RNA, 20 nt, Human herpesvirus 1
gcggcguccgcgccccucug

SEQ ID NO: 3952957 - RNA, 21 nt, Human herpesvirus 1
gcggcgugguaucggccgugu

SEQ ID NO: 3952958 - RNA, 14 nt, Human herpesvirus 1
gcggcucguggcgu

SEQ ID NO: 3952959 - RNA, 20 nt, Human herpesvirus 1
gcggcugguccacacccagu

SEQ ID NO: 3952960 - RNA, 23 nt, Human herpesvirus 1
gcgggacuggccaaucggcggcc

SEQ ID NO: 3952961 - RNA, 20 nt, Human herpesvirus 1
gcgggaguuaccgcccaaug

SEQ ID NO: 3952962 - RNA, 17 nt, Human herpesvirus 1
gcggggacucgggcgag

SEQ ID NO: 3952963 - RNA, 13 nt, Human herpesvirus 1
gcggggcccggcc

SEQ ID NO: 3952964 - RNA, 13 nt, Human herpesvirus 1
gcgggggccccgc

SEQ ID NO: 3952965 - RNA, 17 nt, Human herpesvirus 1
gcgggguugggauggga

SEQ ID NO: 3952966 - RNA, 22 nt, Human herpesvirus 1
gcgggugaacgagccgacggcc

SEQ ID NO: 3952967 - RNA, 17 nt, Human herpesvirus 1
gcggucugucucgucuc

SEQ ID NO: 3952968 - RNA, 14 nt, Human herpesvirus 1
gcggugacgaacgc

SEQ ID NO: 3952969 - RNA, 13 nt, Human herpesvirus 1
gcggugguaucua

SEQ ID NO: 3952970 - RNA, 21 nt, Human herpesvirus 1
gcguaccaaacaaacaaacca

SEQ ID NO: 3952971 - RNA, 16 nt, Human herpesvirus 1
gcguauccacccccgc

SEQ ID NO: 3952972 - RNA, 21 nt, Human herpesvirus 1
gcguccgguuggccgcgcggc

SEQ ID NO: 3952973 - RNA, 13 nt, Human herpesvirus 1
gcgucggcggcuc

SEQ ID NO: 3952974 - RNA, 18 nt, Human herpesvirus 1
gcguuucugaccugcacc

SEQ ID NO: 3952975 - RNA, 11 nt, Human herpesvirus 1
gcuacgacauc

SEQ ID NO: 3952976 - RNA, 14 nt, Human herpesvirus 1
gcuacuauccccgc

SEQ ID NO: 3952977 - RNA, 13 nt, Human herpesvirus 1
gcuaucuccuggg

SEQ ID NO: 3952978 - RNA, 17 nt, Human herpesvirus 1
gcucagcgccaagguca

SEQ ID NO: 3952979 - RNA, 17 nt, Human herpesvirus 1
gcucccgccuuccggac

SEQ ID NO: 3952980 - RNA, 22 nt, Human herpesvirus 1
gcuccuacaacaagucucuggg

SEQ ID NO: 3952981 - RNA, 22 nt, Human herpesvirus 1
gcucggccuauggcuccugcga

SEQ ID NO: 3952982 - RNA, 19 nt, Human herpesvirus 1
gcucggcggcagcccggag

SEQ ID NO: 3952983 - RNA, 16 nt, Human herpesvirus 1
gcucggcuccccgccg

SEQ ID NO: 3952984 - RNA, 16 nt, Human herpesvirus 1
gcucgucgccuggcug

SEQ ID NO: 3952985 - RNA, 13 nt, Human herpesvirus 1
gcucuacugcaga

SEQ ID NO: 3952986 - RNA, 20 nt, Human herpesvirus 1
gcugaagcacaacgccagcc

SEQ ID NO: 3952987 - RNA, 21 nt, Human herpesvirus 1
gcugacccuguggaacgaggc

SEQ ID NO: 3952988 - RNA, 21 nt, Human herpesvirus 1
gcugccccgcuucauccccga

SEQ ID NO: 3952989 - RNA, 23 nt, Human herpesvirus 1
gcugccccgcuucauccccgaga

SEQ ID NO: 3952990 - RNA, 21 nt, Human herpesvirus 1
gcugcccgacccggcccgagg

SEQ ID NO: 3952991 - RNA, 22 nt, Human herpesvirus 1
gcugccgucgcuagaccacgcc

SEQ ID NO: 3952992 - RNA, 21 nt, Human herpesvirus 1
gcugcgcggcguccgcgcccc

SEQ ID NO: 3952993 - RNA, 20 nt, Human herpesvirus 1
gcugcggccacacagccggc

SEQ ID NO: 3952994 - RNA, 13 nt, Human herpesvirus 1
gcugcgugucaaa

SEQ ID NO: 3952995 - RNA, 15 nt, Human herpesvirus 1
gcuggcaacucgccc

SEQ ID NO: 3952996 - RNA, 23 nt, Human herpesvirus 1
gcugggggagaacaacgagcugc

SEQ ID NO: 3952997 - RNA, 17 nt, Human herpesvirus 1
gcuggguggucucuggc

SEQ ID NO: 3952998 - RNA, 21 nt, Human herpesvirus 1
gcugguccacacccaguggcu

SEQ ID NO: 3952999 - RNA, 22 nt, Human herpesvirus 1
gcuucauccccgagaaccagcg

SEQ ID NO: 3953000 - RNA, 20 nt, Human herpesvirus 1
gcuuccgacgccccccgugg

SEQ ID NO: 3953001 - RNA, 20 nt, Human herpesvirus 1
gcuucggccguuucuccgcc

SEQ ID NO: 3953002 - RNA, 15 nt, Human herpesvirus 1
gcuugagucuguccg

SEQ ID NO: 3953003 - RNA, 18 nt, Human herpesvirus 1
gcuugguuucggauggga

SEQ ID NO: 3953004 - RNA, 12 nt, Human herpesvirus 1
ggaaacccccga

SEQ ID NO: 3953005 - RNA, 12 nt, Human herpesvirus 1
ggaaagcaagaa

SEQ ID NO: 3953006 - RNA, 15 nt, Human herpesvirus 1
ggaacacacccccgu

SEQ ID NO: 3953007 - RNA, 21 nt, Human herpesvirus 1
ggaacacacccccgugacuca

SEQ ID NO: 3953008 - RNA, 22 nt, Human herpesvirus 1
ggaacacgccuaccggccccug

SEQ ID NO: 3953009 - RNA, 17 nt, Human herpesvirus 1
ggaaccugcucacgacc

SEQ ID NO: 3953010 - RNA, 20 nt, Human herpesvirus 1
ggaacgggaggccacagcgc

SEQ ID NO: 3953011 - RNA, 23 nt, Human herpesvirus 1
ggacacuacgaucucgaagccau

SEQ ID NO: 3953012 - RNA, 20 nt, Human herpesvirus 1
ggacacuggguucuccugga

SEQ ID NO: 3953013 - RNA, 21 nt, Human herpesvirus 1
ggacacuggguucuccuggaa

SEQ ID NO: 3953014 - RNA, 14 nt, Human herpesvirus 1
ggacagccaggagc

SEQ ID NO: 3953015 - RNA, 18 nt, Human herpesvirus 1
ggacauccaccacccggc

SEQ ID NO: 3953016 - RNA, 17 nt, Human herpesvirus 1
ggaccaccgccccccug

SEQ ID NO: 3953017 - RNA, 14 nt, Human herpesvirus 1
ggaccccacgacac

SEQ ID NO: 3953018 - RNA, 18 nt, Human herpesvirus 1
ggaccccagcgaccccac

SEQ ID NO: 3953019 - RNA, 19 nt, Human herpesvirus 1
ggacccccccucgcgccac

SEQ ID NO: 3953020 - RNA, 19 nt, Human herpesvirus 1
ggaccgccugccgcgcgga

SEQ ID NO: 3953021 - RNA, 17 nt, Human herpesvirus 1
ggaccggggucccagcg

SEQ ID NO: 3953022 - RNA, 15 nt, Human herpesvirus 1
ggacgccggggccuu

SEQ ID NO: 3953023 - RNA, 21 nt, Human herpesvirus 1
ggacgcgcggcgcgagcuccc

SEQ ID NO: 3953024 - RNA, 20 nt, Human herpesvirus 1
ggacgcguccggggagggcg

SEQ ID NO: 3953025 - RNA, 16 nt, Human herpesvirus 1
gggcaucgcggugguc

SEQ ID NO: 3953026 - RNA, 13 nt, Human herpesvirus 1
gggccagccgcag

SEQ ID NO: 3953027 - RNA, 21 nt, Human herpesvirus 1
gggccauggacagcgaccugg

SEQ ID NO: 3953028 - RNA, 20 nt, Human herpesvirus 1
gggcccacgaucaccgcggg

SEQ ID NO: 3953029 - RNA, 22 nt, Human herpesvirus 1
gggcccacgaucaccgcgggag

SEQ ID NO: 3953030 - RNA, 12 nt, Human herpesvirus 1
gggcccccgccc

SEQ ID NO: 3953031 - RNA, 20 nt, Human herpesvirus 1
gggccccgggacacccccca

SEQ ID NO: 3953032 - RNA, 16 nt, Human herpesvirus 1
gggcccgggggccugg

SEQ ID NO: 3953033 - RNA, 18 nt, Human herpesvirus 1
gggcccugcuccggcggg

SEQ ID NO: 3953034 - RNA, 14 nt, Human herpesvirus 1
gggccgcgguggac

SEQ ID NO: 3953035 - RNA, 15 nt, Human herpesvirus 1
gggccguggcggcca

SEQ ID NO: 3953036 - RNA, 14 nt, Human herpesvirus 1
gggccguugcccgg

SEQ ID NO: 3953037 - RNA, 18 nt, Human herpesvirus 1
gggcgaggagggcggcga

SEQ ID NO: 3953038 - RNA, 15 nt, Human herpesvirus 1
gggcgcuggccgugg

SEQ ID NO: 3953039 - RNA, 12 nt, Human herpesvirus 1
gggcggccccgg

SEQ ID NO: 3953040 - RNA, 12 nt, Human herpesvirus 1
gggcggcggcgu

SEQ ID NO: 3953041 - RNA, 21 nt, Human herpesvirus 1
gggcguaacguuccgccugga

SEQ ID NO: 3953042 - RNA, 23 nt, Human herpesvirus 1
gggcucuacccucuggacgcccg

SEQ ID NO: 3953043 - RNA, 18 nt, Human herpesvirus 1
ggggaaaagugaaagaca

SEQ ID NO: 3953044 - RNA, 17 nt, Human herpesvirus 1
ggggaccagguccccca

SEQ ID NO: 3953045 - RNA, 13 nt, Human herpesvirus 1
ggggacccggccc

SEQ ID NO: 3953046 - RNA, 14 nt, Human herpesvirus 1
ggggagagcccaca

SEQ ID NO: 3953047 - RNA, 12 nt, Human herpesvirus 1
ggggagcuucgc

SEQ ID NO: 3953048 - RNA, 18 nt, Human herpesvirus 1
ggggaugggcgaccuggg

SEQ ID NO: 3953049 - RNA, 15 nt, Human herpesvirus 1
ggggcccggccaacc

SEQ ID NO: 3953050 - RNA, 15 nt, Human herpesvirus 1
ggggccucccccgga

SEQ ID NO: 3953051 - RNA, 10 nt, Human herpesvirus 1
ggggcgggac

SEQ ID NO: 3953052 - RNA, 19 nt, Human herpesvirus 1
gggggaugcuagccugugu

SEQ ID NO: 3953053 - RNA, 22 nt, Human herpesvirus 1
gggggcugcgaguccugcgccc

SEQ ID NO: 3953054 - RNA, 17 nt, Human herpesvirus 1
ggggucuccgaaagcca

SEQ ID NO: 3953055 - RNA, 23 nt, Human herpesvirus 1
gggucagaacuacacggagggca

SEQ ID NO: 3953056 - RNA, 18 nt, Human herpesvirus 1
gggucugugccaccagcc

SEQ ID NO: 3953057 - RNA, 17 nt, Human herpesvirus 1
gggucuguuggggacac

SEQ ID NO: 3953058 - RNA, 12 nt, Human herpesvirus 1
ggguucuccugg

SEQ ID NO: 3953059 - RNA, 22 nt, Human herpesvirus 1
gguaccgcgugaccccagggau

SEQ ID NO: 3953060 - RNA, 14 nt, Human herpesvirus 1
gguacgugaacgcu

SEQ ID NO: 3953061 - RNA, 14 nt, Human herpesvirus 1
gguagcgggggacg

SEQ ID NO: 3953062 - RNA, 17 nt, Human herpesvirus 1
ggucaaaugccgggcca

SEQ ID NO: 3953063 - RNA, 15 nt, Human herpesvirus 1
gguccacggccacug

SEQ ID NO: 3953064 - RNA, 19 nt, Human herpesvirus 1
gguccccucugggcccgcc

SEQ ID NO: 3953065 - RNA, 17 nt, Human herpesvirus 1
ggucgaucccgaacgac

SEQ ID NO: 3953066 - RNA, 15 nt, Human herpesvirus 1
ggucggcgaccgcca

SEQ ID NO: 3953067 - RNA, 16 nt, Human herpesvirus 1
ggucggcgggcccgcg

SEQ ID NO: 3953068 - RNA, 15 nt, Human herpesvirus 1
ggucgggaggccgca

SEQ ID NO: 3953069 - RNA, 15 nt, Human herpesvirus 1
ggucgggcggagaaa

SEQ ID NO: 3953070 - RNA, 13 nt, Human herpesvirus 1
ggucucccaggga

SEQ ID NO: 3953071 - RNA, 23 nt, Human herpesvirus 1
ggucucccagggagccccggucu

SEQ ID NO: 3953072 - RNA, 17 nt, Human herpesvirus 1
ggucuccccgggagccc

SEQ ID NO: 3953073 - RNA, 19 nt, Human herpesvirus 1
ggucuccccgggagccccg

SEQ ID NO: 3953074 - RNA, 16 nt, Human herpesvirus 1
ggucucuggccgcgcc

SEQ ID NO: 3953075 - RNA, 18 nt, Human herpesvirus 1
ggucucuggccgcgccca

SEQ ID NO: 3953076 - RNA, 19 nt, Human herpesvirus 1
ggucugggaacggacacgc

SEQ ID NO: 3953077 - RNA, 19 nt, Human herpesvirus 1
ggucugucucgucuccucu

SEQ ID NO: 3953078 - RNA, 20 nt, Human herpesvirus 1
ggugacguuuaucggcaggc

SEQ ID NO: 3953079 - RNA, 21 nt, Human herpesvirus 1
ggugccugacgccugccaacc

SEQ ID NO: 3953080 - RNA, 23 nt, Human herpesvirus 1
ggugcgauggcgacacaccugug

SEQ ID NO: 3953081 - RNA, 14 nt, Human herpesvirus 1
gguggagcugcccg

SEQ ID NO: 3953082 - RNA, 11 nt, Human herpesvirus 1
gguggagggug

SEQ ID NO: 3953083 - RNA, 16 nt, Human herpesvirus 1
gguggcgucgcaucga

SEQ ID NO: 3953084 - RNA, 14 nt, Human herpesvirus 1
gguggugcccagcg

SEQ ID NO: 3953085 - RNA, 13 nt, Human herpesvirus 1
gguuaauguaaau

SEQ ID NO: 3953086 - RNA, 17 nt, Human herpesvirus 1
gguuacgcgggccccgg

SEQ ID NO: 3953087 - RNA, 15 nt, Human herpesvirus 1
gguuccgcgaccacc

SEQ ID NO: 3953088 - RNA, 13 nt, Human herpesvirus 1
gguugcggcccgc

SEQ ID NO: 3953089 - RNA, 18 nt, Human herpesvirus 1
gguuguccguggccccac

SEQ ID NO: 3953090 - RNA, 15 nt, Human herpesvirus 1
guaaccccccccaaa

SEQ ID NO: 3953091 - RNA, 16 nt, Human herpesvirus 1
guaacggcauaugcaa

SEQ ID NO: 3953092 - RNA, 17 nt, Human herpesvirus 1
guacggcacccgcgcga

SEQ ID NO: 3953093 - RNA, 15 nt, Human herpesvirus 1
guacggggccgggag

SEQ ID NO: 3953094 - RNA, 22 nt, Human herpesvirus 1
guacguggucguccgcggaccg

SEQ ID NO: 3953095 - RNA, 17 nt, Human herpesvirus 1
guacuggaugcgccgcc

SEQ ID NO: 3953096 - RNA, 20 nt, Human herpesvirus 1
guagcgccccggcgacccug

SEQ ID NO: 3953097 - RNA, 12 nt, Human herpesvirus 1
guaggcccagca

SEQ ID NO: 3953098 - RNA, 15 nt, Human herpesvirus 1
guagggugguuccug

SEQ ID NO: 3953099 - RNA, 22 nt, Human herpesvirus 1
guagggugguuccuguaucugg

SEQ ID NO: 3953100 - RNA, 19 nt, Human herpesvirus 1
guaucggggguucccacca

SEQ ID NO: 3953101 - RNA, 16 nt, Human herpesvirus 1
guaucugacgcgcccc

SEQ ID NO: 3953102 - RNA, 17 nt, Human herpesvirus 1
gucaaacgaccucauca

SEQ ID NO: 3953103 - RNA, 23 nt, Human herpesvirus 1
gucacagcgaccgcaacuuccca

SEQ ID NO: 3953104 - RNA, 22 nt, Human herpesvirus 1
gucacggugaccgcgugcccac

SEQ ID NO: 3953105 - RNA, 22 nt, Human herpesvirus 1
guccaccaaagucucugugggu

SEQ ID NO: 3953106 - RNA, 17 nt, Human herpesvirus 1
guccacgguaggcccag

SEQ ID NO: 3953107 - RNA, 20 nt, Human herpesvirus 1
guccagcgccgcaaccagcu

SEQ ID NO: 3953108 - RNA, 19 nt, Human herpesvirus 1
gucccauccgaacgcagcc

SEQ ID NO: 3953109 - RNA, 19 nt, Human herpesvirus 1
gucccaucugugcggggag

SEQ ID NO: 3953110 - RNA, 17 nt, Human herpesvirus 1
guccccaaaauaaaaga

SEQ ID NO: 3953111 - RNA, 13 nt, Human herpesvirus 1
guccccgaggacc

SEQ ID NO: 3953112 - RNA, 21 nt, Human herpesvirus 1
guccccgaggaccccgugggc

SEQ ID NO: 3953113 - RNA, 16 nt, Human herpesvirus 1
guccccgcgaagaccc

SEQ ID NO: 3953114 - RNA, 18 nt, Human herpesvirus 1
guccccggcccggaggag

SEQ ID NO: 3953115 - RNA, 13 nt, Human herpesvirus 1
guccccucugggc

SEQ ID NO: 3953116 - RNA, 22 nt, Human herpesvirus 1
gucccgacauuaaccaccugcg

SEQ ID NO: 3953117 - RNA, 15 nt, Human herpesvirus 1
gucccuccuuagcac

SEQ ID NO: 3953118 - RNA, 14 nt, Human herpesvirus 1
gucccugcgucgcc

SEQ ID NO: 3953119 - RNA, 14 nt, Human herpesvirus 1
guccgcggaccggc

SEQ ID NO: 3953120 - RNA, 16 nt, Human herpesvirus 1
guccgcggaccggcgg

SEQ ID NO: 3953121 - RNA, 18 nt, Human herpesvirus 1
guccggagccgcgcggcc

SEQ ID NO: 3953122 - RNA, 18 nt, Human herpesvirus 1
guccuggaugcuguggac

SEQ ID NO: 3953123 - RNA, 11 nt, Human herpesvirus 1
guccuggggau

SEQ ID NO: 3953124 - RNA, 16 nt, Human herpesvirus 1
guccuggggauggcca

SEQ ID NO: 3953125 - RNA, 12 nt, Human herpesvirus 1
guccuguggagc

SEQ ID NO: 3953126 - RNA, 11 nt, Human herpesvirus 1
gucgacgagau

SEQ ID NO: 3953127 - RNA, 20 nt, Human herpesvirus 1
gucgcaacgccgcaggggag

SEQ ID NO: 3953128 - RNA, 12 nt, Human herpesvirus 1
gucgcacccaca

SEQ ID NO: 3953129 - RNA, 14 nt, Human herpesvirus 1
gucgccccuguggc

SEQ ID NO: 3953130 - RNA, 22 nt, Human herpesvirus 1
gucgccguuucgggcggcaggc

SEQ ID NO: 3953131 - RNA, 19 nt, Human herpesvirus 1
gucgccuggcugacccacg

SEQ ID NO: 3953132 - RNA, 16 nt, Human herpesvirus 1
gucgcgcuccucugcg

SEQ ID NO: 3953133 - RNA, 17 nt, Human herpesvirus 1
gucgcgggacccgacag

SEQ ID NO: 3953134 - RNA, 20 nt, Human herpesvirus 1
gucggcaagauccucgggcu

SEQ ID NO: 3953135 - RNA, 20 nt, Human herpesvirus 1
gucgucauagugggccucca

SEQ ID NO: 3953136 - RNA, 18 nt, Human herpesvirus 1
gucgucucucuucccccc

SEQ ID NO: 3953137 - RNA, 15 nt, Human herpesvirus 1
gucuccacgugcgug

SEQ ID NO: 3953138 - RNA, 13 nt, Human herpesvirus 1
gucucccagggag

SEQ ID NO: 3953139 - RNA, 12 nt, Human herpesvirus 1
gucuccucuucu

SEQ ID NO: 3953140 - RNA, 19 nt, Human herpesvirus 1
gucuccucuucuccccuuc

SEQ ID NO: 3953141 - RNA, 11 nt, Human herpesvirus 1
gucucuggccg

SEQ ID NO: 3953142 - RNA, 14 nt, Human herpesvirus 1
gucuguccucggga

SEQ ID NO: 3953143 - RNA, 16 nt, Human herpesvirus 1
gucuucggccccgcgu

SEQ ID NO: 3953144 - RNA, 19 nt, Human herpesvirus 1
gugaaagacacgggcacca

SEQ ID NO: 3953145 - RNA, 15 nt, Human herpesvirus 1
gugacgcacccccug

SEQ ID NO: 3953146 - RNA, 18 nt, Human herpesvirus 1
gugagcgcgcggaugcuc

SEQ ID NO: 3953147 - RNA, 14 nt, Human herpesvirus 1
gugcacagccuggc

SEQ ID NO: 3953148 - RNA, 14 nt, Human herpesvirus 1
gugccaccagccug

SEQ ID NO: 3953149 - RNA, 16 nt, Human herpesvirus 1
gugcccacgucgcccc

SEQ ID NO: 3953150 - RNA, 23 nt, Human herpesvirus 1
gugcccccccucguucugcugca

SEQ ID NO: 3953151 - RNA, 15 nt, Human herpesvirus 1
gugccgcuguggccu

SEQ ID NO: 3953152 - RNA, 16 nt, Human herpesvirus 1
gugcgauggcgacaca

SEQ ID NO: 3953153 - RNA, 17 nt, Human herpesvirus 1
gugcgauucagcgcgga

SEQ ID NO: 3953154 - RNA, 21 nt, Human herpesvirus 1
gugcgcucgcucucggugccc

SEQ ID NO: 3953155 - RNA, 15 nt, Human herpesvirus 1
gugcgggcggcccug

SEQ ID NO: 3953156 - RNA, 18 nt, Human herpesvirus 1
gugcguagcauaccuggg

SEQ ID NO: 3953157 - RNA, 19 nt, Human herpesvirus 1
gugcgucgggccucccgga

SEQ ID NO: 3953158 - RNA, 13 nt, Human herpesvirus 1
gugcuuuggaaac

SEQ ID NO: 3953159 - RNA, 23 nt, Human herpesvirus 1
guggaacgaggcccgcaagcuga

SEQ ID NO: 3953160 - RNA, 14 nt, Human herpesvirus 1
guggacccaaagcc

SEQ ID NO: 3953161 - RNA, 17 nt, Human herpesvirus 1
guggacgccggggccuu

SEQ ID NO: 3953162 - RNA, 21 nt, Human herpesvirus 1
guggagcaaaacgccuccccc

SEQ ID NO: 3953163 - RNA, 14 nt, Human herpesvirus 1
guggaucuuagccu

SEQ ID NO: 3953164 - RNA, 17 nt, Human herpesvirus 1
guggcacgggcccaagg

SEQ ID NO: 3953165 - RNA, 21 nt, Human herpesvirus 1
guggccggccugcgcgacgcc

SEQ ID NO: 3953166 - RNA, 22 nt, Human herpesvirus 1
guggcucucgagaugagccaga

SEQ ID NO: 3953167 - RNA, 17 nt, Human herpesvirus 1
gugggcgacugcgaccc

SEQ ID NO: 3953168 - RNA, 22 nt, Human herpesvirus 1
gugggggaaccuagggcggggc

SEQ ID NO: 3953169 - RNA, 15 nt, Human herpesvirus 1
gugggugaugucggg

SEQ ID NO: 3953170 - RNA, 22 nt, Human herpesvirus 1
guggguuuuuuaaaaacgacac

SEQ ID NO: 3953171 - RNA, 21 nt, Human herpesvirus 1
gugguccgcggggccuccccc

SEQ ID NO: 3953172 - RNA, 14 nt, Human herpesvirus 1
guggucucuggccg

SEQ ID NO: 3953173 - RNA, 23 nt, Human herpesvirus 1
gugguuuuuauuuacaacaaacc

SEQ ID NO: 3953174 - RNA, 22 nt, Human herpesvirus 1
gugucugcuccccaccccggag

SEQ ID NO: 3953175 - RNA, 12 nt, Human herpesvirus 1
gugugcccaccc

SEQ ID NO: 3953176 - RNA, 18 nt, Human herpesvirus 1
gugugggguccucaugga

SEQ ID NO: 3953177 - RNA, 15 nt, Human herpesvirus 1
guguggguggaggag

SEQ ID NO: 3953178 - RNA, 14 nt, Human herpesvirus 1
guuaauguaaauaa

SEQ ID NO: 3953179 - RNA, 20 nt, Human herpesvirus 1
guuauucccaaacagggccu

SEQ ID NO: 3953180 - RNA, 12 nt, Human herpesvirus 1
guucccccccgu

SEQ ID NO: 3953181 - RNA, 16 nt, Human herpesvirus 1
guuccggaggcgccgc

SEQ ID NO: 3953182 - RNA, 21 nt, Human herpesvirus 1
guuccgggaugccgugccgcc

SEQ ID NO: 3953183 - RNA, 15 nt, Human herpesvirus 1
guucgagcagccgcg

SEQ ID NO: 3953184 - RNA, 19 nt, Human herpesvirus 1
guucgagcagccgcgccgc

SEQ ID NO: 3953185 - RNA, 14 nt, Human herpesvirus 1
guucgagcgccacc

SEQ ID NO: 3953186 - RNA, 19 nt, Human herpesvirus 1
guucgcgucccgcccaccg

SEQ ID NO: 3953187 - RNA, 14 nt, Human herpesvirus 1
guucggccaccgcu

SEQ ID NO: 3953188 - RNA, 12 nt, Human herpesvirus 1
guucguuccggg

SEQ ID NO: 3953189 - RNA, 14 nt, Human herpesvirus 1
guucucccuguuca

SEQ ID NO: 3953190 - RNA, 22 nt, Human herpesvirus 1
guucuggacgggagucccgagg

SEQ ID NO: 3953191 - RNA, 17 nt, Human herpesvirus 1
guugcccgcggaccacc

SEQ ID NO: 3953192 - RNA, 17 nt, Human herpesvirus 1
guuggcgucgggaccau

SEQ ID NO: 3953193 - RNA, 21 nt, Human herpesvirus 1
guuggguuuucuuugugccug

SEQ ID NO: 3953194 - RNA, 16 nt, Human herpesvirus 1
guugugguuauaugca

SEQ ID NO: 3953195 - RNA, 17 nt, Human herpesvirus 1
guuuacgcgggcacgca

SEQ ID NO: 3953196 - RNA, 16 nt, Human herpesvirus 1
guuuaggguaccacag

SEQ ID NO: 3953197 - RNA, 14 nt, Human herpesvirus 1
guuugcccuccccc

SEQ ID NO: 3953198 - RNA, 13 nt, Human herpesvirus 1
guuuucucuuccc

SEQ ID NO: 3953199 - RNA, 21 nt, Human herpesvirus 1
uaaagggccggugguccgccu

SEQ ID NO: 3953200 - RNA, 19 nt, Human herpesvirus 1
uaaaugguguccgcggucc

SEQ ID NO: 3953201 - RNA, 20 nt, Human herpesvirus 1
uaaauuccggaaggggacac

SEQ ID NO: 3953202 - RNA, 19 nt, Human herpesvirus 1
uaaauuuuacaaacagauu

SEQ ID NO: 3953203 - RNA, 16 nt, Human herpesvirus 1
uaacccagaccccggg

SEQ ID NO: 3953204 - RNA, 21 nt, Human herpesvirus 1
uacaaccacauacagcgccau

SEQ ID NO: 3953205 - RNA, 14 nt, Human herpesvirus 1
uacaaguucaaggc

SEQ ID NO: 3953206 - RNA, 13 nt, Human herpesvirus 1
uacacagccaccc

SEQ ID NO: 3953207 - RNA, 22 nt, Human herpesvirus 1
uacaccgaaugcuccuacaaca

SEQ ID NO: 3953208 - RNA, 17 nt, Human herpesvirus 1
uacaccggccacccagg

SEQ ID NO: 3953209 - RNA, 22 nt, Human herpesvirus 1
uacaccucccagugucccgaca

SEQ ID NO: 3953210 - RNA, 21 nt, Human herpesvirus 1
uacacgagcacccugcugccc

SEQ ID NO: 3953211 - RNA, 17 nt, Human herpesvirus 1
uacagcauggcgccaca

SEQ ID NO: 3953212 - RNA, 12 nt, Human herpesvirus 1
uacagcccccag

SEQ ID NO: 3953213 - RNA, 19 nt, Human herpesvirus 1
uaccaacccgccccuaacc

SEQ ID NO: 3953214 - RNA, 15 nt, Human herpesvirus 1
uaccaucccccggcc

SEQ ID NO: 3953215 - RNA, 23 nt, Human herpesvirus 1
uacgccgccaccguggccggccu

SEQ ID NO: 3953216 - RNA, 13 nt, Human herpesvirus 1
uacgcgggccccg

SEQ ID NO: 3953217 - RNA, 14 nt, Human herpesvirus 1
uacgcgggccccgg

SEQ ID NO: 3953218 - RNA, 15 nt, Human herpesvirus 1
uacgcgggccccggg

SEQ ID NO: 3953219 - RNA, 19 nt, Human herpesvirus 1
uacgcgguacgccccaccg

SEQ ID NO: 3953220 - RNA, 19 nt, Human herpesvirus 1
uacggcuaccgggaggggu

SEQ ID NO: 3953221 - RNA, 14 nt, Human herpesvirus 1
uacuauccccgcag

SEQ ID NO: 3953222 - RNA, 22 nt, Human herpesvirus 1
uacuccggccgcgguacagauc

SEQ ID NO: 3953223 - RNA, 16 nt, Human herpesvirus 1
uacucgaucacggagg

SEQ ID NO: 3953224 - RNA, 14 nt, Human herpesvirus 1
uacugcugggccau

SEQ ID NO: 3953225 - RNA, 13 nt, Human herpesvirus 1
uacuugcgcggcu

SEQ ID NO: 3953226 - RNA, 12 nt, Human herpesvirus 1
uagaccacgccc

SEQ ID NO: 3953227 - RNA, 21 nt, Human herpesvirus 1
uagccagcagacgcugcuccg

SEQ ID NO: 3953228 - RNA, 12 nt, Human herpesvirus 1
uauaaggccugg

SEQ ID NO: 3953229 - RNA, 16 nt, Human herpesvirus 1
uaucccgcccaccgcu

SEQ ID NO: 3953230 - RNA, 19 nt, Human herpesvirus 1
uaucccuaaggcccggcua

SEQ ID NO: 3953231 - RNA, 22 nt, Human herpesvirus 1
uauggggcgggggauggggaga

SEQ ID NO: 3953232 - RNA, 15 nt, Human herpesvirus 1
ucaaaaguuguuagc

SEQ ID NO: 3953233 - RNA, 20 nt, Human herpesvirus 1
ucaaccacccggccauccgc

SEQ ID NO: 3953234 - RNA, 19 nt, Human herpesvirus 1
ucacagggcgggccgccuc

SEQ ID NO: 3953235 - RNA, 15 nt, Human herpesvirus 1
ucaccaccaaggccc

SEQ ID NO: 3953236 - RNA, 12 nt, Human herpesvirus 1
ucacccacgccg

SEQ ID NO: 3953237 - RNA, 21 nt, Human herpesvirus 1
ucacccccgaguucccccggg

SEQ ID NO: 3953238 - RNA, 21 nt, Human herpesvirus 1
ucacgcgggaggccgcccagc

SEQ ID NO: 3953239 - RNA, 17 nt, Human herpesvirus 1
ucagccagacgccgggu

SEQ ID NO: 3953240 - RNA, 18 nt, Human herpesvirus 1
ucagcuuuuaccgcuucc

SEQ ID NO: 3953241 - RNA, 14 nt, Human herpesvirus 1
ucauaaccacgccc

SEQ ID NO: 3953242 - RNA, 14 nt, Human herpesvirus 1
ucaucaacgcgacc

SEQ ID NO: 3953243 - RNA, 16 nt, Human herpesvirus 1
uccaaaaccacaaccu

SEQ ID NO: 3953244 - RNA, 23 nt, Human herpesvirus 1
uccaccacccaaccccaacucca

SEQ ID NO: 3953245 - RNA, 16 nt, Human herpesvirus 1
uccaccaccuucacca

SEQ ID NO: 3953246 - RNA, 20 nt, Human herpesvirus 1
uccacccccucgaccaccau

SEQ ID NO: 3953247 - RNA, 15 nt, Human herpesvirus 1
uccacgaacccagcg

SEQ ID NO: 3953248 - RNA, 19 nt, Human herpesvirus 1
uccacgguaggcccagcau

SEQ ID NO: 3953249 - RNA, 12 nt, Human herpesvirus 1
uccagcccccca

SEQ ID NO: 3953250 - RNA, 17 nt, Human herpesvirus 1
uccaggcugucgacgcc

SEQ ID NO: 3953251 - RNA, 14 nt, Human herpesvirus 1
uccagggcggggcu

SEQ ID NO: 3953252 - RNA, 15 nt, Human herpesvirus 1
uccauaccgaccaca

SEQ ID NO: 3953253 - RNA, 17 nt, Human herpesvirus 1
uccauaccgaccacacc

SEQ ID NO: 3953254 - RNA, 13 nt, Human herpesvirus 1
ucccaacaacucc

SEQ ID NO: 3953255 - RNA, 15 nt, Human herpesvirus 1
ucccaacgaccccgc

SEQ ID NO: 3953256 - RNA, 20 nt, Human herpesvirus 1
acccugaucccccgcgcggc

SEQ ID NO: 3953257 - RNA, 18 nt, Human herpesvirus 1
acccuguggaacgaggcc

SEQ ID NO: 3953258 - RNA, 15 nt, Human herpesvirus 1
accgacagcacucac

SEQ ID NO: 3953259 - RNA, 17 nt, Human herpesvirus 1
accgacucucccaccgc

SEQ ID NO: 3953260 - RNA, 13 nt, Human herpesvirus 1
accgcagccuggu

SEQ ID NO: 3953261 - RNA, 15 nt, Human herpesvirus 1
accgcagucccugag

SEQ ID NO: 3953262 - RNA, 17 nt, Human herpesvirus 1
accgcagucccugaguu

SEQ ID NO: 3953263 - RNA, 22 nt, Human herpesvirus 1
accgcccaaugggccgggccgc

SEQ ID NO: 3953264 - RNA, 17 nt, Human herpesvirus 1
accgcccaccuccuggc

SEQ ID NO: 3953265 - RNA, 16 nt, Human herpesvirus 1
accgccggcgaggugg

SEQ ID NO: 3953266 - RNA, 17 nt, Human herpesvirus 1
accgcgguucgcguccc

SEQ ID NO: 3953267 - RNA, 20 nt, Human herpesvirus 1
accgcgguucgcgucccgcc

SEQ ID NO: 3953268 - RNA, 19 nt, Human herpesvirus 1
accgcgugaccccagggau

SEQ ID NO: 3953269 - RNA, 17 nt, Human herpesvirus 1
accggacccgcaucccc

SEQ ID NO: 3953270 - RNA, 23 nt, Human herpesvirus 1
accggacccgcaucccccgucug

SEQ ID NO: 3953271 - RNA, 21 nt, Human herpesvirus 1
accggcaccaccgacucuccc

SEQ ID NO: 3953272 - RNA, 18 nt, Human herpesvirus 1
accgguaugccgcggcca

SEQ ID NO: 3953273 - RNA, 19 nt, Human herpesvirus 1
accguaacggcauaugcaa

SEQ ID NO: 3953274 - RNA, 15 nt, Human herpesvirus 1
accucaccaccaagg

SEQ ID NO: 3953275 - RNA, 14 nt, Human herpesvirus 1
accucgaggacacc

SEQ ID NO: 3953276 - RNA, 17 nt, Human herpesvirus 1
accucggacgccacacc

SEQ ID NO: 3953277 - RNA, 13 nt, Human herpesvirus 1
accucuccacacc

SEQ ID NO: 3953278 - RNA, 13 nt, Human herpesvirus 1
accuucaucgacc

SEQ ID NO: 3953279 - RNA, 20 nt, Human herpesvirus 1
accuuccguccccugccccc

SEQ ID NO: 3953280 - RNA, 22 nt, Human herpesvirus 1
accuucugcgggucaccugcca

SEQ ID NO: 3953281 - RNA, 14 nt, Human herpesvirus 1
accuugccccggcc

SEQ ID NO: 3953282 - RNA, 15 nt, Human herpesvirus 1
accuuggcccuggcu

SEQ ID NO: 3953283 - RNA, 15 nt, Human herpesvirus 1
accuuggucuggccc

SEQ ID NO: 3953284 - RNA, 18 nt, Human herpesvirus 1
acgaacgcggaccccccc

SEQ ID NO: 3953285 - RNA, 22 nt, Human herpesvirus 1
acgacccucgagauccccgggg

SEQ ID NO: 3953286 - RNA, 12 nt, Human herpesvirus 1
acgaggccaagc

SEQ ID NO: 3953287 - RNA, 15 nt, Human herpesvirus 1
acgaugaccgccccc

SEQ ID NO: 3953288 - RNA, 18 nt, Human herpesvirus 1
acgaugaccgcccccagc

SEQ ID NO: 3953289 - RNA, 20 nt, Human herpesvirus 1
acgaugaccgcccccagcug

SEQ ID NO: 3953290 - RNA, 16 nt, Human herpesvirus 1
acgcaagaccaggccu

SEQ ID NO: 3953291 - RNA, 17 nt, Human herpesvirus 1
acgcaagaccaggccug

SEQ ID NO: 3953292 - RNA, 23 nt, Human herpesvirus 1
acgcacaugggggaggugccccc

SEQ ID NO: 3953293 - RNA, 16 nt, Human herpesvirus 1
acgcacccccugaccc

SEQ ID NO: 3953294 - RNA, 20 nt, Human herpesvirus 1
acgcacccgcugcgucggca

SEQ ID NO: 3953295 - RNA, 13 nt, Human herpesvirus 1
acgcacuguggcu

SEQ ID NO: 3953296 - RNA, 20 nt, Human herpesvirus 1
acgcacuugcggcaagaccc

SEQ ID NO: 3953297 - RNA, 19 nt, Human herpesvirus 1
acgcagccagaacucgccc

SEQ ID NO: 3953298 - RNA, 16 nt, Human herpesvirus 1
acgccaaugcccuccc

SEQ ID NO: 3953299 - RNA, 18 nt, Human herpesvirus 1
acgccauacacagccacc

SEQ ID NO: 3953300 - RNA, 17 nt, Human herpesvirus 1
acgccaucgccucggcc

SEQ ID NO: 3953301 - RNA, 22 nt, Human herpesvirus 1
acgcccgccgcaaagccaccca

SEQ ID NO: 3953302 - RNA, 18 nt, Human herpesvirus 1
acgcccgcgacccggacg

SEQ ID NO: 3953303 - RNA, 14 nt, Human herpesvirus 1
acgccgcugacccc

SEQ ID NO: 3953304 - RNA, 23 nt, Human herpesvirus 1
acgccggguagcguacggaccgc

SEQ ID NO: 3953305 - RNA, 20 nt, Human herpesvirus 1
acgccguggcgccccggccc

SEQ ID NO: 3953306 - RNA, 17 nt, Human herpesvirus 1
acgccuaccggccccug

SEQ ID NO: 3953307 - RNA, 13 nt, Human herpesvirus 1
acgccucccccug

SEQ ID NO: 3953308 - RNA, 13 nt, Human herpesvirus 1
acgccugccaacc

SEQ ID NO: 3953309 - RNA, 21 nt, Human herpesvirus 1
acgccuuaccaucccccggcc

SEQ ID NO: 3953310 - RNA, 16 nt, Human herpesvirus 1
acgcgagcgacccgcg

SEQ ID NO: 3953311 - RNA, 23 nt, Human herpesvirus 1
acgcgcauccgucgggaggccac

SEQ ID NO: 3953312 - RNA, 17 nt, Human herpesvirus 1
acgcgccggccgcaccc

SEQ ID NO: 3953313 - RNA, 16 nt, Human herpesvirus 1
acgcgcgcgaccucac

SEQ ID NO: 3953314 - RNA, 12 nt, Human herpesvirus 1
acgcgcuaacgg

SEQ ID NO: 3953315 - RNA, 13 nt, Human herpesvirus 1
acgcgcuggggcu

SEQ ID NO: 3953316 - RNA, 19 nt, Human herpesvirus 1
acgcgguauggcugccccc

SEQ ID NO: 3953317 - RNA, 20 nt, Human herpesvirus 1
acgcucuccccugcugccau

SEQ ID NO: 3953318 - RNA, 20 nt, Human herpesvirus 1
acgcugcuccgccuggccug

SEQ ID NO: 3953319 - RNA, 19 nt, Human herpesvirus 1
acgcuggggguccuggugg

SEQ ID NO: 3953320 - RNA, 12 nt, Human herpesvirus 1
acggaccgucug

SEQ ID NO: 3953321 - RNA, 19 nt, Human herpesvirus 1
acggcccgaagccugcugu

SEQ ID NO: 3953322 - RNA, 21 nt, Human herpesvirus 1
acggccuccgcguacgaggac

SEQ ID NO: 3953323 - RNA, 21 nt, Human herpesvirus 1
acggcgccggggcucucgggg

SEQ ID NO: 3953324 - RNA, 15 nt, Human herpesvirus 1
acggcgucugggcca

SEQ ID NO: 3953325 - RNA, 19 nt, Human herpesvirus 1
acggcgucugggccaccga

SEQ ID NO: 3953326 - RNA, 22 nt, Human herpesvirus 1
acgggacacuuguccggagaac

SEQ ID NO: 3953327 - RNA, 20 nt, Human herpesvirus 1
acgucaauugcccgaggcgc

SEQ ID NO: 3953328 - RNA, 14 nt, Human herpesvirus 1
acgucgagaaggac

SEQ ID NO: 3953329 - RNA, 15 nt, Human herpesvirus 1
acgucgcgccugggu

SEQ ID NO: 3953330 - RNA, 18 nt, Human herpesvirus 1
acgugcacagccuggccg

SEQ ID NO: 3953331 - RNA, 15 nt, Human herpesvirus 1
acgugcucgacagcc

SEQ ID NO: 3953332 - RNA, 15 nt, Human herpesvirus 1
acgugggccucaccc

SEQ ID NO: 3953333 - RNA, 23 nt, Human herpesvirus 1
acguucgcgcgccaucuggaccg

SEQ ID NO: 3953334 - RNA, 15 nt, Human herpesvirus 1
acuacaccagccaau

SEQ ID NO: 3953335 - RNA, 19 nt, Human herpesvirus 1
acuacucggaaagcgaaga

SEQ ID NO: 3953336 - RNA, 22 nt, Human herpesvirus 1
acucauuuguggacgccggggc

SEQ ID NO: 3953337 - RNA, 19 nt, Human herpesvirus 1
acucccgacaccaccagcu

SEQ ID NO: 3953338 - RNA, 14 nt, Human herpesvirus 1
acucucccaccgcc

SEQ ID NO: 3953339 - RNA, 15 nt, Human herpesvirus 1
acucucccaccgcca

SEQ ID NO: 3953340 - RNA, 22 nt, Human herpesvirus 1
acugcaucgucgaggaggugga

SEQ ID NO: 3953341 - RNA, 13 nt, Human herpesvirus 1
acugcgaccccag

SEQ ID NO: 3953342 - RNA, 22 nt, Human herpesvirus 1
acuggugccggucgugagagaa

SEQ ID NO: 3953343 - RNA, 22 nt, Human herpesvirus 1
acuucccgguaugguaauuaaa

SEQ ID NO: 3953344 - RNA, 15 nt, Human herpesvirus 1
acuugcggcaagacc

SEQ ID NO: 3953345 - RNA, 14 nt, Human herpesvirus 1
agacacgggcacca

SEQ ID NO: 3953346 - RNA, 18 nt, Human herpesvirus 1
agacacgggcaccacaca

SEQ ID NO: 3953347 - RNA, 21 nt, Human herpesvirus 1
agacacgggcaccacacacca

SEQ ID NO: 3953348 - RNA, 16 nt, Human herpesvirus 1
agacagccgaucucca

SEQ ID NO: 3953349 - RNA, 21 nt, Human herpesvirus 1
agaccaccggucgucccucgc

SEQ ID NO: 3953350 - RNA, 21 nt, Human herpesvirus 1
agacccgggcgaugagccaac

SEQ ID NO: 3953351 - RNA, 20 nt, Human herpesvirus 1
agaccggcaccaccgacucu

SEQ ID NO: 3953352 - RNA, 22 nt, Human herpesvirus 1
agacgaaaagccccgggccgcg

SEQ ID NO: 3953353 - RNA, 16 nt, Human herpesvirus 1
agacgacaccgugguc

SEQ ID NO: 3953354 - RNA, 19 nt, Human herpesvirus 1
agacgagcgcgcuuguccc

SEQ ID NO: 3953355 - RNA, 22 nt, Human herpesvirus 1
agacgcgggcgacgcacacacc

SEQ ID NO: 3953356 - RNA, 22 nt, Human herpesvirus 1
agacggcauucgggccugccug

SEQ ID NO: 3953357 - RNA, 20 nt, Human herpesvirus 1
agcaaacgccccgcccacac

SEQ ID NO: 3953358 - RNA, 12 nt, Human herpesvirus 1
agcaccacauaa

SEQ ID NO: 3953359 - RNA, 15 nt, Human herpesvirus 1
agcacccugcugccc

SEQ ID NO: 3953360 - RNA, 14 nt, Human herpesvirus 1
agcaccgacaccgc

SEQ ID NO: 3953361 - RNA, 21 nt, Human herpesvirus 1
agcaccucuaccagcaggucc

SEQ ID NO: 3953362 - RNA, 13 nt, Human herpesvirus 1
agcauaccugggu

SEQ ID NO: 3953363 - RNA, 23 nt, Human herpesvirus 1
agcauacgcucgggcccgcgucg

SEQ ID NO: 3953364 - RNA, 20 nt, Human herpesvirus 1
agcaucgaccacgcccuucc

SEQ ID NO: 3953365 - RNA, 22 nt, Human herpesvirus 1
agcauggcgccacaccacgcca

SEQ ID NO: 3953366 - RNA, 15 nt, Human herpesvirus 1
agccagacccaaccc

SEQ ID NO: 3953367 - RNA, 14 nt, Human herpesvirus 1
agccccggacccca

SEQ ID NO: 3953368 - RNA, 19 nt, Human herpesvirus 1
agccccggucuccccggga

SEQ ID NO: 3953369 - RNA, 21 nt, Human herpesvirus 1
agcccugguguuucuggggag

SEQ ID NO: 3953370 - RNA, 21 nt, Human herpesvirus 1
gugcgccaggucggcgaccgc

SEQ ID NO: 3953371 - RNA, 17 nt, Human herpesvirus 1
gugcgucgggccucccg

SEQ ID NO: 3953372 - RNA, 19 nt, Human herpesvirus 1
gugcucgugugguacaccg

SEQ ID NO: 3953373 - RNA, 18 nt, Human herpesvirus 1
gugcugccgucgcuagac

SEQ ID NO: 3953374 - RNA, 21 nt, Human herpesvirus 1
gugcugcugcggcccacccug

SEQ ID NO: 3953375 - RNA, 14 nt, Human herpesvirus 1
gugcuugagucugu

SEQ ID NO: 3953376 - RNA, 16 nt, Human herpesvirus 1
gugcuugagucugucc

SEQ ID NO: 3953377 - RNA, 14 nt, Human herpesvirus 1
gugcuuucuggugc

SEQ ID NO: 3953378 - RNA, 21 nt, Human herpesvirus 1
guggacgggcucgccagcgac

SEQ ID NO: 3953379 - RNA, 22 nt, Human herpesvirus 1
guggagcugcccggcggccagu

SEQ ID NO: 3953380 - RNA, 16 nt, Human herpesvirus 1
guggaggcgcggcgcc

SEQ ID NO: 3953381 - RNA, 14 nt, Human herpesvirus 1
guggcaccucccca

SEQ ID NO: 3953382 - RNA, 19 nt, Human herpesvirus 1
guggcgcacgaauccuucg

SEQ ID NO: 3953383 - RNA, 11 nt, Human herpesvirus 1
guggcgccccg

SEQ ID NO: 3953384 - RNA, 19 nt, Human herpesvirus 1
guggcgccgcaaaucccac

SEQ ID NO: 3953385 - RNA, 18 nt, Human herpesvirus 1
guggcuccgggccaacca

SEQ ID NO: 3953386 - RNA, 16 nt, Human herpesvirus 1
gugggcgaggggggag

SEQ ID NO: 3953387 - RNA, 14 nt, Human herpesvirus 1
gugggcguccugga

SEQ ID NO: 3953388 - RNA, 15 nt, Human herpesvirus 1
gugggggugggcauc

SEQ ID NO: 3953389 - RNA, 16 nt, Human herpesvirus 1
gugggguccucaugga

SEQ ID NO: 3953390 - RNA, 19 nt, Human herpesvirus 1
gugggucuguugguccugg

SEQ ID NO: 3953391 - RNA, 16 nt, Human herpesvirus 1
guggucuucaaggaga

SEQ ID NO: 3953392 - RNA, 19 nt, Human herpesvirus 1
gugguucccccccguggcu

SEQ ID NO: 3953393 - RNA, 15 nt, Human herpesvirus 1
gugguucgggugugc

SEQ ID NO: 3953394 - RNA, 14 nt, Human herpesvirus 1
gugucaauggacgc

SEQ ID NO: 3953395 - RNA, 20 nt, Human herpesvirus 1
gugugaguuuguggacccaa

SEQ ID NO: 3953396 - RNA, 18 nt, Human herpesvirus 1
guguucguacgcggggcu

SEQ ID NO: 3953397 - RNA, 15 nt, Human herpesvirus 1
guguuuguggggagg

SEQ ID NO: 3953398 - RNA, 15 nt, Human herpesvirus 1
guuacgcgggccccg

SEQ ID NO: 3953399 - RNA, 12 nt, Human herpesvirus 1
guucccuggccg

SEQ ID NO: 3953400 - RNA, 21 nt, Human herpesvirus 1
guuccgccugucgcacccaca

SEQ ID NO: 3953401 - RNA, 22 nt, Human herpesvirus 1
guuccgcuuccaucgccccugg

SEQ ID NO: 3953402 - RNA, 13 nt, Human herpesvirus 1
guucgggcggacg

SEQ ID NO: 3953403 - RNA, 22 nt, Human herpesvirus 1
guucgucgcccuccaccaacgc

SEQ ID NO: 3953404 - RNA, 14 nt, Human herpesvirus 1
guucguuccgggca

SEQ ID NO: 3953405 - RNA, 20 nt, Human herpesvirus 1
guugacgcuggggguccugg

SEQ ID NO: 3953406 - RNA, 24 nt, Human herpesvirus 1
guugccaucgcguggugcgagcug

SEQ ID NO: 3953407 - RNA, 18 nt, Human herpesvirus 1
guugcugcgcggcgcccg

SEQ ID NO: 3953408 - RNA, 20 nt, Human herpesvirus 1
guuggggggugggggaaccu

SEQ ID NO: 3953409 - RNA, 14 nt, Human herpesvirus 1
guuguggcucgggg

SEQ ID NO: 3953410 - RNA, 17 nt, Human herpesvirus 1
guuguuagcccugcucg

SEQ ID NO: 3953411 - RNA, 17 nt, Human herpesvirus 1
guuuaggguaccacagg

SEQ ID NO: 3953412 - RNA, 16 nt, Human herpesvirus 1
guuuccgcgacccacc

SEQ ID NO: 3953413 - RNA, 18 nt, Human herpesvirus 1
guuucuuggccccugggg

SEQ ID NO: 3953414 - RNA, 14 nt, Human herpesvirus 1
guuugcgggccugg

SEQ ID NO: 3953415 - RNA, 17 nt, Human herpesvirus 1
uaaaagaccaaaaucaa

SEQ ID NO: 3953416 - RNA, 15 nt, Human herpesvirus 1
uaaaauaaauuauug

SEQ ID NO: 3953417 - RNA, 17 nt, Human herpesvirus 1
uaaacccccaaacaccc

SEQ ID NO: 3953418 - RNA, 17 nt, Human herpesvirus 1
uaaaccgguauuauuua

SEQ ID NO: 3953419 - RNA, 15 nt, Human herpesvirus 1
uaaagccacugaaac

SEQ ID NO: 3953420 - RNA, 22 nt, Human herpesvirus 1
uaaccaccugcgcucccucagc

SEQ ID NO: 3953421 - RNA, 23 nt, Human herpesvirus 1
uaaccgaccgcagucccugaguu

SEQ ID NO: 3953422 - RNA, 10 nt, Human herpesvirus 1
uaaggccugg

SEQ ID NO: 3953423 - RNA, 14 nt, Human herpesvirus 1
uaaggucauccgag

SEQ ID NO: 3953424 - RNA, 17 nt, Human herpesvirus 1
uacacagccacccaccc

SEQ ID NO: 3953425 - RNA, 13 nt, Human herpesvirus 1
uacacccaaguuc

SEQ ID NO: 3953426 - RNA, 18 nt, Human herpesvirus 1
uacaccggccacccaggu

SEQ ID NO: 3953427 - RNA, 15 nt, Human herpesvirus 1
uaccccaguccccgg

SEQ ID NO: 3953428 - RNA, 14 nt, Human herpesvirus 1
uaccgaccacaccg

SEQ ID NO: 3953429 - RNA, 17 nt, Human herpesvirus 1
uaccgcgagcucccaga

SEQ ID NO: 3953430 - RNA, 19 nt, Human herpesvirus 1
uacgcuaaucccccggcuc

SEQ ID NO: 3953431 - RNA, 18 nt, Human herpesvirus 1
uacgcuucggccgccacc

SEQ ID NO: 3953432 - RNA, 16 nt, Human herpesvirus 1
uacgugugcccacccc

SEQ ID NO: 3953433 - RNA, 22 nt, Human herpesvirus 1
uacugcgcgaucguccaccucc

SEQ ID NO: 3953434 - RNA, 23 nt, Human herpesvirus 1
uagaccagaggcgcgcgcaccuc

SEQ ID NO: 3953435 - RNA, 16 nt, Human herpesvirus 1
uagcgccccggcgacc

SEQ ID NO: 3953436 - RNA, 15 nt, Human herpesvirus 1
uagcguguucgugga

SEQ ID NO: 3953437 - RNA, 21 nt, Human herpesvirus 1
uaggaugccagccagggcggc

SEQ ID NO: 3953438 - RNA, 15 nt, Human herpesvirus 1
uauccuggagcaccg

SEQ ID NO: 3953439 - RNA, 16 nt, Human herpesvirus 1
uaugccccccuggcga

SEQ ID NO: 3953440 - RNA, 24 nt, Human herpesvirus 1
uaugguacacacgggugcgucugg

SEQ ID NO: 3953441 - RNA, 23 nt, Human herpesvirus 1
uauguccccaaaauaaaagacca

SEQ ID NO: 3953442 - RNA, 19 nt, Human herpesvirus 1
uauucccaaacagggccuu

SEQ ID NO: 3953443 - RNA, 20 nt, Human herpesvirus 1
ucaaccccagggaccuccug

SEQ ID NO: 3953444 - RNA, 13 nt, Human herpesvirus 1
ucaagcaggccau

SEQ ID NO: 3953445 - RNA, 23 nt, Human herpesvirus 1
ucaagcaggccaucgccggggac

SEQ ID NO: 3953446 - RNA, 22 nt, Human herpesvirus 1
ucaaggacagcggccugcugga

SEQ ID NO: 3953447 - RNA, 19 nt, Human herpesvirus 1
ucacacagcaucccccgcc

SEQ ID NO: 3953448 - RNA, 16 nt, Human herpesvirus 1
ucaccaaccacccggg

SEQ ID NO: 3953449 - RNA, 13 nt, Human herpesvirus 1
ucaccaccaaggc

SEQ ID NO: 3953450 - RNA, 19 nt, Human herpesvirus 1
ucaccaccauggccccccg

SEQ ID NO: 3953451 - RNA, 18 nt, Human herpesvirus 1
ucaccaccgucagcaccu

SEQ ID NO: 3953452 - RNA, 16 nt, Human herpesvirus 1
ucaccaugcuggagga

SEQ ID NO: 3953453 - RNA, 21 nt, Human herpesvirus 1
ucaccccaaucccccccgacc

SEQ ID NO: 3953454 - RNA, 19 nt, Human herpesvirus 1
ucaccccgaagccccggcc

SEQ ID NO: 3953455 - RNA, 22 nt, Human herpesvirus 1
ucaccccgaagccccggcccug

SEQ ID NO: 3953456 - RNA, 10 nt, Human herpesvirus 1
ucaccccgca

SEQ ID NO: 3953457 - RNA, 22 nt, Human herpesvirus 1
ucaccggguacggcgucugggc

SEQ ID NO: 3953458 - RNA, 17 nt, Human herpesvirus 1
ucacgcaagaccaggcc

SEQ ID NO: 3953459 - RNA, 23 nt, Human herpesvirus 1
ucacgcgggaggccgcccagcuc

SEQ ID NO: 3953460 - RNA, 13 nt, Human herpesvirus 1
ucacggcaaggag

SEQ ID NO: 3953461 - RNA, 14 nt, Human herpesvirus 1
ucacgugcugcugc

SEQ ID NO: 3953462 - RNA, 19 nt, Human herpesvirus 1
ucagccuuaccacgcccga

SEQ ID NO: 3953463 - RNA, 14 nt, Human herpesvirus 1
ucagcgccaagguc

SEQ ID NO: 3953464 - RNA, 21 nt, Human herpesvirus 1
ucagcgcgauccgacaugucc

SEQ ID NO: 3953465 - RNA, 20 nt, Human herpesvirus 1
ucagggcucuacccucugga

SEQ ID NO: 3953466 - RNA, 15 nt, Human herpesvirus 1
ucaucaccgacgacg

SEQ ID NO: 3953467 - RNA, 19 nt, Human herpesvirus 1
uccaccaaagucucugugg

SEQ ID NO: 3953468 - RNA, 15 nt, Human herpesvirus 1
uccacccccucgacc

SEQ ID NO: 3953469 - RNA, 20 nt, Human herpesvirus 1
uccacgccgacgccaacgcc

SEQ ID NO: 3953470 - RNA, 11 nt, Human herpesvirus 1
uccacggccac

SEQ ID NO: 3953471 - RNA, 16 nt, Human herpesvirus 1
uccacuacuacgugga

SEQ ID NO: 3953472 - RNA, 15 nt, Human herpesvirus 1
uccagccccccagcc

SEQ ID NO: 3953473 - RNA, 19 nt, Human herpesvirus 1
uccagccccccagccuccc

SEQ ID NO: 3953474 - RNA, 17 nt, Human herpesvirus 1
uccagccuccccuccag

SEQ ID NO: 3953475 - RNA, 15 nt, Human herpesvirus 1
uccaggucccaccug

SEQ ID NO: 3953476 - RNA, 10 nt, Human herpesvirus 1
uccaucgccc

SEQ ID NO: 3953477 - RNA, 15 nt, Human herpesvirus 1
ucccaaacagggccu

SEQ ID NO: 3953478 - RNA, 15 nt, Human herpesvirus 1
ucccacgcucucccc

SEQ ID NO: 3953479 - RNA, 14 nt, Human herpesvirus 1
ucccaggaucacac

SEQ ID NO: 3953480 - RNA, 22 nt, Human herpesvirus 1
ucccauccgaacgcagccccgc

SEQ ID NO: 3953481 - RNA, 20 nt, Human herpesvirus 1
uccccaagaccccccuggcc

SEQ ID NO: 3953482 - RNA, 23 nt, Human herpesvirus 1
ucccccaccgcccacagagggcc

SEQ ID NO: 3953483 - RNA, 17 nt, Human herpesvirus 1
ucccccgcgcgccccga

SEQ ID NO: 3953484 - RNA, 17 nt, Human herpesvirus 1
ucccccggcacgccugg

SEQ ID NO: 3953485 - RNA, 20 nt, Human herpesvirus 1
ucccccggcacgccuggggu

SEQ ID NO: 3953486 - RNA, 18 nt, Human herpesvirus 1
ucccccuccgcaucccag

SEQ ID NO: 3953487 - RNA, 20 nt, Human herpesvirus 1
ucccccuccgcaucccagga

SEQ ID NO: 3953488 - RNA, 15 nt, Human herpesvirus 1
uccccgauggcccuc

SEQ ID NO: 3953489 - RNA, 23 nt, Human herpesvirus 1
uccccgcgaagacccccccggag

SEQ ID NO: 3953490 - RNA, 23 nt, Human herpesvirus 1
uccccgcuccccaagcaucgacc

SEQ ID NO: 3953491 - RNA, 14 nt, Human herpesvirus 1
uccccgcugucacu

SEQ ID NO: 3953492 - RNA, 14 nt, Human herpesvirus 1
uccccucugggccc

SEQ ID NO: 3953493 - RNA, 12 nt, Human herpesvirus 1
ucccgaagccca

SEQ ID NO: 3953494 - RNA, 13 nt, Human herpesvirus 1
ucccgacaccacc

SEQ ID NO: 3953495 - RNA, 22 nt, Human herpesvirus 1
ucccgcagauuccauucggggu

SEQ ID NO: 3953496 - RNA, 23 nt, Human herpesvirus 1
ucccggggggucggcaggcgacg

SEQ ID NO: 3953497 - RNA, 22 nt, Human herpesvirus 1
ucccgguaugguaauuaaaaac

SEQ ID NO: 3953498 - RNA, 15 nt, Human herpesvirus 1
ucccucgaccaccau

SEQ ID NO: 3953499 - RNA, 20 nt, Human herpesvirus 1
ucccucgcaugaagccccca

SEQ ID NO: 3953500 - RNA, 15 nt, Human herpesvirus 1
ucccuggccgugguc

SEQ ID NO: 3953501 - RNA, 14 nt, Human herpesvirus 1
ucccugucgccucc

SEQ ID NO: 3953502 - RNA, 22 nt, Human herpesvirus 1
ucccuguuugucgccuggcugg

SEQ ID NO: 3953503 - RNA, 14 nt, Human herpesvirus 1
uccgaacccaggcc

SEQ ID NO: 3953504 - RNA, 17 nt, Human herpesvirus 1
uccgaacgcagccccgc

SEQ ID NO: 3953505 - RNA, 20 nt, Human herpesvirus 1
uccgcccccaaccccuuccc

SEQ ID NO: 3953506 - RNA, 20 nt, Human herpesvirus 1
uccgcgccaggcccgccgcc

SEQ ID NO: 3953507 - RNA, 17 nt, Human herpesvirus 1
uccgcggagcucccggg

SEQ ID NO: 3953508 - RNA, 15 nt, Human herpesvirus 1
uccgcggccccagcc

SEQ ID NO: 3953509 - RNA, 19 nt, Human herpesvirus 1
uccggcgcgcgucucuggg

SEQ ID NO: 3953510 - RNA, 17 nt, Human herpesvirus 1
uccgggaccugaacccc

SEQ ID NO: 3953511 - RNA, 13 nt, Human herpesvirus 1
uccggggcccggc

SEQ ID NO: 3953512 - RNA, 13 nt, Human herpesvirus 1
uccguccccugcc

SEQ ID NO: 3953513 - RNA, 18 nt, Human herpesvirus 1
uccguccccugccccccc

SEQ ID NO: 3953514 - RNA, 18 nt, Human herpesvirus 1
uccgucuucggccccgcg

SEQ ID NO: 3953515 - RNA, 15 nt, Human herpesvirus 1
uccguggccccggcc

SEQ ID NO: 3953516 - RNA, 13 nt, Human herpesvirus 1
uccucccgccacc

SEQ ID NO: 3953517 - RNA, 14 nt, Human herpesvirus 1
uccucccgcucggc

SEQ ID NO: 3953518 - RNA, 15 nt, Human herpesvirus 1
uccucgugcccucgc

SEQ ID NO: 3953519 - RNA, 12 nt, Human herpesvirus 1
uccucguggccg

SEQ ID NO: 3953520 - RNA, 19 nt, Human herpesvirus 1
uccugaugcacgcccccgc

SEQ ID NO: 3953521 - RNA, 20 nt, Human herpesvirus 1
uccugaugcacgcccccgcg

SEQ ID NO: 3953522 - RNA, 17 nt, Human herpesvirus 1
uccugcgccccgccgcc

SEQ ID NO: 3953523 - RNA, 14 nt, Human herpesvirus 1
uccugggccaccug

SEQ ID NO: 3953524 - RNA, 19 nt, Human herpesvirus 1
ucgaagcugaugucccuca

SEQ ID NO: 3953525 - RNA, 14 nt, Human herpesvirus 1
ucgaccaccauccc

SEQ ID NO: 3953526 - RNA, 21 nt, Human herpesvirus 1
ucgaccccauggaccccagcg

SEQ ID NO: 3953527 - RNA, 15 nt, Human herpesvirus 1
ucgacgaccugggga

SEQ ID NO: 3953528 - RNA, 20 nt, Human herpesvirus 1
ucgacgucgcgccugggugc

SEQ ID NO: 3953529 - RNA, 14 nt, Human herpesvirus 1
ucgagcagccgcgc

SEQ ID NO: 3953530 - RNA, 15 nt, Human herpesvirus 1
ucgaggcggccgagg

SEQ ID NO: 3953531 - RNA, 16 nt, Human herpesvirus 1
ucgaguucgccaggcu

SEQ ID NO: 3953532 - RNA, 17 nt, Human herpesvirus 1
ucgaguucgccaggcug

SEQ ID NO: 3953533 - RNA, 14 nt, Human herpesvirus 1
ucgcacccacagcu

SEQ ID NO: 3953534 - RNA, 14 nt, Human herpesvirus 1
ucgccacgucgacc

SEQ ID NO: 3953535 - RNA, 16 nt, Human herpesvirus 1
ucgccccacgacccga

SEQ ID NO: 3953536 - RNA, 13 nt, Human herpesvirus 1
ucgcccuccacca

SEQ ID NO: 3953537 - RNA, 16 nt, Human herpesvirus 1
ucgccgcggcucccgg

SEQ ID NO: 3953538 - RNA, 17 nt, Human herpesvirus 1
ucgccgcggcucccggc

SEQ ID NO: 3953539 - RNA, 22 nt, Human herpesvirus 1
ucgccggggaccgcagccuggu

SEQ ID NO: 3953540 - RNA, 15 nt, Human herpesvirus 1
ucgccuaccuucgca

SEQ ID NO: 3953541 - RNA, 15 nt, Human herpesvirus 1
ucgccugcggcgacc

SEQ ID NO: 3953542 - RNA, 20 nt, Human herpesvirus 1
ucgcggagggcggccagccg

SEQ ID NO: 3953543 - RNA, 19 nt, Human herpesvirus 1
ucgcggccgcgacccaggc

SEQ ID NO: 3953544 - RNA, 11 nt, Human herpesvirus 1
ucggcauggug

SEQ ID NO: 3953545 - RNA, 19 nt, Human herpesvirus 1
ucggccuauggcuccugcg

SEQ ID NO: 3953546 - RNA, 21 nt, Human herpesvirus 1
ucggcgagcuggauggcgcgu

SEQ ID NO: 3953547 - RNA, 13 nt, Human herpesvirus 1
ucggcuccccgcc

SEQ ID NO: 3953548 - RNA, 19 nt, Human herpesvirus 1
ucgggaccaucaucggggg

SEQ ID NO: 3953549 - RNA, 17 nt, Human herpesvirus 1
ucgggaugcugccccgc

SEQ ID NO: 3953550 - RNA, 14 nt, Human herpesvirus 1
ucgggccucccgga

SEQ ID NO: 3953551 - RNA, 15 nt, Human herpesvirus 1
ucgggcgccaaagcc

SEQ ID NO: 3953552 - RNA, 13 nt, Human herpesvirus 1
ucgggcgcugggu

SEQ ID NO: 3953553 - RNA, 15 nt, Human herpesvirus 1
ucgggcgcugggugg

SEQ ID NO: 3953554 - RNA, 22 nt, Human herpesvirus 1
ucgggcgcuggguggucucugg

SEQ ID NO: 3953555 - RNA, 20 nt, Human herpesvirus 1
ucggggaggggaaaagugaa

SEQ ID NO: 3953556 - RNA, 16 nt, Human herpesvirus 1
ucggggccgcccuggc

SEQ ID NO: 3953557 - RNA, 14 nt, Human herpesvirus 1
ucguccccuggggc

SEQ ID NO: 3953558 - RNA, 18 nt, Human herpesvirus 1
ucgucgggcgccaaagcc

SEQ ID NO: 3953559 - RNA, 12 nt, Human herpesvirus 1
ucgugagagaau

SEQ ID NO: 3953560 - RNA, 15 nt, Human herpesvirus 1
ucgugcaugucguca

SEQ ID NO: 3953561 - RNA, 19 nt, Human herpesvirus 1
ucgugggccucugggucug

SEQ ID NO: 3953562 - RNA, 16 nt, Human herpesvirus 1
ucgugucuuucggugg

SEQ ID NO: 3953563 - RNA, 21 nt, Human herpesvirus 1
ucucaucgccgcgcguccccc

SEQ ID NO: 3953564 - RNA, 14 nt, Human herpesvirus 1
ucuccacaccugca

SEQ ID NO: 3953565 - RNA, 12 nt, Human herpesvirus 1
ucuccgcccgac

SEQ ID NO: 3953566 - RNA, 12 nt, Human herpesvirus 1
ucuccgccucuc

SEQ ID NO: 3953567 - RNA, 22 nt, Human herpesvirus 1
ucuccuccaccacccaacccca

SEQ ID NO: 3953568 - RNA, 18 nt, Human herpesvirus 1
ucuggccaucgguccccu

SEQ ID NO: 3953569 - RNA, 21 nt, Human herpesvirus 1
ucugggcccgacagaccuccc

SEQ ID NO: 3953570 - RNA, 18 nt, Human herpesvirus 1
ucugggguuugcccuccc

SEQ ID NO: 3953571 - RNA, 15 nt, Human herpesvirus 1
ucuggguuuuccccu

SEQ ID NO: 3953572 - RNA, 19 nt, Human herpesvirus 1
ucugguccgccgcgagccc

SEQ ID NO: 3953573 - RNA, 12 nt, Human herpesvirus 1
ucugugggccaa

SEQ ID NO: 3953574 - RNA, 15 nt, Human herpesvirus 1
ucuguuucuuggccc

SEQ ID NO: 3953575 - RNA, 20 nt, Human herpesvirus 1
ucuuccgcggagcucccggg

SEQ ID NO: 3953576 - RNA, 14 nt, Human herpesvirus 1
ucuucuccccuucc

SEQ ID NO: 3953577 - RNA, 14 nt, Human herpesvirus 1
ucuuuccugugugu

SEQ ID NO: 3953578 - RNA, 18 nt, Human herpesvirus 1
ucuuuuguguuggcccua

SEQ ID NO: 3953579 - RNA, 17 nt, Human herpesvirus 1
ugaaaccggccaacgcc

SEQ ID NO: 3953580 - RNA, 12 nt, Human herpesvirus 1
ugaaccccagcc

SEQ ID NO: 3953581 - RNA, 17 nt, Human herpesvirus 1
ugacacccuaccccagu

SEQ ID NO: 3953582 - RNA, 19 nt, Human herpesvirus 1
ugaccaacgacggcccgac

SEQ ID NO: 3953583 - RNA, 19 nt, Human herpesvirus 1
ugaccagcgcacugcccga

SEQ ID NO: 3953584 - RNA, 16 nt, Human herpesvirus 1
ugaccccgcuccugug

SEQ ID NO: 3953585 - RNA, 14 nt, Human herpesvirus 1
ugacccucuccggg

SEQ ID NO: 3953586 - RNA, 21 nt, Human herpesvirus 1
ugaccgcccgccccucgccac

SEQ ID NO: 3953587 - RNA, 12 nt, Human herpesvirus 1
ugaccugcaccg

SEQ ID NO: 3953588 - RNA, 15 nt, Human herpesvirus 1
ugacggccaucgccg

SEQ ID NO: 3953589 - RNA, 15 nt, Human herpesvirus 1
ugacggccgacgacg

SEQ ID NO: 3953590 - RNA, 21 nt, Human herpesvirus 1
ugaggacgucgagaaggacaa

SEQ ID NO: 3953591 - RNA, 17 nt, Human herpesvirus 1
ugauggcacaccggucc

SEQ ID NO: 3953592 - RNA, 18 nt, Human herpesvirus 1
ugauggccugugcuuucu

SEQ ID NO: 3953593 - RNA, 17 nt, Human herpesvirus 1
ugauuccucuccgcggu

SEQ ID NO: 3953594 - RNA, 18 nt, Human herpesvirus 1
ugcaccgguucucccugu

SEQ ID NO: 3953595 - RNA, 22 nt, Human herpesvirus 1
ugcagggccuggugcucguggg

SEQ ID NO: 3953596 - RNA, 19 nt, Human herpesvirus 1
ugcaugucgucacggugac

SEQ ID NO: 3953597 - RNA, 18 nt, Human herpesvirus 1
ugccaccagccugguugu

SEQ ID NO: 3953598 - RNA, 13 nt, Human herpesvirus 1
ugccagaccucaa

SEQ ID NO: 3953599 - RNA, 11 nt, Human herpesvirus 1
ugcccacgggu

SEQ ID NO: 3953600 - RNA, 12 nt, Human herpesvirus 1
ugcccagcggcc

SEQ ID NO: 3953601 - RNA, 14 nt, Human herpesvirus 1
ugcccccggagcug

SEQ ID NO: 3953602 - RNA, 23 nt, Human herpesvirus 1
ugcccucgcgggccucgugggca

SEQ ID NO: 3953603 - RNA, 22 nt, Human herpesvirus 1
ugcccuuccaggucccaccuga

SEQ ID NO: 3953604 - RNA, 16 nt, Human herpesvirus 1
ugccgcuuuacgaggc

SEQ ID NO: 3953605 - RNA, 22 nt, Human herpesvirus 1
gggcguaacguuccgccuggag

SEQ ID NO: 3953606 - RNA, 14 nt, Human herpesvirus 1
gggcguagagcugu

SEQ ID NO: 3953607 - RNA, 13 nt, Human herpesvirus 1
gggcucggcuccc

SEQ ID NO: 3953608 - RNA, 15 nt, Human herpesvirus 1
gggcucguccccugg

SEQ ID NO: 3953609 - RNA, 16 nt, Human herpesvirus 1
gggcucuacccucugg

SEQ ID NO: 3953610 - RNA, 16 nt, Human herpesvirus 1
ggggacccgccccgga

SEQ ID NO: 3953611 - RNA, 18 nt, Human herpesvirus 1
ggggaccuugccccggcc

SEQ ID NO: 3953612 - RNA, 21 nt, Human herpesvirus 1
ggggacgcgcaccuguuccgc

SEQ ID NO: 3953613 - RNA, 15 nt, Human herpesvirus 1
ggggacggcggggca

SEQ ID NO: 3953614 - RNA, 14 nt, Human herpesvirus 1
ggggagggcagggc

SEQ ID NO: 3953615 - RNA, 23 nt, Human herpesvirus 1
ggggaggggggggucgggcgcug

SEQ ID NO: 3953616 - RNA, 14 nt, Human herpesvirus 1
ggggcauuucagug

SEQ ID NO: 3953617 - RNA, 19 nt, Human herpesvirus 1
ggggccauguugggccgcc

SEQ ID NO: 3953618 - RNA, 17 nt, Human herpesvirus 1
ggggcccacccacccga

SEQ ID NO: 3953619 - RNA, 13 nt, Human herpesvirus 1
ggggccggggacg

SEQ ID NO: 3953620 - RNA, 18 nt, Human herpesvirus 1
ggggccuuggcggccgcc

SEQ ID NO: 3953621 - RNA, 15 nt, Human herpesvirus 1
ggggcgcuggccgug

SEQ ID NO: 3953622 - RNA, 17 nt, Human herpesvirus 1
ggggcgggggccccgcc

SEQ ID NO: 3953623 - RNA, 21 nt, Human herpesvirus 1
ggggcgugucuguuucuuggc

SEQ ID NO: 3953624 - RNA, 21 nt, Human herpesvirus 1
ggggcuggcgcaaccacgccc

SEQ ID NO: 3953625 - RNA, 14 nt, Human herpesvirus 1
gggggcccggaacg

SEQ ID NO: 3953626 - RNA, 12 nt, Human herpesvirus 1
ggggggcuuccg

SEQ ID NO: 3953627 - RNA, 21 nt, Human herpesvirus 1
ggggguccggcacggacccaa

SEQ ID NO: 3953628 - RNA, 19 nt, Human herpesvirus 1
gggguccggcacggaccca

SEQ ID NO: 3953629 - RNA, 15 nt, Human herpesvirus 1
ggggugggggugggc

SEQ ID NO: 3953630 - RNA, 20 nt, Human herpesvirus 1
ggguaccgcgugaccccagg

SEQ ID NO: 3953631 - RNA, 11 nt, Human herpesvirus 1
ggguccgggcc

SEQ ID NO: 3953632 - RNA, 19 nt, Human herpesvirus 1
ggguggagggugucccagg

SEQ ID NO: 3953633 - RNA, 13 nt, Human herpesvirus 1
ggguggcacagaa

SEQ ID NO: 3953634 - RNA, 13 nt, Human herpesvirus 1
ggguucuccugga

SEQ ID NO: 3953635 - RNA, 11 nt, Human herpesvirus 1
ggucaccugcc

SEQ ID NO: 3953636 - RNA, 14 nt, Human herpesvirus 1
ggucaccugccagu

SEQ ID NO: 3953637 - RNA, 15 nt, Human herpesvirus 1
ggucagaggcccacg

SEQ ID NO: 3953638 - RNA, 21 nt, Human herpesvirus 1
ggucagcgacguccugggcca

SEQ ID NO: 3953639 - RNA, 11 nt, Human herpesvirus 1
gguccccccuc

SEQ ID NO: 3953640 - RNA, 16 nt, Human herpesvirus 1
gguccccucugggccc

SEQ ID NO: 3953641 - RNA, 13 nt, Human herpesvirus 1
gguccggcacgga

SEQ ID NO: 3953642 - RNA, 17 nt, Human herpesvirus 1
gguccuggccggccugg

SEQ ID NO: 3953643 - RNA, 21 nt, Human herpesvirus 1
ggucgaucccgaagcccagcg

SEQ ID NO: 3953644 - RNA, 22 nt, Human herpesvirus 1
ggucgcccgucucugcuacgcc

SEQ ID NO: 3953645 - RNA, 19 nt, Human herpesvirus 1
ggucggcaagguggugaug

SEQ ID NO: 3953646 - RNA, 17 nt, Human herpesvirus 1
ggucgggcgcugggugg

SEQ ID NO: 3953647 - RNA, 16 nt, Human herpesvirus 1
ggucggugacgcgcca

SEQ ID NO: 3953648 - RNA, 22 nt, Human herpesvirus 1
ggucgucccucgcaugaagccc

SEQ ID NO: 3953649 - RNA, 19 nt, Human herpesvirus 1
ggucucgcuuugccgggaa

SEQ ID NO: 3953650 - RNA, 13 nt, Human herpesvirus 1
ggucuggcccacg

SEQ ID NO: 3953651 - RNA, 17 nt, Human herpesvirus 1
ggucuguauagcccggg

SEQ ID NO: 3953652 - RNA, 17 nt, Human herpesvirus 1
ggugauguugcccgcgg

SEQ ID NO: 3953653 - RNA, 19 nt, Human herpesvirus 1
ggugccaaagcgcccgucg

SEQ ID NO: 3953654 - RNA, 18 nt, Human herpesvirus 1
ggugccaauaaaccccca

SEQ ID NO: 3953655 - RNA, 20 nt, Human herpesvirus 1
ggugccaguccgcugcaccg

SEQ ID NO: 3953656 - RNA, 18 nt, Human herpesvirus 1
ggugccccaaggagggcg

SEQ ID NO: 3953657 - RNA, 22 nt, Human herpesvirus 1
ggugccgaccgggucccuccuu

SEQ ID NO: 3953658 - RNA, 11 nt, Human herpesvirus 1
ggugcuccgcc

SEQ ID NO: 3953659 - RNA, 17 nt, Human herpesvirus 1
gguggagcugcccggcg

SEQ ID NO: 3953660 - RNA, 14 nt, Human herpesvirus 1
ggugggcguccugg

SEQ ID NO: 3953661 - RNA, 11 nt, Human herpesvirus 1
ggugggggaac

SEQ ID NO: 3953662 - RNA, 17 nt, Human herpesvirus 1
ggugguccguguggagg

SEQ ID NO: 3953663 - RNA, 16 nt, Human herpesvirus 1
gguuagacccaugggu

SEQ ID NO: 3953664 - RNA, 23 nt, Human herpesvirus 1
guaauuucuacgugcccccggau

SEQ ID NO: 3953665 - RNA, 20 nt, Human herpesvirus 1
guacaacaucauccagcugg

SEQ ID NO: 3953666 - RNA, 17 nt, Human herpesvirus 1
guacaacggcucggccu

SEQ ID NO: 3953667 - RNA, 21 nt, Human herpesvirus 1
guacauguucuuuaugcgccc

SEQ ID NO: 3953668 - RNA, 15 nt, Human herpesvirus 1
guacgaccaucaccc

SEQ ID NO: 3953669 - RNA, 14 nt, Human herpesvirus 1
guacgccccaccgg

SEQ ID NO: 3953670 - RNA, 19 nt, Human herpesvirus 1
guacgcccucccgcugcgc

SEQ ID NO: 3953671 - RNA, 17 nt, Human herpesvirus 1
guacugcggucugucuc

SEQ ID NO: 3953672 - RNA, 16 nt, Human herpesvirus 1
guauccacccccgccc

SEQ ID NO: 3953673 - RNA, 16 nt, Human herpesvirus 1
guaugacagcggggac

SEQ ID NO: 3953674 - RNA, 15 nt, Human herpesvirus 1
gucacgcacgccgcc

SEQ ID NO: 3953675 - RNA, 21 nt, Human herpesvirus 1
gucagccugccucucccccca

SEQ ID NO: 3953676 - RNA, 13 nt, Human herpesvirus 1
gucagcgacgucc

SEQ ID NO: 3953677 - RNA, 17 nt, Human herpesvirus 1
gucagcuccucgcgcgg

SEQ ID NO: 3953678 - RNA, 15 nt, Human herpesvirus 1
gucauagugggccuc

SEQ ID NO: 3953679 - RNA, 11 nt, Human herpesvirus 1
gucauaugcaa

SEQ ID NO: 3953680 - RNA, 18 nt, Human herpesvirus 1
gucaugcgcaagcgccgc

SEQ ID NO: 3953681 - RNA, 13 nt, Human herpesvirus 1
guccagcgccgca

SEQ ID NO: 3953682 - RNA, 21 nt, Human herpesvirus 1
guccagggggaugcuagccug

SEQ ID NO: 3953683 - RNA, 13 nt, Human herpesvirus 1
guccccaaaauaa

SEQ ID NO: 3953684 - RNA, 15 nt, Human herpesvirus 1
gucccccacaccacc

SEQ ID NO: 3953685 - RNA, 14 nt, Human herpesvirus 1
gucccccuggaggu

SEQ ID NO: 3953686 - RNA, 15 nt, Human herpesvirus 1
gucccccuggaggug

SEQ ID NO: 3953687 - RNA, 22 nt, Human herpesvirus 1
guccccgaacaaacgacccacc

SEQ ID NO: 3953688 - RNA, 19 nt, Human herpesvirus 1
guccccugccccccccacc

SEQ ID NO: 3953689 - RNA, 12 nt, Human herpesvirus 1
guccccuggggc

SEQ ID NO: 3953690 - RNA, 12 nt, Human herpesvirus 1
gucccgcccacc

SEQ ID NO: 3953691 - RNA, 15 nt, Human herpesvirus 1
gucccgcccaccgga

SEQ ID NO: 3953692 - RNA, 20 nt, Human herpesvirus 1
guccgcggggccucccccgg

SEQ ID NO: 3953693 - RNA, 22 nt, Human herpesvirus 1
guccggcacggacccaaaauaa

SEQ ID NO: 3953694 - RNA, 20 nt, Human herpesvirus 1
guccgggggcucggaaacug

SEQ ID NO: 3953695 - RNA, 14 nt, Human herpesvirus 1
guccugacggccaa

SEQ ID NO: 3953696 - RNA, 15 nt, Human herpesvirus 1
guccugcgccccgcc

SEQ ID NO: 3953697 - RNA, 15 nt, Human herpesvirus 1
guccuggaccagcug

SEQ ID NO: 3953698 - RNA, 18 nt, Human herpesvirus 1
guccuggagcuccgggga

SEQ ID NO: 3953699 - RNA, 17 nt, Human herpesvirus 1
guccuggccggccuggc

SEQ ID NO: 3953700 - RNA, 20 nt, Human herpesvirus 1
gucgaccgcgcccucgccac

SEQ ID NO: 3953701 - RNA, 15 nt, Human herpesvirus 1
gucgccccuguggcc

SEQ ID NO: 3953702 - RNA, 23 nt, Human herpesvirus 1
gucgcccgauuuacagcccccag

SEQ ID NO: 3953703 - RNA, 21 nt, Human herpesvirus 1
gucgcgcgcgcuuugcggagg

SEQ ID NO: 3953704 - RNA, 15 nt, Human herpesvirus 1
gucggaccaccgccc

SEQ ID NO: 3953705 - RNA, 18 nt, Human herpesvirus 1
gucgggaggccacagaaa

SEQ ID NO: 3953706 - RNA, 17 nt, Human herpesvirus 1
gucggggcgucccugga

SEQ ID NO: 3953707 - RNA, 13 nt, Human herpesvirus 1
gucgucagcaccg

SEQ ID NO: 3953708 - RNA, 19 nt, Human herpesvirus 1
gucgucgggcgccaaagcc

SEQ ID NO: 3953709 - RNA, 16 nt, Human herpesvirus 1
gucuccaagcuuuccg

SEQ ID NO: 3953710 - RNA, 21 nt, Human herpesvirus 1
gucuccgaaagccaccaauag

SEQ ID NO: 3953711 - RNA, 12 nt, Human herpesvirus 1
gucucucuuccc

SEQ ID NO: 3953712 - RNA, 20 nt, Human herpesvirus 1
gucucuggccgcgcccacua

SEQ ID NO: 3953713 - RNA, 14 nt, Human herpesvirus 1
gucuggagacccua

SEQ ID NO: 3953714 - RNA, 22 nt, Human herpesvirus 1
gucugugccggagguggggcgg

SEQ ID NO: 3953715 - RNA, 22 nt, Human herpesvirus 1
gugaacacggcgaaugcagcgc

SEQ ID NO: 3953716 - RNA, 16 nt, Human herpesvirus 1
gugaccgcgugcccac

SEQ ID NO: 3953717 - RNA, 23 nt, Human herpesvirus 1
gugacgcgccaaacgccagccug

SEQ ID NO: 3953718 - RNA, 14 nt, Human herpesvirus 1
gugauuccucuccg

SEQ ID NO: 3953719 - RNA, 12 nt, Human herpesvirus 1
gugcacagccug

SEQ ID NO: 3953720 - RNA, 15 nt, Human herpesvirus 1
gugcacagccuggcc

SEQ ID NO: 3953721 - RNA, 22 nt, Human herpesvirus 1
gugcccauuuacguggcugggu

SEQ ID NO: 3953722 - RNA, 17 nt, Human herpesvirus 1
gugccugacgccugcca

SEQ ID NO: 3953723 - RNA, 19 nt, Human herpesvirus 1
gcgcgaauugacccuagga

SEQ ID NO: 3953724 - RNA, 14 nt, Human herpesvirus 1
gcgcgaccucacca

SEQ ID NO: 3953725 - RNA, 15 nt, Human herpesvirus 1
gcgcgaucguccacc

SEQ ID NO: 3953726 - RNA, 22 nt, Human herpesvirus 1
gcgcgccaucuggaccgggguc

SEQ ID NO: 3953727 - RNA, 13 nt, Human herpesvirus 1
gcgcgccgcgagu

SEQ ID NO: 3953728 - RNA, 18 nt, Human herpesvirus 1
gcgcgcgcaccuccuccg

SEQ ID NO: 3953729 - RNA, 18 nt, Human herpesvirus 1
gcgcgcggaugcucggcg

SEQ ID NO: 3953730 - RNA, 20 nt, Human herpesvirus 1
gcgcgcuuguccccgaacaa

SEQ ID NO: 3953731 - RNA, 16 nt, Human herpesvirus 1
gcgcggaugacggccc

SEQ ID NO: 3953732 - RNA, 16 nt, Human herpesvirus 1
gcgcggaugcucggcg

SEQ ID NO: 3953733 - RNA, 20 nt, Human herpesvirus 1
gcgcggccacgucguccggg

SEQ ID NO: 3953734 - RNA, 14 nt, Human herpesvirus 1
gcgcggccgugggc

SEQ ID NO: 3953735 - RNA, 13 nt, Human herpesvirus 1
gcgcggcguccgc

SEQ ID NO: 3953736 - RNA, 21 nt, Human herpesvirus 1
gcgcgucgacgucgcgccugg

SEQ ID NO: 3953737 - RNA, 15 nt, Human herpesvirus 1
gcgcguuugcacaac

SEQ ID NO: 3953738 - RNA, 22 nt, Human herpesvirus 1
gcgcucaaccaccgcucccccc

SEQ ID NO: 3953739 - RNA, 14 nt, Human herpesvirus 1
gcgcuuccccgcgg

SEQ ID NO: 3953740 - RNA, 23 nt, Human herpesvirus 1
gcgcuucuacccguguuugccca

SEQ ID NO: 3953741 - RNA, 13 nt, Human herpesvirus 1
gcgcuuugcggag

SEQ ID NO: 3953742 - RNA, 16 nt, Human herpesvirus 1
gcggacaacgugaucg

SEQ ID NO: 3953743 - RNA, 12 nt, Human herpesvirus 1
gcggacccccgg

SEQ ID NO: 3953744 - RNA, 22 nt, Human herpesvirus 1
gcggagguccggccugggccgc

SEQ ID NO: 3953745 - RNA, 14 nt, Human herpesvirus 1
gcggaugacggccc

SEQ ID NO: 3953746 - RNA, 15 nt, Human herpesvirus 1
gcggauuuggggcgc

SEQ ID NO: 3953747 - RNA, 17 nt, Human herpesvirus 1
gcggcauaacuccgacc

SEQ ID NO: 3953748 - RNA, 21 nt, Human herpesvirus 1
gcggccacgcaaaaccaggcc

SEQ ID NO: 3953749 - RNA, 12 nt, Human herpesvirus 1
gcggccauggcc

SEQ ID NO: 3953750 - RNA, 17 nt, Human herpesvirus 1
gcggccgcccaacucuc

SEQ ID NO: 3953751 - RNA, 20 nt, Human herpesvirus 1
gcggcgaacgggggcccugc

SEQ ID NO: 3953752 - RNA, 11 nt, Human herpesvirus 1
gcggcggggca

SEQ ID NO: 3953753 - RNA, 16 nt, Human herpesvirus 1
gcggcggucagcgacg

SEQ ID NO: 3953754 - RNA, 16 nt, Human herpesvirus 1
gcggcucaacgagcuc

SEQ ID NO: 3953755 - RNA, 13 nt, Human herpesvirus 1
gcggcucguggcg

SEQ ID NO: 3953756 - RNA, 22 nt, Human herpesvirus 1
gcggcuuaugaacgacugggcc

SEQ ID NO: 3953757 - RNA, 16 nt, Human herpesvirus 1
gcgggacaucaaggcg

SEQ ID NO: 3953758 - RNA, 15 nt, Human herpesvirus 1
gcgggagacgggcgg

SEQ ID NO: 3953759 - RNA, 20 nt, Human herpesvirus 1
gcgggaguuucuccgcgguc

SEQ ID NO: 3953760 - RNA, 17 nt, Human herpesvirus 1
gcgggccccggggagac

SEQ ID NO: 3953761 - RNA, 14 nt, Human herpesvirus 1
gcgggccucguggg

SEQ ID NO: 3953762 - RNA, 20 nt, Human herpesvirus 1
gcgggcucgucuuggccacc

SEQ ID NO: 3953763 - RNA, 17 nt, Human herpesvirus 1
gcggggaggggggcaag

SEQ ID NO: 3953764 - RNA, 12 nt, Human herpesvirus 1
gcggggcagagc

SEQ ID NO: 3953765 - RNA, 20 nt, Human herpesvirus 1
gcggggccuuggcggccgcc

SEQ ID NO: 3953766 - RNA, 12 nt, Human herpesvirus 1
gcgggggauggg

SEQ ID NO: 3953767 - RNA, 13 nt, Human herpesvirus 1
gcgggggaugggg

SEQ ID NO: 3953768 - RNA, 17 nt, Human herpesvirus 1
gcgggguuauaggccac

SEQ ID NO: 3953769 - RNA, 19 nt, Human herpesvirus 1
gcgggguugggaugggacc

SEQ ID NO: 3953770 - RNA, 15 nt, Human herpesvirus 1
gcgggugucugcucc

SEQ ID NO: 3953771 - RNA, 20 nt, Human herpesvirus 1
gcgguacagaucggcgccgc

SEQ ID NO: 3953772 - RNA, 15 nt, Human herpesvirus 1
gcggucggcaaggug

SEQ ID NO: 3953773 - RNA, 22 nt, Human herpesvirus 1
gcguacaacggcucggccuaug

SEQ ID NO: 3953774 - RNA, 18 nt, Human herpesvirus 1
gcguagcaaacgccccgc

SEQ ID NO: 3953775 - RNA, 16 nt, Human herpesvirus 1
gcguagcauaccuggg

SEQ ID NO: 3953776 - RNA, 19 nt, Human herpesvirus 1
gcguaucugguccccgcga

SEQ ID NO: 3953777 - RNA, 15 nt, Human herpesvirus 1
gcguccaaacccacc

SEQ ID NO: 3953778 - RNA, 18 nt, Human herpesvirus 1
gcguccaucauagcccug

SEQ ID NO: 3953779 - RNA, 16 nt, Human herpesvirus 1
gcguccccggcccgga

SEQ ID NO: 3953780 - RNA, 20 nt, Human herpesvirus 1
gcguccuggaugcuguggac

SEQ ID NO: 3953781 - RNA, 17 nt, Human herpesvirus 1
gcgucgacgucgcgccu

SEQ ID NO: 3953782 - RNA, 20 nt, Human herpesvirus 1
gcgugcccacgucgccccgc

SEQ ID NO: 3953783 - RNA, 18 nt, Human herpesvirus 1
gcguucaucggacccccc

SEQ ID NO: 3953784 - RNA, 21 nt, Human herpesvirus 1
gcguuucugucggaccaccgc

SEQ ID NO: 3953785 - RNA, 17 nt, Human herpesvirus 1
gcuaagugcccaggacg

SEQ ID NO: 3953786 - RNA, 17 nt, Human herpesvirus 1
gcuagccgaggcccggg

SEQ ID NO: 3953787 - RNA, 19 nt, Human herpesvirus 1
gcuauccccaucacgguca

SEQ ID NO: 3953788 - RNA, 18 nt, Human herpesvirus 1
gcucaaaucgcauccgag

SEQ ID NO: 3953789 - RNA, 18 nt, Human herpesvirus 1
gcucaaccaccgcucccc

SEQ ID NO: 3953790 - RNA, 17 nt, Human herpesvirus 1
gcucaagaaccccacca

SEQ ID NO: 3953791 - RNA, 18 nt, Human herpesvirus 1
gcucccagagaccccagg

SEQ ID NO: 3953792 - RNA, 17 nt, Human herpesvirus 1
gcucccgggagcuccgc

SEQ ID NO: 3953793 - RNA, 15 nt, Human herpesvirus 1
gcucccucgaccacc

SEQ ID NO: 3953794 - RNA, 14 nt, Human herpesvirus 1
gcucccugcggcug

SEQ ID NO: 3953795 - RNA, 19 nt, Human herpesvirus 1
gcuccgacgacgcgcagcc

SEQ ID NO: 3953796 - RNA, 22 nt, Human herpesvirus 1
gcuccgacgacgcgcagccggc

SEQ ID NO: 3953797 - RNA, 16 nt, Human herpesvirus 1
gcuccgccuggccugc

SEQ ID NO: 3953798 - RNA, 21 nt, Human herpesvirus 1
gcuccggggaucugguccgcc

SEQ ID NO: 3953799 - RNA, 15 nt, Human herpesvirus 1
gcuccugauguggcu

SEQ ID NO: 3953800 - RNA, 17 nt, Human herpesvirus 1
gcuccugcgacccgaaa

SEQ ID NO: 3953801 - RNA, 23 nt, Human herpesvirus 1
gcuccuggccaggaucaccaacc

SEQ ID NO: 3953802 - RNA, 16 nt, Human herpesvirus 1
gcuccuuagcgcggcc

SEQ ID NO: 3953803 - RNA, 23 nt, Human herpesvirus 1
gcucgaccucuccacaccugcac

SEQ ID NO: 3953804 - RNA, 20 nt, Human herpesvirus 1
gcucgcggagggcggccagc

SEQ ID NO: 3953805 - RNA, 15 nt, Human herpesvirus 1
gcucgcucucggugc

SEQ ID NO: 3953806 - RNA, 13 nt, Human herpesvirus 1
gcucgggcccgcg

SEQ ID NO: 3953807 - RNA, 23 nt, Human herpesvirus 1
gcucgucagggccggcggcgcuc

SEQ ID NO: 3953808 - RNA, 12 nt, Human herpesvirus 1
gcucgucgccug

SEQ ID NO: 3953809 - RNA, 18 nt, Human herpesvirus 1
gcucuccccugcugccau

SEQ ID NO: 3953810 - RNA, 23 nt, Human herpesvirus 1
gcugacccccaccgcgcuccucc

SEQ ID NO: 3953811 - RNA, 14 nt, Human herpesvirus 1
gcugaggacgucga

SEQ ID NO: 3953812 - RNA, 22 nt, Human herpesvirus 1
gcugaugucccucauuuuacaa

SEQ ID NO: 3953813 - RNA, 14 nt, Human herpesvirus 1
gcugccaaacagcu

SEQ ID NO: 3953814 - RNA, 15 nt, Human herpesvirus 1
gcugccagaccucaa

SEQ ID NO: 3953815 - RNA, 17 nt, Human herpesvirus 1
gcugcgcauccccccgu

SEQ ID NO: 3953816 - RNA, 13 nt, Human herpesvirus 1
gcugcucagcgcc

SEQ ID NO: 3953817 - RNA, 18 nt, Human herpesvirus 1
gcugcugcggccagucca

SEQ ID NO: 3953818 - RNA, 16 nt, Human herpesvirus 1
gcuggccgacguggcg

SEQ ID NO: 3953819 - RNA, 18 nt, Human herpesvirus 1
gcuggccgcucgguggcu

SEQ ID NO: 3953820 - RNA, 12 nt, Human herpesvirus 1
gcugucauuccu

SEQ ID NO: 3953821 - RNA, 16 nt, Human herpesvirus 1
gcuguccgagaccccc

SEQ ID NO: 3953822 - RNA, 12 nt, Human herpesvirus 1
gcuugcggggcu

SEQ ID NO: 3953823 - RNA, 12 nt, Human herpesvirus 1
gcuuggagccag

SEQ ID NO: 3953824 - RNA, 22 nt, Human herpesvirus 1
gcuuuaucccacggccucgcca

SEQ ID NO: 3953825 - RNA, 11 nt, Human herpesvirus 1
ggaacccgcgc

SEQ ID NO: 3953826 - RNA, 16 nt, Human herpesvirus 1
ggaacuacuaugacag

SEQ ID NO: 3953827 - RNA, 14 nt, Human herpesvirus 1
ggacaccccccaug

SEQ ID NO: 3953828 - RNA, 17 nt, Human herpesvirus 1
ggacagcaaccagaagc

SEQ ID NO: 3953829 - RNA, 15 nt, Human herpesvirus 1
ggaccaccgcccccc

SEQ ID NO: 3953830 - RNA, 12 nt, Human herpesvirus 1
ggaccacgugca

SEQ ID NO: 3953831 - RNA, 19 nt, Human herpesvirus 1
ggaccacgugcacagccug

SEQ ID NO: 3953832 - RNA, 20 nt, Human herpesvirus 1
ggaccacgugcacagccugg

SEQ ID NO: 3953833 - RNA, 14 nt, Human herpesvirus 1
ggaccagguccccc

SEQ ID NO: 3953834 - RNA, 21 nt, Human herpesvirus 1
ggaccaggucccccacaccac

SEQ ID NO: 3953835 - RNA, 19 nt, Human herpesvirus 1
ggaccccggggcucagcca

SEQ ID NO: 3953836 - RNA, 14 nt, Human herpesvirus 1
ggaccgcagccugg

SEQ ID NO: 3953837 - RNA, 16 nt, Human herpesvirus 1
ggaccggggucccagc

SEQ ID NO: 3953838 - RNA, 12 nt, Human herpesvirus 1
ggaccuccugga

SEQ ID NO: 3953839 - RNA, 17 nt, Human herpesvirus 1
ggacgccauacacagcc

SEQ ID NO: 3953840 - RNA, 20 nt, Human herpesvirus 1
ggacgccauacacagccacc

SEQ ID NO: 3953841 - RNA, 22 nt, Human herpesvirus 1
ggacgccgaccgacuccccgcc

SEQ ID NO: 3953842 - RNA, 17 nt, Human herpesvirus 1
ggacgggcucgccagcg

SEQ ID NO: 3953843 - RNA, 15 nt, Human herpesvirus 1
ggacuuugagcuugc

SEQ ID NO: 3953844 - RNA, 16 nt, Human herpesvirus 1
ggagacauggcccccg

SEQ ID NO: 3953845 - RNA, 18 nt, Human herpesvirus 1
ggagagcccacaugcgga

SEQ ID NO: 3953846 - RNA, 23 nt, Human herpesvirus 1
ggagagcccacaugcggaaagca

SEQ ID NO: 3953847 - RNA, 13 nt, Human herpesvirus 1
ggagcaccacaua

SEQ ID NO: 3953848 - RNA, 21 nt, Human herpesvirus 1
ggagccccggaccccacgcac

SEQ ID NO: 3953849 - RNA, 23 nt, Human herpesvirus 1
ggagccccggucuccccgggagc

SEQ ID NO: 3953850 - RNA, 14 nt, Human herpesvirus 1
ggagccgagcucaa

SEQ ID NO: 3953851 - RNA, 20 nt, Human herpesvirus 1
ggagcucaagaaccccacca

SEQ ID NO: 3953852 - RNA, 14 nt, Human herpesvirus 1
ggagcucccgggag

SEQ ID NO: 3953853 - RNA, 21 nt, Human herpesvirus 1
ggagcuguccgagacccccaa

SEQ ID NO: 3953854 - RNA, 16 nt, Human herpesvirus 1
ggaggagccccugccc

SEQ ID NO: 3953855 - RNA, 13 nt, Human herpesvirus 1
ggagguccagcgc

SEQ ID NO: 3953856 - RNA, 20 nt, Human herpesvirus 1
ggagguccagcgccgcaacc

SEQ ID NO: 3953857 - RNA, 20 nt, Human herpesvirus 1
ggauccgacccccauggagc

SEQ ID NO: 3953858 - RNA, 20 nt, Human herpesvirus 1
ggaucuuugaggaccgcgcc

SEQ ID NO: 3953859 - RNA, 13 nt, Human herpesvirus 1
ggaugcugccccg

SEQ ID NO: 3953860 - RNA, 16 nt, Human herpesvirus 1
ggaugcugccccgcuu

SEQ ID NO: 3953861 - RNA, 18 nt, Human herpesvirus 1
ggcacaccgguccccgga

SEQ ID NO: 3953862 - RNA, 17 nt, Human herpesvirus 1
ggcaccuccccagcggc

SEQ ID NO: 3953863 - RNA, 20 nt, Human herpesvirus 1
ggcacgcccccuacgaggac

SEQ ID NO: 3953864 - RNA, 17 nt, Human herpesvirus 1
ggcagcgcuccgacgac

SEQ ID NO: 3953865 - RNA, 21 nt, Human herpesvirus 1
ggcagucuccuggcagcccug

SEQ ID NO: 3953866 - RNA, 13 nt, Human herpesvirus 1
ggcaucggaacac

SEQ ID NO: 3953867 - RNA, 17 nt, Human herpesvirus 1
ggcauggcgcagcuggg

SEQ ID NO: 3953868 - RNA, 18 nt, Human herpesvirus 1
ggcauggggggggggcgg

SEQ ID NO: 3953869 - RNA, 20 nt, Human herpesvirus 1
ggccaaccagcguccgccga

SEQ ID NO: 3953870 - RNA, 20 nt, Human herpesvirus 1
ggccaacgacuuccucguac

SEQ ID NO: 3953871 - RNA, 23 nt, Human herpesvirus 1
ggccaauaucgcuagagacagcc

SEQ ID NO: 3953872 - RNA, 17 nt, Human herpesvirus 1
ggccacacagccggcca

SEQ ID NO: 3953873 - RNA, 23 nt, Human herpesvirus 1
ggccagccgcaguacuaccuggc

SEQ ID NO: 3953874 - RNA, 18 nt, Human herpesvirus 1
ggccaggggcauccggga

SEQ ID NO: 3953875 - RNA, 23 nt, Human herpesvirus 1
ggccauuaacuuuaucaccacca

SEQ ID NO: 3953876 - RNA, 12 nt, Human herpesvirus 1
ggcccaacagcc

SEQ ID NO: 3953877 - RNA, 20 nt, Human herpesvirus 1
ggcccacgaucaccgcggga

SEQ ID NO: 3953878 - RNA, 12 nt, Human herpesvirus 1
ggccccccgccg

SEQ ID NO: 3953879 - RNA, 23 nt, Human herpesvirus 1
ggccccggggagacagcgccugc

SEQ ID NO: 3953880 - RNA, 20 nt, Human herpesvirus 1
ggcccgccaucugggauggc

SEQ ID NO: 3953881 - RNA, 22 nt, Human herpesvirus 1
ggcccgggggacucacuaccca

SEQ ID NO: 3953882 - RNA, 19 nt, Human herpesvirus 1
ggcccgggggccugguggc

SEQ ID NO: 3953883 - RNA, 14 nt, Human herpesvirus 1
ggcccugcuccggc

SEQ ID NO: 3953884 - RNA, 22 nt, Human herpesvirus 1
ggcccuuccuaacccagacccc

SEQ ID NO: 3953885 - RNA, 22 nt, Human herpesvirus 1
ggccgaggcgauuagccagcag

SEQ ID NO: 3953886 - RNA, 16 nt, Human herpesvirus 1
ggccgcaggacccagc

SEQ ID NO: 3953887 - RNA, 21 nt, Human herpesvirus 1
ggccgcccaacucucgcacca

SEQ ID NO: 3953888 - RNA, 22 nt, Human herpesvirus 1
ggccgccccgaagagggggacc

SEQ ID NO: 3953889 - RNA, 18 nt, Human herpesvirus 1
ggccgcccuggccgcgga

SEQ ID NO: 3953890 - RNA, 20 nt, Human herpesvirus 1
ggccgcgacccaggcggcga

SEQ ID NO: 3953891 - RNA, 18 nt, Human herpesvirus 1
ggccgcgguggacagcca

SEQ ID NO: 3953892 - RNA, 14 nt, Human herpesvirus 1
ggccgcucgguggc

SEQ ID NO: 3953893 - RNA, 20 nt, Human herpesvirus 1
ggccggcggcgcuccucgcc

SEQ ID NO: 3953894 - RNA, 12 nt, Human herpesvirus 1
ggccgucgggca

SEQ ID NO: 3953895 - RNA, 15 nt, Human herpesvirus 1
ggccguggcggccaa

SEQ ID NO: 3953896 - RNA, 22 nt, Human herpesvirus 1
ggccgugggucuguugguccug

SEQ ID NO: 3953897 - RNA, 14 nt, Human herpesvirus 1
ggccucgugggcac

SEQ ID NO: 3953898 - RNA, 21 nt, Human herpesvirus 1
ggccuggacguccccgaggac

SEQ ID NO: 3953899 - RNA, 19 nt, Human herpesvirus 1
ggccugggucuuccgcgga

SEQ ID NO: 3953900 - RNA, 17 nt, Human herpesvirus 1
ggcgacgcacacacccu

SEQ ID NO: 3953901 - RNA, 19 nt, Human herpesvirus 1
ggcgccacaccacgccaca

SEQ ID NO: 3953902 - RNA, 10 nt, Human herpesvirus 1
ggcgcccccc

SEQ ID NO: 3953903 - RNA, 15 nt, Human herpesvirus 1
ggcgccgaccacccg

SEQ ID NO: 3953904 - RNA, 11 nt, Human herpesvirus 1
ggcgccgcgag

SEQ ID NO: 3953905 - RNA, 20 nt, Human herpesvirus 1
ggcgccgcgagauggccgcc

SEQ ID NO: 3953906 - RNA, 19 nt, Human herpesvirus 1
ggcgccggucgucacgcac

SEQ ID NO: 3953907 - RNA, 18 nt, Human herpesvirus 1
ggcgccucggucacccca

SEQ ID NO: 3953908 - RNA, 22 nt, Human herpesvirus 1
ggcgcgacaacgagcccccgcc

SEQ ID NO: 3953909 - RNA, 23 nt, Human herpesvirus 1
ggcgcgcgaaaucguggcgcggc

SEQ ID NO: 3953910 - RNA, 19 nt, Human herpesvirus 1
ggcgcucagggcggcgguc

SEQ ID NO: 3953911 - RNA, 22 nt, Human herpesvirus 1
ggcgcugacggaccuuggucug

SEQ ID NO: 3953912 - RNA, 14 nt, Human herpesvirus 1
ggcgcuuggccggg

SEQ ID NO: 3953913 - RNA, 17 nt, Human herpesvirus 1
ggcggacccaagccgcc

SEQ ID NO: 3953914 - RNA, 23 nt, Human herpesvirus 1
ggcggagaaacggccgaagccac

SEQ ID NO: 3953915 - RNA, 15 nt, Human herpesvirus 1
ggcggcaggcgccag

SEQ ID NO: 3953916 - RNA, 16 nt, Human herpesvirus 1
ggcggcaggcgccagc

SEQ ID NO: 3953917 - RNA, 20 nt, Human herpesvirus 1
ggcggccaaguacgccgcca

SEQ ID NO: 3953918 - RNA, 16 nt, Human herpesvirus 1
ggcggccccggcagcc

SEQ ID NO: 3953919 - RNA, 16 nt, Human herpesvirus 1
ggcggcgacgugcccc

SEQ ID NO: 3953920 - RNA, 15 nt, Human herpesvirus 1
ggcggcgaggccggc

SEQ ID NO: 3953921 - RNA, 20 nt, Human herpesvirus 1
ggcggcgaggccggcgccga

SEQ ID NO: 3953922 - RNA, 16 nt, Human herpesvirus 1
ggcggcggucagcgac

SEQ ID NO: 3953923 - RNA, 22 nt, Human herpesvirus 1
ggcggcgugugggggugcccca

SEQ ID NO: 3953924 - RNA, 10 nt, Human herpesvirus 1
ggcgggccgu

SEQ ID NO: 3953925 - RNA, 20 nt, Human herpesvirus 1
ggcggucagcgacguccugg

SEQ ID NO: 3953926 - RNA, 15 nt, Human herpesvirus 1
ggcggugcuccgccg

SEQ ID NO: 3953927 - RNA, 16 nt, Human herpesvirus 1
ggcguaacguuccgcc

SEQ ID NO: 3953928 - RNA, 19 nt, Human herpesvirus 1
ggcguacaacggcucggcc

SEQ ID NO: 3953929 - RNA, 23 nt, Human herpesvirus 1
ggcgucgcugugaugaagcagcg

SEQ ID NO: 3953930 - RNA, 14 nt, Human herpesvirus 1
ggcgucgggcaugg

SEQ ID NO: 3953931 - RNA, 17 nt, Human herpesvirus 1
ggcuccagucccggccc

SEQ ID NO: 3953932 - RNA, 22 nt, Human herpesvirus 1
ggcuccaugcagugcauggcgc

SEQ ID NO: 3953933 - RNA, 20 nt, Human herpesvirus 1
ggcuccccgccgcggccugg

SEQ ID NO: 3953934 - RNA, 15 nt, Human herpesvirus 1
ggcuccgggccaacc

SEQ ID NO: 3953935 - RNA, 23 nt, Human herpesvirus 1
ggcuccuguaaguacgcccuccc

SEQ ID NO: 3953936 - RNA, 14 nt, Human herpesvirus 1
ggcucgccagcgac

SEQ ID NO: 3953937 - RNA, 14 nt, Human herpesvirus 1
ggcucggcuccccg

SEQ ID NO: 3953938 - RNA, 17 nt, Human herpesvirus 1
ggcucguggcgucucgc

SEQ ID NO: 3953939 - RNA, 21 nt, Human herpesvirus 1
ggcucguggcgucucgccgga

SEQ ID NO: 3953940 - RNA, 18 nt, Human herpesvirus 1
ggcuugguucggggccgc

SEQ ID NO: 3953941 - RNA, 20 nt, Human herpesvirus 1
gggacacuuguccggagaac

SEQ ID NO: 3953942 - RNA, 12 nt, Human herpesvirus 1
gggaccuccugg

SEQ ID NO: 3953943 - RNA, 16 nt, Human herpesvirus 1
gggaugcuagccugug

SEQ ID NO: 3953944 - RNA, 17 nt, Human herpesvirus 1
gggauggggagagccca

SEQ ID NO: 3953945 - RNA, 18 nt, Human herpesvirus 1
gggauugguuagacccau

SEQ ID NO: 3953946 - RNA, 20 nt, Human herpesvirus 1
gggcaaguaugccccccugg

SEQ ID NO: 3953947 - RNA, 20 nt, Human herpesvirus 1
gggcacccaaggggccgugc

SEQ ID NO: 3953948 - RNA, 20 nt, Human herpesvirus 1
gggccaaccaagagacgucg

SEQ ID NO: 3953949 - RNA, 16 nt, Human herpesvirus 1
gggccgccacgcgcgg

SEQ ID NO: 3953950 - RNA, 12 nt, Human herpesvirus 1
gggccgcgcgga

SEQ ID NO: 3953951 - RNA, 20 nt, Human herpesvirus 1
gggccucccggaagagccug

SEQ ID NO: 3953952 - RNA, 18 nt, Human herpesvirus 1
gggccucugggucugugc

SEQ ID NO: 3953953 - RNA, 19 nt, Human herpesvirus 1
gggccugccugcggcucgu

SEQ ID NO: 3953954 - RNA, 23 nt, Human herpesvirus 1
gggccuggugcucgugggccucu

SEQ ID NO: 3953955 - RNA, 15 nt, Human herpesvirus 1
gggcgcugggugguc

SEQ ID NO: 3953956 - RNA, 13 nt, Human herpesvirus 1
gggcgguucgccg

SEQ ID NO: 3953957 - RNA, 15 nt, Human herpesvirus 1
aaacccccaaacacc

SEQ ID NO: 3953958 - RNA, 21 nt, Human herpesvirus 1
aaacuguccugucuuggggcc

SEQ ID NO: 3953959 - RNA, 20 nt, Human herpesvirus 1
aaagcaagaacaauaaaggc

SEQ ID NO: 3953960 - RNA, 14 nt, Human herpesvirus 1
aaagccacugaaac

SEQ ID NO: 3953961 - RNA, 19 nt, Human herpesvirus 1
aaagggauacacaaacuuc

SEQ ID NO: 3953962 - RNA, 17 nt, Human herpesvirus 1
aaaguuguuagcccugc

SEQ ID NO: 3953963 - RNA, 11 nt, Human herpesvirus 1
aaauaaagcca

SEQ ID NO: 3953964 - RNA, 22 nt, Human herpesvirus 1
aaauacagcauggcgccacacc

SEQ ID NO: 3953965 - RNA, 18 nt, Human herpesvirus 1
aaauuuuacaaacagauu

SEQ ID NO: 3953966 - RNA, 14 nt, Human herpesvirus 1
aacacaaacaucug

SEQ ID NO: 3953967 - RNA, 15 nt, Human herpesvirus 1
aacagcccccggguu

SEQ ID NO: 3953968 - RNA, 17 nt, Human herpesvirus 1
aaccccaacuccagacc

SEQ ID NO: 3953969 - RNA, 16 nt, Human herpesvirus 1
aaccccaccccugugc

SEQ ID NO: 3953970 - RNA, 19 nt, Human herpesvirus 1
aacccccuaagacccaccc

SEQ ID NO: 3953971 - RNA, 20 nt, Human herpesvirus 1
aacccccuccgcgccaggcc

SEQ ID NO: 3953972 - RNA, 13 nt, Human herpesvirus 1
aaccgguauuauu

SEQ ID NO: 3953973 - RNA, 17 nt, Human herpesvirus 1
aaccucgggugcauauc

SEQ ID NO: 3953974 - RNA, 20 nt, Human herpesvirus 1
aaccuucgcaacaccucccc

SEQ ID NO: 3953975 - RNA, 17 nt, Human herpesvirus 1
aacgagccgacggcccg

SEQ ID NO: 3953976 - RNA, 16 nt, Human herpesvirus 1
aacgcagccccgcugg

SEQ ID NO: 3953977 - RNA, 22 nt, Human herpesvirus 1
aacucucgcaccaucccggguu

SEQ ID NO: 3953978 - RNA, 18 nt, Human herpesvirus 1
aacugccugacccucucc

SEQ ID NO: 3953979 - RNA, 17 nt, Human herpesvirus 1
aacugucuggagacccu

SEQ ID NO: 3953980 - RNA, 16 nt, Human herpesvirus 1
aacuucaucacccccg

SEQ ID NO: 3953981 - RNA, 15 nt, Human herpesvirus 1
aagaccaaaaucaaa

SEQ ID NO: 3953982 - RNA, 20 nt, Human herpesvirus 1
aagacccgggcgaugagcca

SEQ ID NO: 3953983 - RNA, 13 nt, Human herpesvirus 1
aagcaagaacaau

SEQ ID NO: 3953984 - RNA, 17 nt, Human herpesvirus 1
aagcaagaacaauaaag

SEQ ID NO: 3953985 - RNA, 13 nt, Human herpesvirus 1
aagcgcugcugcg

SEQ ID NO: 3953986 - RNA, 13 nt, Human herpesvirus 1
aagcugauguccc

SEQ ID NO: 3953987 - RNA, 23 nt, Human herpesvirus 1
aagcugaugucccucauuuuaca

SEQ ID NO: 3953988 - RNA, 21 nt, Human herpesvirus 1
aaggcgcugcgguugcccccg

SEQ ID NO: 3953989 - RNA, 18 nt, Human herpesvirus 1
aagucucugggggccugu

SEQ ID NO: 3953990 - RNA, 13 nt, Human herpesvirus 1
aagugaaagacac

SEQ ID NO: 3953991 - RNA, 18 nt, Human herpesvirus 1
cgggcgacgcacacaccc

SEQ ID NO: 3953992 - RNA, 13 nt, Human herpesvirus 1
cgggcgaugagcc

SEQ ID NO: 3953993 - RNA, 14 nt, Human herpesvirus 1
cgggcgaugagcca

SEQ ID NO: 3953994 - RNA, 19 nt, Human herpesvirus 1
cgggcgccuucccccggcc

SEQ ID NO: 3953995 - RNA, 14 nt, Human herpesvirus 1
cgggcgcgcccucu

SEQ ID NO: 3953996 - RNA, 17 nt, Human herpesvirus 1
cgggcgcguccccggcc

SEQ ID NO: 3953997 - RNA, 13 nt, Human herpesvirus 1
cgggcggagaaac

SEQ ID NO: 3953998 - RNA, 13 nt, Human herpesvirus 1
cgggcggcccugc

SEQ ID NO: 3953999 - RNA, 18 nt, Human herpesvirus 1
cgggcgucaccaugcagc

SEQ ID NO: 3954000 - RNA, 15 nt, Human herpesvirus 1
cgggcuacacggccg

SEQ ID NO: 3954001 - RNA, 15 nt, Human herpesvirus 1
cgggcuacugguggg

SEQ ID NO: 3954002 - RNA, 19 nt, Human herpesvirus 1
cggggaccuugccccggcc

SEQ ID NO: 3954003 - RNA, 18 nt, Human herpesvirus 1
cggggccguggcggccaa

SEQ ID NO: 3954004 - RNA, 17 nt, Human herpesvirus 1
guaggcuggucagcacg

SEQ ID NO: 3954005 - RNA, 12 nt, Human herpesvirus 1
guaucaaacuca

SEQ ID NO: 3954006 - RNA, 14 nt, Human herpesvirus 1
guauggggggggcu

SEQ ID NO: 3954007 - RNA, 11 nt, Human herpesvirus 1
guaugucccca

SEQ ID NO: 3954008 - RNA, 21 nt, Human herpesvirus 1
guauguccccaaaauaaaaga

SEQ ID NO: 3954009 - RNA, 23 nt, Human herpesvirus 1
gucaccgguucguauccacaaua

SEQ ID NO: 3954010 - RNA, 18 nt, Human herpesvirus 1
gucaucacccgggugcuu

SEQ ID NO: 3954011 - RNA, 12 nt, Human herpesvirus 1
guccaccaaagu

SEQ ID NO: 3954012 - RNA, 20 nt, Human herpesvirus 1
guccacggccacuggccggg

SEQ ID NO: 3954013 - RNA, 21 nt, Human herpesvirus 1
guccacgguaggcccagcaug

SEQ ID NO: 3954014 - RNA, 13 nt, Human herpesvirus 1
guccagaccacgg

SEQ ID NO: 3954015 - RNA, 20 nt, Human herpesvirus 1
guccaucaccacgcccagua

SEQ ID NO: 3954016 - RNA, 23 nt, Human herpesvirus 1
guccccccucuaucccgcccacc

SEQ ID NO: 3954017 - RNA, 19 nt, Human herpesvirus 1
guccccgggucuguugggg

SEQ ID NO: 3954018 - RNA, 23 nt, Human herpesvirus 1
guccccucugggcccgccuggau

SEQ ID NO: 3954019 - RNA, 18 nt, Human herpesvirus 1
gucccgaagaccgccggu

SEQ ID NO: 3954020 - RNA, 19 nt, Human herpesvirus 1
guccgccaaauaaagccac

SEQ ID NO: 3954021 - RNA, 19 nt, Human herpesvirus 1
guccgcugugccaucgcgc

SEQ ID NO: 3954022 - RNA, 14 nt, Human herpesvirus 1
guccguggagcgca

SEQ ID NO: 3954023 - RNA, 13 nt, Human herpesvirus 1
guccguguggagg

SEQ ID NO: 3954024 - RNA, 18 nt, Human herpesvirus 1
guccucaucaccgacgac

SEQ ID NO: 3954025 - RNA, 15 nt, Human herpesvirus 1
guccuguggagccug

SEQ ID NO: 3954026 - RNA, 13 nt, Human herpesvirus 1
guccuucuugucg

SEQ ID NO: 3954027 - RNA, 21 nt, Human herpesvirus 1
guccuuugggcgggaggaagc

SEQ ID NO: 3954028 - RNA, 19 nt, Human herpesvirus 1
gucgaccgcgcccucgcca

SEQ ID NO: 3954029 - RNA, 19 nt, Human herpesvirus 1
gucgacgaccuggggacgg

SEQ ID NO: 3954030 - RNA, 16 nt, Human herpesvirus 1
gucgacgucgcgccug

SEQ ID NO: 3954031 - RNA, 19 nt, Human herpesvirus 1
gucgcccgauuuacagccc

SEQ ID NO: 3954032 - RNA, 14 nt, Human herpesvirus 1
gucgcccuccacca

SEQ ID NO: 3954033 - RNA, 19 nt, Human herpesvirus 1
gucgccgcgggccacgcca

SEQ ID NO: 3954034 - RNA, 15 nt, Human herpesvirus 1
gucgcgccugggugc

SEQ ID NO: 3954035 - RNA, 19 nt, Human herpesvirus 1
gucggcaagauccucgggc

SEQ ID NO: 3954036 - RNA, 16 nt, Human herpesvirus 1
gucggcggcuguagcg

SEQ ID NO: 3954037 - RNA, 15 nt, Human herpesvirus 1
gucgucgggcgccaa

SEQ ID NO: 3954038 - RNA, 12 nt, Human herpesvirus 1
gucgucucucuu

SEQ ID NO: 3954039 - RNA, 17 nt, Human herpesvirus 1
gucuccccgauggcccu

SEQ ID NO: 3954040 - RNA, 20 nt, Human herpesvirus 1
gucuccccgggagccccgga

SEQ ID NO: 3954041 - RNA, 15 nt, Human herpesvirus 1
gucuccccggggccc

SEQ ID NO: 3954042 - RNA, 17 nt, Human herpesvirus 1
gucugcuccccaccccg

SEQ ID NO: 3954043 - RNA, 21 nt, Human herpesvirus 1
gucuggagacccuaugguaca

SEQ ID NO: 3954044 - RNA, 13 nt, Human herpesvirus 1
gucuggccccggc

SEQ ID NO: 3954045 - RNA, 15 nt, Human herpesvirus 1
gucugggcccgacag

SEQ ID NO: 3954046 - RNA, 21 nt, Human herpesvirus 1
gucuggguuuuccccucccgu

SEQ ID NO: 3954047 - RNA, 18 nt, Human herpesvirus 1
gucugugccaccagccug

SEQ ID NO: 3954048 - RNA, 18 nt, Human herpesvirus 1
gucuucgcgaacccccgu

SEQ ID NO: 3954049 - RNA, 14 nt, Human herpesvirus 1
gucuucggccccgc

SEQ ID NO: 3954050 - RNA, 16 nt, Human herpesvirus 1
gugaaagacacgggca

SEQ ID NO: 3954051 - RNA, 15 nt, Human herpesvirus 1
gugacucaggacauc

SEQ ID NO: 3954052 - RNA, 16 nt, Human herpesvirus 1
gugaucagcacgccac

SEQ ID NO: 3954053 - RNA, 12 nt, Human herpesvirus 1
gugauuccucuc

SEQ ID NO: 3954054 - RNA, 20 nt, Human herpesvirus 1
gugccgcccguugcagggcc

SEQ ID NO: 3954055 - RNA, 15 nt, Human herpesvirus 1
gugcgccaggucggc

SEQ ID NO: 3954056 - RNA, 15 nt, Human herpesvirus 1
gugcucgacagccac

SEQ ID NO: 3954057 - RNA, 16 nt, Human herpesvirus 1
guggacgagaugcugc

SEQ ID NO: 3954058 - RNA, 20 nt, Human herpesvirus 1
guggagcugcccggcggcca

SEQ ID NO: 3954059 - RNA, 18 nt, Human herpesvirus 1
guggcacuaccccauggg

SEQ ID NO: 3954060 - RNA, 17 nt, Human herpesvirus 1
guggccgggcguugggg

SEQ ID NO: 3954061 - RNA, 22 nt, Human herpesvirus 1
guggcgucucgccggacgacgu

SEQ ID NO: 3954062 - RNA, 20 nt, Human herpesvirus 1
guggcuccggggggcuuccg

SEQ ID NO: 3954063 - RNA, 22 nt, Human herpesvirus 1
gugggcgacugcgaccccagcc

SEQ ID NO: 3954064 - RNA, 15 nt, Human herpesvirus 1
gugggggugccccaa

SEQ ID NO: 3954065 - RNA, 16 nt, Human herpesvirus 1
gugggugcuuuggaaa

SEQ ID NO: 3954066 - RNA, 17 nt, Human herpesvirus 1
gugguccuguggagccu

SEQ ID NO: 3954067 - RNA, 14 nt, Human herpesvirus 1
guggugcgagcugc

SEQ ID NO: 3954068 - RNA, 16 nt, Human herpesvirus 1
gugucagguggcccuu

SEQ ID NO: 3954069 - RNA, 13 nt, Human herpesvirus 1
guguucgagggcc

SEQ ID NO: 3954070 - RNA, 11 nt, Human herpesvirus 1
guucaaggcca

SEQ ID NO: 3954071 - RNA, 22 nt, Human herpesvirus 1
gacagcccccccaagcgccccc

SEQ ID NO: 3954072 - RNA, 16 nt, Human herpesvirus 1
gacaucagcuguggac

SEQ ID NO: 3954073 - RNA, 14 nt, Human herpesvirus 1
gacauccaccaccc

SEQ ID NO: 3954074 - RNA, 17 nt, Human herpesvirus 1
gacauggucaugcgcaa

SEQ ID NO: 3954075 - RNA, 21 nt, Human herpesvirus 1
gacauuccgcuaucuccuggg

SEQ ID NO: 3954076 - RNA, 17 nt, Human herpesvirus 1
gaccaccaccuccaccc

SEQ ID NO: 3954077 - RNA, 15 nt, Human herpesvirus 1
gaccaccauccccgc

SEQ ID NO: 3954078 - RNA, 14 nt, Human herpesvirus 1
gaccaccccaaaua

SEQ ID NO: 3954079 - RNA, 16 nt, Human herpesvirus 1
gaccacgagaccgaca

SEQ ID NO: 3954080 - RNA, 20 nt, Human herpesvirus 1
gaccacgcccuuccccacgg

SEQ ID NO: 3954081 - RNA, 16 nt, Human herpesvirus 1
gaccagccguccucgc

SEQ ID NO: 3954082 - RNA, 23 nt, Human herpesvirus 1
gaccagccguccucgcaccagcc

SEQ ID NO: 3954083 - RNA, 16 nt, Human herpesvirus 1
gaccagcgccgggugg

SEQ ID NO: 3954084 - RNA, 11 nt, Human herpesvirus 1
gaccaggcgcg

SEQ ID NO: 3954085 - RNA, 15 nt, Human herpesvirus 1
gaccaggucccccac

SEQ ID NO: 3954086 - RNA, 16 nt, Human herpesvirus 1
gacccaaagcccucag

SEQ ID NO: 3954087 - RNA, 13 nt, Human herpesvirus 1
gacccaccaauaa

SEQ ID NO: 3954088 - RNA, 14 nt, Human herpesvirus 1
gacccaccgggccc

SEQ ID NO: 3954089 - RNA, 17 nt, Human herpesvirus 1
gaccccacgacacccac

SEQ ID NO: 3954090 - RNA, 19 nt, Human herpesvirus 1
gacccccaacgccacgcag

SEQ ID NO: 3954091 - RNA, 19 nt, Human herpesvirus 1
gacccccuuguaugucccc

SEQ ID NO: 3954092 - RNA, 19 nt, Human herpesvirus 1
acgaguccauccugcggcu

SEQ ID NO: 3954093 - RNA, 19 nt, Human herpesvirus 1
acgcaagaccaggccuggu

SEQ ID NO: 3954094 - RNA, 16 nt, Human herpesvirus 1
acgcacacacccuagc

SEQ ID NO: 3954095 - RNA, 16 nt, Human herpesvirus 1
acgcacgccaaugccc

SEQ ID NO: 3954096 - RNA, 14 nt, Human herpesvirus 1
acgcacgccgcccc

SEQ ID NO: 3954097 - RNA, 14 nt, Human herpesvirus 1
acgcaugggccgcc

SEQ ID NO: 3954098 - RNA, 17 nt, Human herpesvirus 1
acgccaagggggucugu

SEQ ID NO: 3954099 - RNA, 19 nt, Human herpesvirus 1
acgcccgaccacacacccc

SEQ ID NO: 3954100 - RNA, 22 nt, Human herpesvirus 1
acgccgccaccguggccggccu

SEQ ID NO: 3954101 - RNA, 14 nt, Human herpesvirus 1
acgccggggccuug

SEQ ID NO: 3954102 - RNA, 16 nt, Human herpesvirus 1
acgccuaccggccccu

SEQ ID NO: 3954103 - RNA, 20 nt, Human herpesvirus 1
acgccuaccggccccugggc

SEQ ID NO: 3954104 - RNA, 23 nt, Human herpesvirus 1
acgccucagggccuccgacccca

SEQ ID NO: 3954105 - RNA, 12 nt, Human herpesvirus 1
cgcgauccggcc

SEQ ID NO: 3954106 - RNA, 22 nt, Human herpesvirus 1
cgcgcauccgucgggaggccac

SEQ ID NO: 3954107 - RNA, 19 nt, Human herpesvirus 1
cgcgccaagguggacuggu

SEQ ID NO: 3954108 - RNA, 14 nt, Human herpesvirus 1
cgcgccccucuggc

SEQ ID NO: 3954109 - RNA, 12 nt, Human herpesvirus 1
cgcgcccgggcg

SEQ ID NO: 3954110 - RNA, 13 nt, Human herpesvirus 1
cgcgcccucgcca

SEQ ID NO: 3954111 - RNA, 13 nt, Human herpesvirus 1
cgcgccgcgagua

SEQ ID NO: 3954112 - RNA, 14 nt, Human herpesvirus 1
cgcacgagccgggg

SEQ ID NO: 3954113 - RNA, 19 nt, Human herpesvirus 1
cgcacggaacacaaggcca

SEQ ID NO: 3954114 - RNA, 20 nt, Human herpesvirus 1
cgcacucgagcggcgugggc

SEQ ID NO: 3954115 - RNA, 22 nt, Human herpesvirus 1
cgcacuugcggcaagacccggg

SEQ ID NO: 3954116 - RNA, 20 nt, Human herpesvirus 1
cgcagacgaaaagccccggg

SEQ ID NO: 3954117 - RNA, 22 nt, Human herpesvirus 1
cgcagcaccuccuacgccgggg

SEQ ID NO: 3954118 - RNA, 17 nt, Human herpesvirus 1
cgcagccccgcuggaac

SEQ ID NO: 3954119 - RNA, 14 nt, Human herpesvirus 1
cgcagccuggucga

SEQ ID NO: 3954120 - RNA, 19 nt, Human herpesvirus 1
cgcaggcgcugucuccccg

SEQ ID NO: 3954121 - RNA, 16 nt, Human herpesvirus 1
cgcauaucccacccug

SEQ ID NO: 3954122 - RNA, 20 nt, Human herpesvirus 1
cgcauccccccgucagccug

SEQ ID NO: 3954123 - RNA, 17 nt, Human herpesvirus 1
cgcaucuuuccugugug

SEQ ID NO: 3954124 - RNA, 16 nt, Human herpesvirus 1
cgccaaagcugcuggc

SEQ ID NO: 3954125 - RNA, 18 nt, Human herpesvirus 1
cgccaacaauccccagga

SEQ ID NO: 3954126 - RNA, 20 nt, Human herpesvirus 1
cgccaagguggacugguugg

SEQ ID NO: 3954127 - RNA, 19 nt, Human herpesvirus 1
cgccacaccaucucccccg

SEQ ID NO: 3954128 - RNA, 13 nt, Human herpesvirus 1
cgccacacccgcg

SEQ ID NO: 3954129 - RNA, 19 nt, Human herpesvirus 1
cgccaccagcaucgcgcgc

SEQ ID NO: 3954130 - RNA, 23 nt, Human herpesvirus 1
cgccacgguggugcaguucgagc

SEQ ID NO: 3954131 - RNA, 15 nt, Human herpesvirus 1
cgccagccugcggcc

SEQ ID NO: 3954132 - RNA, 18 nt, Human herpesvirus 1
cgccagccugcggccgga

SEQ ID NO: 3954133 - RNA, 22 nt, Human herpesvirus 1
cgccaggucggcgaccgccagc

SEQ ID NO: 3954134 - RNA, 17 nt, Human herpesvirus 1
cgccagguugggggccg

SEQ ID NO: 3954135 - RNA, 23 nt, Human herpesvirus 1
cgccaucugggauggcuccuggc

SEQ ID NO: 3954136 - RNA, 15 nt, Human herpesvirus 1
cgccaugcuggcgga

SEQ ID NO: 3954137 - RNA, 23 nt, Human herpesvirus 1
cgccauguuugcgggccugggcg

SEQ ID NO: 3954138 - RNA, 15 nt, Human herpesvirus 1
cgcccaaugggccgg

SEQ ID NO: 3954139 - RNA, 14 nt, Human herpesvirus 1
cgcccaccuccugg

SEQ ID NO: 3954140 - RNA, 21 nt, Human herpesvirus 1
cgccccaucccgaggccccac

SEQ ID NO: 3954141 - RNA, 15 nt, Human herpesvirus 1
cgcccccagcugggc

SEQ ID NO: 3954142 - RNA, 17 nt, Human herpesvirus 1
cgcccccagcugggccc

SEQ ID NO: 3954143 - RNA, 20 nt, Human herpesvirus 1
cgcccccggcuacaggggcc

SEQ ID NO: 3954144 - RNA, 20 nt, Human herpesvirus 1
cgccccgaagagggggaccc

SEQ ID NO: 3954145 - RNA, 19 nt, Human herpesvirus 1
cgccccgacccccuuguau

SEQ ID NO: 3954146 - RNA, 14 nt, Human herpesvirus 1
cgccccggccgccu

SEQ ID NO: 3954147 - RNA, 19 nt, Human herpesvirus 1
cgccccggcgacccugauc

SEQ ID NO: 3954148 - RNA, 16 nt, Human herpesvirus 1
cgccccuaaccaggcc

SEQ ID NO: 3954149 - RNA, 19 nt, Human herpesvirus 1
cgccccucgccacgucgac

SEQ ID NO: 3954150 - RNA, 12 nt, Human herpesvirus 1
cgccccuguggc

SEQ ID NO: 3954151 - RNA, 13 nt, Human herpesvirus 1
cgccccuguggcc

SEQ ID NO: 3954152 - RNA, 18 nt, Human herpesvirus 1
cgcccgauuuacagcccc

SEQ ID NO: 3954153 - RNA, 22 nt, Human herpesvirus 1
cgcccgauuuacagcccccaga

SEQ ID NO: 3954154 - RNA, 17 nt, Human herpesvirus 1
cgcccgccaucgagcca

SEQ ID NO: 3954155 - RNA, 16 nt, Human herpesvirus 1
cgcccgccccucgcca

SEQ ID NO: 3954156 - RNA, 13 nt, Human herpesvirus 1
cgcccgccccugc

SEQ ID NO: 3954157 - RNA, 17 nt, Human herpesvirus 1
cgcccggggccagcgcc

SEQ ID NO: 3954158 - RNA, 16 nt, Human herpesvirus 1
cgcccggguccccgcg

SEQ ID NO: 3954159 - RNA, 16 nt, Human herpesvirus 1
cgcccguccucgcccg

SEQ ID NO: 3954160 - RNA, 22 nt, Human herpesvirus 1
cgcccuaacagucuuccgcuga

SEQ ID NO: 3954161 - RNA, 22 nt, Human herpesvirus 1
cgcccucgcccagacgcccucc

SEQ ID NO: 3954162 - RNA, 21 nt, Human herpesvirus 1
cgcccucgguucgccuucacg

SEQ ID NO: 3954163 - RNA, 14 nt, Human herpesvirus 1
cgccgaccacccgg

SEQ ID NO: 3954164 - RNA, 19 nt, Human herpesvirus 1
cgccgagucuucggggccc

SEQ ID NO: 3954165 - RNA, 22 nt, Human herpesvirus 1
cgccgcaaagccacccacgccg

SEQ ID NO: 3954166 - RNA, 16 nt, Human herpesvirus 1
cgccgcgagauggccg

SEQ ID NO: 3954167 - RNA, 16 nt, Human herpesvirus 1
cgccgcggccuggguu

SEQ ID NO: 3954168 - RNA, 12 nt, Human herpesvirus 1
cgccgcgggcca

SEQ ID NO: 3954169 - RNA, 14 nt, Human herpesvirus 1
cgccgcgggccacg

SEQ ID NO: 3954170 - RNA, 19 nt, Human herpesvirus 1
cgccgcugacccccaccgc

SEQ ID NO: 3954171 - RNA, 14 nt, Human herpesvirus 1
cgccggccgcaccc

SEQ ID NO: 3954172 - RNA, 23 nt, Human herpesvirus 1
cgccggcggcgacgugcccccuc

SEQ ID NO: 3954173 - RNA, 21 nt, Human herpesvirus 1
cgccggguagcguacggaccg

SEQ ID NO: 3954174 - RNA, 19 nt, Human herpesvirus 1
cgccgucccacgcucuccc

SEQ ID NO: 3954175 - RNA, 13 nt, Human herpesvirus 1
cgccucagggccu

SEQ ID NO: 3954176 - RNA, 20 nt, Human herpesvirus 1
cgccucccccacauccggga

SEQ ID NO: 3954177 - RNA, 20 nt, Human herpesvirus 1
cgccuccgcccgugcugccg

SEQ ID NO: 3954178 - RNA, 13 nt, Human herpesvirus 1
cgccucggagccg

SEQ ID NO: 3954179 - RNA, 15 nt, Human herpesvirus 1
cgccucggcccgcga

SEQ ID NO: 3954180 - RNA, 23 nt, Human herpesvirus 1
cgccugccaaccugauccgcggc

SEQ ID NO: 3954181 - RNA, 17 nt, Human herpesvirus 1
cgccugcccccuggacg

SEQ ID NO: 3954182 - RNA, 22 nt, Human herpesvirus 1
cgccugcguucaucggaccccc

SEQ ID NO: 3954183 - RNA, 21 nt, Human herpesvirus 1
cgccuggauucgcuggaccuc

SEQ ID NO: 3954184 - RNA, 18 nt, Human herpesvirus 1
cgccuggcgucuccucug

SEQ ID NO: 3954185 - RNA, 21 nt, Human herpesvirus 1
cgccuggcgucuccucugggg

SEQ ID NO: 3954186 - RNA, 14 nt, Human herpesvirus 1
cgccuugcggcagc

SEQ ID NO: 3954187 - RNA, 17 nt, Human herpesvirus 1
cgcgaccaccccgagaa

SEQ ID NO: 3954188 - RNA, 14 nt, Human herpesvirus 1
cgcgacccuccggg

SEQ ID NO: 3954189 - RNA, 17 nt, Human herpesvirus 1
cgcgaccucaccaccaa

SEQ ID NO: 3954190 - RNA, 14 nt, Human herpesvirus 1
cgcgaucccccgcc

SEQ ID NO: 3954191 - RNA, 19 nt, Human herpesvirus 1
cgcgaucguccaccuccgg

SEQ ID NO: 3954192 - RNA, 15 nt, Human herpesvirus 1
cgcgauguggauaaa

SEQ ID NO: 3954193 - RNA, 13 nt, Human herpesvirus 1
cgcgcauggcagc

SEQ ID NO: 3954194 - RNA, 22 nt, Human herpesvirus 1
cgcgcccacuacaccagccaau

SEQ ID NO: 3954195 - RNA, 20 nt, Human herpesvirus 1
cgcgccgcgggcccccggcc

SEQ ID NO: 3954196 - RNA, 14 nt, Human herpesvirus 1
cgcgccgcugcccg

SEQ ID NO: 3954197 - RNA, 16 nt, Human herpesvirus 1
cgcgccguuggccccc

SEQ ID NO: 3954198 - RNA, 13 nt, Human herpesvirus 1
cgcgccucccggg

SEQ ID NO: 3954199 - RNA, 13 nt, Human herpesvirus 1
cgcgcgaccucac

SEQ ID NO: 3954200 - RNA, 20 nt, Human herpesvirus 1
cgcgcgauagagucgacgac

SEQ ID NO: 3954201 - RNA, 23 nt, Human herpesvirus 1
cgcgcgaugcgaucgagccgugc

SEQ ID NO: 3954202 - RNA, 21 nt, Human herpesvirus 1
cgcgcggacggcgcggggccc

SEQ ID NO: 3954203 - RNA, 17 nt, Human herpesvirus 1
cgcgcggaugacggccc

SEQ ID NO: 3954204 - RNA, 19 nt, Human herpesvirus 1
cgcgcggcgcgagcucccu

SEQ ID NO: 3954205 - RNA, 17 nt, Human herpesvirus 1
cgcgcguccuucuuguc

SEQ ID NO: 3954206 - RNA, 20 nt, Human herpesvirus 1
cgcgcgucucuggggagccu

SEQ ID NO: 3954207 - RNA, 18 nt, Human herpesvirus 1
cgcgcuaugacggcaaua

SEQ ID NO: 3954208 - RNA, 19 nt, Human herpesvirus 1
cgcggacggcgcggggccc

SEQ ID NO: 3954209 - RNA, 15 nt, Human herpesvirus 1
cgcggaucugcuccg

SEQ ID NO: 3954210 - RNA, 17 nt, Human herpesvirus 1
cgcggcauaacuccgac

SEQ ID NO: 3954211 - RNA, 14 nt, Human herpesvirus 1
cgcggcccggggcc

SEQ ID NO: 3954212 - RNA, 11 nt, Human herpesvirus 1
cgcggcgcgcu

SEQ ID NO: 3954213 - RNA, 17 nt, Human herpesvirus 1
cgcggcguccgcgcccc

SEQ ID NO: 3954214 - RNA, 13 nt, Human herpesvirus 1
cgcggcucccggc

SEQ ID NO: 3954215 - RNA, 14 nt, Human herpesvirus 1
cgcggcugguccac

SEQ ID NO: 3954216 - RNA, 18 nt, Human herpesvirus 1
cgcgggcccccggccgcc

SEQ ID NO: 3954217 - RNA, 19 nt, Human herpesvirus 1
cgcgggcgacgccccggcc

SEQ ID NO: 3954218 - RNA, 19 nt, Human herpesvirus 1
cgcgggcucgucuuggcca

SEQ ID NO: 3954219 - RNA, 13 nt, Human herpesvirus 1
cgcggggccuccg

SEQ ID NO: 3954220 - RNA, 12 nt, Human herpesvirus 1
cgcgggggcgcc

SEQ ID NO: 3954221 - RNA, 19 nt, Human herpesvirus 1
cgcgggguuacgcgggccc

SEQ ID NO: 3954222 - RNA, 23 nt, Human herpesvirus 1
cgcgggucuguauagcccgggca

SEQ ID NO: 3954223 - RNA, 16 nt, Human herpesvirus 1
cgcggguugcugcgcg

SEQ ID NO: 3954224 - RNA, 13 nt, Human herpesvirus 1
cgcgguucgcguc

SEQ ID NO: 3954225 - RNA, 21 nt, Human herpesvirus 1
cgcgguuuaccgccaccagca

SEQ ID NO: 3954226 - RNA, 15 nt, Human herpesvirus 1
cgucccggcucuccg

SEQ ID NO: 3954227 - RNA, 22 nt, Human herpesvirus 1
cgucccguagucccaucccccg

SEQ ID NO: 3954228 - RNA, 17 nt, Human herpesvirus 1
cguccgaacccaggccu

SEQ ID NO: 3954229 - RNA, 15 nt, Human herpesvirus 1
cguccggggagggcg

SEQ ID NO: 3954230 - RNA, 21 nt, Human herpesvirus 1
cguccgguuggccgcgcggca

SEQ ID NO: 3954231 - RNA, 12 nt, Human herpesvirus 1
cgucgauccagg

SEQ ID NO: 3954232 - RNA, 14 nt, Human herpesvirus 1
cgucgcgggacccg

SEQ ID NO: 3954233 - RNA, 16 nt, Human herpesvirus 1
cgucgcugugaugaag

SEQ ID NO: 3954234 - RNA, 23 nt, Human herpesvirus 1
cgucucccgggggcgcuuggccg

SEQ ID NO: 3954235 - RNA, 15 nt, Human herpesvirus 1
cgucuccuccaccac

SEQ ID NO: 3954236 - RNA, 14 nt, Human herpesvirus 1
cgucucucuucccc

SEQ ID NO: 3954237 - RNA, 22 nt, Human herpesvirus 1
cgucugggcccgacagaccucc

SEQ ID NO: 3954238 - RNA, 23 nt, Human herpesvirus 1
cgugacuaagcgucccugggccc

SEQ ID NO: 3954239 - RNA, 18 nt, Human herpesvirus 1
cgugcgggaacaccuccg

SEQ ID NO: 3954240 - RNA, 15 nt, Human herpesvirus 1
cgugcgugccggucg

SEQ ID NO: 3954241 - RNA, 21 nt, Human herpesvirus 1
cgugcugcgccuugggcccgg

SEQ ID NO: 3954242 - RNA, 17 nt, Human herpesvirus 1
cguggaccugggggacu

SEQ ID NO: 3954243 - RNA, 15 nt, Human herpesvirus 1
cguggacgggcucgc

SEQ ID NO: 3954244 - RNA, 19 nt, Human herpesvirus 1
cguggacgggcucgccagc

SEQ ID NO: 3954245 - RNA, 20 nt, Human herpesvirus 1
cguggauaucgaguccgaag

SEQ ID NO: 3954246 - RNA, 19 nt, Human herpesvirus 1
cguggccgacaacugccug

SEQ ID NO: 3954247 - RNA, 18 nt, Human herpesvirus 1
cguggccgguaccaucaa

SEQ ID NO: 3954248 - RNA, 19 nt, Human herpesvirus 1
cguggcgucucgccggacg

SEQ ID NO: 3954249 - RNA, 22 nt, Human herpesvirus 1
cgugggcgccuugcggcagcgc

SEQ ID NO: 3954250 - RNA, 16 nt, Human herpesvirus 1
cguggugcgucgggcc

SEQ ID NO: 3954251 - RNA, 23 nt, Human herpesvirus 1
cguguacaacaucauccagcugg

SEQ ID NO: 3954252 - RNA, 19 nt, Human herpesvirus 1
cguguuggagcgcgccugc

SEQ ID NO: 3954253 - RNA, 14 nt, Human herpesvirus 1
cguguuugcccaua

SEQ ID NO: 3954254 - RNA, 18 nt, Human herpesvirus 1
cguguuugcccauaauaa

SEQ ID NO: 3954255 - RNA, 21 nt, Human herpesvirus 1
cguuacuaucaccgucccccc

SEQ ID NO: 3954256 - RNA, 18 nt, Human herpesvirus 1
cguuccucacugccuccc

SEQ ID NO: 3954257 - RNA, 16 nt, Human herpesvirus 1
cguucgcgcgccaucu

SEQ ID NO: 3954258 - RNA, 18 nt, Human herpesvirus 1
cguugcagggccuggugc

SEQ ID NO: 3954259 - RNA, 23 nt, Human herpesvirus 1
cguugggguggaucuuagccucc

SEQ ID NO: 3954260 - RNA, 16 nt, Human herpesvirus 1
cguuucccacccccac

SEQ ID NO: 3954261 - RNA, 20 nt, Human herpesvirus 1
cuaagacccaccccccgucc

SEQ ID NO: 3954262 - RNA, 14 nt, Human herpesvirus 1
cuaagcgucccugg

SEQ ID NO: 3954263 - RNA, 20 nt, Human herpesvirus 1
cuaagcgucccugggcccug

SEQ ID NO: 3954264 - RNA, 13 nt, Human herpesvirus 1
cuaagugcccagg

SEQ ID NO: 3954265 - RNA, 15 nt, Human herpesvirus 1
cuacaccagccaauc

SEQ ID NO: 3954266 - RNA, 18 nt, Human herpesvirus 1
cuacacccuuguguguca

SEQ ID NO: 3954267 - RNA, 16 nt, Human herpesvirus 1
cuacaccucccagugu

SEQ ID NO: 3954268 - RNA, 23 nt, Human herpesvirus 1
cuacaggggccauguugggccgc

SEQ ID NO: 3954269 - RNA, 17 nt, Human herpesvirus 1
cuacccguguuugccca

SEQ ID NO: 3954270 - RNA, 12 nt, Human herpesvirus 1
cuacgugccccc

SEQ ID NO: 3954271 - RNA, 13 nt, Human herpesvirus 1
cuagagacagccg

SEQ ID NO: 3954272 - RNA, 17 nt, Human herpesvirus 1
cuagauacccccccuua

SEQ ID NO: 3954273 - RNA, 19 nt, Human herpesvirus 1
cuagccgaggcccgggaga

SEQ ID NO: 3954274 - RNA, 12 nt, Human herpesvirus 1
cuagcucgcgga

SEQ ID NO: 3954275 - RNA, 19 nt, Human herpesvirus 1
cuaucacacccgccccucc

SEQ ID NO: 3954276 - RNA, 20 nt, Human herpesvirus 1
cuaucacggcaaggagcgcc

SEQ ID NO: 3954277 - RNA, 21 nt, Human herpesvirus 1
cuaucccgcccaccgcugggc

SEQ ID NO: 3954278 - RNA, 16 nt, Human herpesvirus 1
cuauuuucccccccgg

SEQ ID NO: 3954279 - RNA, 13 nt, Human herpesvirus 1
cucaacaucacca

SEQ ID NO: 3954280 - RNA, 13 nt, Human herpesvirus 1
cucaaucuggccc

SEQ ID NO: 3954281 - RNA, 20 nt, Human herpesvirus 1
cucaccaccaaggcccgggc

SEQ ID NO: 3954282 - RNA, 23 nt, Human herpesvirus 1
cucaccggguacggcgucugggc

SEQ ID NO: 3954283 - RNA, 22 nt, Human herpesvirus 1
cucacgcgcauccgcaagcuau

SEQ ID NO: 3954284 - RNA, 16 nt, Human herpesvirus 1
cucacuaucgagggcg

SEQ ID NO: 3954285 - RNA, 19 nt, Human herpesvirus 1
cucagggccuccgacccca

SEQ ID NO: 3954286 - RNA, 22 nt, Human herpesvirus 1
cucagggccuccgaccccagac

SEQ ID NO: 3954287 - RNA, 22 nt, Human herpesvirus 1
cuccacccccucgaccaccacc

SEQ ID NO: 3954288 - RNA, 23 nt, Human herpesvirus 1
cucccaccagcugagccgcgccg

SEQ ID NO: 3954289 - RNA, 18 nt, Human herpesvirus 1
cucccagagaccccaggg

SEQ ID NO: 3954290 - RNA, 22 nt, Human herpesvirus 1
cuccccaagcaucgaccacgcc

SEQ ID NO: 3954291 - RNA, 14 nt, Human herpesvirus 1
cuccccccgcguca

SEQ ID NO: 3954292 - RNA, 17 nt, Human herpesvirus 1
cuccccgauggcccucc

SEQ ID NO: 3954293 - RNA, 23 nt, Human herpesvirus 1
cuccccgggagccccggacccca

SEQ ID NO: 3954294 - RNA, 15 nt, Human herpesvirus 1
cuccccuucccuccc

SEQ ID NO: 3954295 - RNA, 15 nt, Human herpesvirus 1
cucccgacaccacca

SEQ ID NO: 3954296 - RNA, 13 nt, Human herpesvirus 1
cucccgccacccg

SEQ ID NO: 3954297 - RNA, 21 nt, Human herpesvirus 1
cucccgcugcgcauccccccg

SEQ ID NO: 3954298 - RNA, 14 nt, Human herpesvirus 1
cucccggaagagcc

SEQ ID NO: 3954299 - RNA, 16 nt, Human herpesvirus 1
cucccggcccgggccc

SEQ ID NO: 3954300 - RNA, 14 nt, Human herpesvirus 1
cucccugcggcugg

SEQ ID NO: 3954301 - RNA, 15 nt, Human herpesvirus 1
cuccgacgacgcgca

SEQ ID NO: 3954302 - RNA, 14 nt, Human herpesvirus 1
cuccgacgcccagc

SEQ ID NO: 3954303 - RNA, 18 nt, Human herpesvirus 1
cuccgaguucccccggca

SEQ ID NO: 3954304 - RNA, 17 nt, Human herpesvirus 1
cuccgcccgugcugccg

SEQ ID NO: 3954305 - RNA, 20 nt, Human herpesvirus 1
cuccgcuggggcccccaggg

SEQ ID NO: 3954306 - RNA, 14 nt, Human herpesvirus 1
cuccggcgccgccc

SEQ ID NO: 3954307 - RNA, 15 nt, Human herpesvirus 1
cuccggcgccgcccg

SEQ ID NO: 3954308 - RNA, 20 nt, Human herpesvirus 1
cuccggggcccggcccugcu

SEQ ID NO: 3954309 - RNA, 21 nt, Human herpesvirus 1
cuccggggguccggcgcgugu

SEQ ID NO: 3954310 - RNA, 19 nt, Human herpesvirus 1
cuccugauguggcugcucc

SEQ ID NO: 3954311 - RNA, 22 nt, Human herpesvirus 1
cuccugauguggcugcuccgcu

SEQ ID NO: 3954312 - RNA, 14 nt, Human herpesvirus 1
cuccuggccaggau

SEQ ID NO: 3954313 - RNA, 20 nt, Human herpesvirus 1
cuccuggccuacgucuccgu

SEQ ID NO: 3954314 - RNA, 17 nt, Human herpesvirus 1
cuccugggucagcuccu

SEQ ID NO: 3954315 - RNA, 14 nt, Human herpesvirus 1
cucgaccaccaccu

SEQ ID NO: 3954316 - RNA, 13 nt, Human herpesvirus 1
cucgaucggccac

SEQ ID NO: 3954317 - RNA, 18 nt, Human herpesvirus 1
cucgcaugaagcccccaa

SEQ ID NO: 3954318 - RNA, 15 nt, Human herpesvirus 1
cucgccccacgaccc

SEQ ID NO: 3954319 - RNA, 20 nt, Human herpesvirus 1
cucgccgcccuagaggcugg

SEQ ID NO: 3954320 - RNA, 14 nt, Human herpesvirus 1
cucgcgccacacuc

SEQ ID NO: 3954321 - RNA, 20 nt, Human herpesvirus 1
cucgcgggccucgugggcac

SEQ ID NO: 3954322 - RNA, 23 nt, Human herpesvirus 1
cucggggccgcaggacccagcaa

SEQ ID NO: 3954323 - RNA, 18 nt, Human herpesvirus 1
cucguccccuggggcggc

SEQ ID NO: 3954324 - RNA, 15 nt, Human herpesvirus 1
cucguccggcgcgcg

SEQ ID NO: 3954325 - RNA, 15 nt, Human herpesvirus 1
cucgucgccuggcug

SEQ ID NO: 3954326 - RNA, 16 nt, Human herpesvirus 1
cucgucgggguggcac

SEQ ID NO: 3954327 - RNA, 13 nt, Human herpesvirus 1
cucgucuccucuu

SEQ ID NO: 3954328 - RNA, 16 nt, Human herpesvirus 1
cucgugcccucgcggg

SEQ ID NO: 3954329 - RNA, 16 nt, Human herpesvirus 1
cucguggcgucucgcc

SEQ ID NO: 3954330 - RNA, 14 nt, Human herpesvirus 1
cucgugggccucug

SEQ ID NO: 3954331 - RNA, 22 nt, Human herpesvirus 1
cucguucuccggggcccggccc

SEQ ID NO: 3954332 - RNA, 17 nt, Human herpesvirus 1
cucuacugcagaugcag

SEQ ID NO: 3954333 - RNA, 23 nt, Human herpesvirus 1
cucuccccccaggccuaccagca

SEQ ID NO: 3954334 - RNA, 14 nt, Human herpesvirus 1
cucuccccugcugc

SEQ ID NO: 3954335 - RNA, 18 nt, Human herpesvirus 1
cucuccgggaugggcuac

SEQ ID NO: 3954336 - RNA, 23 nt, Human herpesvirus 1
cucucgcaccaucccggguuaau

SEQ ID NO: 3954337 - RNA, 19 nt, Human herpesvirus 1
cucucggugaucuuggcgu

SEQ ID NO: 3954338 - RNA, 18 nt, Human herpesvirus 1
cucuggccaucggucccc

SEQ ID NO: 3954339 - RNA, 20 nt, Human herpesvirus 1
cucugggggccugucccauc

SEQ ID NO: 3954340 - RNA, 17 nt, Human herpesvirus 1
gacccuaugguacacac

SEQ ID NO: 3954341 - RNA, 18 nt, Human herpesvirus 1
gaccgcaacuucccaccc

SEQ ID NO: 3954342 - RNA, 15 nt, Human herpesvirus 1
gaccgcgcccucgcc

SEQ ID NO: 3954343 - RNA, 22 nt, Human herpesvirus 1
gaccggcaccaccgacucuccc

SEQ ID NO: 3954344 - RNA, 20 nt, Human herpesvirus 1
gaccggcgggucccgaccga

SEQ ID NO: 3954345 - RNA, 15 nt, Human herpesvirus 1
gaccggggucccagc

SEQ ID NO: 3954346 - RNA, 20 nt, Human herpesvirus 1
gaccgggucccuccuuagca

SEQ ID NO: 3954347 - RNA, 14 nt, Human herpesvirus 1
gaccgucugcaaga

SEQ ID NO: 3954348 - RNA, 18 nt, Human herpesvirus 1
gaccucggcgccucugga

SEQ ID NO: 3954349 - RNA, 16 nt, Human herpesvirus 1
gaccugcaccgaucgc

SEQ ID NO: 3954350 - RNA, 17 nt, Human herpesvirus 1
gaccuguugauggccug

SEQ ID NO: 3954351 - RNA, 16 nt, Human herpesvirus 1
gacgacacgcucgccg

SEQ ID NO: 3954352 - RNA, 19 nt, Human herpesvirus 1
gacgagaugcugcgcuccg

SEQ ID NO: 3954353 - RNA, 12 nt, Human herpesvirus 1
gacgccccccgu

SEQ ID NO: 3954354 - RNA, 16 nt, Human herpesvirus 1
gacgccguggcgcccc

SEQ ID NO: 3954355 - RNA, 14 nt, Human herpesvirus 1
gacgccgugggcaa

SEQ ID NO: 3954356 - RNA, 21 nt, Human herpesvirus 1
gacgccuuaccaucccccggc

SEQ ID NO: 3954357 - RNA, 14 nt, Human herpesvirus 1
gacgcgcagccggc

SEQ ID NO: 3954358 - RNA, 23 nt, Human herpesvirus 1
gacgcguggcggccccugaugga

SEQ ID NO: 3954359 - RNA, 15 nt, Human herpesvirus 1
gacggugagcgagga

SEQ ID NO: 3954360 - RNA, 18 nt, Human herpesvirus 1
gacucucccccaccgccc

SEQ ID NO: 3954361 - RNA, 22 nt, Human herpesvirus 1
gacuggccaaucggcggccgcc

SEQ ID NO: 3954362 - RNA, 19 nt, Human herpesvirus 1
gacuuuuggaugucgcccg

SEQ ID NO: 3954363 - RNA, 13 nt, Human herpesvirus 1
gagacaauaccgg

SEQ ID NO: 3954364 - RNA, 17 nt, Human herpesvirus 1
gagacccccaacgccac

SEQ ID NO: 3954365 - RNA, 22 nt, Human herpesvirus 1
gagaucuauaaggccauccagc

SEQ ID NO: 3954366 - RNA, 22 nt, Human herpesvirus 1
gagcaaccccaugaaggcccug

SEQ ID NO: 3954367 - RNA, 12 nt, Human herpesvirus 1
gagcaccccccc

SEQ ID NO: 3954368 - RNA, 18 nt, Human herpesvirus 1
gagccaacgcccugacca

SEQ ID NO: 3954369 - RNA, 21 nt, Human herpesvirus 1
gagccaguggucggcgagcug

SEQ ID NO: 3954370 - RNA, 23 nt, Human herpesvirus 1
gagccccccgcugcggccacaca

SEQ ID NO: 3954371 - RNA, 16 nt, Human herpesvirus 1
gagccgugcaccgugg

SEQ ID NO: 3954372 - RNA, 15 nt, Human herpesvirus 1
gagcgaaggcugccg

SEQ ID NO: 3954373 - RNA, 13 nt, Human herpesvirus 1
gagcucccagaga

SEQ ID NO: 3954374 - RNA, 18 nt, Human herpesvirus 1
gagcugcagaaucacgag

SEQ ID NO: 3954375 - RNA, 17 nt, Human herpesvirus 1
gagcugcccggcggcca

SEQ ID NO: 3954376 - RNA, 18 nt, Human herpesvirus 1
gagcuguacgugcgggaa

SEQ ID NO: 3954377 - RNA, 22 nt, Human herpesvirus 1
gagcuucgcuuugugggggacc

SEQ ID NO: 3954378 - RNA, 19 nt, Human herpesvirus 1
gaggaccgcgcccccgucc

SEQ ID NO: 3954379 - RNA, 22 nt, Human herpesvirus 1
gaggacggcgccggggcucucg

SEQ ID NO: 3954380 - RNA, 12 nt, Human herpesvirus 1
gaggauuacuuu

SEQ ID NO: 3954381 - RNA, 21 nt, Human herpesvirus 1
gaggccacguguagccuggau

SEQ ID NO: 3954382 - RNA, 13 nt, Human herpesvirus 1
gagggcggccagc

SEQ ID NO: 3954383 - RNA, 18 nt, Human herpesvirus 1
gagggcguaacguuccgc

SEQ ID NO: 3954384 - RNA, 13 nt, Human herpesvirus 1
gaggggggagggg

SEQ ID NO: 3954385 - RNA, 11 nt, Human herpesvirus 1
gaggggggcaa

SEQ ID NO: 3954386 - RNA, 18 nt, Human herpesvirus 1
gaggguuggggggguccg

SEQ ID NO: 3954387 - RNA, 18 nt, Human herpesvirus 1
gaggucaaaugccgggcc

SEQ ID NO: 3954388 - RNA, 18 nt, Human herpesvirus 1
gagucgacgaccugggga

SEQ ID NO: 3954389 - RNA, 20 nt, Human herpesvirus 1
gagucuggaaggggggaaag

SEQ ID NO: 3954390 - RNA, 19 nt, Human herpesvirus 1
gagugucgcagcaccuccu

SEQ ID NO: 3954391 - RNA, 22 nt, Human herpesvirus 1
gaguugccccaccguugcccgg

SEQ ID NO: 3954392 - RNA, 20 nt, Human herpesvirus 1
gaguuuguggacccaaagcc

SEQ ID NO: 3954393 - RNA, 13 nt, Human herpesvirus 1
gauaaaaagccag

SEQ ID NO: 3954394 - RNA, 20 nt, Human herpesvirus 1
gauaacaaccacccgcaccc

SEQ ID NO: 3954395 - RNA, 13 nt, Human herpesvirus 1
gauacccccccuu

SEQ ID NO: 3954396 - RNA, 21 nt, Human herpesvirus 1
gaucaugguacggggccggga

SEQ ID NO: 3954397 - RNA, 20 nt, Human herpesvirus 1
gauccaaaaccacaaccucc

SEQ ID NO: 3954398 - RNA, 18 nt, Human herpesvirus 1
gaucccacguccccgggu

SEQ ID NO: 3954399 - RNA, 12 nt, Human herpesvirus 1
gaucccccgccc

SEQ ID NO: 3954400 - RNA, 15 nt, Human herpesvirus 1
gaucccucgcgaggg

SEQ ID NO: 3954401 - RNA, 15 nt, Human herpesvirus 1
gauccgcggcgacaa

SEQ ID NO: 3954402 - RNA, 23 nt, Human herpesvirus 1
gauccgcggcgacaacgcgggcg

SEQ ID NO: 3954403 - RNA, 17 nt, Human herpesvirus 1
gauccucgggcuacugg

SEQ ID NO: 3954404 - RNA, 16 nt, Human herpesvirus 1
gaucgcgcucgucacc

SEQ ID NO: 3954405 - RNA, 16 nt, Human herpesvirus 1
gaucgcguaccagccc

SEQ ID NO: 3954406 - RNA, 15 nt, Human herpesvirus 1
gaugcacgcccccgc

SEQ ID NO: 3954407 - RNA, 19 nt, Human herpesvirus 1
gaugccgugccgcccguug

SEQ ID NO: 3954408 - RNA, 13 nt, Human herpesvirus 1
gaugccugugggu

SEQ ID NO: 3954409 - RNA, 17 nt, Human herpesvirus 1
gaugcgaucgagccgug

SEQ ID NO: 3954410 - RNA, 15 nt, Human herpesvirus 1
gcaacgcgcuggggc

SEQ ID NO: 3954411 - RNA, 19 nt, Human herpesvirus 1
gcaacgcgcuggggcugcc

SEQ ID NO: 3954412 - RNA, 21 nt, Human herpesvirus 1
gcaacggcgggagcuggguua

SEQ ID NO: 3954413 - RNA, 14 nt, Human herpesvirus 1
gcaacggggcgccg

SEQ ID NO: 3954414 - RNA, 14 nt, Human herpesvirus 1
gcaagaacaauaaa

SEQ ID NO: 3954415 - RNA, 20 nt, Human herpesvirus 1
gcaagaggucgucgggggac

SEQ ID NO: 3954416 - RNA, 12 nt, Human herpesvirus 1
gcaagcugaacc

SEQ ID NO: 3954417 - RNA, 23 nt, Human herpesvirus 1
gcaaugcggagggcacccaacaa

SEQ ID NO: 3954418 - RNA, 17 nt, Human herpesvirus 1
gcaauuugcacccagcc

SEQ ID NO: 3954419 - RNA, 23 nt, Human herpesvirus 1
gcacaacacaaacaucuggaggc

SEQ ID NO: 3954420 - RNA, 17 nt, Human herpesvirus 1
gcacaacgccagccugc

SEQ ID NO: 3954421 - RNA, 15 nt, Human herpesvirus 1
gcacacacccuagcg

SEQ ID NO: 3954422 - RNA, 14 nt, Human herpesvirus 1
gcacaccggucccc

SEQ ID NO: 3954423 - RNA, 21 nt, Human herpesvirus 1
gcaccacggguauaaggacau

SEQ ID NO: 3954424 - RNA, 17 nt, Human herpesvirus 1
gcaccagcgcggaggag

SEQ ID NO: 3954425 - RNA, 15 nt, Human herpesvirus 1
gcaccaucccggguu

SEQ ID NO: 3954426 - RNA, 17 nt, Human herpesvirus 1
gcacccccugaccccgc

SEQ ID NO: 3954427 - RNA, 16 nt, Human herpesvirus 1
gcacgagcaggcgguc

SEQ ID NO: 3954428 - RNA, 16 nt, Human herpesvirus 1
gcacgaucgagguggc

SEQ ID NO: 3954429 - RNA, 16 nt, Human herpesvirus 1
gcacgcauacgggcgg

SEQ ID NO: 3954430 - RNA, 21 nt, Human herpesvirus 1
gcacgcgcgauagagucgacg

SEQ ID NO: 3954431 - RNA, 16 nt, Human herpesvirus 1
gcacgggcccaaggcc

SEQ ID NO: 3954432 - RNA, 14 nt, Human herpesvirus 1
gcacuguggcucuc

SEQ ID NO: 3954433 - RNA, 22 nt, Human herpesvirus 1
gcacuugcggcaagacccgggc

SEQ ID NO: 3954434 - RNA, 17 nt, Human herpesvirus 1
gcagacgcugcuccgcc

SEQ ID NO: 3954435 - RNA, 13 nt, Human herpesvirus 1
gcagcaaauuaaa

SEQ ID NO: 3954436 - RNA, 17 nt, Human herpesvirus 1
gcagcaugggacccaca

SEQ ID NO: 3954437 - RNA, 21 nt, Human herpesvirus 1
gcagccagaacucgccccgga

SEQ ID NO: 3954438 - RNA, 21 nt, Human herpesvirus 1
gcagcgccggacgcgcggcgc

SEQ ID NO: 3954439 - RNA, 21 nt, Human herpesvirus 1
gcaggcgccuccggggguccg

SEQ ID NO: 3954440 - RNA, 21 nt, Human herpesvirus 1
gcagggccgcggggggggcgg

SEQ ID NO: 3954441 - RNA, 14 nt, Human herpesvirus 1
gcagggggaugggg

SEQ ID NO: 3954442 - RNA, 14 nt, Human herpesvirus 1
gcaggugugguucg

SEQ ID NO: 3954443 - RNA, 20 nt, Human herpesvirus 1
gcaguacuggaaguaccugc

SEQ ID NO: 3954444 - RNA, 18 nt, Human herpesvirus 1
gcaguccacgggggggag

SEQ ID NO: 3954445 - RNA, 20 nt, Human herpesvirus 1
gcagucuccuggcagcccug

SEQ ID NO: 3954446 - RNA, 23 nt, Human herpesvirus 1
gcaucaaggcuugguucggggcc

SEQ ID NO: 3954447 - RNA, 14 nt, Human herpesvirus 1
gcauccacccuccg

SEQ ID NO: 3954448 - RNA, 15 nt, Human herpesvirus 1
gcauccacccuccgc

SEQ ID NO: 3954449 - RNA, 16 nt, Human herpesvirus 1
gcaucccaggaucaca

SEQ ID NO: 3954450 - RNA, 15 nt, Human herpesvirus 1
gcaucggaacacgcc

SEQ ID NO: 3954451 - RNA, 21 nt, Human herpesvirus 1
gcaucggcaaggacgcccgcg

SEQ ID NO: 3954452 - RNA, 17 nt, Human herpesvirus 1
gcaugaagcccccaaca

SEQ ID NO: 3954453 - RNA, 19 nt, Human herpesvirus 1
gcaugaagcccccaacaug

SEQ ID NO: 3954454 - RNA, 16 nt, Human herpesvirus 1
gcaugcgcgggcucgu

SEQ ID NO: 3954455 - RNA, 13 nt, Human herpesvirus 1
cccguggacccca

SEQ ID NO: 3954456 - RNA, 12 nt, Human herpesvirus 1
cccguggcucuc

SEQ ID NO: 3954457 - RNA, 15 nt, Human herpesvirus 1
cccgugugccgcgcc

SEQ ID NO: 3954458 - RNA, 17 nt, Human herpesvirus 1
cccuccgcaucccagga

SEQ ID NO: 3954459 - RNA, 20 nt, Human herpesvirus 1
cccucgaccaccauccccgc

SEQ ID NO: 3954460 - RNA, 17 nt, Human herpesvirus 1
cccucucuucucucccg

SEQ ID NO: 3954461 - RNA, 18 nt, Human herpesvirus 1
cccucuggacgcccgggc

SEQ ID NO: 3954462 - RNA, 19 nt, Human herpesvirus 1
cccucugggcccgccugga

SEQ ID NO: 3954463 - RNA, 20 nt, Human herpesvirus 1
cccugagcgcccuccugacc

SEQ ID NO: 3954464 - RNA, 15 nt, Human herpesvirus 1
cccugaucccccgcg

SEQ ID NO: 3954465 - RNA, 20 nt, Human herpesvirus 1
cccugcuccggcggggccuc

SEQ ID NO: 3954466 - RNA, 23 nt, Human herpesvirus 1
cccuuaauaaauuuuacaaacag

SEQ ID NO: 3954467 - RNA, 15 nt, Human herpesvirus 1
cccuuccccacggga

SEQ ID NO: 3954468 - RNA, 17 nt, Human herpesvirus 1
ccgaacaaacgacccac

SEQ ID NO: 3954469 - RNA, 20 nt, Human herpesvirus 1
ccgaacgcagccccgcugga

SEQ ID NO: 3954470 - RNA, 13 nt, Human herpesvirus 1
ccgaagaggugcu

SEQ ID NO: 3954471 - RNA, 20 nt, Human herpesvirus 1
ccgacagcacucacagcccc

SEQ ID NO: 3954472 - RNA, 17 nt, Human herpesvirus 1
ccgaccauccgccggca

SEQ ID NO: 3954473 - RNA, 16 nt, Human herpesvirus 1
ccgacccggcccgagg

SEQ ID NO: 3954474 - RNA, 13 nt, Human herpesvirus 1
ccgacccuccggg

SEQ ID NO: 3954475 - RNA, 14 nt, Human herpesvirus 1
ccgaccgcaguccc

SEQ ID NO: 3954476 - RNA, 17 nt, Human herpesvirus 1
ccgaccucggacgccac

SEQ ID NO: 3954477 - RNA, 13 nt, Human herpesvirus 1
ccgacgccagcuu

SEQ ID NO: 3954478 - RNA, 15 nt, Human herpesvirus 1
ccgacucaccucaaa

SEQ ID NO: 3954479 - RNA, 16 nt, Human herpesvirus 1
ccgacucucccaccgc

SEQ ID NO: 3954480 - RNA, 19 nt, Human herpesvirus 1
ccgagacccccaacgccac

SEQ ID NO: 3954481 - RNA, 12 nt, Human herpesvirus 1
ccgagccaaggg

SEQ ID NO: 3954482 - RNA, 15 nt, Human herpesvirus 1
ccgagcuaugggccu

SEQ ID NO: 3954483 - RNA, 20 nt, Human herpesvirus 1
ccgagcuuguuuucgugggg

SEQ ID NO: 3954484 - RNA, 14 nt, Human herpesvirus 1
ccgaguucccccgg

SEQ ID NO: 3954485 - RNA, 13 nt, Human herpesvirus 1
ccgcaaaucccac

SEQ ID NO: 3954486 - RNA, 18 nt, Human herpesvirus 1
ccgcaacgcgcuggggcu

SEQ ID NO: 3954487 - RNA, 21 nt, Human herpesvirus 1
ccgcaagcccccaaaccccac

SEQ ID NO: 3954488 - RNA, 15 nt, Human herpesvirus 1
ccgcaauuugcaccc

SEQ ID NO: 3954489 - RNA, 22 nt, Human herpesvirus 1
ccgcagcaccucuaccagcagg

SEQ ID NO: 3954490 - RNA, 12 nt, Human herpesvirus 1
ccgcagucccug

SEQ ID NO: 3954491 - RNA, 20 nt, Human herpesvirus 1
ccgcaucccccgucuggguu

SEQ ID NO: 3954492 - RNA, 22 nt, Human herpesvirus 1
ccgccaacgcacuguggcucuc

SEQ ID NO: 3954493 - RNA, 13 nt, Human herpesvirus 1
ccgcccacuuccc

SEQ ID NO: 3954494 - RNA, 18 nt, Human herpesvirus 1
ccgcccggggccagcgcc

SEQ ID NO: 3954495 - RNA, 19 nt, Human herpesvirus 1
ccgccgagucuucggggcc

SEQ ID NO: 3954496 - RNA, 15 nt, Human herpesvirus 1
ccgccgcgccccgcc

SEQ ID NO: 3954497 - RNA, 21 nt, Human herpesvirus 1
ccgccgcggaucgggccuugg

SEQ ID NO: 3954498 - RNA, 13 nt, Human herpesvirus 1
ccgccggcgaggu

SEQ ID NO: 3954499 - RNA, 14 nt, Human herpesvirus 1
ccgccguccgaacc

SEQ ID NO: 3954500 - RNA, 16 nt, Human herpesvirus 1
ccgccguugagccccu

SEQ ID NO: 3954501 - RNA, 14 nt, Human herpesvirus 1
ccgccucggagccg

SEQ ID NO: 3954502 - RNA, 23 nt, Human herpesvirus 1
ccgccucguuugccgccaucgcc

SEQ ID NO: 3954503 - RNA, 21 nt, Human herpesvirus 1
ccgccugucgcacccacagcu

SEQ ID NO: 3954504 - RNA, 18 nt, Human herpesvirus 1
ccgcgaagacccccccgg

SEQ ID NO: 3954505 - RNA, 17 nt, Human herpesvirus 1
ccgcgacccccgggcua

SEQ ID NO: 3954506 - RNA, 15 nt, Human herpesvirus 1
ccgcgagcucccaga

SEQ ID NO: 3954507 - RNA, 14 nt, Human herpesvirus 1
ccgcgcauccgacc

SEQ ID NO: 3954508 - RNA, 13 nt, Human herpesvirus 1
ccgcgccccccga

SEQ ID NO: 3954509 - RNA, 22 nt, Human herpesvirus 1
ccgcgccgacaucaccaccguc

SEQ ID NO: 3954510 - RNA, 13 nt, Human herpesvirus 1
ccgcgcgccccga

SEQ ID NO: 3954511 - RNA, 21 nt, Human herpesvirus 1
ccgcgcggacggcgcggggcc

SEQ ID NO: 3954512 - RNA, 13 nt, Human herpesvirus 1
ccgcgcggcugcc

SEQ ID NO: 3954513 - RNA, 21 nt, Human herpesvirus 1
ccgcggcuucaucgcgccccu

SEQ ID NO: 3954514 - RNA, 19 nt, Human herpesvirus 1
ccgcguccaaacccaccga

SEQ ID NO: 3954515 - RNA, 15 nt, Human herpesvirus 1
ccgcgucgccggcac

SEQ ID NO: 3954516 - RNA, 17 nt, Human herpesvirus 1
ccgcuguucucguuccu

SEQ ID NO: 3954517 - RNA, 19 nt, Human herpesvirus 1
ccgcuuuaucccacggccu

SEQ ID NO: 3954518 - RNA, 17 nt, Human herpesvirus 1
ccggaagcccaacccac

SEQ ID NO: 3954519 - RNA, 11 nt, Human herpesvirus 1
ccggaccccac

SEQ ID NO: 3954520 - RNA, 12 nt, Human herpesvirus 1
ccggacccccgc

SEQ ID NO: 3954521 - RNA, 15 nt, Human herpesvirus 1
ccggagccgggcgcg

SEQ ID NO: 3954522 - RNA, 19 nt, Human herpesvirus 1
ccggagcucgcggcacgcg

SEQ ID NO: 3954523 - RNA, 17 nt, Human herpesvirus 1
ccggaggaaacccccga

SEQ ID NO: 3954524 - RNA, 18 nt, Human herpesvirus 1
ccggaggcgccugccccg

SEQ ID NO: 3954525 - RNA, 18 nt, Human herpesvirus 1
ccggcaauucccgcggcc

SEQ ID NO: 3954526 - RNA, 22 nt, Human herpesvirus 1
ccggcagggggaugggggggca

SEQ ID NO: 3954527 - RNA, 14 nt, Human herpesvirus 1
ccggccuggcggcg

SEQ ID NO: 3954528 - RNA, 14 nt, Human herpesvirus 1
ccggcgccgacacg

SEQ ID NO: 3954529 - RNA, 15 nt, Human herpesvirus 1
ccggcggacccccgg

SEQ ID NO: 3954530 - RNA, 19 nt, Human herpesvirus 1
ccggcggcgacgugccccc

SEQ ID NO: 3954531 - RNA, 16 nt, Human herpesvirus 1
ccggcggggccucacg

SEQ ID NO: 3954532 - RNA, 22 nt, Human herpesvirus 1
ccggcguuucugaccugcaccg

SEQ ID NO: 3954533 - RNA, 15 nt, Human herpesvirus 1
ccggcuagacccacg

SEQ ID NO: 3954534 - RNA, 20 nt, Human herpesvirus 1
ccgggaccugaaccccagcc

SEQ ID NO: 3954535 - RNA, 22 nt, Human herpesvirus 1
ccgggacuuuuggaugucgccc

SEQ ID NO: 3954536 - RNA, 23 nt, Human herpesvirus 1
ccgggccccauaaaacccaagcc

SEQ ID NO: 3954537 - RNA, 14 nt, Human herpesvirus 1
ccgggccgcaccgg

SEQ ID NO: 3954538 - RNA, 19 nt, Human herpesvirus 1
ccgggccggagcucgcggc

SEQ ID NO: 3954539 - RNA, 21 nt, Human herpesvirus 1
ccggggagacagcgccugcgu

SEQ ID NO: 3954540 - RNA, 15 nt, Human herpesvirus 1
ccggggaucuggucc

SEQ ID NO: 3954541 - RNA, 23 nt, Human herpesvirus 1
ccggggcaggcgguugucggggg

SEQ ID NO: 3954542 - RNA, 15 nt, Human herpesvirus 1
ccggggccagcgcca

SEQ ID NO: 3954543 - RNA, 23 nt, Human herpesvirus 1
ccggggcucucggggccgcagga

SEQ ID NO: 3954544 - RNA, 20 nt, Human herpesvirus 1
ccgggggccugguggcaccu

SEQ ID NO: 3954545 - RNA, 11 nt, Human herpesvirus 1
ccgggggcgcu

SEQ ID NO: 3954546 - RNA, 17 nt, Human herpesvirus 1
ccggggucccagcggca

SEQ ID NO: 3954547 - RNA, 19 nt, Human herpesvirus 1
ccggguacggcgucugggc

SEQ ID NO: 3954548 - RNA, 19 nt, Human herpesvirus 1
ccggguccccgcggaagcg

SEQ ID NO: 3954549 - RNA, 15 nt, Human herpesvirus 1
ccgguaugguaauua

SEQ ID NO: 3954550 - RNA, 18 nt, Human herpesvirus 1
ccggucaacgaggguugg

SEQ ID NO: 3954551 - RNA, 22 nt, Human herpesvirus 1
ccggucgccccgacccccuugu

SEQ ID NO: 3954552 - RNA, 15 nt, Human herpesvirus 1
ccggucuccccggga

SEQ ID NO: 3954553 - RNA, 20 nt, Human herpesvirus 1
ccggucuccccgggagcccc

SEQ ID NO: 3954554 - RNA, 13 nt, Human herpesvirus 1
ccggugcgccccc

SEQ ID NO: 3954555 - RNA, 13 nt, Human herpesvirus 1
ccguccgaccgcc

SEQ ID NO: 3954556 - RNA, 22 nt, Human herpesvirus 1
ccguccgccggcaugcacccca

SEQ ID NO: 3954557 - RNA, 21 nt, Human herpesvirus 1
ccgucgcuagaccacgccccu

SEQ ID NO: 3954558 - RNA, 23 nt, Human herpesvirus 1
ccgucguaacggaguccuguccc

SEQ ID NO: 3954559 - RNA, 15 nt, Human herpesvirus 1
ccgucucugcuacgc

SEQ ID NO: 3954560 - RNA, 22 nt, Human herpesvirus 1
ccgugcugccgucgcuagacca

SEQ ID NO: 3954561 - RNA, 13 nt, Human herpesvirus 1
ccguguccuggag

SEQ ID NO: 3954562 - RNA, 20 nt, Human herpesvirus 1
ccguuggcccccgccucugg

SEQ ID NO: 3954563 - RNA, 23 nt, Human herpesvirus 1
ccuaccggacccguuccagcccc

SEQ ID NO: 3954564 - RNA, 20 nt, Human herpesvirus 1
ccuaucacggcaaggagcgc

SEQ ID NO: 3954565 - RNA, 14 nt, Human herpesvirus 1
ccuauguguuucag

SEQ ID NO: 3954566 - RNA, 15 nt, Human herpesvirus 1
ccucaaguacaaccc

SEQ ID NO: 3954567 - RNA, 23 nt, Human herpesvirus 1
ccucaccaccaaggcccgggcca

SEQ ID NO: 3954568 - RNA, 17 nt, Human herpesvirus 1
ccucacccacgccggca

SEQ ID NO: 3954569 - RNA, 13 nt, Human herpesvirus 1
ccucaucaccgac

SEQ ID NO: 3954570 - RNA, 14 nt, Human herpesvirus 1
ccucaucccacccc

SEQ ID NO: 3954571 - RNA, 20 nt, Human herpesvirus 1
ccuccaucgaguucgccagg

SEQ ID NO: 3954572 - RNA, 14 nt, Human herpesvirus 1
ccucccccacaucc

SEQ ID NO: 3954573 - RNA, 17 nt, Human herpesvirus 1
ccucccgcucggcggca

SEQ ID NO: 3954574 - RNA, 21 nt, Human herpesvirus 1
ccucccggaagagccugccgc

SEQ ID NO: 3954575 - RNA, 22 nt, Human herpesvirus 1
ccucccggggggucggcaggcg

SEQ ID NO: 3954576 - RNA, 20 nt, Human herpesvirus 1
ccucccggggucaaccacga

SEQ ID NO: 3954577 - RNA, 20 nt, Human herpesvirus 1
ccuccgacgcccagcagcuc

SEQ ID NO: 3954578 - RNA, 22 nt, Human herpesvirus 1
ccuccgcgccaggcccgccgcc

SEQ ID NO: 3954579 - RNA, 19 nt, Human herpesvirus 1
ccuccucguccggcgcgcg

SEQ ID NO: 3954580 - RNA, 14 nt, Human herpesvirus 1
ccucgaccaccauc

SEQ ID NO: 3954581 - RNA, 15 nt, Human herpesvirus 1
ccucgaccaccaucc

SEQ ID NO: 3954582 - RNA, 17 nt, Human herpesvirus 1
ccucgaccaccaucccc

SEQ ID NO: 3954583 - RNA, 18 nt, Human herpesvirus 1
ccucgaugacgucccggc

SEQ ID NO: 3954584 - RNA, 13 nt, Human herpesvirus 1
ccucgcaccagcc

SEQ ID NO: 3954585 - RNA, 18 nt, Human herpesvirus 1
ccucgccccauacucccg

SEQ ID NO: 3954586 - RNA, 12 nt, Human herpesvirus 1
ccucgcgcggcg

SEQ ID NO: 3954587 - RNA, 19 nt, Human herpesvirus 1
ccucggacgccacaccauc

SEQ ID NO: 3954588 - RNA, 12 nt, Human herpesvirus 1
ccucggccagcu

SEQ ID NO: 3954589 - RNA, 16 nt, Human herpesvirus 1
ccucggcgggcacgcc

SEQ ID NO: 3954590 - RNA, 13 nt, Human herpesvirus 1
ccucguggccccg

SEQ ID NO: 3954591 - RNA, 15 nt, Human herpesvirus 1
ccucguuugccgcca

SEQ ID NO: 3954592 - RNA, 16 nt, Human herpesvirus 1
ccucucgcugcuggcg

SEQ ID NO: 3954593 - RNA, 22 nt, Human herpesvirus 1
ccucugggucugugccaccagc

SEQ ID NO: 3954594 - RNA, 21 nt, Human herpesvirus 1
ccucuucuccccuucccuccc

SEQ ID NO: 3954595 - RNA, 18 nt, Human herpesvirus 1
ccugaccaacgacggccc

SEQ ID NO: 3954596 - RNA, 16 nt, Human herpesvirus 1
ccugacgcgccuagcc

SEQ ID NO: 3954597 - RNA, 16 nt, Human herpesvirus 1
ccugaguugggaauaa

SEQ ID NO: 3954598 - RNA, 16 nt, Human herpesvirus 1
ccugaugcacgccccc

SEQ ID NO: 3954599 - RNA, 14 nt, Human herpesvirus 1
ccugauguggcugc

SEQ ID NO: 3954600 - RNA, 18 nt, Human herpesvirus 1
ccugccacuccggcgccg

SEQ ID NO: 3954601 - RNA, 18 nt, Human herpesvirus 1
ccugccccccccacccca

SEQ ID NO: 3954602 - RNA, 20 nt, Human herpesvirus 1
ccugccccccccaccccaga

SEQ ID NO: 3954603 - RNA, 23 nt, Human herpesvirus 1
ccugcgcgacgcccuccaucgga

SEQ ID NO: 3954604 - RNA, 14 nt, Human herpesvirus 1
ccugcgcuucgccg

SEQ ID NO: 3954605 - RNA, 23 nt, Human herpesvirus 1
ccugcgggacaucaaggcggaga

SEQ ID NO: 3954606 - RNA, 13 nt, Human herpesvirus 1
ccuggaccagcug

SEQ ID NO: 3954607 - RNA, 13 nt, Human herpesvirus 1
ccuggacgcggca

SEQ ID NO: 3954608 - RNA, 15 nt, Human herpesvirus 1
ccuggagcaccgagc

SEQ ID NO: 3954609 - RNA, 21 nt, Human herpesvirus 1
ccuggagcucaaucuggccca

SEQ ID NO: 3954610 - RNA, 17 nt, Human herpesvirus 1
ccuggccaaugggggcu

SEQ ID NO: 3954611 - RNA, 19 nt, Human herpesvirus 1
ccuggccgugguccucgag

SEQ ID NO: 3954612 - RNA, 18 nt, Human herpesvirus 1
ccuggcgagcccagaccc

SEQ ID NO: 3954613 - RNA, 22 nt, Human herpesvirus 1
ccuggcgccaaagcugcuggcg

SEQ ID NO: 3954614 - RNA, 19 nt, Human herpesvirus 1
ccuggcgguccagggggau

SEQ ID NO: 3954615 - RNA, 14 nt, Human herpesvirus 1
ccuggcugacccac

SEQ ID NO: 3954616 - RNA, 18 nt, Human herpesvirus 1
ccugggauccgaccccca

SEQ ID NO: 3954617 - RNA, 20 nt, Human herpesvirus 1
ccugggccaccugacgcgcc

SEQ ID NO: 3954618 - RNA, 14 nt, Human herpesvirus 1
ccugggcccuggcc

SEQ ID NO: 3954619 - RNA, 11 nt, Human herpesvirus 1
ccuggggcgcg

SEQ ID NO: 3954620 - RNA, 20 nt, Human herpesvirus 1
ccugggggacugcaucggca

SEQ ID NO: 3954621 - RNA, 18 nt, Human herpesvirus 1
ccuggucagaggcccacg

SEQ ID NO: 3954622 - RNA, 19 nt, Human herpesvirus 1
ccugguuguccguggcccc

SEQ ID NO: 3954623 - RNA, 20 nt, Human herpesvirus 1
ccugucuuggggcccaccca

SEQ ID NO: 3954624 - RNA, 14 nt, Human herpesvirus 1
ccugugcuuucugg

SEQ ID NO: 3954625 - RNA, 19 nt, Human herpesvirus 1
ccugugugucguauguuua

SEQ ID NO: 3954626 - RNA, 21 nt, Human herpesvirus 1
ccugugugucguauguuuaug

SEQ ID NO: 3954627 - RNA, 20 nt, Human herpesvirus 1
ccugugugucuucucuucgu

SEQ ID NO: 3954628 - RNA, 14 nt, Human herpesvirus 1
ccuucccgcuuccg

SEQ ID NO: 3954629 - RNA, 15 nt, Human herpesvirus 1
ccuucccucccccuc

SEQ ID NO: 3954630 - RNA, 18 nt, Human herpesvirus 1
ccuuccuaacccagaccc

SEQ ID NO: 3954631 - RNA, 20 nt, Human herpesvirus 1
ccuucgccccacacagcccu

SEQ ID NO: 3954632 - RNA, 17 nt, Human herpesvirus 1
ccuugccccggccggau

SEQ ID NO: 3954633 - RNA, 21 nt, Human herpesvirus 1
ccuugggcccgggggccuggu

SEQ ID NO: 3954634 - RNA, 17 nt, Human herpesvirus 1
ccuuguuccgcuucccg

SEQ ID NO: 3954635 - RNA, 14 nt, Human herpesvirus 1
ccuuuccgcccgcc

SEQ ID NO: 3954636 - RNA, 20 nt, Human herpesvirus 1
ccuuugcgcucccgccuucc

SEQ ID NO: 3954637 - RNA, 20 nt, Human herpesvirus 1
ccuuuuggguuucacugaaa

SEQ ID NO: 3954638 - RNA, 22 nt, Human herpesvirus 1
cgaagccccggcccugaugcag

SEQ ID NO: 3954639 - RNA, 22 nt, Human herpesvirus 1
cgaagcugcucucgcacucgag

SEQ ID NO: 3954640 - RNA, 20 nt, Human herpesvirus 1
cgacaacgcgggcguucccg

SEQ ID NO: 3954641 - RNA, 17 nt, Human herpesvirus 1
cgacacgcucgccgagc

SEQ ID NO: 3954642 - RNA, 20 nt, Human herpesvirus 1
cgacacggucauccacgccg

SEQ ID NO: 3954643 - RNA, 20 nt, Human herpesvirus 1
cgacagcggauggcacgagu

SEQ ID NO: 3954644 - RNA, 13 nt, Human herpesvirus 1
cgacaucuugucg

SEQ ID NO: 3954645 - RNA, 19 nt, Human herpesvirus 1
cgaccaacuaccccgauca

SEQ ID NO: 3954646 - RNA, 17 nt, Human herpesvirus 1
cgaccacgcccuucccc

SEQ ID NO: 3954647 - RNA, 16 nt, Human herpesvirus 1
cgaccacgggcuguca

SEQ ID NO: 3954648 - RNA, 13 nt, Human herpesvirus 1
cgaccaucacccg

SEQ ID NO: 3954649 - RNA, 20 nt, Human herpesvirus 1
cgacccuguuggucggggag

SEQ ID NO: 3954650 - RNA, 17 nt, Human herpesvirus 1
cgaccgcagucccugag

SEQ ID NO: 3954651 - RNA, 21 nt, Human herpesvirus 1
cgaccgccaacaauccccagg

SEQ ID NO: 3954652 - RNA, 21 nt, Human herpesvirus 1
cgaccggacccgcaucccccg

SEQ ID NO: 3954653 - RNA, 16 nt, Human herpesvirus 1
cgaccggguucccccg

SEQ ID NO: 3954654 - RNA, 16 nt, Human herpesvirus 1
cgaccucaacaucacc

SEQ ID NO: 3954655 - RNA, 22 nt, Human herpesvirus 1
cgaccucuccacaccugcacca

SEQ ID NO: 3954656 - RNA, 12 nt, Human herpesvirus 1
cgagaaggacaa

SEQ ID NO: 3954657 - RNA, 12 nt, Human herpesvirus 1
cgagcagagccg

SEQ ID NO: 3954658 - RNA, 19 nt, Human herpesvirus 1
cgagccaagggcuccugua

SEQ ID NO: 3954659 - RNA, 14 nt, Human herpesvirus 1
cgagcgccagcgcu

SEQ ID NO: 3954660 - RNA, 14 nt, Human herpesvirus 1
cgagcucccagaga

SEQ ID NO: 3954661 - RNA, 18 nt, Human herpesvirus 1
cgagcucccagagacccc

SEQ ID NO: 3954662 - RNA, 17 nt, Human herpesvirus 1
cgagcugacccugugga

SEQ ID NO: 3954663 - RNA, 20 nt, Human herpesvirus 1
cgaggaccacgugcacagcc

SEQ ID NO: 3954664 - RNA, 12 nt, Human herpesvirus 1
cgaggagcccgc

SEQ ID NO: 3954665 - RNA, 16 nt, Human herpesvirus 1
cgaggagggguuuggg

SEQ ID NO: 3954666 - RNA, 19 nt, Human herpesvirus 1
cgaggcgauuagccagcag

SEQ ID NO: 3954667 - RNA, 15 nt, Human herpesvirus 1
cgagggccgggcccc

SEQ ID NO: 3954668 - RNA, 23 nt, Human herpesvirus 1
cgagggcgcuuggucgggaggcc

SEQ ID NO: 3954669 - RNA, 22 nt, Human herpesvirus 1
cgaggggaugggcgaccugggg

SEQ ID NO: 3954670 - RNA, 14 nt, Human herpesvirus 1
cgaggggcagcugg

SEQ ID NO: 3954671 - RNA, 22 nt, Human herpesvirus 1
cgaggucaaaugccgggccaag

SEQ ID NO: 3954672 - RNA, 18 nt, Human herpesvirus 1
cgaggugcgccaggucgg

SEQ ID NO: 3954673 - RNA, 23 nt, Human herpesvirus 1
cgaggugcgguuggggaggcugu

SEQ ID NO: 3954674 - RNA, 16 nt, Human herpesvirus 1
cgagucuucggggccc

SEQ ID NO: 3954675 - RNA, 16 nt, Human herpesvirus 1
cgaucccaacuccuca

SEQ ID NO: 3954676 - RNA, 12 nt, Human herpesvirus 1
cgauuggcaaug

SEQ ID NO: 3954677 - RNA, 16 nt, Human herpesvirus 1
cgcaacaaccuggaga

SEQ ID NO: 3954678 - RNA, 14 nt, Human herpesvirus 1
cgcaacggggcgcc

SEQ ID NO: 3954679 - RNA, 21 nt, Human herpesvirus 1
cgcaauuugcacccagccuuu

SEQ ID NO: 3954680 - RNA, 17 nt, Human herpesvirus 1
cgcacauccucacccuc

SEQ ID NO: 3954681 - RNA, 13 nt, Human herpesvirus 1
cgcaccagcccuu

SEQ ID NO: 3954682 - RNA, 15 nt, Human herpesvirus 1
cgcaccgaggggcca

SEQ ID NO: 3954683 - RNA, 14 nt, Human herpesvirus 1
cgcaccgggccccc

SEQ ID NO: 3954684 - RNA, 19 nt, Human herpesvirus 1
cgcaccgucggaggccccc

SEQ ID NO: 3954685 - RNA, 20 nt, Human herpesvirus 1
cgcguccggggagggcgagg

SEQ ID NO: 3954686 - RNA, 16 nt, Human herpesvirus 1
cgcgucuggccccggc

SEQ ID NO: 3954687 - RNA, 15 nt, Human herpesvirus 1
cgcgugaccccaggg

SEQ ID NO: 3954688 - RNA, 18 nt, Human herpesvirus 1
cgcgugcugcgccuuggg

SEQ ID NO: 3954689 - RNA, 16 nt, Human herpesvirus 1
cgcuaaucccccggcu

SEQ ID NO: 3954690 - RNA, 15 nt, Human herpesvirus 1
cgcucaaccaccgcu

SEQ ID NO: 3954691 - RNA, 16 nt, Human herpesvirus 1
cgcucccucgaccacc

SEQ ID NO: 3954692 - RNA, 19 nt, Human herpesvirus 1
cgcucgguguacccguacg

SEQ ID NO: 3954693 - RNA, 16 nt, Human herpesvirus 1
cgcucgucgccuggcu

SEQ ID NO: 3954694 - RNA, 23 nt, Human herpesvirus 1
cgcucuugggguugacgcugggg

SEQ ID NO: 3954695 - RNA, 16 nt, Human herpesvirus 1
cgcugacccccaccgc

SEQ ID NO: 3954696 - RNA, 20 nt, Human herpesvirus 1
cgcuggggcccccagggucc

SEQ ID NO: 3954697 - RNA, 23 nt, Human herpesvirus 1
cgcuggguggucucuggccgcgc

SEQ ID NO: 3954698 - RNA, 22 nt, Human herpesvirus 1
cggaacgcaccgaggggccaag

SEQ ID NO: 3954699 - RNA, 15 nt, Human herpesvirus 1
cggaacgggaggcca

SEQ ID NO: 3954700 - RNA, 11 nt, Human herpesvirus 1
cggaagcccaa

SEQ ID NO: 3954701 - RNA, 21 nt, Human herpesvirus 1
cggacagccauauccugagcc

SEQ ID NO: 3954702 - RNA, 16 nt, Human herpesvirus 1
cggaccaccgcccccc

SEQ ID NO: 3954703 - RNA, 23 nt, Human herpesvirus 1
cggaccaccgccccccuguuccc

SEQ ID NO: 3954704 - RNA, 21 nt, Human herpesvirus 1
cggacccccggaggcgccugc

SEQ ID NO: 3954705 - RNA, 20 nt, Human herpesvirus 1
cggacccguuccagcccccc

SEQ ID NO: 3954706 - RNA, 16 nt, Human herpesvirus 1
cggacgacggcggcga

SEQ ID NO: 3954707 - RNA, 13 nt, Human herpesvirus 1
cggacgccacacc

SEQ ID NO: 3954708 - RNA, 15 nt, Human herpesvirus 1
cggagcgggggggcg

SEQ ID NO: 3954709 - RNA, 24 nt, Human herpesvirus 1
cggaggauuacuuuaagcgcugcu

SEQ ID NO: 3954710 - RNA, 23 nt, Human herpesvirus 1
cggaguccugucccugcgucgcc

SEQ ID NO: 3954711 - RNA, 23 nt, Human herpesvirus 1
cggaucugcuccgcaacggggcg

SEQ ID NO: 3954712 - RNA, 16 nt, Human herpesvirus 1
cggcaagacccgggcg

SEQ ID NO: 3954713 - RNA, 20 nt, Human herpesvirus 1
cggcagcaugggacccacag

SEQ ID NO: 3954714 - RNA, 15 nt, Human herpesvirus 1
cggcaugccucugcg

SEQ ID NO: 3954715 - RNA, 16 nt, Human herpesvirus 1
cggccaacgaggacca

SEQ ID NO: 3954716 - RNA, 21 nt, Human herpesvirus 1
cggccaacgccgcgacccgca

SEQ ID NO: 3954717 - RNA, 20 nt, Human herpesvirus 1
cggccacgcaaaaccaggcc

SEQ ID NO: 3954718 - RNA, 20 nt, Human herpesvirus 1
cggccacgggcugcguguca

SEQ ID NO: 3954719 - RNA, 19 nt, Human herpesvirus 1
cggccacuggccgggagca

SEQ ID NO: 3954720 - RNA, 13 nt, Human herpesvirus 1
cggccccagcccu

SEQ ID NO: 3954721 - RNA, 18 nt, Human herpesvirus 1
cggccccagcccucuccc

SEQ ID NO: 3954722 - RNA, 17 nt, Human herpesvirus 1
cggcccccgaggccagc

SEQ ID NO: 3954723 - RNA, 18 nt, Human herpesvirus 1
cggccccggcaccacggg

SEQ ID NO: 3954724 - RNA, 16 nt, Human herpesvirus 1
cggcccgggggacuca

SEQ ID NO: 3954725 - RNA, 16 nt, Human herpesvirus 1
cggccgccaccauccu

SEQ ID NO: 3954726 - RNA, 13 nt, Human herpesvirus 1
cggccgccgcgga

SEQ ID NO: 3954727 - RNA, 18 nt, Human herpesvirus 1
cggccggauucccgggcc

SEQ ID NO: 3954728 - RNA, 13 nt, Human herpesvirus 1
cggccuccgcgua

SEQ ID NO: 3954729 - RNA, 15 nt, Human herpesvirus 1
cggccucuccggccu

SEQ ID NO: 3954730 - RNA, 13 nt, Human herpesvirus 1
cggccugcuggac

SEQ ID NO: 3954731 - RNA, 20 nt, Human herpesvirus 1
cggccugggucuuccgcgga

SEQ ID NO: 3954732 - RNA, 19 nt, Human herpesvirus 1
cggccuguuugagcagaag

SEQ ID NO: 3954733 - RNA, 10 nt, Human herpesvirus 1
cggcgcggcc

SEQ ID NO: 3954734 - RNA, 16 nt, Human herpesvirus 1
cggcggacccccggag

SEQ ID NO: 3954735 - RNA, 20 nt, Human herpesvirus 1
cggcggcgaggccggcgccg

SEQ ID NO: 3954736 - RNA, 20 nt, Human herpesvirus 1
cggcgggcacgccaagcccc

SEQ ID NO: 3954737 - RNA, 13 nt, Human herpesvirus 1
cggcggggccuca

SEQ ID NO: 3954738 - RNA, 13 nt, Human herpesvirus 1
cggcgucugggcc

SEQ ID NO: 3954739 - RNA, 14 nt, Human herpesvirus 1
cggcgucugggcca

SEQ ID NO: 3954740 - RNA, 13 nt, Human herpesvirus 1
cggcucaacgagc

SEQ ID NO: 3954741 - RNA, 22 nt, Human herpesvirus 1
cggcucuccgaucccaacuccu

SEQ ID NO: 3954742 - RNA, 15 nt, Human herpesvirus 1
cggcugguccacacc

SEQ ID NO: 3954743 - RNA, 18 nt, Human herpesvirus 1
cggcugguccacacccag

SEQ ID NO: 3954744 - RNA, 23 nt, Human herpesvirus 1
cggcugguccacacccaguggcu

SEQ ID NO: 3954745 - RNA, 14 nt, Human herpesvirus 1
cgggaccugaaccc

SEQ ID NO: 3954746 - RNA, 20 nt, Human herpesvirus 1
cgggagccccggucuccccg

SEQ ID NO: 3954747 - RNA, 12 nt, Human herpesvirus 1
cgggaggaagcc

SEQ ID NO: 3954748 - RNA, 15 nt, Human herpesvirus 1
cgggaggauguguuu

SEQ ID NO: 3954749 - RNA, 21 nt, Human herpesvirus 1
cgggaggccgcaucgaacgca

SEQ ID NO: 3954750 - RNA, 21 nt, Human herpesvirus 1
cgggccacgccacccugcgcg

SEQ ID NO: 3954751 - RNA, 17 nt, Human herpesvirus 1
cgggcccccggccgccg

SEQ ID NO: 3954752 - RNA, 19 nt, Human herpesvirus 1
cgggccccggggagacagc

SEQ ID NO: 3954753 - RNA, 21 nt, Human herpesvirus 1
cgggccccggggagacagcgc

SEQ ID NO: 3954754 - RNA, 23 nt, Human herpesvirus 1
cgggcgacgcacacacccuagcg

SEQ ID NO: 3954755 - RNA, 11 nt, Human herpesvirus 1
cgggcgcggcg

SEQ ID NO: 3954756 - RNA, 12 nt, Human herpesvirus 1
cgggcgcugggu

SEQ ID NO: 3954757 - RNA, 14 nt, Human herpesvirus 1
cgggcggccacccc

SEQ ID NO: 3954758 - RNA, 12 nt, Human herpesvirus 1
cgggcguccgcc

SEQ ID NO: 3954759 - RNA, 18 nt, Human herpesvirus 1
cgggcuguuccgccaggc

SEQ ID NO: 3954760 - RNA, 22 nt, Human herpesvirus 1
cgggcuguuccgccaggcgguc

SEQ ID NO: 3954761 - RNA, 21 nt, Human herpesvirus 1
cggggacggggaggcgggccc

SEQ ID NO: 3954762 - RNA, 14 nt, Human herpesvirus 1
cggggagggcaggg

SEQ ID NO: 3954763 - RNA, 24 nt, Human herpesvirus 1
cggggaucugguccgccgcgagcc

SEQ ID NO: 3954764 - RNA, 15 nt, Human herpesvirus 1
cggggcccggcccau

SEQ ID NO: 3954765 - RNA, 19 nt, Human herpesvirus 1
cggggcccggcccugcugc

SEQ ID NO: 3954766 - RNA, 22 nt, Human herpesvirus 1
cggggcggggguguccgggggc

SEQ ID NO: 3954767 - RNA, 13 nt, Human herpesvirus 1
cggggcucagcca

SEQ ID NO: 3954768 - RNA, 19 nt, Human herpesvirus 1
cggggcuguacucgaccca

SEQ ID NO: 3954769 - RNA, 16 nt, Human herpesvirus 1
cgggggauggggagag

SEQ ID NO: 3954770 - RNA, 14 nt, Human herpesvirus 1
cgggggccuggugg

SEQ ID NO: 3954771 - RNA, 19 nt, Human herpesvirus 1
cgggguuacgcgggccccg

SEQ ID NO: 3954772 - RNA, 22 nt, Human herpesvirus 1
cgggucuuuuguguuggcccua

SEQ ID NO: 3954773 - RNA, 18 nt, Human herpesvirus 1
cgggugcuucccacgcga

SEQ ID NO: 3954774 - RNA, 18 nt, Human herpesvirus 1
cggguuccgcgaccaccc

SEQ ID NO: 3954775 - RNA, 21 nt, Human herpesvirus 1
cggucagcgacguccugggcc

SEQ ID NO: 3954776 - RNA, 22 nt, Human herpesvirus 1
cggucagcgagacgaccucccc

SEQ ID NO: 3954777 - RNA, 21 nt, Human herpesvirus 1
cggucauccacgccgacgcca

SEQ ID NO: 3954778 - RNA, 13 nt, Human herpesvirus 1
cgguccacggcca

SEQ ID NO: 3954779 - RNA, 16 nt, Human herpesvirus 1
cgguccccucugggcc

SEQ ID NO: 3954780 - RNA, 20 nt, Human herpesvirus 1
cgguccggagccgcgcggcc

SEQ ID NO: 3954781 - RNA, 22 nt, Human herpesvirus 1
cgguccggagccgcgcggccac

SEQ ID NO: 3954782 - RNA, 18 nt, Human herpesvirus 1
cggucgccccgacccccu

SEQ ID NO: 3954783 - RNA, 18 nt, Human herpesvirus 1
cggucucccagggagccc

SEQ ID NO: 3954784 - RNA, 18 nt, Human herpesvirus 1
cggugaacgaagcggcca

SEQ ID NO: 3954785 - RNA, 21 nt, Human herpesvirus 1
cggugaacgaagcggccaugg

SEQ ID NO: 3954786 - RNA, 14 nt, Human herpesvirus 1
cggugaccgcgugc

SEQ ID NO: 3954787 - RNA, 17 nt, Human herpesvirus 1
cggugcgucugggcccg

SEQ ID NO: 3954788 - RNA, 17 nt, Human herpesvirus 1
cggugcuccgccgcgga

SEQ ID NO: 3954789 - RNA, 13 nt, Human herpesvirus 1
cgguggacagcca

SEQ ID NO: 3954790 - RNA, 21 nt, Human herpesvirus 1
cggugguccgccuagccgcag

SEQ ID NO: 3954791 - RNA, 13 nt, Human herpesvirus 1
cgguucgccgcca

SEQ ID NO: 3954792 - RNA, 21 nt, Human herpesvirus 1
cgguuuccuuugcgcucccgc

SEQ ID NO: 3954793 - RNA, 21 nt, Human herpesvirus 1
cguacaaguucaaggccacca

SEQ ID NO: 3954794 - RNA, 15 nt, Human herpesvirus 1
cguacgcaugggccg

SEQ ID NO: 3954795 - RNA, 15 nt, Human herpesvirus 1
cguaucugacggccg

SEQ ID NO: 3954796 - RNA, 14 nt, Human herpesvirus 1
cgucaccaugcagc

SEQ ID NO: 3954797 - RNA, 18 nt, Human herpesvirus 1
cgucagccugccucuccc

SEQ ID NO: 3954798 - RNA, 14 nt, Human herpesvirus 1
cguccaccaaaguc

SEQ ID NO: 3954799 - RNA, 23 nt, Human herpesvirus 1
cucugugucagguggcccuuccu

SEQ ID NO: 3954800 - RNA, 13 nt, Human herpesvirus 1
cucuuccccccca

SEQ ID NO: 3954801 - RNA, 16 nt, Human herpesvirus 1
cucuuggaggaccccg

SEQ ID NO: 3954802 - RNA, 18 nt, Human herpesvirus 1
cugaaccccagccccaga

SEQ ID NO: 3954803 - RNA, 23 nt, Human herpesvirus 1
cugacccucuccgggaugggcua

SEQ ID NO: 3954804 - RNA, 14 nt, Human herpesvirus 1
cugacgccucaggg

SEQ ID NO: 3954805 - RNA, 17 nt, Human herpesvirus 1
cugacgccucagggccu

SEQ ID NO: 3954806 - RNA, 21 nt, Human herpesvirus 1
cugagacaagagcgcuccccc

SEQ ID NO: 3954807 - RNA, 21 nt, Human herpesvirus 1
cugagccgcgccgacaucacc

SEQ ID NO: 3954808 - RNA, 20 nt, Human herpesvirus 1
cugagcgcccuccugaccaa

SEQ ID NO: 3954809 - RNA, 16 nt, Human herpesvirus 1
cugauguggcugcucc

SEQ ID NO: 3954810 - RNA, 23 nt, Human herpesvirus 1
cugcaagaggucgucgggggacg

SEQ ID NO: 3954811 - RNA, 18 nt, Human herpesvirus 1
cugcaccgguucucccug

SEQ ID NO: 3954812 - RNA, 13 nt, Human herpesvirus 1
cugccagaccuca

SEQ ID NO: 3954813 - RNA, 21 nt, Human herpesvirus 1
cugccagcuaugggcccugcu

SEQ ID NO: 3954814 - RNA, 15 nt, Human herpesvirus 1
cugccccccccaccc

SEQ ID NO: 3954815 - RNA, 16 nt, Human herpesvirus 1
cugccccgccacccag

SEQ ID NO: 3954816 - RNA, 17 nt, Human herpesvirus 1
cugcccgucgcgcgugu

SEQ ID NO: 3954817 - RNA, 16 nt, Human herpesvirus 1
cugccgucgcuagacc

SEQ ID NO: 3954818 - RNA, 18 nt, Human herpesvirus 1
cugccgucgcuagaccac

SEQ ID NO: 3954819 - RNA, 16 nt, Human herpesvirus 1
cugcgcgacgcccucc

SEQ ID NO: 3954820 - RNA, 10 nt, Human herpesvirus 1
cugcgcggcg

SEQ ID NO: 3954821 - RNA, 21 nt, Human herpesvirus 1
cugcggccacacagccggcca

SEQ ID NO: 3954822 - RNA, 22 nt, Human herpesvirus 1
cugcggcucaacgagcuccugg

SEQ ID NO: 3954823 - RNA, 23 nt, Human herpesvirus 1
cugcggcucaacgagcuccuggc

SEQ ID NO: 3954824 - RNA, 15 nt, Human herpesvirus 1
cugcuccgccuggcc

SEQ ID NO: 3954825 - RNA, 20 nt, Human herpesvirus 1
cugcuccgcuaaaagaccgc

SEQ ID NO: 3954826 - RNA, 18 nt, Human herpesvirus 1
cugcugcaggccccccgc

SEQ ID NO: 3954827 - RNA, 15 nt, Human herpesvirus 1
cugcugcggccaguc

SEQ ID NO: 3954828 - RNA, 13 nt, Human herpesvirus 1
cugcugggccaug

SEQ ID NO: 3954829 - RNA, 17 nt, Human herpesvirus 1
cugcuuauucucgggga

SEQ ID NO: 3954830 - RNA, 18 nt, Human herpesvirus 1
cuggacguccccgaggac

SEQ ID NO: 3954831 - RNA, 16 nt, Human herpesvirus 1
cuggacgugggccuca

SEQ ID NO: 3954832 - RNA, 15 nt, Human herpesvirus 1
cuggaugcgccgcca

SEQ ID NO: 3954833 - RNA, 14 nt, Human herpesvirus 1
cuggccgcgcccac

SEQ ID NO: 3954834 - RNA, 20 nt, Human herpesvirus 1
cuggcgcggugccugacgcc

SEQ ID NO: 3954835 - RNA, 19 nt, Human herpesvirus 1
cuggcguucgucgcccucc

SEQ ID NO: 3954836 - RNA, 20 nt, Human herpesvirus 1
cuggcguucgucgcccucca

SEQ ID NO: 3954837 - RNA, 13 nt, Human herpesvirus 1
cuggcuggccgcu

SEQ ID NO: 3954838 - RNA, 14 nt, Human herpesvirus 1
cugggaccccggcg

SEQ ID NO: 3954839 - RNA, 17 nt, Human herpesvirus 1
cugggaccccggcggcc

SEQ ID NO: 3954840 - RNA, 19 nt, Human herpesvirus 1
cugggcgagguggagcugc

SEQ ID NO: 3954841 - RNA, 20 nt, Human herpesvirus 1
cugggcuuccgacgcccccc

SEQ ID NO: 3954842 - RNA, 15 nt, Human herpesvirus 1
cuggggucgcggccg

SEQ ID NO: 3954843 - RNA, 22 nt, Human herpesvirus 1
cuggggucgcggccgcgaccca

SEQ ID NO: 3954844 - RNA, 17 nt, Human herpesvirus 1
cugggucugugccacca

SEQ ID NO: 3954845 - RNA, 20 nt, Human herpesvirus 1
cugggucugugccaccagcc

SEQ ID NO: 3954846 - RNA, 15 nt, Human herpesvirus 1
cuggguggucucugg

SEQ ID NO: 3954847 - RNA, 17 nt, Human herpesvirus 1
cuggguggucucuggcc

SEQ ID NO: 3954848 - RNA, 20 nt, Human herpesvirus 1
cuggguuggcgucgggacca

SEQ ID NO: 3954849 - RNA, 14 nt, Human herpesvirus 1
cuggguuuuccccu

SEQ ID NO: 3954850 - RNA, 16 nt, Human herpesvirus 1
cuggucagaggcccac

SEQ ID NO: 3954851 - RNA, 14 nt, Human herpesvirus 1
cugguccacaccca

SEQ ID NO: 3954852 - RNA, 16 nt, Human herpesvirus 1
cuggucgaggcggccg

SEQ ID NO: 3954853 - RNA, 22 nt, Human herpesvirus 1
cuggucgucgggcgccaaagcc

SEQ ID NO: 3954854 - RNA, 20 nt, Human herpesvirus 1
cuguacccgcuaaccaccaa

SEQ ID NO: 3954855 - RNA, 21 nt, Human herpesvirus 1
cuguaccggugggcguccugg

SEQ ID NO: 3954856 - RNA, 22 nt, Human herpesvirus 1
cuguaccggugggcguccugga

SEQ ID NO: 3954857 - RNA, 15 nt, Human herpesvirus 1
cuguaggucugggaa

SEQ ID NO: 3954858 - RNA, 15 nt, Human herpesvirus 1
cuguauagcccgggc

SEQ ID NO: 3954859 - RNA, 19 nt, Human herpesvirus 1
cugucucgucuccucuucu

SEQ ID NO: 3954860 - RNA, 14 nt, Human herpesvirus 1
cugugccaccagcc

SEQ ID NO: 3954861 - RNA, 19 nt, Human herpesvirus 1
cuguggccucaccugacca

SEQ ID NO: 3954862 - RNA, 13 nt, Human herpesvirus 1
cuguggcucuccu

SEQ ID NO: 3954863 - RNA, 20 nt, Human herpesvirus 1
cuguugguccuggccggccu

SEQ ID NO: 3954864 - RNA, 18 nt, Human herpesvirus 1
cuuaauaaauuuuacaaa

SEQ ID NO: 3954865 - RNA, 14 nt, Human herpesvirus 1
cuuaccgccacagg

SEQ ID NO: 3954866 - RNA, 22 nt, Human herpesvirus 1
cuuauccacaugaagccacugu

SEQ ID NO: 3954867 - RNA, 13 nt, Human herpesvirus 1
cuuccccgcuguc

SEQ ID NO: 3954868 - RNA, 23 nt, Human herpesvirus 1
cuucccucccccuccgcauccca

SEQ ID NO: 3954869 - RNA, 14 nt, Human herpesvirus 1
cuuccggccucgau

SEQ ID NO: 3954870 - RNA, 14 nt, Human herpesvirus 1
cuuccggccugggg

SEQ ID NO: 3954871 - RNA, 22 nt, Human herpesvirus 1
cuuccguccccugcccccccca

SEQ ID NO: 3954872 - RNA, 19 nt, Human herpesvirus 1
cuucgcgaacccccgucac

SEQ ID NO: 3954873 - RNA, 16 nt, Human herpesvirus 1
cuucgcgcccgggcgc

SEQ ID NO: 3954874 - RNA, 15 nt, Human herpesvirus 1
cuucgcuuugugggg

SEQ ID NO: 3954875 - RNA, 21 nt, Human herpesvirus 1
cuucggccccgcgucuggccc

SEQ ID NO: 3954876 - RNA, 14 nt, Human herpesvirus 1
cuucuccccuuccc

SEQ ID NO: 3954877 - RNA, 15 nt, Human herpesvirus 1
cuucuccccuucccu

SEQ ID NO: 3954878 - RNA, 21 nt, Human herpesvirus 1
cuugaagaucgccggguggca

SEQ ID NO: 3954879 - RNA, 17 nt, Human herpesvirus 1
cuugcgcaccuggugau

SEQ ID NO: 3954880 - RNA, 21 nt, Human herpesvirus 1
cuuggagccagcccgcccuca

SEQ ID NO: 3954881 - RNA, 19 nt, Human herpesvirus 1
cuugggcccgggggccugg

SEQ ID NO: 3954882 - RNA, 17 nt, Human herpesvirus 1
cuugguucggggccgcc

SEQ ID NO: 3954883 - RNA, 17 nt, Human herpesvirus 1
cuuuaagcgcugcugcg

SEQ ID NO: 3954884 - RNA, 17 nt, Human herpesvirus 1
gaaauagcaacaaggcc

SEQ ID NO: 3954885 - RNA, 19 nt, Human herpesvirus 1
gaaaugcccccccccccuu

SEQ ID NO: 3954886 - RNA, 23 nt, Human herpesvirus 1
gaaccguggucgaggugucucgc

SEQ ID NO: 3954887 - RNA, 14 nt, Human herpesvirus 1
gaacgcagccccgc

SEQ ID NO: 3954888 - RNA, 22 nt, Human herpesvirus 1
gaacgccuccgcccgugcugcc

SEQ ID NO: 3954889 - RNA, 18 nt, Human herpesvirus 1
gaagaacagaaaaccgaa

SEQ ID NO: 3954890 - RNA, 15 nt, Human herpesvirus 1
gaagacaccccccac

SEQ ID NO: 3954891 - RNA, 20 nt, Human herpesvirus 1
gaagaucgccggguggcacg

SEQ ID NO: 3954892 - RNA, 20 nt, Human herpesvirus 1
gaagcccaacccacacgcac

SEQ ID NO: 3954893 - RNA, 12 nt, Human herpesvirus 1
gaagcugauguc

SEQ ID NO: 3954894 - RNA, 22 nt, Human herpesvirus 1
gaaggagacaauaccggaagga

SEQ ID NO: 3954895 - RNA, 17 nt, Human herpesvirus 1
gaaugugugcggagguc

SEQ ID NO: 3954896 - RNA, 21 nt, Human herpesvirus 1
gacaaccccggucucccaggg

SEQ ID NO: 3954897 - RNA, 19 nt, Human herpesvirus 1
gacaauaccggaaggaacc

SEQ ID NO: 3954898 - RNA, 18 nt, Human herpesvirus 1
gacacaaaugcccacggg

SEQ ID NO: 3954899 - RNA, 15 nt, Human herpesvirus 1
gacacgcgcguccuu

SEQ ID NO: 3954900 - RNA, 14 nt, Human herpesvirus 1
gacacgggcaccac

SEQ ID NO: 3954901 - RNA, 16 nt, Human herpesvirus 1
gacagcaaccagaagc

SEQ ID NO: 3954902 - RNA, 18 nt, Human herpesvirus 1
gacagcggauggcacgag

SEQ ID NO: 3954903 - RNA, 18 nt, Human herpesvirus 1
gaccacgugcacagccug

SEQ ID NO: 3954904 - RNA, 22 nt, Human herpesvirus 1
gaccagcugaccgacccuccgg

SEQ ID NO: 3954905 - RNA, 22 nt, Human herpesvirus 1
gaccccaucagccucgucccgc

SEQ ID NO: 3954906 - RNA, 14 nt, Human herpesvirus 1
gacccccccgacau

SEQ ID NO: 3954907 - RNA, 23 nt, Human herpesvirus 1
gacccccccucgcgccacacuca

SEQ ID NO: 3954908 - RNA, 21 nt, Human herpesvirus 1
gacccccuuguauguccccaa

SEQ ID NO: 3954909 - RNA, 22 nt, Human herpesvirus 1
gacccccuuguauguccccaaa

SEQ ID NO: 3954910 - RNA, 15 nt, Human herpesvirus 1
gacccgacucaccuc

SEQ ID NO: 3954911 - RNA, 17 nt, Human herpesvirus 1
gacccgcaacgcgcugg

SEQ ID NO: 3954912 - RNA, 19 nt, Human herpesvirus 1
gacccgcaucccccgucug

SEQ ID NO: 3954913 - RNA, 17 nt, Human herpesvirus 1
gcauggggggggggcgg

SEQ ID NO: 3954914 - RNA, 17 nt, Human herpesvirus 1
gccaaauuuauguguua

SEQ ID NO: 3954915 - RNA, 17 nt, Human herpesvirus 1
gccaacaauccccagga

SEQ ID NO: 3954916 - RNA, 19 nt, Human herpesvirus 1
gccaacgccgcgacccgca

SEQ ID NO: 3954917 - RNA, 17 nt, Human herpesvirus 1
gccaaguuggcccccgg

SEQ ID NO: 3954918 - RNA, 20 nt, Human herpesvirus 1
gccacccaggcgcugggcga

SEQ ID NO: 3954919 - RNA, 21 nt, Human herpesvirus 1
gccacccgaaccaccacugca

SEQ ID NO: 3954920 - RNA, 21 nt, Human herpesvirus 1
gccacccgacaacagcccccg

SEQ ID NO: 3954921 - RNA, 14 nt, Human herpesvirus 1
gccacgccagggcc

SEQ ID NO: 3954922 - RNA, 19 nt, Human herpesvirus 1
gccacuggccgggagcacc

SEQ ID NO: 3954923 - RNA, 20 nt, Human herpesvirus 1
gccacuggccgggagcacca

SEQ ID NO: 3954924 - RNA, 23 nt, Human herpesvirus 1
gccagccuguuuguccuggggau

SEQ ID NO: 3954925 - RNA, 16 nt, Human herpesvirus 1
gccagcgcggcggggc

SEQ ID NO: 3954926 - RNA, 13 nt, Human herpesvirus 1
gccagcuaugggc

SEQ ID NO: 3954927 - RNA, 16 nt, Human herpesvirus 1
gccagcuaugggcccu

SEQ ID NO: 3954928 - RNA, 22 nt, Human herpesvirus 1
gccagcuaugggcccugcuccg

SEQ ID NO: 3954929 - RNA, 16 nt, Human herpesvirus 1
gccaggaccgccugcc

SEQ ID NO: 3954930 - RNA, 17 nt, Human herpesvirus 1
gccagggcgcccccgcg

SEQ ID NO: 3954931 - RNA, 18 nt, Human herpesvirus 1
gccaggucggcgaccgcc

SEQ ID NO: 3954932 - RNA, 13 nt, Human herpesvirus 1
gccauccucacgc

SEQ ID NO: 3954933 - RNA, 19 nt, Human herpesvirus 1
gccaucugggauggcuccu

SEQ ID NO: 3954934 - RNA, 14 nt, Human herpesvirus 1
gccaugcgugccgu

SEQ ID NO: 3954935 - RNA, 24 nt, Human herpesvirus 1
gcccaacucucgcaccaucccggg

SEQ ID NO: 3954936 - RNA, 14 nt, Human herpesvirus 1
gcccaccgcugggc

SEQ ID NO: 3954937 - RNA, 15 nt, Human herpesvirus 1
gcccaccgcugggcg

SEQ ID NO: 3954938 - RNA, 15 nt, Human herpesvirus 1
gcccacgucgccccg

SEQ ID NO: 3954939 - RNA, 18 nt, Human herpesvirus 1
gcccacgucgccccgccg

SEQ ID NO: 3954940 - RNA, 15 nt, Human herpesvirus 1
gcccagacgcccucc

SEQ ID NO: 3954941 - RNA, 19 nt, Human herpesvirus 1
gcccaguaacaugcgcacg

SEQ ID NO: 3954942 - RNA, 21 nt, Human herpesvirus 1
gccccauacucccgccagcac

SEQ ID NO: 3954943 - RNA, 19 nt, Human herpesvirus 1
gccccccccaccccagacg

SEQ ID NO: 3954944 - RNA, 23 nt, Human herpesvirus 1
gcccccccccccuugcgggcggu

SEQ ID NO: 3954945 - RNA, 21 nt, Human herpesvirus 1
gccccccguguuuguggggag

SEQ ID NO: 3954946 - RNA, 13 nt, Human herpesvirus 1
gcccccgccccuc

SEQ ID NO: 3954947 - RNA, 23 nt, Human herpesvirus 1
gcccccuuuguccccgccgacaa

SEQ ID NO: 3954948 - RNA, 22 nt, Human herpesvirus 1
gccccgaacccugcgguccgga

SEQ ID NO: 3954949 - RNA, 13 nt, Human herpesvirus 1
gccccgacgcacc

SEQ ID NO: 3954950 - RNA, 23 nt, Human herpesvirus 1
gccccgauggcccuggacgcggc

SEQ ID NO: 3954951 - RNA, 21 nt, Human herpesvirus 1
gccccgcauaucccacccugg

SEQ ID NO: 3954952 - RNA, 17 nt, Human herpesvirus 1
gccccgcgucuggcccc

SEQ ID NO: 3954953 - RNA, 18 nt, Human herpesvirus 1
gccccggaccccacgcac

SEQ ID NO: 3954954 - RNA, 16 nt, Human herpesvirus 1
gccccgggacaccccc

SEQ ID NO: 3954955 - RNA, 17 nt, Human herpesvirus 1
gccccggucuccccggg

SEQ ID NO: 3954956 - RNA, 18 nt, Human herpesvirus 1
gccccgguguccgagccc

SEQ ID NO: 3954957 - RNA, 22 nt, Human herpesvirus 1
gccccguacaaguucaaggcca

SEQ ID NO: 3954958 - RNA, 23 nt, Human herpesvirus 1
gccccguacaaguucaaggccac

SEQ ID NO: 3954959 - RNA, 17 nt, Human herpesvirus 1
gcccgaagacacccccc

SEQ ID NO: 3954960 - RNA, 20 nt, Human herpesvirus 1
gcccgaccaacgucgccgcc

SEQ ID NO: 3954961 - RNA, 15 nt, Human herpesvirus 1
gcccgaccacacacc

SEQ ID NO: 3954962 - RNA, 24 nt, Human herpesvirus 1
gcccgccaucugggauggcuccug

SEQ ID NO: 3954963 - RNA, 13 nt, Human herpesvirus 1
gcccgcgaacggc

SEQ ID NO: 3954964 - RNA, 15 nt, Human herpesvirus 1
gcccgcguaaccccg

SEQ ID NO: 3954965 - RNA, 19 nt, Human herpesvirus 1
gcccgcguuuggccugcgg

SEQ ID NO: 3954966 - RNA, 20 nt, Human herpesvirus 1
gcccggcccauugggcggga

SEQ ID NO: 3954967 - RNA, 21 nt, Human herpesvirus 1
gcccgggcaaguaugcccccc

SEQ ID NO: 3954968 - RNA, 10 nt, Human herpesvirus 1
gcccggggcc

SEQ ID NO: 3954969 - RNA, 21 nt, Human herpesvirus 1
gcccgggggccugguggcacc

SEQ ID NO: 3954970 - RNA, 21 nt, Human herpesvirus 1
gcccggguauaaauuccggaa

SEQ ID NO: 3954971 - RNA, 14 nt, Human herpesvirus 1
gcccggguccccgc

SEQ ID NO: 3954972 - RNA, 18 nt, Human herpesvirus 1
gcccguugcagggccugg

SEQ ID NO: 3954973 - RNA, 23 nt, Human herpesvirus 1
gcccugguguuucuggggagcug

SEQ ID NO: 3954974 - RNA, 17 nt, Human herpesvirus 1
gccgacaucgacacggu

SEQ ID NO: 3954975 - RNA, 16 nt, Human herpesvirus 1
gccgagccccccgcug

SEQ ID NO: 3954976 - RNA, 22 nt, Human herpesvirus 1
gccgagccccccgcugcggcca

SEQ ID NO: 3954977 - RNA, 21 nt, Human herpesvirus 1
gccgaggcgauuagccagcag

SEQ ID NO: 3954978 - RNA, 23 nt, Human herpesvirus 1
gccgaggucccgugcaacccuua

SEQ ID NO: 3954979 - RNA, 21 nt, Human herpesvirus 1
gccgagucuucggggcccggc

SEQ ID NO: 3954980 - RNA, 16 nt, Human herpesvirus 1
gccgcaaaucccacca

SEQ ID NO: 3954981 - RNA, 16 nt, Human herpesvirus 1
gccgcaggacccagca

SEQ ID NO: 3954982 - RNA, 20 nt, Human herpesvirus 1
gccgcaguacuaccuggcca

SEQ ID NO: 3954983 - RNA, 23 nt, Human herpesvirus 1
gccgccaccauccucaagcaggc

SEQ ID NO: 3954984 - RNA, 19 nt, Human herpesvirus 1
gccgccaccguggccggcc

SEQ ID NO: 3954985 - RNA, 17 nt, Human herpesvirus 1
gccgccacgcgcccgag

SEQ ID NO: 3954986 - RNA, 20 nt, Human herpesvirus 1
gccgcccaacucucgcacca

SEQ ID NO: 3954987 - RNA, 15 nt, Human herpesvirus 1
gccgcccuagaggcu

SEQ ID NO: 3954988 - RNA, 15 nt, Human herpesvirus 1
gccgcgacccgcacg

SEQ ID NO: 3954989 - RNA, 14 nt, Human herpesvirus 1
gccgcgccccgccg

SEQ ID NO: 3954990 - RNA, 16 nt, Human herpesvirus 1
gccgcgccgcugcccg

SEQ ID NO: 3954991 - RNA, 16 nt, Human herpesvirus 1
gccgcgcgccgcgcgu

SEQ ID NO: 3954992 - RNA, 17 nt, Human herpesvirus 1
gccgcggaucugcuccg

SEQ ID NO: 3954993 - RNA, 13 nt, Human herpesvirus 1
gccgcggcucccg

SEQ ID NO: 3954994 - RNA, 21 nt, Human herpesvirus 1
gccgcgggcccccggccgccg

SEQ ID NO: 3954995 - RNA, 23 nt, Human herpesvirus 1
gccgcgguacagaucggcgccgc

SEQ ID NO: 3954996 - RNA, 18 nt, Human herpesvirus 1
gccggauucccgggccgg

SEQ ID NO: 3954997 - RNA, 13 nt, Human herpesvirus 1
gccggcggcgacg

SEQ ID NO: 3954998 - RNA, 16 nt, Human herpesvirus 1
gccgggaacgcuagcc

SEQ ID NO: 3954999 - RNA, 19 nt, Human herpesvirus 1
gccgggacuccgcggacgg

SEQ ID NO: 3955000 - RNA, 20 nt, Human herpesvirus 1
gccgggccgcccacuucccg

SEQ ID NO: 3955001 - RNA, 19 nt, Human herpesvirus 1
gccggggagggcagggccg

SEQ ID NO: 3955002 - RNA, 18 nt, Human herpesvirus 1
gccggguggcgccugugu

SEQ ID NO: 3955003 - RNA, 19 nt, Human herpesvirus 1
gccgguccgcugugccauc

SEQ ID NO: 3955004 - RNA, 17 nt, Human herpesvirus 1
gccggucgccgugcucc

SEQ ID NO: 3955005 - RNA, 24 nt, Human herpesvirus 1
gccggugguccgccuagccgcagc

SEQ ID NO: 3955006 - RNA, 16 nt, Human herpesvirus 1
gccgucgcuagaccac

SEQ ID NO: 3955007 - RNA, 16 nt, Human herpesvirus 1
gccgugguccugugga

SEQ ID NO: 3955008 - RNA, 13 nt, Human herpesvirus 1
gccguugucuccc

SEQ ID NO: 3955009 - RNA, 14 nt, Human herpesvirus 1
gccuaccagcaggg

SEQ ID NO: 3955010 - RNA, 19 nt, Human herpesvirus 1
gccucaacauaccccgcug

SEQ ID NO: 3955011 - RNA, 20 nt, Human herpesvirus 1
gccucacgaccgcauccacc

SEQ ID NO: 3955012 - RNA, 14 nt, Human herpesvirus 1
gccuccaccgggcc

SEQ ID NO: 3955013 - RNA, 19 nt, Human herpesvirus 1
gccuccaugggguccgcag

SEQ ID NO: 3955014 - RNA, 14 nt, Human herpesvirus 1
gccucccccugagc

SEQ ID NO: 3955015 - RNA, 17 nt, Human herpesvirus 1
gccucucgcugcuggcg

SEQ ID NO: 3955016 - RNA, 18 nt, Human herpesvirus 1
gccucugggguuugcccu

SEQ ID NO: 3955017 - RNA, 17 nt, Human herpesvirus 1
gccucugggucugugcc

SEQ ID NO: 3955018 - RNA, 20 nt, Human herpesvirus 1
gccucugggucugugccacc

SEQ ID NO: 3955019 - RNA, 14 nt, Human herpesvirus 1
gccugacgccugcc

SEQ ID NO: 3955020 - RNA, 23 nt, Human herpesvirus 1
gccugacgcgccgcgggcccccg

SEQ ID NO: 3955021 - RNA, 17 nt, Human herpesvirus 1
gccuggcauucgacgac

SEQ ID NO: 3955022 - RNA, 17 nt, Human herpesvirus 1
gccuggucagaggccca

SEQ ID NO: 3955023 - RNA, 18 nt, Human herpesvirus 1
gccugucgcacccacagc

SEQ ID NO: 3955024 - RNA, 18 nt, Human herpesvirus 1
gccugugugucuucucuu

SEQ ID NO: 3955025 - RNA, 15 nt, Human herpesvirus 1
gccuguuugagcaga

SEQ ID NO: 3955026 - RNA, 17 nt, Human herpesvirus 1
gccuuccggaccugcuc

SEQ ID NO: 3955027 - RNA, 19 nt, Human herpesvirus 1
gacccgacaggcgaccgcc

SEQ ID NO: 3955028 - RNA, 19 nt, Human herpesvirus 1
gacccgcaacgcgcugggg

SEQ ID NO: 3955029 - RNA, 23 nt, Human herpesvirus 1
gacccgcaacgcgcuggggcugc

SEQ ID NO: 3955030 - RNA, 13 nt, Human herpesvirus 1
gacccggcccgag

SEQ ID NO: 3955031 - RNA, 18 nt, Human herpesvirus 1
gacccggcccuaacccca

SEQ ID NO: 3955032 - RNA, 17 nt, Human herpesvirus 1
gacccguuccagccccc

SEQ ID NO: 3955033 - RNA, 12 nt, Human herpesvirus 1
gacccuccggga

SEQ ID NO: 3955034 - RNA, 22 nt, Human herpesvirus 1
gacccucucuucucucccgggc

SEQ ID NO: 3955035 - RNA, 14 nt, Human herpesvirus 1
gaccgcagucccug

SEQ ID NO: 3955036 - RNA, 17 nt, Human herpesvirus 1
gaccggcaagcggagcg

SEQ ID NO: 3955037 - RNA, 21 nt, Human herpesvirus 1
gaccguuuggggcgugucugu

SEQ ID NO: 3955038 - RNA, 13 nt, Human herpesvirus 1
gaccucaccacca

SEQ ID NO: 3955039 - RNA, 14 nt, Human herpesvirus 1
gaccucggcgccuc

SEQ ID NO: 3955040 - RNA, 21 nt, Human herpesvirus 1
gaccuggggucgcucugucca

SEQ ID NO: 3955041 - RNA, 21 nt, Human herpesvirus 1
gacgagacgaacucguggacg

SEQ ID NO: 3955042 - RNA, 14 nt, Human herpesvirus 1
gacgcacacacccu

SEQ ID NO: 3955043 - RNA, 15 nt, Human herpesvirus 1
gacgcccagcagcuc

SEQ ID NO: 3955044 - RNA, 15 nt, Human herpesvirus 1
gacgccccggccgcc

SEQ ID NO: 3955045 - RNA, 22 nt, Human herpesvirus 1
gacgcgccccaaggcgcugcgg

SEQ ID NO: 3955046 - RNA, 17 nt, Human herpesvirus 1
gacgcucccgucgcccg

SEQ ID NO: 3955047 - RNA, 20 nt, Human herpesvirus 1
gacgcucuggacgucuggga

SEQ ID NO: 3955048 - RNA, 21 nt, Human herpesvirus 1
gacgcugcuccgccuggccug

SEQ ID NO: 3955049 - RNA, 20 nt, Human herpesvirus 1
gacgcuggccgacguggcgc

SEQ ID NO: 3955050 - RNA, 11 nt, Human herpesvirus 1
gacgcuggggg

SEQ ID NO: 3955051 - RNA, 18 nt, Human herpesvirus 1
gacggacgugcgccugga

SEQ ID NO: 3955052 - RNA, 17 nt, Human herpesvirus 1
gacggccaacgaggacc

SEQ ID NO: 3955053 - RNA, 17 nt, Human herpesvirus 1
gacggcccgaagccugc

SEQ ID NO: 3955054 - RNA, 20 nt, Human herpesvirus 1
gacggcccuuacggaccaga

SEQ ID NO: 3955055 - RNA, 18 nt, Human herpesvirus 1
gacggugagcgaggacgg

SEQ ID NO: 3955056 - RNA, 13 nt, Human herpesvirus 1
gacgguggugccc

SEQ ID NO: 3955057 - RNA, 16 nt, Human herpesvirus 1
gacguccugggccacc

SEQ ID NO: 3955058 - RNA, 19 nt, Human herpesvirus 1
gacgucgagaaggacaaac

SEQ ID NO: 3955059 - RNA, 18 nt, Human herpesvirus 1
gacgucuccaagcuuucc

SEQ ID NO: 3955060 - RNA, 15 nt, Human herpesvirus 1
gacucucccaccgcc

SEQ ID NO: 3955061 - RNA, 13 nt, Human herpesvirus 1
gacucucccccac

SEQ ID NO: 3955062 - RNA, 19 nt, Human herpesvirus 1
gagaaccuagggaacccag

SEQ ID NO: 3955063 - RNA, 23 nt, Human herpesvirus 1
gagcaaaacgccucccccugagc

SEQ ID NO: 3955064 - RNA, 21 nt, Human herpesvirus 1
gagcagagccgcaagccccca

SEQ ID NO: 3955065 - RNA, 18 nt, Human herpesvirus 1
gagcaggcggucggcggc

SEQ ID NO: 3955066 - RNA, 22 nt, Human herpesvirus 1
gagccacccgacaacagccccc

SEQ ID NO: 3955067 - RNA, 21 nt, Human herpesvirus 1
gagccagacccaacccccggc

SEQ ID NO: 3955068 - RNA, 19 nt, Human herpesvirus 1
gagcccccgccccuccccc

SEQ ID NO: 3955069 - RNA, 18 nt, Human herpesvirus 1
gagccccggaccccacgc

SEQ ID NO: 3955070 - RNA, 21 nt, Human herpesvirus 1
gagccccucgcccguccucgc

SEQ ID NO: 3955071 - RNA, 12 nt, Human herpesvirus 1
gagcgacccgcg

SEQ ID NO: 3955072 - RNA, 11 nt, Human herpesvirus 1
gagcuaugggc

SEQ ID NO: 3955073 - RNA, 22 nt, Human herpesvirus 1
gagcucccagagaccccagggu

SEQ ID NO: 3955074 - RNA, 21 nt, Human herpesvirus 1
gaggacaccccucguggcccc

SEQ ID NO: 3955075 - RNA, 20 nt, Human herpesvirus 1
gaggacgucgagaaggacaa

SEQ ID NO: 3955076 - RNA, 18 nt, Human herpesvirus 1
gaggagcccgcccuucgc

SEQ ID NO: 3955077 - RNA, 21 nt, Human herpesvirus 1
gaggaggaagaggaggagggg

SEQ ID NO: 3955078 - RNA, 23 nt, Human herpesvirus 1
gaggagggggccggggacggcga

SEQ ID NO: 3955079 - RNA, 19 nt, Human herpesvirus 1
gaggccuuguuccgcuucc

SEQ ID NO: 3955080 - RNA, 17 nt, Human herpesvirus 1
gaggcgcgcgcaccucc

SEQ ID NO: 3955081 - RNA, 23 nt, Human herpesvirus 1
gagggcaacgcgggacuaugccg

SEQ ID NO: 3955082 - RNA, 23 nt, Human herpesvirus 1
gagggcguaacguuccgccugga

SEQ ID NO: 3955083 - RNA, 17 nt, Human herpesvirus 1
gaggggcugggggagcg

SEQ ID NO: 3955084 - RNA, 22 nt, Human herpesvirus 1
gagguggacgucggagacgagc

SEQ ID NO: 3955085 - RNA, 14 nt, Human herpesvirus 1
gaguacgaggaucu

SEQ ID NO: 3955086 - RNA, 15 nt, Human herpesvirus 1
gauagagcugcuccg

SEQ ID NO: 3955087 - RNA, 19 nt, Human herpesvirus 1
gaucacggagggaaccacc

SEQ ID NO: 3955088 - RNA, 14 nt, Human herpesvirus 1
gauccucggccagc

SEQ ID NO: 3955089 - RNA, 16 nt, Human herpesvirus 1
gauccucgggcuacug

SEQ ID NO: 3955090 - RNA, 13 nt, Human herpesvirus 1
gaucggcgccgcg

SEQ ID NO: 3955091 - RNA, 17 nt, Human herpesvirus 1
gaugcuguggacgacgg

SEQ ID NO: 3955092 - RNA, 17 nt, Human herpesvirus 1
gaugucggguccaaacu

SEQ ID NO: 3955093 - RNA, 23 nt, Human herpesvirus 1
gauuuggguugggguuucugugu

SEQ ID NO: 3955094 - RNA, 23 nt, Human herpesvirus 1
gcaaaacgccucccccugagccg

SEQ ID NO: 3955095 - RNA, 17 nt, Human herpesvirus 1
gcaaaucccaccaaacu

SEQ ID NO: 3955096 - RNA, 20 nt, Human herpesvirus 1
gcaacaaggccguggacggc

SEQ ID NO: 3955097 - RNA, 19 nt, Human herpesvirus 1
gcaacacaacacgguuccc

SEQ ID NO: 3955098 - RNA, 18 nt, Human herpesvirus 1
gcaaccagcugcacgacc

SEQ ID NO: 3955099 - RNA, 19 nt, Human herpesvirus 1
gcaaccccaugaaggcccu

SEQ ID NO: 3955100 - RNA, 20 nt, Human herpesvirus 1
gcacaaaaagaccccgaucc

SEQ ID NO: 3955101 - RNA, 13 nt, Human herpesvirus 1
gcaccacccccgc

SEQ ID NO: 3955102 - RNA, 13 nt, Human herpesvirus 1
gcaccaucccggg

SEQ ID NO: 3955103 - RNA, 15 nt, Human herpesvirus 1
gcacccacgcccgcg

SEQ ID NO: 3955104 - RNA, 19 nt, Human herpesvirus 1
gcaccccccucgucccccu

SEQ ID NO: 3955105 - RNA, 20 nt, Human herpesvirus 1
gcaccgcaccagcgcggagg

SEQ ID NO: 3955106 - RNA, 15 nt, Human herpesvirus 1
gcaccgggcccccgc

SEQ ID NO: 3955107 - RNA, 16 nt, Human herpesvirus 1
gcaccgguucucccug

SEQ ID NO: 3955108 - RNA, 20 nt, Human herpesvirus 1
gcaccuccuacgccggggcg

SEQ ID NO: 3955109 - RNA, 16 nt, Human herpesvirus 1
gcaccucgaggacacc

SEQ ID NO: 3955110 - RNA, 20 nt, Human herpesvirus 1
gcacgaguucaaccucgggu

SEQ ID NO: 3955111 - RNA, 20 nt, Human herpesvirus 1
gcacgcccccuacgaggacg

SEQ ID NO: 3955112 - RNA, 15 nt, Human herpesvirus 1
gcagaccuauguguu

SEQ ID NO: 3955113 - RNA, 15 nt, Human herpesvirus 1
gcagacgcacccgcu

SEQ ID NO: 3955114 - RNA, 21 nt, Human herpesvirus 1
gcagcccggaggcgcccgcgg

SEQ ID NO: 3955115 - RNA, 15 nt, Human herpesvirus 1
gcagccuucucccgg

SEQ ID NO: 3955116 - RNA, 16 nt, Human herpesvirus 1
gcagccuucucccggu

SEQ ID NO: 3955117 - RNA, 14 nt, Human herpesvirus 1
gcagcuccccauga

SEQ ID NO: 3955118 - RNA, 15 nt, Human herpesvirus 1
guucagggcgacgcc

SEQ ID NO: 3955119 - RNA, 22 nt, Human herpesvirus 1
guucccccggcacgccuggggu

SEQ ID NO: 3955120 - RNA, 13 nt, Human herpesvirus 1
guuccgccuggag

SEQ ID NO: 3955121 - RNA, 23 nt, Human herpesvirus 1
guuccggacgccuucgccccaca

SEQ ID NO: 3955122 - RNA, 16 nt, Human herpesvirus 1
guuccguuuuccggaa

SEQ ID NO: 3955123 - RNA, 13 nt, Human herpesvirus 1
guugggaugggac

SEQ ID NO: 3955124 - RNA, 13 nt, Human herpesvirus 1
guugguccagacg

SEQ ID NO: 3955125 - RNA, 13 nt, Human herpesvirus 1
guuguugcuggcg

SEQ ID NO: 3955126 - RNA, 23 nt, Human herpesvirus 1
guuucguuccuucccccuccccc

SEQ ID NO: 3955127 - RNA, 14 nt, Human herpesvirus 1
guuugguccccccu

SEQ ID NO: 3955128 - RNA, 14 nt, Human herpesvirus 1
guuuucucuucccg

SEQ ID NO: 3955129 - RNA, 13 nt, Human herpesvirus 1
uaaaagaccaaaa

SEQ ID NO: 3955130 - RNA, 15 nt, Human herpesvirus 1
uaaaagaccacacca

SEQ ID NO: 3955131 - RNA, 12 nt, Human herpesvirus 1
uaaaaggcauua

SEQ ID NO: 3955132 - RNA, 20 nt, Human herpesvirus 1
uaaaccagguaauaccaaau

SEQ ID NO: 3955133 - RNA, 18 nt, Human herpesvirus 1
uaaauuuuacaaacagau

SEQ ID NO: 3955134 - RNA, 22 nt, Human herpesvirus 1
uaacaaccacccgcacccccag

SEQ ID NO: 3955135 - RNA, 17 nt, Human herpesvirus 1
uaacuacauuaaauugg

SEQ ID NO: 3955136 - RNA, 13 nt, Human herpesvirus 1
uaagacucucccc

SEQ ID NO: 3955137 - RNA, 13 nt, Human herpesvirus 1
uaaugaccaccac

SEQ ID NO: 3955138 - RNA, 11 nt, Human herpesvirus 1
uacaaacagau

SEQ ID NO: 3955139 - RNA, 13 nt, Human herpesvirus 1
uacaaccugacca

SEQ ID NO: 3955140 - RNA, 14 nt, Human herpesvirus 1
uacacagccaccca

SEQ ID NO: 3955141 - RNA, 13 nt, Human herpesvirus 1
uacacgagcaccc

SEQ ID NO: 3955142 - RNA, 14 nt, Human herpesvirus 1
uacacgagcacccu

SEQ ID NO: 3955143 - RNA, 14 nt, Human herpesvirus 1
uacagcccccagau

SEQ ID NO: 3955144 - RNA, 21 nt, Human herpesvirus 1
uacauugaggcggaaaauccc

SEQ ID NO: 3955145 - RNA, 23 nt, Human herpesvirus 1
uaccacgcccgaccacacacccc

SEQ ID NO: 3955146 - RNA, 18 nt, Human herpesvirus 1
uaccgaaggcgcuucccc

SEQ ID NO: 3955147 - RNA, 22 nt, Human herpesvirus 1
uaccggacccguuccagccccc

SEQ ID NO: 3955148 - RNA, 15 nt, Human herpesvirus 1
uaccuuuuuaauauc

SEQ ID NO: 3955149 - RNA, 14 nt, Human herpesvirus 1
uacggaccgccucg

SEQ ID NO: 3955150 - RNA, 21 nt, Human herpesvirus 1
uacuacaacgggagucgccuc

SEQ ID NO: 3955151 - RNA, 18 nt, Human herpesvirus 1
uacuacucggaaagcgaa

SEQ ID NO: 3955152 - RNA, 16 nt, Human herpesvirus 1
uacugcggucugucuc

SEQ ID NO: 3955153 - RNA, 19 nt, Human herpesvirus 1
uagaaacucauuaaugggc

SEQ ID NO: 3955154 - RNA, 12 nt, Human herpesvirus 1
uagcgccccggc

SEQ ID NO: 3955155 - RNA, 16 nt, Human herpesvirus 1
uagcucgcggagggcg

SEQ ID NO: 3955156 - RNA, 14 nt, Human herpesvirus 1
uagggaacccagag

SEQ ID NO: 3955157 - RNA, 15 nt, Human herpesvirus 1
uauacacagauguca

SEQ ID NO: 3955158 - RNA, 18 nt, Human herpesvirus 1
uauagccuaugccacgcc

SEQ ID NO: 3955159 - RNA, 13 nt, Human herpesvirus 1
uauauccguguau

SEQ ID NO: 3955160 - RNA, 14 nt, Human herpesvirus 1
uaucccacccugga

SEQ ID NO: 3955161 - RNA, 13 nt, Human herpesvirus 1
uaucccacggccu

SEQ ID NO: 3955162 - RNA, 21 nt, Human herpesvirus 1
uauccgaucccaggcgccgac

SEQ ID NO: 3955163 - RNA, 12 nt, Human herpesvirus 1
uauccugagccc

SEQ ID NO: 3955164 - RNA, 12 nt, Human herpesvirus 1
uauuauuuaccu

SEQ ID NO: 3955165 - RNA, 12 nt, Human herpesvirus 1
uauuccugccga

SEQ ID NO: 3955166 - RNA, 15 nt, Human herpesvirus 1
ucaacauaccccgcu

SEQ ID NO: 3955167 - RNA, 14 nt, Human herpesvirus 1
ucaaccacccggcc

SEQ ID NO: 3955168 - RNA, 15 nt, Human herpesvirus 1
ucaauaaaaggcauu

SEQ ID NO: 3955169 - RNA, 13 nt, Human herpesvirus 1
ucacagccccgca

SEQ ID NO: 3955170 - RNA, 13 nt, Human herpesvirus 1
cugaaccccagcc

SEQ ID NO: 3955171 - RNA, 16 nt, Human herpesvirus 1
cugaccccgcuccugu

SEQ ID NO: 3955172 - RNA, 16 nt, Human herpesvirus 1
cugacgccucagggcc

SEQ ID NO: 3955173 - RNA, 15 nt, Human herpesvirus 1
cugacgcgccuagcc

SEQ ID NO: 3955174 - RNA, 18 nt, Human herpesvirus 1
cugagccgcuuuccuacc

SEQ ID NO: 3955175 - RNA, 15 nt, Human herpesvirus 1
cugagcgcccuccug

SEQ ID NO: 3955176 - RNA, 16 nt, Human herpesvirus 1
cugaucccccgcgcgg

SEQ ID NO: 3955177 - RNA, 14 nt, Human herpesvirus 1
cugauguggcugcu

SEQ ID NO: 3955178 - RNA, 19 nt, Human herpesvirus 1
cugcaagaggucgucgggg

SEQ ID NO: 3955179 - RNA, 22 nt, Human herpesvirus 1
cugcagaaucacgagcugaccc

SEQ ID NO: 3955180 - RNA, 17 nt, Human herpesvirus 1
cugccaaacagcuggcc

SEQ ID NO: 3955181 - RNA, 14 nt, Human herpesvirus 1
cugccagaccucaa

SEQ ID NO: 3955182 - RNA, 14 nt, Human herpesvirus 1
cugccccgccaccc

SEQ ID NO: 3955183 - RNA, 15 nt, Human herpesvirus 1
cugcccggcggccag

SEQ ID NO: 3955184 - RNA, 16 nt, Human herpesvirus 1
cugcccuucugucugg

SEQ ID NO: 3955185 - RNA, 17 nt, Human herpesvirus 1
cugccucuccccccagg

SEQ ID NO: 3955186 - RNA, 18 nt, Human herpesvirus 1
cugccugacccucuccgg

SEQ ID NO: 3955187 - RNA, 20 nt, Human herpesvirus 1
cugccugacccucuccggga

SEQ ID NO: 3955188 - RNA, 21 nt, Human herpesvirus 1
cugcgaguccugcgccccgcc

SEQ ID NO: 3955189 - RNA, 16 nt, Human herpesvirus 1
cugcgccuugggcccg

SEQ ID NO: 3955190 - RNA, 19 nt, Human herpesvirus 1
cugcgccuugggcccgggg

SEQ ID NO: 3955191 - RNA, 19 nt, Human herpesvirus 1
cugcgcgagcaccugcggg

SEQ ID NO: 3955192 - RNA, 15 nt, Human herpesvirus 1
cugcgcggcgcccgc

SEQ ID NO: 3955193 - RNA, 22 nt, Human herpesvirus 1
cugcgggccgcgguggacagcc

SEQ ID NO: 3955194 - RNA, 23 nt, Human herpesvirus 1
cugcgggccgcgguggacagcca

SEQ ID NO: 3955195 - RNA, 23 nt, Human herpesvirus 1
cugcgguccggagccgcgcggcc

SEQ ID NO: 3955196 - RNA, 12 nt, Human herpesvirus 1
cugcgugucaaa

SEQ ID NO: 3955197 - RNA, 18 nt, Human herpesvirus 1
cugcuccccaccccggag

SEQ ID NO: 3955198 - RNA, 19 nt, Human herpesvirus 1
cugcuccgcaacggggcgc

SEQ ID NO: 3955199 - RNA, 15 nt, Human herpesvirus 1
cuggacgcccgggcg

SEQ ID NO: 3955200 - RNA, 17 nt, Human herpesvirus 1
cuggccaaucggcggcc

SEQ ID NO: 3955201 - RNA, 17 nt, Human herpesvirus 1
cuggccccaguccccaa

SEQ ID NO: 3955202 - RNA, 19 nt, Human herpesvirus 1
cuggccccaguccccaaga

SEQ ID NO: 3955203 - RNA, 18 nt, Human herpesvirus 1
cuggccgacguggcgcac

SEQ ID NO: 3955204 - RNA, 18 nt, Human herpesvirus 1
cuggccgcucgguggcuc

SEQ ID NO: 3955205 - RNA, 18 nt, Human herpesvirus 1
cuggccgggagcaccaca

SEQ ID NO: 3955206 - RNA, 21 nt, Human herpesvirus 1
cuggccugcgaggugcgccag

SEQ ID NO: 3955207 - RNA, 18 nt, Human herpesvirus 1
cuggccuuuuacgagguc

SEQ ID NO: 3955208 - RNA, 15 nt, Human herpesvirus 1
cuggcguacaacggc

SEQ ID NO: 3955209 - RNA, 23 nt, Human herpesvirus 1
cuggcguucgucgcccuccacca

SEQ ID NO: 3955210 - RNA, 17 nt, Human herpesvirus 1
cugggauccgaccccca

SEQ ID NO: 3955211 - RNA, 15 nt, Human herpesvirus 1
cugggauggcuccug

SEQ ID NO: 3955212 - RNA, 14 nt, Human herpesvirus 1
cugggccaccugac

SEQ ID NO: 3955213 - RNA, 20 nt, Human herpesvirus 1
cugggccauggacagcgacc

SEQ ID NO: 3955214 - RNA, 13 nt, Human herpesvirus 1
cugggccgagguc

SEQ ID NO: 3955215 - RNA, 18 nt, Human herpesvirus 1
cugggggcacccacgccc

SEQ ID NO: 3955216 - RNA, 20 nt, Human herpesvirus 1
cugggggggauccgcccuau

SEQ ID NO: 3955217 - RNA, 14 nt, Human herpesvirus 1
cuggguucuccugg

SEQ ID NO: 3955218 - RNA, 19 nt, Human herpesvirus 1
cugguccacacccaguggc

SEQ ID NO: 3955219 - RNA, 18 nt, Human herpesvirus 1
cuggucccccggggaccu

SEQ ID NO: 3955220 - RNA, 15 nt, Human herpesvirus 1
cugguugcggcccgc

SEQ ID NO: 3955221 - RNA, 19 nt, Human herpesvirus 1
cugguuguccguggcccca

SEQ ID NO: 3955222 - RNA, 22 nt, Human herpesvirus 1
cuguccugucuuggggcccacc

SEQ ID NO: 3955223 - RNA, 17 nt, Human herpesvirus 1
cugucgcacccacagcu

SEQ ID NO: 3955224 - RNA, 16 nt, Human herpesvirus 1
cugucggaccaccgcc

SEQ ID NO: 3955225 - RNA, 16 nt, Human herpesvirus 1
cugugccaccagccug

SEQ ID NO: 3955226 - RNA, 14 nt, Human herpesvirus 1
cuguggacccgagc

SEQ ID NO: 3955227 - RNA, 16 nt, Human herpesvirus 1
cuguggcagaccggca

SEQ ID NO: 3955228 - RNA, 20 nt, Human herpesvirus 1
cuuaauaaauuuuacaaaca

SEQ ID NO: 3955229 - RNA, 14 nt, Human herpesvirus 1
cuucagcgccguca

SEQ ID NO: 3955230 - RNA, 14 nt, Human herpesvirus 1
cuucaucacccccg

SEQ ID NO: 3955231 - RNA, 17 nt, Human herpesvirus 1
cuuccccccccccccuu

SEQ ID NO: 3955232 - RNA, 14 nt, Human herpesvirus 1
cuucccucagguca

SEQ ID NO: 3955233 - RNA, 12 nt, Human herpesvirus 1
cuucccuccccc

SEQ ID NO: 3955234 - RNA, 13 nt, Human herpesvirus 1
cuucccucccccu

SEQ ID NO: 3955235 - RNA, 14 nt, Human herpesvirus 1
cuuccgguccugga

SEQ ID NO: 3955236 - RNA, 17 nt, Human herpesvirus 1
cuucgacguggaggaag

SEQ ID NO: 3955237 - RNA, 16 nt, Human herpesvirus 1
cuucggccccgcgucu

SEQ ID NO: 3955238 - RNA, 21 nt, Human herpesvirus 1
cuucuugucgucucucuuccc

SEQ ID NO: 3955239 - RNA, 22 nt, Human herpesvirus 1
cuugaggggggagaugggaccc

SEQ ID NO: 3955240 - RNA, 18 nt, Human herpesvirus 1
cuuggccggggagggcag

SEQ ID NO: 3955241 - RNA, 12 nt, Human herpesvirus 1
cuuggcggccgc

SEQ ID NO: 3955242 - RNA, 20 nt, Human herpesvirus 1
cuugguucggggccgcccug

SEQ ID NO: 3955243 - RNA, 23 nt, Human herpesvirus 1
cuugguucggggccgcccuggcc

SEQ ID NO: 3955244 - RNA, 15 nt, Human herpesvirus 1
cuuuaaccucccccg

SEQ ID NO: 3955245 - RNA, 16 nt, Human herpesvirus 1
cuuuaacuacauuaaa

SEQ ID NO: 3955246 - RNA, 23 nt, Human herpesvirus 1
cuuuccgagggcgagcucagcuu

SEQ ID NO: 3955247 - RNA, 18 nt, Human herpesvirus 1
gaaaaugaaccagacccu

SEQ ID NO: 3955248 - RNA, 15 nt, Human herpesvirus 1
gaaacuggcccgcgc

SEQ ID NO: 3955249 - RNA, 18 nt, Human herpesvirus 1
gaacaauaaaggcggugg

SEQ ID NO: 3955250 - RNA, 14 nt, Human herpesvirus 1
gaacacaaggccaa

SEQ ID NO: 3955251 - RNA, 22 nt, Human herpesvirus 1
gaacacggggacggcggggcag

SEQ ID NO: 3955252 - RNA, 21 nt, Human herpesvirus 1
gaaccacguacggcucgcggg

SEQ ID NO: 3955253 - RNA, 21 nt, Human herpesvirus 1
gaaccuagggaacccagagua

SEQ ID NO: 3955254 - RNA, 15 nt, Human herpesvirus 1
gaacgcagccccgcu

SEQ ID NO: 3955255 - RNA, 16 nt, Human herpesvirus 1
gaacgcggaccccccc

SEQ ID NO: 3955256 - RNA, 14 nt, Human herpesvirus 1
gaagaccagggccc

SEQ ID NO: 3955257 - RNA, 15 nt, Human herpesvirus 1
gaagacccccccgga

SEQ ID NO: 3955258 - RNA, 24 nt, Human herpesvirus 1
gaagaccugcuuauucucggggag

SEQ ID NO: 3955259 - RNA, 15 nt, Human herpesvirus 1
gaagacgaggcggcc

SEQ ID NO: 3955260 - RNA, 16 nt, Human herpesvirus 1
gaaggcgcuuccccgc

SEQ ID NO: 3955261 - RNA, 14 nt, Human herpesvirus 1
gaaucccccaaggg

SEQ ID NO: 3955262 - RNA, 19 nt, Human herpesvirus 1
gacacacggcguggagcaa

SEQ ID NO: 3955263 - RNA, 16 nt, Human herpesvirus 1
gacaccgcguguuccc

SEQ ID NO: 3955264 - RNA, 22 nt, Human herpesvirus 1
gacacguugggguuguugcugg

SEQ ID NO: 3955265 - RNA, 20 nt, Human herpesvirus 1
gacagcacucacagccccgc

SEQ ID NO: 3955266 - RNA, 21 nt, Human herpesvirus 1
cgcgccgcugcccgacccggc

SEQ ID NO: 3955267 - RNA, 19 nt, Human herpesvirus 1
cgcgccguuggcccccgcc

SEQ ID NO: 3955268 - RNA, 12 nt, Human herpesvirus 1
cgcgccucccgg

SEQ ID NO: 3955269 - RNA, 16 nt, Human herpesvirus 1
cgcgcgaaaucguggc

SEQ ID NO: 3955270 - RNA, 17 nt, Human herpesvirus 1
cgcgcggacgacggcgg

SEQ ID NO: 3955271 - RNA, 15 nt, Human herpesvirus 1
cgcgcggucggcaag

SEQ ID NO: 3955272 - RNA, 14 nt, Human herpesvirus 1
cgcgcgucgacguc

SEQ ID NO: 3955273 - RNA, 19 nt, Human herpesvirus 1
cgcgcgucucuggggagcc

SEQ ID NO: 3955274 - RNA, 17 nt, Human herpesvirus 1
cgcgcguggaccugggg

SEQ ID NO: 3955275 - RNA, 17 nt, Human herpesvirus 1
cgcggagggcggccagc

SEQ ID NO: 3955276 - RNA, 17 nt, Human herpesvirus 1
cgcggcccggggccugc

SEQ ID NO: 3955277 - RNA, 18 nt, Human herpesvirus 1
cgcggccgcgacccaggc

SEQ ID NO: 3955278 - RNA, 16 nt, Human herpesvirus 1
cgcggcgacaacgcgg

SEQ ID NO: 3955279 - RNA, 21 nt, Human herpesvirus 1
cgcggcugccaaacagcuggc

SEQ ID NO: 3955280 - RNA, 19 nt, Human herpesvirus 1
cgcggcuucaucgcgcccc

SEQ ID NO: 3955281 - RNA, 16 nt, Human herpesvirus 1
cgcgggaggccgcccc

SEQ ID NO: 3955282 - RNA, 13 nt, Human herpesvirus 1
cgcgggcgacgcc

SEQ ID NO: 3955283 - RNA, 14 nt, Human herpesvirus 1
cgcggggcccccgc

SEQ ID NO: 3955284 - RNA, 15 nt, Human herpesvirus 1
cgcggggccuccccc

SEQ ID NO: 3955285 - RNA, 23 nt, Human herpesvirus 1
cgcggggggggcgggcucguccc

SEQ ID NO: 3955286 - RNA, 23 nt, Human herpesvirus 1
cgcgguacgccccaccggcacca

SEQ ID NO: 3955287 - RNA, 16 nt, Human herpesvirus 1
cgcgguagcccggccg

SEQ ID NO: 3955288 - RNA, 19 nt, Human herpesvirus 1
cgcgguagcccggccgugu

SEQ ID NO: 3955289 - RNA, 22 nt, Human herpesvirus 1
cgcgguucgcgucccgcccacc

SEQ ID NO: 3955290 - RNA, 18 nt, Human herpesvirus 1
cgcgugcccacgucgccc

SEQ ID NO: 3955291 - RNA, 21 nt, Human herpesvirus 1
cgcgugcccacgucgccccgc

SEQ ID NO: 3955292 - RNA, 14 nt, Human herpesvirus 1
cgcucccgccuucc

SEQ ID NO: 3955293 - RNA, 18 nt, Human herpesvirus 1
cgcuccugugcacccuca

SEQ ID NO: 3955294 - RNA, 21 nt, Human herpesvirus 1
cgcucgcucucggugccccug

SEQ ID NO: 3955295 - RNA, 14 nt, Human herpesvirus 1
cgcucugacggccc

SEQ ID NO: 3955296 - RNA, 16 nt, Human herpesvirus 1
cgcuggggcugccgug

SEQ ID NO: 3955297 - RNA, 21 nt, Human herpesvirus 1
cgcuggguggucucuggccgc

SEQ ID NO: 3955298 - RNA, 12 nt, Human herpesvirus 1
cgcugugccauc

SEQ ID NO: 3955299 - RNA, 17 nt, Human herpesvirus 1
cgcugugccaucgcgcc

SEQ ID NO: 3955300 - RNA, 23 nt, Human herpesvirus 1
cgcuguucucguuccucacugcc

SEQ ID NO: 3955301 - RNA, 15 nt, Human herpesvirus 1
cgcuucauccccgag

SEQ ID NO: 3955302 - RNA, 17 nt, Human herpesvirus 1
cgcuuuauaggccggga

SEQ ID NO: 3955303 - RNA, 23 nt, Human herpesvirus 1
cggaaaaccugggcggccucucc

SEQ ID NO: 3955304 - RNA, 22 nt, Human herpesvirus 1
cggaaagcaagaacaauaaagg

SEQ ID NO: 3955305 - RNA, 23 nt, Human herpesvirus 1
cggacccucucuucucucccggg

SEQ ID NO: 3955306 - RNA, 15 nt, Human herpesvirus 1
cggaccugcucucgc

SEQ ID NO: 3955307 - RNA, 21 nt, Human herpesvirus 1
cggacgccguggcgccccggc

SEQ ID NO: 3955308 - RNA, 19 nt, Human herpesvirus 1
cggacggcgcggggccccc

SEQ ID NO: 3955309 - RNA, 14 nt, Human herpesvirus 1
cggagcccgcuggg

SEQ ID NO: 3955310 - RNA, 20 nt, Human herpesvirus 1
cggagcuuucuuccggccuc

SEQ ID NO: 3955311 - RNA, 19 nt, Human herpesvirus 1
cggaggaaacccccgaccc

SEQ ID NO: 3955312 - RNA, 13 nt, Human herpesvirus 1
cggaggagccagu

SEQ ID NO: 3955313 - RNA, 23 nt, Human herpesvirus 1
cggaggggcuccuuagcgcggcc

SEQ ID NO: 3955314 - RNA, 16 nt, Human herpesvirus 1
cggcaagauccucggg

SEQ ID NO: 3955315 - RNA, 17 nt, Human herpesvirus 1
cggcaauucccgcggcc

SEQ ID NO: 3955316 - RNA, 19 nt, Human herpesvirus 1
cggcaccaccgacucuccc

SEQ ID NO: 3955317 - RNA, 14 nt, Human herpesvirus 1
cggcacgccugggg

SEQ ID NO: 3955318 - RNA, 18 nt, Human herpesvirus 1
cggcagcgcuccgacgac

SEQ ID NO: 3955319 - RNA, 19 nt, Human herpesvirus 1
cggcaggcaccgcaccagc

SEQ ID NO: 3955320 - RNA, 19 nt, Human herpesvirus 1
cggcauucgggccugccug

SEQ ID NO: 3955321 - RNA, 16 nt, Human herpesvirus 1
cggccaaccagcgucc

SEQ ID NO: 3955322 - RNA, 18 nt, Human herpesvirus 1
cggccacacagccggcca

SEQ ID NO: 3955323 - RNA, 12 nt, Human herpesvirus 1
cggccaccgcua

SEQ ID NO: 3955324 - RNA, 21 nt, Human herpesvirus 1
cggccagaucuacugcugggc

SEQ ID NO: 3955325 - RNA, 12 nt, Human herpesvirus 1
cggccccagccc

SEQ ID NO: 3955326 - RNA, 23 nt, Human herpesvirus 1
cggccccgcgucuggccccggcg

SEQ ID NO: 3955327 - RNA, 18 nt, Human herpesvirus 1
cggccccugggccccggg

SEQ ID NO: 3955328 - RNA, 19 nt, Human herpesvirus 1
cggccccugggccccggga

SEQ ID NO: 3955329 - RNA, 18 nt, Human herpesvirus 1
cggcccgcguuuggccug

SEQ ID NO: 3955330 - RNA, 20 nt, Human herpesvirus 1
cggcccucuuggaggacccc

SEQ ID NO: 3955331 - RNA, 16 nt, Human herpesvirus 1
cggcccugaugcagga

SEQ ID NO: 3955332 - RNA, 12 nt, Human herpesvirus 1
cggcccugcugc

SEQ ID NO: 3955333 - RNA, 19 nt, Human herpesvirus 1
cggccgccacccaggcgcu

SEQ ID NO: 3955334 - RNA, 15 nt, Human herpesvirus 1
cggccgugggcgccu

SEQ ID NO: 3955335 - RNA, 17 nt, Human herpesvirus 1
cggccguugucuccccg

SEQ ID NO: 3955336 - RNA, 21 nt, Human herpesvirus 1
cggcgaccucggcgccucugg

SEQ ID NO: 3955337 - RNA, 20 nt, Human herpesvirus 1
cggcgacuuugacgaggcca

SEQ ID NO: 3955338 - RNA, 17 nt, Human herpesvirus 1
cggcgcccaccccgugu

SEQ ID NO: 3955339 - RNA, 21 nt, Human herpesvirus 1
cggcgccggggcucucggggc

SEQ ID NO: 3955340 - RNA, 23 nt, Human herpesvirus 1
cggcgcgacaacgagcccccgcc

SEQ ID NO: 3955341 - RNA, 17 nt, Human herpesvirus 1
cggcgcgagcucccugc

SEQ ID NO: 3955342 - RNA, 13 nt, Human herpesvirus 1
cggcgcggggccc

SEQ ID NO: 3955343 - RNA, 19 nt, Human herpesvirus 1
cggcgcguguaccacaucc

SEQ ID NO: 3955344 - RNA, 14 nt, Human herpesvirus 1
cggcgcugcagcgc

SEQ ID NO: 3955345 - RNA, 22 nt, Human herpesvirus 1
cggcggccaguugagccgcgcc

SEQ ID NO: 3955346 - RNA, 21 nt, Human herpesvirus 1
cggcggcuguagcgccccggc

SEQ ID NO: 3955347 - RNA, 15 nt, Human herpesvirus 1
cggcggggcccggcc

SEQ ID NO: 3955348 - RNA, 20 nt, Human herpesvirus 1
cggcgggugucugcucccca

SEQ ID NO: 3955349 - RNA, 23 nt, Human herpesvirus 1
cggcgguaaucauaaccacgccc

SEQ ID NO: 3955350 - RNA, 14 nt, Human herpesvirus 1
cggcgugucggugc

SEQ ID NO: 3955351 - RNA, 14 nt, Human herpesvirus 1
cggcuaccuggccc

SEQ ID NO: 3955352 - RNA, 16 nt, Human herpesvirus 1
cggcucggccuauggc

SEQ ID NO: 3955353 - RNA, 19 nt, Human herpesvirus 1
cggcugccaaacagcuggc

SEQ ID NO: 3955354 - RNA, 14 nt, Human herpesvirus 1
cgggagccccggac

SEQ ID NO: 3955355 - RNA, 14 nt, Human herpesvirus 1
cgggagcgccagga

SEQ ID NO: 3955356 - RNA, 16 nt, Human herpesvirus 1
cgggaggaagccacaa

SEQ ID NO: 3955357 - RNA, 23 nt, Human herpesvirus 1
cgggauaccgguaugccgcggcc

SEQ ID NO: 3955358 - RNA, 14 nt, Human herpesvirus 1
cgggauccacaccg

SEQ ID NO: 3955359 - RNA, 13 nt, Human herpesvirus 1
cgggcaccacaca

SEQ ID NO: 3955360 - RNA, 16 nt, Human herpesvirus 1
cgggcaucucgcgccc

SEQ ID NO: 3955361 - RNA, 18 nt, Human herpesvirus 1
cgggccacgccacccugc

SEQ ID NO: 3955362 - RNA, 13 nt, Human herpesvirus 1
cgggcccaaggcc

SEQ ID NO: 3955363 - RNA, 16 nt, Human herpesvirus 1
cgggcccaaggcccca

SEQ ID NO: 3955364 - RNA, 13 nt, Human herpesvirus 1
cgggcccccggcc

SEQ ID NO: 3955365 - RNA, 22 nt, Human herpesvirus 1
cgggccccggggagacagcgcc

SEQ ID NO: 3955366 - RNA, 14 nt, Human herpesvirus 1
cgggcccggccagg

SEQ ID NO: 3955367 - RNA, 13 nt, Human herpesvirus 1
cgggccgcccacu

SEQ ID NO: 3955368 - RNA, 19 nt, Human herpesvirus 1
cgggccgcccacuucccgg

SEQ ID NO: 3955369 - RNA, 16 nt, Human herpesvirus 1
cgggccucgugggcac

SEQ ID NO: 3955370 - RNA, 16 nt, Human herpesvirus 1
caaggugggccagccg

SEQ ID NO: 3955371 - RNA, 20 nt, Human herpesvirus 1
caaguggcaggagguggacg

SEQ ID NO: 3955372 - RNA, 13 nt, Human herpesvirus 1
caaucggcggccg

SEQ ID NO: 3955373 - RNA, 20 nt, Human herpesvirus 1
caauguuuuuauuggucaaa

SEQ ID NO: 3955374 - RNA, 14 nt, Human herpesvirus 1
caauuugcacccag

SEQ ID NO: 3955375 - RNA, 17 nt, Human herpesvirus 1
caauuugcacccagccu

SEQ ID NO: 3955376 - RNA, 18 nt, Human herpesvirus 1
caauuugcacccagccuu

SEQ ID NO: 3955377 - RNA, 19 nt, Human herpesvirus 1
cacaacgccagccugcggc

SEQ ID NO: 3955378 - RNA, 20 nt, Human herpesvirus 1
cacaacggcaugccucugcg

SEQ ID NO: 3955379 - RNA, 13 nt, Human herpesvirus 1
cacacaccagcgg

SEQ ID NO: 3955380 - RNA, 14 nt, Human herpesvirus 1
cacacaccccccau

SEQ ID NO: 3955381 - RNA, 19 nt, Human herpesvirus 1
cacaccagcuacgccgccg

SEQ ID NO: 3955382 - RNA, 16 nt, Human herpesvirus 1
cacaccgguccccgga

SEQ ID NO: 3955383 - RNA, 17 nt, Human herpesvirus 1
cacacgggugcgucugg

SEQ ID NO: 3955384 - RNA, 13 nt, Human herpesvirus 1
cacagccuggccg

SEQ ID NO: 3955385 - RNA, 16 nt, Human herpesvirus 1
cacagccuggccgugc

SEQ ID NO: 3955386 - RNA, 15 nt, Human herpesvirus 1
cacaugcggaaagca

SEQ ID NO: 3955387 - RNA, 17 nt, Human herpesvirus 1
cacaugcggaaagcaag

SEQ ID NO: 3955388 - RNA, 21 nt, Human herpesvirus 1
cacaugcggaaagcaagaaca

SEQ ID NO: 3955389 - RNA, 20 nt, Human herpesvirus 1
cacaugggggaggugccccc

SEQ ID NO: 3955390 - RNA, 15 nt, Human herpesvirus 1
caccaacgcacgagc

SEQ ID NO: 3955391 - RNA, 15 nt, Human herpesvirus 1
caccaccaaccugac

SEQ ID NO: 3955392 - RNA, 14 nt, Human herpesvirus 1
caccaccuucacca

SEQ ID NO: 3955393 - RNA, 17 nt, Human herpesvirus 1
caccagcagcuugcggg

SEQ ID NO: 3955394 - RNA, 12 nt, Human herpesvirus 1
caccagccuggu

SEQ ID NO: 3955395 - RNA, 23 nt, Human herpesvirus 1
caccagccugguuguccguggcc

SEQ ID NO: 3955396 - RNA, 16 nt, Human herpesvirus 1
caccaugcuggaggau

SEQ ID NO: 3955397 - RNA, 16 nt, Human herpesvirus 1
cacccacccaccaaga

SEQ ID NO: 3955398 - RNA, 14 nt, Human herpesvirus 1
cacccacgccgccu

SEQ ID NO: 3955399 - RNA, 18 nt, Human herpesvirus 1
cacccaguuuccaccccc

SEQ ID NO: 3955400 - RNA, 15 nt, Human herpesvirus 1
cacccccccaacggg

SEQ ID NO: 3955401 - RNA, 14 nt, Human herpesvirus 1
cacccccgcccggg

SEQ ID NO: 3955402 - RNA, 17 nt, Human herpesvirus 1
caccccgaagccccggc

SEQ ID NO: 3955403 - RNA, 23 nt, Human herpesvirus 1
caccccgcaauuugcacccagcc

SEQ ID NO: 3955404 - RNA, 15 nt, Human herpesvirus 1
cacccgaaccaccac

SEQ ID NO: 3955405 - RNA, 16 nt, Human herpesvirus 1
cacccgaggcggccug

SEQ ID NO: 3955406 - RNA, 16 nt, Human herpesvirus 1
cacccuaccccagucc

SEQ ID NO: 3955407 - RNA, 22 nt, Human herpesvirus 1
cacccuccgcuggggcccccag

SEQ ID NO: 3955408 - RNA, 18 nt, Human herpesvirus 1
cacccugcugcccccgga

SEQ ID NO: 3955409 - RNA, 19 nt, Human herpesvirus 1
cacccugcugcccccggag

SEQ ID NO: 3955410 - RNA, 17 nt, Human herpesvirus 1
caccgaacccggcccgg

SEQ ID NO: 3955411 - RNA, 14 nt, Human herpesvirus 1
caccgacacaugca

SEQ ID NO: 3955412 - RNA, 21 nt, Human herpesvirus 1
caccgacaccgcacugcggcu

SEQ ID NO: 3955413 - RNA, 16 nt, Human herpesvirus 1
caccgcaccagcgcgg

SEQ ID NO: 3955414 - RNA, 17 nt, Human herpesvirus 1
caccgcccacagagggc

SEQ ID NO: 3955415 - RNA, 14 nt, Human herpesvirus 1
caccgcugggcgcu

SEQ ID NO: 3955416 - RNA, 18 nt, Human herpesvirus 1
caccgggaagcagggccc

SEQ ID NO: 3955417 - RNA, 16 nt, Human herpesvirus 1
caccggugcgcccccc

SEQ ID NO: 3955418 - RNA, 19 nt, Human herpesvirus 1
caccgguucguauccacaa

SEQ ID NO: 3955419 - RNA, 12 nt, Human herpesvirus 1
caccuccacccc

SEQ ID NO: 3955420 - RNA, 22 nt, Human herpesvirus 1
caccuccacccccucgaccacc

SEQ ID NO: 3955421 - RNA, 18 nt, Human herpesvirus 1
caccuccccagcggccag

SEQ ID NO: 3955422 - RNA, 20 nt, Human herpesvirus 1
caccuccgcgagcagagccg

SEQ ID NO: 3955423 - RNA, 19 nt, Human herpesvirus 1
caccuuugacggcgcggcc

SEQ ID NO: 3955424 - RNA, 20 nt, Human herpesvirus 1
caccuuugacggcgcggccg

SEQ ID NO: 3955425 - RNA, 16 nt, Human herpesvirus 1
cacgacacccacccca

SEQ ID NO: 3955426 - RNA, 13 nt, Human herpesvirus 1
cacgaccugcgcu

SEQ ID NO: 3955427 - RNA, 13 nt, Human herpesvirus 1
cacgagcgccagc

SEQ ID NO: 3955428 - RNA, 17 nt, Human herpesvirus 1
cacgauuccgguuuggg

SEQ ID NO: 3955429 - RNA, 15 nt, Human herpesvirus 1
cacgcaagaccaggc

SEQ ID NO: 3955430 - RNA, 19 nt, Human herpesvirus 1
cacgcaagaccaggccugg

SEQ ID NO: 3955431 - RNA, 15 nt, Human herpesvirus 1
cacgcacgcucccau

SEQ ID NO: 3955432 - RNA, 17 nt, Human herpesvirus 1
cacgccaagcccccgcc

SEQ ID NO: 3955433 - RNA, 18 nt, Human herpesvirus 1
cacgccaaugcccucccu

SEQ ID NO: 3955434 - RNA, 18 nt, Human herpesvirus 1
cacgccuaccggccccug

SEQ ID NO: 3955435 - RNA, 21 nt, Human herpesvirus 1
cacgccuaccggccccugggc

SEQ ID NO: 3955436 - RNA, 20 nt, Human herpesvirus 1
cacgccuggggucgcggccg

SEQ ID NO: 3955437 - RNA, 23 nt, Human herpesvirus 1
cacgcgccgccgacucccggcuu

SEQ ID NO: 3955438 - RNA, 20 nt, Human herpesvirus 1
cacgcucgcggagcuguacg

SEQ ID NO: 3955439 - RNA, 20 nt, Human herpesvirus 1
cacgggcaccacacaccagc

SEQ ID NO: 3955440 - RNA, 13 nt, Human herpesvirus 1
cacggggacggcg

SEQ ID NO: 3955441 - RNA, 22 nt, Human herpesvirus 1
cacggguggccgggcguugggg

SEQ ID NO: 3955442 - RNA, 21 nt, Human herpesvirus 1
cacgugaucagcacgccaccg

SEQ ID NO: 3955443 - RNA, 14 nt, Human herpesvirus 1
cacgugcugcugcg

SEQ ID NO: 3955444 - RNA, 16 nt, Human herpesvirus 1
cacuacaccagccaau

SEQ ID NO: 3955445 - RNA, 22 nt, Human herpesvirus 1
cacuacccaccgcgagaugucc

SEQ ID NO: 3955446 - RNA, 22 nt, Human herpesvirus 1
cacuacgcuucggccgccaccc

SEQ ID NO: 3955447 - RNA, 15 nt, Human herpesvirus 1
cacucacagccccgc

SEQ ID NO: 3955448 - RNA, 22 nt, Human herpesvirus 1
cacucaccggcggacccccgga

SEQ ID NO: 3955449 - RNA, 16 nt, Human herpesvirus 1
cacugcccgucgcgcg

SEQ ID NO: 3955450 - RNA, 16 nt, Human herpesvirus 1
cacuggccgggagcac

SEQ ID NO: 3955451 - RNA, 11 nt, Human herpesvirus 1
cacugucgucg

SEQ ID NO: 3955452 - RNA, 16 nt, Human herpesvirus 1
cacuguuuuccgcccc

SEQ ID NO: 3955453 - RNA, 18 nt, Human herpesvirus 1
cacuucccgguaugguaa

SEQ ID NO: 3955454 - RNA, 16 nt, Human herpesvirus 1
cagaacucgccccgga

SEQ ID NO: 3955455 - RNA, 19 nt, Human herpesvirus 1
cagaccccuucuccccaca

SEQ ID NO: 3955456 - RNA, 19 nt, Human herpesvirus 1
cagacgaaaagccccgggc

SEQ ID NO: 3955457 - RNA, 15 nt, Human herpesvirus 1
cagagaccccagggu

SEQ ID NO: 3955458 - RNA, 20 nt, Human herpesvirus 1
cagaucuacugcugggccau

SEQ ID NO: 3955459 - RNA, 20 nt, Human herpesvirus 1
cagauuguccgcggggccuc

SEQ ID NO: 3955460 - RNA, 18 nt, Human herpesvirus 1
cagcaaauaugccuuggu

SEQ ID NO: 3955461 - RNA, 20 nt, Human herpesvirus 1
cagcaaauaugccuuggugg

SEQ ID NO: 3955462 - RNA, 19 nt, Human herpesvirus 1
cagcaucgggaugcugccc

SEQ ID NO: 3955463 - RNA, 14 nt, Human herpesvirus 1
cagcauggcgccac

SEQ ID NO: 3955464 - RNA, 15 nt, Human herpesvirus 1
cagccacuuccccga

SEQ ID NO: 3955465 - RNA, 18 nt, Human herpesvirus 1
cagccauauccugagccc

SEQ ID NO: 3955466 - RNA, 19 nt, Human herpesvirus 1
cagcccgcccucacagggc

SEQ ID NO: 3955467 - RNA, 15 nt, Human herpesvirus 1
cagcccucccgaccg

SEQ ID NO: 3955468 - RNA, 15 nt, Human herpesvirus 1
cagccugccucuccc

SEQ ID NO: 3955469 - RNA, 16 nt, Human herpesvirus 1
cagccuuuaacuacau

SEQ ID NO: 3955470 - RNA, 20 nt, Human herpesvirus 1
cagcgaagcagccgccuggc

SEQ ID NO: 3955471 - RNA, 16 nt, Human herpesvirus 1
cagcgaccccacggcc

SEQ ID NO: 3955472 - RNA, 22 nt, Human herpesvirus 1
cagcgaccccacggccuccgcg

SEQ ID NO: 3955473 - RNA, 14 nt, Human herpesvirus 1
cagcgaccuggggu

SEQ ID NO: 3955474 - RNA, 18 nt, Human herpesvirus 1
cagcgccggccuccccgu

SEQ ID NO: 3955475 - RNA, 14 nt, Human herpesvirus 1
cagcggccugcugg

SEQ ID NO: 3955476 - RNA, 16 nt, Human herpesvirus 1
cagcugaccgacccuc

SEQ ID NO: 3955477 - RNA, 13 nt, Human herpesvirus 1
cagcugagccgcg

SEQ ID NO: 3955478 - RNA, 19 nt, Human herpesvirus 1
caggaaauccguggccccg

SEQ ID NO: 3955479 - RNA, 22 nt, Human herpesvirus 1
caggaaauccguggccccggcc

SEQ ID NO: 3955480 - RNA, 15 nt, Human herpesvirus 1
caggacaccgcgugu

SEQ ID NO: 3955481 - RNA, 22 nt, Human herpesvirus 1
caggacgccgcgacgccuuacc

SEQ ID NO: 3955482 - RNA, 21 nt, Human herpesvirus 1
caggccguuccgaucgcccug

SEQ ID NO: 3955483 - RNA, 14 nt, Human herpesvirus 1
caggccuccacccc

SEQ ID NO: 3955484 - RNA, 16 nt, Human herpesvirus 1
caggccuccacccccu

SEQ ID NO: 3955485 - RNA, 12 nt, Human herpesvirus 1
cccaacagccgc

SEQ ID NO: 3955486 - RNA, 15 nt, Human herpesvirus 1
cccaacccacacgca

SEQ ID NO: 3955487 - RNA, 15 nt, Human herpesvirus 1
cccaacgccacgcag

SEQ ID NO: 3955488 - RNA, 19 nt, Human herpesvirus 1
cccacacaacgcuccgccc

SEQ ID NO: 3955489 - RNA, 12 nt, Human herpesvirus 1
cccacacgcacu

SEQ ID NO: 3955490 - RNA, 17 nt, Human herpesvirus 1
cccacccacuccucccc

SEQ ID NO: 3955491 - RNA, 15 nt, Human herpesvirus 1
cccaccccccacggg

SEQ ID NO: 3955492 - RNA, 13 nt, Human herpesvirus 1
cccaccccccguc

SEQ ID NO: 3955493 - RNA, 24 nt, Human herpesvirus 1
cccacgaucaccgcgggagcggug

SEQ ID NO: 3955494 - RNA, 15 nt, Human herpesvirus 1
cccacgcccccgccg

SEQ ID NO: 3955495 - RNA, 12 nt, Human herpesvirus 1
cccacgccgccu

SEQ ID NO: 3955496 - RNA, 13 nt, Human herpesvirus 1
cccacgucgcccc

SEQ ID NO: 3955497 - RNA, 14 nt, Human herpesvirus 1
cccacuccuccccg

SEQ ID NO: 3955498 - RNA, 15 nt, Human herpesvirus 1
cccagaccccgggcg

SEQ ID NO: 3955499 - RNA, 17 nt, Human herpesvirus 1
cccagagaccccagggu

SEQ ID NO: 3955500 - RNA, 19 nt, Human herpesvirus 1
cccagagguguucacgcac

SEQ ID NO: 3955501 - RNA, 20 nt, Human herpesvirus 1
cccagagguguucacgcacc

SEQ ID NO: 3955502 - RNA, 13 nt, Human herpesvirus 1
cccagccucccga

SEQ ID NO: 3955503 - RNA, 15 nt, Human herpesvirus 1
cccagccucccgauc

SEQ ID NO: 3955504 - RNA, 23 nt, Human herpesvirus 1
cccagccuucacgugcugcugcg

SEQ ID NO: 3955505 - RNA, 13 nt, Human herpesvirus 1
cccagcgacccca

SEQ ID NO: 3955506 - RNA, 18 nt, Human herpesvirus 1
cccagcgaccccacggcc

SEQ ID NO: 3955507 - RNA, 15 nt, Human herpesvirus 1
cccaggaucacaccg

SEQ ID NO: 3955508 - RNA, 18 nt, Human herpesvirus 1
cccaggaucacaccgguc

SEQ ID NO: 3955509 - RNA, 14 nt, Human herpesvirus 1
cccaggcgcugggc

SEQ ID NO: 3955510 - RNA, 23 nt, Human herpesvirus 1
cccaggcggcgaacgggggcccu

SEQ ID NO: 3955511 - RNA, 21 nt, Human herpesvirus 1
cccaguaacaugcgcacguga

SEQ ID NO: 3955512 - RNA, 21 nt, Human herpesvirus 1
cccauaaaacccaagccggga

SEQ ID NO: 3955513 - RNA, 23 nt, Human herpesvirus 1
cccauccgaacgcagccccgcug

SEQ ID NO: 3955514 - RNA, 20 nt, Human herpesvirus 1
cccaucgccgcggcucccgg

SEQ ID NO: 3955515 - RNA, 16 nt, Human herpesvirus 1
cccaucgcgggcgcca

SEQ ID NO: 3955516 - RNA, 23 nt, Human herpesvirus 1
cccaucugugcggggaggggggc

SEQ ID NO: 3955517 - RNA, 14 nt, Human herpesvirus 1
cccaugaaggcccu

SEQ ID NO: 3955518 - RNA, 14 nt, Human herpesvirus 1
ccccaacgccacgc

SEQ ID NO: 3955519 - RNA, 19 nt, Human herpesvirus 1
ccccaacgccacgcagcca

SEQ ID NO: 3955520 - RNA, 21 nt, Human herpesvirus 1
ccccaacgccacgcagccaga

SEQ ID NO: 3955521 - RNA, 10 nt, Human herpesvirus 1
ccccaaggag

SEQ ID NO: 3955522 - RNA, 20 nt, Human herpesvirus 1
ccccaguccccgggcccagc

SEQ ID NO: 3955523 - RNA, 19 nt, Human herpesvirus 1
ccccauacacgagcacccu

SEQ ID NO: 3955524 - RNA, 21 nt, Human herpesvirus 1
ccccaucgccgcggcucccgg

SEQ ID NO: 3955525 - RNA, 18 nt, Human herpesvirus 1
ccccaucuaaugccacgc

SEQ ID NO: 3955526 - RNA, 11 nt, Human herpesvirus 1
cccccaaacac

SEQ ID NO: 3955527 - RNA, 19 nt, Human herpesvirus 1
cccccaaaucccggcgccg

SEQ ID NO: 3955528 - RNA, 13 nt, Human herpesvirus 1
cccccccacccgc

SEQ ID NO: 3955529 - RNA, 16 nt, Human herpesvirus 1
cccccgccucuggggu

SEQ ID NO: 3955530 - RNA, 21 nt, Human herpesvirus 1
cccccggacgacauggccagc

SEQ ID NO: 3955531 - RNA, 16 nt, Human herpesvirus 1
cccccggccaccccga

SEQ ID NO: 3955532 - RNA, 17 nt, Human herpesvirus 1
cccccggccgccgcgga

SEQ ID NO: 3955533 - RNA, 22 nt, Human herpesvirus 1
cccccggccgccgcggacgccg

SEQ ID NO: 3955534 - RNA, 12 nt, Human herpesvirus 1
cccccgggccgc

SEQ ID NO: 3955535 - RNA, 14 nt, Human herpesvirus 1
cccccgucagccug

SEQ ID NO: 3955536 - RNA, 22 nt, Human herpesvirus 1
cccccguguuuguggggagggg

SEQ ID NO: 3955537 - RNA, 13 nt, Human herpesvirus 1
cccccuggaggug

SEQ ID NO: 3955538 - RNA, 20 nt, Human herpesvirus 1
cccccuggagguguacaccc

SEQ ID NO: 3955539 - RNA, 19 nt, Human herpesvirus 1
cccccuuguauguccccaa

SEQ ID NO: 3955540 - RNA, 15 nt, Human herpesvirus 1
ccccgacagcccccc

SEQ ID NO: 3955541 - RNA, 15 nt, Human herpesvirus 1
ccccgaccagcgccg

SEQ ID NO: 3955542 - RNA, 15 nt, Human herpesvirus 1
ccccgacugcccccc

SEQ ID NO: 3955543 - RNA, 15 nt, Human herpesvirus 1
ccccgauggcccucc

SEQ ID NO: 3955544 - RNA, 18 nt, Human herpesvirus 1
ccccgcaauuugcaccca

SEQ ID NO: 3955545 - RNA, 12 nt, Human herpesvirus 1
ccccgcccgggg

SEQ ID NO: 3955546 - RNA, 12 nt, Human herpesvirus 1
ccccgcccgggu

SEQ ID NO: 3955547 - RNA, 20 nt, Human herpesvirus 1
ccccgcgccucccggcccgu

SEQ ID NO: 3955548 - RNA, 17 nt, Human herpesvirus 1
ccccgcuucauccccga

SEQ ID NO: 3955549 - RNA, 14 nt, Human herpesvirus 1
ccccggagccgggc

SEQ ID NO: 3955550 - RNA, 12 nt, Human herpesvirus 1
ccccgucacccg

SEQ ID NO: 3955551 - RNA, 17 nt, Human herpesvirus 1
ccccuaagacccacccc

SEQ ID NO: 3955552 - RNA, 18 nt, Human herpesvirus 1
ccccuccgcgccaggccc

SEQ ID NO: 3955553 - RNA, 15 nt, Human herpesvirus 1
ccccugauggagccu

SEQ ID NO: 3955554 - RNA, 19 nt, Human herpesvirus 1
ccccugccccccccacccc

SEQ ID NO: 3955555 - RNA, 13 nt, Human herpesvirus 1
ccccuggcgagcc

SEQ ID NO: 3955556 - RNA, 18 nt, Human herpesvirus 1
ccccuguggcccuggcgg

SEQ ID NO: 3955557 - RNA, 19 nt, Human herpesvirus 1
ccccuuaaugggugcgggg

SEQ ID NO: 3955558 - RNA, 20 nt, Human herpesvirus 1
cccgaaacuucaucaccccc

SEQ ID NO: 3955559 - RNA, 15 nt, Human herpesvirus 1
cccgacaccaccagc

SEQ ID NO: 3955560 - RNA, 23 nt, Human herpesvirus 1
cccgcaacgcgcuggggcugccg

SEQ ID NO: 3955561 - RNA, 17 nt, Human herpesvirus 1
cccgcccaccgcugggc

SEQ ID NO: 3955562 - RNA, 13 nt, Human herpesvirus 1
cccgccccggagg

SEQ ID NO: 3955563 - RNA, 18 nt, Human herpesvirus 1
cccgccccucgccacguc

SEQ ID NO: 3955564 - RNA, 14 nt, Human herpesvirus 1
cccgccgccacugu

SEQ ID NO: 3955565 - RNA, 13 nt, Human herpesvirus 1
cccgccgccccac

SEQ ID NO: 3955566 - RNA, 18 nt, Human herpesvirus 1
cccgccguugagccccuc

SEQ ID NO: 3955567 - RNA, 18 nt, Human herpesvirus 1
cccgcgacccggacgccg

SEQ ID NO: 3955568 - RNA, 21 nt, Human herpesvirus 1
cccgcgcgccccgagaccagu

SEQ ID NO: 3955569 - RNA, 13 nt, Human herpesvirus 1
cccgcguccaccc

SEQ ID NO: 3955570 - RNA, 18 nt, Human herpesvirus 1
cccgcguccacccggagg

SEQ ID NO: 3955571 - RNA, 18 nt, Human herpesvirus 1
cccgcgucuggccccggc

SEQ ID NO: 3955572 - RNA, 16 nt, Human herpesvirus 1
cccgcucugacggccc

SEQ ID NO: 3955573 - RNA, 14 nt, Human herpesvirus 1
cccgcuggggcggc

SEQ ID NO: 3955574 - RNA, 17 nt, Human herpesvirus 1
cccggaaccugcucacg

SEQ ID NO: 3955575 - RNA, 22 nt, Human herpesvirus 1
cccggaagagccugccgccuca

SEQ ID NO: 3955576 - RNA, 17 nt, Human herpesvirus 1
cccggaccccacgcacc

SEQ ID NO: 3955577 - RNA, 16 nt, Human herpesvirus 1
cccggacgacauggcc

SEQ ID NO: 3955578 - RNA, 15 nt, Human herpesvirus 1
cccggaggaggcucu

SEQ ID NO: 3955579 - RNA, 22 nt, Human herpesvirus 1
cccggccggauucccgggccgg

SEQ ID NO: 3955580 - RNA, 24 nt, Human herpesvirus 1
cccggcgggguuauaggccacgca

SEQ ID NO: 3955581 - RNA, 15 nt, Human herpesvirus 1
cccggggcucagcca

SEQ ID NO: 3955582 - RNA, 16 nt, Human herpesvirus 1
cccgggucuguugggg

SEQ ID NO: 3955583 - RNA, 16 nt, Human herpesvirus 1
cccggucucccaggga

SEQ ID NO: 3955584 - RNA, 17 nt, Human herpesvirus 1
cccguaaaugguugcag

SEQ ID NO: 3955585 - RNA, 17 nt, Human herpesvirus 1
cccguagucccaucccc

SEQ ID NO: 3955586 - RNA, 20 nt, Human herpesvirus 1
cccguggggacgguggcgcc

SEQ ID NO: 3955587 - RNA, 23 nt, Human herpesvirus 1
cccguggggacgguggcgccgca

SEQ ID NO: 3955588 - RNA, 14 nt, Human herpesvirus 1
cccgugucuguggg

SEQ ID NO: 3955589 - RNA, 18 nt, Human herpesvirus 1
cccguuccagccccccag

SEQ ID NO: 3955590 - RNA, 14 nt, Human herpesvirus 1
cccuaaccaccgcu

SEQ ID NO: 3955591 - RNA, 19 nt, Human herpesvirus 1
cccuacaccggccacccag

SEQ ID NO: 3955592 - RNA, 19 nt, Human herpesvirus 1
cccucacagggcgggccgc

SEQ ID NO: 3955593 - RNA, 14 nt, Human herpesvirus 1
cccuccccccgcgu

SEQ ID NO: 3955594 - RNA, 22 nt, Human herpesvirus 1
cccuccggggguccggcgcgug

SEQ ID NO: 3955595 - RNA, 20 nt, Human herpesvirus 1
cccucgaccaccaccuccac

SEQ ID NO: 3955596 - RNA, 15 nt, Human herpesvirus 1
cccucgggcaucucg

SEQ ID NO: 3955597 - RNA, 19 nt, Human herpesvirus 1
cccucguucugcugcaccg

SEQ ID NO: 3955598 - RNA, 15 nt, Human herpesvirus 1
cccucugggcccgcc

SEQ ID NO: 3955599 - RNA, 23 nt, Human herpesvirus 1
cccucuuggaggaccccgugggg

SEQ ID NO: 3955600 - RNA, 18 nt, Human herpesvirus 1
cgacgguaaacugcaucg

SEQ ID NO: 3955601 - RNA, 16 nt, Human herpesvirus 1
cgacgucgcgccuggg

SEQ ID NO: 3955602 - RNA, 23 nt, Human herpesvirus 1
cgacgugguccgcggggccuccc

SEQ ID NO: 3955603 - RNA, 15 nt, Human herpesvirus 1
cgacugcccccccca

SEQ ID NO: 3955604 - RNA, 20 nt, Human herpesvirus 1
cgacugcgaccccagccuuc

SEQ ID NO: 3955605 - RNA, 20 nt, Human herpesvirus 1
cgagaucaaggacagcggcc

SEQ ID NO: 3955606 - RNA, 17 nt, Human herpesvirus 1
cgagauccccggggccc

SEQ ID NO: 3955607 - RNA, 19 nt, Human herpesvirus 1
cgagcagccgcgccgcugc

SEQ ID NO: 3955608 - RNA, 17 nt, Human herpesvirus 1
cgagccaacgcccugac

SEQ ID NO: 3955609 - RNA, 12 nt, Human herpesvirus 1
cgagccccccgc

SEQ ID NO: 3955610 - RNA, 16 nt, Human herpesvirus 1
cgagccggggcuggca

SEQ ID NO: 3955611 - RNA, 22 nt, Human herpesvirus 1
cgagccgugcaccgugggacac

SEQ ID NO: 3955612 - RNA, 12 nt, Human herpesvirus 1
cgagcgcgcugc

SEQ ID NO: 3955613 - RNA, 19 nt, Human herpesvirus 1
cgagcgcgcuuguccccga

SEQ ID NO: 3955614 - RNA, 16 nt, Human herpesvirus 1
cgagcuaugggccucu

SEQ ID NO: 3955615 - RNA, 16 nt, Human herpesvirus 1
cgagcugacccugugg

SEQ ID NO: 3955616 - RNA, 22 nt, Human herpesvirus 1
cgaggaccacgugcacagccug

SEQ ID NO: 3955617 - RNA, 23 nt, Human herpesvirus 1
cgaggaggacgucuccaagcuuu

SEQ ID NO: 3955618 - RNA, 16 nt, Human herpesvirus 1
cgaggcccgcaagcug

SEQ ID NO: 3955619 - RNA, 20 nt, Human herpesvirus 1
cgaggcccgcaagcugaacc

SEQ ID NO: 3955620 - RNA, 22 nt, Human herpesvirus 1
cgaggcggccugggucuuccgc

SEQ ID NO: 3955621 - RNA, 22 nt, Human herpesvirus 1
cgagggcaucuuuuuugccgcc

SEQ ID NO: 3955622 - RNA, 23 nt, Human herpesvirus 1
cgagguggagcugcccggcggcc

SEQ ID NO: 3955623 - RNA, 15 nt, Human herpesvirus 1
cgaguccgaagagga

SEQ ID NO: 3955624 - RNA, 17 nt, Human herpesvirus 1
cgagucuucggggcccg

SEQ ID NO: 3955625 - RNA, 21 nt, Human herpesvirus 1
cgaucccaacaacucccccgc

SEQ ID NO: 3955626 - RNA, 23 nt, Human herpesvirus 1
cgaucuccacgcgaccccauggc

SEQ ID NO: 3955627 - RNA, 21 nt, Human herpesvirus 1
cgaucugugagugucgcggcg

SEQ ID NO: 3955628 - RNA, 17 nt, Human herpesvirus 1
cgcaacgcgcuggggcu

SEQ ID NO: 3955629 - RNA, 15 nt, Human herpesvirus 1
cgcaauugcggccac

SEQ ID NO: 3955630 - RNA, 20 nt, Human herpesvirus 1
cgcaauuugcacccagccuu

SEQ ID NO: 3955631 - RNA, 20 nt, Human herpesvirus 1
cgcacaucaaggugggccag

SEQ ID NO: 3955632 - RNA, 13 nt, Human herpesvirus 1
cgcacccacagcu

SEQ ID NO: 3955633 - RNA, 19 nt, Human herpesvirus 1
cgcaccgggcccccgcccc

SEQ ID NO: 3955634 - RNA, 20 nt, Human herpesvirus 1
cgcaccgucggaggcccccc

SEQ ID NO: 3955635 - RNA, 21 nt, Human herpesvirus 1
cgcaccuccuccgacgcccag

SEQ ID NO: 3955636 - RNA, 12 nt, Human herpesvirus 1
cgcaccugguga

SEQ ID NO: 3955637 - RNA, 16 nt, Human herpesvirus 1
cgcacgagccggggcu

SEQ ID NO: 3955638 - RNA, 16 nt, Human herpesvirus 1
cgcagaggcggccaga

SEQ ID NO: 3955639 - RNA, 20 nt, Human herpesvirus 1
cgcaguccacgggggggagc

SEQ ID NO: 3955640 - RNA, 16 nt, Human herpesvirus 1
cgcagucccgggggcu

SEQ ID NO: 3955641 - RNA, 23 nt, Human herpesvirus 1
cgcauccgucgggaggccacaga

SEQ ID NO: 3955642 - RNA, 15 nt, Human herpesvirus 1
cgcaucuuuccugug

SEQ ID NO: 3955643 - RNA, 17 nt, Human herpesvirus 1
cgcaugaucuccggacc

SEQ ID NO: 3955644 - RNA, 21 nt, Human herpesvirus 1
cgcaugaucuccggacccccg

SEQ ID NO: 3955645 - RNA, 14 nt, Human herpesvirus 1
cgccacccaggcgc

SEQ ID NO: 3955646 - RNA, 14 nt, Human herpesvirus 1
cgccagcaccccgg

SEQ ID NO: 3955647 - RNA, 19 nt, Human herpesvirus 1
cgccagcgcggcggggccc

SEQ ID NO: 3955648 - RNA, 20 nt, Human herpesvirus 1
cgccagcuuuccgcugagcc

SEQ ID NO: 3955649 - RNA, 13 nt, Human herpesvirus 1
cgccagggccucg

SEQ ID NO: 3955650 - RNA, 22 nt, Human herpesvirus 1
cgccagggcgcccccgcgcggg

SEQ ID NO: 3955651 - RNA, 13 nt, Human herpesvirus 1
cgccaucagccuu

SEQ ID NO: 3955652 - RNA, 20 nt, Human herpesvirus 1
cgccauguuugcgggccugg

SEQ ID NO: 3955653 - RNA, 21 nt, Human herpesvirus 1
cgccauguuugcgggccuggg

SEQ ID NO: 3955654 - RNA, 21 nt, Human herpesvirus 1
cgcccagacgcccuccgagga

SEQ ID NO: 3955655 - RNA, 20 nt, Human herpesvirus 1
cgccccccguguuugugggg

SEQ ID NO: 3955656 - RNA, 11 nt, Human herpesvirus 1
cgcccccggca

SEQ ID NO: 3955657 - RNA, 19 nt, Human herpesvirus 1
cgccccggaagaccccgag

SEQ ID NO: 3955658 - RNA, 17 nt, Human herpesvirus 1
cgccccucccccgaccu

SEQ ID NO: 3955659 - RNA, 14 nt, Human herpesvirus 1
cgccccuggcgcgc

SEQ ID NO: 3955660 - RNA, 18 nt, Human herpesvirus 1
cgccccuguggcccuggc

SEQ ID NO: 3955661 - RNA, 15 nt, Human herpesvirus 1
cgcccgaccgcgugu

SEQ ID NO: 3955662 - RNA, 17 nt, Human herpesvirus 1
cgcccgccccccgaccg

SEQ ID NO: 3955663 - RNA, 17 nt, Human herpesvirus 1
cgcccgccccugcgcag

SEQ ID NO: 3955664 - RNA, 21 nt, Human herpesvirus 1
cgcccgcgacgccauggaccg

SEQ ID NO: 3955665 - RNA, 13 nt, Human herpesvirus 1
cgcccggggccag

SEQ ID NO: 3955666 - RNA, 22 nt, Human herpesvirus 1
cgcccgucuuuaaccucccccg

SEQ ID NO: 3955667 - RNA, 21 nt, Human herpesvirus 1
cgcccucacagggcgggccgc

SEQ ID NO: 3955668 - RNA, 15 nt, Human herpesvirus 1
cgcccuggccgcgga

SEQ ID NO: 3955669 - RNA, 21 nt, Human herpesvirus 1
cgccgacaucaccaccgucag

SEQ ID NO: 3955670 - RNA, 13 nt, Human herpesvirus 1
cgccgacucccgg

SEQ ID NO: 3955671 - RNA, 13 nt, Human herpesvirus 1
cgccgagcccccc

SEQ ID NO: 3955672 - RNA, 21 nt, Human herpesvirus 1
cgccgagcugcgaucgcuggu

SEQ ID NO: 3955673 - RNA, 23 nt, Human herpesvirus 1
cgccgagucuucggggcccggcc

SEQ ID NO: 3955674 - RNA, 21 nt, Human herpesvirus 1
cgccgcaaagccacccacgcc

SEQ ID NO: 3955675 - RNA, 16 nt, Human herpesvirus 1
cgccgccaccguggcc

SEQ ID NO: 3955676 - RNA, 19 nt, Human herpesvirus 1
cgccgccaccguggccggc

SEQ ID NO: 3955677 - RNA, 16 nt, Human herpesvirus 1
cgccgcccugagcgcc

SEQ ID NO: 3955678 - RNA, 16 nt, Human herpesvirus 1
cgccgcgagcccgucu

SEQ ID NO: 3955679 - RNA, 21 nt, Human herpesvirus 1
cgccgcgaguacguggccggu

SEQ ID NO: 3955680 - RNA, 19 nt, Human herpesvirus 1
cgccgcgcguugggcccug

SEQ ID NO: 3955681 - RNA, 15 nt, Human herpesvirus 1
cgccgcggccugggu

SEQ ID NO: 3955682 - RNA, 12 nt, Human herpesvirus 1
cgccgcgggccc

SEQ ID NO: 3955683 - RNA, 13 nt, Human herpesvirus 1
cgccgcugacccc

SEQ ID NO: 3955684 - RNA, 22 nt, Human herpesvirus 1
cgccggcggucgcgcuccucug

SEQ ID NO: 3955685 - RNA, 21 nt, Human herpesvirus 1
cgccggggcucucggggccgc

SEQ ID NO: 3955686 - RNA, 12 nt, Human herpesvirus 1
cgccguccgaac

SEQ ID NO: 3955687 - RNA, 15 nt, Human herpesvirus 1
cgccguccgaaccca

SEQ ID NO: 3955688 - RNA, 14 nt, Human herpesvirus 1
cgccguccuugcau

SEQ ID NO: 3955689 - RNA, 14 nt, Human herpesvirus 1
cgccguggcgcccc

SEQ ID NO: 3955690 - RNA, 16 nt, Human herpesvirus 1
cgccguguuggagcgc

SEQ ID NO: 3955691 - RNA, 16 nt, Human herpesvirus 1
cgccguuggcccccgc

SEQ ID NO: 3955692 - RNA, 17 nt, Human herpesvirus 1
cgccucaacauaccccg

SEQ ID NO: 3955693 - RNA, 22 nt, Human herpesvirus 1
cgccucaacauaccccgcuguu

SEQ ID NO: 3955694 - RNA, 20 nt, Human herpesvirus 1
cgccucccggggggucggca

SEQ ID NO: 3955695 - RNA, 19 nt, Human herpesvirus 1
cgccuccgcccgugcugcc

SEQ ID NO: 3955696 - RNA, 12 nt, Human herpesvirus 1
cgccucgggcga

SEQ ID NO: 3955697 - RNA, 19 nt, Human herpesvirus 1
cgccuggcugacccacgcg

SEQ ID NO: 3955698 - RNA, 22 nt, Human herpesvirus 1
cgccuggcuggccgcucggugg

SEQ ID NO: 3955699 - RNA, 14 nt, Human herpesvirus 1
cgccuuaccauccc

SEQ ID NO: 3955700 - RNA, 22 nt, Human herpesvirus 1
cgccuuuuuggguccgggcccg

SEQ ID NO: 3955701 - RNA, 14 nt, Human herpesvirus 1
cgcgaacgaccaac

SEQ ID NO: 3955702 - RNA, 20 nt, Human herpesvirus 1
cgcgaaggacgccggagccg

SEQ ID NO: 3955703 - RNA, 19 nt, Human herpesvirus 1
cgcgacccaccgggcccgg

SEQ ID NO: 3955704 - RNA, 14 nt, Human herpesvirus 1
cgcgacccaggcgg

SEQ ID NO: 3955705 - RNA, 15 nt, Human herpesvirus 1
cgcgaccccauggcc

SEQ ID NO: 3955706 - RNA, 17 nt, Human herpesvirus 1
cgcgaccgacagcacuc

SEQ ID NO: 3955707 - RNA, 21 nt, Human herpesvirus 1
cgcgaccucaccaccaaggcc

SEQ ID NO: 3955708 - RNA, 17 nt, Human herpesvirus 1
cgcgagauggccgcccc

SEQ ID NO: 3955709 - RNA, 22 nt, Human herpesvirus 1
cgcgagauggccgccccggugu

SEQ ID NO: 3955710 - RNA, 18 nt, Human herpesvirus 1
cgcgagcagagccgcaag

SEQ ID NO: 3955711 - RNA, 18 nt, Human herpesvirus 1
cgcgauuccgagggccgg

SEQ ID NO: 3955712 - RNA, 19 nt, Human herpesvirus 1
cgcgcaccuguuccgccug

SEQ ID NO: 3955713 - RNA, 20 nt, Human herpesvirus 1
cgcgcaccuguuccgccugu

SEQ ID NO: 3955714 - RNA, 22 nt, Human herpesvirus 1
ucugucucgucuccucuucucc

SEQ ID NO: 3955715 - RNA, 19 nt, Human herpesvirus 1
ucuuagccuccccgggcca

SEQ ID NO: 3955716 - RNA, 16 nt, Human herpesvirus 1
ucuucccccccaucac

SEQ ID NO: 3955717 - RNA, 15 nt, Human herpesvirus 1
ucuucuccccuuccc

SEQ ID NO: 3955718 - RNA, 14 nt, Human herpesvirus 1
ucuucucucccggg

SEQ ID NO: 3955719 - RNA, 23 nt, Human herpesvirus 1
ucuuggaggaccccguggggacg

SEQ ID NO: 3955720 - RNA, 12 nt, Human herpesvirus 1
ucuuugugccug

SEQ ID NO: 3955721 - RNA, 18 nt, Human herpesvirus 1
ugaacgaagcggccaugg

SEQ ID NO: 3955722 - RNA, 21 nt, Human herpesvirus 1
ugaacgcaacggcgggagcug

SEQ ID NO: 3955723 - RNA, 17 nt, Human herpesvirus 1
ugacccagaccggcacc

SEQ ID NO: 3955724 - RNA, 15 nt, Human herpesvirus 1
ugaccgcccccagcu

SEQ ID NO: 3955725 - RNA, 18 nt, Human herpesvirus 1
ugagcccggcggcgcugg

SEQ ID NO: 3955726 - RNA, 17 nt, Human herpesvirus 1
ugagcgcccuccugacc

SEQ ID NO: 3955727 - RNA, 18 nt, Human herpesvirus 1
ugagcgcccuccugacca

SEQ ID NO: 3955728 - RNA, 22 nt, Human herpesvirus 1
ugaugucccucauuuuacaaua

SEQ ID NO: 3955729 - RNA, 22 nt, Human herpesvirus 1
ugcacaacacaaacaucuggag

SEQ ID NO: 3955730 - RNA, 15 nt, Human herpesvirus 1
ugcacucccugccgc

SEQ ID NO: 3955731 - RNA, 13 nt, Human herpesvirus 1
ugcauauccuggg

SEQ ID NO: 3955732 - RNA, 13 nt, Human herpesvirus 1
ugcccauaauaaa

SEQ ID NO: 3955733 - RNA, 20 nt, Human herpesvirus 1
ugcccgacagggccgugccc

SEQ ID NO: 3955734 - RNA, 21 nt, Human herpesvirus 1
ugcccucccugacggccaucg

SEQ ID NO: 3955735 - RNA, 13 nt, Human herpesvirus 1
ugcccucgcgggc

SEQ ID NO: 3955736 - RNA, 21 nt, Human herpesvirus 1
ugcccucgcgggccucguggg

SEQ ID NO: 3955737 - RNA, 13 nt, Human herpesvirus 1
ugccgggaacgcu

SEQ ID NO: 3955738 - RNA, 20 nt, Human herpesvirus 1
ugccuugguggaugccucuc

SEQ ID NO: 3955739 - RNA, 13 nt, Human herpesvirus 1
ugcgaccccagcc

SEQ ID NO: 3955740 - RNA, 20 nt, Human herpesvirus 1
ugcgccuggauucgcuggac

SEQ ID NO: 3955741 - RNA, 19 nt, Human herpesvirus 1
ugcgcgaucccccgccccc

SEQ ID NO: 3955742 - RNA, 16 nt, Human herpesvirus 1
ugcggagggcacccaa

SEQ ID NO: 3955743 - RNA, 22 nt, Human herpesvirus 1
ugcggcuuaugaacgacugggc

SEQ ID NO: 3955744 - RNA, 15 nt, Human herpesvirus 1
ugcgggcucggcucc

SEQ ID NO: 3955745 - RNA, 14 nt, Human herpesvirus 1
ugcgguuggggagg

SEQ ID NO: 3955746 - RNA, 13 nt, Human herpesvirus 1
ugcuacagccgcc

SEQ ID NO: 3955747 - RNA, 17 nt, Human herpesvirus 1
ugcucagcgccaagguc

SEQ ID NO: 3955748 - RNA, 15 nt, Human herpesvirus 1
ugcucgacagccacu

SEQ ID NO: 3955749 - RNA, 22 nt, Human herpesvirus 1
ugcugcaggccccccgccgucc

SEQ ID NO: 3955750 - RNA, 20 nt, Human herpesvirus 1
ugcugcccccggagcugucc

SEQ ID NO: 3955751 - RNA, 17 nt, Human herpesvirus 1
ugcugcggcccacccug

SEQ ID NO: 3955752 - RNA, 13 nt, Human herpesvirus 1
ugcuucccacgcg

SEQ ID NO: 3955753 - RNA, 22 nt, Human herpesvirus 1
uggaacgaggccgcagccuucu

SEQ ID NO: 3955754 - RNA, 17 nt, Human herpesvirus 1
uggaccuugggccgucg

SEQ ID NO: 3955755 - RNA, 15 nt, Human herpesvirus 1
uggacgcgccucccg

SEQ ID NO: 3955756 - RNA, 17 nt, Human herpesvirus 1
uggacgcgccucccggg

SEQ ID NO: 3955757 - RNA, 23 nt, Human herpesvirus 1
uggagcgcacggaacacaaggcc

SEQ ID NO: 3955758 - RNA, 15 nt, Human herpesvirus 1
uggaggcgcggcgcc

SEQ ID NO: 3955759 - RNA, 15 nt, Human herpesvirus 1
uggagggugucccag

SEQ ID NO: 3955760 - RNA, 16 nt, Human herpesvirus 1
uggaggucguuuucau

SEQ ID NO: 3955761 - RNA, 16 nt, Human herpesvirus 1
uggaucuuagccuccc

SEQ ID NO: 3955762 - RNA, 21 nt, Human herpesvirus 1
uggcacaaaaagaccccgauc

SEQ ID NO: 3955763 - RNA, 23 nt, Human herpesvirus 1
uggcagccgaugccccgggagac

SEQ ID NO: 3955764 - RNA, 15 nt, Human herpesvirus 1
uggcauucgacgaca

SEQ ID NO: 3955765 - RNA, 12 nt, Human herpesvirus 1
uggccagcggcc

SEQ ID NO: 3955766 - RNA, 15 nt, Human herpesvirus 1
uggccagcggcccgg

SEQ ID NO: 3955767 - RNA, 21 nt, Human herpesvirus 1
uggccaucgguccccucuggg

SEQ ID NO: 3955768 - RNA, 16 nt, Human herpesvirus 1
uggccccaguccccaa

SEQ ID NO: 3955769 - RNA, 12 nt, Human herpesvirus 1
uggcccuccagg

SEQ ID NO: 3955770 - RNA, 12 nt, Human herpesvirus 1
uggcccuggcuc

SEQ ID NO: 3955771 - RNA, 21 nt, Human herpesvirus 1
uggccggggagggcagggccg

SEQ ID NO: 3955772 - RNA, 17 nt, Human herpesvirus 1
uggcgagcccagacccc

SEQ ID NO: 3955773 - RNA, 12 nt, Human herpesvirus 1
uggcgccccggc

SEQ ID NO: 3955774 - RNA, 18 nt, Human herpesvirus 1
uggcgccugacgcgccgc

SEQ ID NO: 3955775 - RNA, 20 nt, Human herpesvirus 1
uggcgcgucguucgggcgga

SEQ ID NO: 3955776 - RNA, 14 nt, Human herpesvirus 1
uggcgucccaucug

SEQ ID NO: 3955777 - RNA, 16 nt, Human herpesvirus 1
uggcuccuggccagga

SEQ ID NO: 3955778 - RNA, 13 nt, Human herpesvirus 1
uggcugccccccc

SEQ ID NO: 3955779 - RNA, 15 nt, Human herpesvirus 1
ugggacaccggcgcu

SEQ ID NO: 3955780 - RNA, 18 nt, Human herpesvirus 1
ugggagagccggccccgg

SEQ ID NO: 3955781 - RNA, 17 nt, Human herpesvirus 1
ugggcacuuuccccaug

SEQ ID NO: 3955782 - RNA, 22 nt, Human herpesvirus 1
ugggcauccagggagaaacccc

SEQ ID NO: 3955783 - RNA, 13 nt, Human herpesvirus 1
ugggccagccgca

SEQ ID NO: 3955784 - RNA, 14 nt, Human herpesvirus 1
ugggccugaucgcc

SEQ ID NO: 3955785 - RNA, 14 nt, Human herpesvirus 1
ugggcggccccggc

SEQ ID NO: 3955786 - RNA, 15 nt, Human herpesvirus 1
ugggcggccccggcc

SEQ ID NO: 3955787 - RNA, 16 nt, Human herpesvirus 1
uggggacgguggcgcc

SEQ ID NO: 3955788 - RNA, 19 nt, Human herpesvirus 1
uggggagagcccacaugcg

SEQ ID NO: 3955789 - RNA, 15 nt, Human herpesvirus 1
uggggagccucgauc

SEQ ID NO: 3955790 - RNA, 18 nt, Human herpesvirus 1
ugggggcguagagcugug

SEQ ID NO: 3955791 - RNA, 16 nt, Human herpesvirus 1
uggggggggcugccgc

SEQ ID NO: 3955792 - RNA, 13 nt, Human herpesvirus 1
uggggggggggcg

SEQ ID NO: 3955793 - RNA, 22 nt, Human herpesvirus 1
ugggugcgggggggucaggucu

SEQ ID NO: 3955794 - RNA, 16 nt, Human herpesvirus 1
ugguaauuagaaacuc

SEQ ID NO: 3955795 - RNA, 18 nt, Human herpesvirus 1
ugguccccccucuauccc

SEQ ID NO: 3955796 - RNA, 22 nt, Human herpesvirus 1
uggucgaucccgaacgacacac

SEQ ID NO: 3955797 - RNA, 12 nt, Human herpesvirus 1
uggucucuggcc

SEQ ID NO: 3955798 - RNA, 13 nt, Human herpesvirus 1
ugguuauaugcac

SEQ ID NO: 3955799 - RNA, 21 nt, Human herpesvirus 1
uguacaacaucauccagcugg

SEQ ID NO: 3955800 - RNA, 14 nt, Human herpesvirus 1
uguagcgccccggc

SEQ ID NO: 3955801 - RNA, 23 nt, Human herpesvirus 1
uguauguccccaaaauaaaagac

SEQ ID NO: 3955802 - RNA, 22 nt, Human herpesvirus 1
uguccaccgggaagcagggccc

SEQ ID NO: 3955803 - RNA, 23 nt, Human herpesvirus 1
ugucccauccgaacgcagccccg

SEQ ID NO: 3955804 - RNA, 23 nt, Human herpesvirus 1
uguccccgccgacaagccgcgau

SEQ ID NO: 3955805 - RNA, 14 nt, Human herpesvirus 1
uguccucgggacau

SEQ ID NO: 3955806 - RNA, 17 nt, Human herpesvirus 1
ugucgucucucuucccc

SEQ ID NO: 3955807 - RNA, 19 nt, Human herpesvirus 1
ugucuccccgauggcccuc

SEQ ID NO: 3955808 - RNA, 14 nt, Human herpesvirus 1
ugucucgucuccuc

SEQ ID NO: 3955809 - RNA, 20 nt, Human herpesvirus 1
ugucugugggccaagauggc

SEQ ID NO: 3955810 - RNA, 21 nt, Human herpesvirus 1
uguucguggaaccaugaccuc

SEQ ID NO: 3955811 - RNA, 12 nt, Human herpesvirus 1
uguuggggacac

SEQ ID NO: 3955812 - RNA, 11 nt, Human herpesvirus 1
uuaacagacga

SEQ ID NO: 3955813 - RNA, 13 nt, Human herpesvirus 1
uuaaccaccugcg

SEQ ID NO: 3955814 - RNA, 11 nt, Human herpesvirus 1
uuacagccccc

SEQ ID NO: 3955815 - RNA, 13 nt, Human herpesvirus 1
uuacguacaacca

SEQ ID NO: 3955816 - RNA, 12 nt, Human herpesvirus 1
uuagccagcaga

SEQ ID NO: 3955817 - RNA, 15 nt, Human herpesvirus 1
uucacgugcugcugc

SEQ ID NO: 3955818 - RNA, 17 nt, Human herpesvirus 1
uuccaggucccaccuga

SEQ ID NO: 3955819 - RNA, 12 nt, Human herpesvirus 1
uuccccucccgu

SEQ ID NO: 3955820 - RNA, 12 nt, Human herpesvirus 1
uucccgaaacuu

SEQ ID NO: 3955821 - RNA, 11 nt, Human herpesvirus 1
uucccuccccc

SEQ ID NO: 3955822 - RNA, 21 nt, Human herpesvirus 1
uuccgcggccccagcccucuc

SEQ ID NO: 3955823 - RNA, 13 nt, Human herpesvirus 1
uucgccccacaca

SEQ ID NO: 3955824 - RNA, 16 nt, Human herpesvirus 1
uucggaugggaggcaa

SEQ ID NO: 3955825 - RNA, 20 nt, Human herpesvirus 1
uugccgugguccuguggagc

SEQ ID NO: 3955826 - RNA, 13 nt, Human herpesvirus 1
uuggggcccaccc

SEQ ID NO: 3955827 - RNA, 14 nt, Human herpesvirus 1
uuggucaaacucag

SEQ ID NO: 3955828 - RNA, 17 nt, Human herpesvirus 1
uugucgucucucuuccc

SEQ ID NO: 3955829 - RNA, 19 nt, Human herpesvirus 1
uuucaccgccccagcaccg

SEQ ID NO: 3955830 - RNA, 20 nt, Human herpesvirus 1
aaaacagcgacgacgucugu

SEQ ID NO: 3955831 - RNA, 18 nt, Human herpesvirus 1
aaaacugauaaaacagcg

SEQ ID NO: 3955832 - RNA, 14 nt, Human herpesvirus 1
aaacaagagccucc

SEQ ID NO: 3955833 - RNA, 23 nt, Human herpesvirus 1
aaacaagagccuccguuggguuu

SEQ ID NO: 3955834 - RNA, 11 nt, Human herpesvirus 1
aaacaucugga

SEQ ID NO: 3955835 - RNA, 13 nt, Human herpesvirus 1
aaaccccacgccc

SEQ ID NO: 3955836 - RNA, 16 nt, Human herpesvirus 1
aaaccccacgcccccg

SEQ ID NO: 3955837 - RNA, 14 nt, Human herpesvirus 1
aaaccugggcggcc

SEQ ID NO: 3955838 - RNA, 13 nt, Human herpesvirus 1
aaacgccagccug

SEQ ID NO: 3955839 - RNA, 22 nt, Human herpesvirus 1
aaacgccucccccugagccgcu

SEQ ID NO: 3955840 - RNA, 20 nt, Human herpesvirus 1
aaacgucagacgagcgcgcu

SEQ ID NO: 3955841 - RNA, 15 nt, Human herpesvirus 1
aaacugacaucgcga

SEQ ID NO: 3955842 - RNA, 19 nt, Human herpesvirus 1
aaagacacgggcaccacac

SEQ ID NO: 3955843 - RNA, 14 nt, Human herpesvirus 1
aaagaccaaaauca

SEQ ID NO: 3955844 - RNA, 21 nt, Human herpesvirus 1
aacaagucucugggggccugu

SEQ ID NO: 3955845 - RNA, 17 nt, Human herpesvirus 1
aacacgcucgcggagcu

SEQ ID NO: 3955846 - RNA, 12 nt, Human herpesvirus 1
aacaugacccag

SEQ ID NO: 3955847 - RNA, 13 nt, Human herpesvirus 1
aacaugggccuga

SEQ ID NO: 3955848 - RNA, 20 nt, Human herpesvirus 1
aaccaccuuccguccccugc

SEQ ID NO: 3955849 - RNA, 13 nt, Human herpesvirus 1
aacccaaccgucc

SEQ ID NO: 3955850 - RNA, 13 nt, Human herpesvirus 1
aaccccaacucca

SEQ ID NO: 3955851 - RNA, 12 nt, Human herpesvirus 1
aaccccaccccu

SEQ ID NO: 3955852 - RNA, 11 nt, Human herpesvirus 1
aaccccaggga

SEQ ID NO: 3955853 - RNA, 16 nt, Human herpesvirus 1
aaccccuuuggggcgc

SEQ ID NO: 3955854 - RNA, 20 nt, Human herpesvirus 1
aacccgccccuaaccaggcc

SEQ ID NO: 3955855 - RNA, 22 nt, Human herpesvirus 1
aaccgcaccccccucguccccc

SEQ ID NO: 3955856 - RNA, 11 nt, Human herpesvirus 1
aaccggccgcc

SEQ ID NO: 3955857 - RNA, 22 nt, Human herpesvirus 1
aaccuuuaggaugccagccagg

SEQ ID NO: 3955858 - RNA, 12 nt, Human herpesvirus 1
aacgaggcccgc

SEQ ID NO: 3955859 - RNA, 20 nt, Human herpesvirus 1
aacgcaacggcgggagcugg

SEQ ID NO: 3955860 - RNA, 12 nt, Human herpesvirus 1
aacgccuccccc

SEQ ID NO: 3955861 - RNA, 15 nt, Human herpesvirus 1
aacgcgcuggggcug

SEQ ID NO: 3955862 - RNA, 16 nt, Human herpesvirus 1
aacgggggggugucgc

SEQ ID NO: 3955863 - RNA, 18 nt, Human herpesvirus 1
aacgucuccuccaccacc

SEQ ID NO: 3955864 - RNA, 15 nt, Human herpesvirus 1
aacgugcgcgauccc

SEQ ID NO: 3955865 - RNA, 14 nt, Human herpesvirus 1
aacucucgcaccau

SEQ ID NO: 3955866 - RNA, 23 nt, Human herpesvirus 1
aacuggguggcggggcaggcgcc

SEQ ID NO: 3955867 - RNA, 18 nt, Human herpesvirus 1
aagaggaggagggggccg

SEQ ID NO: 3955868 - RNA, 13 nt, Human herpesvirus 1
aagaggggcuggg

SEQ ID NO: 3955869 - RNA, 17 nt, Human herpesvirus 1
aagcacacacgggggag

SEQ ID NO: 3955870 - RNA, 12 nt, Human herpesvirus 1
aagcuagccgag

SEQ ID NO: 3955871 - RNA, 18 nt, Human herpesvirus 1
aaggugggccagccgcag

SEQ ID NO: 3955872 - RNA, 18 nt, Human herpesvirus 1
aaguucaccguggccugg

SEQ ID NO: 3955873 - RNA, 19 nt, Human herpesvirus 1
aaguucaccguggccuggg

SEQ ID NO: 3955874 - RNA, 15 nt, Human herpesvirus 1
aauaaauuuuacaaa

SEQ ID NO: 3955875 - RNA, 19 nt, Human herpesvirus 1
aaucaccggugcgcccccc

SEQ ID NO: 3955876 - RNA, 18 nt, Human herpesvirus 1
aaugggcggccccggccg

SEQ ID NO: 3955877 - RNA, 15 nt, Human herpesvirus 1
aauuagaaacucauu

SEQ ID NO: 3955878 - RNA, 23 nt, Human herpesvirus 1
aauucccgcggcccuuaaugggc

SEQ ID NO: 3955879 - RNA, 15 nt, Human herpesvirus 1
aauuugcacccagcc

SEQ ID NO: 3955880 - RNA, 14 nt, Human herpesvirus 1
acaacccuacaacc

SEQ ID NO: 3955881 - RNA, 19 nt, Human herpesvirus 1
acaacgccagccugcggcc

SEQ ID NO: 3955882 - RNA, 14 nt, Human herpesvirus 1
acaacggcaugccu

SEQ ID NO: 3955883 - RNA, 22 nt, Human herpesvirus 1
acaacucccccgcgcgccccga

SEQ ID NO: 3955884 - RNA, 19 nt, Human herpesvirus 1
acaagaucaacgccaaggg

SEQ ID NO: 3955885 - RNA, 21 nt, Human herpesvirus 1
acaauccccaggacaccgcgu

SEQ ID NO: 3955886 - RNA, 20 nt, Human herpesvirus 1
acacaaaaggcguaccaaac

SEQ ID NO: 3955887 - RNA, 21 nt, Human herpesvirus 1
acaccagcgggucuuuugugu

SEQ ID NO: 3955888 - RNA, 15 nt, Human herpesvirus 1
acacccgccccucca

SEQ ID NO: 3955889 - RNA, 21 nt, Human herpesvirus 1
acaccgcguguuccccgggag

SEQ ID NO: 3955890 - RNA, 21 nt, Human herpesvirus 1
acaccggucaacgaggguugg

SEQ ID NO: 3955891 - RNA, 18 nt, Human herpesvirus 1
acaccuuggcccuggcuc

SEQ ID NO: 3955892 - RNA, 17 nt, Human herpesvirus 1
acacgagcgccagcgcu

SEQ ID NO: 3955893 - RNA, 18 nt, Human herpesvirus 1
acacggccguugucuccc

SEQ ID NO: 3955894 - RNA, 18 nt, Human herpesvirus 1
acagccgcccccugguca

SEQ ID NO: 3955895 - RNA, 20 nt, Human herpesvirus 1
acaggcgaccgccggcggcg

SEQ ID NO: 3955896 - RNA, 22 nt, Human herpesvirus 1
acaggggccauguugggccgcc

SEQ ID NO: 3955897 - RNA, 12 nt, Human herpesvirus 1
acauccccccga

SEQ ID NO: 3955898 - RNA, 22 nt, Human herpesvirus 1
acauguccgugccgcuuuaucc

SEQ ID NO: 3955899 - RNA, 18 nt, Human herpesvirus 1
accacaccaacgcacgag

SEQ ID NO: 3955900 - RNA, 21 nt, Human herpesvirus 1
accacaggugggugcuuugga

SEQ ID NO: 3955901 - RNA, 22 nt, Human herpesvirus 1
accacauaaccgaccgcagucc

SEQ ID NO: 3955902 - RNA, 16 nt, Human herpesvirus 1
accacccaaccccaac

SEQ ID NO: 3955903 - RNA, 17 nt, Human herpesvirus 1
accaccccaaauacagc

SEQ ID NO: 3955904 - RNA, 22 nt, Human herpesvirus 1
accacccccgccguccgaaccc

SEQ ID NO: 3955905 - RNA, 16 nt, Human herpesvirus 1
accaccgucagcaccu

SEQ ID NO: 3955906 - RNA, 17 nt, Human herpesvirus 1
acuacgcuucggccgcc

SEQ ID NO: 3955907 - RNA, 17 nt, Human herpesvirus 1
acucaccggcggacccc

SEQ ID NO: 3955908 - RNA, 21 nt, Human herpesvirus 1
acucauuaaugggcggccccg

SEQ ID NO: 3955909 - RNA, 23 nt, Human herpesvirus 1
acucccccgcgcgccccgagacc

SEQ ID NO: 3955910 - RNA, 13 nt, Human herpesvirus 1
acucucccaccgc

SEQ ID NO: 3955911 - RNA, 22 nt, Human herpesvirus 1
acucucccaccgccaucagccu

SEQ ID NO: 3955912 - RNA, 13 nt, Human herpesvirus 1
acucucgcaccau

SEQ ID NO: 3955913 - RNA, 17 nt, Human herpesvirus 1
acugccugacccucucc

SEQ ID NO: 3955914 - RNA, 18 nt, Human herpesvirus 1
acugccugacccucuccg

SEQ ID NO: 3955915 - RNA, 15 nt, Human herpesvirus 1
acuggaugcgccgcc

SEQ ID NO: 3955916 - RNA, 14 nt, Human herpesvirus 1
acuggccgggagca

SEQ ID NO: 3955917 - RNA, 17 nt, Human herpesvirus 1
acugugcuauccccauc

SEQ ID NO: 3955918 - RNA, 23 nt, Human herpesvirus 1
acuucccacccggagcuuucuuc

SEQ ID NO: 3955919 - RNA, 18 nt, Human herpesvirus 1
acuuccccgacugccccc

SEQ ID NO: 3955920 - RNA, 18 nt, Human herpesvirus 1
acuucgcgcccgggcgcg

SEQ ID NO: 3955921 - RNA, 16 nt, Human herpesvirus 1
agaacucgccccggaa

SEQ ID NO: 3955922 - RNA, 20 nt, Human herpesvirus 1
agaaguaauaguccguguuc

SEQ ID NO: 3955923 - RNA, 15 nt, Human herpesvirus 1
agacacgggcaccac

SEQ ID NO: 3955924 - RNA, 14 nt, Human herpesvirus 1
agacccaacccccg

SEQ ID NO: 3955925 - RNA, 12 nt, Human herpesvirus 1
agacccccccgg

SEQ ID NO: 3955926 - RNA, 23 nt, Human herpesvirus 1
agacccgggcgaugagccaaccu

SEQ ID NO: 3955927 - RNA, 17 nt, Human herpesvirus 1
agaccgcaucgacacgc

SEQ ID NO: 3955928 - RNA, 17 nt, Human herpesvirus 1
agacgaccagccguccu

SEQ ID NO: 3955929 - RNA, 21 nt, Human herpesvirus 1
agacgagcgcgcuuguccccg

SEQ ID NO: 3955930 - RNA, 21 nt, Human herpesvirus 1
agacgcugcuccgccuggccu

SEQ ID NO: 3955931 - RNA, 14 nt, Human herpesvirus 1
agacgucgccccug

SEQ ID NO: 3955932 - RNA, 14 nt, Human herpesvirus 1
agagaccccagggu

SEQ ID NO: 3955933 - RNA, 13 nt, Human herpesvirus 1
agagcaaccccau

SEQ ID NO: 3955934 - RNA, 12 nt, Human herpesvirus 1
agaggugcugcc

SEQ ID NO: 3955935 - RNA, 17 nt, Human herpesvirus 1
agagucgacgaccuggg

SEQ ID NO: 3955936 - RNA, 15 nt, Human herpesvirus 1
agauguccaauccac

SEQ ID NO: 3955937 - RNA, 18 nt, Human herpesvirus 1
agauuguccgcggggccu

SEQ ID NO: 3955938 - RNA, 21 nt, Human herpesvirus 1
agcacccugcugcccccggag

SEQ ID NO: 3955939 - RNA, 19 nt, Human herpesvirus 1
agcacgccaccgacaccgc

SEQ ID NO: 3955940 - RNA, 16 nt, Human herpesvirus 1
agccauccccgcgucc

SEQ ID NO: 3955941 - RNA, 14 nt, Human herpesvirus 1
agccccccagccuc

SEQ ID NO: 3955942 - RNA, 16 nt, Human herpesvirus 1
agcccccgccccuccc

SEQ ID NO: 3955943 - RNA, 17 nt, Human herpesvirus 1
agccccgcauaucccac

SEQ ID NO: 3955944 - RNA, 13 nt, Human herpesvirus 1
agccccggacccc

SEQ ID NO: 3955945 - RNA, 17 nt, Human herpesvirus 1
agccccucgcccguccu

SEQ ID NO: 3955946 - RNA, 23 nt, Human herpesvirus 1
agccuguuuguccuggggauggc

SEQ ID NO: 3955947 - RNA, 17 nt, Human herpesvirus 1
agcgccggguggcgccu

SEQ ID NO: 3955948 - RNA, 19 nt, Human herpesvirus 1
agcgcgcugcucagcgcca

SEQ ID NO: 3955949 - RNA, 13 nt, Human herpesvirus 1
agcgcucuugucu

SEQ ID NO: 3955950 - RNA, 23 nt, Human herpesvirus 1
agcggccauggcccgccucggag

SEQ ID NO: 3955951 - RNA, 15 nt, Human herpesvirus 1
agcguauccaccccc

SEQ ID NO: 3955952 - RNA, 21 nt, Human herpesvirus 1
agcgugcgauacuucgcgccc

SEQ ID NO: 3955953 - RNA, 16 nt, Human herpesvirus 1
agcucccagagacccc

SEQ ID NO: 3955954 - RNA, 22 nt, Human herpesvirus 1
agcugcucgagaugggccaggg

SEQ ID NO: 3955955 - RNA, 21 nt, Human herpesvirus 1
agcugggaccccggcggcccc

SEQ ID NO: 3955956 - RNA, 14 nt, Human herpesvirus 1
aggaaauccguggc

SEQ ID NO: 3955957 - RNA, 12 nt, Human herpesvirus 1
aggaacacaccc

SEQ ID NO: 3955958 - RNA, 20 nt, Human herpesvirus 1
aggacgucuccaagcuuucc

SEQ ID NO: 3955959 - RNA, 13 nt, Human herpesvirus 1
aggagcccgcccu

SEQ ID NO: 3955960 - RNA, 13 nt, Human herpesvirus 1
aggaggccgccac

SEQ ID NO: 3955961 - RNA, 18 nt, Human herpesvirus 1
aggcaguuaacugucugg

SEQ ID NO: 3955962 - RNA, 17 nt, Human herpesvirus 1
aggcccgggccacggcg

SEQ ID NO: 3955963 - RNA, 17 nt, Human herpesvirus 1
aggccgcagccuucucc

SEQ ID NO: 3955964 - RNA, 23 nt, Human herpesvirus 1
aggcgacggcgucucccgggggc

SEQ ID NO: 3955965 - RNA, 20 nt, Human herpesvirus 1
aggcgcauaaagggccggug

SEQ ID NO: 3955966 - RNA, 14 nt, Human herpesvirus 1
aggcgccugccccg

SEQ ID NO: 3955967 - RNA, 17 nt, Human herpesvirus 1
aggcgccugccccgcca

SEQ ID NO: 3955968 - RNA, 18 nt, Human herpesvirus 1
aggcgcugucuccccggg

SEQ ID NO: 3955969 - RNA, 16 nt, Human herpesvirus 1
aggcuguaggucuggg

SEQ ID NO: 3955970 - RNA, 23 nt, Human herpesvirus 1
agggccacucacgcauccccagu

SEQ ID NO: 3955971 - RNA, 17 nt, Human herpesvirus 1
agggccucgcugaccag

SEQ ID NO: 3955972 - RNA, 20 nt, Human herpesvirus 1
aggggcuccuuagcgcggcc

SEQ ID NO: 3955973 - RNA, 12 nt, Human herpesvirus 1
aggggggguccg

SEQ ID NO: 3955974 - RNA, 14 nt, Human herpesvirus 1
aggucccaccugac

SEQ ID NO: 3955975 - RNA, 14 nt, Human herpesvirus 1
agguccggccuggg

SEQ ID NO: 3955976 - RNA, 23 nt, Human herpesvirus 1
aguacgcguacucccaccagcug

SEQ ID NO: 3955977 - RNA, 17 nt, Human herpesvirus 1
aguaugccccccuggcg

SEQ ID NO: 3955978 - RNA, 13 nt, Human herpesvirus 1
aguccccgggccc

SEQ ID NO: 3955979 - RNA, 20 nt, Human herpesvirus 1
aguccccgggcccagccuuc

SEQ ID NO: 3955980 - RNA, 19 nt, Human herpesvirus 1
agucccugaguugggaaua

SEQ ID NO: 3955981 - RNA, 19 nt, Human herpesvirus 1
agucucugggggccugucc

SEQ ID NO: 3955982 - RNA, 11 nt, Human herpesvirus 1
agugaaagaca

SEQ ID NO: 3955983 - RNA, 15 nt, Human herpesvirus 1
agugaaagacacggg

SEQ ID NO: 3955984 - RNA, 16 nt, Human herpesvirus 1
agugaaagacacgggc

SEQ ID NO: 3955985 - RNA, 17 nt, Human herpesvirus 1
aguggaggaagaccugc

SEQ ID NO: 3955986 - RNA, 14 nt, Human herpesvirus 1
agugggccuccaug

SEQ ID NO: 3955987 - RNA, 20 nt, Human herpesvirus 1
uggccggggagggcagggcc

SEQ ID NO: 3955988 - RNA, 22 nt, Human herpesvirus 1
uggccggggagggcagggccgc

SEQ ID NO: 3955989 - RNA, 16 nt, Human herpesvirus 1
uggcgagcccagaccc

SEQ ID NO: 3955990 - RNA, 16 nt, Human herpesvirus 1
uggcgcagcugggacc

SEQ ID NO: 3955991 - RNA, 20 nt, Human herpesvirus 1
uggcgcagcugggaccccgg

SEQ ID NO: 3955992 - RNA, 23 nt, Human herpesvirus 1
uggcgcccccccaacgggggacc

SEQ ID NO: 3955993 - RNA, 20 nt, Human herpesvirus 1
uggcgcccccgaccucggac

SEQ ID NO: 3955994 - RNA, 17 nt, Human herpesvirus 1
uggcgcgcaccccguuc

SEQ ID NO: 3955995 - RNA, 18 nt, Human herpesvirus 1
uggcggggcaggcgccuc

SEQ ID NO: 3955996 - RNA, 13 nt, Human herpesvirus 1
uggcuggccgcuc

SEQ ID NO: 3955997 - RNA, 18 nt, Human herpesvirus 1
ugggauccgacccccaug

SEQ ID NO: 3955998 - RNA, 19 nt, Human herpesvirus 1
ugggcgaccuggggcgcgc

SEQ ID NO: 3955999 - RNA, 23 nt, Human herpesvirus 1
uggggacccggcccuaaccccac

SEQ ID NO: 3956000 - RNA, 18 nt, Human herpesvirus 1
uggggauggccauagccg

SEQ ID NO: 3956001 - RNA, 14 nt, Human herpesvirus 1
ugggggccuguccc

SEQ ID NO: 3956002 - RNA, 17 nt, Human herpesvirus 1
ugggguccgggagggcg

SEQ ID NO: 3956003 - RNA, 20 nt, Human herpesvirus 1
ugggguggaucuuagccucc

SEQ ID NO: 3956004 - RNA, 13 nt, Human herpesvirus 1
uggguccgggccc

SEQ ID NO: 3956005 - RNA, 17 nt, Human herpesvirus 1
ugggucggugacgcgcc

SEQ ID NO: 3956006 - RNA, 20 nt, Human herpesvirus 1
ugguauagguccacggccac

SEQ ID NO: 3956007 - RNA, 18 nt, Human herpesvirus 1
ugguccacacccaguggc

SEQ ID NO: 3956008 - RNA, 19 nt, Human herpesvirus 1
ugguccuguggagccuguu

SEQ ID NO: 3956009 - RNA, 15 nt, Human herpesvirus 1
uggucggcgagcugg

SEQ ID NO: 3956010 - RNA, 23 nt, Human herpesvirus 1
uggucguccgcggaccggcggcg

SEQ ID NO: 3956011 - RNA, 20 nt, Human herpesvirus 1
uggucgucgggcgccaaagc

SEQ ID NO: 3956012 - RNA, 23 nt, Human herpesvirus 1
uggucucuggccgcgcccacuac

SEQ ID NO: 3956013 - RNA, 17 nt, Human herpesvirus 1
uggugcgauggcgacac

SEQ ID NO: 3956014 - RNA, 19 nt, Human herpesvirus 1
uggugcgucgggccucccg

SEQ ID NO: 3956015 - RNA, 15 nt, Human herpesvirus 1
uggugcugucugaca

SEQ ID NO: 3956016 - RNA, 18 nt, Human herpesvirus 1
uggugcugucugacacac

SEQ ID NO: 3956017 - RNA, 11 nt, Human herpesvirus 1
ugguugcagug

SEQ ID NO: 3956018 - RNA, 20 nt, Human herpesvirus 1
uguacugcggucugucucgu

SEQ ID NO: 3956019 - RNA, 17 nt, Human herpesvirus 1
uguccccgaacaaacga

SEQ ID NO: 3956020 - RNA, 17 nt, Human herpesvirus 1
uguccgcgcauccgacc

SEQ ID NO: 3956021 - RNA, 17 nt, Human herpesvirus 1
uguccgcggggccuccg

SEQ ID NO: 3956022 - RNA, 22 nt, Human herpesvirus 1
uguccggcagggggaugggggg

SEQ ID NO: 3956023 - RNA, 16 nt, Human herpesvirus 1
ugucgcagcaccuccu

SEQ ID NO: 3956024 - RNA, 17 nt, Human herpesvirus 1
ugucgcagggcgccaug

SEQ ID NO: 3956025 - RNA, 14 nt, Human herpesvirus 1
ugucugugggccaa

SEQ ID NO: 3956026 - RNA, 15 nt, Human herpesvirus 1
ugucuguuucuuggc

SEQ ID NO: 3956027 - RNA, 15 nt, Human herpesvirus 1
ugugccaccagccug

SEQ ID NO: 3956028 - RNA, 22 nt, Human herpesvirus 1
ugugcuuucuggugcugucuga

SEQ ID NO: 3956029 - RNA, 15 nt, Human herpesvirus 1
uguggacccaaagcc

SEQ ID NO: 3956030 - RNA, 16 nt, Human herpesvirus 1
uguggacccaaagccc

SEQ ID NO: 3956031 - RNA, 14 nt, Human herpesvirus 1
uguggggacccgcc

SEQ ID NO: 3956032 - RNA, 16 nt, Human herpesvirus 1
uguggggacccggccc

SEQ ID NO: 3956033 - RNA, 13 nt, Human herpesvirus 1
ugugggguccuca

SEQ ID NO: 3956034 - RNA, 20 nt, Human herpesvirus 1
uguuccccgggagccccggg

SEQ ID NO: 3956035 - RNA, 14 nt, Human herpesvirus 1
uguuccgccugucg

SEQ ID NO: 3956036 - RNA, 20 nt, Human herpesvirus 1
uguuggagcgcgccugccgc

SEQ ID NO: 3956037 - RNA, 12 nt, Human herpesvirus 1
uguuggcccuaa

SEQ ID NO: 3956038 - RNA, 13 nt, Human herpesvirus 1
uguugggcgggac

SEQ ID NO: 3956039 - RNA, 16 nt, Human herpesvirus 1
uguuugucgccuggcu

SEQ ID NO: 3956040 - RNA, 18 nt, Human herpesvirus 1
uuaaccgcaccccccucg

SEQ ID NO: 3956041 - RNA, 16 nt, Human herpesvirus 1
uuaacuacauuaaauu

SEQ ID NO: 3956042 - RNA, 22 nt, Human herpesvirus 1
uuaccgcccaaugggccgggcc

SEQ ID NO: 3956043 - RNA, 16 nt, Human herpesvirus 1
uuagccuccccgggcc

SEQ ID NO: 3956044 - RNA, 21 nt, Human herpesvirus 1
uuauuaacucacaggggcgcu

SEQ ID NO: 3956045 - RNA, 14 nt, Human herpesvirus 1
uucaucgaccucaa

SEQ ID NO: 3956046 - RNA, 22 nt, Human herpesvirus 1
uucccacgcgaaucgucgccug

SEQ ID NO: 3956047 - RNA, 16 nt, Human herpesvirus 1
uuccgagggccgggcc

SEQ ID NO: 3956048 - RNA, 18 nt, Human herpesvirus 1
uuccucuccgcggugucu

SEQ ID NO: 3956049 - RNA, 17 nt, Human herpesvirus 1
uucgcaacaccuccccc

SEQ ID NO: 3956050 - RNA, 17 nt, Human herpesvirus 1
uucgcaccaacaaccuu

SEQ ID NO: 3956051 - RNA, 13 nt, Human herpesvirus 1
uucuuccggccuc

SEQ ID NO: 3956052 - RNA, 19 nt, Human herpesvirus 1
uugcacaacacaaacaucu

SEQ ID NO: 3956053 - RNA, 16 nt, Human herpesvirus 1
uuggacuggaggagga

SEQ ID NO: 3956054 - RNA, 14 nt, Human herpesvirus 1
uuggcugaggacgu

SEQ ID NO: 3956055 - RNA, 13 nt, Human herpesvirus 1
uuggggggguccg

SEQ ID NO: 3956056 - RNA, 19 nt, Human herpesvirus 1
uugucgucucucuuccccc

SEQ ID NO: 3956057 - RNA, 20 nt, Human herpesvirus 1
uuguggggaggggggggucg

SEQ ID NO: 3956058 - RNA, 14 nt, Human herpesvirus 1
uuguguuggcccua

SEQ ID NO: 3956059 - RNA, 13 nt, Human herpesvirus 1
uuucaccgggacg

SEQ ID NO: 3956060 - RNA, 21 nt, Human herpesvirus 1
uuugcggacccucucuucucu

SEQ ID NO: 3956061 - RNA, 22 nt, Human herpesvirus 1
uuuguacccuuaauaaauuuua

SEQ ID NO: 3956062 - RNA, 16 nt, Human herpesvirus 1
uuuuacaaacagauuu

SEQ ID NO: 3956063 - RNA, 17 nt, Human herpesvirus 1
uuuucgccgcccucgcc

SEQ ID NO: 3956064 - RNA, 13 nt, Human herpesvirus 1
augcccucccuga

SEQ ID NO: 3956065 - RNA, 16 nt, Human herpesvirus 1
augccgcggccauggu

SEQ ID NO: 3956066 - RNA, 18 nt, Human herpesvirus 1
augcgccagggcgccccc

SEQ ID NO: 3956067 - RNA, 19 nt, Human herpesvirus 1
augcgccagggcgcccccg

SEQ ID NO: 3956068 - RNA, 18 nt, Human herpesvirus 1
auggacagcgaccugggg

SEQ ID NO: 3956069 - RNA, 24 nt, Human herpesvirus 1
auggcacgaguucaaccucgggug

SEQ ID NO: 3956070 - RNA, 12 nt, Human herpesvirus 1
auggcaggagcc

SEQ ID NO: 3956071 - RNA, 16 nt, Human herpesvirus 1
auggccauagccgccg

SEQ ID NO: 3956072 - RNA, 17 nt, Human herpesvirus 1
auggcccuggugucugc

SEQ ID NO: 3956073 - RNA, 15 nt, Human herpesvirus 1
auggcgggacugggc

SEQ ID NO: 3956074 - RNA, 19 nt, Human herpesvirus 1
augggccagggcgaggugc

SEQ ID NO: 3956075 - RNA, 14 nt, Human herpesvirus 1
augggcgaccuggg

SEQ ID NO: 3956076 - RNA, 12 nt, Human herpesvirus 1
auggggagagcc

SEQ ID NO: 3956077 - RNA, 17 nt, Human herpesvirus 1
auggggcgggggauggg

SEQ ID NO: 3956078 - RNA, 22 nt, Human herpesvirus 1
augggucccaauuggccguccc

SEQ ID NO: 3956079 - RNA, 23 nt, Human herpesvirus 1
auggucggggcgucccuggauau

SEQ ID NO: 3956080 - RNA, 14 nt, Human herpesvirus 1
auguccccaaaaua

SEQ ID NO: 3956081 - RNA, 14 nt, Human herpesvirus 1
auuaaccaccugcg

SEQ ID NO: 3956082 - RNA, 15 nt, Human herpesvirus 1
auuccaaagugcccc

SEQ ID NO: 3956083 - RNA, 15 nt, Human herpesvirus 1
auucccaaacagggc

SEQ ID NO: 3956084 - RNA, 11 nt, Human herpesvirus 1
auuccucuccg

SEQ ID NO: 3956085 - RNA, 17 nt, Human herpesvirus 1
auuuguacccuuaauaa

SEQ ID NO: 3956086 - RNA, 21 nt, Human herpesvirus 1
caaacacaaaacacacggguu

SEQ ID NO: 3956087 - RNA, 15 nt, Human herpesvirus 1
caacagcccccgggu

SEQ ID NO: 3956088 - RNA, 13 nt, Human herpesvirus 1
caacaugacccag

SEQ ID NO: 3956089 - RNA, 15 nt, Human herpesvirus 1
caaccagcugcacga

SEQ ID NO: 3956090 - RNA, 15 nt, Human herpesvirus 1
caaccccaacuccag

SEQ ID NO: 3956091 - RNA, 23 nt, Human herpesvirus 1
caaccccagggaccuccuggacu

SEQ ID NO: 3956092 - RNA, 19 nt, Human herpesvirus 1
caaccuggagaccaccgcg

SEQ ID NO: 3956093 - RNA, 15 nt, Human herpesvirus 1
caacgagcugcggcu

SEQ ID NO: 3956094 - RNA, 15 nt, Human herpesvirus 1
caacgaggguugggg

SEQ ID NO: 3956095 - RNA, 17 nt, Human herpesvirus 1
caacgcgacccucaccg

SEQ ID NO: 3956096 - RNA, 20 nt, Human herpesvirus 1
caacgcgggcguucccgagc

SEQ ID NO: 3956097 - RNA, 20 nt, Human herpesvirus 1
caacuucccacccggagcuu

SEQ ID NO: 3956098 - RNA, 20 nt, Human herpesvirus 1
caagaggucgucgggggacg

SEQ ID NO: 3956099 - RNA, 17 nt, Human herpesvirus 1
caagccccuagccccgc

SEQ ID NO: 3956100 - RNA, 23 nt, Human herpesvirus 1
caagccccuagccccgcccccuu

SEQ ID NO: 3956101 - RNA, 15 nt, Human herpesvirus 1
caagccgccccagca

SEQ ID NO: 3956102 - RNA, 19 nt, Human herpesvirus 1
caaggcuugguucggggcc

SEQ ID NO: 3956103 - RNA, 14 nt, Human herpesvirus 1
caaggugggccagc

SEQ ID NO: 3956104 - RNA, 14 nt, Human herpesvirus 1
caaguucaaggcca

SEQ ID NO: 3956105 - RNA, 20 nt, Human herpesvirus 1
caaucccccccgaccggguu

SEQ ID NO: 3956106 - RNA, 17 nt, Human herpesvirus 1
caauccgugucggggag

SEQ ID NO: 3956107 - RNA, 12 nt, Human herpesvirus 1
cacaaccucccg

SEQ ID NO: 3956108 - RNA, 10 nt, Human herpesvirus 1
cacaccaccg

SEQ ID NO: 3956109 - RNA, 15 nt, Human herpesvirus 1
cacaccggucaacga

SEQ ID NO: 3956110 - RNA, 15 nt, Human herpesvirus 1
cacacggagcugcuc

SEQ ID NO: 3956111 - RNA, 14 nt, Human herpesvirus 1
cacagccggccacg

SEQ ID NO: 3956112 - RNA, 23 nt, Human herpesvirus 1
cacagggcgggccgccucggggg

SEQ ID NO: 3956113 - RNA, 18 nt, Human herpesvirus 1
cacaucaaggugggccag

SEQ ID NO: 3956114 - RNA, 17 nt, Human herpesvirus 1
cacaugaagccacuguu

SEQ ID NO: 3956115 - RNA, 18 nt, Human herpesvirus 1
cacaugcggaaagcaaga

SEQ ID NO: 3956116 - RNA, 12 nt, Human herpesvirus 1
caccaccagcug

SEQ ID NO: 3956117 - RNA, 20 nt, Human herpesvirus 1
caccaccgucagcaccuuca

SEQ ID NO: 3956118 - RNA, 14 nt, Human herpesvirus 1
caccagccugguug

SEQ ID NO: 3956119 - RNA, 19 nt, Human herpesvirus 1
caccaucccggguuaaugu

SEQ ID NO: 3956120 - RNA, 15 nt, Human herpesvirus 1
cacccaguggcuccg

SEQ ID NO: 3956121 - RNA, 14 nt, Human herpesvirus 1
caccccccacgggc

SEQ ID NO: 3956122 - RNA, 14 nt, Human herpesvirus 1
caccccccaugucc

SEQ ID NO: 3956123 - RNA, 20 nt, Human herpesvirus 1
cacccccucgaccaccaccu

SEQ ID NO: 3956124 - RNA, 15 nt, Human herpesvirus 1
caccccgaagccccg

SEQ ID NO: 3956125 - RNA, 16 nt, Human herpesvirus 1
caccccgcaauuugca

SEQ ID NO: 3956126 - RNA, 17 nt, Human herpesvirus 1
caccccgcaauuugcac

SEQ ID NO: 3956127 - RNA, 22 nt, Human herpesvirus 1
caccccgcaauuugcacccagc

SEQ ID NO: 3956128 - RNA, 21 nt, Human herpesvirus 1
cacccgacaacagcccccggg

SEQ ID NO: 3956129 - RNA, 19 nt, Human herpesvirus 1
cacccgaggcggccugggu

SEQ ID NO: 3956130 - RNA, 18 nt, Human herpesvirus 1
cacccggaaccugcucac

SEQ ID NO: 3956131 - RNA, 17 nt, Human herpesvirus 1
cacccgggugcuuccca

SEQ ID NO: 3956132 - RNA, 22 nt, Human herpesvirus 1
cacccgggugcuucccacgcga

SEQ ID NO: 3956133 - RNA, 16 nt, Human herpesvirus 1
cacccucacgcgcauc

SEQ ID NO: 3956134 - RNA, 15 nt, Human herpesvirus 1
cacccucucuucccu

SEQ ID NO: 3956135 - RNA, 20 nt, Human herpesvirus 1
caccgacgaaucccccaagg

SEQ ID NO: 3956136 - RNA, 16 nt, Human herpesvirus 1
caccgccaucagccuu

SEQ ID NO: 3956137 - RNA, 19 nt, Human herpesvirus 1
caccgcguguuccccggga

SEQ ID NO: 3956138 - RNA, 22 nt, Human herpesvirus 1
caccggugcgccccccaaacca

SEQ ID NO: 3956139 - RNA, 22 nt, Human herpesvirus 1
caccgucggaggccccccagau

SEQ ID NO: 3956140 - RNA, 15 nt, Human herpesvirus 1
caccguggccuggga

SEQ ID NO: 3956141 - RNA, 11 nt, Human herpesvirus 1
caccuccaccc

SEQ ID NO: 3956142 - RNA, 15 nt, Human herpesvirus 1
caccuguuccgccug

SEQ ID NO: 3956143 - RNA, 15 nt, Human herpesvirus 1
cacgaacccccaucu

SEQ ID NO: 3956144 - RNA, 23 nt, Human herpesvirus 1
cacgaccuguugauggccugugc

SEQ ID NO: 3956145 - RNA, 15 nt, Human herpesvirus 1
cacgagcacccugcu

SEQ ID NO: 3956146 - RNA, 19 nt, Human herpesvirus 1
cacgagcacccugcugccc

SEQ ID NO: 3956147 - RNA, 15 nt, Human herpesvirus 1
cacgcaaaaccaggc

SEQ ID NO: 3956148 - RNA, 21 nt, Human herpesvirus 1
cacgcaagaccaggccugguc

SEQ ID NO: 3956149 - RNA, 23 nt, Human herpesvirus 1
cacgcaccucgaggacacccgcg

SEQ ID NO: 3956150 - RNA, 18 nt, Human herpesvirus 1
cacgcccgaccacacacc

SEQ ID NO: 3956151 - RNA, 13 nt, Human herpesvirus 1
cagccccccagcc

SEQ ID NO: 3956152 - RNA, 16 nt, Human herpesvirus 1
cagccgcgccgcugcc

SEQ ID NO: 3956153 - RNA, 17 nt, Human herpesvirus 1
cagccgcgccgcugccc

SEQ ID NO: 3956154 - RNA, 19 nt, Human herpesvirus 1
cagccggaaugaggagcuc

SEQ ID NO: 3956155 - RNA, 24 nt, Human herpesvirus 1
cagccuggucgaggcggccgaggc

SEQ ID NO: 3956156 - RNA, 18 nt, Human herpesvirus 1
cagccuguuuguccuggg

SEQ ID NO: 3956157 - RNA, 23 nt, Human herpesvirus 1
cagccuucucccggugccuuucc

SEQ ID NO: 3956158 - RNA, 13 nt, Human herpesvirus 1
cagcgaccugggg

SEQ ID NO: 3956159 - RNA, 18 nt, Human herpesvirus 1
cagcgacguccugggcca

SEQ ID NO: 3956160 - RNA, 14 nt, Human herpesvirus 1
cagcgccggguggc

SEQ ID NO: 3956161 - RNA, 15 nt, Human herpesvirus 1
cagcgccugcguuca

SEQ ID NO: 3956162 - RNA, 14 nt, Human herpesvirus 1
cagcgggcgcggcg

SEQ ID NO: 3956163 - RNA, 14 nt, Human herpesvirus 1
cagcuaugggcccu

SEQ ID NO: 3956164 - RNA, 17 nt, Human herpesvirus 1
cagcugaccgacccucc

SEQ ID NO: 3956165 - RNA, 15 nt, Human herpesvirus 1
cagcugagccgcgcc

SEQ ID NO: 3956166 - RNA, 17 nt, Human herpesvirus 1
cagcugcacgaccugcg

SEQ ID NO: 3956167 - RNA, 20 nt, Human herpesvirus 1
cagcugggaccccggcggcc

SEQ ID NO: 3956168 - RNA, 20 nt, Human herpesvirus 1
cagcuggugcuuuuccacaa

SEQ ID NO: 3956169 - RNA, 15 nt, Human herpesvirus 1
cagcuucagcgccgu

SEQ ID NO: 3956170 - RNA, 18 nt, Human herpesvirus 1
cagcuuuccgcugagccu

SEQ ID NO: 3956171 - RNA, 23 nt, Human herpesvirus 1
caggaucacaccggucaacgagg

SEQ ID NO: 3956172 - RNA, 16 nt, Human herpesvirus 1
caggccgacugccagc

SEQ ID NO: 3956173 - RNA, 17 nt, Human herpesvirus 1
caggccgacugccagcu

SEQ ID NO: 3956174 - RNA, 14 nt, Human herpesvirus 1
caggcgggccuacc

SEQ ID NO: 3956175 - RNA, 20 nt, Human herpesvirus 1
caggcugucgacgcccccuc

SEQ ID NO: 3956176 - RNA, 22 nt, Human herpesvirus 1
cagggagaaaccccagcauacc

SEQ ID NO: 3956177 - RNA, 15 nt, Human herpesvirus 1
cagggcccgccaucu

SEQ ID NO: 3956178 - RNA, 20 nt, Human herpesvirus 1
cagggccuccgaccccagac

SEQ ID NO: 3956179 - RNA, 15 nt, Human herpesvirus 1
caggguaccgcguga

SEQ ID NO: 3956180 - RNA, 21 nt, Human herpesvirus 1
cagguggcccuuccuaaccca

SEQ ID NO: 3956181 - RNA, 14 nt, Human herpesvirus 1
caguauaucaucaa

SEQ ID NO: 3956182 - RNA, 15 nt, Human herpesvirus 1
cagugauguaaaugg

SEQ ID NO: 3956183 - RNA, 20 nt, Human herpesvirus 1
caguggcuccgggccaacca

SEQ ID NO: 3956184 - RNA, 21 nt, Human herpesvirus 1
caguggcugaagcacaacgcc

SEQ ID NO: 3956185 - RNA, 18 nt, Human herpesvirus 1
cauaccuggguguguuua

SEQ ID NO: 3956186 - RNA, 20 nt, Human herpesvirus 1
cauacuccggccgcgguaca

SEQ ID NO: 3956187 - RNA, 14 nt, Human herpesvirus 1
cauaucccacccug

SEQ ID NO: 3956188 - RNA, 12 nt, Human herpesvirus 1
caucacccccga

SEQ ID NO: 3956189 - RNA, 18 nt, Human herpesvirus 1
caucagccucgucccgcc

SEQ ID NO: 3956190 - RNA, 14 nt, Human herpesvirus 1
caucauccagcugg

SEQ ID NO: 3956191 - RNA, 13 nt, Human herpesvirus 1
caucccacccccc

SEQ ID NO: 3956192 - RNA, 21 nt, Human herpesvirus 1
cauccgaacgcagccccgcug

SEQ ID NO: 3956193 - RNA, 18 nt, Human herpesvirus 1
caucggggguugcugucc

SEQ ID NO: 3956194 - RNA, 22 nt, Human herpesvirus 1
caugaagcccccaacaugaccc

SEQ ID NO: 3956195 - RNA, 22 nt, Human herpesvirus 1
caugaccgcccgccccucgcca

SEQ ID NO: 3956196 - RNA, 13 nt, Human herpesvirus 1
caugcaccccaga

SEQ ID NO: 3956197 - RNA, 23 nt, Human herpesvirus 1
caugcgcgggcucgucuuggcca

SEQ ID NO: 3956198 - RNA, 14 nt, Human herpesvirus 1
cauggccagcggcc

SEQ ID NO: 3956199 - RNA, 20 nt, Human herpesvirus 1
caugggacacaaaugcccac

SEQ ID NO: 3956200 - RNA, 20 nt, Human herpesvirus 1
caugggccugaucgccggcg

SEQ ID NO: 3956201 - RNA, 15 nt, Human herpesvirus 1
cauguccgugccgcu

SEQ ID NO: 3956202 - RNA, 19 nt, Human herpesvirus 1
cauguuugcgggccugggc

SEQ ID NO: 3956203 - RNA, 12 nt, Human herpesvirus 1
cauuagggagaa

SEQ ID NO: 3956204 - RNA, 24 nt, Human herpesvirus 1
cauugccgcguugguccucgugcc

SEQ ID NO: 3956205 - RNA, 13 nt, Human herpesvirus 1
cauuuuacaauaa

SEQ ID NO: 3956206 - RNA, 15 nt, Human herpesvirus 1
ccaaagcgcccgucg

SEQ ID NO: 3956207 - RNA, 19 nt, Human herpesvirus 1
ccaacacaacggcaugccu

SEQ ID NO: 3956208 - RNA, 21 nt, Human herpesvirus 1
ccaaccucggaugacucaggg

SEQ ID NO: 3956209 - RNA, 15 nt, Human herpesvirus 1
ccaacgccuccccug

SEQ ID NO: 3956210 - RNA, 13 nt, Human herpesvirus 1
ccaacuccagacc

SEQ ID NO: 3956211 - RNA, 14 nt, Human herpesvirus 1
ccaacuccagacca

SEQ ID NO: 3956212 - RNA, 21 nt, Human herpesvirus 1
ccaagcuagccgaggcccggg

SEQ ID NO: 3956213 - RNA, 13 nt, Human herpesvirus 1
ccacaaccucccg

SEQ ID NO: 3956214 - RNA, 14 nt, Human herpesvirus 1
ccacaaccucccgg

SEQ ID NO: 3956215 - RNA, 11 nt, Human herpesvirus 1
ccacaccaccu

SEQ ID NO: 3956216 - RNA, 13 nt, Human herpesvirus 1
ccacacccagugg

SEQ ID NO: 3956217 - RNA, 15 nt, Human herpesvirus 1
ccacauacagcgcca

SEQ ID NO: 3956218 - RNA, 23 nt, Human herpesvirus 1
ccacauccaggcgggccuaccgg

SEQ ID NO: 3956219 - RNA, 17 nt, Human herpesvirus 1
ccacaugcggaaagcaa

SEQ ID NO: 3956220 - RNA, 20 nt, Human herpesvirus 1
ccacaugcggaaagcaagaa

SEQ ID NO: 3956221 - RNA, 14 nt, Human herpesvirus 1
ccaccaaggcccgg

SEQ ID NO: 3956222 - RNA, 18 nt, Human herpesvirus 1
ccaccaaggcccgggcca

SEQ ID NO: 3956223 - RNA, 19 nt, Human herpesvirus 1
ccaccaccuccacccccuc

SEQ ID NO: 3956224 - RNA, 11 nt, Human herpesvirus 1
ccaccagccug

SEQ ID NO: 3956225 - RNA, 15 nt, Human herpesvirus 1
ccaccauccccgcuc

SEQ ID NO: 3956226 - RNA, 18 nt, Human herpesvirus 1
ccaccauuaucgggccgc

SEQ ID NO: 3956227 - RNA, 15 nt, Human herpesvirus 1
ccacccccgcccggg

SEQ ID NO: 3956228 - RNA, 17 nt, Human herpesvirus 1
ccacccccgccguccga

SEQ ID NO: 3956229 - RNA, 13 nt, Human herpesvirus 1
ccacccgaaccac

SEQ ID NO: 3956230 - RNA, 13 nt, Human herpesvirus 1
ccaccgaccucaa

SEQ ID NO: 3956231 - RNA, 20 nt, Human herpesvirus 1
ccaccgauagcguccgggcg

SEQ ID NO: 3956232 - RNA, 19 nt, Human herpesvirus 1
ccaccgccccgaacccugc

SEQ ID NO: 3956233 - RNA, 12 nt, Human herpesvirus 1
ccaccggaagcc

SEQ ID NO: 3956234 - RNA, 18 nt, Human herpesvirus 1
ccaccggaagcccaaccc

SEQ ID NO: 3956235 - RNA, 21 nt, Human herpesvirus 1
ccaccgugggccggcggguga

SEQ ID NO: 3956236 - RNA, 16 nt, Human herpesvirus 1
ccaccuccacccccuc

SEQ ID NO: 3956237 - RNA, 20 nt, Human herpesvirus 1
ccaccugacgcgccuagcca

SEQ ID NO: 3956238 - RNA, 22 nt, Human herpesvirus 1
ccaccugcgcucccucagcauc

SEQ ID NO: 3956239 - RNA, 20 nt, Human herpesvirus 1
ccacgccccuuucccccugu

SEQ ID NO: 3956240 - RNA, 15 nt, Human herpesvirus 1
ccacgccgacgccaa

SEQ ID NO: 3956241 - RNA, 13 nt, Human herpesvirus 1
ccacgccucgggc

SEQ ID NO: 3956242 - RNA, 15 nt, Human herpesvirus 1
ccacgggggggagca

SEQ ID NO: 3956243 - RNA, 18 nt, Human herpesvirus 1
ccacgugaucagcacgcc

SEQ ID NO: 3956244 - RNA, 17 nt, Human herpesvirus 1
ccacgugcacagccugg

SEQ ID NO: 3956245 - RNA, 17 nt, Human herpesvirus 1
ccacguguagccuggau

SEQ ID NO: 3956246 - RNA, 15 nt, Human herpesvirus 1
ccacugccugcaucu

SEQ ID NO: 3956247 - RNA, 17 nt, Human herpesvirus 1
ccacuguuuuccgcccc

SEQ ID NO: 3956248 - RNA, 16 nt, Human herpesvirus 1
ccagaccggcaccacc

SEQ ID NO: 3956249 - RNA, 18 nt, Human herpesvirus 1
ccagacgcgggcgacgca

SEQ ID NO: 3956250 - RNA, 15 nt, Human herpesvirus 1
ccagaggcgcgcgca

SEQ ID NO: 3956251 - RNA, 21 nt, Human herpesvirus 1
ccagaguaccgcgagcuccca

SEQ ID NO: 3956252 - RNA, 15 nt, Human herpesvirus 1
ccagaugcccacggg

SEQ ID NO: 3956253 - RNA, 17 nt, Human herpesvirus 1
ccagaugcccacgggca

SEQ ID NO: 3956254 - RNA, 20 nt, Human herpesvirus 1
ccagcagacgcugcuccgcc

SEQ ID NO: 3956255 - RNA, 18 nt, Human herpesvirus 1
ccagcagcuugcggggcu

SEQ ID NO: 3956256 - RNA, 17 nt, Human herpesvirus 1
ccagcaucgcgcgcguc

SEQ ID NO: 3956257 - RNA, 18 nt, Human herpesvirus 1
ccagccagggcggcggua

SEQ ID NO: 3956258 - RNA, 21 nt, Human herpesvirus 1
ccagccuguuuguccugggga

SEQ ID NO: 3956259 - RNA, 15 nt, Human herpesvirus 1
ccagcgaccucgccg

SEQ ID NO: 3956260 - RNA, 17 nt, Human herpesvirus 1
ccagcgaccucgccgaa

SEQ ID NO: 3956261 - RNA, 16 nt, Human herpesvirus 1
ccagcggcacgaccgg

SEQ ID NO: 3956262 - RNA, 15 nt, Human herpesvirus 1
ccagcuacgccgccg

SEQ ID NO: 3956263 - RNA, 21 nt, Human herpesvirus 1
ccagcuaugggcccugcuccg

SEQ ID NO: 3956264 - RNA, 17 nt, Human herpesvirus 1
ccagcugagccgcgccg

SEQ ID NO: 3956265 - RNA, 17 nt, Human herpesvirus 1
ccaggaaauccguggcc

SEQ ID NO: 3956266 - RNA, 11 nt, Human herpesvirus 1
ccaggaucaca

SEQ ID NO: 3956267 - RNA, 17 nt, Human herpesvirus 1
ccaggcccgccgccacu

SEQ ID NO: 3956268 - RNA, 19 nt, Human herpesvirus 1
ccaggccuaccagcagggg

SEQ ID NO: 3956269 - RNA, 15 nt, Human herpesvirus 1
ccaggccuccacccc

SEQ ID NO: 3956270 - RNA, 17 nt, Human herpesvirus 1
ccaggcgccgacggaca

SEQ ID NO: 3956271 - RNA, 19 nt, Human herpesvirus 1
ccaggcggcgaacgggggc

SEQ ID NO: 3956272 - RNA, 19 nt, Human herpesvirus 1
ccaggcugucgacgccccc

SEQ ID NO: 3956273 - RNA, 22 nt, Human herpesvirus 1
ccagggcgcccccgcgcggggg

SEQ ID NO: 3956274 - RNA, 13 nt, Human herpesvirus 1
ccaggucccaccu

SEQ ID NO: 3956275 - RNA, 15 nt, Human herpesvirus 1
ccaguccccgggccc

SEQ ID NO: 3956276 - RNA, 17 nt, Human herpesvirus 1
ccagucccggcccggcg

SEQ ID NO: 3956277 - RNA, 22 nt, Human herpesvirus 1
ccagucgcccgaagacaccccc

SEQ ID NO: 3956278 - RNA, 17 nt, Human herpesvirus 1
ccaguggcuccgggcca

SEQ ID NO: 3956279 - RNA, 16 nt, Human herpesvirus 1
ccaguugagccgcgcc

SEQ ID NO: 3956280 - RNA, 15 nt, Human herpesvirus 1
ccauauccaccaccu

SEQ ID NO: 3956281 - RNA, 18 nt, Human herpesvirus 1
ccaucccccggccacccc

SEQ ID NO: 3956282 - RNA, 16 nt, Human herpesvirus 1
ccaucccgaggcccca

SEQ ID NO: 3956283 - RNA, 13 nt, Human herpesvirus 1
ccauccgccggca

SEQ ID NO: 3956284 - RNA, 22 nt, Human herpesvirus 1
ccaucgccggggaccgcagccu

SEQ ID NO: 3956285 - RNA, 11 nt, Human herpesvirus 1
ccaugcuggcg

SEQ ID NO: 3956286 - RNA, 17 nt, Human herpesvirus 1
ccauggagcgcacggaa

SEQ ID NO: 3956287 - RNA, 21 nt, Human herpesvirus 1
ccaugggacacaaaugcccac

SEQ ID NO: 3956288 - RNA, 22 nt, Human herpesvirus 1
ccauuaucgggccgcuggcaac

SEQ ID NO: 3956289 - RNA, 18 nt, Human herpesvirus 1
ccauuuacguggcugggu

SEQ ID NO: 3956290 - RNA, 20 nt, Human herpesvirus 1
cccaaaacacacggagcugc

SEQ ID NO: 3956291 - RNA, 22 nt, Human herpesvirus 1
cccaacaaagacggugacgccg

SEQ ID NO: 3956292 - RNA, 12 nt, Human herpesvirus 1
cccaacaacacc

SEQ ID NO: 3956293 - RNA, 12 nt, Human herpesvirus 1
cccaacggggga

SEQ ID NO: 3956294 - RNA, 12 nt, Human herpesvirus 1
cccaacgggggc

SEQ ID NO: 3956295 - RNA, 14 nt, Human herpesvirus 1
cccaacuccagacc

SEQ ID NO: 3956296 - RNA, 15 nt, Human herpesvirus 1
cccaacuccagacca

SEQ ID NO: 3956297 - RNA, 12 nt, Human herpesvirus 1
cccaccagcuga

SEQ ID NO: 3956298 - RNA, 18 nt, Human herpesvirus 1
cccaccgcgcuccucccg

SEQ ID NO: 3956299 - RNA, 17 nt, Human herpesvirus 1
cccaccgggcccggcca

SEQ ID NO: 3956300 - RNA, 15 nt, Human herpesvirus 1
cccacgacccgacuc

SEQ ID NO: 3956301 - RNA, 20 nt, Human herpesvirus 1
cccacgacccgacucaccuc

SEQ ID NO: 3956302 - RNA, 17 nt, Human herpesvirus 1
cccacgcaccccccgcg

SEQ ID NO: 3956303 - RNA, 16 nt, Human herpesvirus 1
cccacuacaccagcca

SEQ ID NO: 3956304 - RNA, 14 nt, Human herpesvirus 1
cccagcgaccucgc

SEQ ID NO: 3956305 - RNA, 12 nt, Human herpesvirus 1
cccagcugggcc

SEQ ID NO: 3956306 - RNA, 14 nt, Human herpesvirus 1
cccagcugggcccg

SEQ ID NO: 3956307 - RNA, 18 nt, Human herpesvirus 1
cccaggccuaccagcagg

SEQ ID NO: 3956308 - RNA, 22 nt, Human herpesvirus 1
cccaggcggcguuaaccgcacc

SEQ ID NO: 3956309 - RNA, 13 nt, Human herpesvirus 1
cccauacucccgc

SEQ ID NO: 3956310 - RNA, 15 nt, Human herpesvirus 1
cccaucaccccgcaa

SEQ ID NO: 3956311 - RNA, 22 nt, Human herpesvirus 1
cccaucgcgggcgccauggcgg

SEQ ID NO: 3956312 - RNA, 15 nt, Human herpesvirus 1
cccaugaaggcccug

SEQ ID NO: 3956313 - RNA, 16 nt, Human herpesvirus 1
cccaugcgacagcgga

SEQ ID NO: 3956314 - RNA, 22 nt, Human herpesvirus 1
cccaugggacacaaaugcccac

SEQ ID NO: 3956315 - RNA, 20 nt, Human herpesvirus 1
ccccauaucgcuucccgacc

SEQ ID NO: 3956316 - RNA, 13 nt, Human herpesvirus 1
ccccaucaccccg

SEQ ID NO: 3956317 - RNA, 15 nt, Human herpesvirus 1
ccccauggaccccag

SEQ ID NO: 3956318 - RNA, 17 nt, Human herpesvirus 1
cccccaaaccccacgcc

SEQ ID NO: 3956319 - RNA, 16 nt, Human herpesvirus 1
cccccaucaccccgca

SEQ ID NO: 3956320 - RNA, 18 nt, Human herpesvirus 1
cccccaucuuguccccaa

SEQ ID NO: 3956321 - RNA, 23 nt, Human herpesvirus 1
ccccccacgugaucagcacgcca

SEQ ID NO: 3956322 - RNA, 14 nt, Human herpesvirus 1
ccccccccacccca

SEQ ID NO: 3956323 - RNA, 14 nt, Human herpesvirus 1
ccccccgcugcggc

SEQ ID NO: 3956324 - RNA, 16 nt, Human herpesvirus 1
ccccccguggacccca

SEQ ID NO: 3956325 - RNA, 13 nt, Human herpesvirus 1
cccccgcgcggcu

SEQ ID NO: 3956326 - RNA, 18 nt, Human herpesvirus 1
cccccggcacgccugggg

SEQ ID NO: 3956327 - RNA, 13 nt, Human herpesvirus 1
cccccgucugggu

SEQ ID NO: 3956328 - RNA, 19 nt, Human herpesvirus 1
cccccguguuuguggggag

SEQ ID NO: 3956329 - RNA, 16 nt, Human herpesvirus 1
ccccgaacccugcggu

SEQ ID NO: 3956330 - RNA, 14 nt, Human herpesvirus 1
ccccgagaaccagc

SEQ ID NO: 3956331 - RNA, 21 nt, Human herpesvirus 1
ccccgagaaccagcgcaccgu

SEQ ID NO: 3956332 - RNA, 15 nt, Human herpesvirus 1
ccccgauccgcgucu

SEQ ID NO: 3956333 - RNA, 15 nt, Human herpesvirus 1
ccccgcgcggcugcc

SEQ ID NO: 3956334 - RNA, 20 nt, Human herpesvirus 1
ccccggaggcgccugccccg

SEQ ID NO: 3956335 - RNA, 14 nt, Human herpesvirus 1
ccccggccaccccg

SEQ ID NO: 3956336 - RNA, 17 nt, Human herpesvirus 1
ccccggcccccaauaaa

SEQ ID NO: 3956337 - RNA, 13 nt, Human herpesvirus 1
ccccgggccaaua

SEQ ID NO: 3956338 - RNA, 23 nt, Human herpesvirus 1
ccccggguuccgcgaccaccccg

SEQ ID NO: 3956339 - RNA, 14 nt, Human herpesvirus 1
ccccggucuccccg

SEQ ID NO: 3956340 - RNA, 12 nt, Human herpesvirus 1
ccccuccauccc

SEQ ID NO: 3956341 - RNA, 15 nt, Human herpesvirus 1
ccccuggacgugggc

SEQ ID NO: 3956342 - RNA, 17 nt, Human herpesvirus 1
ccccuuccccgcuguca

SEQ ID NO: 3956343 - RNA, 16 nt, Human herpesvirus 1
ccccuucccucccccu

SEQ ID NO: 3956344 - RNA, 19 nt, Human herpesvirus 1
ccccuucccucccccuccg

SEQ ID NO: 3956345 - RNA, 19 nt, Human herpesvirus 1
cccgaaccaggccguuccg

SEQ ID NO: 3956346 - RNA, 19 nt, Human herpesvirus 1
cccgaagacaccccccacc

SEQ ID NO: 3956347 - RNA, 19 nt, Human herpesvirus 1
cccgaagccugcuguuucg

SEQ ID NO: 3956348 - RNA, 18 nt, Human herpesvirus 1
cccgacgccagcuuuccg

SEQ ID NO: 3956349 - RNA, 21 nt, Human herpesvirus 1
cccgagaaccuagggaaccca

SEQ ID NO: 3956350 - RNA, 18 nt, Human herpesvirus 1
cccgagaccagucgcccg

SEQ ID NO: 3956351 - RNA, 15 nt, Human herpesvirus 1
cccgaugcggcggcg

SEQ ID NO: 3956352 - RNA, 20 nt, Human herpesvirus 1
cccgauggcccuccaggcug

SEQ ID NO: 3956353 - RNA, 22 nt, Human herpesvirus 1
cccgcaauuugcacccagccuu

SEQ ID NO: 3956354 - RNA, 13 nt, Human herpesvirus 1
cccgcacccccag

SEQ ID NO: 3956355 - RNA, 20 nt, Human herpesvirus 1
cccgcauaucccacccugga

SEQ ID NO: 3956356 - RNA, 23 nt, Human herpesvirus 1
cccgcauaucccacccuggagcu

SEQ ID NO: 3956357 - RNA, 15 nt, Human herpesvirus 1
cccgcaucccccguc

SEQ ID NO: 3956358 - RNA, 19 nt, Human herpesvirus 1
cccgccaacacccccuucc

SEQ ID NO: 3956359 - RNA, 13 nt, Human herpesvirus 1
cccgcccccggca

SEQ ID NO: 3956360 - RNA, 13 nt, Human herpesvirus 1
cccgcccccggcu

SEQ ID NO: 3956361 - RNA, 15 nt, Human herpesvirus 1
cccgccgccacuguc

SEQ ID NO: 3956362 - RNA, 15 nt, Human herpesvirus 1
cccgcgcggcugcca

SEQ ID NO: 3956363 - RNA, 15 nt, Human herpesvirus 1
cccgcggaccaccgg

SEQ ID NO: 3956364 - RNA, 23 nt, Human herpesvirus 1
cccgcgucuggccccggcgagcg

SEQ ID NO: 3956365 - RNA, 22 nt, Human herpesvirus 1
cccgcguuugagaccgccggca

SEQ ID NO: 3956366 - RNA, 15 nt, Human herpesvirus 1
cccgcucccucgacc

SEQ ID NO: 3956367 - RNA, 21 nt, Human herpesvirus 1
cccgcuccugugcacccucac

SEQ ID NO: 3956368 - RNA, 16 nt, Human herpesvirus 1
cccggaccccacgcac

SEQ ID NO: 3956369 - RNA, 24 nt, Human herpesvirus 1
cccggacgacauggccagcggccc

SEQ ID NO: 3956370 - RNA, 21 nt, Human herpesvirus 1
cccggcaaccccgaaggcgga

SEQ ID NO: 3956371 - RNA, 14 nt, Human herpesvirus 1
cccggcaccacggg

SEQ ID NO: 3956372 - RNA, 16 nt, Human herpesvirus 1
cccggcacgccugggg

SEQ ID NO: 3956373 - RNA, 19 nt, Human herpesvirus 1
cccggcauggcgcagcugg

SEQ ID NO: 3956374 - RNA, 22 nt, Human herpesvirus 1
cccggcucuccgaucccaacuc

SEQ ID NO: 3956375 - RNA, 12 nt, Human herpesvirus 1
cccggggccagc

SEQ ID NO: 3956376 - RNA, 13 nt, Human herpesvirus 1
cccggggccugcu

SEQ ID NO: 3956377 - RNA, 14 nt, Human herpesvirus 1
cccggggcucagcc

SEQ ID NO: 3956378 - RNA, 13 nt, Human herpesvirus 1
cccggucucccag

SEQ ID NO: 3956379 - RNA, 23 nt, Human herpesvirus 1
cccgucucgcugcccuucugucu

SEQ ID NO: 3956380 - RNA, 21 nt, Human herpesvirus 1
cccgucuggguuuuccccucc

SEQ ID NO: 3956381 - RNA, 18 nt, Human herpesvirus 1
gccuuguuccgcuucccg

SEQ ID NO: 3956382 - RNA, 14 nt, Human herpesvirus 1
gcgacaacgcgacc

SEQ ID NO: 3956383 - RNA, 15 nt, Human herpesvirus 1
gcgaccacgggcugu

SEQ ID NO: 3956384 - RNA, 23 nt, Human herpesvirus 1
gcgacccguaaaugguugcagug

SEQ ID NO: 3956385 - RNA, 18 nt, Human herpesvirus 1
gcgacccugaucccccgc

SEQ ID NO: 3956386 - RNA, 12 nt, Human herpesvirus 1
gcgaccuggggu

SEQ ID NO: 3956387 - RNA, 15 nt, Human herpesvirus 1
gcgacgcacacaccc

SEQ ID NO: 3956388 - RNA, 17 nt, Human herpesvirus 1
gcgacugcgaccccagc

SEQ ID NO: 3956389 - RNA, 21 nt, Human herpesvirus 1
gcgaggugcgguuggggaggc

SEQ ID NO: 3956390 - RNA, 17 nt, Human herpesvirus 1
gcgaguccugcgccccg

SEQ ID NO: 3956391 - RNA, 17 nt, Human herpesvirus 1
gcgaugagccaaccucg

SEQ ID NO: 3956392 - RNA, 15 nt, Human herpesvirus 1
gcgcaccuggugaug

SEQ ID NO: 3956393 - RNA, 19 nt, Human herpesvirus 1
gcgcagcugggaccccggc

SEQ ID NO: 3956394 - RNA, 19 nt, Human herpesvirus 1
gcgcauacgccucccccac

SEQ ID NO: 3956395 - RNA, 11 nt, Human herpesvirus 1
gcgccaaagcc

SEQ ID NO: 3956396 - RNA, 10 nt, Human herpesvirus 1
gcgccaggcc

SEQ ID NO: 3956397 - RNA, 21 nt, Human herpesvirus 1
gcgccauggcgggacugggca

SEQ ID NO: 3956398 - RNA, 15 nt, Human herpesvirus 1
gcgcccacuacacca

SEQ ID NO: 3956399 - RNA, 14 nt, Human herpesvirus 1
gcgcccccgcgcgg

SEQ ID NO: 3956400 - RNA, 21 nt, Human herpesvirus 1
gcgccgacaucaccaccguca

SEQ ID NO: 3956401 - RNA, 13 nt, Human herpesvirus 1
gcgccgcgggccc

SEQ ID NO: 3956402 - RNA, 17 nt, Human herpesvirus 1
gcgccgucgggcguccc

SEQ ID NO: 3956403 - RNA, 17 nt, Human herpesvirus 1
gcgccuugcggcagcgc

SEQ ID NO: 3956404 - RNA, 15 nt, Human herpesvirus 1
gcgcgcgaccucacc

SEQ ID NO: 3956405 - RNA, 21 nt, Human herpesvirus 1
gcgcggacaacauccccccga

SEQ ID NO: 3956406 - RNA, 12 nt, Human herpesvirus 1
gcgcguccccgg

SEQ ID NO: 3956407 - RNA, 17 nt, Human herpesvirus 1
gcgcgucguucgggcgg

SEQ ID NO: 3956408 - RNA, 17 nt, Human herpesvirus 1
gcgcuccgacgacgcgc

SEQ ID NO: 3956409 - RNA, 16 nt, Human herpesvirus 1
gcgcugcucagcgcca

SEQ ID NO: 3956410 - RNA, 15 nt, Human herpesvirus 1
gcgcuggccgugggu

SEQ ID NO: 3956411 - RNA, 15 nt, Human herpesvirus 1
gcgcuggggcugccg

SEQ ID NO: 3956412 - RNA, 17 nt, Human herpesvirus 1
gcggaccggcggcgcug

SEQ ID NO: 3956413 - RNA, 19 nt, Human herpesvirus 1
gcggacgccguggcgcccc

SEQ ID NO: 3956414 - RNA, 22 nt, Human herpesvirus 1
gcggacggcgcggggcccccgc

SEQ ID NO: 3956415 - RNA, 20 nt, Human herpesvirus 1
gcggcaccaccggggccuga

SEQ ID NO: 3956416 - RNA, 15 nt, Human herpesvirus 1
gcggcagcccggagg

SEQ ID NO: 3956417 - RNA, 22 nt, Human herpesvirus 1
gcggccaucgaaaacuacgugc

SEQ ID NO: 3956418 - RNA, 14 nt, Human herpesvirus 1
gcggccgcccaacu

SEQ ID NO: 3956419 - RNA, 16 nt, Human herpesvirus 1
gcggcgcuggcggcca

SEQ ID NO: 3956420 - RNA, 21 nt, Human herpesvirus 1
gcggcgguacguacgggaccg

SEQ ID NO: 3956421 - RNA, 13 nt, Human herpesvirus 1
gcggcgugugggg

SEQ ID NO: 3956422 - RNA, 22 nt, Human herpesvirus 1
gcggcucaacgagcuccuggcc

SEQ ID NO: 3956423 - RNA, 17 nt, Human herpesvirus 1
gcgggcccccggccgcc

SEQ ID NO: 3956424 - RNA, 16 nt, Human herpesvirus 1
gcgggccgccucgggg

SEQ ID NO: 3956425 - RNA, 13 nt, Human herpesvirus 1
gcgggcgccaugg

SEQ ID NO: 3956426 - RNA, 12 nt, Human herpesvirus 1
gcggggccgugg

SEQ ID NO: 3956427 - RNA, 17 nt, Human herpesvirus 1
gcgggggauggggagag

SEQ ID NO: 3956428 - RNA, 15 nt, Human herpesvirus 1
gcggggggugggacc

SEQ ID NO: 3956429 - RNA, 15 nt, Human herpesvirus 1
gcggguagggucgug

SEQ ID NO: 3956430 - RNA, 22 nt, Human herpesvirus 1
gcggguaugguggaccgcggac

SEQ ID NO: 3956431 - RNA, 16 nt, Human herpesvirus 1
gcgggugucugcuccc

SEQ ID NO: 3956432 - RNA, 23 nt, Human herpesvirus 1
gcggguugcugcgcggcguccgc

SEQ ID NO: 3956433 - RNA, 23 nt, Human herpesvirus 1
gcguccaaacccaccgacacaug

SEQ ID NO: 3956434 - RNA, 13 nt, Human herpesvirus 1
gcguccacccgga

SEQ ID NO: 3956435 - RNA, 24 nt, Human herpesvirus 1
gcguccuucuugucgucucucuuc

SEQ ID NO: 3956436 - RNA, 11 nt, Human herpesvirus 1
gcgucuggccc

SEQ ID NO: 3956437 - RNA, 13 nt, Human herpesvirus 1
gcgucugggccac

SEQ ID NO: 3956438 - RNA, 14 nt, Human herpesvirus 1
gcgucugggccacc

SEQ ID NO: 3956439 - RNA, 15 nt, Human herpesvirus 1
gcgugaccccaggga

SEQ ID NO: 3956440 - RNA, 16 nt, Human herpesvirus 1
gcgugaccccagggau

SEQ ID NO: 3956441 - RNA, 16 nt, Human herpesvirus 1
gcgugacgcacccccu

SEQ ID NO: 3956442 - RNA, 18 nt, Human herpesvirus 1
gcgugacgcacccccuga

SEQ ID NO: 3956443 - RNA, 21 nt, Human herpesvirus 1
gcgugcuccuaaacgcaccgu

SEQ ID NO: 3956444 - RNA, 17 nt, Human herpesvirus 1
gcguggaccugggggac

SEQ ID NO: 3956445 - RNA, 16 nt, Human herpesvirus 1
gcguggaucggcgcca

SEQ ID NO: 3956446 - RNA, 18 nt, Human herpesvirus 1
gcuacgaguugccccacc

SEQ ID NO: 3956447 - RNA, 18 nt, Human herpesvirus 1
gcuacgccgcugaccccc

SEQ ID NO: 3956448 - RNA, 20 nt, Human herpesvirus 1
gcuacgccgcugacccccac

SEQ ID NO: 3956449 - RNA, 21 nt, Human herpesvirus 1
gcuagaccacgccccuuuccc

SEQ ID NO: 3956450 - RNA, 13 nt, Human herpesvirus 1
gcuaugacggcaa

SEQ ID NO: 3956451 - RNA, 15 nt, Human herpesvirus 1
gcucaaucuggccca

SEQ ID NO: 3956452 - RNA, 21 nt, Human herpesvirus 1
gcuccgaguucccccggcacg

SEQ ID NO: 3956453 - RNA, 13 nt, Human herpesvirus 1
gcuccgccgcgga

SEQ ID NO: 3956454 - RNA, 21 nt, Human herpesvirus 1
gcuccggggggcuuccggccu

SEQ ID NO: 3956455 - RNA, 18 nt, Human herpesvirus 1
gcuccugauguggcugcu

SEQ ID NO: 3956456 - RNA, 18 nt, Human herpesvirus 1
gcucgcggaggagccagu

SEQ ID NO: 3956457 - RNA, 18 nt, Human herpesvirus 1
gcucgcggagggcggcca

SEQ ID NO: 3956458 - RNA, 21 nt, Human herpesvirus 1
gcucgcggagggcggccagcc

SEQ ID NO: 3956459 - RNA, 15 nt, Human herpesvirus 1
gcucggccuauggcu

SEQ ID NO: 3956460 - RNA, 14 nt, Human herpesvirus 1
gcucgguggcuccg

SEQ ID NO: 3956461 - RNA, 20 nt, Human herpesvirus 1
gcucgucgggguggcacaga

SEQ ID NO: 3956462 - RNA, 17 nt, Human herpesvirus 1
gcucgugggccucuggg

SEQ ID NO: 3956463 - RNA, 17 nt, Human herpesvirus 1
gcucuccgaucccaacu

SEQ ID NO: 3956464 - RNA, 21 nt, Human herpesvirus 1
gcucucgcgcguggaccuggg

SEQ ID NO: 3956465 - RNA, 14 nt, Human herpesvirus 1
gcugccagaccuca

SEQ ID NO: 3956466 - RNA, 20 nt, Human herpesvirus 1
gcugccccgcuucauccccg

SEQ ID NO: 3956467 - RNA, 16 nt, Human herpesvirus 1
gcugcccuucugucug

SEQ ID NO: 3956468 - RNA, 21 nt, Human herpesvirus 1
gcugcccuucugucuggacca

SEQ ID NO: 3956469 - RNA, 19 nt, Human herpesvirus 1
gcugcgaguccugcgcccc

SEQ ID NO: 3956470 - RNA, 22 nt, Human herpesvirus 1
gcugcgcggcguccgcgccccu

SEQ ID NO: 3956471 - RNA, 12 nt, Human herpesvirus 1
gcuggaccucac

SEQ ID NO: 3956472 - RNA, 19 nt, Human herpesvirus 1
gcuggacuacacggagguc

SEQ ID NO: 3956473 - RNA, 17 nt, Human herpesvirus 1
gcuggcaacucgcccca

SEQ ID NO: 3956474 - RNA, 17 nt, Human herpesvirus 1
gcuggggcggcugggcu

SEQ ID NO: 3956475 - RNA, 18 nt, Human herpesvirus 1
gcuggguggucucuggcc

SEQ ID NO: 3956476 - RNA, 19 nt, Human herpesvirus 1
gcuggguggucucuggccg

SEQ ID NO: 3956477 - RNA, 16 nt, Human herpesvirus 1
gcuguacucgacccac

SEQ ID NO: 3956478 - RNA, 17 nt, Human herpesvirus 1
gcuuguccccgaacaaa

SEQ ID NO: 3956479 - RNA, 23 nt, Human herpesvirus 1
ggaaaccguaacggcauaugcaa

SEQ ID NO: 3956480 - RNA, 15 nt, Human herpesvirus 1
ggaaagcaagaacaa

SEQ ID NO: 3956481 - RNA, 14 nt, Human herpesvirus 1
ggaaagguggacag

SEQ ID NO: 3956482 - RNA, 22 nt, Human herpesvirus 1
ggaacuacuaugacagcuucag

SEQ ID NO: 3956483 - RNA, 23 nt, Human herpesvirus 1
ggaagcagggcccgccaucuggg

SEQ ID NO: 3956484 - RNA, 22 nt, Human herpesvirus 1
ggacaccggcgcuacuucaccu

SEQ ID NO: 3956485 - RNA, 20 nt, Human herpesvirus 1
ggacagccauauccugagcc

SEQ ID NO: 3956486 - RNA, 14 nt, Human herpesvirus 1
ggaccagagcgcga

SEQ ID NO: 3956487 - RNA, 23 nt, Human herpesvirus 1
ggacccaagccgccccagcaccg

SEQ ID NO: 3956488 - RNA, 12 nt, Human herpesvirus 1
ggacccccggag

SEQ ID NO: 3956489 - RNA, 23 nt, Human herpesvirus 1
ggacccgugacacccuaccccag

SEQ ID NO: 3956490 - RNA, 15 nt, Human herpesvirus 1
ggaccuccuggacuu

SEQ ID NO: 3956491 - RNA, 22 nt, Human herpesvirus 1
ggacgacggcggcgaggccggc

SEQ ID NO: 3956492 - RNA, 21 nt, Human herpesvirus 1
ggagcaaaacgccucccccug

SEQ ID NO: 3956493 - RNA, 17 nt, Human herpesvirus 1
ggagccccggaccccac

SEQ ID NO: 3956494 - RNA, 14 nt, Human herpesvirus 1
ggagccuguugugg

SEQ ID NO: 3956495 - RNA, 13 nt, Human herpesvirus 1
ggagcgccaggac

SEQ ID NO: 3956496 - RNA, 23 nt, Human herpesvirus 1
gggcgucaccaugcagcgccgga

SEQ ID NO: 3956497 - RNA, 13 nt, Human herpesvirus 1
gggcgucccugga

SEQ ID NO: 3956498 - RNA, 19 nt, Human herpesvirus 1
gggcucgccagcgacccgc

SEQ ID NO: 3956499 - RNA, 18 nt, Human herpesvirus 1
gggcucggcuccccgccg

SEQ ID NO: 3956500 - RNA, 21 nt, Human herpesvirus 1
gggcucggcuccccgccgcgg

SEQ ID NO: 3956501 - RNA, 13 nt, Human herpesvirus 1
gggcugccgugag

SEQ ID NO: 3956502 - RNA, 18 nt, Human herpesvirus 1
gggcuggcacaccaccga

SEQ ID NO: 3956503 - RNA, 19 nt, Human herpesvirus 1
gggcuguacucgacccacu

SEQ ID NO: 3956504 - RNA, 18 nt, Human herpesvirus 1
gggcuguuccgccaggcg

SEQ ID NO: 3956505 - RNA, 21 nt, Human herpesvirus 1
gggcuuggacgcgccucccgg

SEQ ID NO: 3956506 - RNA, 22 nt, Human herpesvirus 1
ggggacugcaucggcaaggacg

SEQ ID NO: 3956507 - RNA, 13 nt, Human herpesvirus 1
ggggagagcccac

SEQ ID NO: 3956508 - RNA, 18 nt, Human herpesvirus 1
ggggcauccgggaccuga

SEQ ID NO: 3956509 - RNA, 20 nt, Human herpesvirus 1
ggggcauccgggaccugaac

SEQ ID NO: 3956510 - RNA, 21 nt, Human herpesvirus 1
ggggccccgacgcaccccccc

SEQ ID NO: 3956511 - RNA, 18 nt, Human herpesvirus 1
ggggcgcuuaccgccaca

SEQ ID NO: 3956512 - RNA, 16 nt, Human herpesvirus 1
ggggcuuccggccugg

SEQ ID NO: 3956513 - RNA, 11 nt, Human herpesvirus 1
gggggcggcgu

SEQ ID NO: 3956514 - RNA, 22 nt, Human herpesvirus 1
gggggcuuccggccugggggcc

SEQ ID NO: 3956515 - RNA, 15 nt, Human herpesvirus 1
ggggguugcuguccc

SEQ ID NO: 3956516 - RNA, 17 nt, Human herpesvirus 1
gggucaccugccaguca

SEQ ID NO: 3956517 - RNA, 21 nt, Human herpesvirus 1
gggucgcucuguccaccggga

SEQ ID NO: 3956518 - RNA, 11 nt, Human herpesvirus 1
gggucgggcgc

SEQ ID NO: 3956519 - RNA, 18 nt, Human herpesvirus 1
gggucuguugguccuggc

SEQ ID NO: 3956520 - RNA, 17 nt, Human herpesvirus 1
ggguucgauuggcaaug

SEQ ID NO: 3956521 - RNA, 23 nt, Human herpesvirus 1
ggguugacgcuggggguccuggu

SEQ ID NO: 3956522 - RNA, 20 nt, Human herpesvirus 1
ggguuggggggguccggcac

SEQ ID NO: 3956523 - RNA, 15 nt, Human herpesvirus 1
ggguuucacugaaac

SEQ ID NO: 3956524 - RNA, 20 nt, Human herpesvirus 1
gguacaacgcgacgcacauc

SEQ ID NO: 3956525 - RNA, 17 nt, Human herpesvirus 1
gguaccgcgugacccca

SEQ ID NO: 3956526 - RNA, 19 nt, Human herpesvirus 1
gguagcccggccgugugac

SEQ ID NO: 3956527 - RNA, 13 nt, Human herpesvirus 1
gguaggcccagca

SEQ ID NO: 3956528 - RNA, 15 nt, Human herpesvirus 1
gguccauuaaagaca

SEQ ID NO: 3956529 - RNA, 15 nt, Human herpesvirus 1
ggucccaccugacgc

SEQ ID NO: 3956530 - RNA, 17 nt, Human herpesvirus 1
gguccgcggggccuccc

SEQ ID NO: 3956531 - RNA, 19 nt, Human herpesvirus 1
ggucggcgagcuggauggc

SEQ ID NO: 3956532 - RNA, 23 nt, Human herpesvirus 1
ggucuccccgggagccccggacc

SEQ ID NO: 3956533 - RNA, 17 nt, Human herpesvirus 1
ggucuguugguccuggc

SEQ ID NO: 3956534 - RNA, 15 nt, Human herpesvirus 1
ggugacgguggacag

SEQ ID NO: 3956535 - RNA, 18 nt, Human herpesvirus 1
gguggagggugucccagg

SEQ ID NO: 3956536 - RNA, 20 nt, Human herpesvirus 1
gguggucucuggccgcgccc

SEQ ID NO: 3956537 - RNA, 17 nt, Human herpesvirus 1
gguguccgagcccaccg

SEQ ID NO: 3956538 - RNA, 12 nt, Human herpesvirus 1
gguguccgcggu

SEQ ID NO: 3956539 - RNA, 22 nt, Human herpesvirus 1
gguuccggaggcgccgcgcgga

SEQ ID NO: 3956540 - RNA, 20 nt, Human herpesvirus 1
gguucgcgucccgcccaccg

SEQ ID NO: 3956541 - RNA, 14 nt, Human herpesvirus 1
gguugcggcccgcg

SEQ ID NO: 3956542 - RNA, 20 nt, Human herpesvirus 1
guacaaguucaaggccacca

SEQ ID NO: 3956543 - RNA, 14 nt, Human herpesvirus 1
guacauguccccgu

SEQ ID NO: 3956544 - RNA, 18 nt, Human herpesvirus 1
guaccaucaaccacccgg

SEQ ID NO: 3956545 - RNA, 19 nt, Human herpesvirus 1
guacgccccaccggcacca

SEQ ID NO: 3956546 - RNA, 14 nt, Human herpesvirus 1
guacucgacccacu

SEQ ID NO: 3956547 - RNA, 18 nt, Human herpesvirus 1
guacugcggucugucucg

SEQ ID NO: 3956548 - RNA, 23 nt, Human herpesvirus 1
guacuggaaguaccugcagacgg

SEQ ID NO: 3956549 - RNA, 23 nt, Human herpesvirus 1
guacuggaugcgccgccacacuc

SEQ ID NO: 3956550 - RNA, 20 nt, Human herpesvirus 1
guaggcccagcauguccgcc

SEQ ID NO: 3956551 - RNA, 22 nt, Human herpesvirus 1
guauggggcgggggauggggag

SEQ ID NO: 3956552 - RNA, 23 nt, Human herpesvirus 1
guaugucaccggcugagucccuc

SEQ ID NO: 3956553 - RNA, 21 nt, Human herpesvirus 1
gucaccgguucguauccacaa

SEQ ID NO: 3956554 - RNA, 23 nt, Human herpesvirus 1
gucaccgguuuccgcgacccacc

SEQ ID NO: 3956555 - RNA, 13 nt, Human herpesvirus 1
guccaaacccacc

SEQ ID NO: 3956556 - RNA, 19 nt, Human herpesvirus 1
guccaccaaagucucugug

SEQ ID NO: 3956557 - RNA, 21 nt, Human herpesvirus 1
guccacggccacuggccggga

SEQ ID NO: 3956558 - RNA, 16 nt, Human herpesvirus 1
guccacgggggggagc

SEQ ID NO: 3956559 - RNA, 15 nt, Human herpesvirus 1
guccccgaacaaacg

SEQ ID NO: 3956560 - RNA, 17 nt, Human herpesvirus 1
guccccggcccggagga

SEQ ID NO: 3956561 - RNA, 18 nt, Human herpesvirus 1
guccccucugggcccgcc

SEQ ID NO: 3956562 - RNA, 13 nt, Human herpesvirus 1
guccccuggggcg

SEQ ID NO: 3956563 - RNA, 15 nt, Human herpesvirus 1
guccccuucgaggag

SEQ ID NO: 3956564 - RNA, 20 nt, Human herpesvirus 1
gucccgcaauuucaccgccc

SEQ ID NO: 3956565 - RNA, 13 nt, Human herpesvirus 1
gucccgcccgugu

SEQ ID NO: 3956566 - RNA, 19 nt, Human herpesvirus 1
gucccggcucuccgauccc

SEQ ID NO: 3956567 - RNA, 21 nt, Human herpesvirus 1
gucccguuaccaagaccaacc

SEQ ID NO: 3956568 - RNA, 16 nt, Human herpesvirus 1
gucccugggcccuggc

SEQ ID NO: 3956569 - RNA, 17 nt, Human herpesvirus 1
guccgcgcauccgaccc

SEQ ID NO: 3956570 - RNA, 16 nt, Human herpesvirus 1
guccgcgggagguucc

SEQ ID NO: 3956571 - RNA, 12 nt, Human herpesvirus 1
guccgcggggcc

SEQ ID NO: 3956572 - RNA, 16 nt, Human herpesvirus 1
guccucaccgagccuc

SEQ ID NO: 3956573 - RNA, 14 nt, Human herpesvirus 1
guccucgcaccagc

SEQ ID NO: 3956574 - RNA, 14 nt, Human herpesvirus 1
guccugcgccccgc

SEQ ID NO: 3956575 - RNA, 16 nt, Human herpesvirus 1
guccugcgccccgccg

SEQ ID NO: 3956576 - RNA, 21 nt, Human herpesvirus 1
gucgacgcagacgcacccgcu

SEQ ID NO: 3956577 - RNA, 20 nt, Human herpesvirus 1
gucgccccgugucugugggc

SEQ ID NO: 3956578 - RNA, 18 nt, Human herpesvirus 1
gucgccgugcuccuguga

SEQ ID NO: 3956579 - RNA, 15 nt, Human herpesvirus 1
gucggaggcccccca

SEQ ID NO: 3956580 - RNA, 14 nt, Human herpesvirus 1
gucgggaggccaca

SEQ ID NO: 3956581 - RNA, 18 nt, Human herpesvirus 1
gucgggguggcacagaac

SEQ ID NO: 3956582 - RNA, 16 nt, Human herpesvirus 1
gucgucacgcacgcca

SEQ ID NO: 3956583 - RNA, 14 nt, Human herpesvirus 1
gucgucgaucgacg

SEQ ID NO: 3956584 - RNA, 21 nt, Human herpesvirus 1
gucgucucucuucccccccau

SEQ ID NO: 3956585 - RNA, 20 nt, Human herpesvirus 1
gucucccagggagccccggu

SEQ ID NO: 3956586 - RNA, 13 nt, Human herpesvirus 1
gucuccgugcugu

SEQ ID NO: 3956587 - RNA, 23 nt, Human herpesvirus 1
gucuccgugcuguaccggugggc

SEQ ID NO: 3956588 - RNA, 17 nt, Human herpesvirus 1
gucuccuccaccaccca

SEQ ID NO: 3956589 - RNA, 19 nt, Human herpesvirus 1
gucugcuccccaccccgga

SEQ ID NO: 3956590 - RNA, 16 nt, Human herpesvirus 1
gucuucggggcccggc

SEQ ID NO: 3956591 - RNA, 18 nt, Human herpesvirus 1
gugaacgcaacggcggga

SEQ ID NO: 3956592 - RNA, 13 nt, Human herpesvirus 1
gugagcgaggacg

SEQ ID NO: 3956593 - RNA, 16 nt, Human herpesvirus 1
gugagucacagcgacc

SEQ ID NO: 3956594 - RNA, 18 nt, Human herpesvirus 1
gugcacagccuggccgug

SEQ ID NO: 3956595 - RNA, 15 nt, Human herpesvirus 1
gugcaugucgucacg

SEQ ID NO: 3956596 - RNA, 15 nt, Human herpesvirus 1
gugccaccagccugg

SEQ ID NO: 3956597 - RNA, 20 nt, Human herpesvirus 1
gugcccacgucgccccgccg

SEQ ID NO: 3956598 - RNA, 12 nt, Human herpesvirus 1
gugcccccgcgc

SEQ ID NO: 3956599 - RNA, 21 nt, Human herpesvirus 1
gugcccccggauaugcgcggg

SEQ ID NO: 3956600 - RNA, 20 nt, Human herpesvirus 1
gugcccuuccaggucccacc

SEQ ID NO: 3956601 - RNA, 23 nt, Human herpesvirus 1
gugccgcccguugcagggccugg

SEQ ID NO: 3956602 - RNA, 16 nt, Human herpesvirus 1
gugccuuuguuuccca

SEQ ID NO: 3956603 - RNA, 23 nt, Human herpesvirus 1
gugcguagcauaccugggugugu

SEQ ID NO: 3956604 - RNA, 15 nt, Human herpesvirus 1
gugcgucugggcccg

SEQ ID NO: 3956605 - RNA, 17 nt, Human herpesvirus 1
gugcucgugggccucug

SEQ ID NO: 3956606 - RNA, 15 nt, Human herpesvirus 1
gugcuuucuggugcu

SEQ ID NO: 3956607 - RNA, 21 nt, Human herpesvirus 1
guggaccccacgacacccacc

SEQ ID NO: 3956608 - RNA, 18 nt, Human herpesvirus 1
guggacgccggggccuug

SEQ ID NO: 3956609 - RNA, 22 nt, Human herpesvirus 1
guggagcaaaacgccucccccu

SEQ ID NO: 3956610 - RNA, 14 nt, Human herpesvirus 1
ucgaccaccaccuc

SEQ ID NO: 3956611 - RNA, 21 nt, Human herpesvirus 1
ucgacccgcaacgcgcugggg

SEQ ID NO: 3956612 - RNA, 19 nt, Human herpesvirus 1
ucgacgcccccucccuguu

SEQ ID NO: 3956613 - RNA, 13 nt, Human herpesvirus 1
ucgagaugagcca

SEQ ID NO: 3956614 - RNA, 19 nt, Human herpesvirus 1
ucgagcagccgcgccgcug

SEQ ID NO: 3956615 - RNA, 14 nt, Human herpesvirus 1
ucgagcgccaccug

SEQ ID NO: 3956616 - RNA, 14 nt, Human herpesvirus 1
ucgaggggcagcug

SEQ ID NO: 3956617 - RNA, 17 nt, Human herpesvirus 1
ucgcagggcgccaugcg

SEQ ID NO: 3956618 - RNA, 16 nt, Human herpesvirus 1
ucgcauccgagcaccc

SEQ ID NO: 3956619 - RNA, 17 nt, Human herpesvirus 1
ucgccacacccgcgacc

SEQ ID NO: 3956620 - RNA, 19 nt, Human herpesvirus 1
ucgccccuguggcccuggc

SEQ ID NO: 3956621 - RNA, 19 nt, Human herpesvirus 1
ucgcccgauuuacagcccc

SEQ ID NO: 3956622 - RNA, 13 nt, Human herpesvirus 1
ucgccgagccccc

SEQ ID NO: 3956623 - RNA, 23 nt, Human herpesvirus 1
ucgccgcccugagcgcccuccug

SEQ ID NO: 3956624 - RNA, 12 nt, Human herpesvirus 1
ucgcgcuccucu

SEQ ID NO: 3956625 - RNA, 24 nt, Human herpesvirus 1
ucgcgggacccgacaggcgaccgc

SEQ ID NO: 3956626 - RNA, 17 nt, Human herpesvirus 1
ucgcgucccgcccaccg

SEQ ID NO: 3956627 - RNA, 23 nt, Human herpesvirus 1
ucgcucucggugcgucugggccc

SEQ ID NO: 3956628 - RNA, 16 nt, Human herpesvirus 1
ucgcuucccgaccucc

SEQ ID NO: 3956629 - RNA, 20 nt, Human herpesvirus 1
ucggccccgcgucuggcccc

SEQ ID NO: 3956630 - RNA, 22 nt, Human herpesvirus 1
ucggccguuucuccgcccgacc

SEQ ID NO: 3956631 - RNA, 17 nt, Human herpesvirus 1
ucggcgaccgccagccg

SEQ ID NO: 3956632 - RNA, 20 nt, Human herpesvirus 1
ucgggccucccggaagagcc

SEQ ID NO: 3956633 - RNA, 16 nt, Human herpesvirus 1
ucgggcgccaaagccc

SEQ ID NO: 3956634 - RNA, 17 nt, Human herpesvirus 1
ucggggccgcccuggcc

SEQ ID NO: 3956635 - RNA, 16 nt, Human herpesvirus 1
ucggucccccgaggcc

SEQ ID NO: 3956636 - RNA, 15 nt, Human herpesvirus 1
ucggucgaagccuac

SEQ ID NO: 3956637 - RNA, 16 nt, Human herpesvirus 1
ucguauccacaauaaa

SEQ ID NO: 3956638 - RNA, 18 nt, Human herpesvirus 1
ucgugcgcucgcucucgg

SEQ ID NO: 3956639 - RNA, 12 nt, Human herpesvirus 1
ucguggccccga

SEQ ID NO: 3956640 - RNA, 21 nt, Human herpesvirus 1
ucuaacgguccucaccgagcc

SEQ ID NO: 3956641 - RNA, 20 nt, Human herpesvirus 1
ucuccgcggugucugggaau

SEQ ID NO: 3956642 - RNA, 16 nt, Human herpesvirus 1
ucuccggggcccggcc

SEQ ID NO: 3956643 - RNA, 16 nt, Human herpesvirus 1
ucuccgucaccgcgac

SEQ ID NO: 3956644 - RNA, 14 nt, Human herpesvirus 1
ucucuucccucagg

SEQ ID NO: 3956645 - RNA, 14 nt, Human herpesvirus 1
ucugaucgacgacg

SEQ ID NO: 3956646 - RNA, 12 nt, Human herpesvirus 1
ucugcgggccgc

SEQ ID NO: 3956647 - RNA, 19 nt, Human herpesvirus 1
ucugcuacgccgcugaccc

SEQ ID NO: 3956648 - RNA, 13 nt, Human herpesvirus 1
ucuggccccggcg

SEQ ID NO: 3956649 - RNA, 17 nt, Human herpesvirus 1
ucuggccgcgcccacua

SEQ ID NO: 3956650 - RNA, 21 nt, Human herpesvirus 1
ucuggcguucgucgcccucca

SEQ ID NO: 3956651 - RNA, 20 nt, Human herpesvirus 1
ucugggauggcuccuggcca

SEQ ID NO: 3956652 - RNA, 23 nt, Human herpesvirus 1
ucugggccaccgacagccugaac

SEQ ID NO: 3956653 - RNA, 13 nt, Human herpesvirus 1
ucugggggccugu

SEQ ID NO: 3956654 - RNA, 22 nt, Human herpesvirus 1
ucuggggucccugucgccuccc

SEQ ID NO: 3956655 - RNA, 18 nt, Human herpesvirus 1
ucuggguuuuccccuccc

SEQ ID NO: 3956656 - RNA, 21 nt, Human herpesvirus 1
ucuggguuuuccccucccguc

SEQ ID NO: 3956657 - RNA, 17 nt, Human herpesvirus 1
ucuggugcugucugaca

SEQ ID NO: 3956658 - RNA, 19 nt, Human herpesvirus 1
ucuguuggggacacugggu

SEQ ID NO: 3956659 - RNA, 23 nt, Human herpesvirus 1
ucuucggccccgcgucuggcccc

SEQ ID NO: 3956660 - RNA, 18 nt, Human herpesvirus 1
ucuucggggcccggccca

SEQ ID NO: 3956661 - RNA, 16 nt, Human herpesvirus 1
ucuuuuguguuggccc

SEQ ID NO: 3956662 - RNA, 17 nt, Human herpesvirus 1
ucuuuuguguuggcccu

SEQ ID NO: 3956663 - RNA, 16 nt, Human herpesvirus 1
ugaaaaucgguccccc

SEQ ID NO: 3956664 - RNA, 14 nt, Human herpesvirus 1
ugaaccagacccua

SEQ ID NO: 3956665 - RNA, 18 nt, Human herpesvirus 1
ugaagaucgccggguggc

SEQ ID NO: 3956666 - RNA, 16 nt, Human herpesvirus 1
ugaaggcccuguaccc

SEQ ID NO: 3956667 - RNA, 13 nt, Human herpesvirus 1
ugacagcggggac

SEQ ID NO: 3956668 - RNA, 18 nt, Human herpesvirus 1
ugaccaacgacggcccga

SEQ ID NO: 3956669 - RNA, 16 nt, Human herpesvirus 1
ugaccgacccuccggg

SEQ ID NO: 3956670 - RNA, 15 nt, Human herpesvirus 1
ugaccgcccacgacu

SEQ ID NO: 3956671 - RNA, 14 nt, Human herpesvirus 1
ugacgaggccaagc

SEQ ID NO: 3956672 - RNA, 22 nt, Human herpesvirus 1
ugacgcacccccugaccccgcu

SEQ ID NO: 3956673 - RNA, 23 nt, Human herpesvirus 1
ugagccagacccaacccccggcc

SEQ ID NO: 3956674 - RNA, 17 nt, Human herpesvirus 1
ugaguacgaggaucugu

SEQ ID NO: 3956675 - RNA, 20 nt, Human herpesvirus 1
ugaguuuguggacccaaagc

SEQ ID NO: 3956676 - RNA, 18 nt, Human herpesvirus 1
ugaucagacgagccgcgc

SEQ ID NO: 3956677 - RNA, 14 nt, Human herpesvirus 1
ugauccgcggcgac

SEQ ID NO: 3956678 - RNA, 16 nt, Human herpesvirus 1
ugauccuuaggggccg

SEQ ID NO: 3956679 - RNA, 18 nt, Human herpesvirus 1
ugaucgcguaccagcccc

SEQ ID NO: 3956680 - RNA, 20 nt, Human herpesvirus 1
ugauggcacaccgguccccg

SEQ ID NO: 3956681 - RNA, 20 nt, Human herpesvirus 1
ugaugucccucauuuuacaa

SEQ ID NO: 3956682 - RNA, 18 nt, Human herpesvirus 1
ugcacagccuggccgugc

SEQ ID NO: 3956683 - RNA, 11 nt, Human herpesvirus 1
ugcacccagcc

SEQ ID NO: 3956684 - RNA, 15 nt, Human herpesvirus 1
ugcacccagccuuua

SEQ ID NO: 3956685 - RNA, 13 nt, Human herpesvirus 1
ugcaccccagagg

SEQ ID NO: 3956686 - RNA, 13 nt, Human herpesvirus 1
ugcacgcccccgc

SEQ ID NO: 3956687 - RNA, 16 nt, Human herpesvirus 1
ugcacgcccccgcguu

SEQ ID NO: 3956688 - RNA, 21 nt, Human herpesvirus 1
ugcagaaucacgagcugaccc

SEQ ID NO: 3956689 - RNA, 19 nt, Human herpesvirus 1
ugcagcgccggccuccccg

SEQ ID NO: 3956690 - RNA, 13 nt, Human herpesvirus 1
ugcaucggcaagg

SEQ ID NO: 3956691 - RNA, 18 nt, Human herpesvirus 1
ugcaugucgucacgguga

SEQ ID NO: 3956692 - RNA, 23 nt, Human herpesvirus 1
ugccacgcgagcgacccgcgacu

SEQ ID NO: 3956693 - RNA, 18 nt, Human herpesvirus 1
ugccagcuaugggcccug

SEQ ID NO: 3956694 - RNA, 17 nt, Human herpesvirus 1
ugccaguccgcugcacc

SEQ ID NO: 3956695 - RNA, 17 nt, Human herpesvirus 1
ugccaucgcgcccccuc

SEQ ID NO: 3956696 - RNA, 16 nt, Human herpesvirus 1
ugcccauuuacguggc

SEQ ID NO: 3956697 - RNA, 22 nt, Human herpesvirus 1
ugcccauuuacguggcuggguu

SEQ ID NO: 3956698 - RNA, 16 nt, Human herpesvirus 1
ugcccccgcgccuccc

SEQ ID NO: 3956699 - RNA, 23 nt, Human herpesvirus 1
ugcccccgcgccucccggcccgu

SEQ ID NO: 3956700 - RNA, 23 nt, Human herpesvirus 1
ugccccuggugaagaccacuccc

SEQ ID NO: 3956701 - RNA, 20 nt, Human herpesvirus 1
ugcccgcggaccaccgggcc

SEQ ID NO: 3956702 - RNA, 20 nt, Human herpesvirus 1
ugcccuuccaggucccaccu

SEQ ID NO: 3956703 - RNA, 19 nt, Human herpesvirus 1
ugccgcccguugcagggcc

SEQ ID NO: 3956704 - RNA, 16 nt, Human herpesvirus 1
ugccggucggcgggcc

SEQ ID NO: 3956705 - RNA, 16 nt, Human herpesvirus 1
ugccuccaccgggccc

SEQ ID NO: 3956706 - RNA, 19 nt, Human herpesvirus 1
ugccucuccccccaggccu

SEQ ID NO: 3956707 - RNA, 16 nt, Human herpesvirus 1
ugcgcccggcggaccc

SEQ ID NO: 3956708 - RNA, 14 nt, Human herpesvirus 1
ugcgccuugggccc

SEQ ID NO: 3956709 - RNA, 17 nt, Human herpesvirus 1
ugcgcucccgccuuccg

SEQ ID NO: 3956710 - RNA, 14 nt, Human herpesvirus 1
ugcggcggcgcugc

SEQ ID NO: 3956711 - RNA, 16 nt, Human herpesvirus 1
ugcggggaggggggca

SEQ ID NO: 3956712 - RNA, 17 nt, Human herpesvirus 1
ugcggggcggggacggg

SEQ ID NO: 3956713 - RNA, 15 nt, Human herpesvirus 1
ugcgggucaccugcc

SEQ ID NO: 3956714 - RNA, 13 nt, Human herpesvirus 1
ugcggucugucuc

SEQ ID NO: 3956715 - RNA, 18 nt, Human herpesvirus 1
ugcgguuggggaggcugu

SEQ ID NO: 3956716 - RNA, 18 nt, Human herpesvirus 1
ugcgucccuccccgguuu

SEQ ID NO: 3956717 - RNA, 21 nt, Human herpesvirus 1
ugcuccgccgcggaucgggcc

SEQ ID NO: 3956718 - RNA, 14 nt, Human herpesvirus 1
ugcuccgccuggcc

SEQ ID NO: 3956719 - RNA, 18 nt, Human herpesvirus 1
ugcucgggcaggugcaga

SEQ ID NO: 3956720 - RNA, 13 nt, Human herpesvirus 1
uggacccaaagcc

SEQ ID NO: 3956721 - RNA, 15 nt, Human herpesvirus 1
uggaccccagcgacc

SEQ ID NO: 3956722 - RNA, 23 nt, Human herpesvirus 1
uggaccccagcgaccccacggcc

SEQ ID NO: 3956723 - RNA, 15 nt, Human herpesvirus 1
uggagagcgaaggcu

SEQ ID NO: 3956724 - RNA, 15 nt, Human herpesvirus 1
uggaucggcgccaug

SEQ ID NO: 3956725 - RNA, 15 nt, Human herpesvirus 1
aaaaccacaaccucc

SEQ ID NO: 3956726 - RNA, 21 nt, Human herpesvirus 1
aaacgacaucuugucgucaaa

SEQ ID NO: 3956727 - RNA, 23 nt, Human herpesvirus 1
aaacucccgacaccaccagcugg

SEQ ID NO: 3956728 - RNA, 21 nt, Human herpesvirus 1
aaagacacgggcaccacacac

SEQ ID NO: 3956729 - RNA, 17 nt, Human herpesvirus 1
aaagugaaagacacggg

SEQ ID NO: 3956730 - RNA, 18 nt, Human herpesvirus 1
aaaugguguccgcggucc

SEQ ID NO: 3956731 - RNA, 14 nt, Human herpesvirus 1
aaauuuuacaaaca

SEQ ID NO: 3956732 - RNA, 16 nt, Human herpesvirus 1
aaauuuuacaaacaga

SEQ ID NO: 3956733 - RNA, 13 nt, Human herpesvirus 1
aacaucaaacacg

SEQ ID NO: 3956734 - RNA, 15 nt, Human herpesvirus 1
aacaugacccagacc

SEQ ID NO: 3956735 - RNA, 17 nt, Human herpesvirus 1
aaccacccgcaccccca

SEQ ID NO: 3956736 - RNA, 15 nt, Human herpesvirus 1
aaccccccccaaaaa

SEQ ID NO: 3956737 - RNA, 14 nt, Human herpesvirus 1
aaccccggucuccc

SEQ ID NO: 3956738 - RNA, 19 nt, Human herpesvirus 1
aaccccuuuggggcgcugg

SEQ ID NO: 3956739 - RNA, 16 nt, Human herpesvirus 1
aacccgcgcuaugacg

SEQ ID NO: 3956740 - RNA, 20 nt, Human herpesvirus 1
aaccucggaugacucagggc

SEQ ID NO: 3956741 - RNA, 19 nt, Human herpesvirus 1
aaccuucgcaacaccuccc

SEQ ID NO: 3956742 - RNA, 23 nt, Human herpesvirus 1
aaccuucugcgggucaccugcca

SEQ ID NO: 3956743 - RNA, 19 nt, Human herpesvirus 1
aacgauauguugggccgcg

SEQ ID NO: 3956744 - RNA, 15 nt, Human herpesvirus 1
aacgccagccugcgg

SEQ ID NO: 3956745 - RNA, 21 nt, Human herpesvirus 1
aacgccucccccugagccgcu

SEQ ID NO: 3956746 - RNA, 17 nt, Human herpesvirus 1
aacgcguccguggagcg

SEQ ID NO: 3956747 - RNA, 13 nt, Human herpesvirus 1
aacgguccucacc

SEQ ID NO: 3956748 - RNA, 20 nt, Human herpesvirus 1
aacucucaguuuaucaugga

SEQ ID NO: 3956749 - RNA, 16 nt, Human herpesvirus 1
aacucucgcaccaucc

SEQ ID NO: 3956750 - RNA, 20 nt, Human herpesvirus 1
aacuucaucacccccgaguu

SEQ ID NO: 3956751 - RNA, 16 nt, Human herpesvirus 1
aagcgucccugggccc

SEQ ID NO: 3956752 - RNA, 17 nt, Human herpesvirus 1
aagcgucccugggcccu

SEQ ID NO: 3956753 - RNA, 18 nt, Human herpesvirus 1
aagcuagccgaggcccgg

SEQ ID NO: 3956754 - RNA, 17 nt, Human herpesvirus 1
aagcuaugcagccccgu

SEQ ID NO: 3956755 - RNA, 12 nt, Human herpesvirus 1
aaggccugggau

SEQ ID NO: 3956756 - RNA, 19 nt, Human herpesvirus 1
aauaaaccgguauuauuua

SEQ ID NO: 3956757 - RNA, 22 nt, Human herpesvirus 1
aauaaagagccguaacccaacc

SEQ ID NO: 3956758 - RNA, 11 nt, Human herpesvirus 1
aauaaagccac

SEQ ID NO: 3956759 - RNA, 13 nt, Human herpesvirus 1
aauaaauuuuaca

SEQ ID NO: 3956760 - RNA, 21 nt, Human herpesvirus 1
aauaacgacccgaagcugcuc

SEQ ID NO: 3956761 - RNA, 21 nt, Human herpesvirus 1
aauacagcauggcgccacacc

SEQ ID NO: 3956762 - RNA, 12 nt, Human herpesvirus 1
aauccccaggac

SEQ ID NO: 3956763 - RNA, 17 nt, Human herpesvirus 1
aaucuggcccaacagcc

SEQ ID NO: 3956764 - RNA, 23 nt, Human herpesvirus 1
aauguuuuuauuggucaaacuca

SEQ ID NO: 3956765 - RNA, 17 nt, Human herpesvirus 1
aauuugcacccagccuu

SEQ ID NO: 3956766 - RNA, 19 nt, Human herpesvirus 1
acaaacccaaccgucccgu

SEQ ID NO: 3956767 - RNA, 15 nt, Human herpesvirus 1
acaacggcucggccu

SEQ ID NO: 3956768 - RNA, 15 nt, Human herpesvirus 1
acaacucccccgcgc

SEQ ID NO: 3956769 - RNA, 19 nt, Human herpesvirus 1
acacaacggcaugccucug

SEQ ID NO: 3956770 - RNA, 11 nt, Human herpesvirus 1
acacacggguu

SEQ ID NO: 3956771 - RNA, 15 nt, Human herpesvirus 1
acacagccggccacg

SEQ ID NO: 3956772 - RNA, 21 nt, Human herpesvirus 1
acaccagcagcuugcggggcu

SEQ ID NO: 3956773 - RNA, 16 nt, Human herpesvirus 1
acaccgguccccggag

SEQ ID NO: 3956774 - RNA, 16 nt, Human herpesvirus 1
acacgcgcguccuucu

SEQ ID NO: 3956775 - RNA, 15 nt, Human herpesvirus 1
acacucgacccccgc

SEQ ID NO: 3956776 - RNA, 17 nt, Human herpesvirus 1
acagagggccacucacg

SEQ ID NO: 3956777 - RNA, 15 nt, Human herpesvirus 1
acagcauggcgccac

SEQ ID NO: 3956778 - RNA, 13 nt, Human herpesvirus 1
acagccgcccccu

SEQ ID NO: 3956779 - RNA, 17 nt, Human herpesvirus 1
acagcuucagcgccguc

SEQ ID NO: 3956780 - RNA, 17 nt, Human herpesvirus 1
acaugcggaaagcaaga

SEQ ID NO: 3956781 - RNA, 17 nt, Human herpesvirus 1
acauggccagcggcccg

SEQ ID NO: 3956782 - RNA, 20 nt, Human herpesvirus 1
accaaacaaacaaaccaaaa

SEQ ID NO: 3956783 - RNA, 20 nt, Human herpesvirus 1
accacaaucgcgaccacccc

SEQ ID NO: 3956784 - RNA, 15 nt, Human herpesvirus 1
accaccaaggcccgg

SEQ ID NO: 3956785 - RNA, 17 nt, Human herpesvirus 1
accaccacugcacuccc

SEQ ID NO: 3956786 - RNA, 18 nt, Human herpesvirus 1
accacccaaccccaacuc

SEQ ID NO: 3956787 - RNA, 21 nt, Human herpesvirus 1
accaccccgagaaccuaggga

SEQ ID NO: 3956788 - RNA, 14 nt, Human herpesvirus 1
accaccgaccucaa

SEQ ID NO: 3956789 - RNA, 19 nt, Human herpesvirus 1
accacgugcacagccuggc

SEQ ID NO: 3956790 - RNA, 13 nt, Human herpesvirus 1
accagcguccgcc

SEQ ID NO: 3956791 - RNA, 16 nt, Human herpesvirus 1
accagcuacgccgccg

SEQ ID NO: 3956792 - RNA, 23 nt, Human herpesvirus 1
accaggaaauccguggccccggc

SEQ ID NO: 3956793 - RNA, 15 nt, Human herpesvirus 1
accaggccuccaccc

SEQ ID NO: 3956794 - RNA, 17 nt, Human herpesvirus 1
accaggucccccacacc

SEQ ID NO: 3956795 - RNA, 15 nt, Human herpesvirus 1
accaucccccggcca

SEQ ID NO: 3956796 - RNA, 15 nt, Human herpesvirus 1
accauccccgcuccc

SEQ ID NO: 3956797 - RNA, 19 nt, Human herpesvirus 1
accaucccggguuaaugua

SEQ ID NO: 3956798 - RNA, 14 nt, Human herpesvirus 1
acccaccccaacgc

SEQ ID NO: 3956799 - RNA, 13 nt, Human herpesvirus 1
acccaccgggccc

SEQ ID NO: 3956800 - RNA, 16 nt, Human herpesvirus 1
acccagccuuuaacua

SEQ ID NO: 3956801 - RNA, 17 nt, Human herpesvirus 1
accccaaauacagcaug

SEQ ID NO: 3956802 - RNA, 17 nt, Human herpesvirus 1
accccaccccugugcua

SEQ ID NO: 3956803 - RNA, 11 nt, Human herpesvirus 1
accccacgccc

SEQ ID NO: 3956804 - RNA, 20 nt, Human herpesvirus 1
accccagcgaccccacggcc

SEQ ID NO: 3956805 - RNA, 18 nt, Human herpesvirus 1
accccagggaccuccugg

SEQ ID NO: 3956806 - RNA, 23 nt, Human herpesvirus 1
accccaguccccgggcccagccu

SEQ ID NO: 3956807 - RNA, 23 nt, Human herpesvirus 1
accccgcaauuugcacccagccu

SEQ ID NO: 3956808 - RNA, 17 nt, Human herpesvirus 1
accccggagggcugcca

SEQ ID NO: 3956809 - RNA, 13 nt, Human herpesvirus 1
acccgacucaccu

SEQ ID NO: 3956810 - RNA, 13 nt, Human herpesvirus 1
acccgccccggag

SEQ ID NO: 3956811 - RNA, 18 nt, Human herpesvirus 1
acccgccccuaaccaggc

SEQ ID NO: 3956812 - RNA, 22 nt, Human herpesvirus 1
acccgccccuaaccaggccucc

SEQ ID NO: 3956813 - RNA, 16 nt, Human herpesvirus 1
acccgcgacccccggg

SEQ ID NO: 3956814 - RNA, 18 nt, Human herpesvirus 1
acccguuccagcccccca

SEQ ID NO: 3956815 - RNA, 21 nt, Human herpesvirus 1
acccguuccagccccccagcc

SEQ ID NO: 3956816 - RNA, 15 nt, Human herpesvirus 1
acccuaccccagucc

SEQ ID NO: 3956817 - RNA, 18 nt, Human herpesvirus 1
acccuaccccaguccccg

SEQ ID NO: 3956818 - RNA, 13 nt, Human herpesvirus 1
acccuaugguaca

SEQ ID NO: 3956819 - RNA, 13 nt, Human herpesvirus 1
acccucucuucuc

SEQ ID NO: 3956820 - RNA, 20 nt, Human herpesvirus 1
acccucuggacgcccgggcg

SEQ ID NO: 3956821 - RNA, 14 nt, Human herpesvirus 2
aaaccugggcggcc

SEQ ID NO: 3956822 - RNA, 19 nt, Human herpesvirus 2
aaacuuuauauuuauaaaa

SEQ ID NO: 3956823 - RNA, 15 nt, Human herpesvirus 2
aaagguccggcggcc

SEQ ID NO: 3956824 - RNA, 15 nt, Human herpesvirus 2
aaauaaaaagacacc

SEQ ID NO: 3956825 - RNA, 18 nt, Human herpesvirus 2
aaaugucacgauaagaac

SEQ ID NO: 3956826 - RNA, 19 nt, Human herpesvirus 2
aacaacacguucgccccgc

SEQ ID NO: 3956827 - RNA, 17 nt, Human herpesvirus 2
aacaacaguacucaucg

SEQ ID NO: 3956828 - RNA, 17 nt, Human herpesvirus 2
aacacaagcucgccgug

SEQ ID NO: 3956829 - RNA, 14 nt, Human herpesvirus 2
aacacugaggaacu

SEQ ID NO: 3956830 - RNA, 13 nt, Human herpesvirus 2
aaccacacacacg

SEQ ID NO: 3956831 - RNA, 18 nt, Human herpesvirus 2
aaccagccccgcaggcag

SEQ ID NO: 3956832 - RNA, 15 nt, Human herpesvirus 2
aacccccgaccccgc

SEQ ID NO: 3956833 - RNA, 17 nt, Human herpesvirus 2
aaccggcgagggcggcc

SEQ ID NO: 3956834 - RNA, 15 nt, Human herpesvirus 2
aacgacccccagcgc

SEQ ID NO: 3956835 - RNA, 13 nt, Human herpesvirus 2
aacuccgcccucg

SEQ ID NO: 3956836 - RNA, 22 nt, Human herpesvirus 2
aagagacgaugggagccccgcg

SEQ ID NO: 3956837 - RNA, 15 nt, Human herpesvirus 2
aagcaagaaaacggu

SEQ ID NO: 3956838 - RNA, 21 nt, Human herpesvirus 2
aagcccgaacggaaggccucc

SEQ ID NO: 3956839 - RNA, 21 nt, Human herpesvirus 2
aagcgccgcgcgggacccacg

SEQ ID NO: 3956840 - RNA, 16 nt, Human herpesvirus 2
aaggaagccgcccccc

SEQ ID NO: 3956841 - RNA, 15 nt, Human herpesvirus 2
aaggagucgccgccc

SEQ ID NO: 3956842 - RNA, 16 nt, Human herpesvirus 2
aaggccaggggggcag

SEQ ID NO: 3956843 - RNA, 14 nt, Human herpesvirus 2
aaggcggacccaga

SEQ ID NO: 3956844 - RNA, 16 nt, Human herpesvirus 2
aagugccgcacggccg

SEQ ID NO: 3956845 - RNA, 15 nt, Human herpesvirus 2
aauaaaacccagacc

SEQ ID NO: 3956846 - RNA, 11 nt, Human herpesvirus 2
aaucacggcac

SEQ ID NO: 3956847 - RNA, 11 nt, Human herpesvirus 2
aauuaaauaca

SEQ ID NO: 3956848 - RNA, 15 nt, Human herpesvirus 2
aauuagcaacuuuua

SEQ ID NO: 3956849 - RNA, 18 nt, Human herpesvirus 2
acaaacagaccgcggaca

SEQ ID NO: 3956850 - RNA, 18 nt, Human herpesvirus 2
acaacagccccugggugu

SEQ ID NO: 3956851 - RNA, 23 nt, Human herpesvirus 2
acacacccccaucgggcugcugg

SEQ ID NO: 3956852 - RNA, 13 nt, Human herpesvirus 2
acacacuuuguug

SEQ ID NO: 3956853 - RNA, 19 nt, Human herpesvirus 2
acacagagaaaggccccca

SEQ ID NO: 3956854 - RNA, 12 nt, Human herpesvirus 2
acaccagggcau

SEQ ID NO: 3956855 - RNA, 19 nt, Human herpesvirus 2
acacccccuguccccgccc

SEQ ID NO: 3956856 - RNA, 14 nt, Human herpesvirus 2
acaccgggcugggg

SEQ ID NO: 3956857 - RNA, 22 nt, Human herpesvirus 2
acacggucggugccccccaucu

SEQ ID NO: 3956858 - RNA, 15 nt, Human herpesvirus 2
acacguucuuugcca

SEQ ID NO: 3956859 - RNA, 22 nt, Human herpesvirus 2
acagaggcgguagcggacgcac

SEQ ID NO: 3956860 - RNA, 15 nt, Human herpesvirus 2
acagccagggcuggg

SEQ ID NO: 3956861 - RNA, 15 nt, Human herpesvirus 2
acagccccuggggcu

SEQ ID NO: 3956862 - RNA, 20 nt, Human herpesvirus 2
acagcugcgccagaaaccgg

SEQ ID NO: 3956863 - RNA, 22 nt, Human herpesvirus 2
acagugggugcucggggacaga

SEQ ID NO: 3956864 - RNA, 16 nt, Human herpesvirus 2
acaugaggcugagggg

SEQ ID NO: 3956865 - RNA, 15 nt, Human herpesvirus 2
accaaccccgucucc

SEQ ID NO: 3956866 - RNA, 12 nt, Human herpesvirus 2
accaccaaggcc

SEQ ID NO: 3956867 - RNA, 23 nt, Human herpesvirus 2
accacgugcacagccuggccgug

SEQ ID NO: 3956868 - RNA, 19 nt, Human herpesvirus 2
accacguguccccagggag

SEQ ID NO: 3956869 - RNA, 16 nt, Human herpesvirus 2
accaggcgcugcugcg

SEQ ID NO: 3956870 - RNA, 13 nt, Human herpesvirus 2
acccccccccauc

SEQ ID NO: 3956871 - RNA, 14 nt, Human herpesvirus 2
accccccccucuca

SEQ ID NO: 3956872 - RNA, 12 nt, Human herpesvirus 2
accccccggguu

SEQ ID NO: 3956873 - RNA, 18 nt, Human herpesvirus 2
acccccgaacagccccug

SEQ ID NO: 3956874 - RNA, 16 nt, Human herpesvirus 2
accccgagcgugcccu

SEQ ID NO: 3956875 - RNA, 17 nt, Human herpesvirus 2
accccgauagucccccg

SEQ ID NO: 3956876 - RNA, 17 nt, Human herpesvirus 2
accccgcccgcuugcau

SEQ ID NO: 3956877 - RNA, 13 nt, Human herpesvirus 2
accccgcugcugu

SEQ ID NO: 3956878 - RNA, 15 nt, Human herpesvirus 2
accccgucucccugc

SEQ ID NO: 3956879 - RNA, 17 nt, Human herpesvirus 2
accccuuccuuuucuuu

SEQ ID NO: 3956880 - RNA, 21 nt, Human herpesvirus 2
acccgacccuguggcgggcgc

SEQ ID NO: 3956881 - RNA, 18 nt, Human herpesvirus 2
acccggacugcagccccg

SEQ ID NO: 3956882 - RNA, 14 nt, Human herpesvirus 2
acccggguccccga

SEQ ID NO: 3956883 - RNA, 11 nt, Human herpesvirus 2
accgagagcgc

SEQ ID NO: 3956884 - RNA, 23 nt, Human herpesvirus 2
accgccucuguuccuuucccuuc

SEQ ID NO: 3956885 - RNA, 13 nt, Human herpesvirus 2
accgcgcgccgcc

SEQ ID NO: 3956886 - RNA, 15 nt, Human herpesvirus 2
accgcgcgccgccgc

SEQ ID NO: 3956887 - RNA, 18 nt, Human herpesvirus 2
accgcggcuucuucgccg

SEQ ID NO: 3956888 - RNA, 20 nt, Human herpesvirus 2
accgcggcuucuucgccgcc

SEQ ID NO: 3956889 - RNA, 15 nt, Human herpesvirus 2
accgcucacccaccc

SEQ ID NO: 3956890 - RNA, 16 nt, Human herpesvirus 2
accgcugucgcccccg

SEQ ID NO: 3956891 - RNA, 19 nt, Human herpesvirus 2
accggcgccgaucgcagcg

SEQ ID NO: 3956892 - RNA, 16 nt, Human herpesvirus 2
accggggccccaucug

SEQ ID NO: 3956893 - RNA, 17 nt, Human herpesvirus 2
accgucgccgccggcca

SEQ ID NO: 3956894 - RNA, 17 nt, Human herpesvirus 2
accgucggugccagacc

SEQ ID NO: 3956895 - RNA, 15 nt, Human herpesvirus 2
accuaauuuuugugu

SEQ ID NO: 3956896 - RNA, 17 nt, Human herpesvirus 2
accuccccggcggccgc

SEQ ID NO: 3956897 - RNA, 16 nt, Human herpesvirus 2
accuccccgugcgugc

SEQ ID NO: 3956898 - RNA, 13 nt, Human herpesvirus 2
accucucgccgcu

SEQ ID NO: 3956899 - RNA, 16 nt, Human herpesvirus 2
accugccccggcgcgu

SEQ ID NO: 3956900 - RNA, 22 nt, Human herpesvirus 2
accugcgcggcguuggcgcgcu

SEQ ID NO: 3956901 - RNA, 22 nt, Human herpesvirus 2
acgaaguggguauacuuuuguc

SEQ ID NO: 3956902 - RNA, 18 nt, Human herpesvirus 2
acgacagcggggacccgg

SEQ ID NO: 3956903 - RNA, 12 nt, Human herpesvirus 2
acgaccugcagc

SEQ ID NO: 3956904 - RNA, 13 nt, Human herpesvirus 2
acgacgccuggcg

SEQ ID NO: 3956905 - RNA, 18 nt, Human herpesvirus 2
acgagaacgagaugguuu

SEQ ID NO: 3956906 - RNA, 12 nt, Human herpesvirus 2
acgagacagacg

SEQ ID NO: 3956907 - RNA, 18 nt, Human herpesvirus 2
acgagccaaaccagcccc

SEQ ID NO: 3956908 - RNA, 17 nt, Human herpesvirus 2
acgccagcugcuggcca

SEQ ID NO: 3956909 - RNA, 13 nt, Human herpesvirus 2
acgccgaugccca

SEQ ID NO: 3956910 - RNA, 24 nt, Human herpesvirus 2
acgccuccggaagagagcgccccg

SEQ ID NO: 3956911 - RNA, 15 nt, Human herpesvirus 2
acgcgccucccgggg

SEQ ID NO: 3956912 - RNA, 21 nt, Human herpesvirus 2
acgcgcgacugccuccacgcc

SEQ ID NO: 3956913 - RNA, 20 nt, Human herpesvirus 2
acgcgguauggcugcccccg

SEQ ID NO: 3956914 - RNA, 23 nt, Human herpesvirus 2
acgcgucgggggccggggcggcc

SEQ ID NO: 3956915 - RNA, 20 nt, Human herpesvirus 2
acggcaacaaagggccuccg

SEQ ID NO: 3956916 - RNA, 17 nt, Human herpesvirus 2
acggcccaccugcacga

SEQ ID NO: 3956917 - RNA, 23 nt, Human herpesvirus 2
acggccccggccgccuccccgcu

SEQ ID NO: 3956918 - RNA, 22 nt, Human herpesvirus 2
acggggaggagacaggaagugg

SEQ ID NO: 3956919 - RNA, 14 nt, Human herpesvirus 2
acgggggggcuggu

SEQ ID NO: 3956920 - RNA, 16 nt, Human herpesvirus 2
acggugaucgaggugu

SEQ ID NO: 3956921 - RNA, 15 nt, Human herpesvirus 2
acguguccccaggga

SEQ ID NO: 3956922 - RNA, 18 nt, Human herpesvirus 2
acguucggacggccccuc

SEQ ID NO: 3956923 - RNA, 21 nt, Human herpesvirus 2
acuacccuuucgacgcgcugg

SEQ ID NO: 3956924 - RNA, 18 nt, Human herpesvirus 2
acuaggacaguucauagg

SEQ ID NO: 3956925 - RNA, 18 nt, Human herpesvirus 2
acucgccauggcggccgc

SEQ ID NO: 3956926 - RNA, 18 nt, Human herpesvirus 2
acugccccccuccugggg

SEQ ID NO: 3956927 - RNA, 22 nt, Human herpesvirus 2
acugggccgaugugcccugcaa

SEQ ID NO: 3956928 - RNA, 21 nt, Human herpesvirus 2
acugggggcggggggugggag

SEQ ID NO: 3956929 - RNA, 12 nt, Human herpesvirus 2
acuuuauuggga

SEQ ID NO: 3956930 - RNA, 17 nt, Human herpesvirus 2
acuuucccccccacucc

SEQ ID NO: 3956931 - RNA, 14 nt, Human herpesvirus 2
agaaacggcaagaa

SEQ ID NO: 3956932 - RNA, 17 nt, Human herpesvirus 2
agaaggggggugugugu

SEQ ID NO: 3956933 - RNA, 22 nt, Human herpesvirus 2
agacggccaugaccucgccccc

SEQ ID NO: 3956934 - RNA, 12 nt, Human herpesvirus 2
agagaaaaagaa

SEQ ID NO: 3956935 - RNA, 13 nt, Human herpesvirus 2
agagagauuuccc

SEQ ID NO: 3956936 - RNA, 17 nt, Human herpesvirus 2
agagccgaacgcagguc

SEQ ID NO: 3956937 - RNA, 15 nt, Human herpesvirus 2
agagccgauccggcc

SEQ ID NO: 3956938 - RNA, 22 nt, Human herpesvirus 2
agaggucaauagauuuccccaa

SEQ ID NO: 3956939 - RNA, 22 nt, Human herpesvirus 2
agagucgauugcggggaccgca

SEQ ID NO: 3956940 - RNA, 17 nt, Human herpesvirus 2
agagugggggcgugagc

SEQ ID NO: 3956941 - RNA, 19 nt, Human herpesvirus 2
agcaacccuauaucccggg

SEQ ID NO: 3956942 - RNA, 20 nt, Human herpesvirus 2
agcagcuuuuaacgggccgc

SEQ ID NO: 3956943 - RNA, 20 nt, Human herpesvirus 2
agcauccugaaccgcuggcu

SEQ ID NO: 3956944 - RNA, 20 nt, Human herpesvirus 2
agccaccgucccgcccgcca

SEQ ID NO: 3956945 - RNA, 14 nt, Human herpesvirus 2
agcccccggcaucg

SEQ ID NO: 3956946 - RNA, 12 nt, Human herpesvirus 2
agccccgcaggc

SEQ ID NO: 3956947 - RNA, 18 nt, Human herpesvirus 2
agccgccaccccccuccc

SEQ ID NO: 3956948 - RNA, 17 nt, Human herpesvirus 2
agccgcccaagcggccc

SEQ ID NO: 3956949 - RNA, 18 nt, Human herpesvirus 2
agccgcccaagcggcccg

SEQ ID NO: 3956950 - RNA, 17 nt, Human herpesvirus 2
agccggggcacgcgguc

SEQ ID NO: 3956951 - RNA, 23 nt, Human herpesvirus 2
agcgccccgcggaccccgcccgc

SEQ ID NO: 3956952 - RNA, 14 nt, Human herpesvirus 2
agcgccgaccagaa

SEQ ID NO: 3956953 - RNA, 18 nt, Human herpesvirus 2
agcgccgcuacugcgcca

SEQ ID NO: 3956954 - RNA, 14 nt, Human herpesvirus 2
agcgcgccaggacc

SEQ ID NO: 3956955 - RNA, 15 nt, Human herpesvirus 2
agcgcguccagguac

SEQ ID NO: 3956956 - RNA, 20 nt, Human herpesvirus 2
agcggccgggucggcugucc

SEQ ID NO: 3956957 - RNA, 16 nt, Human herpesvirus 2
agcggcgaacacugcc

SEQ ID NO: 3956958 - RNA, 20 nt, Human herpesvirus 2
agcggcgagugcucgcagca

SEQ ID NO: 3956959 - RNA, 18 nt, Human herpesvirus 2
agcguaucggccaggagg

SEQ ID NO: 3956960 - RNA, 20 nt, Human herpesvirus 2
agcucgcggagggcggccag

SEQ ID NO: 3956961 - RNA, 17 nt, Human herpesvirus 2
agcucgucgcgacccug

SEQ ID NO: 3956962 - RNA, 19 nt, Human herpesvirus 2
agcuggcccuggacccaga

SEQ ID NO: 3956963 - RNA, 16 nt, Human herpesvirus 2
ggcggcgccugcgccc

SEQ ID NO: 3956964 - RNA, 14 nt, Human herpesvirus 2
ggcggcguggccgc

SEQ ID NO: 3956965 - RNA, 14 nt, Human herpesvirus 2
ggcggcucccccgc

SEQ ID NO: 3956966 - RNA, 16 nt, Human herpesvirus 2
ggcgggggugccgugg

SEQ ID NO: 3956967 - RNA, 22 nt, Human herpesvirus 2
ggcgguucgcgugcggccagcc

SEQ ID NO: 3956968 - RNA, 17 nt, Human herpesvirus 2
ggcgucuagcucgcgga

SEQ ID NO: 3956969 - RNA, 13 nt, Human herpesvirus 2
ggcgugcugugcc

SEQ ID NO: 3956970 - RNA, 21 nt, Human herpesvirus 2
ggcucccccgcggaccuuggc

SEQ ID NO: 3956971 - RNA, 12 nt, Human herpesvirus 2
ggcuccugcgca

SEQ ID NO: 3956972 - RNA, 17 nt, Human herpesvirus 2
ggcugcgggcgugucgu

SEQ ID NO: 3956973 - RNA, 13 nt, Human herpesvirus 2
ggcugcggggggc

SEQ ID NO: 3956974 - RNA, 15 nt, Human herpesvirus 2
ggcugcuauccagga

SEQ ID NO: 3956975 - RNA, 12 nt, Human herpesvirus 2
ggcugcuccgcu

SEQ ID NO: 3956976 - RNA, 21 nt, Human herpesvirus 2
ggcuggagcgcuggugggacg

SEQ ID NO: 3956977 - RNA, 21 nt, Human herpesvirus 2
ggcugguuggauguuuuugca

SEQ ID NO: 3956978 - RNA, 12 nt, Human herpesvirus 2
ggcuucgugggu

SEQ ID NO: 3956979 - RNA, 23 nt, Human herpesvirus 2
ggcuucuucgccgcccucgccca

SEQ ID NO: 3956980 - RNA, 22 nt, Human herpesvirus 2
gggaauaugcaagcgggcgggg

SEQ ID NO: 3956981 - RNA, 19 nt, Human herpesvirus 2
gggaccccgacguggcccg

SEQ ID NO: 3956982 - RNA, 23 nt, Human herpesvirus 2
gggacccgccagagacccugccc

SEQ ID NO: 3956983 - RNA, 13 nt, Human herpesvirus 2
gggacggccgggc

SEQ ID NO: 3956984 - RNA, 16 nt, Human herpesvirus 2
gggacugggggcgggg

SEQ ID NO: 3956985 - RNA, 16 nt, Human herpesvirus 2
gggagccgcggccccg

SEQ ID NO: 3956986 - RNA, 23 nt, Human herpesvirus 2
gggagcuucauuuugugggggcc

SEQ ID NO: 3956987 - RNA, 12 nt, Human herpesvirus 2
gggaggaggcgg

SEQ ID NO: 3956988 - RNA, 13 nt, Human herpesvirus 2
gggaggggcggga

SEQ ID NO: 3956989 - RNA, 21 nt, Human herpesvirus 2
gggagguggggggggggaaag

SEQ ID NO: 3956990 - RNA, 18 nt, Human herpesvirus 2
gggagguucccccguggc

SEQ ID NO: 3956991 - RNA, 16 nt, Human herpesvirus 2
gggcacggcguccucc

SEQ ID NO: 3956992 - RNA, 21 nt, Human herpesvirus 2
gggcacucuggcguccccagg

SEQ ID NO: 3956993 - RNA, 22 nt, Human herpesvirus 2
gggcagugcaguaccccaguuc

SEQ ID NO: 3956994 - RNA, 21 nt, Human herpesvirus 2
gggcccacagcugcgccagaa

SEQ ID NO: 3956995 - RNA, 19 nt, Human herpesvirus 2
gggccccgccccgccccac

SEQ ID NO: 3956996 - RNA, 17 nt, Human herpesvirus 2
gggcccggacuccgccc

SEQ ID NO: 3956997 - RNA, 17 nt, Human herpesvirus 2
gggccggcguucccgcu

SEQ ID NO: 3956998 - RNA, 23 nt, Human herpesvirus 2
gggccucggucgacgaggccugg

SEQ ID NO: 3956999 - RNA, 14 nt, Human herpesvirus 2
gggcgagcuggccc

SEQ ID NO: 3957000 - RNA, 15 nt, Human herpesvirus 2
gggcgcccccgccuc

SEQ ID NO: 3957001 - RNA, 16 nt, Human herpesvirus 2
gggcgcgagccaggca

SEQ ID NO: 3957002 - RNA, 15 nt, Human herpesvirus 2
gggcgcugguggccg

SEQ ID NO: 3957003 - RNA, 14 nt, Human herpesvirus 2
gggcggcguggccg

SEQ ID NO: 3957004 - RNA, 19 nt, Human herpesvirus 2
gggcggcguggccgcgacc

SEQ ID NO: 3957005 - RNA, 13 nt, Human herpesvirus 2
gggcgggcgggcg

SEQ ID NO: 3957006 - RNA, 19 nt, Human herpesvirus 2
gggcgggggugccguggac

SEQ ID NO: 3957007 - RNA, 22 nt, Human herpesvirus 2
gggcgguugcgguucguucugg

SEQ ID NO: 3957008 - RNA, 14 nt, Human herpesvirus 2
gggcguccccgagc

SEQ ID NO: 3957009 - RNA, 17 nt, Human herpesvirus 2
gggcgucgcgguggcaa

SEQ ID NO: 3957010 - RNA, 18 nt, Human herpesvirus 2
gggcguuauaagccgccg

SEQ ID NO: 3957011 - RNA, 17 nt, Human herpesvirus 2
gggcugucgggcgaugc

SEQ ID NO: 3957012 - RNA, 21 nt, Human herpesvirus 2
gggcuuggacgcgccucccgg

SEQ ID NO: 3957013 - RNA, 20 nt, Human herpesvirus 2
ggggaaagaaagagaaacaa

SEQ ID NO: 3957014 - RNA, 15 nt, Human herpesvirus 2
ggggaaagugggccg

SEQ ID NO: 3957015 - RNA, 20 nt, Human herpesvirus 2
ggggaaauguauggguccuu

SEQ ID NO: 3957016 - RNA, 20 nt, Human herpesvirus 2
ggggacacgcggcgggucgg

SEQ ID NO: 3957017 - RNA, 19 nt, Human herpesvirus 2
ggggacuugacggucgcca

SEQ ID NO: 3957018 - RNA, 16 nt, Human herpesvirus 2
ggggaggggggaagga

SEQ ID NO: 3957019 - RNA, 23 nt, Human herpesvirus 2
ggggagguggggggggggaaaga

SEQ ID NO: 3957020 - RNA, 20 nt, Human herpesvirus 2
ggggcaccaaaaaccagguc

SEQ ID NO: 3957021 - RNA, 13 nt, Human herpesvirus 2
ggggcacgcgguc

SEQ ID NO: 3957022 - RNA, 17 nt, Human herpesvirus 2
ggggcacgcggucagca

SEQ ID NO: 3957023 - RNA, 15 nt, Human herpesvirus 2
ggggcccgccgccgc

SEQ ID NO: 3957024 - RNA, 18 nt, Human herpesvirus 2
ggggccggggcggccccg

SEQ ID NO: 3957025 - RNA, 23 nt, Human herpesvirus 2
ggggccucggucgacgaggccug

SEQ ID NO: 3957026 - RNA, 17 nt, Human herpesvirus 2
ggggcgcugguggccgc

SEQ ID NO: 3957027 - RNA, 13 nt, Human herpesvirus 2
gggggaggcgcgc

SEQ ID NO: 3957028 - RNA, 16 nt, Human herpesvirus 2
gggggcaagugcagua

SEQ ID NO: 3957029 - RNA, 14 nt, Human herpesvirus 2
gggggccaugacac

SEQ ID NO: 3957030 - RNA, 16 nt, Human herpesvirus 2
gggggcccaggucccc

SEQ ID NO: 3957031 - RNA, 16 nt, Human herpesvirus 2
gggggcccgggguucu

SEQ ID NO: 3957032 - RNA, 15 nt, Human herpesvirus 2
gggggcuaggagccg

SEQ ID NO: 3957033 - RNA, 19 nt, Human herpesvirus 2
gggggcuugauuugcgcgc

SEQ ID NO: 3957034 - RNA, 12 nt, Human herpesvirus 2
gggggggaaaga

SEQ ID NO: 3957035 - RNA, 13 nt, Human herpesvirus 2
gggggggaagaga

SEQ ID NO: 3957036 - RNA, 13 nt, Human herpesvirus 2
gggggggaaggga

SEQ ID NO: 3957037 - RNA, 21 nt, Human herpesvirus 2
ggggucccgccucccggccgc

SEQ ID NO: 3957038 - RNA, 15 nt, Human herpesvirus 2
ggggucgaaggaaag

SEQ ID NO: 3957039 - RNA, 16 nt, Human herpesvirus 2
gggguguagggcccaa

SEQ ID NO: 3957040 - RNA, 14 nt, Human herpesvirus 2
gggguugggucugc

SEQ ID NO: 3957041 - RNA, 12 nt, Human herpesvirus 2
ggguccuggugg

SEQ ID NO: 3957042 - RNA, 12 nt, Human herpesvirus 2
gggucggcaugc

SEQ ID NO: 3957043 - RNA, 16 nt, Human herpesvirus 2
gggugcucggggacag

SEQ ID NO: 3957044 - RNA, 20 nt, Human herpesvirus 2
ggguuccccgagagcccagg

SEQ ID NO: 3957045 - RNA, 16 nt, Human herpesvirus 2
ggguuuuggcggcccg

SEQ ID NO: 3957046 - RNA, 19 nt, Human herpesvirus 2
gguaauuagcaacuuuuaa

SEQ ID NO: 3957047 - RNA, 12 nt, Human herpesvirus 2
gguacugcacug

SEQ ID NO: 3957048 - RNA, 22 nt, Human herpesvirus 2
gguaguguguccccccccccuc

SEQ ID NO: 3957049 - RNA, 16 nt, Human herpesvirus 2
ggucaauagauuuccc

SEQ ID NO: 3957050 - RNA, 13 nt, Human herpesvirus 2
ggucaccggggcg

SEQ ID NO: 3957051 - RNA, 18 nt, Human herpesvirus 2
gguccuggaggggggugc

SEQ ID NO: 3957052 - RNA, 21 nt, Human herpesvirus 2
ggucgcgcuuuuccgccgccg

SEQ ID NO: 3957053 - RNA, 18 nt, Human herpesvirus 2
ggucgcguuuucucuguu

SEQ ID NO: 3957054 - RNA, 12 nt, Human herpesvirus 2
ggucggacagga

SEQ ID NO: 3957055 - RNA, 22 nt, Human herpesvirus 2
ggucggccagcacgaccaggga

SEQ ID NO: 3957056 - RNA, 16 nt, Human herpesvirus 2
ggucugugggugguga

SEQ ID NO: 3957057 - RNA, 20 nt, Human herpesvirus 2
ggugccucacgguccucacc

SEQ ID NO: 3957058 - RNA, 14 nt, Human herpesvirus 2
ggugcgccccgccg

SEQ ID NO: 3957059 - RNA, 24 nt, Human herpesvirus 2
ggugcgccccgccggggcgcacaa

SEQ ID NO: 3957060 - RNA, 22 nt, Human herpesvirus 2
ggugggccuagccgugggccug

SEQ ID NO: 3957061 - RNA, 13 nt, Human herpesvirus 2
ggugggggaagaa

SEQ ID NO: 3957062 - RNA, 21 nt, Human herpesvirus 2
gguggugauggggguccuggu

SEQ ID NO: 3957063 - RNA, 13 nt, Human herpesvirus 2
gguggugcaguuu

SEQ ID NO: 3957064 - RNA, 16 nt, Human herpesvirus 2
gguguggucgggcgga

SEQ ID NO: 3957065 - RNA, 15 nt, Human herpesvirus 2
gguucccauuggccc

SEQ ID NO: 3957066 - RNA, 20 nt, Human herpesvirus 2
gguucggggccagggcuggc

SEQ ID NO: 3957067 - RNA, 15 nt, Human herpesvirus 2
gguugaugggcgggg

SEQ ID NO: 3957068 - RNA, 22 nt, Human herpesvirus 2
gguugucuucuuuuccaccccu

SEQ ID NO: 3957069 - RNA, 16 nt, Human herpesvirus 2
guaacccaguuccuca

SEQ ID NO: 3957070 - RNA, 18 nt, Human herpesvirus 2
guacccggcagagagauu

SEQ ID NO: 3957071 - RNA, 14 nt, Human herpesvirus 2
guacucaucgggac

SEQ ID NO: 3957072 - RNA, 15 nt, Human herpesvirus 2
guauaguacggggga

SEQ ID NO: 3957073 - RNA, 18 nt, Human herpesvirus 2
guaucgugccuggcggca

SEQ ID NO: 3957074 - RNA, 16 nt, Human herpesvirus 2
gucaccggggcgcccc

SEQ ID NO: 3957075 - RNA, 15 nt, Human herpesvirus 2
gucaccgggggcccc

SEQ ID NO: 3957076 - RNA, 18 nt, Human herpesvirus 2
gucaccgggggccccggg

SEQ ID NO: 3957077 - RNA, 20 nt, Human herpesvirus 2
gucagcgaucgccagccgcg

SEQ ID NO: 3957078 - RNA, 22 nt, Human herpesvirus 2
gucaggcgcgcgguaugcgugg

SEQ ID NO: 3957079 - RNA, 17 nt, Human herpesvirus 2
guccagguacccggcgg

SEQ ID NO: 3957080 - RNA, 23 nt, Human herpesvirus 2
gccccccccccucaccccuccga

SEQ ID NO: 3957081 - RNA, 17 nt, Human herpesvirus 2
gccccccgacgugcgcg

SEQ ID NO: 3957082 - RNA, 14 nt, Human herpesvirus 2
gccccccgggagcc

SEQ ID NO: 3957083 - RNA, 18 nt, Human herpesvirus 2
gcccccgacccggggccc

SEQ ID NO: 3957084 - RNA, 20 nt, Human herpesvirus 2
gcccccgacccggggcccga

SEQ ID NO: 3957085 - RNA, 21 nt, Human herpesvirus 2
gcccccggccuuugcuuccuc

SEQ ID NO: 3957086 - RNA, 22 nt, Human herpesvirus 2
gccccgaacagcaacacacacc

SEQ ID NO: 3957087 - RNA, 18 nt, Human herpesvirus 2
gccccgacaucaaccacc

SEQ ID NO: 3957088 - RNA, 16 nt, Human herpesvirus 2
gccccgcggaccccgc

SEQ ID NO: 3957089 - RNA, 22 nt, Human herpesvirus 2
gccccgcggucgcgcgggccgu

SEQ ID NO: 3957090 - RNA, 14 nt, Human herpesvirus 2
gccccggcggcccc

SEQ ID NO: 3957091 - RNA, 16 nt, Human herpesvirus 2
gccccggucugugggu

SEQ ID NO: 3957092 - RNA, 13 nt, Human herpesvirus 2
gccccucugcuuu

SEQ ID NO: 3957093 - RNA, 15 nt, Human herpesvirus 2
gcccgaaccccgcgg

SEQ ID NO: 3957094 - RNA, 23 nt, Human herpesvirus 2
gcccgaaccccgcggcccugagc

SEQ ID NO: 3957095 - RNA, 17 nt, Human herpesvirus 2
gcccgaccgggcggugc

SEQ ID NO: 3957096 - RNA, 15 nt, Human herpesvirus 2
gcccgccaacccccg

SEQ ID NO: 3957097 - RNA, 13 nt, Human herpesvirus 2
gcccgccagggcc

SEQ ID NO: 3957098 - RNA, 22 nt, Human herpesvirus 2
gcccgccagugcaucccagacg

SEQ ID NO: 3957099 - RNA, 13 nt, Human herpesvirus 2
gcccgccccaggg

SEQ ID NO: 3957100 - RNA, 19 nt, Human herpesvirus 2
gcccgccccagggggcggc

SEQ ID NO: 3957101 - RNA, 15 nt, Human herpesvirus 2
gcccgcccccgacgg

SEQ ID NO: 3957102 - RNA, 15 nt, Human herpesvirus 2
gcccgcgagccgcac

SEQ ID NO: 3957103 - RNA, 14 nt, Human herpesvirus 2
gcccgcguccccgg

SEQ ID NO: 3957104 - RNA, 19 nt, Human herpesvirus 2
gcccgcguccccggcccuc

SEQ ID NO: 3957105 - RNA, 21 nt, Human herpesvirus 2
gcccgcgugccgcagaccacc

SEQ ID NO: 3957106 - RNA, 18 nt, Human herpesvirus 2
gcccggacuccgccccgg

SEQ ID NO: 3957107 - RNA, 15 nt, Human herpesvirus 2
gcccguggguggcca

SEQ ID NO: 3957108 - RNA, 14 nt, Human herpesvirus 2
gcccuacggcggcc

SEQ ID NO: 3957109 - RNA, 20 nt, Human herpesvirus 2
gcccucacgucuucgcccac

SEQ ID NO: 3957110 - RNA, 21 nt, Human herpesvirus 2
gcccuggacccagacacggug

SEQ ID NO: 3957111 - RNA, 16 nt, Human herpesvirus 2
gccgacgugccgggga

SEQ ID NO: 3957112 - RNA, 15 nt, Human herpesvirus 2
gccgacuccaggagc

SEQ ID NO: 3957113 - RNA, 20 nt, Human herpesvirus 2
gccgagcguaucggccagga

SEQ ID NO: 3957114 - RNA, 16 nt, Human herpesvirus 2
gccgaucgcagcgucc

SEQ ID NO: 3957115 - RNA, 19 nt, Human herpesvirus 2
gccgcagaccaccucgcgg

SEQ ID NO: 3957116 - RNA, 17 nt, Human herpesvirus 2
gccgcccgcgccgcgac

SEQ ID NO: 3957117 - RNA, 12 nt, Human herpesvirus 2
gccgccggccac

SEQ ID NO: 3957118 - RNA, 15 nt, Human herpesvirus 2
gccgccuccccgcug

SEQ ID NO: 3957119 - RNA, 13 nt, Human herpesvirus 2
gccgcgcccccgg

SEQ ID NO: 3957120 - RNA, 12 nt, Human herpesvirus 2
gccgcgcccgcg

SEQ ID NO: 3957121 - RNA, 18 nt, Human herpesvirus 2
gccgcgcgagcggccgug

SEQ ID NO: 3957122 - RNA, 16 nt, Human herpesvirus 2
gccgcgggggaggcgc

SEQ ID NO: 3957123 - RNA, 21 nt, Human herpesvirus 2
gccgcgguggcgucggcggcc

SEQ ID NO: 3957124 - RNA, 18 nt, Human herpesvirus 2
gccgcugcccgacgcgcc

SEQ ID NO: 3957125 - RNA, 17 nt, Human herpesvirus 2
gccgcugggggggcggg

SEQ ID NO: 3957126 - RNA, 13 nt, Human herpesvirus 2
gccgcugugccag

SEQ ID NO: 3957127 - RNA, 18 nt, Human herpesvirus 2
gccgcuguggcccuggcg

SEQ ID NO: 3957128 - RNA, 19 nt, Human herpesvirus 2
gccgcuuuaccccgcggcc

SEQ ID NO: 3957129 - RNA, 12 nt, Human herpesvirus 2
gccgggagaguu

SEQ ID NO: 3957130 - RNA, 16 nt, Human herpesvirus 2
gccgggagcguggggc

SEQ ID NO: 3957131 - RNA, 15 nt, Human herpesvirus 2
gccgucgggccccgg

SEQ ID NO: 3957132 - RNA, 22 nt, Human herpesvirus 2
gccgugggccuguggggccugc

SEQ ID NO: 3957133 - RNA, 18 nt, Human herpesvirus 2
gccuagccgugggccugu

SEQ ID NO: 3957134 - RNA, 20 nt, Human herpesvirus 2
gccucccgcaagagccugcc

SEQ ID NO: 3957135 - RNA, 15 nt, Human herpesvirus 2
gccucgggcggcgug

SEQ ID NO: 3957136 - RNA, 24 nt, Human herpesvirus 2
gccucgggcggcguggccgcgacc

SEQ ID NO: 3957137 - RNA, 12 nt, Human herpesvirus 2
gccucguggggc

SEQ ID NO: 3957138 - RNA, 21 nt, Human herpesvirus 2
gccucuguuucuccaggcgcu

SEQ ID NO: 3957139 - RNA, 15 nt, Human herpesvirus 2
gccucuuugggccgu

SEQ ID NO: 3957140 - RNA, 22 nt, Human herpesvirus 2
gccugccccgcggaggcguggu

SEQ ID NO: 3957141 - RNA, 16 nt, Human herpesvirus 2
gccugguggucgucgg

SEQ ID NO: 3957142 - RNA, 17 nt, Human herpesvirus 2
gcgacccgccgggggcg

SEQ ID NO: 3957143 - RNA, 22 nt, Human herpesvirus 2
gcgaccgggcggcgcgcccccc

SEQ ID NO: 3957144 - RNA, 20 nt, Human herpesvirus 2
gcgacugccuccacgcccug

SEQ ID NO: 3957145 - RNA, 20 nt, Human herpesvirus 2
gcgagaaguaauaguccgug

SEQ ID NO: 3957146 - RNA, 20 nt, Human herpesvirus 2
gcgagcucccugcggcuggc

SEQ ID NO: 3957147 - RNA, 19 nt, Human herpesvirus 2
gcgaggggcgggaggggcg

SEQ ID NO: 3957148 - RNA, 14 nt, Human herpesvirus 2
gcgauccugggccu

SEQ ID NO: 3957149 - RNA, 18 nt, Human herpesvirus 2
gcgcaggggggccgggga

SEQ ID NO: 3957150 - RNA, 16 nt, Human herpesvirus 2
gcgccaccgcccgcac

SEQ ID NO: 3957151 - RNA, 19 nt, Human herpesvirus 2
gcgcccccgacccggggcc

SEQ ID NO: 3957152 - RNA, 18 nt, Human herpesvirus 2
gcgccgccgcgcgggccc

SEQ ID NO: 3957153 - RNA, 17 nt, Human herpesvirus 2
gcgccggcaccaggcua

SEQ ID NO: 3957154 - RNA, 17 nt, Human herpesvirus 2
gcgccgggccucccgca

SEQ ID NO: 3957155 - RNA, 12 nt, Human herpesvirus 2
gcgccgggcgcg

SEQ ID NO: 3957156 - RNA, 14 nt, Human herpesvirus 2
gcgccgucgggccc

SEQ ID NO: 3957157 - RNA, 16 nt, Human herpesvirus 2
gcgccgucgucgcccg

SEQ ID NO: 3957158 - RNA, 23 nt, Human herpesvirus 2
gcgcgacugccuccacgcccugc

SEQ ID NO: 3957159 - RNA, 13 nt, Human herpesvirus 2
gcgcgcauccaca

SEQ ID NO: 3957160 - RNA, 18 nt, Human herpesvirus 2
gcgcgccaccgcccgcac

SEQ ID NO: 3957161 - RNA, 19 nt, Human herpesvirus 2
gcgcgccgacgaccugcag

SEQ ID NO: 3957162 - RNA, 19 nt, Human herpesvirus 2
gcgcguugguccgggggcg

SEQ ID NO: 3957163 - RNA, 16 nt, Human herpesvirus 2
gcgcuccgaucggggu

SEQ ID NO: 3957164 - RNA, 14 nt, Human herpesvirus 2
gcgcucgcucuccg

SEQ ID NO: 3957165 - RNA, 13 nt, Human herpesvirus 2
gcgcugcggggac

SEQ ID NO: 3957166 - RNA, 19 nt, Human herpesvirus 2
gcgcuuauaagagcgggcc

SEQ ID NO: 3957167 - RNA, 18 nt, Human herpesvirus 2
gcgcuucaucgucgccga

SEQ ID NO: 3957168 - RNA, 22 nt, Human herpesvirus 2
gcgcuucaucgucgccgacucc

SEQ ID NO: 3957169 - RNA, 18 nt, Human herpesvirus 2
gcggacgcacgcggggac

SEQ ID NO: 3957170 - RNA, 21 nt, Human herpesvirus 2
gcggagagagggggggaaaga

SEQ ID NO: 3957171 - RNA, 14 nt, Human herpesvirus 2
gcggcaccggggaa

SEQ ID NO: 3957172 - RNA, 14 nt, Human herpesvirus 2
gcggcccuggagcg

SEQ ID NO: 3957173 - RNA, 23 nt, Human herpesvirus 2
gcggcgaaccgguagccggggca

SEQ ID NO: 3957174 - RNA, 16 nt, Human herpesvirus 2
gcggcggcaugcgcgg

SEQ ID NO: 3957175 - RNA, 16 nt, Human herpesvirus 2
gcgggagccagggucg

SEQ ID NO: 3957176 - RNA, 13 nt, Human herpesvirus 2
gcgggaggggcgg

SEQ ID NO: 3957177 - RNA, 20 nt, Human herpesvirus 2
gcgggcacucuggcgucccc

SEQ ID NO: 3957178 - RNA, 11 nt, Human herpesvirus 2
gcgggccccgu

SEQ ID NO: 3957179 - RNA, 22 nt, Human herpesvirus 2
gcgggccguucggcaggcccgc

SEQ ID NO: 3957180 - RNA, 23 nt, Human herpesvirus 2
gcgggcucguguuggccaccaac

SEQ ID NO: 3957181 - RNA, 20 nt, Human herpesvirus 2
gcggggacccgccagagacc

SEQ ID NO: 3957182 - RNA, 14 nt, Human herpesvirus 2
gcggggcaccggca

SEQ ID NO: 3957183 - RNA, 18 nt, Human herpesvirus 2
gcggucgcgcgggccgug

SEQ ID NO: 3957184 - RNA, 19 nt, Human herpesvirus 2
gcgucgcucucggucccgc

SEQ ID NO: 3957185 - RNA, 15 nt, Human herpesvirus 2
gcgucgggcacaggc

SEQ ID NO: 3957186 - RNA, 16 nt, Human herpesvirus 2
gcgucgggggccgggg

SEQ ID NO: 3957187 - RNA, 16 nt, Human herpesvirus 2
gcgugccuggccgcgc

SEQ ID NO: 3957188 - RNA, 22 nt, Human herpesvirus 2
gcgugcguucuggcggcccugg

SEQ ID NO: 3957189 - RNA, 23 nt, Human herpesvirus 2
gcgugcugcugagcccugccccg

SEQ ID NO: 3957190 - RNA, 21 nt, Human herpesvirus 2
gcguucuggcggcccuggagc

SEQ ID NO: 3957191 - RNA, 16 nt, Human herpesvirus 2
gcguugccgggggcca

SEQ ID NO: 3957192 - RNA, 17 nt, Human herpesvirus 2
gcguugccgggggccau

SEQ ID NO: 3957193 - RNA, 21 nt, Human herpesvirus 2
gcuaacgagcgcgcugccgga

SEQ ID NO: 3957194 - RNA, 14 nt, Human herpesvirus 2
gcuaccucacccca

SEQ ID NO: 3957195 - RNA, 20 nt, Human herpesvirus 2
gcuagucuccgaucugcccc

SEQ ID NO: 3957196 - RNA, 18 nt, Human herpesvirus 2
gcuccccuucagccugga

SEQ ID NO: 3957197 - RNA, 14 nt, Human herpesvirus 2
gcuccuagcccccc

SEQ ID NO: 3957198 - RNA, 15 nt, Human herpesvirus 2
gcucgaccagcggcc

SEQ ID NO: 3957199 - RNA, 18 nt, Human herpesvirus 2
gcucgcggagggcggcca

SEQ ID NO: 3957200 - RNA, 13 nt, Human herpesvirus 2
gcucgggcuggcc

SEQ ID NO: 3957201 - RNA, 22 nt, Human herpesvirus 2
gcucguaaaaauggcggccgcc

SEQ ID NO: 3957202 - RNA, 23 nt, Human herpesvirus 2
gcucucaacacccacgacccacc

SEQ ID NO: 3957203 - RNA, 22 nt, Human herpesvirus 2
gcucuccgagggcgagcucggc

SEQ ID NO: 3957204 - RNA, 14 nt, Human herpesvirus 2
gcucugccugcacg

SEQ ID NO: 3957205 - RNA, 20 nt, Human herpesvirus 2
gcugagggcggcgacguucg

SEQ ID NO: 3957206 - RNA, 20 nt, Human herpesvirus 2
gcugcacgucggacgccagc

SEQ ID NO: 3957207 - RNA, 13 nt, Human herpesvirus 2
gcugccccgcggu

SEQ ID NO: 3957208 - RNA, 22 nt, Human herpesvirus 2
gcugccccgcgugcagcgcggg

SEQ ID NO: 3957209 - RNA, 17 nt, Human herpesvirus 2
gcugcccgcggaccacc

SEQ ID NO: 3957210 - RNA, 14 nt, Human herpesvirus 2
gcugccgccgcggg

SEQ ID NO: 3957211 - RNA, 22 nt, Human herpesvirus 2
gcugcucucccguaccccgccg

SEQ ID NO: 3957212 - RNA, 14 nt, Human herpesvirus 2
gcugcugagcccug

SEQ ID NO: 3957213 - RNA, 15 nt, Human herpesvirus 2
gcugcugagcccugc

SEQ ID NO: 3957214 - RNA, 16 nt, Human herpesvirus 2
gcugcugcgcauggcc

SEQ ID NO: 3957215 - RNA, 12 nt, Human herpesvirus 2
gcuggcccugga

SEQ ID NO: 3957216 - RNA, 15 nt, Human herpesvirus 2
gcuggcccuggaccc

SEQ ID NO: 3957217 - RNA, 15 nt, Human herpesvirus 2
gcuguaucuggucug

SEQ ID NO: 3957218 - RNA, 17 nt, Human herpesvirus 2
gcuguauucccuugccc

SEQ ID NO: 3957219 - RNA, 21 nt, Human herpesvirus 2
gcuuagggugugaccccccca

SEQ ID NO: 3957220 - RNA, 23 nt, Human herpesvirus 2
gcuuccaccccccccccccuucc

SEQ ID NO: 3957221 - RNA, 16 nt, Human herpesvirus 2
gcuucccccgcccacc

SEQ ID NO: 3957222 - RNA, 14 nt, Human herpesvirus 2
gcuugaagggcacu

SEQ ID NO: 3957223 - RNA, 21 nt, Human herpesvirus 2
gcuugccccucccccggccca

SEQ ID NO: 3957224 - RNA, 19 nt, Human herpesvirus 2
gcuuggaggcccucuggga

SEQ ID NO: 3957225 - RNA, 20 nt, Human herpesvirus 2
gcuuggccguguggucgccc

SEQ ID NO: 3957226 - RNA, 22 nt, Human herpesvirus 2
gcuugugcccucguaggcccgg

SEQ ID NO: 3957227 - RNA, 15 nt, Human herpesvirus 2
gcuuuccacaccccc

SEQ ID NO: 3957228 - RNA, 18 nt, Human herpesvirus 2
gcuuucccuccacccgcc

SEQ ID NO: 3957229 - RNA, 16 nt, Human herpesvirus 2
gcuuuuacccucaccc

SEQ ID NO: 3957230 - RNA, 21 nt, Human herpesvirus 2
ggaaagggaacagcgaccaaa

SEQ ID NO: 3957231 - RNA, 21 nt, Human herpesvirus 2
ggaacacaggcgcuucaucgu

SEQ ID NO: 3957232 - RNA, 16 nt, Human herpesvirus 2
ggaagaagagaggcga

SEQ ID NO: 3957233 - RNA, 22 nt, Human herpesvirus 2
ggaagcugccucccccccggag

SEQ ID NO: 3957234 - RNA, 22 nt, Human herpesvirus 2
ggacacggcccccgaauccggg

SEQ ID NO: 3957235 - RNA, 13 nt, Human herpesvirus 2
ggacagccagggc

SEQ ID NO: 3957236 - RNA, 17 nt, Human herpesvirus 2
ggacagccagggcuggg

SEQ ID NO: 3957237 - RNA, 12 nt, Human herpesvirus 2
ggaccggccccc

SEQ ID NO: 3957238 - RNA, 14 nt, Human herpesvirus 2
ggacgacgggcgcc

SEQ ID NO: 3957239 - RNA, 17 nt, Human herpesvirus 2
ggacgagccaaaccagc

SEQ ID NO: 3957240 - RNA, 23 nt, Human herpesvirus 2
ggacgcacgcggggacccgccag

SEQ ID NO: 3957241 - RNA, 21 nt, Human herpesvirus 2
ggacgcagcggcguccacgcc

SEQ ID NO: 3957242 - RNA, 22 nt, Human herpesvirus 2
ggacgcagcggcguccacgccc

SEQ ID NO: 3957243 - RNA, 16 nt, Human herpesvirus 2
ggacgcguucgagggu

SEQ ID NO: 3957244 - RNA, 14 nt, Human herpesvirus 2
ggacggccgggcag

SEQ ID NO: 3957245 - RNA, 20 nt, Human herpesvirus 2
ggacggguauaaaggccagg

SEQ ID NO: 3957246 - RNA, 18 nt, Human herpesvirus 2
ggagaguucaauagauuu

SEQ ID NO: 3957247 - RNA, 14 nt, Human herpesvirus 2
ggagcguggggcgc

SEQ ID NO: 3957248 - RNA, 18 nt, Human herpesvirus 2
ggaggaggcggcgccugc

SEQ ID NO: 3957249 - RNA, 20 nt, Human herpesvirus 2
ggaggagggcgaugacccac

SEQ ID NO: 3957250 - RNA, 15 nt, Human herpesvirus 2
ggaggcgccucugcc

SEQ ID NO: 3957251 - RNA, 19 nt, Human herpesvirus 2
ggagggcagggccgcuggg

SEQ ID NO: 3957252 - RNA, 12 nt, Human herpesvirus 2
ggaggggcuccu

SEQ ID NO: 3957253 - RNA, 16 nt, Human herpesvirus 2
ggaggggggugcugug

SEQ ID NO: 3957254 - RNA, 16 nt, Human herpesvirus 2
ggauacgggggcgggg

SEQ ID NO: 3957255 - RNA, 17 nt, Human herpesvirus 2
ggauccaggggagggcg

SEQ ID NO: 3957256 - RNA, 21 nt, Human herpesvirus 2
ggaucgugugcacgaaaaaga

SEQ ID NO: 3957257 - RNA, 17 nt, Human herpesvirus 2
ggcacaccggcggggcg

SEQ ID NO: 3957258 - RNA, 20 nt, Human herpesvirus 2
ggcacaccggcggggcgggc

SEQ ID NO: 3957259 - RNA, 15 nt, Human herpesvirus 2
ggcacagguggugca

SEQ ID NO: 3957260 - RNA, 17 nt, Human herpesvirus 2
ggcacagguggugcacg

SEQ ID NO: 3957261 - RNA, 16 nt, Human herpesvirus 2
ggcacgagaagccgcc

SEQ ID NO: 3957262 - RNA, 15 nt, Human herpesvirus 2
ggcaggagggcgggc

SEQ ID NO: 3957263 - RNA, 11 nt, Human herpesvirus 2
ggcaggccgcg

SEQ ID NO: 3957264 - RNA, 16 nt, Human herpesvirus 2
ggcaggcgcgcggguc

SEQ ID NO: 3957265 - RNA, 14 nt, Human herpesvirus 2
ggcaggggcagcuc

SEQ ID NO: 3957266 - RNA, 18 nt, Human herpesvirus 2
ggcauaccuccgaccggc

SEQ ID NO: 3957267 - RNA, 16 nt, Human herpesvirus 2
ggcaugcgacggcguc

SEQ ID NO: 3957268 - RNA, 13 nt, Human herpesvirus 2
ggcauggaagccc

SEQ ID NO: 3957269 - RNA, 18 nt, Human herpesvirus 2
ggccaaccgcgcgccgcc

SEQ ID NO: 3957270 - RNA, 24 nt, Human herpesvirus 2
ggccagagcguucggcggagcugg

SEQ ID NO: 3957271 - RNA, 14 nt, Human herpesvirus 2
ggccagcgggggcc

SEQ ID NO: 3957272 - RNA, 13 nt, Human herpesvirus 2
ggcccacgagcuc

SEQ ID NO: 3957273 - RNA, 23 nt, Human herpesvirus 2
ggccccgccccgccccaccccgc

SEQ ID NO: 3957274 - RNA, 12 nt, Human herpesvirus 2
ggccccgccggg

SEQ ID NO: 3957275 - RNA, 16 nt, Human herpesvirus 2
ggccccggcggccccg

SEQ ID NO: 3957276 - RNA, 15 nt, Human herpesvirus 2
ggccccucgcucccc

SEQ ID NO: 3957277 - RNA, 13 nt, Human herpesvirus 2
ggcccgcagcuuc

SEQ ID NO: 3957278 - RNA, 15 nt, Human herpesvirus 2
ggcccggacuccgcc

SEQ ID NO: 3957279 - RNA, 18 nt, Human herpesvirus 2
ggcccucgcugcucuccc

SEQ ID NO: 3957280 - RNA, 15 nt, Human herpesvirus 2
ggcccugccuccgga

SEQ ID NO: 3957281 - RNA, 17 nt, Human herpesvirus 2
ggccgacgugccgggga

SEQ ID NO: 3957282 - RNA, 20 nt, Human herpesvirus 2
ggccgagcguaucggccagg

SEQ ID NO: 3957283 - RNA, 9 nt, Human herpesvirus 2
ggccgccgg

SEQ ID NO: 3957284 - RNA, 20 nt, Human herpesvirus 2
ggccgccuccccgcuggagc

SEQ ID NO: 3957285 - RNA, 22 nt, Human herpesvirus 2
ggccgccuccccgcuggagccc

SEQ ID NO: 3957286 - RNA, 15 nt, Human herpesvirus 2
ggccgcgguggcguc

SEQ ID NO: 3957287 - RNA, 20 nt, Human herpesvirus 2
ggccgcucgcugcagggccu

SEQ ID NO: 3957288 - RNA, 22 nt, Human herpesvirus 2
ggccgcucgcugcagggccugg

SEQ ID NO: 3957289 - RNA, 12 nt, Human herpesvirus 2
ggccgcuggggg

SEQ ID NO: 3957290 - RNA, 19 nt, Human herpesvirus 2
ggccggcguucccgcucgc

SEQ ID NO: 3957291 - RNA, 14 nt, Human herpesvirus 2
ggccgggacggcgc

SEQ ID NO: 3957292 - RNA, 21 nt, Human herpesvirus 2
ggccggggagggcagggccgc

SEQ ID NO: 3957293 - RNA, 13 nt, Human herpesvirus 2
ggccgugggcguc

SEQ ID NO: 3957294 - RNA, 19 nt, Human herpesvirus 2
ggccucccgcaagagccug

SEQ ID NO: 3957295 - RNA, 17 nt, Human herpesvirus 2
ggcgacgccgcggccga

SEQ ID NO: 3957296 - RNA, 20 nt, Human herpesvirus 2
ggcgacggcaccgccgggcg

SEQ ID NO: 3957297 - RNA, 15 nt, Human herpesvirus 2
ggcgagugcucgcag

SEQ ID NO: 3957298 - RNA, 21 nt, Human herpesvirus 2
ggcgaugcgacgccgccccug

SEQ ID NO: 3957299 - RNA, 20 nt, Human herpesvirus 2
ggcgauguccggggcgguga

SEQ ID NO: 3957300 - RNA, 23 nt, Human herpesvirus 2
ggcgcacacgccaucgacccgga

SEQ ID NO: 3957301 - RNA, 16 nt, Human herpesvirus 2
ggcgccaagcgccccg

SEQ ID NO: 3957302 - RNA, 18 nt, Human herpesvirus 2
ggcgcccgccccugcgca

SEQ ID NO: 3957303 - RNA, 13 nt, Human herpesvirus 2
ggcgccgccccgc

SEQ ID NO: 3957304 - RNA, 12 nt, Human herpesvirus 2
ggcgccgccggu

SEQ ID NO: 3957305 - RNA, 13 nt, Human herpesvirus 2
ggcgcgcccaccg

SEQ ID NO: 3957306 - RNA, 14 nt, Human herpesvirus 2
ggcgcggugccuga

SEQ ID NO: 3957307 - RNA, 14 nt, Human herpesvirus 2
ggcgcugguggccg

SEQ ID NO: 3957308 - RNA, 18 nt, Human herpesvirus 2
ggcgcuucaucgucgccg

SEQ ID NO: 3957309 - RNA, 14 nt, Human herpesvirus 2
ggcggccaccccgc

SEQ ID NO: 3957310 - RNA, 15 nt, Human herpesvirus 2
ggcggccaccccgcc

SEQ ID NO: 3957311 - RNA, 16 nt, Human herpesvirus 2
ggcggcccuggagcgc

SEQ ID NO: 3957312 - RNA, 22 nt, Human herpesvirus 2
ggcggccucggccggcggagcc

SEQ ID NO: 3957313 - RNA, 21 nt, Human herpesvirus 2
ggcggcgaaccgguagccggg

SEQ ID NO: 3957314 - RNA, 16 nt, Human herpesvirus 2
uaguccgcgccuccug

SEQ ID NO: 3957315 - RNA, 20 nt, Human herpesvirus 2
uaguguguccccccccccuc

SEQ ID NO: 3957316 - RNA, 14 nt, Human herpesvirus 2
uaugcuaauuaaau

SEQ ID NO: 3957317 - RNA, 14 nt, Human herpesvirus 2
uauuagcaucgggg

SEQ ID NO: 3957318 - RNA, 17 nt, Human herpesvirus 2
uauugaaacagacauac

SEQ ID NO: 3957319 - RNA, 13 nt, Human herpesvirus 2
ucaaacaggccau

SEQ ID NO: 3957320 - RNA, 16 nt, Human herpesvirus 2
ucaccccaccccaucc

SEQ ID NO: 3957321 - RNA, 18 nt, Human herpesvirus 2
ucacccccgaguuccccc

SEQ ID NO: 3957322 - RNA, 22 nt, Human herpesvirus 2
ucaccgguguucggaaccaguu

SEQ ID NO: 3957323 - RNA, 18 nt, Human herpesvirus 2
ucacgagguuuggggcgg

SEQ ID NO: 3957324 - RNA, 14 nt, Human herpesvirus 2
ucaguccgcgcggg

SEQ ID NO: 3957325 - RNA, 18 nt, Human herpesvirus 2
ucaucaaacacgggcucg

SEQ ID NO: 3957326 - RNA, 17 nt, Human herpesvirus 2
uccaccaccagcaccac

SEQ ID NO: 3957327 - RNA, 16 nt, Human herpesvirus 2
uccacgcccugcugua

SEQ ID NO: 3957328 - RNA, 15 nt, Human herpesvirus 2
uccacgccguggacg

SEQ ID NO: 3957329 - RNA, 23 nt, Human herpesvirus 2
uccagaacccccguaaacaccag

SEQ ID NO: 3957330 - RNA, 15 nt, Human herpesvirus 2
ucccaauucgucacc

SEQ ID NO: 3957331 - RNA, 21 nt, Human herpesvirus 2
uccccaggcgacgccaggccc

SEQ ID NO: 3957332 - RNA, 14 nt, Human herpesvirus 2
uccccccggggggc

SEQ ID NO: 3957333 - RNA, 20 nt, Human herpesvirus 2
ucccccgggcagccgggccc

SEQ ID NO: 3957334 - RNA, 16 nt, Human herpesvirus 2
uccccgaaagccacca

SEQ ID NO: 3957335 - RNA, 14 nt, Human herpesvirus 2
uccccgcuggagcc

SEQ ID NO: 3957336 - RNA, 15 nt, Human herpesvirus 2
uccccuucagccugg

SEQ ID NO: 3957337 - RNA, 17 nt, Human herpesvirus 2
uccccuucagccuggac

SEQ ID NO: 3957338 - RNA, 12 nt, Human herpesvirus 2
ucccgcaagagc

SEQ ID NO: 3957339 - RNA, 21 nt, Human herpesvirus 2
ucccuaacacggaggagccgg

SEQ ID NO: 3957340 - RNA, 20 nt, Human herpesvirus 2
uccgacgacgcguacguggc

SEQ ID NO: 3957341 - RNA, 20 nt, Human herpesvirus 2
uccgacguugcuuuuaccca

SEQ ID NO: 3957342 - RNA, 17 nt, Human herpesvirus 2
uccgcacccccgccuac

SEQ ID NO: 3957343 - RNA, 12 nt, Human herpesvirus 2
uccgcccgcccc

SEQ ID NO: 3957344 - RNA, 21 nt, Human herpesvirus 2
uccgcggcuuuaucaccccgc

SEQ ID NO: 3957345 - RNA, 14 nt, Human herpesvirus 2
uccgcucccgccuc

SEQ ID NO: 3957346 - RNA, 18 nt, Human herpesvirus 2
uccgggagcgggggaggg

SEQ ID NO: 3957347 - RNA, 11 nt, Human herpesvirus 2
uccggggcggu

SEQ ID NO: 3957348 - RNA, 16 nt, Human herpesvirus 2
uccgggggccuggugg

SEQ ID NO: 3957349 - RNA, 14 nt, Human herpesvirus 2
uccggucccuuccc

SEQ ID NO: 3957350 - RNA, 22 nt, Human herpesvirus 2
uccgucguuuggggcuccccga

SEQ ID NO: 3957351 - RNA, 15 nt, Human herpesvirus 2
uccucaaacaggcca

SEQ ID NO: 3957352 - RNA, 15 nt, Human herpesvirus 2
uccucacgggggggc

SEQ ID NO: 3957353 - RNA, 19 nt, Human herpesvirus 2
uccuccguguuagggaagu

SEQ ID NO: 3957354 - RNA, 19 nt, Human herpesvirus 2
uccucguuuuguuuucucu

SEQ ID NO: 3957355 - RNA, 12 nt, Human herpesvirus 2
ucgaaggucggg

SEQ ID NO: 3957356 - RNA, 16 nt, Human herpesvirus 2
ucgaaucugggaagac

SEQ ID NO: 3957357 - RNA, 21 nt, Human herpesvirus 2
ucgacacacacaccccccuuc

SEQ ID NO: 3957358 - RNA, 21 nt, Human herpesvirus 2
ucgagguggcggaggggauca

SEQ ID NO: 3957359 - RNA, 21 nt, Human herpesvirus 2
ucgaugagccgguagugcagg

SEQ ID NO: 3957360 - RNA, 15 nt, Human herpesvirus 2
ucgcaaccacagcaa

SEQ ID NO: 3957361 - RNA, 16 nt, Human herpesvirus 2
ucgcaagccacccugg

SEQ ID NO: 3957362 - RNA, 14 nt, Human herpesvirus 2
ucgccaacucuguc

SEQ ID NO: 3957363 - RNA, 19 nt, Human herpesvirus 2
ucgccgccccgacucugug

SEQ ID NO: 3957364 - RNA, 18 nt, Human herpesvirus 2
ucgccucucuucuucccc

SEQ ID NO: 3957365 - RNA, 18 nt, Human herpesvirus 2
ucgcgcuuuuccgccgcc

SEQ ID NO: 3957366 - RNA, 13 nt, Human herpesvirus 2
caccccgcccgcu

SEQ ID NO: 3957367 - RNA, 13 nt, Human herpesvirus 2
caccccgccgcag

SEQ ID NO: 3957368 - RNA, 16 nt, Human herpesvirus 2
cacccgggcgccgggg

SEQ ID NO: 3957369 - RNA, 19 nt, Human herpesvirus 2
cacccuagccuucggccac

SEQ ID NO: 3957370 - RNA, 15 nt, Human herpesvirus 2
cacccugggucggga

SEQ ID NO: 3957371 - RNA, 12 nt, Human herpesvirus 2
caccgcccccau

SEQ ID NO: 3957372 - RNA, 14 nt, Human herpesvirus 2
caccgcgcccacag

SEQ ID NO: 3957373 - RNA, 19 nt, Human herpesvirus 2
caccggcguuucggugcug

SEQ ID NO: 3957374 - RNA, 23 nt, Human herpesvirus 2
caccgggcugggggucccgcgcu

SEQ ID NO: 3957375 - RNA, 15 nt, Human herpesvirus 2
caccggggaaacagg

SEQ ID NO: 3957376 - RNA, 18 nt, Human herpesvirus 2
caccggggaaacaggcac

SEQ ID NO: 3957377 - RNA, 19 nt, Human herpesvirus 2
cacgaccagggaggccaga

SEQ ID NO: 3957378 - RNA, 19 nt, Human herpesvirus 2
cacgacccaccgcccccgc

SEQ ID NO: 3957379 - RNA, 13 nt, Human herpesvirus 2
cacgacccgccuc

SEQ ID NO: 3957380 - RNA, 21 nt, Human herpesvirus 2
cacgcaggccgcccccagcag

SEQ ID NO: 3957381 - RNA, 13 nt, Human herpesvirus 2
cacgcccccacuc

SEQ ID NO: 3957382 - RNA, 21 nt, Human herpesvirus 2
cacgccguggacgcccccucc

SEQ ID NO: 3957383 - RNA, 16 nt, Human herpesvirus 2
cacgcgcuggccccuc

SEQ ID NO: 3957384 - RNA, 12 nt, Human herpesvirus 2
cacggccccgaa

SEQ ID NO: 3957385 - RNA, 20 nt, Human herpesvirus 2
cacgguccucaccgagccgc

SEQ ID NO: 3957386 - RNA, 18 nt, Human herpesvirus 2
cacguguccccagggagc

SEQ ID NO: 3957387 - RNA, 20 nt, Human herpesvirus 2
cacguguccccagggagccc

SEQ ID NO: 3957388 - RNA, 16 nt, Human herpesvirus 2
cacguucgccccgcag

SEQ ID NO: 3957389 - RNA, 21 nt, Human herpesvirus 2
cacucccgaaaccgcaggcgc

SEQ ID NO: 3957390 - RNA, 13 nt, Human herpesvirus 2
cagaauaaaaggc

SEQ ID NO: 3957391 - RNA, 17 nt, Human herpesvirus 2
cagacccgagcuccggg

SEQ ID NO: 3957392 - RNA, 21 nt, Human herpesvirus 2
cagacgcccuccgaggagauc

SEQ ID NO: 3957393 - RNA, 20 nt, Human herpesvirus 2
cagagacccugccccccggc

SEQ ID NO: 3957394 - RNA, 15 nt, Human herpesvirus 2
cagcacggcggccag

SEQ ID NO: 3957395 - RNA, 15 nt, Human herpesvirus 2
cagccagggcuggga

SEQ ID NO: 3957396 - RNA, 13 nt, Human herpesvirus 2
cagccccuggggc

SEQ ID NO: 3957397 - RNA, 22 nt, Human herpesvirus 2
cagccccuggggcugucgggcg

SEQ ID NO: 3957398 - RNA, 14 nt, Human herpesvirus 2
cagcccggaccccu

SEQ ID NO: 3957399 - RNA, 15 nt, Human herpesvirus 2
cagccuacaucaccc

SEQ ID NO: 3957400 - RNA, 18 nt, Human herpesvirus 2
cagcgcccuuccgcgucc

SEQ ID NO: 3957401 - RNA, 17 nt, Human herpesvirus 2
cagcgcgucggugccgc

SEQ ID NO: 3957402 - RNA, 20 nt, Human herpesvirus 2
cagcguaacgcacccccgga

SEQ ID NO: 3957403 - RNA, 21 nt, Human herpesvirus 2
cagcgugucaaaggccagcag

SEQ ID NO: 3957404 - RNA, 14 nt, Human herpesvirus 2
cagcugcgccagaa

SEQ ID NO: 3957405 - RNA, 20 nt, Human herpesvirus 2
cagcuuuuaacgggccgcca

SEQ ID NO: 3957406 - RNA, 23 nt, Human herpesvirus 2
caggaauggagaagggaaaggaa

SEQ ID NO: 3957407 - RNA, 18 nt, Human herpesvirus 2
caggccaucgccggggac

SEQ ID NO: 3957408 - RNA, 17 nt, Human herpesvirus 2
caggcccgccccaccgc

SEQ ID NO: 3957409 - RNA, 14 nt, Human herpesvirus 2
caggcccgccgacg

SEQ ID NO: 3957410 - RNA, 16 nt, Human herpesvirus 2
caggcgacccgccgcc

SEQ ID NO: 3957411 - RNA, 15 nt, Human herpesvirus 2
caggcgacgccaggc

SEQ ID NO: 3957412 - RNA, 22 nt, Human herpesvirus 2
caggcgcuccagguacugcugc

SEQ ID NO: 3957413 - RNA, 16 nt, Human herpesvirus 2
caggcgucgcucucgg

SEQ ID NO: 3957414 - RNA, 20 nt, Human herpesvirus 2
caggcuggagcucugccugc

SEQ ID NO: 3957415 - RNA, 14 nt, Human herpesvirus 2
cagggaaacagaaa

SEQ ID NO: 3957416 - RNA, 20 nt, Human herpesvirus 2
cagggagccacucccgcggc

SEQ ID NO: 3957417 - RNA, 21 nt, Human herpesvirus 2
cagggagccacucccgcggcc

SEQ ID NO: 3957418 - RNA, 18 nt, Human herpesvirus 2
caggggggcaggcgggcc

SEQ ID NO: 3957419 - RNA, 23 nt, Human herpesvirus 2
caggggggcuuggacugggagcc

SEQ ID NO: 3957420 - RNA, 12 nt, Human herpesvirus 2
cagguggcccuu

SEQ ID NO: 3957421 - RNA, 13 nt, Human herpesvirus 2
caguaacggggga

SEQ ID NO: 3957422 - RNA, 23 nt, Human herpesvirus 2
caguggagccaaaccccccggcc

SEQ ID NO: 3957423 - RNA, 22 nt, Human herpesvirus 2
caguucgcgaccgaucuggagc

SEQ ID NO: 3957424 - RNA, 19 nt, Human herpesvirus 2
caguuucaccgccccagca

SEQ ID NO: 3957425 - RNA, 16 nt, Human herpesvirus 2
cauaaaacccacccuc

SEQ ID NO: 3957426 - RNA, 16 nt, Human herpesvirus 2
cauacaccccacccua

SEQ ID NO: 3957427 - RNA, 13 nt, Human herpesvirus 2
cauacgcggcgug

SEQ ID NO: 3957428 - RNA, 19 nt, Human herpesvirus 2
caucaagaauucccagggc

SEQ ID NO: 3957429 - RNA, 19 nt, Human herpesvirus 2
cauccgaucgaugagccgg

SEQ ID NO: 3957430 - RNA, 16 nt, Human herpesvirus 2
caucgccaacucuguc

SEQ ID NO: 3957431 - RNA, 20 nt, Human herpesvirus 2
caucgucccccgucugccag

SEQ ID NO: 3957432 - RNA, 16 nt, Human herpesvirus 2
caugaccucucgccgc

SEQ ID NO: 3957433 - RNA, 15 nt, Human herpesvirus 2
caugcaaaugggauu

SEQ ID NO: 3957434 - RNA, 18 nt, Human herpesvirus 2
cauggcggggggggggcu

SEQ ID NO: 3957435 - RNA, 13 nt, Human herpesvirus 2
cauuggcaagcaa

SEQ ID NO: 3957436 - RNA, 20 nt, Human herpesvirus 2
cauuguugucguguggugug

SEQ ID NO: 3957437 - RNA, 19 nt, Human herpesvirus 2
cauuugcccgcgggucugc

SEQ ID NO: 3957438 - RNA, 20 nt, Human herpesvirus 2
ccaacagggaguccucgccg

SEQ ID NO: 3957439 - RNA, 18 nt, Human herpesvirus 2
ccaaccccgucucccugc

SEQ ID NO: 3957440 - RNA, 18 nt, Human herpesvirus 2
ccaacgcgggcggucugg

SEQ ID NO: 3957441 - RNA, 21 nt, Human herpesvirus 2
ccaacucauacacgcgcuggc

SEQ ID NO: 3957442 - RNA, 13 nt, Human herpesvirus 2
ccaaggaacccaa

SEQ ID NO: 3957443 - RNA, 11 nt, Human herpesvirus 2
ccacacagaaa

SEQ ID NO: 3957444 - RNA, 12 nt, Human herpesvirus 2
ccacacaguccg

SEQ ID NO: 3957445 - RNA, 17 nt, Human herpesvirus 2
ccacacccccuccccgu

SEQ ID NO: 3957446 - RNA, 20 nt, Human herpesvirus 2
ccaccaauacaccagagccg

SEQ ID NO: 3957447 - RNA, 12 nt, Human herpesvirus 2
ccacccuggguc

SEQ ID NO: 3957448 - RNA, 16 nt, Human herpesvirus 2
ccaccgcgcccacagc

SEQ ID NO: 3957449 - RNA, 18 nt, Human herpesvirus 2
ccaccggccgaggcgccu

SEQ ID NO: 3957450 - RNA, 18 nt, Human herpesvirus 2
ccaccgucccgcccgcca

SEQ ID NO: 3957451 - RNA, 11 nt, Human herpesvirus 2
ccacgcccugc

SEQ ID NO: 3957452 - RNA, 14 nt, Human herpesvirus 2
ccacgcccugcugu

SEQ ID NO: 3957453 - RNA, 15 nt, Human herpesvirus 2
ccacgcugcgcggcg

SEQ ID NO: 3957454 - RNA, 20 nt, Human herpesvirus 2
ccacgucaccgggggccccg

SEQ ID NO: 3957455 - RNA, 19 nt, Human herpesvirus 2
ccagagccccccacguggg

SEQ ID NO: 3957456 - RNA, 14 nt, Human herpesvirus 2
ccagauggggcccc

SEQ ID NO: 3957457 - RNA, 13 nt, Human herpesvirus 2
ccagccccgcagg

SEQ ID NO: 3957458 - RNA, 21 nt, Human herpesvirus 2
ccagcgccggguggcgccucu

SEQ ID NO: 3957459 - RNA, 22 nt, Human herpesvirus 2
ccaggaacucacggcagacgcg

SEQ ID NO: 3957460 - RNA, 18 nt, Human herpesvirus 2
ccaggaggggggcagugc

SEQ ID NO: 3957461 - RNA, 23 nt, Human herpesvirus 2
ccaggcaaacgguaagcagcgcg

SEQ ID NO: 3957462 - RNA, 20 nt, Human herpesvirus 2
ccaggcgacgccaggccccc

SEQ ID NO: 3957463 - RNA, 22 nt, Human herpesvirus 2
ccagggcgucgcuaacgagcgc

SEQ ID NO: 3957464 - RNA, 13 nt, Human herpesvirus 2
ccagggcuucgug

SEQ ID NO: 3957465 - RNA, 13 nt, Human herpesvirus 2
ccagguacugcug

SEQ ID NO: 3957466 - RNA, 14 nt, Human herpesvirus 2
ccaucgcucccagg

SEQ ID NO: 3957467 - RNA, 16 nt, Human herpesvirus 2
ccaugcaacgccgggc

SEQ ID NO: 3957468 - RNA, 18 nt, Human herpesvirus 2
ccaugggccccggucugu

SEQ ID NO: 3957469 - RNA, 17 nt, Human herpesvirus 2
cccaaggcgcugcgccu

SEQ ID NO: 3957470 - RNA, 17 nt, Human herpesvirus 2
cccacggaccuccggga

SEQ ID NO: 3957471 - RNA, 13 nt, Human herpesvirus 2
cccacggaugccg

SEQ ID NO: 3957472 - RNA, 15 nt, Human herpesvirus 2
cccagacccucacag

SEQ ID NO: 3957473 - RNA, 22 nt, Human herpesvirus 2
cccaggaggggggcagugcagu

SEQ ID NO: 3957474 - RNA, 23 nt, Human herpesvirus 2
cccaggaggggggcagugcagua

SEQ ID NO: 3957475 - RNA, 14 nt, Human herpesvirus 2
cccagggagccccg

SEQ ID NO: 3957476 - RNA, 22 nt, Human herpesvirus 2
cccagggcuucguggaagagga

SEQ ID NO: 3957477 - RNA, 16 nt, Human herpesvirus 2
cccagggggcggcgcc

SEQ ID NO: 3957478 - RNA, 10 nt, Human herpesvirus 2
cccagguccc

SEQ ID NO: 3957479 - RNA, 15 nt, Human herpesvirus 2
ccccaaccacccaac

SEQ ID NO: 3957480 - RNA, 14 nt, Human herpesvirus 2
ccccaccccggagg

SEQ ID NO: 3957481 - RNA, 13 nt, Human herpesvirus 2
ccccacuccaccc

SEQ ID NO: 3957482 - RNA, 16 nt, Human herpesvirus 2
ccccagggagccccgg

SEQ ID NO: 3957483 - RNA, 14 nt, Human herpesvirus 2
ccccagggcuucgu

SEQ ID NO: 3957484 - RNA, 12 nt, Human herpesvirus 2
cccccccaucug

SEQ ID NO: 3957485 - RNA, 12 nt, Human herpesvirus 2
ccccccccucca

SEQ ID NO: 3957486 - RNA, 12 nt, Human herpesvirus 2
ccccccccuucc

SEQ ID NO: 3957487 - RNA, 23 nt, Human herpesvirus 2
cccccgaacagccccuggggcug

SEQ ID NO: 3957488 - RNA, 22 nt, Human herpesvirus 2
cccccggccuuugcuuccucgc

SEQ ID NO: 3957489 - RNA, 23 nt, Human herpesvirus 2
cccccggcgcgggcggcgccgcg

SEQ ID NO: 3957490 - RNA, 21 nt, Human herpesvirus 2
cccccucucaaacaaaaacac

SEQ ID NO: 3957491 - RNA, 10 nt, Human herpesvirus 2
cccccucucu

SEQ ID NO: 3957492 - RNA, 18 nt, Human herpesvirus 2
ccccgaagcggccccgac

SEQ ID NO: 3957493 - RNA, 14 nt, Human herpesvirus 2
ccccgagcagcacg

SEQ ID NO: 3957494 - RNA, 15 nt, Human herpesvirus 2
ccccgcguuccggug

SEQ ID NO: 3957495 - RNA, 22 nt, Human herpesvirus 2
ccccgcucccguguaccucugg

SEQ ID NO: 3957496 - RNA, 23 nt, Human herpesvirus 2
ccccgggaggaggcggcgccugc

SEQ ID NO: 3957497 - RNA, 22 nt, Human herpesvirus 2
ccccgggcgaaaaggcccggcc

SEQ ID NO: 3957498 - RNA, 15 nt, Human herpesvirus 2
ccccgugcuccaacu

SEQ ID NO: 3957499 - RNA, 20 nt, Human herpesvirus 2
ccccgugguagucuuccggg

SEQ ID NO: 3957500 - RNA, 17 nt, Human herpesvirus 2
ccccucguucugcugca

SEQ ID NO: 3957501 - RNA, 13 nt, Human herpesvirus 2
ccccuucuccuua

SEQ ID NO: 3957502 - RNA, 23 nt, Human herpesvirus 2
ccccuugacgugguccacccggg

SEQ ID NO: 3957503 - RNA, 23 nt, Human herpesvirus 2
cccgaauccggggcgugcugugc

SEQ ID NO: 3957504 - RNA, 16 nt, Human herpesvirus 2
cccgaccccgccgccg

SEQ ID NO: 3957505 - RNA, 23 nt, Human herpesvirus 2
cccgagcgugcccuuuucugcga

SEQ ID NO: 3957506 - RNA, 15 nt, Human herpesvirus 2
cccgcaacccgcagg

SEQ ID NO: 3957507 - RNA, 17 nt, Human herpesvirus 2
cccgccgacgccucguc

SEQ ID NO: 3957508 - RNA, 17 nt, Human herpesvirus 2
cccgccgggucaccggg

SEQ ID NO: 3957509 - RNA, 16 nt, Human herpesvirus 2
cccgcggaccaccggg

SEQ ID NO: 3957510 - RNA, 19 nt, Human herpesvirus 2
cccggcccugcggccaagc

SEQ ID NO: 3957511 - RNA, 17 nt, Human herpesvirus 2
cccggcgaccgccccgc

SEQ ID NO: 3957512 - RNA, 18 nt, Human herpesvirus 2
cccggcgaccgccccgcg

SEQ ID NO: 3957513 - RNA, 21 nt, Human herpesvirus 2
cccggcgaccgccccgcgccg

SEQ ID NO: 3957514 - RNA, 15 nt, Human herpesvirus 2
cccggcggccccggc

SEQ ID NO: 3957515 - RNA, 21 nt, Human herpesvirus 2
cccggcggccgcauauacugc

SEQ ID NO: 3957516 - RNA, 19 nt, Human herpesvirus 2
cccgggcgagcuggcccug

SEQ ID NO: 3957517 - RNA, 23 nt, Human herpesvirus 2
cccgggggggggcaagugcagua

SEQ ID NO: 3957518 - RNA, 16 nt, Human herpesvirus 2
cccguacuacccuuuc

SEQ ID NO: 3957519 - RNA, 17 nt, Human herpesvirus 2
cccguguaccucugggc

SEQ ID NO: 3957520 - RNA, 13 nt, Human herpesvirus 2
cccgugugggagg

SEQ ID NO: 3957521 - RNA, 13 nt, Human herpesvirus 2
cccuagaggcugu

SEQ ID NO: 3957522 - RNA, 15 nt, Human herpesvirus 2
cccucccgcaccccc

SEQ ID NO: 3957523 - RNA, 19 nt, Human herpesvirus 2
cccucucaacgcccaggcc

SEQ ID NO: 3957524 - RNA, 21 nt, Human herpesvirus 2
cccucugcuuuuggugcgucu

SEQ ID NO: 3957525 - RNA, 17 nt, Human herpesvirus 2
cccugccccgcccccuc

SEQ ID NO: 3957526 - RNA, 13 nt, Human herpesvirus 2
cccugcgucgccc

SEQ ID NO: 3957527 - RNA, 23 nt, Human herpesvirus 2
cccugggccgcucguuccucacg

SEQ ID NO: 3957528 - RNA, 21 nt, Human herpesvirus 2
cccuguccccgccccccccag

SEQ ID NO: 3957529 - RNA, 20 nt, Human herpesvirus 2
cccuuucuuuucccccuacc

SEQ ID NO: 3957530 - RNA, 15 nt, Human herpesvirus 2
ccgaacagccccugg

SEQ ID NO: 3957531 - RNA, 15 nt, Human herpesvirus 2
ccgaacggaaggccu

SEQ ID NO: 3957532 - RNA, 15 nt, Human herpesvirus 2
ccgaagcggccccga

SEQ ID NO: 3957533 - RNA, 18 nt, Human herpesvirus 2
ccgaaggaagccgccccc

SEQ ID NO: 3957534 - RNA, 16 nt, Human herpesvirus 2
ccgaccagcgccgggu

SEQ ID NO: 3957535 - RNA, 15 nt, Human herpesvirus 2
ccgaccccgccgccg

SEQ ID NO: 3957536 - RNA, 13 nt, Human herpesvirus 2
ccgacccuguggc

SEQ ID NO: 3957537 - RNA, 18 nt, Human herpesvirus 2
ccgaccucgucgcgcgca

SEQ ID NO: 3957538 - RNA, 15 nt, Human herpesvirus 2
ccgacggcggggccc

SEQ ID NO: 3957539 - RNA, 14 nt, Human herpesvirus 2
ccgagaauuucuua

SEQ ID NO: 3957540 - RNA, 17 nt, Human herpesvirus 2
ccgagccgcugugccag

SEQ ID NO: 3957541 - RNA, 15 nt, Human herpesvirus 2
ccgagggcagguccc

SEQ ID NO: 3957542 - RNA, 14 nt, Human herpesvirus 2
ccgaguucccccgg

SEQ ID NO: 3957543 - RNA, 16 nt, Human herpesvirus 2
ccgauagccuccgagg

SEQ ID NO: 3957544 - RNA, 17 nt, Human herpesvirus 2
ccgaucgaugagccggu

SEQ ID NO: 3957545 - RNA, 17 nt, Human herpesvirus 2
ccgcaccggggcggcga

SEQ ID NO: 3957546 - RNA, 14 nt, Human herpesvirus 2
ccgcaggcgcgcca

SEQ ID NO: 3957547 - RNA, 22 nt, Human herpesvirus 2
ccgcaguuucaccgccccagca

SEQ ID NO: 3957548 - RNA, 17 nt, Human herpesvirus 2
ccgcauauacugcuggg

SEQ ID NO: 3957549 - RNA, 13 nt, Human herpesvirus 2
ccgccaacaccag

SEQ ID NO: 3957550 - RNA, 14 nt, Human herpesvirus 2
ccgcccgcagcugc

SEQ ID NO: 3957551 - RNA, 15 nt, Human herpesvirus 2
ccgcccgccccaggg

SEQ ID NO: 3957552 - RNA, 13 nt, Human herpesvirus 2
ccgccggcgguga

SEQ ID NO: 3957553 - RNA, 14 nt, Human herpesvirus 2
ccgccuaccagccc

SEQ ID NO: 3957554 - RNA, 23 nt, Human herpesvirus 2
ccgcgacggccccggccgccucc

SEQ ID NO: 3957555 - RNA, 16 nt, Human herpesvirus 2
ccgcgaugaccucccg

SEQ ID NO: 3957556 - RNA, 17 nt, Human herpesvirus 2
ccgcgaugaccucccgg

SEQ ID NO: 3957557 - RNA, 14 nt, Human herpesvirus 2
ccgcgauuccgagg

SEQ ID NO: 3957558 - RNA, 19 nt, Human herpesvirus 2
ccgcgauuccgagggcagg

SEQ ID NO: 3957559 - RNA, 16 nt, Human herpesvirus 2
ccgcggacagccaggg

SEQ ID NO: 3957560 - RNA, 22 nt, Human herpesvirus 2
ccgcggucgcgcgggccguggc

SEQ ID NO: 3957561 - RNA, 13 nt, Human herpesvirus 2
ccgcucccgccuc

SEQ ID NO: 3957562 - RNA, 22 nt, Human herpesvirus 2
ccgcucgucccccgaggccccc

SEQ ID NO: 3957563 - RNA, 16 nt, Human herpesvirus 2
ccgcugguuucucugc

SEQ ID NO: 3957564 - RNA, 16 nt, Human herpesvirus 2
ccgcuguggcccuggc

SEQ ID NO: 3957565 - RNA, 19 nt, Human herpesvirus 2
ccgcuguggcccuggcgga

SEQ ID NO: 3957566 - RNA, 16 nt, Human herpesvirus 2
ccggaaccccucuggg

SEQ ID NO: 3957567 - RNA, 19 nt, Human herpesvirus 2
ccggaccccgcugcugugc

SEQ ID NO: 3957568 - RNA, 18 nt, Human herpesvirus 2
ccggcccucccgcacccc

SEQ ID NO: 3957569 - RNA, 13 nt, Human herpesvirus 2
ccggcgcgggcgg

SEQ ID NO: 3957570 - RNA, 15 nt, Human herpesvirus 2
ccggcgcgggcggcg

SEQ ID NO: 3957571 - RNA, 22 nt, Human herpesvirus 2
ccggcggccgcauauacugcug

SEQ ID NO: 3957572 - RNA, 13 nt, Human herpesvirus 2
ccggcggcgggga

SEQ ID NO: 3957573 - RNA, 19 nt, Human herpesvirus 2
ccggcgugggugacuggga

SEQ ID NO: 3957574 - RNA, 22 nt, Human herpesvirus 2
ccggcguuucugaccggcgccg

SEQ ID NO: 3957575 - RNA, 15 nt, Human herpesvirus 2
ccgggcagccgggcc

SEQ ID NO: 3957576 - RNA, 13 nt, Human herpesvirus 2
ccgggcccggccg

SEQ ID NO: 3957577 - RNA, 15 nt, Human herpesvirus 2
ccgggcccggccgcg

SEQ ID NO: 3957578 - RNA, 20 nt, Human herpesvirus 2
ccgggcgaaaaggcccggcc

SEQ ID NO: 3957579 - RNA, 19 nt, Human herpesvirus 2
ccggggacacgcggcgggu

SEQ ID NO: 3957580 - RNA, 18 nt, Human herpesvirus 2
ccggggaccgcagucugg

SEQ ID NO: 3957581 - RNA, 17 nt, Human herpesvirus 2
ccggggcacgcggucag

SEQ ID NO: 3957582 - RNA, 20 nt, Human herpesvirus 2
ccggggccguggggccccag

SEQ ID NO: 3957583 - RNA, 13 nt, Human herpesvirus 2
ccggggcucuucu

SEQ ID NO: 3957584 - RNA, 13 nt, Human herpesvirus 2
ccgggggccccgg

SEQ ID NO: 3957585 - RNA, 21 nt, Human herpesvirus 2
ccgggguuuccccggcccacc

SEQ ID NO: 3957586 - RNA, 12 nt, Human herpesvirus 2
ccggucucccuc

SEQ ID NO: 3957587 - RNA, 16 nt, Human herpesvirus 2
ccguaucagcacccca

SEQ ID NO: 3957588 - RNA, 18 nt, Human herpesvirus 2
ccgucacgagccccuggg

SEQ ID NO: 3957589 - RNA, 19 nt, Human herpesvirus 2
ccgucgccgccggccacgc

SEQ ID NO: 3957590 - RNA, 16 nt, Human herpesvirus 2
ccgucuuugggccccg

SEQ ID NO: 3957591 - RNA, 18 nt, Human herpesvirus 2
ccgucuuugggccccgcc

SEQ ID NO: 3957592 - RNA, 19 nt, Human herpesvirus 2
ccgugaugucgggcguggg

SEQ ID NO: 3957593 - RNA, 19 nt, Human herpesvirus 2
ccguggcgccuggggacua

SEQ ID NO: 3957594 - RNA, 13 nt, Human herpesvirus 2
ccguggggcccca

SEQ ID NO: 3957595 - RNA, 17 nt, Human herpesvirus 2
ccguguaccucugggcc

SEQ ID NO: 3957596 - RNA, 21 nt, Human herpesvirus 2
caggcccucgcugcucucccg

SEQ ID NO: 3957597 - RNA, 15 nt, Human herpesvirus 2
caggccgcccccagc

SEQ ID NO: 3957598 - RNA, 14 nt, Human herpesvirus 2
caggcgcugcugcg

SEQ ID NO: 3957599 - RNA, 23 nt, Human herpesvirus 2
caggcgucgaucucaucaaacac

SEQ ID NO: 3957600 - RNA, 13 nt, Human herpesvirus 2
cagggaggccaga

SEQ ID NO: 3957601 - RNA, 14 nt, Human herpesvirus 2
caggggcccgccgc

SEQ ID NO: 3957602 - RNA, 11 nt, Human herpesvirus 2
caguggagcca

SEQ ID NO: 3957603 - RNA, 22 nt, Human herpesvirus 2
cagugggugcucggggacagag

SEQ ID NO: 3957604 - RNA, 16 nt, Human herpesvirus 2
cauacgauauucgcgu

SEQ ID NO: 3957605 - RNA, 14 nt, Human herpesvirus 2
caucaggcucauug

SEQ ID NO: 3957606 - RNA, 16 nt, Human herpesvirus 2
cauccggucgacgucc

SEQ ID NO: 3957607 - RNA, 17 nt, Human herpesvirus 2
caucgcaagccacccug

SEQ ID NO: 3957608 - RNA, 15 nt, Human herpesvirus 2
caugcgacggcgucu

SEQ ID NO: 3957609 - RNA, 23 nt, Human herpesvirus 2
cauggauaacagcuacccgcauc

SEQ ID NO: 3957610 - RNA, 13 nt, Human herpesvirus 2
cauggggaacccc

SEQ ID NO: 3957611 - RNA, 17 nt, Human herpesvirus 2
cauggggaacccccaga

SEQ ID NO: 3957612 - RNA, 17 nt, Human herpesvirus 2
cauuuaggauggcugcu

SEQ ID NO: 3957613 - RNA, 20 nt, Human herpesvirus 2
ccaaccuggcacagcgggca

SEQ ID NO: 3957614 - RNA, 22 nt, Human herpesvirus 2
ccaacgcgcuguggcgcgcccc

SEQ ID NO: 3957615 - RNA, 17 nt, Human herpesvirus 2
ccaagcuaaggcgcccg

SEQ ID NO: 3957616 - RNA, 12 nt, Human herpesvirus 2
ccacacacaccc

SEQ ID NO: 3957617 - RNA, 17 nt, Human herpesvirus 2
ccacacacacccccugu

SEQ ID NO: 3957618 - RNA, 12 nt, Human herpesvirus 2
ccacagccaccu

SEQ ID NO: 3957619 - RNA, 12 nt, Human herpesvirus 2
ccaccaaccugg

SEQ ID NO: 3957620 - RNA, 15 nt, Human herpesvirus 2
ccaccccgccgcagc

SEQ ID NO: 3957621 - RNA, 12 nt, Human herpesvirus 2
ccaccgcacccg

SEQ ID NO: 3957622 - RNA, 15 nt, Human herpesvirus 2
ccaccgcucacccac

SEQ ID NO: 3957623 - RNA, 15 nt, Human herpesvirus 2
ccacggaccuccggg

SEQ ID NO: 3957624 - RNA, 20 nt, Human herpesvirus 2
ccacggucaggaccagggac

SEQ ID NO: 3957625 - RNA, 15 nt, Human herpesvirus 2
ccacggucagucugg

SEQ ID NO: 3957626 - RNA, 16 nt, Human herpesvirus 2
ccacguccaccuuggc

SEQ ID NO: 3957627 - RNA, 17 nt, Human herpesvirus 2
ccacgugcacagccugg

SEQ ID NO: 3957628 - RNA, 22 nt, Human herpesvirus 2
ccacuuccuauaaacucucccc

SEQ ID NO: 3957629 - RNA, 23 nt, Human herpesvirus 2
ccagacgaagucacccggguccc

SEQ ID NO: 3957630 - RNA, 15 nt, Human herpesvirus 2
ccagacgcccuccga

SEQ ID NO: 3957631 - RNA, 18 nt, Human herpesvirus 2
ccagcagcuugcggggcu

SEQ ID NO: 3957632 - RNA, 16 nt, Human herpesvirus 2
ccagccccgcaggcag

SEQ ID NO: 3957633 - RNA, 15 nt, Human herpesvirus 2
ccagcgcacccuggc

SEQ ID NO: 3957634 - RNA, 16 nt, Human herpesvirus 2
ccagcuuucccuccac

SEQ ID NO: 3957635 - RNA, 16 nt, Human herpesvirus 2
ccaggaacucacggca

SEQ ID NO: 3957636 - RNA, 20 nt, Human herpesvirus 2
ccaggaggggggcagugcag

SEQ ID NO: 3957637 - RNA, 17 nt, Human herpesvirus 2
ccaggcgacgccaggcc

SEQ ID NO: 3957638 - RNA, 13 nt, Human herpesvirus 2
ccagguggcccuu

SEQ ID NO: 3957639 - RNA, 15 nt, Human herpesvirus 2
ccauaacgcgcccgc

SEQ ID NO: 3957640 - RNA, 17 nt, Human herpesvirus 2
ccauacaaauuaaauac

SEQ ID NO: 3957641 - RNA, 19 nt, Human herpesvirus 2
ccauauguacgcguacccc

SEQ ID NO: 3957642 - RNA, 16 nt, Human herpesvirus 2
ccaugaccucgccccc

SEQ ID NO: 3957643 - RNA, 17 nt, Human herpesvirus 2
ccaugaccucucgccgc

SEQ ID NO: 3957644 - RNA, 17 nt, Human herpesvirus 2
ccaugcaacgccgggcg

SEQ ID NO: 3957645 - RNA, 12 nt, Human herpesvirus 2
ccaugggccccg

SEQ ID NO: 3957646 - RNA, 14 nt, Human herpesvirus 2
cccacagccaccuc

SEQ ID NO: 3957647 - RNA, 19 nt, Human herpesvirus 2
cccacagcugcgccagaaa

SEQ ID NO: 3957648 - RNA, 17 nt, Human herpesvirus 2
cccacccuuguuggagc

SEQ ID NO: 3957649 - RNA, 15 nt, Human herpesvirus 2
cccaccgcaccacca

SEQ ID NO: 3957650 - RNA, 12 nt, Human herpesvirus 2
cccagacacggu

SEQ ID NO: 3957651 - RNA, 15 nt, Human herpesvirus 2
cccagcacaggcagg

SEQ ID NO: 3957652 - RNA, 21 nt, Human herpesvirus 2
cccagcgcggacgcggccaga

SEQ ID NO: 3957653 - RNA, 19 nt, Human herpesvirus 2
cccagcuuucccuccaccc

SEQ ID NO: 3957654 - RNA, 11 nt, Human herpesvirus 2
cccagggcacc

SEQ ID NO: 3957655 - RNA, 21 nt, Human herpesvirus 2
ccccaaaccccgguuggggcg

SEQ ID NO: 3957656 - RNA, 15 nt, Human herpesvirus 2
ccccagcuuucccuc

SEQ ID NO: 3957657 - RNA, 18 nt, Human herpesvirus 2
ccccaggaggggggcagu

SEQ ID NO: 3957658 - RNA, 19 nt, Human herpesvirus 2
ccccaggaggggggcagug

SEQ ID NO: 3957659 - RNA, 23 nt, Human herpesvirus 2
ccccaggaggggggcagugcagu

SEQ ID NO: 3957660 - RNA, 23 nt, Human herpesvirus 2
cccccaggaggggggcagugcag

SEQ ID NO: 3957661 - RNA, 12 nt, Human herpesvirus 2
ccccccaucugc

SEQ ID NO: 3957662 - RNA, 12 nt, Human herpesvirus 2
cccccggaagga

SEQ ID NO: 3957663 - RNA, 12 nt, Human herpesvirus 2
cccccgggggug

SEQ ID NO: 3957664 - RNA, 19 nt, Human herpesvirus 2
cccccucccccgcuucugg

SEQ ID NO: 3957665 - RNA, 20 nt, Human herpesvirus 2
cccccugaguugcgccggca

SEQ ID NO: 3957666 - RNA, 13 nt, Human herpesvirus 2
ccccgagcagcac

SEQ ID NO: 3957667 - RNA, 20 nt, Human herpesvirus 2
ccccgaguucccccgggacu

SEQ ID NO: 3957668 - RNA, 19 nt, Human herpesvirus 2
ccccgcccccucucccaca

SEQ ID NO: 3957669 - RNA, 11 nt, Human herpesvirus 2
ccccgccgggu

SEQ ID NO: 3957670 - RNA, 21 nt, Human herpesvirus 2
ccccgcgcacgcgcgacugcc

SEQ ID NO: 3957671 - RNA, 23 nt, Human herpesvirus 2
ccccgcucguggcgggcgcggca

SEQ ID NO: 3957672 - RNA, 23 nt, Human herpesvirus 2
ccccggaggggcuccucagcgcg

SEQ ID NO: 3957673 - RNA, 15 nt, Human herpesvirus 2
ccccggcggccccgg

SEQ ID NO: 3957674 - RNA, 22 nt, Human herpesvirus 2
ccccgggcguuauaagccgccg

SEQ ID NO: 3957675 - RNA, 15 nt, Human herpesvirus 2
ccccggggcccgcag

SEQ ID NO: 3957676 - RNA, 16 nt, Human herpesvirus 2
ccccggggccgucgcg

SEQ ID NO: 3957677 - RNA, 15 nt, Human herpesvirus 2
ccccggguuccccga

SEQ ID NO: 3957678 - RNA, 22 nt, Human herpesvirus 2
ccccgguuggggcgggcagccg

SEQ ID NO: 3957679 - RNA, 17 nt, Human herpesvirus 2
ccccgucugucgccucu

SEQ ID NO: 3957680 - RNA, 23 nt, Human herpesvirus 2
ccccugggugucgaccgcugucg

SEQ ID NO: 3957681 - RNA, 13 nt, Human herpesvirus 2
ccccuuccguccc

SEQ ID NO: 3957682 - RNA, 20 nt, Human herpesvirus 2
cccgaacagccccuggggcu

SEQ ID NO: 3957683 - RNA, 22 nt, Human herpesvirus 2
cccgaacagccccuggggcugu

SEQ ID NO: 3957684 - RNA, 15 nt, Human herpesvirus 2
cccgaacggaaggcc

SEQ ID NO: 3957685 - RNA, 14 nt, Human herpesvirus 2
cccgcaccagcucg

SEQ ID NO: 3957686 - RNA, 23 nt, Human herpesvirus 2
cccgcacgaagugaaccaacugc

SEQ ID NO: 3957687 - RNA, 12 nt, Human herpesvirus 2
cccgccauggcg

SEQ ID NO: 3957688 - RNA, 16 nt, Human herpesvirus 2
cccgccccgccccacc

SEQ ID NO: 3957689 - RNA, 12 nt, Human herpesvirus 2
cccgccgcagcu

SEQ ID NO: 3957690 - RNA, 21 nt, Human herpesvirus 2
cccgccgggucaccggggcgc

SEQ ID NO: 3957691 - RNA, 17 nt, Human herpesvirus 2
cccgcggaccaccgggc

SEQ ID NO: 3957692 - RNA, 17 nt, Human herpesvirus 2
cccgcggcccugagccg

SEQ ID NO: 3957693 - RNA, 19 nt, Human herpesvirus 2
cccgcguauauauccgcga

SEQ ID NO: 3957694 - RNA, 19 nt, Human herpesvirus 2
cccgcuggagccccugggg

SEQ ID NO: 3957695 - RNA, 23 nt, Human herpesvirus 2
cccggcggccgcauauacugcug

SEQ ID NO: 3957696 - RNA, 23 nt, Human herpesvirus 2
cccggcguggagcgccgggccuc

SEQ ID NO: 3957697 - RNA, 17 nt, Human herpesvirus 2
cccggggcccgcagcuu

SEQ ID NO: 3957698 - RNA, 13 nt, Human herpesvirus 2
cccggggggagga

SEQ ID NO: 3957699 - RNA, 22 nt, Human herpesvirus 2
cccgggggggggcaagugcagu

SEQ ID NO: 3957700 - RNA, 13 nt, Human herpesvirus 2
cccggguccgggg

SEQ ID NO: 3957701 - RNA, 15 nt, Human herpesvirus 2
cccggucugugggug

SEQ ID NO: 3957702 - RNA, 13 nt, Human herpesvirus 2
cccgucccggcag

SEQ ID NO: 3957703 - RNA, 13 nt, Human herpesvirus 2
cccgucugccagg

SEQ ID NO: 3957704 - RNA, 12 nt, Human herpesvirus 2
cccguggcccac

SEQ ID NO: 3957705 - RNA, 16 nt, Human herpesvirus 2
cccguguaccucuggg

SEQ ID NO: 3957706 - RNA, 16 nt, Human herpesvirus 2
cccgugucgcuccccu

SEQ ID NO: 3957707 - RNA, 12 nt, Human herpesvirus 2
cccuacccuucc

SEQ ID NO: 3957708 - RNA, 16 nt, Human herpesvirus 2
cccuagccuucggcca

SEQ ID NO: 3957709 - RNA, 22 nt, Human herpesvirus 2
cccuauacgcgguauggcugcc

SEQ ID NO: 3957710 - RNA, 13 nt, Human herpesvirus 2
cccucaccccucc

SEQ ID NO: 3957711 - RNA, 20 nt, Human herpesvirus 2
cccucccgcacccccgcguu

SEQ ID NO: 3957712 - RNA, 21 nt, Human herpesvirus 2
ccgcauauacugcugggccau

SEQ ID NO: 3957713 - RNA, 22 nt, Human herpesvirus 2
ccgcaucaguccgcgcggggcg

SEQ ID NO: 3957714 - RNA, 16 nt, Human herpesvirus 2
ccgccagcgcccuucc

SEQ ID NO: 3957715 - RNA, 15 nt, Human herpesvirus 2
ccgcccccucuccca

SEQ ID NO: 3957716 - RNA, 22 nt, Human herpesvirus 2
ccgcgcacgcgcgacugccucc

SEQ ID NO: 3957717 - RNA, 17 nt, Human herpesvirus 2
ccgcggccauccugccc

SEQ ID NO: 3957718 - RNA, 20 nt, Human herpesvirus 2
ccgcggcccugagccgcgcg

SEQ ID NO: 3957719 - RNA, 13 nt, Human herpesvirus 2
ccgcgggaggaag

SEQ ID NO: 3957720 - RNA, 14 nt, Human herpesvirus 2
ccgcgggaggaugu

SEQ ID NO: 3957721 - RNA, 16 nt, Human herpesvirus 2
ccgcgggaggcggugg

SEQ ID NO: 3957722 - RNA, 13 nt, Human herpesvirus 2
ccgcgucugcuac

SEQ ID NO: 3957723 - RNA, 16 nt, Human herpesvirus 2
ccgcgugcuuccgcac

SEQ ID NO: 3957724 - RNA, 13 nt, Human herpesvirus 2
ccgcugcugugca

SEQ ID NO: 3957725 - RNA, 22 nt, Human herpesvirus 2
ccggacugcagccccggucccc

SEQ ID NO: 3957726 - RNA, 21 nt, Human herpesvirus 2
ccggaggaaacccccgacccc

SEQ ID NO: 3957727 - RNA, 17 nt, Human herpesvirus 2
ccggcgguucgcgugcg

SEQ ID NO: 3957728 - RNA, 20 nt, Human herpesvirus 2
ccgggacgagccaaaccagc

SEQ ID NO: 3957729 - RNA, 14 nt, Human herpesvirus 2
ccgggagccgcggc

SEQ ID NO: 3957730 - RNA, 13 nt, Human herpesvirus 2
ccgggagcguggg

SEQ ID NO: 3957731 - RNA, 17 nt, Human herpesvirus 2
ccgggcgagcuggcccu

SEQ ID NO: 3957732 - RNA, 18 nt, Human herpesvirus 2
ccgggcgagcuggcccug

SEQ ID NO: 3957733 - RNA, 14 nt, Human herpesvirus 2
ccggggaaacaggc

SEQ ID NO: 3957734 - RNA, 14 nt, Human herpesvirus 2
ccggggagggcagg

SEQ ID NO: 3957735 - RNA, 16 nt, Human herpesvirus 2
ccggggagggcagggc

SEQ ID NO: 3957736 - RNA, 18 nt, Human herpesvirus 2
ccggggcgaacgggggau

SEQ ID NO: 3957737 - RNA, 20 nt, Human herpesvirus 2
ccgggggccugguggcaccu

SEQ ID NO: 3957738 - RNA, 11 nt, Human herpesvirus 2
ccgggggcgcu

SEQ ID NO: 3957739 - RNA, 23 nt, Human herpesvirus 2
ccggggggacgcgagccuguguc

SEQ ID NO: 3957740 - RNA, 14 nt, Human herpesvirus 2
ccggucccuucccc

SEQ ID NO: 3957741 - RNA, 20 nt, Human herpesvirus 2
ccggugucucgcggcccggc

SEQ ID NO: 3957742 - RNA, 16 nt, Human herpesvirus 2
ccguccuuuccacccc

SEQ ID NO: 3957743 - RNA, 13 nt, Human herpesvirus 2
ccgucgcuccggc

SEQ ID NO: 3957744 - RNA, 18 nt, Human herpesvirus 2
ccgugcugggcgcgagcc

SEQ ID NO: 3957745 - RNA, 19 nt, Human herpesvirus 2
ccgugcugggcgcgagcca

SEQ ID NO: 3957746 - RNA, 22 nt, Human herpesvirus 2
ccgugcugggcgcgagccaggc

SEQ ID NO: 3957747 - RNA, 14 nt, Human herpesvirus 2
ccguggggccccag

SEQ ID NO: 3957748 - RNA, 23 nt, Human herpesvirus 2
ccguggguuacgcaggcccucgc

SEQ ID NO: 3957749 - RNA, 22 nt, Human herpesvirus 2
ccguguuagggaagucucuugg

SEQ ID NO: 3957750 - RNA, 12 nt, Human herpesvirus 2
ccuacgcacccu

SEQ ID NO: 3957751 - RNA, 15 nt, Human herpesvirus 2
ccuagaggcuguccg

SEQ ID NO: 3957752 - RNA, 19 nt, Human herpesvirus 2
ccucacgguccucaccgag

SEQ ID NO: 3957753 - RNA, 15 nt, Human herpesvirus 2
ccucccagugccccg

SEQ ID NO: 3957754 - RNA, 14 nt, Human herpesvirus 2
ccuccgaggagauc

SEQ ID NO: 3957755 - RNA, 16 nt, Human herpesvirus 2
ccuccgcccuccgcca

SEQ ID NO: 3957756 - RNA, 18 nt, Human herpesvirus 2
ccuccgcccuccgccagc

SEQ ID NO: 3957757 - RNA, 21 nt, Human herpesvirus 2
ccuccuucgccgacgccuucc

SEQ ID NO: 3957758 - RNA, 19 nt, Human herpesvirus 2
ccucgagcucuucggcugc

SEQ ID NO: 3957759 - RNA, 13 nt, Human herpesvirus 2
ccucgcugcgccg

SEQ ID NO: 3957760 - RNA, 17 nt, Human herpesvirus 2
ccucgggccuacgcacc

SEQ ID NO: 3957761 - RNA, 21 nt, Human herpesvirus 2
ccucggggacgcacggcaccc

SEQ ID NO: 3957762 - RNA, 20 nt, Human herpesvirus 2
ccucgggggcagggggaggu

SEQ ID NO: 3957763 - RNA, 15 nt, Human herpesvirus 2
ccucugcgcgcggcg

SEQ ID NO: 3957764 - RNA, 17 nt, Human herpesvirus 2
ccugcgucgccccgugc

SEQ ID NO: 3957765 - RNA, 23 nt, Human herpesvirus 2
ccuggcgauccugggccuguggg

SEQ ID NO: 3957766 - RNA, 14 nt, Human herpesvirus 2
ccuggcggacggcc

SEQ ID NO: 3957767 - RNA, 21 nt, Human herpesvirus 2
ccuggcggccccuguuggagc

SEQ ID NO: 3957768 - RNA, 12 nt, Human herpesvirus 2
ccuggcucgccg

SEQ ID NO: 3957769 - RNA, 14 nt, Human herpesvirus 2
ccuggggcuccugc

SEQ ID NO: 3957770 - RNA, 13 nt, Human herpesvirus 2
ccuggggcugucg

SEQ ID NO: 3957771 - RNA, 23 nt, Human herpesvirus 2
ccuggguccgggggccugguggc

SEQ ID NO: 3957772 - RNA, 15 nt, Human herpesvirus 2
ccuggucacaaaagg

SEQ ID NO: 3957773 - RNA, 19 nt, Human herpesvirus 2
ccuguacgacagcggggac

SEQ ID NO: 3957774 - RNA, 14 nt, Human herpesvirus 2
ccugugucagcucc

SEQ ID NO: 3957775 - RNA, 13 nt, Human herpesvirus 2
ccuguugggcaca

SEQ ID NO: 3957776 - RNA, 14 nt, Human herpesvirus 2
ccuguuuccuuucc

SEQ ID NO: 3957777 - RNA, 12 nt, Human herpesvirus 2
ccuucagccugg

SEQ ID NO: 3957778 - RNA, 14 nt, Human herpesvirus 2
ccuucagccuggac

SEQ ID NO: 3957779 - RNA, 14 nt, Human herpesvirus 2
ccuuccccaccacc

SEQ ID NO: 3957780 - RNA, 17 nt, Human herpesvirus 2
ccuucgcgagggccccg

SEQ ID NO: 3957781 - RNA, 18 nt, Human herpesvirus 2
ccuuguuggagcggucgc

SEQ ID NO: 3957782 - RNA, 22 nt, Human herpesvirus 2
ccuuuccuuaaaaggcacccca

SEQ ID NO: 3957783 - RNA, 22 nt, Human herpesvirus 2
ccuuuuuucuuuuucucuuccc

SEQ ID NO: 3957784 - RNA, 12 nt, Human herpesvirus 2
cgaacacugccu

SEQ ID NO: 3957785 - RNA, 14 nt, Human herpesvirus 2
cgaacagccccugg

SEQ ID NO: 3957786 - RNA, 23 nt, Human herpesvirus 2
cgaauccggggcgugcugugccc

SEQ ID NO: 3957787 - RNA, 21 nt, Human herpesvirus 2
cgaccaaaacggaccccgcgu

SEQ ID NO: 3957788 - RNA, 18 nt, Human herpesvirus 2
cgaccagcguccugcgcg

SEQ ID NO: 3957789 - RNA, 14 nt, Human herpesvirus 2
cgaccccccggguu

SEQ ID NO: 3957790 - RNA, 11 nt, Human herpesvirus 2
cgacccgccuc

SEQ ID NO: 3957791 - RNA, 16 nt, Human herpesvirus 2
cgacccuguggcgggc

SEQ ID NO: 3957792 - RNA, 21 nt, Human herpesvirus 2
cgaccgccggccccaccgucu

SEQ ID NO: 3957793 - RNA, 19 nt, Human herpesvirus 2
cgaccgggcggugcccauc

SEQ ID NO: 3957794 - RNA, 16 nt, Human herpesvirus 2
cgacgaggccuucccg

SEQ ID NO: 3957795 - RNA, 22 nt, Human herpesvirus 2
cgacgagguccgucguuugggg

SEQ ID NO: 3957796 - RNA, 13 nt, Human herpesvirus 2
cgacgccaggccc

SEQ ID NO: 3957797 - RNA, 17 nt, Human herpesvirus 2
cgacggcuccugccacc

SEQ ID NO: 3957798 - RNA, 14 nt, Human herpesvirus 2
cgacgugccgggga

SEQ ID NO: 3957799 - RNA, 15 nt, Human herpesvirus 2
cgagaacgagauggu

SEQ ID NO: 3957800 - RNA, 23 nt, Human herpesvirus 2
cgagacauggggaacccccagac

SEQ ID NO: 3957801 - RNA, 20 nt, Human herpesvirus 2
cgagccccgcgaccaccaag

SEQ ID NO: 3957802 - RNA, 16 nt, Human herpesvirus 2
cgagccgcugugccag

SEQ ID NO: 3957803 - RNA, 14 nt, Human herpesvirus 2
cgagcggugucgcg

SEQ ID NO: 3957804 - RNA, 19 nt, Human herpesvirus 2
cgagcguggccggcgaccc

SEQ ID NO: 3957805 - RNA, 20 nt, Human herpesvirus 2
gcacguaaaacacgggcgcu

SEQ ID NO: 3957806 - RNA, 18 nt, Human herpesvirus 2
gcacgugcgucuucccag

SEQ ID NO: 3957807 - RNA, 16 nt, Human herpesvirus 2
gcagccccgguccccc

SEQ ID NO: 3957808 - RNA, 19 nt, Human herpesvirus 2
gcagccccggucccccgga

SEQ ID NO: 3957809 - RNA, 17 nt, Human herpesvirus 2
gcagcgugucaaaggcc

SEQ ID NO: 3957810 - RNA, 15 nt, Human herpesvirus 2
gcagcucgcccccgu

SEQ ID NO: 3957811 - RNA, 18 nt, Human herpesvirus 2
gcaggagggcgggccacg

SEQ ID NO: 3957812 - RNA, 17 nt, Human herpesvirus 2
gcaggcgcgcggguccc

SEQ ID NO: 3957813 - RNA, 14 nt, Human herpesvirus 2
gcaggcggcgggga

SEQ ID NO: 3957814 - RNA, 20 nt, Human herpesvirus 2
gcaggcgggcccaucacugu

SEQ ID NO: 3957815 - RNA, 13 nt, Human herpesvirus 2
gcaugcgacggcg

SEQ ID NO: 3957816 - RNA, 19 nt, Human herpesvirus 2
gcauggaccccccacgccc

SEQ ID NO: 3957817 - RNA, 12 nt, Human herpesvirus 2
gccaacucuguc

SEQ ID NO: 3957818 - RNA, 13 nt, Human herpesvirus 2
gccaacucugucu

SEQ ID NO: 3957819 - RNA, 23 nt, Human herpesvirus 2
gccaacucugucuucguguggcg

SEQ ID NO: 3957820 - RNA, 20 nt, Human herpesvirus 2
gccaccgucccgcccgccag

SEQ ID NO: 3957821 - RNA, 13 nt, Human herpesvirus 2
gccacucccgcgg

SEQ ID NO: 3957822 - RNA, 18 nt, Human herpesvirus 2
gccagauggggccccggu

SEQ ID NO: 3957823 - RNA, 22 nt, Human herpesvirus 2
gccagcacgaccagggaggcca

SEQ ID NO: 3957824 - RNA, 22 nt, Human herpesvirus 2
gccaggaacuccagcuuggccg

SEQ ID NO: 3957825 - RNA, 14 nt, Human herpesvirus 2
gccagugcauccca

SEQ ID NO: 3957826 - RNA, 17 nt, Human herpesvirus 2
gccauccucaaacaggc

SEQ ID NO: 3957827 - RNA, 23 nt, Human herpesvirus 2
gcccaacccaaccgacucccucc

SEQ ID NO: 3957828 - RNA, 14 nt, Human herpesvirus 2
gcccaccugcacga

SEQ ID NO: 3957829 - RNA, 16 nt, Human herpesvirus 2
gcccagcgcacccugg

SEQ ID NO: 3957830 - RNA, 19 nt, Human herpesvirus 2
gcccaggcccuggcgcacc

SEQ ID NO: 3957831 - RNA, 19 nt, Human herpesvirus 2
gcccauaaacaggccccgc

SEQ ID NO: 3957832 - RNA, 14 nt, Human herpesvirus 2
gccccaccccgccc

SEQ ID NO: 3957833 - RNA, 20 nt, Human herpesvirus 2
gccccacgucaccgggggcc

SEQ ID NO: 3957834 - RNA, 23 nt, Human herpesvirus 2
gccccagagccccccacgugggc

SEQ ID NO: 3957835 - RNA, 12 nt, Human herpesvirus 2
gcccccaccccc

SEQ ID NO: 3957836 - RNA, 23 nt, Human herpesvirus 2
agcuucauuuugugggggcccag

SEQ ID NO: 3957837 - RNA, 17 nt, Human herpesvirus 2
aggaaacgcgcgccccc

SEQ ID NO: 3957838 - RNA, 12 nt, Human herpesvirus 2
aggaagaaagaa

SEQ ID NO: 3957839 - RNA, 20 nt, Human herpesvirus 2
aggaccgccugccccgcgga

SEQ ID NO: 3957840 - RNA, 18 nt, Human herpesvirus 2
aggacgccggccgguccu

SEQ ID NO: 3957841 - RNA, 20 nt, Human herpesvirus 2
aggaguuucggaaagccggc

SEQ ID NO: 3957842 - RNA, 22 nt, Human herpesvirus 2
aggcaggggcagcucgcccccg

SEQ ID NO: 3957843 - RNA, 19 nt, Human herpesvirus 2
aggcccucugggacaccca

SEQ ID NO: 3957844 - RNA, 19 nt, Human herpesvirus 2
aggccgcccccagcaggug

SEQ ID NO: 3957845 - RNA, 17 nt, Human herpesvirus 2
aggcgaccccgcccccc

SEQ ID NO: 3957846 - RNA, 13 nt, Human herpesvirus 2
aggcgccucugcc

SEQ ID NO: 3957847 - RNA, 13 nt, Human herpesvirus 2
agggaauaugcaa

SEQ ID NO: 3957848 - RNA, 14 nt, Human herpesvirus 2
agggacgcgcagcg

SEQ ID NO: 3957849 - RNA, 14 nt, Human herpesvirus 2
aggggcaccaaaaa

SEQ ID NO: 3957850 - RNA, 21 nt, Human herpesvirus 2
aggggcaccaaaaaccagguc

SEQ ID NO: 3957851 - RNA, 18 nt, Human herpesvirus 2
aggggcgggaggaaggac

SEQ ID NO: 3957852 - RNA, 20 nt, Human herpesvirus 2
aggggcuccucagcgcggcc

SEQ ID NO: 3957853 - RNA, 12 nt, Human herpesvirus 2
aggggggagaug

SEQ ID NO: 3957854 - RNA, 23 nt, Human herpesvirus 2
agggugggggugguggugguggg

SEQ ID NO: 3957855 - RNA, 20 nt, Human herpesvirus 2
aggucugcgcgaggccgcuc

SEQ ID NO: 3957856 - RNA, 19 nt, Human herpesvirus 2
aggucuguuguguuugcug

SEQ ID NO: 3957857 - RNA, 20 nt, Human herpesvirus 2
agguggggggggggaaagac

SEQ ID NO: 3957858 - RNA, 23 nt, Human herpesvirus 2
aguaacaaacagagaaaaaaaac

SEQ ID NO: 3957859 - RNA, 14 nt, Human herpesvirus 2
agucucuuggggaa

SEQ ID NO: 3957860 - RNA, 13 nt, Human herpesvirus 2
aguguuugggaaa

SEQ ID NO: 3957861 - RNA, 21 nt, Human herpesvirus 2
aguuccuccgugcuggggaaa

SEQ ID NO: 3957862 - RNA, 10 nt, Human herpesvirus 2
auaaagagcu

SEQ ID NO: 3957863 - RNA, 15 nt, Human herpesvirus 2
auaaagguccggcgg

SEQ ID NO: 3957864 - RNA, 15 nt, Human herpesvirus 2
auagagggaacaaag

SEQ ID NO: 3957865 - RNA, 18 nt, Human herpesvirus 2
auagauuuccccaagaga

SEQ ID NO: 3957866 - RNA, 19 nt, Human herpesvirus 2
aucaguccgcgcggggcgc

SEQ ID NO: 3957867 - RNA, 17 nt, Human herpesvirus 2
aucccgaagccaucuga

SEQ ID NO: 3957868 - RNA, 14 nt, Human herpesvirus 2
auccggccucgggu

SEQ ID NO: 3957869 - RNA, 17 nt, Human herpesvirus 2
auccucaaacaggccau

SEQ ID NO: 3957870 - RNA, 15 nt, Human herpesvirus 2
aucggccaggagguc

SEQ ID NO: 3957871 - RNA, 20 nt, Human herpesvirus 2
aucgugugcacgaaaaagag

SEQ ID NO: 3957872 - RNA, 11 nt, Human herpesvirus 2
aucugggaaga

SEQ ID NO: 3957873 - RNA, 14 nt, Human herpesvirus 2
augaacugauugcc

SEQ ID NO: 3957874 - RNA, 16 nt, Human herpesvirus 2
augaugaccugggguc

SEQ ID NO: 3957875 - RNA, 21 nt, Human herpesvirus 2
augcgacggcgucucccgggg

SEQ ID NO: 3957876 - RNA, 14 nt, Human herpesvirus 2
auggagaagggaaa

SEQ ID NO: 3957877 - RNA, 23 nt, Human herpesvirus 2
auggcggccgcgcccccggccgc

SEQ ID NO: 3957878 - RNA, 13 nt, Human herpesvirus 2
augggcucggcgu

SEQ ID NO: 3957879 - RNA, 13 nt, Human herpesvirus 2
auggggagagggg

SEQ ID NO: 3957880 - RNA, 14 nt, Human herpesvirus 2
augggggggaaggg

SEQ ID NO: 3957881 - RNA, 15 nt, Human herpesvirus 2
auggggggggaaagg

SEQ ID NO: 3957882 - RNA, 15 nt, Human herpesvirus 2
auguucaaaaauaca

SEQ ID NO: 3957883 - RNA, 18 nt, Human herpesvirus 2
auguuguguucgccgacc

SEQ ID NO: 3957884 - RNA, 20 nt, Human herpesvirus 2
auugaccggggccccaucug

SEQ ID NO: 3957885 - RNA, 19 nt, Human herpesvirus 2
auuuaaggagucgccgccc

SEQ ID NO: 3957886 - RNA, 16 nt, Human herpesvirus 2
auuuuccccccacccc

SEQ ID NO: 3957887 - RNA, 15 nt, Human herpesvirus 2
auuuucuggaagagc

SEQ ID NO: 3957888 - RNA, 22 nt, Human herpesvirus 2
caaaagaaacggcaagaaagac

SEQ ID NO: 3957889 - RNA, 20 nt, Human herpesvirus 2
caacaugacaacgacgcccc

SEQ ID NO: 3957890 - RNA, 21 nt, Human herpesvirus 2
caacgcacguacguucugccc

SEQ ID NO: 3957891 - RNA, 23 nt, Human herpesvirus 2
caacgcccccuuuacgccuuucc

SEQ ID NO: 3957892 - RNA, 13 nt, Human herpesvirus 2
caacguccgggcg

SEQ ID NO: 3957893 - RNA, 17 nt, Human herpesvirus 2
caagaccugccccggcg

SEQ ID NO: 3957894 - RNA, 14 nt, Human herpesvirus 2
caagcccacaaccc

SEQ ID NO: 3957895 - RNA, 22 nt, Human herpesvirus 2
caagcgccccgcggaccccgcc

SEQ ID NO: 3957896 - RNA, 17 nt, Human herpesvirus 2
caauaaacgccuucccg

SEQ ID NO: 3957897 - RNA, 12 nt, Human herpesvirus 2
caauaaagccag

SEQ ID NO: 3957898 - RNA, 20 nt, Human herpesvirus 2
caauauggcccagcgcaccc

SEQ ID NO: 3957899 - RNA, 15 nt, Human herpesvirus 2
cacacacacaggccc

SEQ ID NO: 3957900 - RNA, 15 nt, Human herpesvirus 2
cacacaggcccacca

SEQ ID NO: 3957901 - RNA, 23 nt, Human herpesvirus 2
cacacccccaucgggcugcuggu

SEQ ID NO: 3957902 - RNA, 16 nt, Human herpesvirus 2
cacaccggagacccaa

SEQ ID NO: 3957903 - RNA, 15 nt, Human herpesvirus 2
cacaccgggcugggg

SEQ ID NO: 3957904 - RNA, 10 nt, Human herpesvirus 2
cacagccacc

SEQ ID NO: 3957905 - RNA, 17 nt, Human herpesvirus 2
cacaguuccgggaaggc

SEQ ID NO: 3957906 - RNA, 20 nt, Human herpesvirus 2
caccaaccuggcacagcggg

SEQ ID NO: 3957907 - RNA, 15 nt, Human herpesvirus 2
caccacccccccacu

SEQ ID NO: 3957908 - RNA, 20 nt, Human herpesvirus 2
caccagcucgggggccagga

SEQ ID NO: 3957909 - RNA, 12 nt, Human herpesvirus 2
caccccccugac

SEQ ID NO: 3957910 - RNA, 15 nt, Human herpesvirus 2
caccccccuucuccu

SEQ ID NO: 3957911 - RNA, 21 nt, Human herpesvirus 2
cacccuagccuucggccaccu

SEQ ID NO: 3957912 - RNA, 23 nt, Human herpesvirus 2
caccggccuggucguccgcggcc

SEQ ID NO: 3957913 - RNA, 22 nt, Human herpesvirus 2
caccggggcgccccccccgacg

SEQ ID NO: 3957914 - RNA, 13 nt, Human herpesvirus 2
caccugcgcggcg

SEQ ID NO: 3957915 - RNA, 20 nt, Human herpesvirus 2
caccuggcucgccgugcgcu

SEQ ID NO: 3957916 - RNA, 22 nt, Human herpesvirus 2
cacgaaguggguauacuuuugu

SEQ ID NO: 3957917 - RNA, 11 nt, Human herpesvirus 2
cacgacagacc

SEQ ID NO: 3957918 - RNA, 20 nt, Human herpesvirus 2
cacgagcucgacggcgccua

SEQ ID NO: 3957919 - RNA, 21 nt, Human herpesvirus 2
cacgaggucgucgugggccgg

SEQ ID NO: 3957920 - RNA, 22 nt, Human herpesvirus 2
cacgcccaacccaaccgacucc

SEQ ID NO: 3957921 - RNA, 19 nt, Human herpesvirus 2
cacgccguggacgcccccu

SEQ ID NO: 3957922 - RNA, 17 nt, Human herpesvirus 2
cacgcgcgacugccucc

SEQ ID NO: 3957923 - RNA, 17 nt, Human herpesvirus 2
cacggugcgugcggccc

SEQ ID NO: 3957924 - RNA, 21 nt, Human herpesvirus 2
cacggugcgugcggcccugcc

SEQ ID NO: 3957925 - RNA, 16 nt, Human herpesvirus 2
cacgucggacgccagc

SEQ ID NO: 3957926 - RNA, 17 nt, Human herpesvirus 2
cacguguccccagggag

SEQ ID NO: 3957927 - RNA, 15 nt, Human herpesvirus 2
cacguucgccccgca

SEQ ID NO: 3957928 - RNA, 19 nt, Human herpesvirus 2
cacucuggcguccccaggc

SEQ ID NO: 3957929 - RNA, 14 nt, Human herpesvirus 2
cacuucgcugucag

SEQ ID NO: 3957930 - RNA, 16 nt, Human herpesvirus 2
cagaccgcggacacgg

SEQ ID NO: 3957931 - RNA, 14 nt, Human herpesvirus 2
cagacucucgguga

SEQ ID NO: 3957932 - RNA, 15 nt, Human herpesvirus 2
cagagcucuuuauug

SEQ ID NO: 3957933 - RNA, 15 nt, Human herpesvirus 2
cagaggacgccggcc

SEQ ID NO: 3957934 - RNA, 13 nt, Human herpesvirus 2
cagauaugugagu

SEQ ID NO: 3957935 - RNA, 21 nt, Human herpesvirus 2
cagcaaccaggcgcugcugcg

SEQ ID NO: 3957936 - RNA, 19 nt, Human herpesvirus 2
cagcaccaccaccccccca

SEQ ID NO: 3957937 - RNA, 15 nt, Human herpesvirus 2
cagcacgaccaggga

SEQ ID NO: 3957938 - RNA, 17 nt, Human herpesvirus 2
cagcauccugaaccgcu

SEQ ID NO: 3957939 - RNA, 14 nt, Human herpesvirus 2
cagcccagaggagc

SEQ ID NO: 3957940 - RNA, 17 nt, Human herpesvirus 2
cagccccgcaggcaggc

SEQ ID NO: 3957941 - RNA, 16 nt, Human herpesvirus 2
cagccgcgccgcugcc

SEQ ID NO: 3957942 - RNA, 19 nt, Human herpesvirus 2
cagccuacaucaccccagg

SEQ ID NO: 3957943 - RNA, 20 nt, Human herpesvirus 2
cagccuacaucaccccaggg

SEQ ID NO: 3957944 - RNA, 22 nt, Human herpesvirus 2
cagccuggaccagaccguggcc

SEQ ID NO: 3957945 - RNA, 14 nt, Human herpesvirus 2
cagcgccggguggc

SEQ ID NO: 3957946 - RNA, 14 nt, Human herpesvirus 2
cagcgcggacgcgg

SEQ ID NO: 3957947 - RNA, 16 nt, Human herpesvirus 2
cagcgcgucggugccg

SEQ ID NO: 3957948 - RNA, 23 nt, Human herpesvirus 2
cagcggggacccgggcgagcugg

SEQ ID NO: 3957949 - RNA, 16 nt, Human herpesvirus 2
cagcguaacgcacccc

SEQ ID NO: 3957950 - RNA, 20 nt, Human herpesvirus 2
cagcucccccgcgcaggggg

SEQ ID NO: 3957951 - RNA, 13 nt, Human herpesvirus 2
cccucgaacaugg

SEQ ID NO: 3957952 - RNA, 15 nt, Human herpesvirus 2
cccucgccgccuucc

SEQ ID NO: 3957953 - RNA, 17 nt, Human herpesvirus 2
cccucggcagcccggac

SEQ ID NO: 3957954 - RNA, 17 nt, Human herpesvirus 2
cccucuuucccucccuc

SEQ ID NO: 3957955 - RNA, 12 nt, Human herpesvirus 2
cccuucagccug

SEQ ID NO: 3957956 - RNA, 14 nt, Human herpesvirus 2
cccuuucccccuuc

SEQ ID NO: 3957957 - RNA, 13 nt, Human herpesvirus 2
ccgaagaggugcu

SEQ ID NO: 3957958 - RNA, 23 nt, Human herpesvirus 2
ccgaaucuuuucaucgaaagggu

SEQ ID NO: 3957959 - RNA, 12 nt, Human herpesvirus 2
ccgaccagaacc

SEQ ID NO: 3957960 - RNA, 16 nt, Human herpesvirus 2
ccgacgcgcgcgcccc

SEQ ID NO: 3957961 - RNA, 16 nt, Human herpesvirus 2
ccgacgucucggcccc

SEQ ID NO: 3957962 - RNA, 13 nt, Human herpesvirus 2
ccgacucccuccg

SEQ ID NO: 3957963 - RNA, 20 nt, Human herpesvirus 2
ccgagcagcacggcggccag

SEQ ID NO: 3957964 - RNA, 16 nt, Human herpesvirus 2
ccgagcgucaggcccg

SEQ ID NO: 3957965 - RNA, 14 nt, Human herpesvirus 2
ccgaucuggagccg

SEQ ID NO: 3957966 - RNA, 15 nt, Human herpesvirus 2
ccgcacccccgccua

SEQ ID NO: 3957967 - RNA, 13 nt, Human herpesvirus 2
ccgcaccggggcg

SEQ ID NO: 3957968 - RNA, 18 nt, Human herpesvirus 2
ccgcagaccaccucgcgg

SEQ ID NO: 3957969 - RNA, 19 nt, Human herpesvirus 2
ccgcaggcgcgccaccgcc

SEQ ID NO: 3957970 - RNA, 11 nt, Human herpesvirus 2
cgagcucccug

SEQ ID NO: 3957971 - RNA, 20 nt, Human herpesvirus 2
cgaggaccacgugcacagcc

SEQ ID NO: 3957972 - RNA, 20 nt, Human herpesvirus 2
cgaggcccacccccccaccc

SEQ ID NO: 3957973 - RNA, 19 nt, Human herpesvirus 2
cgaggcccccggcccugcg

SEQ ID NO: 3957974 - RNA, 21 nt, Human herpesvirus 2
cgaggcgccucgggggcaggg

SEQ ID NO: 3957975 - RNA, 14 nt, Human herpesvirus 2
cgagggccccggcc

SEQ ID NO: 3957976 - RNA, 14 nt, Human herpesvirus 2
cgaguccugggugg

SEQ ID NO: 3957977 - RNA, 19 nt, Human herpesvirus 2
cgcaauaaacgccuucccg

SEQ ID NO: 3957978 - RNA, 16 nt, Human herpesvirus 2
cgcacccccggacccc

SEQ ID NO: 3957979 - RNA, 20 nt, Human herpesvirus 2
cgcaccgcugucccgacgau

SEQ ID NO: 3957980 - RNA, 22 nt, Human herpesvirus 2
cgcacguacguucugccccgcg

SEQ ID NO: 3957981 - RNA, 17 nt, Human herpesvirus 2
cgcaggccgcccccagc

SEQ ID NO: 3957982 - RNA, 14 nt, Human herpesvirus 2
cgcaucggaccccc

SEQ ID NO: 3957983 - RNA, 20 nt, Human herpesvirus 2
cgcaugggccgccagcaguc

SEQ ID NO: 3957984 - RNA, 22 nt, Human herpesvirus 2
cgcauuuaaggagucgccgccc

SEQ ID NO: 3957985 - RNA, 23 nt, Human herpesvirus 2
cgccaagcgccccgcggaccccg

SEQ ID NO: 3957986 - RNA, 20 nt, Human herpesvirus 2
cgccagacgggccggugggc

SEQ ID NO: 3957987 - RNA, 22 nt, Human herpesvirus 2
cgccaggccccccgggagccgc

SEQ ID NO: 3957988 - RNA, 18 nt, Human herpesvirus 2
cgcccagacccucacaga

SEQ ID NO: 3957989 - RNA, 23 nt, Human herpesvirus 2
cgcccaggcccuggcgcaccugc

SEQ ID NO: 3957990 - RNA, 23 nt, Human herpesvirus 2
cgccccgccccaccccgccccac

SEQ ID NO: 3957991 - RNA, 13 nt, Human herpesvirus 2
cgccccgcggacc

SEQ ID NO: 3957992 - RNA, 15 nt, Human herpesvirus 2
cgcccgaaaccagag

SEQ ID NO: 3957993 - RNA, 12 nt, Human herpesvirus 2
cgcccgccccag

SEQ ID NO: 3957994 - RNA, 13 nt, Human herpesvirus 2
cgcccgccccugc

SEQ ID NO: 3957995 - RNA, 15 nt, Human herpesvirus 2
cgcccgcguccgaca

SEQ ID NO: 3957996 - RNA, 16 nt, Human herpesvirus 2
cgccgacaacguccgg

SEQ ID NO: 3957997 - RNA, 15 nt, Human herpesvirus 2
cgccgacgccuuccc

SEQ ID NO: 3957998 - RNA, 19 nt, Human herpesvirus 2
cgccgccgggaaccccggc

SEQ ID NO: 3957999 - RNA, 21 nt, Human herpesvirus 2
cgccgcgcgggacccacgagg

SEQ ID NO: 3958000 - RNA, 21 nt, Human herpesvirus 2
cgccgcuacugcgccaccguc

SEQ ID NO: 3958001 - RNA, 22 nt, Human herpesvirus 2
cgccggccaaccgcgcgccgcc

SEQ ID NO: 3958002 - RNA, 19 nt, Human herpesvirus 2
cgccgggaaccccggcgug

SEQ ID NO: 3958003 - RNA, 18 nt, Human herpesvirus 2
cgccgggcgcgcggcgcg

SEQ ID NO: 3958004 - RNA, 19 nt, Human herpesvirus 2
cgccggguggcgccucugc

SEQ ID NO: 3958005 - RNA, 16 nt, Human herpesvirus 2
cgccguggacgccccc

SEQ ID NO: 3958006 - RNA, 18 nt, Human herpesvirus 2
cgccuccccgcuggagcc

SEQ ID NO: 3958007 - RNA, 21 nt, Human herpesvirus 2
cgccucccggccgccccccgu

SEQ ID NO: 3958008 - RNA, 21 nt, Human herpesvirus 2
cgccucgauguauggcgccuu

SEQ ID NO: 3958009 - RNA, 20 nt, Human herpesvirus 2
cgccuguuguuggucggguu

SEQ ID NO: 3958010 - RNA, 19 nt, Human herpesvirus 2
cgccuuccgacgcucucug

SEQ ID NO: 3958011 - RNA, 14 nt, Human herpesvirus 2
cgccuuuccucccc

SEQ ID NO: 3958012 - RNA, 16 nt, Human herpesvirus 2
cgcgacaagacccggc

SEQ ID NO: 3958013 - RNA, 16 nt, Human herpesvirus 2
cgcgaccaccaaggcc

SEQ ID NO: 3958014 - RNA, 12 nt, Human herpesvirus 2
cgcgacggcccc

SEQ ID NO: 3958015 - RNA, 23 nt, Human herpesvirus 2
cgcgaggccgcucuccgaagaga

SEQ ID NO: 3958016 - RNA, 16 nt, Human herpesvirus 2
cgcgagggccccggcc

SEQ ID NO: 3958017 - RNA, 12 nt, Human herpesvirus 2
cgcgauuccgag

SEQ ID NO: 3958018 - RNA, 12 nt, Human herpesvirus 2
cgcgcaccgcug

SEQ ID NO: 3958019 - RNA, 16 nt, Human herpesvirus 2
cgcgcaggggggccgg

SEQ ID NO: 3958020 - RNA, 13 nt, Human herpesvirus 2
cgcgccucccggg

SEQ ID NO: 3958021 - RNA, 14 nt, Human herpesvirus 2
cgcgcgcagaggga

SEQ ID NO: 3958022 - RNA, 18 nt, Human herpesvirus 2
cgcgcuaguacccagagg

SEQ ID NO: 3958023 - RNA, 18 nt, Human herpesvirus 2
cgcgcuguggcgcgcccc

SEQ ID NO: 3958024 - RNA, 22 nt, Human herpesvirus 2
cgcggaguaugaccgucggugc

SEQ ID NO: 3958025 - RNA, 21 nt, Human herpesvirus 2
cgcggccauccugcccaccgg

SEQ ID NO: 3958026 - RNA, 13 nt, Human herpesvirus 2
cgcggcggccgca

SEQ ID NO: 3958027 - RNA, 17 nt, Human herpesvirus 2
cgcgggcaggccgcggc

SEQ ID NO: 3958028 - RNA, 16 nt, Human herpesvirus 2
cgcgggcgggggcgcg

SEQ ID NO: 3958029 - RNA, 13 nt, Human herpesvirus 2
cgcgggcgucccc

SEQ ID NO: 3958030 - RNA, 23 nt, Human herpesvirus 2
cgcgggcucguguuccggccgug

SEQ ID NO: 3958031 - RNA, 23 nt, Human herpesvirus 2
cgcgggggaggcgcgcgcgcgcu

SEQ ID NO: 3958032 - RNA, 19 nt, Human herpesvirus 2
cgcggggggcacgggcccg

SEQ ID NO: 3958033 - RNA, 19 nt, Human herpesvirus 2
cgcgguggcgucggcggcc

SEQ ID NO: 3958034 - RNA, 17 nt, Human herpesvirus 2
cgcguacguggcgucgg

SEQ ID NO: 3958035 - RNA, 16 nt, Human herpesvirus 2
cgcgugcggccagccg

SEQ ID NO: 3958036 - RNA, 13 nt, Human herpesvirus 2
cgcuaccucaccc

SEQ ID NO: 3958037 - RNA, 23 nt, Human herpesvirus 2
cgcucggggguucgcgcaucucu

SEQ ID NO: 3958038 - RNA, 14 nt, Human herpesvirus 2
cgcugcggggacca

SEQ ID NO: 3958039 - RNA, 15 nt, Human herpesvirus 2
cgcuggagccccugg

SEQ ID NO: 3958040 - RNA, 15 nt, Human herpesvirus 2
cgcuggccccucugc

SEQ ID NO: 3958041 - RNA, 14 nt, Human herpesvirus 2
cgcuguggcgcgcc

SEQ ID NO: 3958042 - RNA, 13 nt, Human herpesvirus 2
cggaaagccggcc

SEQ ID NO: 3958043 - RNA, 19 nt, Human herpesvirus 2
cggaagagagcgccccgcc

SEQ ID NO: 3958044 - RNA, 13 nt, Human herpesvirus 2
cggacacggcccc

SEQ ID NO: 3958045 - RNA, 18 nt, Human herpesvirus 2
cggacacggccccgaaca

SEQ ID NO: 3958046 - RNA, 13 nt, Human herpesvirus 2
cggacccaccgca

SEQ ID NO: 3958047 - RNA, 19 nt, Human herpesvirus 2
cggacgccagcugcuggcc

SEQ ID NO: 3958048 - RNA, 22 nt, Human herpesvirus 2
cggacggccccucgcuccccgc

SEQ ID NO: 3958049 - RNA, 14 nt, Human herpesvirus 2
cggcacccccggcg

SEQ ID NO: 3958050 - RNA, 17 nt, Human herpesvirus 2
cggcagcccggaccccu

SEQ ID NO: 3958051 - RNA, 20 nt, Human herpesvirus 2
cggccaagcuaaggcgcccg

SEQ ID NO: 3958052 - RNA, 13 nt, Human herpesvirus 2
cggccaccccgcc

SEQ ID NO: 3958053 - RNA, 15 nt, Human herpesvirus 2
cggccaccccgccgc

SEQ ID NO: 3958054 - RNA, 14 nt, Human herpesvirus 2
cggccagccgcgcg

SEQ ID NO: 3958055 - RNA, 15 nt, Human herpesvirus 2
cggccauccccggcg

SEQ ID NO: 3958056 - RNA, 14 nt, Human herpesvirus 2
cggccauccugccc

SEQ ID NO: 3958057 - RNA, 22 nt, Human herpesvirus 2
cggcccgauccgaacggcgcac

SEQ ID NO: 3958058 - RNA, 10 nt, Human herpesvirus 2
cggcccgugg

SEQ ID NO: 3958059 - RNA, 12 nt, Human herpesvirus 2
cggcccugccuc

SEQ ID NO: 3958060 - RNA, 13 nt, Human herpesvirus 2
cggcccugcggcc

SEQ ID NO: 3958061 - RNA, 16 nt, Human herpesvirus 2
cggccgccauccccgc

SEQ ID NO: 3958062 - RNA, 12 nt, Human herpesvirus 2
cggccgccgcaa

SEQ ID NO: 3958063 - RNA, 19 nt, Human herpesvirus 2
cggccgcgcuaccucaccc

SEQ ID NO: 3958064 - RNA, 15 nt, Human herpesvirus 2
cggcgaccgccccgc

SEQ ID NO: 3958065 - RNA, 21 nt, Human herpesvirus 2
cggcgaccgccccgcgccggc

SEQ ID NO: 3958066 - RNA, 20 nt, Human herpesvirus 2
cggcgcacgcggugcgucgg

SEQ ID NO: 3958067 - RNA, 14 nt, Human herpesvirus 2
cggcgccgccccgc

SEQ ID NO: 3958068 - RNA, 24 nt, Human herpesvirus 2
cggcgccuaccugguacccacgga

SEQ ID NO: 3958069 - RNA, 15 nt, Human herpesvirus 2
cggcgcgagcucccu

SEQ ID NO: 3958070 - RNA, 15 nt, Human herpesvirus 2
cggcgcgggcggcgc

SEQ ID NO: 3958071 - RNA, 13 nt, Human herpesvirus 2
cggcggccccggc

SEQ ID NO: 3958072 - RNA, 13 nt, Human herpesvirus 2
cggcggcuccccc

SEQ ID NO: 3958073 - RNA, 22 nt, Human herpesvirus 2
cggcguuucugaccggcgccga

SEQ ID NO: 3958074 - RNA, 21 nt, Human herpesvirus 2
cggcucccccgacgucucggc

SEQ ID NO: 3958075 - RNA, 21 nt, Human herpesvirus 2
cggcucccccgcggccuuucc

SEQ ID NO: 3958076 - RNA, 23 nt, Human herpesvirus 2
cgggaggaaggacacgccucccu

SEQ ID NO: 3958077 - RNA, 21 nt, Human herpesvirus 2
cgggaggauguguucuccugg

SEQ ID NO: 3958078 - RNA, 22 nt, Human herpesvirus 2
cgggccguucggcaggcccgcc

SEQ ID NO: 3958079 - RNA, 15 nt, Human herpesvirus 2
cgggcgagcuggccc

SEQ ID NO: 3958080 - RNA, 17 nt, Human herpesvirus 2
cgggcgagcuggcccug

SEQ ID NO: 3958081 - RNA, 17 nt, Human herpesvirus 2
cgggcgggggucgggcg

SEQ ID NO: 3958082 - RNA, 18 nt, Human herpesvirus 2
cgggcgucugugcgccuu

SEQ ID NO: 3958083 - RNA, 16 nt, Human herpesvirus 2
cgggcugggggucccg

SEQ ID NO: 3958084 - RNA, 13 nt, Human herpesvirus 2
cggggagggacaa

SEQ ID NO: 3958085 - RNA, 20 nt, Human herpesvirus 2
cggggagggcagggccgcug

SEQ ID NO: 3958086 - RNA, 18 nt, Human herpesvirus 2
cggggcacgcggucagca

SEQ ID NO: 3958087 - RNA, 23 nt, Human herpesvirus 2
cggggcgugucuguccguugccc

SEQ ID NO: 3958088 - RNA, 22 nt, Human herpesvirus 2
cgggggaucugucgccggcgug

SEQ ID NO: 3958089 - RNA, 17 nt, Human herpesvirus 2
cgggggauggugguggg

SEQ ID NO: 3958090 - RNA, 14 nt, Human herpesvirus 2
cgggggccuggugg

SEQ ID NO: 3958091 - RNA, 21 nt, Human herpesvirus 2
cgggggucccgccucccggcc

SEQ ID NO: 3958092 - RNA, 16 nt, Human herpesvirus 2
cgggggucgggcgggc

SEQ ID NO: 3958093 - RNA, 11 nt, Human herpesvirus 2
cgggguggugg

SEQ ID NO: 3958094 - RNA, 16 nt, Human herpesvirus 2
cggguuuuuggcccug

SEQ ID NO: 3958095 - RNA, 21 nt, Human herpesvirus 2
cgguaagcagcgcguccaggu

SEQ ID NO: 3958096 - RNA, 22 nt, Human herpesvirus 2
cgguagugcaggugggccgacg

SEQ ID NO: 3958097 - RNA, 22 nt, Human herpesvirus 2
cgguauggcugcccccgcgcac

SEQ ID NO: 3958098 - RNA, 16 nt, Human herpesvirus 2
cggucaauaaagagcu

SEQ ID NO: 3958099 - RNA, 15 nt, Human herpesvirus 2
cggucaggaccaggg

SEQ ID NO: 3958100 - RNA, 17 nt, Human herpesvirus 2
cggucccuuccccacca

SEQ ID NO: 3958101 - RNA, 18 nt, Human herpesvirus 2
cgguccucaccgagccgc

SEQ ID NO: 3958102 - RNA, 14 nt, Human herpesvirus 2
cggugaucgaggug

SEQ ID NO: 3958103 - RNA, 23 nt, Human herpesvirus 2
cggugccgcuuuaccccgcggcc

SEQ ID NO: 3958104 - RNA, 17 nt, Human herpesvirus 2
cguacguucugccccgc

SEQ ID NO: 3958105 - RNA, 16 nt, Human herpesvirus 2
cgucacccccaggggg

SEQ ID NO: 3958106 - RNA, 20 nt, Human herpesvirus 2
cgucccagaauuuagccagg

SEQ ID NO: 3958107 - RNA, 13 nt, Human herpesvirus 2
cgucccgccacac

SEQ ID NO: 3958108 - RNA, 17 nt, Human herpesvirus 2
cguccggcuggcggcgc

SEQ ID NO: 3958109 - RNA, 18 nt, Human herpesvirus 2
cguccggcuggcggcgcg

SEQ ID NO: 3958110 - RNA, 21 nt, Human herpesvirus 2
cguccguauguuaauugcaau

SEQ ID NO: 3958111 - RNA, 13 nt, Human herpesvirus 2
cgucgaccgggga

SEQ ID NO: 3958112 - RNA, 17 nt, Human herpesvirus 2
cgucgaccggggacucc

SEQ ID NO: 3958113 - RNA, 21 nt, Human herpesvirus 2
cgucgccgaauacgacgccca

SEQ ID NO: 3958114 - RNA, 23 nt, Human herpesvirus 2
cgucucccgggggcgcuuggccg

SEQ ID NO: 3958115 - RNA, 16 nt, Human herpesvirus 2
cgucucgucgccgcuc

SEQ ID NO: 3958116 - RNA, 22 nt, Human herpesvirus 2
cgugcacagagccgauccggcc

SEQ ID NO: 3958117 - RNA, 21 nt, Human herpesvirus 2
cgugcgcucgcucuccgugcc

SEQ ID NO: 3958118 - RNA, 17 nt, Human herpesvirus 2
cgugcucugccacacgu

SEQ ID NO: 3958119 - RNA, 20 nt, Human herpesvirus 2
cgugcugggcgcgagccagg

SEQ ID NO: 3958120 - RNA, 21 nt, Human herpesvirus 2
cgugcugggcgcgagccaggc

SEQ ID NO: 3958121 - RNA, 14 nt, Human herpesvirus 2
cguggacgcccccu

SEQ ID NO: 3958122 - RNA, 19 nt, Human herpesvirus 2
cguggaugccggggccgug

SEQ ID NO: 3958123 - RNA, 19 nt, Human herpesvirus 2
cguggcccuccacgccgug

SEQ ID NO: 3958124 - RNA, 17 nt, Human herpesvirus 2
cguggcgccuggggacu

SEQ ID NO: 3958125 - RNA, 16 nt, Human herpesvirus 2
cgugugggaggguggc

SEQ ID NO: 3958126 - RNA, 15 nt, Human herpesvirus 2
cguucguucgcccgg

SEQ ID NO: 3958127 - RNA, 14 nt, Human herpesvirus 2
cguugcccccccgg

SEQ ID NO: 3958128 - RNA, 23 nt, Human herpesvirus 2
cuacgcguguacgcgaaggcgga

SEQ ID NO: 3958129 - RNA, 14 nt, Human herpesvirus 2
cuacuaccugggga

SEQ ID NO: 3958130 - RNA, 20 nt, Human herpesvirus 2
cucaccgagccgcugugcca

SEQ ID NO: 3958131 - RNA, 14 nt, Human herpesvirus 2
cucacggccaacga

SEQ ID NO: 3958132 - RNA, 15 nt, Human herpesvirus 2
cucagcgcggccgug

SEQ ID NO: 3958133 - RNA, 20 nt, Human herpesvirus 2
cucauacacgcgcuggcccc

SEQ ID NO: 3958134 - RNA, 23 nt, Human herpesvirus 2
cucauacacgcgcuggccccucu

SEQ ID NO: 3958135 - RNA, 14 nt, Human herpesvirus 2
cucaucgcacggcg

SEQ ID NO: 3958136 - RNA, 15 nt, Human herpesvirus 2
cucccccgcuucugg

SEQ ID NO: 3958137 - RNA, 21 nt, Human herpesvirus 2
cucccggccauccccggcgcc

SEQ ID NO: 3958138 - RNA, 13 nt, Human herpesvirus 2
cucccucgccgcc

SEQ ID NO: 3958139 - RNA, 15 nt, Human herpesvirus 2
cucccuuuuuucccc

SEQ ID NO: 3958140 - RNA, 22 nt, Human herpesvirus 2
cuccgcaauaaacgccuucccg

SEQ ID NO: 3958141 - RNA, 14 nt, Human herpesvirus 2
cuccgccagcgccc

SEQ ID NO: 3958142 - RNA, 11 nt, Human herpesvirus 2
cuccgcccucg

SEQ ID NO: 3958143 - RNA, 19 nt, Human herpesvirus 2
cuccggagaacccccugcc

SEQ ID NO: 3958144 - RNA, 17 nt, Human herpesvirus 2
cuccggucccuucccca

SEQ ID NO: 3958145 - RNA, 23 nt, Human herpesvirus 2
cuccggucccuuccccaccacca

SEQ ID NO: 3958146 - RNA, 14 nt, Human herpesvirus 2
cucgccgcuguggc

SEQ ID NO: 3958147 - RNA, 15 nt, Human herpesvirus 2
cucgcgucgggccag

SEQ ID NO: 3958148 - RNA, 15 nt, Human herpesvirus 2
cucgcugcucucccg

SEQ ID NO: 3958149 - RNA, 19 nt, Human herpesvirus 2
cucgcuguuuuuuuucucu

SEQ ID NO: 3958150 - RNA, 21 nt, Human herpesvirus 2
cucggcuugauggagccugcg

SEQ ID NO: 3958151 - RNA, 16 nt, Human herpesvirus 2
cucgggcggcguggcc

SEQ ID NO: 3958152 - RNA, 15 nt, Human herpesvirus 2
cucguaggcccgggg

SEQ ID NO: 3958153 - RNA, 13 nt, Human herpesvirus 2
cucucgaucccga

SEQ ID NO: 3958154 - RNA, 19 nt, Human herpesvirus 2
cucucggugaucuuggcgu

SEQ ID NO: 3958155 - RNA, 18 nt, Human herpesvirus 2
cucuggcuccaggccgcc

SEQ ID NO: 3958156 - RNA, 16 nt, Human herpesvirus 2
cucuggugucggccgc

SEQ ID NO: 3958157 - RNA, 17 nt, Human herpesvirus 2
cucuuccccccccccca

SEQ ID NO: 3958158 - RNA, 14 nt, Human herpesvirus 2
cucuucuuccccca

SEQ ID NO: 3958159 - RNA, 22 nt, Human herpesvirus 2
cugaaccgcuggcuggagaccg

SEQ ID NO: 3958160 - RNA, 19 nt, Human herpesvirus 2
cugaauuucccgcagaacc

SEQ ID NO: 3958161 - RNA, 23 nt, Human herpesvirus 2
cugacccucucgggcaugggcua

SEQ ID NO: 3958162 - RNA, 18 nt, Human herpesvirus 2
cugacgccggccaaccuc

SEQ ID NO: 3958163 - RNA, 21 nt, Human herpesvirus 2
cugaggccucauccggcccgc

SEQ ID NO: 3958164 - RNA, 22 nt, Human herpesvirus 2
cugcacgucggacgccagcugc

SEQ ID NO: 3958165 - RNA, 21 nt, Human herpesvirus 2
cugcacuugcccccccccggg

SEQ ID NO: 3958166 - RNA, 19 nt, Human herpesvirus 2
cugcagaugcugcccgcgg

SEQ ID NO: 3958167 - RNA, 17 nt, Human herpesvirus 2
cugccccccggcgcggg

SEQ ID NO: 3958168 - RNA, 15 nt, Human herpesvirus 2
cugcccgaccgggcg

SEQ ID NO: 3958169 - RNA, 14 nt, Human herpesvirus 2
cugcccgcggacca

SEQ ID NO: 3958170 - RNA, 22 nt, Human herpesvirus 2
cugccgacuuccgugccccugg

SEQ ID NO: 3958171 - RNA, 17 nt, Human herpesvirus 2
cugccgccgcgggagga

SEQ ID NO: 3958172 - RNA, 16 nt, Human herpesvirus 2
cugccucccccccgga

SEQ ID NO: 3958173 - RNA, 17 nt, Human herpesvirus 2
cugccucccccccggag

SEQ ID NO: 3958174 - RNA, 15 nt, Human herpesvirus 2
cugcgaggugcgcca

SEQ ID NO: 3958175 - RNA, 22 nt, Human herpesvirus 2
cugcgcagguccgagacggcca

SEQ ID NO: 3958176 - RNA, 23 nt, Human herpesvirus 2
cugcgcauggccugcgaggugcg

SEQ ID NO: 3958177 - RNA, 13 nt, Human herpesvirus 2
cugcgcgagccgu

SEQ ID NO: 3958178 - RNA, 16 nt, Human herpesvirus 2
cugcgcgcgcaccugc

SEQ ID NO: 3958179 - RNA, 12 nt, Human herpesvirus 2
cugcugagcccu

SEQ ID NO: 3958180 - RNA, 16 nt, Human herpesvirus 2
cugcugggccauggau

SEQ ID NO: 3958181 - RNA, 15 nt, Human herpesvirus 2
cuggacgggaguucc

SEQ ID NO: 3958182 - RNA, 23 nt, Human herpesvirus 2
cuggccgagcguaucggccagga

SEQ ID NO: 3958183 - RNA, 20 nt, Human herpesvirus 2
cuggccguccggggggacgc

SEQ ID NO: 3958184 - RNA, 13 nt, Human herpesvirus 2
cuggcggcgcggc

SEQ ID NO: 3958185 - RNA, 13 nt, Human herpesvirus 2
cuggcgggagcca

SEQ ID NO: 3958186 - RNA, 15 nt, Human herpesvirus 2
cuggcguccccaggc

SEQ ID NO: 3958187 - RNA, 20 nt, Human herpesvirus 2
cuggcugcggggggcggugg

SEQ ID NO: 3958188 - RNA, 20 nt, Human herpesvirus 2
cuggcuguguuugucugucg

SEQ ID NO: 3958189 - RNA, 13 nt, Human herpesvirus 2
cugggcccgccga

SEQ ID NO: 3958190 - RNA, 18 nt, Human herpesvirus 2
cugggccgcucguuccuc

SEQ ID NO: 3958191 - RNA, 21 nt, Human herpesvirus 2
cugggggcggggggugggagg

SEQ ID NO: 3958192 - RNA, 21 nt, Human herpesvirus 2
cuggucacaaaaggcacggcg

SEQ ID NO: 3958193 - RNA, 17 nt, Human herpesvirus 2
cugguuuuucugggggu

SEQ ID NO: 3958194 - RNA, 12 nt, Human herpesvirus 2
cuguaucugguc

SEQ ID NO: 3958195 - RNA, 13 nt, Human herpesvirus 2
cugucggccgcgg

SEQ ID NO: 3958196 - RNA, 21 nt, Human herpesvirus 2
cugugccagguggcccuuccg

SEQ ID NO: 3958197 - RNA, 17 nt, Human herpesvirus 2
cugugcgccuuuaagac

SEQ ID NO: 3958198 - RNA, 14 nt, Human herpesvirus 2
cugugcggcccucu

SEQ ID NO: 3958199 - RNA, 12 nt, Human herpesvirus 2
cuguuggagccg

SEQ ID NO: 3958200 - RNA, 15 nt, Human herpesvirus 2
cuguuguuguuucug

SEQ ID NO: 3958201 - RNA, 20 nt, Human herpesvirus 2
cuguuuccuuuccuuucccc

SEQ ID NO: 3958202 - RNA, 14 nt, Human herpesvirus 2
cuucccccccccua

SEQ ID NO: 3958203 - RNA, 20 nt, Human herpesvirus 2
cuuccgaccgacgggccccc

SEQ ID NO: 3958204 - RNA, 17 nt, Human herpesvirus 2
cuucgcggcggccgcac

SEQ ID NO: 3958205 - RNA, 20 nt, Human herpesvirus 2
cuucgucguagaucgggucc

SEQ ID NO: 3958206 - RNA, 18 nt, Human herpesvirus 2
cuugauuuacgagggggc

SEQ ID NO: 3958207 - RNA, 20 nt, Human herpesvirus 2
cuuggaggcccucugggaca

SEQ ID NO: 3958208 - RNA, 15 nt, Human herpesvirus 2
cuuggugcgccgccg

SEQ ID NO: 3958209 - RNA, 16 nt, Human herpesvirus 2
cuuuccccccccccuc

SEQ ID NO: 3958210 - RNA, 13 nt, Human herpesvirus 2
cuuucccccccuc

SEQ ID NO: 3958211 - RNA, 21 nt, Human herpesvirus 2
cuuuccgugcuucgggacccg

SEQ ID NO: 3958212 - RNA, 14 nt, Human herpesvirus 2
cuuuccuuuccccc

SEQ ID NO: 3958213 - RNA, 14 nt, Human herpesvirus 2
cuuugacuccuggg

SEQ ID NO: 3958214 - RNA, 14 nt, Human herpesvirus 2
cuuuuccgccgccg

SEQ ID NO: 3958215 - RNA, 15 nt, Human herpesvirus 2
cuuuuucucuucccc

SEQ ID NO: 3958216 - RNA, 21 nt, Human herpesvirus 2
gaaacacgguggcgcgcuggc

SEQ ID NO: 3958217 - RNA, 15 nt, Human herpesvirus 2
gaaacgaugaaggac

SEQ ID NO: 3958218 - RNA, 14 nt, Human herpesvirus 2
gaaacuuccgggag

SEQ ID NO: 3958219 - RNA, 21 nt, Human herpesvirus 2
gaaagaaacacaaggccccga

SEQ ID NO: 3958220 - RNA, 20 nt, Human herpesvirus 2
gaaagacaugauagagggaa

SEQ ID NO: 3958221 - RNA, 16 nt, Human herpesvirus 2
gaacagccccuggggc

SEQ ID NO: 3958222 - RNA, 22 nt, Human herpesvirus 2
gaacagcucgcggacgagcccg

SEQ ID NO: 3958223 - RNA, 19 nt, Human herpesvirus 2
gaacccccagacgaccauc

SEQ ID NO: 3958224 - RNA, 15 nt, Human herpesvirus 2
gaaccccucuggggu

SEQ ID NO: 3958225 - RNA, 23 nt, Human herpesvirus 2
gaaccgcuggcuggagaccgagc

SEQ ID NO: 3958226 - RNA, 16 nt, Human herpesvirus 2
gaaccgguagccgggg

SEQ ID NO: 3958227 - RNA, 19 nt, Human herpesvirus 2
gaaccgguagccggggcac

SEQ ID NO: 3958228 - RNA, 15 nt, Human herpesvirus 2
gaacggucuccgcca

SEQ ID NO: 3958229 - RNA, 24 nt, Human herpesvirus 2
gaacgugguguugggcgccggcca

SEQ ID NO: 3958230 - RNA, 23 nt, Human herpesvirus 2
gaacucgcccgccguuggggaua

SEQ ID NO: 3958231 - RNA, 15 nt, Human herpesvirus 2
gaacugauugccauc

SEQ ID NO: 3958232 - RNA, 16 nt, Human herpesvirus 2
gacacacacacaggcc

SEQ ID NO: 3958233 - RNA, 20 nt, Human herpesvirus 2
gacacgcaacaacggcgggc

SEQ ID NO: 3958234 - RNA, 14 nt, Human herpesvirus 2
gacagacgcggcga

SEQ ID NO: 3958235 - RNA, 17 nt, Human herpesvirus 2
gacagcggggacccggg

SEQ ID NO: 3958236 - RNA, 14 nt, Human herpesvirus 2
gacaucaaccaccu

SEQ ID NO: 3958237 - RNA, 16 nt, Human herpesvirus 2
gacaucaaccaccuuc

SEQ ID NO: 3958238 - RNA, 19 nt, Human herpesvirus 2
gacauguuacaccccccug

SEQ ID NO: 3958239 - RNA, 18 nt, Human herpesvirus 2
gaccaccccaaaaaccgc

SEQ ID NO: 3958240 - RNA, 20 nt, Human herpesvirus 2
gaccacccuaaggaugcccg

SEQ ID NO: 3958241 - RNA, 21 nt, Human herpesvirus 2
gaccacgcgcacgucgggggg

SEQ ID NO: 3958242 - RNA, 18 nt, Human herpesvirus 2
gaccagggaggccagaaa

SEQ ID NO: 3958243 - RNA, 19 nt, Human herpesvirus 2
gacccaccgcaccaccaua

SEQ ID NO: 3958244 - RNA, 16 nt, Human herpesvirus 2
gacccaccgcccccgc

SEQ ID NO: 3958245 - RNA, 14 nt, Human herpesvirus 2
gacccagucgccca

SEQ ID NO: 3958246 - RNA, 19 nt, Human herpesvirus 2
gacccugccccccggcgcg

SEQ ID NO: 3958247 - RNA, 11 nt, Human herpesvirus 2
gaccgcccccc

SEQ ID NO: 3958248 - RNA, 16 nt, Human herpesvirus 2
gaccgccccgcgccgg

SEQ ID NO: 3958249 - RNA, 14 nt, Human herpesvirus 2
gaccgccggcccca

SEQ ID NO: 3958250 - RNA, 17 nt, Human herpesvirus 2
gaccgccugccccgcgg

SEQ ID NO: 3958251 - RNA, 21 nt, Human herpesvirus 2
gaccgcugucgcccccgucug

SEQ ID NO: 3958252 - RNA, 21 nt, Human herpesvirus 2
gaccggcccccggaguccccc

SEQ ID NO: 3958253 - RNA, 13 nt, Human herpesvirus 2
gaccggcggggcc

SEQ ID NO: 3958254 - RNA, 15 nt, Human herpesvirus 2
gaccgucgccgccgg

SEQ ID NO: 3958255 - RNA, 17 nt, Human herpesvirus 2
gaccgucgccgccggcc

SEQ ID NO: 3958256 - RNA, 19 nt, Human herpesvirus 2
gaccgucuuugggccccgc

SEQ ID NO: 3958257 - RNA, 22 nt, Human herpesvirus 2
gaccuccccgugcgugcugcug

SEQ ID NO: 3958258 - RNA, 18 nt, Human herpesvirus 2
gaccugccccggcgcguc

SEQ ID NO: 3958259 - RNA, 14 nt, Human herpesvirus 2
gacgaggccuuccc

SEQ ID NO: 3958260 - RNA, 13 nt, Human herpesvirus 2
gacgcccgcgagc

SEQ ID NO: 3958261 - RNA, 22 nt, Human herpesvirus 2
gacgccucgauguauggcgccu

SEQ ID NO: 3958262 - RNA, 14 nt, Human herpesvirus 2
gacgcgaggcgcgg

SEQ ID NO: 3958263 - RNA, 13 nt, Human herpesvirus 2
gacgcucucugcc

SEQ ID NO: 3958264 - RNA, 22 nt, Human herpesvirus 2
gacgcuguuguuucugggcccg

SEQ ID NO: 3958265 - RNA, 16 nt, Human herpesvirus 2
gacggccccggccgcc

SEQ ID NO: 3958266 - RNA, 21 nt, Human herpesvirus 2
gacgggcgccacgguggugca

SEQ ID NO: 3958267 - RNA, 17 nt, Human herpesvirus 2
gacgucacgcccgucag

SEQ ID NO: 3958268 - RNA, 22 nt, Human herpesvirus 2
gacucgccuuugguuaaacaau

SEQ ID NO: 3958269 - RNA, 21 nt, Human herpesvirus 2
gacugauucucaccuggggcu

SEQ ID NO: 3958270 - RNA, 20 nt, Human herpesvirus 2
gacugggccgaugugcccug

SEQ ID NO: 3958271 - RNA, 16 nt, Human herpesvirus 2
gacuugacggucgcca

SEQ ID NO: 3958272 - RNA, 11 nt, Human herpesvirus 2
gagagcccagg

SEQ ID NO: 3958273 - RNA, 15 nt, Human herpesvirus 2
gagccccgcgaccac

SEQ ID NO: 3958274 - RNA, 16 nt, Human herpesvirus 2
gagcccugccccgccc

SEQ ID NO: 3958275 - RNA, 14 nt, Human herpesvirus 2
gagccgcgcggcca

SEQ ID NO: 3958276 - RNA, 21 nt, Human herpesvirus 2
gagccgguagugcaggugggc

SEQ ID NO: 3958277 - RNA, 21 nt, Human herpesvirus 2
gagccucuuugggccgugggu

SEQ ID NO: 3958278 - RNA, 21 nt, Human herpesvirus 2
gagcgccgucgggccccgggu

SEQ ID NO: 3958279 - RNA, 14 nt, Human herpesvirus 2
gagcugccccgcgg

SEQ ID NO: 3958280 - RNA, 18 nt, Human herpesvirus 2
gagcuuugcacgcggggu

SEQ ID NO: 3958281 - RNA, 19 nt, Human herpesvirus 2
gaggauguguucuccugga

SEQ ID NO: 3958282 - RNA, 15 nt, Human herpesvirus 2
gaggcgccucugccc

SEQ ID NO: 3958283 - RNA, 18 nt, Human herpesvirus 2
gaggggcuuggccuuccc

SEQ ID NO: 3958284 - RNA, 19 nt, Human herpesvirus 2
gagggggggaaagaaagag

SEQ ID NO: 3958285 - RNA, 17 nt, Human herpesvirus 2
gaggugcgccaggucag

SEQ ID NO: 3958286 - RNA, 18 nt, Human herpesvirus 2
gaguugcgccggcaccag

SEQ ID NO: 3958287 - RNA, 13 nt, Human herpesvirus 2
gauccaggggagg

SEQ ID NO: 3958288 - RNA, 15 nt, Human herpesvirus 2
gauccccggggggag

SEQ ID NO: 3958289 - RNA, 20 nt, Human herpesvirus 2
gaucccgaagccaucugaag

SEQ ID NO: 3958290 - RNA, 16 nt, Human herpesvirus 2
gaucgacgacgccugg

SEQ ID NO: 3958291 - RNA, 16 nt, Human herpesvirus 2
gaucgccagccgcggu

SEQ ID NO: 3958292 - RNA, 16 nt, Human herpesvirus 2
gaugaccucccggccc

SEQ ID NO: 3958293 - RNA, 24 nt, Human herpesvirus 2
gaugaccucccggcccgccgacca

SEQ ID NO: 3958294 - RNA, 18 nt, Human herpesvirus 2
gaugacggcaauaaaaga

SEQ ID NO: 3958295 - RNA, 19 nt, Human herpesvirus 2
gaugauaacgacgaccacc

SEQ ID NO: 3958296 - RNA, 17 nt, Human herpesvirus 2
gaugcgacgccgccccu

SEQ ID NO: 3958297 - RNA, 22 nt, Human herpesvirus 2
gauggggacgacgggcgccccc

SEQ ID NO: 3958298 - RNA, 21 nt, Human herpesvirus 2
gaugggggggaagggaggagg

SEQ ID NO: 3958299 - RNA, 16 nt, Human herpesvirus 2
gauguguucuccugga

SEQ ID NO: 3958300 - RNA, 21 nt, Human herpesvirus 2
gauuccggugugccccacccc

SEQ ID NO: 3958301 - RNA, 11 nt, Human herpesvirus 2
gauuuccccag

SEQ ID NO: 3958302 - RNA, 22 nt, Human herpesvirus 2
gcaacgggugguggccgaacgc

SEQ ID NO: 3958303 - RNA, 14 nt, Human herpesvirus 2
gcaagagccugccg

SEQ ID NO: 3958304 - RNA, 18 nt, Human herpesvirus 2
gcaagcgggcgggguggg

SEQ ID NO: 3958305 - RNA, 12 nt, Human herpesvirus 2
gcaauaaaagaa

SEQ ID NO: 3958306 - RNA, 17 nt, Human herpesvirus 2
gcacccaccggccccgc

SEQ ID NO: 3958307 - RNA, 17 nt, Human herpesvirus 2
gcacccgggccggguga

SEQ ID NO: 3958308 - RNA, 14 nt, Human herpesvirus 2
gcacccucgcacgu

SEQ ID NO: 3958309 - RNA, 13 nt, Human herpesvirus 2
gcaccgcuguccc

SEQ ID NO: 3958310 - RNA, 21 nt, Human herpesvirus 2
gcaccggacgcgcacgugggg

SEQ ID NO: 3958311 - RNA, 18 nt, Human herpesvirus 2
gcaccugcagaugcugcc

SEQ ID NO: 3958312 - RNA, 20 nt, Human herpesvirus 2
gcacgcgcgacugccuccac

SEQ ID NO: 3958313 - RNA, 22 nt, Human herpesvirus 2
gcacgcgcgcaggcuggagcuc

SEQ ID NO: 3958314 - RNA, 17 nt, Human herpesvirus 2
ugcgacggcgucucccg

SEQ ID NO: 3958315 - RNA, 18 nt, Human herpesvirus 2
ugcgacggcgucucccgg

SEQ ID NO: 3958316 - RNA, 19 nt, Human herpesvirus 2
ugcgacggcgucucccggg

SEQ ID NO: 3958317 - RNA, 15 nt, Human herpesvirus 2
ugcgaugacgugggu

SEQ ID NO: 3958318 - RNA, 19 nt, Human herpesvirus 2
ugcgcgagccguccgggaa

SEQ ID NO: 3958319 - RNA, 18 nt, Human herpesvirus 2
ugcgcgcuggucgugggg

SEQ ID NO: 3958320 - RNA, 22 nt, Human herpesvirus 2
ugcguuaacacacaugcugguu

SEQ ID NO: 3958321 - RNA, 23 nt, Human herpesvirus 2
ugcguucuggcggcccuggagcg

SEQ ID NO: 3958322 - RNA, 21 nt, Human herpesvirus 2
uggacggguauaaaggccagg

SEQ ID NO: 3958323 - RNA, 20 nt, Human herpesvirus 2
uggagccaaaccccccggcc

SEQ ID NO: 3958324 - RNA, 14 nt, Human herpesvirus 2
uggagcgcuggugg

SEQ ID NO: 3958325 - RNA, 21 nt, Human herpesvirus 2
uggaggcgccucugcccgacc

SEQ ID NO: 3958326 - RNA, 20 nt, Human herpesvirus 2
uggcaaacacaccgggcugg

SEQ ID NO: 3958327 - RNA, 14 nt, Human herpesvirus 2
uggccgcgaccguc

SEQ ID NO: 3958328 - RNA, 21 nt, Human herpesvirus 2
uggccggggagggcagggccg

SEQ ID NO: 3958329 - RNA, 19 nt, Human herpesvirus 2
uggccggguuuuuggcccu

SEQ ID NO: 3958330 - RNA, 23 nt, Human herpesvirus 2
uggcgaccgucuuugggccccgc

SEQ ID NO: 3958331 - RNA, 22 nt, Human herpesvirus 2
uggcggccgccgcaacacccgg

SEQ ID NO: 3958332 - RNA, 20 nt, Human herpesvirus 2
uggcggcuggggaaagggaa

SEQ ID NO: 3958333 - RNA, 16 nt, Human herpesvirus 2
uggcgucggcggcccc

SEQ ID NO: 3958334 - RNA, 18 nt, Human herpesvirus 2
ugggauaucucacacaga

SEQ ID NO: 3958335 - RNA, 22 nt, Human herpesvirus 2
ugggccugugggucugcgccac

SEQ ID NO: 3958336 - RNA, 18 nt, Human herpesvirus 2
ugggcgcgagccaggcaa

SEQ ID NO: 3958337 - RNA, 14 nt, Human herpesvirus 2
ugggcucggcgucg

SEQ ID NO: 3958338 - RNA, 15 nt, Human herpesvirus 2
uggggaaaucuauug

SEQ ID NO: 3958339 - RNA, 19 nt, Human herpesvirus 2
uggggacgacgggcgcccc

SEQ ID NO: 3958340 - RNA, 13 nt, Human herpesvirus 2
ugggggaagagag

SEQ ID NO: 3958341 - RNA, 12 nt, Human herpesvirus 2
uggggggggucg

SEQ ID NO: 3958342 - RNA, 15 nt, Human herpesvirus 2
uggggggggugugug

SEQ ID NO: 3958343 - RNA, 23 nt, Human herpesvirus 2
uggguguggucguggugcuggcc

SEQ ID NO: 3958344 - RNA, 16 nt, Human herpesvirus 2
ugguccacccgggacg

SEQ ID NO: 3958345 - RNA, 16 nt, Human herpesvirus 2
ugguccccgagcagca

SEQ ID NO: 3958346 - RNA, 17 nt, Human herpesvirus 2
ugguccccgagcagcac

SEQ ID NO: 3958347 - RNA, 21 nt, Human herpesvirus 2
uggucgggcggacguccaggg

SEQ ID NO: 3958348 - RNA, 23 nt, Human herpesvirus 2
uggugcaguuugagcagccgcgc

SEQ ID NO: 3958349 - RNA, 13 nt, Human herpesvirus 2
uggugcgccgccg

SEQ ID NO: 3958350 - RNA, 22 nt, Human herpesvirus 2
ugguggccgaaagaaaaggaag

SEQ ID NO: 3958351 - RNA, 13 nt, Human herpesvirus 2
uggugguggggug

SEQ ID NO: 3958352 - RNA, 17 nt, Human herpesvirus 2
uguaaaacgcgggcggg

SEQ ID NO: 3958353 - RNA, 14 nt, Human herpesvirus 2
uguauucccuugcc

SEQ ID NO: 3958354 - RNA, 21 nt, Human herpesvirus 2
ugucaucguauaccagccgcc

SEQ ID NO: 3958355 - RNA, 16 nt, Human herpesvirus 2
ugucgccggcgugggu

SEQ ID NO: 3958356 - RNA, 21 nt, Human herpesvirus 2
ugucgcggggacagccccggg

SEQ ID NO: 3958357 - RNA, 21 nt, Human herpesvirus 2
ugucugagugucugguuuuuc

SEQ ID NO: 3958358 - RNA, 20 nt, Human herpesvirus 2
ugugauagcgacgacagaac

SEQ ID NO: 3958359 - RNA, 18 nt, Human herpesvirus 2
uguggcggucggccagca

SEQ ID NO: 3958360 - RNA, 16 nt, Human herpesvirus 2
ugugggggcccagguc

SEQ ID NO: 3958361 - RNA, 14 nt, Human herpesvirus 2
uguguucuccugga

SEQ ID NO: 3958362 - RNA, 18 nt, Human herpesvirus 2
uguuccggccguggccug

SEQ ID NO: 3958363 - RNA, 14 nt, Human herpesvirus 2
uguuucccccccua

SEQ ID NO: 3958364 - RNA, 15 nt, Human herpesvirus 2
uguuugugcgggugc

SEQ ID NO: 3958365 - RNA, 14 nt, Human herpesvirus 2
uguuuuucuguugu

SEQ ID NO: 3958366 - RNA, 19 nt, Human herpesvirus 2
uuagggggacgaacaggcg

SEQ ID NO: 3958367 - RNA, 18 nt, Human herpesvirus 2
uuaggucggaggggugag

SEQ ID NO: 3958368 - RNA, 14 nt, Human herpesvirus 2
uuauaagccgccgc

SEQ ID NO: 3958369 - RNA, 13 nt, Human herpesvirus 2
uuauugaccaaau

SEQ ID NO: 3958370 - RNA, 13 nt, Human herpesvirus 2
uucaucacccccg

SEQ ID NO: 3958371 - RNA, 16 nt, Human herpesvirus 2
uuccacacccccuccc

SEQ ID NO: 3958372 - RNA, 12 nt, Human herpesvirus 2
uuccccaagaga

SEQ ID NO: 3958373 - RNA, 22 nt, Human herpesvirus 2
uuccccagcacggaggaacugg

SEQ ID NO: 3958374 - RNA, 22 nt, Human herpesvirus 2
uucccuucgcgagggccccggc

SEQ ID NO: 3958375 - RNA, 18 nt, Human herpesvirus 2
uuccgggagcgggggagg

SEQ ID NO: 3958376 - RNA, 23 nt, Human herpesvirus 2
uuccucaguguuugggaaaucua

SEQ ID NO: 3958377 - RNA, 21 nt, Human herpesvirus 2
uucgcggcggccgcacccacg

SEQ ID NO: 3958378 - RNA, 19 nt, Human herpesvirus 2
uucgugugcuuguguuuuu

SEQ ID NO: 3958379 - RNA, 15 nt, Human herpesvirus 2
uucucguacccccuc

SEQ ID NO: 3958380 - RNA, 22 nt, Human herpesvirus 2
uucuucgcgggcaggccgcggc

SEQ ID NO: 3958381 - RNA, 17 nt, Human herpesvirus 2
uugagaggggggggugg

SEQ ID NO: 3958382 - RNA, 20 nt, Human herpesvirus 2
uugcgcuuuccggcccuccc

SEQ ID NO: 3958383 - RNA, 19 nt, Human herpesvirus 2
uuggacgaucccgggcccu

SEQ ID NO: 3958384 - RNA, 18 nt, Human herpesvirus 2
uuggaggcgccucugccc

SEQ ID NO: 3958385 - RNA, 18 nt, Human herpesvirus 2
uuggcaaacacaccgggc

SEQ ID NO: 3958386 - RNA, 22 nt, Human herpesvirus 2
uuggcaaacacaccgggcuggg

SEQ ID NO: 3958387 - RNA, 21 nt, Human herpesvirus 2
uugggggggguguguguuuuc

SEQ ID NO: 3958388 - RNA, 20 nt, Human herpesvirus 2
uuggucaauaaaccggggcc

SEQ ID NO: 3958389 - RNA, 22 nt, Human herpesvirus 2
uuguaaaacgcgggcgggggcg

SEQ ID NO: 3958390 - RNA, 16 nt, Human herpesvirus 2
uuucagguuccggggg

SEQ ID NO: 3958391 - RNA, 19 nt, Human herpesvirus 2
uuuccggcaacccuccucg

SEQ ID NO: 3958392 - RNA, 23 nt, Human herpesvirus 2
uuuccuccgcgggucccuuccca

SEQ ID NO: 3958393 - RNA, 18 nt, Human herpesvirus 2
uuuugucguuccuuccuc

SEQ ID NO: 3958394 - RNA, 18 nt, Human herpesvirus 2
ccgggucaccggggcgcc

SEQ ID NO: 3958395 - RNA, 15 nt, Human herpesvirus 2
ccgggucggcugucc

SEQ ID NO: 3958396 - RNA, 18 nt, Human herpesvirus 2
ccggguuauaggccacac

SEQ ID NO: 3958397 - RNA, 16 nt, Human herpesvirus 2
ccgguacgccgcggcc

SEQ ID NO: 3958398 - RNA, 15 nt, Human herpesvirus 2
ccgguaugguaauua

SEQ ID NO: 3958399 - RNA, 17 nt, Human herpesvirus 2
ccgguguucggaaccag

SEQ ID NO: 3958400 - RNA, 22 nt, Human herpesvirus 2
ccguaaacugcuuggaggcccu

SEQ ID NO: 3958401 - RNA, 15 nt, Human herpesvirus 2
ccgucccgcccgcca

SEQ ID NO: 3958402 - RNA, 22 nt, Human herpesvirus 2
ccgucgcggccgcccgcgccgc

SEQ ID NO: 3958403 - RNA, 22 nt, Human herpesvirus 2
ccgucgcuccggcucccggccc

SEQ ID NO: 3958404 - RNA, 19 nt, Human herpesvirus 2
ccgugcccccccucguucu

SEQ ID NO: 3958405 - RNA, 21 nt, Human herpesvirus 2
ccgugcugggcgcgagccagg

SEQ ID NO: 3958406 - RNA, 17 nt, Human herpesvirus 2
ccguggcggaggccugu

SEQ ID NO: 3958407 - RNA, 17 nt, Human herpesvirus 2
ccguggggccccagggc

SEQ ID NO: 3958408 - RNA, 19 nt, Human herpesvirus 2
ccguggggccccagggcuu

SEQ ID NO: 3958409 - RNA, 20 nt, Human herpesvirus 2
ccguggguacggacaccccc

SEQ ID NO: 3958410 - RNA, 15 nt, Human herpesvirus 2
ccguguaccucuggg

SEQ ID NO: 3958411 - RNA, 18 nt, Human herpesvirus 2
ccguguaccucugggccc

SEQ ID NO: 3958412 - RNA, 22 nt, Human herpesvirus 2
ccgugucgcuccccuucagccu

SEQ ID NO: 3958413 - RNA, 16 nt, Human herpesvirus 2
ccuaccugcgcgugca

SEQ ID NO: 3958414 - RNA, 16 nt, Human herpesvirus 2
ccucaaacaggccauc

SEQ ID NO: 3958415 - RNA, 15 nt, Human herpesvirus 2
ccucaccccacccca

SEQ ID NO: 3958416 - RNA, 20 nt, Human herpesvirus 2
ccucacgguccucaccgagc

SEQ ID NO: 3958417 - RNA, 13 nt, Human herpesvirus 2
ccucagcgcggcc

SEQ ID NO: 3958418 - RNA, 17 nt, Human herpesvirus 2
ccucccuuccgagcgcg

SEQ ID NO: 3958419 - RNA, 20 nt, Human herpesvirus 2
ccuccgccagcgcccuuccg

SEQ ID NO: 3958420 - RNA, 20 nt, Human herpesvirus 2
ccuccgcccuccgccagcgc

SEQ ID NO: 3958421 - RNA, 22 nt, Human herpesvirus 2
ccuccggggcuugugcccucgu

SEQ ID NO: 3958422 - RNA, 20 nt, Human herpesvirus 2
ccucuguuccuuucccuucu

SEQ ID NO: 3958423 - RNA, 23 nt, Human herpesvirus 2
ccugccguaugcuaauuaaauac

SEQ ID NO: 3958424 - RNA, 21 nt, Human herpesvirus 2
ccugcgaggugcgccagguca

SEQ ID NO: 3958425 - RNA, 21 nt, Human herpesvirus 2
ccugcgccccgacggcccaca

SEQ ID NO: 3958426 - RNA, 14 nt, Human herpesvirus 2
ccugcggcagcgcg

SEQ ID NO: 3958427 - RNA, 17 nt, Human herpesvirus 2
ccugcggcagcgcgccg

SEQ ID NO: 3958428 - RNA, 22 nt, Human herpesvirus 2
ccuggagcgccagacgggccgg

SEQ ID NO: 3958429 - RNA, 20 nt, Human herpesvirus 2
ccuggccguccggggggacg

SEQ ID NO: 3958430 - RNA, 14 nt, Human herpesvirus 2
ccuggcgcaccugc

SEQ ID NO: 3958431 - RNA, 14 nt, Human herpesvirus 2
ccugggccuguggg

SEQ ID NO: 3958432 - RNA, 18 nt, Human herpesvirus 2
ccuggguccgggggccug

SEQ ID NO: 3958433 - RNA, 19 nt, Human herpesvirus 2
ccuguccccgcccccccca

SEQ ID NO: 3958434 - RNA, 17 nt, Human herpesvirus 2
ccuguggggccugcugu

SEQ ID NO: 3958435 - RNA, 23 nt, Human herpesvirus 2
ccuguuuuuacgggccccggaca

SEQ ID NO: 3958436 - RNA, 12 nt, Human herpesvirus 2
ccuucuucgccc

SEQ ID NO: 3958437 - RNA, 17 nt, Human herpesvirus 2
ccuugugugguuuauuc

SEQ ID NO: 3958438 - RNA, 13 nt, Human herpesvirus 2
ccuuuaagacaga

SEQ ID NO: 3958439 - RNA, 19 nt, Human herpesvirus 2
ccuuuccaccccccuuccc

SEQ ID NO: 3958440 - RNA, 15 nt, Human herpesvirus 2
ccuuucccccuuccc

SEQ ID NO: 3958441 - RNA, 21 nt, Human herpesvirus 2
cgaaccuguuuuuacgggccc

SEQ ID NO: 3958442 - RNA, 17 nt, Human herpesvirus 2
cgaacgggggucccgcc

SEQ ID NO: 3958443 - RNA, 15 nt, Human herpesvirus 2
cgacaacguccgggc

SEQ ID NO: 3958444 - RNA, 14 nt, Human herpesvirus 2
cgacacccgggccc

SEQ ID NO: 3958445 - RNA, 13 nt, Human herpesvirus 2
cgacagcggggac

SEQ ID NO: 3958446 - RNA, 14 nt, Human herpesvirus 2
cgacagcggggacc

SEQ ID NO: 3958447 - RNA, 15 nt, Human herpesvirus 2
cgacaucaaccaccu

SEQ ID NO: 3958448 - RNA, 17 nt, Human herpesvirus 2
cgaccagcgccgggugg

SEQ ID NO: 3958449 - RNA, 15 nt, Human herpesvirus 2
cgaccgacgggcccc

SEQ ID NO: 3958450 - RNA, 18 nt, Human herpesvirus 2
cgaccgccccgcgccggc

SEQ ID NO: 3958451 - RNA, 17 nt, Human herpesvirus 2
cgaccgucuuugggccc

SEQ ID NO: 3958452 - RNA, 18 nt, Human herpesvirus 2
cgacgcaaccuccggggc

SEQ ID NO: 3958453 - RNA, 13 nt, Human herpesvirus 2
cgacgccuggcgg

SEQ ID NO: 3958454 - RNA, 21 nt, Human herpesvirus 2
cgacgcgcgcgcccccgaccc

SEQ ID NO: 3958455 - RNA, 20 nt, Human herpesvirus 2
cgagagcgccgucgggcccc

SEQ ID NO: 3958456 - RNA, 17 nt, Human herpesvirus 2
cgagcccguggcccacg

SEQ ID NO: 3958457 - RNA, 19 nt, Human herpesvirus 2
cgagcucccugcggcuggc

SEQ ID NO: 3958458 - RNA, 13 nt, Human herpesvirus 2
cgagcuggcccug

SEQ ID NO: 3958459 - RNA, 15 nt, Human herpesvirus 2
cgagggcgagcucgg

SEQ ID NO: 3958460 - RNA, 21 nt, Human herpesvirus 2
cgaggugucccgccugugugc

SEQ ID NO: 3958461 - RNA, 14 nt, Human herpesvirus 2
cgaucgugcugcgc

SEQ ID NO: 3958462 - RNA, 13 nt, Human herpesvirus 2
cgaugggagcccc

SEQ ID NO: 3958463 - RNA, 15 nt, Human herpesvirus 2
cgcaccccaccccug

SEQ ID NO: 3958464 - RNA, 14 nt, Human herpesvirus 2
cgcacccuugcccg

SEQ ID NO: 3958465 - RNA, 15 nt, Human herpesvirus 2
cgcacgcggggaccc

SEQ ID NO: 3958466 - RNA, 21 nt, Human herpesvirus 2
cgcacucccgaaaccgcaggc

SEQ ID NO: 3958467 - RNA, 14 nt, Human herpesvirus 2
cgcagaccaccucg

SEQ ID NO: 3958468 - RNA, 12 nt, Human herpesvirus 2
cgcagcguccgg

SEQ ID NO: 3958469 - RNA, 22 nt, Human herpesvirus 2
cgcaggaacguguugaccugcu

SEQ ID NO: 3958470 - RNA, 21 nt, Human herpesvirus 2
cgcaggcuggagcucugccug

SEQ ID NO: 3958471 - RNA, 19 nt, Human herpesvirus 2
cgcagucuggucgaggugg

SEQ ID NO: 3958472 - RNA, 20 nt, Human herpesvirus 2
cgcaguuucaccgccccagc

SEQ ID NO: 3958473 - RNA, 15 nt, Human herpesvirus 2
cgcauaaagguccgg

SEQ ID NO: 3958474 - RNA, 21 nt, Human herpesvirus 2
cgcauaucgccauggaucccg

SEQ ID NO: 3958475 - RNA, 22 nt, Human herpesvirus 2
cgcaugacgacacgucccgcca

SEQ ID NO: 3958476 - RNA, 13 nt, Human herpesvirus 2
cgcaugguaauua

SEQ ID NO: 3958477 - RNA, 15 nt, Human herpesvirus 2
cgccaccguccaccu

SEQ ID NO: 3958478 - RNA, 18 nt, Human herpesvirus 2
cgccacgguggugcaguu

SEQ ID NO: 3958479 - RNA, 14 nt, Human herpesvirus 2
cgccagcugcuggc

SEQ ID NO: 3958480 - RNA, 14 nt, Human herpesvirus 2
cgccaggccccccg

SEQ ID NO: 3958481 - RNA, 21 nt, Human herpesvirus 2
cgccaugcaacgccgggcgcg

SEQ ID NO: 3958482 - RNA, 20 nt, Human herpesvirus 2
cgccauuucaaauaaaaggc

SEQ ID NO: 3958483 - RNA, 14 nt, Human herpesvirus 2
cgcccaacccgagc

SEQ ID NO: 3958484 - RNA, 17 nt, Human herpesvirus 2
cgcccaagcggcccgag

SEQ ID NO: 3958485 - RNA, 16 nt, Human herpesvirus 2
cgcccccacccccgag

SEQ ID NO: 3958486 - RNA, 15 nt, Human herpesvirus 2
cgcccccgacccggg

SEQ ID NO: 3958487 - RNA, 16 nt, Human herpesvirus 2
cgcccccgcggccucc

SEQ ID NO: 3958488 - RNA, 13 nt, Human herpesvirus 2
cgcccccgcuggc

SEQ ID NO: 3958489 - RNA, 17 nt, Human herpesvirus 2
cgcccccgcuggcggga

SEQ ID NO: 3958490 - RNA, 15 nt, Human herpesvirus 2
cgcccccgugccugu

SEQ ID NO: 3958491 - RNA, 15 nt, Human herpesvirus 2
cgccccgcgccggcu

SEQ ID NO: 3958492 - RNA, 19 nt, Human herpesvirus 2
cgccccgcgccggcuuccc

SEQ ID NO: 3958493 - RNA, 14 nt, Human herpesvirus 2
cgcccgccgcccuc

SEQ ID NO: 3958494 - RNA, 23 nt, Human herpesvirus 2
cgcccgcgugccgcagaccaccu

SEQ ID NO: 3958495 - RNA, 18 nt, Human herpesvirus 2
cgcccggagcggugggga

SEQ ID NO: 3958496 - RNA, 20 nt, Human herpesvirus 2
cgcccgggugaccacgcgca

SEQ ID NO: 3958497 - RNA, 22 nt, Human herpesvirus 2
cgcccucgagaugugccuucca

SEQ ID NO: 3958498 - RNA, 18 nt, Human herpesvirus 2
cgcccuuccgcguccgcg

SEQ ID NO: 3958499 - RNA, 12 nt, Human herpesvirus 2
cgccgccccgac

SEQ ID NO: 3958500 - RNA, 14 nt, Human herpesvirus 2
cgccgcgcgggccc

SEQ ID NO: 3958501 - RNA, 18 nt, Human herpesvirus 2
cgccgcgggggaggcgcg

SEQ ID NO: 3958502 - RNA, 20 nt, Human herpesvirus 2
cgccgcgggggaggcgcgcg

SEQ ID NO: 3958503 - RNA, 18 nt, Human herpesvirus 2
cgccgcuguggcccuggc

SEQ ID NO: 3958504 - RNA, 19 nt, Human herpesvirus 2
cgccggccaaccgcgcgcc

SEQ ID NO: 3958505 - RNA, 21 nt, Human herpesvirus 2
cgccggccaaccgcgcgccgc

SEQ ID NO: 3958506 - RNA, 19 nt, Human herpesvirus 2
cgccguggcggaggccugu

SEQ ID NO: 3958507 - RNA, 23 nt, Human herpesvirus 2
cgccucgauguauggcgccuucu

SEQ ID NO: 3958508 - RNA, 18 nt, Human herpesvirus 2
cgccucgggggcaggggg

SEQ ID NO: 3958509 - RNA, 17 nt, Human herpesvirus 2
cgccucugcccgaccgg

SEQ ID NO: 3958510 - RNA, 13 nt, Human herpesvirus 2
cgcgacacgcgcc

SEQ ID NO: 3958511 - RNA, 17 nt, Human herpesvirus 2
gcacccccggaccccgc

SEQ ID NO: 3958512 - RNA, 18 nt, Human herpesvirus 2
gcacgcgcgcaggcugga

SEQ ID NO: 3958513 - RNA, 22 nt, Human herpesvirus 2
gcacgcggggacccgccagaga

SEQ ID NO: 3958514 - RNA, 14 nt, Human herpesvirus 2
gcacgcggugcguc

SEQ ID NO: 3958515 - RNA, 13 nt, Human herpesvirus 2
gcacggaggaacu

SEQ ID NO: 3958516 - RNA, 21 nt, Human herpesvirus 2
gcagacgcguauucaccgacc

SEQ ID NO: 3958517 - RNA, 16 nt, Human herpesvirus 2
gcagagagauuucccc

SEQ ID NO: 3958518 - RNA, 15 nt, Human herpesvirus 2
gcagcacggcggcca

SEQ ID NO: 3958519 - RNA, 15 nt, Human herpesvirus 2
gcagcgcgggcgacg

SEQ ID NO: 3958520 - RNA, 23 nt, Human herpesvirus 2
gcagcgcgggcgacgggcggcug

SEQ ID NO: 3958521 - RNA, 20 nt, Human herpesvirus 2
gcagcguaacgcacccccgg

SEQ ID NO: 3958522 - RNA, 14 nt, Human herpesvirus 2
gcagcucccccgcg

SEQ ID NO: 3958523 - RNA, 18 nt, Human herpesvirus 2
gcaggcgcgccaccgccc

SEQ ID NO: 3958524 - RNA, 19 nt, Human herpesvirus 2
gcaggcguguugggaaggg

SEQ ID NO: 3958525 - RNA, 19 nt, Human herpesvirus 2
gcaggcuggagcucugccu

SEQ ID NO: 3958526 - RNA, 21 nt, Human herpesvirus 2
gcagggccgcugggggggcgg

SEQ ID NO: 3958527 - RNA, 13 nt, Human herpesvirus 2
gcaggugaugggc

SEQ ID NO: 3958528 - RNA, 15 nt, Human herpesvirus 2
gcaucacggcccacc

SEQ ID NO: 3958529 - RNA, 13 nt, Human herpesvirus 2
gcaucgggagggg

SEQ ID NO: 3958530 - RNA, 16 nt, Human herpesvirus 2
gcaugguaauuagcaa

SEQ ID NO: 3958531 - RNA, 15 nt, Human herpesvirus 2
gccaacagggagucc

SEQ ID NO: 3958532 - RNA, 16 nt, Human herpesvirus 2
gccaaccgcgcgccgc

SEQ ID NO: 3958533 - RNA, 17 nt, Human herpesvirus 2
gccaacgcgggcguccc

SEQ ID NO: 3958534 - RNA, 12 nt, Human herpesvirus 2
gccacccugggu

SEQ ID NO: 3958535 - RNA, 16 nt, Human herpesvirus 2
gccacgucgggguccc

SEQ ID NO: 3958536 - RNA, 17 nt, Human herpesvirus 2
gccagccgcccccgccg

SEQ ID NO: 3958537 - RNA, 22 nt, Human herpesvirus 2
gccaggaccgccugccccgcgg

SEQ ID NO: 3958538 - RNA, 23 nt, Human herpesvirus 2
gccaggagguccuggaggggggu

SEQ ID NO: 3958539 - RNA, 16 nt, Human herpesvirus 2
gccagggcuggcaccg

SEQ ID NO: 3958540 - RNA, 13 nt, Human herpesvirus 2
gccagggcuggga

SEQ ID NO: 3958541 - RNA, 22 nt, Human herpesvirus 2
gccaggucagcgaucgccagcc

SEQ ID NO: 3958542 - RNA, 13 nt, Human herpesvirus 2
gcccagcacaggc

SEQ ID NO: 3958543 - RNA, 19 nt, Human herpesvirus 2
gccccagggggcggcgccg

SEQ ID NO: 3958544 - RNA, 19 nt, Human herpesvirus 2
gcccccccuccgcgcagga

SEQ ID NO: 3958545 - RNA, 16 nt, Human herpesvirus 2
gccccccgggagccgc

SEQ ID NO: 3958546 - RNA, 23 nt, Human herpesvirus 2
gccccccgucccgagccccgcga

SEQ ID NO: 3958547 - RNA, 16 nt, Human herpesvirus 2
gcccccgcggccuccc

SEQ ID NO: 3958548 - RNA, 19 nt, Human herpesvirus 2
gcccccgcuggcgggagcc

SEQ ID NO: 3958549 - RNA, 15 nt, Human herpesvirus 2
gcccccggcccugcg

SEQ ID NO: 3958550 - RNA, 23 nt, Human herpesvirus 2
gccccgcgugcagcgcgggcgac

SEQ ID NO: 3958551 - RNA, 16 nt, Human herpesvirus 2
gccccucgcccccgcg

SEQ ID NO: 3958552 - RNA, 21 nt, Human herpesvirus 2
gccccuggugaagacgacccc

SEQ ID NO: 3958553 - RNA, 17 nt, Human herpesvirus 2
gccccuguuggagccgg

SEQ ID NO: 3958554 - RNA, 14 nt, Human herpesvirus 2
gcccgaccagcgcc

SEQ ID NO: 3958555 - RNA, 12 nt, Human herpesvirus 2
gcccgaccuguu

SEQ ID NO: 3958556 - RNA, 22 nt, Human herpesvirus 2
gcccgccccagggggcggcgcc

SEQ ID NO: 3958557 - RNA, 15 nt, Human herpesvirus 2
gcccgcccgccgccc

SEQ ID NO: 3958558 - RNA, 18 nt, Human herpesvirus 2
gcccgcgccgcgacggcc

SEQ ID NO: 3958559 - RNA, 13 nt, Human herpesvirus 2
gcccgcggaccac

SEQ ID NO: 3958560 - RNA, 15 nt, Human herpesvirus 2
gcccggccgcgacaa

SEQ ID NO: 3958561 - RNA, 13 nt, Human herpesvirus 2
gcccggcgccgcc

SEQ ID NO: 3958562 - RNA, 23 nt, Human herpesvirus 2
gcccggcgccgccccgccgcucc

SEQ ID NO: 3958563 - RNA, 16 nt, Human herpesvirus 2
gcccuccgccagcgcc

SEQ ID NO: 3958564 - RNA, 15 nt, Human herpesvirus 2
gcccuccgcuacacg

SEQ ID NO: 3958565 - RNA, 17 nt, Human herpesvirus 2
gcccucgcugcucuccc

SEQ ID NO: 3958566 - RNA, 21 nt, Human herpesvirus 2
gcccucucgaucccgaagcca

SEQ ID NO: 3958567 - RNA, 14 nt, Human herpesvirus 2
gccgaacgccucac

SEQ ID NO: 3958568 - RNA, 16 nt, Human herpesvirus 2
gccgacgaccugcagc

SEQ ID NO: 3958569 - RNA, 13 nt, Human herpesvirus 2
gccgccauccuca

SEQ ID NO: 3958570 - RNA, 22 nt, Human herpesvirus 2
gccgccauccucaaacaggcca

SEQ ID NO: 3958571 - RNA, 16 nt, Human herpesvirus 2
gccgcccaagcggccc

SEQ ID NO: 3958572 - RNA, 21 nt, Human herpesvirus 2
gccgccccgacucugugucuu

SEQ ID NO: 3958573 - RNA, 13 nt, Human herpesvirus 2
gccgccccgcagu

SEQ ID NO: 3958574 - RNA, 21 nt, Human herpesvirus 2
gccgcccgcgcaucacggccc

SEQ ID NO: 3958575 - RNA, 13 nt, Human herpesvirus 2
gccgccgaacagc

SEQ ID NO: 3958576 - RNA, 19 nt, Human herpesvirus 2
gccgccgagcgucaggccc

SEQ ID NO: 3958577 - RNA, 21 nt, Human herpesvirus 2
gccgccgagcgucaggcccgc

SEQ ID NO: 3958578 - RNA, 23 nt, Human herpesvirus 2
gccgccgagcgucaggcccgccg

SEQ ID NO: 3958579 - RNA, 15 nt, Human herpesvirus 2
gccgccggccacgcc

SEQ ID NO: 3958580 - RNA, 19 nt, Human herpesvirus 2
gccgcgacccacguccgua

SEQ ID NO: 3958581 - RNA, 15 nt, Human herpesvirus 2
gccgcgacggccccg

SEQ ID NO: 3958582 - RNA, 15 nt, Human herpesvirus 2
gccgcgccgcugccc

SEQ ID NO: 3958583 - RNA, 18 nt, Human herpesvirus 2
gccgcgcgacggccgaga

SEQ ID NO: 3958584 - RNA, 22 nt, Human herpesvirus 2
gccggccaauucuucccggagc

SEQ ID NO: 3958585 - RNA, 16 nt, Human herpesvirus 2
gccggggcggccccga

SEQ ID NO: 3958586 - RNA, 20 nt, Human herpesvirus 2
gccgggucaccggggcgccc

SEQ ID NO: 3958587 - RNA, 15 nt, Human herpesvirus 2
gccggguggcgccuc

SEQ ID NO: 3958588 - RNA, 14 nt, Human herpesvirus 2
gccgguagugcagg

SEQ ID NO: 3958589 - RNA, 18 nt, Human herpesvirus 2
gccgguagugcagguggg

SEQ ID NO: 3958590 - RNA, 20 nt, Human herpesvirus 2
gccgucgcacgcgcgcaggc

SEQ ID NO: 3958591 - RNA, 20 nt, Human herpesvirus 2
gccgucguuggucggugggu

SEQ ID NO: 3958592 - RNA, 17 nt, Human herpesvirus 2
gccguggacgcccccuc

SEQ ID NO: 3958593 - RNA, 15 nt, Human herpesvirus 2
gccuacgucugggug

SEQ ID NO: 3958594 - RNA, 12 nt, Human herpesvirus 2
gccucccaacgc

SEQ ID NO: 3958595 - RNA, 14 nt, Human herpesvirus 2
gccuccccgcugga

SEQ ID NO: 3958596 - RNA, 21 nt, Human herpesvirus 2
gccucccgcaagagccugccg

SEQ ID NO: 3958597 - RNA, 14 nt, Human herpesvirus 2
gccuccgcccuccg

SEQ ID NO: 3958598 - RNA, 16 nt, Human herpesvirus 2
gccuccgcccuccgcc

SEQ ID NO: 3958599 - RNA, 18 nt, Human herpesvirus 2
gccucgcgucgggccaga

SEQ ID NO: 3958600 - RNA, 17 nt, Human herpesvirus 2
gccucguggucgggggc

SEQ ID NO: 3958601 - RNA, 17 nt, Human herpesvirus 2
gccucuuugggccgugg

SEQ ID NO: 3958602 - RNA, 19 nt, Human herpesvirus 2
gccugccgucgcacgcgcg

SEQ ID NO: 3958603 - RNA, 16 nt, Human herpesvirus 2
gccugugggucugcgc

SEQ ID NO: 3958604 - RNA, 20 nt, Human herpesvirus 2
gccuugaacgucacgcaggc

SEQ ID NO: 3958605 - RNA, 21 nt, Human herpesvirus 2
gccuuucccguggcccuccac

SEQ ID NO: 3958606 - RNA, 22 nt, Human herpesvirus 2
gcgacacgcgcccggggcgggu

SEQ ID NO: 3958607 - RNA, 19 nt, Human herpesvirus 2
gcgaccccgauaguccccc

SEQ ID NO: 3958608 - RNA, 16 nt, Human herpesvirus 2
gcgaccgucgccgccg

SEQ ID NO: 3958609 - RNA, 19 nt, Human herpesvirus 2
gcgaccgucuuugggcccc

SEQ ID NO: 3958610 - RNA, 23 nt, Human herpesvirus 2
gcgaccgucuuugggccccgccc

SEQ ID NO: 3958611 - RNA, 15 nt, Human herpesvirus 2
gcgacgccaggcccc

SEQ ID NO: 3958612 - RNA, 15 nt, Human herpesvirus 2
gcgauccugggccug

SEQ ID NO: 3958613 - RNA, 20 nt, Human herpesvirus 2
gcgaugaccucccggcccgc

SEQ ID NO: 3958614 - RNA, 22 nt, Human herpesvirus 2
gcgcaggaucgugugcacgaaa

SEQ ID NO: 3958615 - RNA, 15 nt, Human herpesvirus 2
gcgccccgccggggc

SEQ ID NO: 3958616 - RNA, 16 nt, Human herpesvirus 2
gcgccgcgcccgcgug

SEQ ID NO: 3958617 - RNA, 17 nt, Human herpesvirus 2
gcgccgcgcccgcgugc

SEQ ID NO: 3958618 - RNA, 24 nt, Human herpesvirus 2
gcgccgcuacugcgccaccgucca

SEQ ID NO: 3958619 - RNA, 13 nt, Human herpesvirus 2
gcgccgggcagac

SEQ ID NO: 3958620 - RNA, 19 nt, Human herpesvirus 2
gcgccugcgccccgacggc

SEQ ID NO: 3958621 - RNA, 15 nt, Human herpesvirus 2
gcgcgccaccgcccg

SEQ ID NO: 3958622 - RNA, 19 nt, Human herpesvirus 2
gcgcgccccccccccacca

SEQ ID NO: 3958623 - RNA, 13 nt, Human herpesvirus 2
gcgcggacgcggc

SEQ ID NO: 3958624 - RNA, 14 nt, Human herpesvirus 2
gcgcgggcggcgcc

SEQ ID NO: 3958625 - RNA, 17 nt, Human herpesvirus 2
gcgcucauggccggaga

SEQ ID NO: 3958626 - RNA, 14 nt, Human herpesvirus 2
ggccccggccgccu

SEQ ID NO: 3958627 - RNA, 15 nt, Human herpesvirus 2
ggcccggccgccggu

SEQ ID NO: 3958628 - RNA, 14 nt, Human herpesvirus 2
ggcccggccgcgac

SEQ ID NO: 3958629 - RNA, 13 nt, Human herpesvirus 2
ggcccuccacgcc

SEQ ID NO: 3958630 - RNA, 21 nt, Human herpesvirus 2
ggccgagcguaucggccagga

SEQ ID NO: 3958631 - RNA, 22 nt, Human herpesvirus 2
ggccgcagggauaggggcaggc

SEQ ID NO: 3958632 - RNA, 14 nt, Human herpesvirus 2
ggccgcccccagca

SEQ ID NO: 3958633 - RNA, 19 nt, Human herpesvirus 2
ggccgccgcaacacccggc

SEQ ID NO: 3958634 - RNA, 23 nt, Human herpesvirus 2
ggccgccgcaacacccggcgcca

SEQ ID NO: 3958635 - RNA, 16 nt, Human herpesvirus 2
ggccgcgacaagaccc

SEQ ID NO: 3958636 - RNA, 24 nt, Human herpesvirus 2
ggccgggagcguggggcgcgcacc

SEQ ID NO: 3958637 - RNA, 19 nt, Human herpesvirus 2
ggccggggagggcagggcc

SEQ ID NO: 3958638 - RNA, 13 nt, Human herpesvirus 2
ccccgggcagccg

SEQ ID NO: 3958639 - RNA, 21 nt, Human herpesvirus 2
ccccuaaccgcgcgccuccuc

SEQ ID NO: 3958640 - RNA, 16 nt, Human herpesvirus 2
ccccucccccgcuucu

SEQ ID NO: 3958641 - RNA, 17 nt, Human herpesvirus 2
cccgaacagccccuggg

SEQ ID NO: 3958642 - RNA, 19 nt, Human herpesvirus 2
cccgaauccggggcgugcu

SEQ ID NO: 3958643 - RNA, 14 nt, Human herpesvirus 2
cccgagagcccagg

SEQ ID NO: 3958644 - RNA, 18 nt, Human herpesvirus 2
cccgcccccgacgggcgc

SEQ ID NO: 3958645 - RNA, 16 nt, Human herpesvirus 2
cccgccucccggccgc

SEQ ID NO: 3958646 - RNA, 17 nt, Human herpesvirus 2
cccgcgccucgggcggc

SEQ ID NO: 3958647 - RNA, 20 nt, Human herpesvirus 2
cccgcguauauauccgcgag

SEQ ID NO: 3958648 - RNA, 20 nt, Human herpesvirus 2
cccgcguccgacacccgggc

SEQ ID NO: 3958649 - RNA, 20 nt, Human herpesvirus 2
cccgcgugccgcagaccacc

SEQ ID NO: 3958650 - RNA, 17 nt, Human herpesvirus 2
cccgcgugccuggccgc

SEQ ID NO: 3958651 - RNA, 14 nt, Human herpesvirus 2
cccggcccgggccc

SEQ ID NO: 3958652 - RNA, 21 nt, Human herpesvirus 2
cccggccgcucgcugcagggc

SEQ ID NO: 3958653 - RNA, 14 nt, Human herpesvirus 2
cccggcguggagcg

SEQ ID NO: 3958654 - RNA, 12 nt, Human herpesvirus 2
cccgggcacgcg

SEQ ID NO: 3958655 - RNA, 20 nt, Human herpesvirus 2
cccggggcccucgagaugcg

SEQ ID NO: 3958656 - RNA, 21 nt, Human herpesvirus 2
cccggggcggguaggccagag

SEQ ID NO: 3958657 - RNA, 15 nt, Human herpesvirus 2
cccggggggggccuc

SEQ ID NO: 3958658 - RNA, 19 nt, Human herpesvirus 2
cccggucccccggaccccg

SEQ ID NO: 3958659 - RNA, 16 nt, Human herpesvirus 2
cccgugugggagggug

SEQ ID NO: 3958660 - RNA, 13 nt, Human herpesvirus 2
cccucaccccacc

SEQ ID NO: 3958661 - RNA, 16 nt, Human herpesvirus 2
cccucaccccacccca

SEQ ID NO: 3958662 - RNA, 20 nt, Human herpesvirus 2
cccuccucgcugcgccgggc

SEQ ID NO: 3958663 - RNA, 14 nt, Human herpesvirus 2
cccucgcugcucuc

SEQ ID NO: 3958664 - RNA, 19 nt, Human herpesvirus 2
cccucguucugcugcaccg

SEQ ID NO: 3958665 - RNA, 14 nt, Human herpesvirus 2
cccuguuggagccg

SEQ ID NO: 3958666 - RNA, 15 nt, Human herpesvirus 2
cccuguuggagccgg

SEQ ID NO: 3958667 - RNA, 15 nt, Human herpesvirus 2
cccuugcccgcuucc

SEQ ID NO: 3958668 - RNA, 14 nt, Human herpesvirus 2
ccgaagcggccccg

SEQ ID NO: 3958669 - RNA, 20 nt, Human herpesvirus 2
ccgaaggaggaaaguggggg

SEQ ID NO: 3958670 - RNA, 17 nt, Human herpesvirus 2
ccgacccuguggcgggc

SEQ ID NO: 3958671 - RNA, 15 nt, Human herpesvirus 2
ccgaccgggcggugc

SEQ ID NO: 3958672 - RNA, 18 nt, Human herpesvirus 2
ccgacgacgugcgcgugg

SEQ ID NO: 3958673 - RNA, 15 nt, Human herpesvirus 2
ccgacgcgaggcgcg

SEQ ID NO: 3958674 - RNA, 17 nt, Human herpesvirus 2
ccgacggcggggccccg

SEQ ID NO: 3958675 - RNA, 15 nt, Human herpesvirus 2
ccgacguggcccgcc

SEQ ID NO: 3958676 - RNA, 16 nt, Human herpesvirus 2
ccgacuuccgugcccc

SEQ ID NO: 3958677 - RNA, 15 nt, Human herpesvirus 2
ccgagagcccaggga

SEQ ID NO: 3958678 - RNA, 15 nt, Human herpesvirus 2
ccgagcgcgggggac

SEQ ID NO: 3958679 - RNA, 17 nt, Human herpesvirus 2
ccgaguccguaugcaac

SEQ ID NO: 3958680 - RNA, 12 nt, Human herpesvirus 2
ccgaugcccagu

SEQ ID NO: 3958681 - RNA, 15 nt, Human herpesvirus 2
ccgcacccgggccgg

SEQ ID NO: 3958682 - RNA, 16 nt, Human herpesvirus 2
ccgcagaccaccucgc

SEQ ID NO: 3958683 - RNA, 22 nt, Human herpesvirus 2
ccgcagccuauguucgcgggcg

SEQ ID NO: 3958684 - RNA, 19 nt, Human herpesvirus 2
ccgcagggauaggggcagg

SEQ ID NO: 3958685 - RNA, 23 nt, Human herpesvirus 2
ccgcaguuucaccgccccagcac

SEQ ID NO: 3958686 - RNA, 22 nt, Human herpesvirus 2
ccgcauauacugcugggccaug

SEQ ID NO: 3958687 - RNA, 18 nt, Human herpesvirus 2
ccgccaacgcgcuguggc

SEQ ID NO: 3958688 - RNA, 23 nt, Human herpesvirus 2
ccgccagagacccugccccccgg

SEQ ID NO: 3958689 - RNA, 14 nt, Human herpesvirus 2
ccgccagcagucgg

SEQ ID NO: 3958690 - RNA, 13 nt, Human herpesvirus 2
ccgcccccacccc

SEQ ID NO: 3958691 - RNA, 12 nt, Human herpesvirus 2
ccgccgcccgcg

SEQ ID NO: 3958692 - RNA, 15 nt, Human herpesvirus 2
ccgccuccggcccga

SEQ ID NO: 3958693 - RNA, 21 nt, Human herpesvirus 2
ccgcgaccaccaaggcccgga

SEQ ID NO: 3958694 - RNA, 23 nt, Human herpesvirus 2
ccgcgagcgccgcuacugcgcca

SEQ ID NO: 3958695 - RNA, 13 nt, Human herpesvirus 2
ccgcgcgccgccg

SEQ ID NO: 3958696 - RNA, 16 nt, Human herpesvirus 2
ccgcggccccacgguc

SEQ ID NO: 3958697 - RNA, 22 nt, Human herpesvirus 2
ccgcgguggcgucggcggcccc

SEQ ID NO: 3958698 - RNA, 14 nt, Human herpesvirus 2
ccgcgugccgcaga

SEQ ID NO: 3958699 - RNA, 19 nt, Human herpesvirus 2
ccgcuacugcgccaccguc

SEQ ID NO: 3958700 - RNA, 20 nt, Human herpesvirus 2
ccgcugugccagguggcccu

SEQ ID NO: 3958701 - RNA, 19 nt, Human herpesvirus 2
ccgcuuuauaggacgcgcu

SEQ ID NO: 3958702 - RNA, 14 nt, Human herpesvirus 2
ccggaaccccucug

SEQ ID NO: 3958703 - RNA, 15 nt, Human herpesvirus 2
ccggagacguccuug

SEQ ID NO: 3958704 - RNA, 22 nt, Human herpesvirus 2
ccggccaaccucauccgcggcg

SEQ ID NO: 3958705 - RNA, 14 nt, Human herpesvirus 2
ccggcccaccccca

SEQ ID NO: 3958706 - RNA, 15 nt, Human herpesvirus 2
ccggcccgcgucccc

SEQ ID NO: 3958707 - RNA, 15 nt, Human herpesvirus 2
ccggcccggcccgcu

SEQ ID NO: 3958708 - RNA, 14 nt, Human herpesvirus 2
ccggccgccauccc

SEQ ID NO: 3958709 - RNA, 17 nt, Human herpesvirus 2
ccggccgccauccccgc

SEQ ID NO: 3958710 - RNA, 19 nt, Human herpesvirus 2
ccggccgcgacaagacccg

SEQ ID NO: 3958711 - RNA, 14 nt, Human herpesvirus 2
ccggcgccaugagc

SEQ ID NO: 3958712 - RNA, 16 nt, Human herpesvirus 2
ccggcggagccccgga

SEQ ID NO: 3958713 - RNA, 19 nt, Human herpesvirus 2
ccggcguggagcgccgggc

SEQ ID NO: 3958714 - RNA, 15 nt, Human herpesvirus 2
ccggcgugggugacu

SEQ ID NO: 3958715 - RNA, 12 nt, Human herpesvirus 2
ccgggcccggcc

SEQ ID NO: 3958716 - RNA, 16 nt, Human herpesvirus 2
ccgggcccggccgccg

SEQ ID NO: 3958717 - RNA, 13 nt, Human herpesvirus 2
ccgggcccuuggg

SEQ ID NO: 3958718 - RNA, 18 nt, Human herpesvirus 2
ccgggcgccggggcccca

SEQ ID NO: 3958719 - RNA, 20 nt, Human herpesvirus 2
ccgggcguuauaagccgccg

SEQ ID NO: 3958720 - RNA, 16 nt, Human herpesvirus 2
ccggggaaacaggcac

SEQ ID NO: 3958721 - RNA, 12 nt, Human herpesvirus 2
ccggggcacgcg

SEQ ID NO: 3958722 - RNA, 13 nt, Human herpesvirus 2
ccgggggccuggu

SEQ ID NO: 3958723 - RNA, 13 nt, Human herpesvirus 2
ccggggggcgugg

SEQ ID NO: 3958724 - RNA, 18 nt, Human herpesvirus 2
ccgggggggggcaagugc

SEQ ID NO: 3958725 - RNA, 21 nt, Human herpesvirus 2
ccgggggggggcaagugcagu

SEQ ID NO: 3958726 - RNA, 22 nt, Human herpesvirus 2
ccgggggggggcaagugcagua

SEQ ID NO: 3958727 - RNA, 17 nt, Human herpesvirus 2
ccggggggucggcaugc

SEQ ID NO: 3958728 - RNA, 16 nt, Human herpesvirus 2
ccgggggucgcacgcc

SEQ ID NO: 3958729 - RNA, 13 nt, Human herpesvirus 2
cgcaaccuccggg

SEQ ID NO: 3958730 - RNA, 16 nt, Human herpesvirus 2
cgcacccaccggcccc

SEQ ID NO: 3958731 - RNA, 13 nt, Human herpesvirus 2
cgcacccuugccc

SEQ ID NO: 3958732 - RNA, 14 nt, Human herpesvirus 2
cgcaccgcuguccc

SEQ ID NO: 3958733 - RNA, 14 nt, Human herpesvirus 2
cgcacgcggggacc

SEQ ID NO: 3958734 - RNA, 18 nt, Human herpesvirus 2
cgcagcguccggcuggcg

SEQ ID NO: 3958735 - RNA, 19 nt, Human herpesvirus 2
cgcaucacggcccaccugc

SEQ ID NO: 3958736 - RNA, 13 nt, Human herpesvirus 2
cgcaucgccgccg

SEQ ID NO: 3958737 - RNA, 14 nt, Human herpesvirus 2
cgcaucuacgaccc

SEQ ID NO: 3958738 - RNA, 16 nt, Human herpesvirus 2
cgccaagcgccccgcg

SEQ ID NO: 3958739 - RNA, 14 nt, Human herpesvirus 2
cgccaccggccugg

SEQ ID NO: 3958740 - RNA, 20 nt, Human herpesvirus 2
cgccagcucggacaccagca

SEQ ID NO: 3958741 - RNA, 16 nt, Human herpesvirus 2
cgccaggccccccggg

SEQ ID NO: 3958742 - RNA, 20 nt, Human herpesvirus 2
cgccauccucaaacaggcca

SEQ ID NO: 3958743 - RNA, 13 nt, Human herpesvirus 2
cgccccccccagg

SEQ ID NO: 3958744 - RNA, 16 nt, Human herpesvirus 2
cgccccccgucccgag

SEQ ID NO: 3958745 - RNA, 13 nt, Human herpesvirus 2
cgccccgccgggg

SEQ ID NO: 3958746 - RNA, 20 nt, Human herpesvirus 2
cgcccgcguccgacacccgg

SEQ ID NO: 3958747 - RNA, 13 nt, Human herpesvirus 2
cgcccgcgugccg

SEQ ID NO: 3958748 - RNA, 23 nt, Human herpesvirus 2
cgcccucgagaugugccuuccag

SEQ ID NO: 3958749 - RNA, 16 nt, Human herpesvirus 2
cgcccuucaccaacga

SEQ ID NO: 3958750 - RNA, 21 nt, Human herpesvirus 2
cgccgaccaagacucggugcg

SEQ ID NO: 3958751 - RNA, 21 nt, Human herpesvirus 2
cgccgaccgccccccccggcg

SEQ ID NO: 3958752 - RNA, 16 nt, Human herpesvirus 2
cgccgagcgucaggcc

SEQ ID NO: 3958753 - RNA, 12 nt, Human herpesvirus 2
cgccgccuuccg

SEQ ID NO: 3958754 - RNA, 22 nt, Human herpesvirus 2
cgccgcgcauuuaaggagucgc

SEQ ID NO: 3958755 - RNA, 22 nt, Human herpesvirus 2
cgccgcgggggaggcgcgcgcg

SEQ ID NO: 3958756 - RNA, 12 nt, Human herpesvirus 2
cgccggggaccg

SEQ ID NO: 3958757 - RNA, 21 nt, Human herpesvirus 2
cgccgggggcggacggccccu

SEQ ID NO: 3958758 - RNA, 14 nt, Human herpesvirus 2
cgccggucucccuc

SEQ ID NO: 3958759 - RNA, 19 nt, Human herpesvirus 2
cgccuccccgcuggagccc

SEQ ID NO: 3958760 - RNA, 23 nt, Human herpesvirus 2
cgccuuccgacgcucucugccuc

SEQ ID NO: 3958761 - RNA, 18 nt, Human herpesvirus 2
cgcgaccgaucuggagcc

SEQ ID NO: 3958762 - RNA, 20 nt, Human herpesvirus 2
cgcgaccgucgccgccggcc

SEQ ID NO: 3958763 - RNA, 13 nt, Human herpesvirus 2
cgcgagggcccgg

SEQ ID NO: 3958764 - RNA, 15 nt, Human herpesvirus 2
cgcgcaucggacccc

SEQ ID NO: 3958765 - RNA, 14 nt, Human herpesvirus 2
cgcgcgagcggccg

SEQ ID NO: 3958766 - RNA, 14 nt, Human herpesvirus 2
cgcgcgcgcgcuuc

SEQ ID NO: 3958767 - RNA, 21 nt, Human herpesvirus 2
cgcgcuuuuccgccgccggga

SEQ ID NO: 3958768 - RNA, 12 nt, Human herpesvirus 2
cgcggaccaccg

SEQ ID NO: 3958769 - RNA, 15 nt, Human herpesvirus 2
cgcggaccggccccc

SEQ ID NO: 3958770 - RNA, 21 nt, Human herpesvirus 2
cgcggacgagcccguggccca

SEQ ID NO: 3958771 - RNA, 17 nt, Human herpesvirus 2
cgcggacgccgggcggc

SEQ ID NO: 3958772 - RNA, 19 nt, Human herpesvirus 2
cgcggcgccaacgcgggcg

SEQ ID NO: 3958773 - RNA, 22 nt, Human herpesvirus 2
cgcggcgccaacgcgggcgucc

SEQ ID NO: 3958774 - RNA, 15 nt, Human herpesvirus 2
cgcgggaggcggugg

SEQ ID NO: 3958775 - RNA, 14 nt, Human herpesvirus 2
cgcgggccguggcc

SEQ ID NO: 3958776 - RNA, 17 nt, Human herpesvirus 2
cgcgggucccuucccaa

SEQ ID NO: 3958777 - RNA, 19 nt, Human herpesvirus 2
cgcgguaauuagcagcuuu

SEQ ID NO: 3958778 - RNA, 20 nt, Human herpesvirus 2
cgcgguauggcugcccccgc

SEQ ID NO: 3958779 - RNA, 17 nt, Human herpesvirus 2
cgcggugccugacgccg

SEQ ID NO: 3958780 - RNA, 13 nt, Human herpesvirus 2
cgcguccccggcc

SEQ ID NO: 3958781 - RNA, 15 nt, Human herpesvirus 2
cgcgucggugccgcu

SEQ ID NO: 3958782 - RNA, 22 nt, Human herpesvirus 2
cgcgucguccgucacgagcccc

SEQ ID NO: 3958783 - RNA, 17 nt, Human herpesvirus 2
cgcguucagacgacaga

SEQ ID NO: 3958784 - RNA, 14 nt, Human herpesvirus 2
cgcuacugcgccac

SEQ ID NO: 3958785 - RNA, 20 nt, Human herpesvirus 2
cgcuccagguacugcugcac

SEQ ID NO: 3958786 - RNA, 22 nt, Human herpesvirus 2
cgcuccagguacugcugcacgu

SEQ ID NO: 3958787 - RNA, 19 nt, Human herpesvirus 2
cgcuccgaucggggucagg

SEQ ID NO: 3958788 - RNA, 19 nt, Human herpesvirus 2
cgcuccgcccgccccaggg

SEQ ID NO: 3958789 - RNA, 14 nt, Human herpesvirus 2
cgcucgcucuccgu

SEQ ID NO: 3958790 - RNA, 16 nt, Human herpesvirus 2
cgcucgcugcagggcc

SEQ ID NO: 3958791 - RNA, 15 nt, Human herpesvirus 2
cgcucggcaugcgcg

SEQ ID NO: 3958792 - RNA, 18 nt, Human herpesvirus 2
cgcucuccgugccccugg

SEQ ID NO: 3958793 - RNA, 12 nt, Human herpesvirus 2
cgcugcgccggg

SEQ ID NO: 3958794 - RNA, 22 nt, Human herpesvirus 2
cgcugcggggaccagccgacgu

SEQ ID NO: 3958795 - RNA, 15 nt, Human herpesvirus 2
cgcuggcgggagcca

SEQ ID NO: 3958796 - RNA, 17 nt, Human herpesvirus 2
cgcugguuucucugcgu

SEQ ID NO: 3958797 - RNA, 19 nt, Human herpesvirus 2
cgcuguggcgcgcccccgc

SEQ ID NO: 3958798 - RNA, 22 nt, Human herpesvirus 2
cgcuugagcuuauagagcgaag

SEQ ID NO: 3958799 - RNA, 15 nt, Human herpesvirus 2
cggaacgccccgggc

SEQ ID NO: 3958800 - RNA, 17 nt, Human herpesvirus 2
cggacacccccccccau

SEQ ID NO: 3958801 - RNA, 12 nt, Human herpesvirus 2
cggaccccgccc

SEQ ID NO: 3958802 - RNA, 12 nt, Human herpesvirus 2
cggaccuccggg

SEQ ID NO: 3958803 - RNA, 13 nt, Human herpesvirus 2
cggaccuggggga

SEQ ID NO: 3958804 - RNA, 16 nt, Human herpesvirus 2
cggacgcggccagaaa

SEQ ID NO: 3958805 - RNA, 23 nt, Human herpesvirus 2
cggaggccugucccugcgucgcc

SEQ ID NO: 3958806 - RNA, 23 nt, Human herpesvirus 2
cggaguaugaccgucggugccag

SEQ ID NO: 3958807 - RNA, 20 nt, Human herpesvirus 2
cggcacacaugauuccggcc

SEQ ID NO: 3958808 - RNA, 15 nt, Human herpesvirus 2
cggcaugcagcccag

SEQ ID NO: 3958809 - RNA, 17 nt, Human herpesvirus 2
cggcaugcagcccagag

SEQ ID NO: 3958810 - RNA, 21 nt, Human herpesvirus 2
cggcaugcgacggcgucuccc

SEQ ID NO: 3958811 - RNA, 22 nt, Human herpesvirus 2
cggccaccccgccgcagcucau

SEQ ID NO: 3958812 - RNA, 17 nt, Human herpesvirus 2
cggccacgucguccggg

SEQ ID NO: 3958813 - RNA, 16 nt, Human herpesvirus 2
cggccccucgcucccc

SEQ ID NO: 3958814 - RNA, 14 nt, Human herpesvirus 2
cggcccugagccgc

SEQ ID NO: 3958815 - RNA, 22 nt, Human herpesvirus 2
cggcccugagccgcgcggccac

SEQ ID NO: 3958816 - RNA, 14 nt, Human herpesvirus 2
cggcccuggagcgc

SEQ ID NO: 3958817 - RNA, 12 nt, Human herpesvirus 2
cggccgcaccca

SEQ ID NO: 3958818 - RNA, 15 nt, Human herpesvirus 2
cggccgcacccacga

SEQ ID NO: 3958819 - RNA, 17 nt, Human herpesvirus 2
cggccgccgcaacaccc

SEQ ID NO: 3958820 - RNA, 16 nt, Human herpesvirus 2
cggccgcggacgaccu

SEQ ID NO: 3958821 - RNA, 18 nt, Human herpesvirus 2
cggccggcggagccccgg

SEQ ID NO: 3958822 - RNA, 14 nt, Human herpesvirus 2
cggccuccccggcg

SEQ ID NO: 3958823 - RNA, 21 nt, Human herpesvirus 2
cggcgaacacugccucggagg

SEQ ID NO: 3958824 - RNA, 21 nt, Human herpesvirus 2
cggcgacccgccgggggcgga

SEQ ID NO: 3958825 - RNA, 20 nt, Human herpesvirus 2
cggcgagggcggccucggcc

SEQ ID NO: 3958826 - RNA, 19 nt, Human herpesvirus 2
cggcgauuaacaacaccaa

SEQ ID NO: 3958827 - RNA, 20 nt, Human herpesvirus 2
cggcgcgggcggcgccgcgc

SEQ ID NO: 3958828 - RNA, 16 nt, Human herpesvirus 2
cggcgcucgguugucc

SEQ ID NO: 3958829 - RNA, 12 nt, Human herpesvirus 2
cggcggagcccc

SEQ ID NO: 3958830 - RNA, 15 nt, Human herpesvirus 2
cggcggccaccccgc

SEQ ID NO: 3958831 - RNA, 13 nt, Human herpesvirus 2
cggcggccccccg

SEQ ID NO: 3958832 - RNA, 14 nt, Human herpesvirus 2
cggcggccccccgc

SEQ ID NO: 3958833 - RNA, 22 nt, Human herpesvirus 2
cggcgguucgcgugcggccagc

SEQ ID NO: 3958834 - RNA, 16 nt, Human herpesvirus 2
cggcgucuagcucgcg

SEQ ID NO: 3958835 - RNA, 19 nt, Human herpesvirus 2
cggcguggagcgccgggcc

SEQ ID NO: 3958836 - RNA, 10 nt, Human herpesvirus 2
cggcugggga

SEQ ID NO: 3958837 - RNA, 16 nt, Human herpesvirus 2
cgggacgagccaaacc

SEQ ID NO: 3958838 - RNA, 21 nt, Human herpesvirus 2
cgggagcaggacagccgaccc

SEQ ID NO: 3958839 - RNA, 19 nt, Human herpesvirus 2
cgggaggggcgggaggaag

SEQ ID NO: 3958840 - RNA, 22 nt, Human herpesvirus 2
cgggaggggcuuggccuucccg

SEQ ID NO: 3958841 - RNA, 21 nt, Human herpesvirus 2
cgggauccuccgccagcucgg

SEQ ID NO: 3958842 - RNA, 19 nt, Human herpesvirus 2
cgggccaacagggaguccu

SEQ ID NO: 3958843 - RNA, 15 nt, Human herpesvirus 2
cgggccgccauuccc

SEQ ID NO: 3958844 - RNA, 19 nt, Human herpesvirus 2
cgggccgucguuggccagc

SEQ ID NO: 3958845 - RNA, 22 nt, Human herpesvirus 2
cgggccuuuuuucggacgguga

SEQ ID NO: 3958846 - RNA, 17 nt, Human herpesvirus 2
ccgagcuccgggggacu

SEQ ID NO: 3958847 - RNA, 20 nt, Human herpesvirus 2
ccgaggcgccucgggggcag

SEQ ID NO: 3958848 - RNA, 21 nt, Human herpesvirus 2
ccgcaauaaacgccuucccgg

SEQ ID NO: 3958849 - RNA, 19 nt, Human herpesvirus 2
ccgcaguuucaccgcccca

SEQ ID NO: 3958850 - RNA, 11 nt, Human herpesvirus 2
ccgccauccuc

SEQ ID NO: 3958851 - RNA, 17 nt, Human herpesvirus 2
ccgcccaagcggcccga

SEQ ID NO: 3958852 - RNA, 18 nt, Human herpesvirus 2
ccgccccagggggcggcg

SEQ ID NO: 3958853 - RNA, 23 nt, Human herpesvirus 2
ccgccccccaccggaccaccggc

SEQ ID NO: 3958854 - RNA, 17 nt, Human herpesvirus 2
ccgccccccccaggggg

SEQ ID NO: 3958855 - RNA, 14 nt, Human herpesvirus 2
ccgcccccgcuggc

SEQ ID NO: 3958856 - RNA, 16 nt, Human herpesvirus 2
ccgcccgaccagcgcc

SEQ ID NO: 3958857 - RNA, 12 nt, Human herpesvirus 2
ccgccgccggga

SEQ ID NO: 3958858 - RNA, 16 nt, Human herpesvirus 2
ccgccggucucccucu

SEQ ID NO: 3958859 - RNA, 21 nt, Human herpesvirus 2
ccgccgucucccccgcgagca

SEQ ID NO: 3958860 - RNA, 16 nt, Human herpesvirus 2
ccgccuaccagccccu

SEQ ID NO: 3958861 - RNA, 21 nt, Human herpesvirus 2
ccgcgagacuagaggcccgga

SEQ ID NO: 3958862 - RNA, 22 nt, Human herpesvirus 2
ccgcgaugaccucccggcccgc

SEQ ID NO: 3958863 - RNA, 19 nt, Human herpesvirus 2
ccgcgcaucacggcccacc

SEQ ID NO: 3958864 - RNA, 19 nt, Human herpesvirus 2
ccgcgcccgcgugccgcag

SEQ ID NO: 3958865 - RNA, 15 nt, Human herpesvirus 2
ccgcgcgggcccgga

SEQ ID NO: 3958866 - RNA, 22 nt, Human herpesvirus 2
ccgcggccuuucccguggcccu

SEQ ID NO: 3958867 - RNA, 23 nt, Human herpesvirus 2
ccgcggggggcacgggcccgggg

SEQ ID NO: 3958868 - RNA, 17 nt, Human herpesvirus 2
ccgcgggucccuuccca

SEQ ID NO: 3958869 - RNA, 20 nt, Human herpesvirus 2
ccgcucgcugcagggccugg

SEQ ID NO: 3958870 - RNA, 12 nt, Human herpesvirus 2
ccgcuggcggga

SEQ ID NO: 3958871 - RNA, 17 nt, Human herpesvirus 2
ccggacgcgcacguggg

SEQ ID NO: 3958872 - RNA, 21 nt, Human herpesvirus 2
ccggauaaauguggggccccg

SEQ ID NO: 3958873 - RNA, 22 nt, Human herpesvirus 2
ccggauaaauguggggccccgg

SEQ ID NO: 3958874 - RNA, 12 nt, Human herpesvirus 2
ccggcaccaggc

SEQ ID NO: 3958875 - RNA, 23 nt, Human herpesvirus 2
ccggccgcucgcugcagggccug

SEQ ID NO: 3958876 - RNA, 22 nt, Human herpesvirus 2
ccggccuggucguccgcggccc

SEQ ID NO: 3958877 - RNA, 20 nt, Human herpesvirus 2
ccgggacuucgagcucgucu

SEQ ID NO: 3958878 - RNA, 14 nt, Human herpesvirus 2
ccgggagguucccc

SEQ ID NO: 3958879 - RNA, 20 nt, Human herpesvirus 2
ccgggauccuccgccagcuc

SEQ ID NO: 3958880 - RNA, 16 nt, Human herpesvirus 2
ccggggacacgcggcg

SEQ ID NO: 3958881 - RNA, 19 nt, Human herpesvirus 2
ccggggcacgcggucagca

SEQ ID NO: 3958882 - RNA, 12 nt, Human herpesvirus 2
ccggggcccgca

SEQ ID NO: 3958883 - RNA, 14 nt, Human herpesvirus 2
ccggggcccgcagc

SEQ ID NO: 3958884 - RNA, 19 nt, Human herpesvirus 2
ccggggcgugcugugcccu

SEQ ID NO: 3958885 - RNA, 13 nt, Human herpesvirus 2
ccggggggggccu

SEQ ID NO: 3958886 - RNA, 14 nt, Human herpesvirus 2
ccggggggggccuc

SEQ ID NO: 3958887 - RNA, 16 nt, Human herpesvirus 2
ccggggggggccucgg

SEQ ID NO: 3958888 - RNA, 20 nt, Human herpesvirus 2
ccgggggggggcaagugcag

SEQ ID NO: 3958889 - RNA, 16 nt, Human herpesvirus 2
ccgggugaccacgcgc

SEQ ID NO: 3958890 - RNA, 16 nt, Human herpesvirus 2
ccggguuuuuggcccu

SEQ ID NO: 3958891 - RNA, 15 nt, Human herpesvirus 2
ccgguaugcccggcc

SEQ ID NO: 3958892 - RNA, 12 nt, Human herpesvirus 2
ccguccaccucc

SEQ ID NO: 3958893 - RNA, 16 nt, Human herpesvirus 2
ccgucccggcagaagc

SEQ ID NO: 3958894 - RNA, 13 nt, Human herpesvirus 2
ccgucgggccccg

SEQ ID NO: 3958895 - RNA, 12 nt, Human herpesvirus 2
ccgugccccugg

SEQ ID NO: 3958896 - RNA, 22 nt, Human herpesvirus 2
ccgugcuggggaaaucucucug

SEQ ID NO: 3958897 - RNA, 20 nt, Human herpesvirus 2
ccgugggccuguggggccug

SEQ ID NO: 3958898 - RNA, 12 nt, Human herpesvirus 2
ccguggguacgg

SEQ ID NO: 3958899 - RNA, 15 nt, Human herpesvirus 2
ccgugucccucccgg

SEQ ID NO: 3958900 - RNA, 17 nt, Human herpesvirus 2
ccuaaggaugcccgcca

SEQ ID NO: 3958901 - RNA, 20 nt, Human herpesvirus 2
ccuagccgugggccuguggg

SEQ ID NO: 3958902 - RNA, 19 nt, Human herpesvirus 2
ccuauaaacucucccccgc

SEQ ID NO: 3958903 - RNA, 14 nt, Human herpesvirus 2
ccuaucuugauccc

SEQ ID NO: 3958904 - RNA, 14 nt, Human herpesvirus 2
ccucaaacaggcca

SEQ ID NO: 3958905 - RNA, 16 nt, Human herpesvirus 2
ccucagcgcggccgug

SEQ ID NO: 3958906 - RNA, 19 nt, Human herpesvirus 2
ccucagcgcggccgugggc

SEQ ID NO: 3958907 - RNA, 14 nt, Human herpesvirus 2
ccuccccgugcgug

SEQ ID NO: 3958908 - RNA, 11 nt, Human herpesvirus 2
ccucccggccg

SEQ ID NO: 3958909 - RNA, 17 nt, Human herpesvirus 2
ccuccgcgggucccuuc

SEQ ID NO: 3958910 - RNA, 18 nt, Human herpesvirus 2
ccuccgcgggucccuucc

SEQ ID NO: 3958911 - RNA, 20 nt, Human herpesvirus 2
ccuccggagaacccccugcc

SEQ ID NO: 3958912 - RNA, 17 nt, Human herpesvirus 2
ccucgcugcucucccgu

SEQ ID NO: 3958913 - RNA, 21 nt, Human herpesvirus 2
ccucgugcgcaugggccgcca

SEQ ID NO: 3958914 - RNA, 23 nt, Human herpesvirus 2
ccucgugcgcaugggccgccagc

SEQ ID NO: 3958915 - RNA, 16 nt, Human herpesvirus 2
ccucguggggcuggac

SEQ ID NO: 3958916 - RNA, 23 nt, Human herpesvirus 2
ccucuaucaugucuuuccaccac

SEQ ID NO: 3958917 - RNA, 23 nt, Human herpesvirus 2
ccucucaacgcccaggcccuggc

SEQ ID NO: 3958918 - RNA, 18 nt, Human herpesvirus 2
ccucugcccgaccgggcg

SEQ ID NO: 3958919 - RNA, 16 nt, Human herpesvirus 2
ccucugggacacccag

SEQ ID NO: 3958920 - RNA, 14 nt, Human herpesvirus 2
ccucuguuucucca

SEQ ID NO: 3958921 - RNA, 17 nt, Human herpesvirus 2
ccucuguuucuccaggc

SEQ ID NO: 3958922 - RNA, 22 nt, Human herpesvirus 2
ccugacccucucgggcaugggc

SEQ ID NO: 3958923 - RNA, 13 nt, Human herpesvirus 2
ccugcggcaggcg

SEQ ID NO: 3958924 - RNA, 18 nt, Human herpesvirus 2
ccugcucgaccagcggcc

SEQ ID NO: 3958925 - RNA, 20 nt, Human herpesvirus 2
ccuggaagcugccucccccc

SEQ ID NO: 3958926 - RNA, 14 nt, Human herpesvirus 2
ccuggccgcgcgga

SEQ ID NO: 3958927 - RNA, 15 nt, Human herpesvirus 2
ccuggcggccccugu

SEQ ID NO: 3958928 - RNA, 18 nt, Human herpesvirus 2
ccugggcggccucuccgg

SEQ ID NO: 3958929 - RNA, 23 nt, Human herpesvirus 2
ccugggggacccgacccuguggc

SEQ ID NO: 3958930 - RNA, 17 nt, Human herpesvirus 2
ccuggguccgggggccu

SEQ ID NO: 3958931 - RNA, 13 nt, Human herpesvirus 2
ccuguuuggggca

SEQ ID NO: 3958932 - RNA, 16 nt, Human herpesvirus 2
ccuuaaaaggcacccc

SEQ ID NO: 3958933 - RNA, 14 nt, Human herpesvirus 2
ccuuccuccacccc

SEQ ID NO: 3958934 - RNA, 10 nt, Human herpesvirus 2
ccuuccuguc

SEQ ID NO: 3958935 - RNA, 18 nt, Human herpesvirus 2
ccuuuccaccccccuucc

SEQ ID NO: 3958936 - RNA, 18 nt, Human herpesvirus 2
cgaaccgauggcccccac

SEQ ID NO: 3958937 - RNA, 15 nt, Human herpesvirus 2
cgaaggcggacccag

SEQ ID NO: 3958938 - RNA, 15 nt, Human herpesvirus 2
cgaaggucgggccgu

SEQ ID NO: 3958939 - RNA, 21 nt, Human herpesvirus 2
cgaccaucaagaauucccagg

SEQ ID NO: 3958940 - RNA, 20 nt, Human herpesvirus 2
cgacccccgugucgcucccc

SEQ ID NO: 3958941 - RNA, 15 nt, Human herpesvirus 2
cgaccccgccccccg

SEQ ID NO: 3958942 - RNA, 16 nt, Human herpesvirus 2
cgaccccgccccccga

SEQ ID NO: 3958943 - RNA, 21 nt, Human herpesvirus 2
cgaccccgccccccgacgcca

SEQ ID NO: 3958944 - RNA, 13 nt, Human herpesvirus 2
cgaccggcggggc

SEQ ID NO: 3958945 - RNA, 14 nt, Human herpesvirus 2
cgaccgggcggugc

SEQ ID NO: 3958946 - RNA, 14 nt, Human herpesvirus 2
cgacgaccaccgcg

SEQ ID NO: 3958947 - RNA, 18 nt, Human herpesvirus 2
cgacgaccaccgcgacca

SEQ ID NO: 3958948 - RNA, 17 nt, Human herpesvirus 2
cgacgaccaugggcccc

SEQ ID NO: 3958949 - RNA, 14 nt, Human herpesvirus 2
cgacgacgugcgcg

SEQ ID NO: 3958950 - RNA, 15 nt, Human herpesvirus 2
cgacgccuucccugu

SEQ ID NO: 3958951 - RNA, 18 nt, Human herpesvirus 2
cgagccccgcgaccacca

SEQ ID NO: 3958952 - RNA, 17 nt, Human herpesvirus 2
cgagccgcugugccagg

SEQ ID NO: 3958953 - RNA, 20 nt, Human herpesvirus 2
cgagccgcugugccaggugg

SEQ ID NO: 3958954 - RNA, 20 nt, Human herpesvirus 2
cgagcggcgcaucuucgccg

SEQ ID NO: 3958955 - RNA, 14 nt, Human herpesvirus 2
cgagcgguuggagg

SEQ ID NO: 3958956 - RNA, 17 nt, Human herpesvirus 2
cgagcguaucggccagg

SEQ ID NO: 3958957 - RNA, 16 nt, Human herpesvirus 2
cgaggccgcucuccga

SEQ ID NO: 3958958 - RNA, 13 nt, Human herpesvirus 2
cgaguccugggug

SEQ ID NO: 3958959 - RNA, 16 nt, Human herpesvirus 2
cgaguccugggugggu

SEQ ID NO: 3958960 - RNA, 14 nt, Human herpesvirus 2
cgaucccgggcccu

SEQ ID NO: 3958961 - RNA, 17 nt, Human herpesvirus 2
cgaugacguggguccgg

SEQ ID NO: 3958962 - RNA, 18 nt, Human herpesvirus 2
cgcaacaacggcgggccc

SEQ ID NO: 3958963 - RNA, 15 nt, Human herpesvirus 2
guggugcuggccaau

SEQ ID NO: 3958964 - RNA, 18 nt, Human herpesvirus 2
gugguuugccguggagcu

SEQ ID NO: 3958965 - RNA, 18 nt, Human herpesvirus 2
gugucggagaggcccgcc

SEQ ID NO: 3958966 - RNA, 20 nt, Human herpesvirus 2
gugucguugggcggcccccg

SEQ ID NO: 3958967 - RNA, 17 nt, Human herpesvirus 2
guguuuauuuucccccc

SEQ ID NO: 3958968 - RNA, 12 nt, Human herpesvirus 2
guguuucccccc

SEQ ID NO: 3958969 - RNA, 12 nt, Human herpesvirus 2
guuacugcacuu

SEQ ID NO: 3958970 - RNA, 18 nt, Human herpesvirus 2
guucaauagauuucccaa

SEQ ID NO: 3958971 - RNA, 18 nt, Human herpesvirus 2
guuccaccgcucacccac

SEQ ID NO: 3958972 - RNA, 18 nt, Human herpesvirus 2
guuccggguugcgccucc

SEQ ID NO: 3958973 - RNA, 14 nt, Human herpesvirus 2
guucgccccgcagc

SEQ ID NO: 3958974 - RNA, 11 nt, Human herpesvirus 2
guucuccugga

SEQ ID NO: 3958975 - RNA, 19 nt, Human herpesvirus 2
guucuuggcgcgcgcggcg

SEQ ID NO: 3958976 - RNA, 17 nt, Human herpesvirus 2
guugccgggggccauga

SEQ ID NO: 3958977 - RNA, 13 nt, Human herpesvirus 2
guugcgccuccgu

SEQ ID NO: 3958978 - RNA, 19 nt, Human herpesvirus 2
guuggacgcguuucccuuu

SEQ ID NO: 3958979 - RNA, 14 nt, Human herpesvirus 2
guuggagcggucgc

SEQ ID NO: 3958980 - RNA, 18 nt, Human herpesvirus 2
guuguccguucugucguc

SEQ ID NO: 3958981 - RNA, 12 nt, Human herpesvirus 2
guugucugucug

SEQ ID NO: 3958982 - RNA, 15 nt, Human herpesvirus 2
guuuacuauccuugc

SEQ ID NO: 3958983 - RNA, 20 nt, Human herpesvirus 2
guuucgggcguuccuucccu

SEQ ID NO: 3958984 - RNA, 22 nt, Human herpesvirus 2
guuucgggcguuccuucccuuu

SEQ ID NO: 3958985 - RNA, 19 nt, Human herpesvirus 2
guuugggaacacaggcgcu

SEQ ID NO: 3958986 - RNA, 18 nt, Human herpesvirus 2
uaaaacgcgggcgggggc

SEQ ID NO: 3958987 - RNA, 12 nt, Human herpesvirus 2
uaaacucucccc

SEQ ID NO: 3958988 - RNA, 22 nt, Human herpesvirus 2
uaaagaacgagacagacgaaaa

SEQ ID NO: 3958989 - RNA, 21 nt, Human herpesvirus 2
uaaagguccggcggccacccc

SEQ ID NO: 3958990 - RNA, 22 nt, Human herpesvirus 2
uaaggagucgccgccccgacuc

SEQ ID NO: 3958991 - RNA, 15 nt, Human herpesvirus 2
uaaggcaggggcagc

SEQ ID NO: 3958992 - RNA, 12 nt, Human herpesvirus 2
uacaaauuaaau

SEQ ID NO: 3958993 - RNA, 16 nt, Human herpesvirus 2
uacacgcgcuggcccc

SEQ ID NO: 3958994 - RNA, 21 nt, Human herpesvirus 2
uacacgcgcuggccccucugc

SEQ ID NO: 3958995 - RNA, 16 nt, Human herpesvirus 2
uacauaaaacccaccc

SEQ ID NO: 3958996 - RNA, 20 nt, Human herpesvirus 2
uaccccgccggucucccucu

SEQ ID NO: 3958997 - RNA, 19 nt, Human herpesvirus 2
uaccccuuugacuccuggg

SEQ ID NO: 3958998 - RNA, 15 nt, Human herpesvirus 2
uaccugacgcggccc

SEQ ID NO: 3958999 - RNA, 22 nt, Human herpesvirus 2
uacgagucugugcggcccucuc

SEQ ID NO: 3959000 - RNA, 13 nt, Human herpesvirus 2
uacuugcgcggcu

SEQ ID NO: 3959001 - RNA, 23 nt, Human herpesvirus 2
uagaacgccagauguggggugcg

SEQ ID NO: 3959002 - RNA, 16 nt, Human herpesvirus 2
uagcucgcggagggcg

SEQ ID NO: 3959003 - RNA, 12 nt, Human herpesvirus 2
uauacugcuggg

SEQ ID NO: 3959004 - RNA, 19 nt, Human herpesvirus 2
uauuuccaaacagggccuu

SEQ ID NO: 3959005 - RNA, 23 nt, Human herpesvirus 2
ucaaacaggccaucgccggggac

SEQ ID NO: 3959006 - RNA, 17 nt, Human herpesvirus 2
ucaauaaaaaacaccaa

SEQ ID NO: 3959007 - RNA, 15 nt, Human herpesvirus 2
ucaauagauuuccca

SEQ ID NO: 3959008 - RNA, 18 nt, Human herpesvirus 2
ucacccacccccccccca

SEQ ID NO: 3959009 - RNA, 18 nt, Human herpesvirus 2
ucaccggggcgccccccc

SEQ ID NO: 3959010 - RNA, 18 nt, Human herpesvirus 2
ucaccgggggccccgggu

SEQ ID NO: 3959011 - RNA, 19 nt, Human herpesvirus 2
ucaccuggggcuccugcgc

SEQ ID NO: 3959012 - RNA, 23 nt, Human herpesvirus 2
ucacgcaggccgcccccagcagg

SEQ ID NO: 3959013 - RNA, 19 nt, Human herpesvirus 2
ucacggcccaccugcacga

SEQ ID NO: 3959014 - RNA, 20 nt, Human herpesvirus 2
ucacggucgauuuaaccacu

SEQ ID NO: 3959015 - RNA, 18 nt, Human herpesvirus 2
ucaguguuugggaaaucu

SEQ ID NO: 3959016 - RNA, 14 nt, Human herpesvirus 2
ucauccggcccgcc

SEQ ID NO: 3959017 - RNA, 17 nt, Human herpesvirus 2
ucaucgggaaucucggg

SEQ ID NO: 3959018 - RNA, 14 nt, Human herpesvirus 2
ucaucgucccgguu

SEQ ID NO: 3959019 - RNA, 17 nt, Human herpesvirus 2
ucaucgucgccgacucc

SEQ ID NO: 3959020 - RNA, 14 nt, Human herpesvirus 2
uccaaacagggccu

SEQ ID NO: 3959021 - RNA, 13 nt, Human herpesvirus 2
uccacacccccuc

SEQ ID NO: 3959022 - RNA, 13 nt, Human herpesvirus 2
uccaccaccagca

SEQ ID NO: 3959023 - RNA, 13 nt, Human herpesvirus 2
uccaccuuggccc

SEQ ID NO: 3959024 - RNA, 13 nt, Human herpesvirus 2
uccagcuuggccg

SEQ ID NO: 3959025 - RNA, 20 nt, Human herpesvirus 2
uccccaagagacuucccuaa

SEQ ID NO: 3959026 - RNA, 19 nt, Human herpesvirus 2
uccccaggcgacgccaggc

SEQ ID NO: 3959027 - RNA, 15 nt, Human herpesvirus 2
uccccccccccucca

SEQ ID NO: 3959028 - RNA, 14 nt, Human herpesvirus 2
ucccccggaccccg

SEQ ID NO: 3959029 - RNA, 21 nt, Human herpesvirus 2
uccccggcgccaugagccgcc

SEQ ID NO: 3959030 - RNA, 14 nt, Human herpesvirus 2
uccccuggggcggc

SEQ ID NO: 3959031 - RNA, 22 nt, Human herpesvirus 2
ucccgauguuguguucgccgac

SEQ ID NO: 3959032 - RNA, 13 nt, Human herpesvirus 2
ucccgcccgccag

SEQ ID NO: 3959033 - RNA, 19 nt, Human herpesvirus 2
ucccgccgucucccccgcg

SEQ ID NO: 3959034 - RNA, 23 nt, Human herpesvirus 2
ucccggccgccauccccgcgcau

SEQ ID NO: 3959035 - RNA, 19 nt, Human herpesvirus 2
ucccggucggggccgccag

SEQ ID NO: 3959036 - RNA, 13 nt, Human herpesvirus 2
uccgaccugcagg

SEQ ID NO: 3959037 - RNA, 16 nt, Human herpesvirus 2
uccgacgacgcggacg

SEQ ID NO: 3959038 - RNA, 22 nt, Human herpesvirus 2
uccgcaauaaacgccuucccgg

SEQ ID NO: 3959039 - RNA, 23 nt, Human herpesvirus 2
uccgccagcgcccuuccgcgucc

SEQ ID NO: 3959040 - RNA, 20 nt, Human herpesvirus 2
uccgccccggcgaccgcccc

SEQ ID NO: 3959041 - RNA, 17 nt, Human herpesvirus 2
uccgcgggaagcgccgc

SEQ ID NO: 3959042 - RNA, 18 nt, Human herpesvirus 2
uccgcgggucccuuccca

SEQ ID NO: 3959043 - RNA, 22 nt, Human herpesvirus 2
uccgcgugguccccgagcagca

SEQ ID NO: 3959044 - RNA, 22 nt, Human herpesvirus 2
uccggcaacccuccucgcugcg

SEQ ID NO: 3959045 - RNA, 16 nt, Human herpesvirus 2
uccggguaaaaaagaa

SEQ ID NO: 3959046 - RNA, 18 nt, Human herpesvirus 2
uccgugcuggggaaaucu

SEQ ID NO: 3959047 - RNA, 16 nt, Human herpesvirus 2
uccucacgggggggcu

SEQ ID NO: 3959048 - RNA, 22 nt, Human herpesvirus 2
ucgaccggggacuccccucuac

SEQ ID NO: 3959049 - RNA, 14 nt, Human herpesvirus 2
ucgacgaggccugg

SEQ ID NO: 3959050 - RNA, 19 nt, Human herpesvirus 2
ucgagcguggccggcgacc

SEQ ID NO: 3959051 - RNA, 17 nt, Human herpesvirus 2
ucgauguauggcgccuu

SEQ ID NO: 3959052 - RNA, 17 nt, Human herpesvirus 2
ucgcaagccacccuggg

SEQ ID NO: 3959053 - RNA, 21 nt, Human herpesvirus 2
ucgcaccccaccccugugugc

SEQ ID NO: 3959054 - RNA, 23 nt, Human herpesvirus 2
ucgcacgcgcgcaggcuggagcu

SEQ ID NO: 3959055 - RNA, 19 nt, Human herpesvirus 2
ucgccccccgucgcuccgg

SEQ ID NO: 3959056 - RNA, 15 nt, Human herpesvirus 2
ucgcccccgugccug

SEQ ID NO: 3959057 - RNA, 15 nt, Human herpesvirus 2
ucgcccuagaggcug

SEQ ID NO: 3959058 - RNA, 12 nt, Human herpesvirus 2
ucgccggggacc

SEQ ID NO: 3959059 - RNA, 16 nt, Human herpesvirus 2
ucgccgucaaccccgc

SEQ ID NO: 3959060 - RNA, 19 nt, Human herpesvirus 2
ucgcgcaucucuggcucca

SEQ ID NO: 3959061 - RNA, 12 nt, Human herpesvirus 2
ucgcggacgagc

SEQ ID NO: 3959062 - RNA, 20 nt, Human herpesvirus 2
ucgcggagggcggccagccg

SEQ ID NO: 3959063 - RNA, 16 nt, Human herpesvirus 2
ucgcggcccggcgcca

SEQ ID NO: 3959064 - RNA, 18 nt, Human herpesvirus 2
ucgcggccgcccgcgccg

SEQ ID NO: 3959065 - RNA, 20 nt, Human herpesvirus 2
ucgcggggacagccccgggg

SEQ ID NO: 3959066 - RNA, 16 nt, Human herpesvirus 2
ucgcgucuccacaaaa

SEQ ID NO: 3959067 - RNA, 17 nt, Human herpesvirus 2
ucgcuccggcucccggc

SEQ ID NO: 3959068 - RNA, 23 nt, Human herpesvirus 2
ucgcuccggcucccggcccgggc

SEQ ID NO: 3959069 - RNA, 14 nt, Human herpesvirus 2
ucgcugcucucccg

SEQ ID NO: 3959070 - RNA, 16 nt, Human herpesvirus 2
ucggaaagccggcccc

SEQ ID NO: 3959071 - RNA, 14 nt, Human herpesvirus 2
ucggacggugaucg

SEQ ID NO: 3959072 - RNA, 20 nt, Human herpesvirus 2
ucggccagcacgaccaggga

SEQ ID NO: 3959073 - RNA, 13 nt, Human herpesvirus 2
ucggcccccgggg

SEQ ID NO: 3959074 - RNA, 18 nt, Human herpesvirus 2
ucggcgauguccggggcg

SEQ ID NO: 3959075 - RNA, 19 nt, Human herpesvirus 2
ucggcggaaaugcgcgagc

SEQ ID NO: 3959076 - RNA, 21 nt, Human herpesvirus 2
ucgggggcucggggggguacg

SEQ ID NO: 3959077 - RNA, 14 nt, Human herpesvirus 2
ucggggggacgagc

SEQ ID NO: 3959078 - RNA, 21 nt, Human herpesvirus 2
ggaacaaagaaauagaagaaa

SEQ ID NO: 3959079 - RNA, 18 nt, Human herpesvirus 2
ggaacuggguuacugcac

SEQ ID NO: 3959080 - RNA, 21 nt, Human herpesvirus 2
ggaagagaaaaagaaaaaagg

SEQ ID NO: 3959081 - RNA, 19 nt, Human herpesvirus 2
ggaagagagcgccccgccc

SEQ ID NO: 3959082 - RNA, 18 nt, Human herpesvirus 2
ggaagccgccccccaccg

SEQ ID NO: 3959083 - RNA, 23 nt, Human herpesvirus 2
ggaagccgccccccaccggacca

SEQ ID NO: 3959084 - RNA, 18 nt, Human herpesvirus 2
ggaagcugccuccccccc

SEQ ID NO: 3959085 - RNA, 15 nt, Human herpesvirus 2
ggaauuuccgcgucc

SEQ ID NO: 3959086 - RNA, 21 nt, Human herpesvirus 2
ggacacgcaacaacggcgggc

SEQ ID NO: 3959087 - RNA, 21 nt, Human herpesvirus 2
ggacaguucauaggccgggag

SEQ ID NO: 3959088 - RNA, 22 nt, Human herpesvirus 2
ggacaguucauaggccgggagc

SEQ ID NO: 3959089 - RNA, 23 nt, Human herpesvirus 2
ggacaucacccacgucgcccccc

SEQ ID NO: 3959090 - RNA, 20 nt, Human herpesvirus 2
ggaccacgugcacagccugg

SEQ ID NO: 3959091 - RNA, 20 nt, Human herpesvirus 2
ggaccccucaucgccgcgcc

SEQ ID NO: 3959092 - RNA, 21 nt, Human herpesvirus 2
ggacccgccagagacccugcc

SEQ ID NO: 3959093 - RNA, 15 nt, Human herpesvirus 2
ggacgacgggcgccc

SEQ ID NO: 3959094 - RNA, 21 nt, Human herpesvirus 2
ggacgacgggcgcccccgccu

SEQ ID NO: 3959095 - RNA, 14 nt, Human herpesvirus 2
ggacgcccggccca

SEQ ID NO: 3959096 - RNA, 14 nt, Human herpesvirus 2
ggacgggugggccu

SEQ ID NO: 3959097 - RNA, 21 nt, Human herpesvirus 2
ggacgucuccaagcucuccga

SEQ ID NO: 3959098 - RNA, 21 nt, Human herpesvirus 2
ggacuccgccccggcgaccgc

SEQ ID NO: 3959099 - RNA, 14 nt, Human herpesvirus 2
ggacugggagccgc

SEQ ID NO: 3959100 - RNA, 10 nt, Human herpesvirus 2
ggacugggcc

SEQ ID NO: 3959101 - RNA, 13 nt, Human herpesvirus 2
ggacugggggcgg

SEQ ID NO: 3959102 - RNA, 20 nt, Human herpesvirus 2
ggagccugcgaaucccccaa

SEQ ID NO: 3959103 - RNA, 14 nt, Human herpesvirus 2
ggagcggugcaggg

SEQ ID NO: 3959104 - RNA, 13 nt, Human herpesvirus 2
ggagcuucaucac

SEQ ID NO: 3959105 - RNA, 13 nt, Human herpesvirus 2
ggaggccuguccc

SEQ ID NO: 3959106 - RNA, 15 nt, Human herpesvirus 2
ggagggcggccagcc

SEQ ID NO: 3959107 - RNA, 19 nt, Human herpesvirus 2
ggaggggggcagugcagua

SEQ ID NO: 3959108 - RNA, 17 nt, Human herpesvirus 2
ggaugauggauugauug

SEQ ID NO: 3959109 - RNA, 14 nt, Human herpesvirus 2
ggaugggcggggcc

SEQ ID NO: 3959110 - RNA, 18 nt, Human herpesvirus 2
ggaugggcggggcccggg

SEQ ID NO: 3959111 - RNA, 17 nt, Human herpesvirus 2
ggcaacaaagggccucc

SEQ ID NO: 3959112 - RNA, 20 nt, Human herpesvirus 2
ggcaacccgacggcggggcc

SEQ ID NO: 3959113 - RNA, 17 nt, Human herpesvirus 2
ggcaccggggaaacagg

SEQ ID NO: 3959114 - RNA, 15 nt, Human herpesvirus 2
ggcaccuccccggcg

SEQ ID NO: 3959115 - RNA, 13 nt, Human herpesvirus 2
ggcagcccggacc

SEQ ID NO: 3959116 - RNA, 17 nt, Human herpesvirus 2
ggcagccgggcccgcca

SEQ ID NO: 3959117 - RNA, 14 nt, Human herpesvirus 2
ggcagcgcgccgac

SEQ ID NO: 3959118 - RNA, 21 nt, Human herpesvirus 2
ggcagcgcgccgacgaccugc

SEQ ID NO: 3959119 - RNA, 21 nt, Human herpesvirus 2
ggcaggcguguugggaaggga

SEQ ID NO: 3959120 - RNA, 21 nt, Human herpesvirus 2
ggccaaccucauccgcggcgc

SEQ ID NO: 3959121 - RNA, 23 nt, Human herpesvirus 2
ggccccagggcuucguggaagag

SEQ ID NO: 3959122 - RNA, 19 nt, Human herpesvirus 2
ggccccgcucguggcgggc

SEQ ID NO: 3959123 - RNA, 14 nt, Human herpesvirus 2
ggcccggggggggc

SEQ ID NO: 3959124 - RNA, 20 nt, Human herpesvirus 2
ggcccguagucuccgcgaga

SEQ ID NO: 3959125 - RNA, 15 nt, Human herpesvirus 2
ggcccgugugggagg

SEQ ID NO: 3959126 - RNA, 19 nt, Human herpesvirus 2
ggcccuccacgccguggac

SEQ ID NO: 3959127 - RNA, 13 nt, Human herpesvirus 2
ggcccucugggac

SEQ ID NO: 3959128 - RNA, 18 nt, Human herpesvirus 2
ggcccucugggacaccca

SEQ ID NO: 3959129 - RNA, 15 nt, Human herpesvirus 2
ggcccuggacccaga

SEQ ID NO: 3959130 - RNA, 19 nt, Human herpesvirus 2
ggcccuuggacgggugggc

SEQ ID NO: 3959131 - RNA, 20 nt, Human herpesvirus 2
ggccgagaagagcggcgagu

SEQ ID NO: 3959132 - RNA, 12 nt, Human herpesvirus 2
ggccgaggcgcc

SEQ ID NO: 3959133 - RNA, 11 nt, Human herpesvirus 2
ggccgcccccc

SEQ ID NO: 3959134 - RNA, 14 nt, Human herpesvirus 2
ggccgccccgcagu

SEQ ID NO: 3959135 - RNA, 21 nt, Human herpesvirus 2
ggccgcgcccccggccgcggu

SEQ ID NO: 3959136 - RNA, 12 nt, Human herpesvirus 2
ggccgcucuccg

SEQ ID NO: 3959137 - RNA, 16 nt, Human herpesvirus 2
ggccggcggagccccg

SEQ ID NO: 3959138 - RNA, 20 nt, Human herpesvirus 2
ggccggcguucccgcucgcg

SEQ ID NO: 3959139 - RNA, 20 nt, Human herpesvirus 2
ggccggggagggcagggccg

SEQ ID NO: 3959140 - RNA, 19 nt, Human herpesvirus 2
ggccucgcccgucccggca

SEQ ID NO: 3959141 - RNA, 14 nt, Human herpesvirus 2
ggccugcugugggu

SEQ ID NO: 3959142 - RNA, 18 nt, Human herpesvirus 2
ggcgaacgggggaucugu

SEQ ID NO: 3959143 - RNA, 20 nt, Human herpesvirus 2
ggcgaccgucuuugggcccc

SEQ ID NO: 3959144 - RNA, 23 nt, Human herpesvirus 2
ggcgaccgucuuugggccccgcc

SEQ ID NO: 3959145 - RNA, 15 nt, Human herpesvirus 2
ggcgacgggcggcug

SEQ ID NO: 3959146 - RNA, 14 nt, Human herpesvirus 2
ggcgagcuggcccu

SEQ ID NO: 3959147 - RNA, 12 nt, Human herpesvirus 2
ggcgagggcggc

SEQ ID NO: 3959148 - RNA, 21 nt, Human herpesvirus 2
ggcgaugguggcgaugggcag

SEQ ID NO: 3959149 - RNA, 16 nt, Human herpesvirus 2
ggcgcccagacccuca

SEQ ID NO: 3959150 - RNA, 15 nt, Human herpesvirus 2
ggcgcgcccccgccg

SEQ ID NO: 3959151 - RNA, 14 nt, Human herpesvirus 2
ggcgcuuggccggg

SEQ ID NO: 3959152 - RNA, 19 nt, Human herpesvirus 2
ggcggcgaaccgguagccg

SEQ ID NO: 3959153 - RNA, 14 nt, Human herpesvirus 2
ggcggcuggccacc

SEQ ID NO: 3959154 - RNA, 15 nt, Human herpesvirus 2
ggcggggccccgggc

SEQ ID NO: 3959155 - RNA, 16 nt, Human herpesvirus 2
ggcggucccggccgcc

SEQ ID NO: 3959156 - RNA, 15 nt, Human herpesvirus 2
ggcggucggccagca

SEQ ID NO: 3959157 - RNA, 12 nt, Human herpesvirus 2
ggcguccccagg

SEQ ID NO: 3959158 - RNA, 15 nt, Human herpesvirus 2
ggcguuauuuccaaa

SEQ ID NO: 3959159 - RNA, 23 nt, Human herpesvirus 2
ggcguuauuuccaaacagggccu

SEQ ID NO: 3959160 - RNA, 22 nt, Human herpesvirus 2
ggcuccagacgaaggacccaua

SEQ ID NO: 3959161 - RNA, 13 nt, Human herpesvirus 2
ggcucgcggggcc

SEQ ID NO: 3959162 - RNA, 16 nt, Human herpesvirus 2
ggcucgcggggccggg

SEQ ID NO: 3959163 - RNA, 16 nt, Human herpesvirus 2
ggcucuucuggucaug

SEQ ID NO: 3959164 - RNA, 13 nt, Human herpesvirus 2
gggaaacuaggac

SEQ ID NO: 3959165 - RNA, 14 nt, Human herpesvirus 2
gggaagucucuugg

SEQ ID NO: 3959166 - RNA, 15 nt, Human herpesvirus 2
gggacccgggcgagc

SEQ ID NO: 3959167 - RNA, 22 nt, Human herpesvirus 2
gggacgcccggcccauaaacag

SEQ ID NO: 3959168 - RNA, 14 nt, Human herpesvirus 2
gggacgcgagccug

SEQ ID NO: 3959169 - RNA, 18 nt, Human herpesvirus 2
gggacucauuugucgccg

SEQ ID NO: 3959170 - RNA, 21 nt, Human herpesvirus 2
gggagccagggucggacagga

SEQ ID NO: 3959171 - RNA, 13 nt, Human herpesvirus 2
gggaggguggcug

SEQ ID NO: 3959172 - RNA, 18 nt, Human herpesvirus 2
gggaugggggggaaggga

SEQ ID NO: 3959173 - RNA, 12 nt, Human herpesvirus 2
gggaugguggug

SEQ ID NO: 3959174 - RNA, 17 nt, Human herpesvirus 2
gggcaccaaaaaccagg

SEQ ID NO: 3959175 - RNA, 20 nt, Human herpesvirus 2
gggcaccacguguccccagg

SEQ ID NO: 3959176 - RNA, 16 nt, Human herpesvirus 2
gggcacgcggggugcg

SEQ ID NO: 3959177 - RNA, 18 nt, Human herpesvirus 2
gggcaggcgggcccauca

SEQ ID NO: 3959178 - RNA, 21 nt, Human herpesvirus 2
gggccauggaugaugaccugg

SEQ ID NO: 3959179 - RNA, 11 nt, Human herpesvirus 2
gggcccggacu

SEQ ID NO: 3959180 - RNA, 21 nt, Human herpesvirus 2
gggcccuucgcagcuucaccg

SEQ ID NO: 3959181 - RNA, 21 nt, Human herpesvirus 2
gggcccuuggguuccgcggac

SEQ ID NO: 3959182 - RNA, 14 nt, Human herpesvirus 2
gggccgccauuccc

SEQ ID NO: 3959183 - RNA, 14 nt, Human herpesvirus 2
gggccggugggccc

SEQ ID NO: 3959184 - RNA, 14 nt, Human herpesvirus 2
gggccguggccaga

SEQ ID NO: 3959185 - RNA, 22 nt, Human herpesvirus 2
gggccucucgacggagagccgg

SEQ ID NO: 3959186 - RNA, 15 nt, Human herpesvirus 2
gggcgaaaaggcccg

SEQ ID NO: 3959187 - RNA, 20 nt, Human herpesvirus 2
gggcgaaaaggcccggcccg

SEQ ID NO: 3959188 - RNA, 20 nt, Human herpesvirus 2
gggcgaagucccgcacgaag

SEQ ID NO: 3959189 - RNA, 16 nt, Human herpesvirus 2
gggcggacguccaggg

SEQ ID NO: 3959190 - RNA, 18 nt, Human herpesvirus 2
gggcggcaagaccugccc

SEQ ID NO: 3959191 - RNA, 19 nt, Human herpesvirus 2
gggcggccagccgcgcgac

SEQ ID NO: 3959192 - RNA, 12 nt, Human herpesvirus 2
gggcgggagggg

SEQ ID NO: 3959193 - RNA, 12 nt, Human herpesvirus 2
gggcgggcgggg

SEQ ID NO: 3959194 - RNA, 19 nt, Human herpesvirus 2
gggcguccugcggcagcgc

SEQ ID NO: 3959195 - RNA, 17 nt, Human herpesvirus 2
cauucacccccaccccc

SEQ ID NO: 3959196 - RNA, 19 nt, Human herpesvirus 2
cauuuugugggggcccagg

SEQ ID NO: 3959197 - RNA, 18 nt, Human herpesvirus 2
ccaaagucacgcccccug

SEQ ID NO: 3959198 - RNA, 23 nt, Human herpesvirus 2
ccaacucauacacgcgcuggccc

SEQ ID NO: 3959199 - RNA, 12 nt, Human herpesvirus 2
ccaacucugucu

SEQ ID NO: 3959200 - RNA, 14 nt, Human herpesvirus 2
ccaauucuucccgg

SEQ ID NO: 3959201 - RNA, 16 nt, Human herpesvirus 2
ccacaagcuaugcauc

SEQ ID NO: 3959202 - RNA, 16 nt, Human herpesvirus 2
ccacccaaccagcgcg

SEQ ID NO: 3959203 - RNA, 21 nt, Human herpesvirus 2
ccaccccccccccccuucccg

SEQ ID NO: 3959204 - RNA, 13 nt, Human herpesvirus 2
ccaccggccuggu

SEQ ID NO: 3959205 - RNA, 11 nt, Human herpesvirus 2
ccaccgggccu

SEQ ID NO: 3959206 - RNA, 14 nt, Human herpesvirus 2
ccaccucgcggcgg

SEQ ID NO: 3959207 - RNA, 19 nt, Human herpesvirus 2
ccaccuggaagcugccucc

SEQ ID NO: 3959208 - RNA, 23 nt, Human herpesvirus 2
ccacgagcacaaacgugcucugc

SEQ ID NO: 3959209 - RNA, 17 nt, Human herpesvirus 2
ccacggaccuccgggac

SEQ ID NO: 3959210 - RNA, 14 nt, Human herpesvirus 2
ccacgucaccgggg

SEQ ID NO: 3959211 - RNA, 14 nt, Human herpesvirus 2
ccacguccaccuug

SEQ ID NO: 3959212 - RNA, 22 nt, Human herpesvirus 2
ccacucgucgccaacggccagc

SEQ ID NO: 3959213 - RNA, 12 nt, Human herpesvirus 2
ccagacgcccgc

SEQ ID NO: 3959214 - RNA, 19 nt, Human herpesvirus 2
ccagacgcuguuguuucug

SEQ ID NO: 3959215 - RNA, 16 nt, Human herpesvirus 2
ccagaggcuggagcgc

SEQ ID NO: 3959216 - RNA, 14 nt, Human herpesvirus 2
ccagauguggggug

SEQ ID NO: 3959217 - RNA, 19 nt, Human herpesvirus 2
ccagcgcguugguccgggg

SEQ ID NO: 3959218 - RNA, 15 nt, Human herpesvirus 2
ccagcguccugcgcg

SEQ ID NO: 3959219 - RNA, 17 nt, Human herpesvirus 2
ccagcucgggggccagg

SEQ ID NO: 3959220 - RNA, 23 nt, Human herpesvirus 2
ccagcucgggggccaggaacucc

SEQ ID NO: 3959221 - RNA, 19 nt, Human herpesvirus 2
ccagcugcuggccaaacau

SEQ ID NO: 3959222 - RNA, 21 nt, Human herpesvirus 2
ccaggaggggggcagugcagu

SEQ ID NO: 3959223 - RNA, 17 nt, Human herpesvirus 2
ccaggcgcugcugcgca

SEQ ID NO: 3959224 - RNA, 21 nt, Human herpesvirus 2
ccagggcaccacgugucccca

SEQ ID NO: 3959225 - RNA, 12 nt, Human herpesvirus 2
ccagggcgucgc

SEQ ID NO: 3959226 - RNA, 23 nt, Human herpesvirus 2
ccaggggugcguuaucgcacccc

SEQ ID NO: 3959227 - RNA, 22 nt, Human herpesvirus 2
ccagguggcccuuccggacccc

SEQ ID NO: 3959228 - RNA, 13 nt, Human herpesvirus 2
ccaguuccuccgu

SEQ ID NO: 3959229 - RNA, 16 nt, Human herpesvirus 2
ccauacauuuccccau

SEQ ID NO: 3959230 - RNA, 15 nt, Human herpesvirus 2
ccaucucuguuucau

SEQ ID NO: 3959231 - RNA, 13 nt, Human herpesvirus 2
cccacaacccauc

SEQ ID NO: 3959232 - RNA, 15 nt, Human herpesvirus 2
cccacccccccgccg

SEQ ID NO: 3959233 - RNA, 21 nt, Human herpesvirus 2
cccaccggauaaauguggggc

SEQ ID NO: 3959234 - RNA, 19 nt, Human herpesvirus 2
cccacuuucccccccacuc

SEQ ID NO: 3959235 - RNA, 17 nt, Human herpesvirus 2
cccagcgcacccuggcc

SEQ ID NO: 3959236 - RNA, 19 nt, Human herpesvirus 2
cccagcgcggacgcggcca

SEQ ID NO: 3959237 - RNA, 18 nt, Human herpesvirus 2
cccaggaggggggcagug

SEQ ID NO: 3959238 - RNA, 14 nt, Human herpesvirus 2
cccaggcgacgcca

SEQ ID NO: 3959239 - RNA, 21 nt, Human herpesvirus 2
cccagggcuucguggaagagg

SEQ ID NO: 3959240 - RNA, 15 nt, Human herpesvirus 2
ccccacgucaccggg

SEQ ID NO: 3959241 - RNA, 23 nt, Human herpesvirus 2
ccccagcuuucccuccacccgcc

SEQ ID NO: 3959242 - RNA, 18 nt, Human herpesvirus 2
ccccaggcgacgccaggc

SEQ ID NO: 3959243 - RNA, 19 nt, Human herpesvirus 2
ccccagggagccccggguu

SEQ ID NO: 3959244 - RNA, 16 nt, Human herpesvirus 2
ccccauccccucccga

SEQ ID NO: 3959245 - RNA, 16 nt, Human herpesvirus 2
ccccauggcauccggg

SEQ ID NO: 3959246 - RNA, 22 nt, Human herpesvirus 2
cccccgggcgucguggcaugga

SEQ ID NO: 3959247 - RNA, 21 nt, Human herpesvirus 2
cccccggggggcguggagggg

SEQ ID NO: 3959248 - RNA, 14 nt, Human herpesvirus 2
ccccgauuccggug

SEQ ID NO: 3959249 - RNA, 15 nt, Human herpesvirus 2
ccccgcaggcaggcg

SEQ ID NO: 3959250 - RNA, 14 nt, Human herpesvirus 2
ccccgcgcaggggg

SEQ ID NO: 3959251 - RNA, 14 nt, Human herpesvirus 2
ccccgcgugcagcg

SEQ ID NO: 3959252 - RNA, 16 nt, Human herpesvirus 2
ccccgcgugcagcgcg

SEQ ID NO: 3959253 - RNA, 20 nt, Human herpesvirus 2
ccccgcugcugugcacccua

SEQ ID NO: 3959254 - RNA, 22 nt, Human herpesvirus 2
ccccggcgaccgccccgcgccg

SEQ ID NO: 3959255 - RNA, 13 nt, Human herpesvirus 2
ccccggcuccgag

SEQ ID NO: 3959256 - RNA, 23 nt, Human herpesvirus 2
ccccgggggggggcaagugcagu

SEQ ID NO: 3959257 - RNA, 17 nt, Human herpesvirus 2
ccccucaaagaacgugg

SEQ ID NO: 3959258 - RNA, 19 nt, Human herpesvirus 2
ccccucaccccuccgaccu

SEQ ID NO: 3959259 - RNA, 16 nt, Human herpesvirus 2
ccccucguucugcugc

SEQ ID NO: 3959260 - RNA, 20 nt, Human herpesvirus 2
ccccugaguugcgccggcac

SEQ ID NO: 3959261 - RNA, 15 nt, Human herpesvirus 2
ccccuguuggagccg

SEQ ID NO: 3959262 - RNA, 17 nt, Human herpesvirus 2
ccccuuugacuccuggg

SEQ ID NO: 3959263 - RNA, 14 nt, Human herpesvirus 2
cccgacccuguggc

SEQ ID NO: 3959264 - RNA, 15 nt, Human herpesvirus 2
cccgacguggcccgc

SEQ ID NO: 3959265 - RNA, 14 nt, Human herpesvirus 2
cccgagcgugcccu

SEQ ID NO: 3959266 - RNA, 13 nt, Human herpesvirus 2
cccgagcuccggg

SEQ ID NO: 3959267 - RNA, 15 nt, Human herpesvirus 2
cccgccagagacccu

SEQ ID NO: 3959268 - RNA, 22 nt, Human herpesvirus 2
cccgccauggcggggggggggc

SEQ ID NO: 3959269 - RNA, 14 nt, Human herpesvirus 2
cccgccccccccag

SEQ ID NO: 3959270 - RNA, 16 nt, Human herpesvirus 2
cccgcccccucuccca

SEQ ID NO: 3959271 - RNA, 13 nt, Human herpesvirus 2
cccgccggggcgc

SEQ ID NO: 3959272 - RNA, 15 nt, Human herpesvirus 2
cccgcgcaggggggc

SEQ ID NO: 3959273 - RNA, 17 nt, Human herpesvirus 2
cccgcgcaucacggccc

SEQ ID NO: 3959274 - RNA, 20 nt, Human herpesvirus 2
cccgcggucgcgcgggccgu

SEQ ID NO: 3959275 - RNA, 19 nt, Human herpesvirus 2
cccgcguccgacacccggg

SEQ ID NO: 3959276 - RNA, 20 nt, Human herpesvirus 2
cccggaccccgcugcugugc

SEQ ID NO: 3959277 - RNA, 15 nt, Human herpesvirus 2
cccggcccggcccgc

SEQ ID NO: 3959278 - RNA, 17 nt, Human herpesvirus 2
cccggccgccccccguc

SEQ ID NO: 3959279 - RNA, 22 nt, Human herpesvirus 2
cccggccuuugcuuccucgcgg

SEQ ID NO: 3959280 - RNA, 13 nt, Human herpesvirus 2
cccggcgccgccc

SEQ ID NO: 3959281 - RNA, 16 nt, Human herpesvirus 2
cccggcgccgccccgc

SEQ ID NO: 3959282 - RNA, 18 nt, Human herpesvirus 2
cccggcgcgggcggcgcc

SEQ ID NO: 3959283 - RNA, 18 nt, Human herpesvirus 2
cccggcggccccccgcgc

SEQ ID NO: 3959284 - RNA, 14 nt, Human herpesvirus 2
cccggcggcggucg

SEQ ID NO: 3959285 - RNA, 18 nt, Human herpesvirus 2
cccggcgucaugcacgcc

SEQ ID NO: 3959286 - RNA, 15 nt, Human herpesvirus 2
cccggcuccuccgug

SEQ ID NO: 3959287 - RNA, 22 nt, Human herpesvirus 2
cccgggauccuccgccagcucg

SEQ ID NO: 3959288 - RNA, 19 nt, Human herpesvirus 2
cccggguuaccgguacgcc

SEQ ID NO: 3959289 - RNA, 10 nt, Human herpesvirus 2
cccgucccga

SEQ ID NO: 3959290 - RNA, 21 nt, Human herpesvirus 2
cccgucuuuuuuuuuccuguu

SEQ ID NO: 3959291 - RNA, 19 nt, Human herpesvirus 2
cccguguaccucugggccc

SEQ ID NO: 3959292 - RNA, 17 nt, Human herpesvirus 2
cccuccgccagcgcccu

SEQ ID NO: 3959293 - RNA, 17 nt, Human herpesvirus 2
cccugcgucgccccgug

SEQ ID NO: 3959294 - RNA, 15 nt, Human herpesvirus 2
cccuggacugggccg

SEQ ID NO: 3959295 - RNA, 16 nt, Human herpesvirus 2
cccuggacugggccgc

SEQ ID NO: 3959296 - RNA, 16 nt, Human herpesvirus 2
cccuggcgcaccugca

SEQ ID NO: 3959297 - RNA, 21 nt, Human herpesvirus 2
cccuggguccgggggccuggu

SEQ ID NO: 3959298 - RNA, 20 nt, Human herpesvirus 2
ccgaacggaaggccucccgg

SEQ ID NO: 3959299 - RNA, 23 nt, Human herpesvirus 2
ccgaagagacgaugggagccccg

SEQ ID NO: 3959300 - RNA, 17 nt, Human herpesvirus 2
ccgaaggaggaaagugg

SEQ ID NO: 3959301 - RNA, 15 nt, Human herpesvirus 2
ccgaauacgacgccc

SEQ ID NO: 3959302 - RNA, 14 nt, Human herpesvirus 2
ccgacaucaaccac

SEQ ID NO: 3959303 - RNA, 16 nt, Human herpesvirus 2
ccgacauuccccucuc

SEQ ID NO: 3959304 - RNA, 14 nt, Human herpesvirus 2
ccgaccccgccgcc

SEQ ID NO: 3959305 - RNA, 20 nt, Human herpesvirus 2
ccgacgauuagccaccgcgc

SEQ ID NO: 3959306 - RNA, 23 nt, Human herpesvirus 2
ccgacggggagggacaaggagga

SEQ ID NO: 3959307 - RNA, 14 nt, Human herpesvirus 2
ccgagcagcacggc

SEQ ID NO: 3959308 - RNA, 15 nt, Human herpesvirus 2
ccgagccgcugugcc

SEQ ID NO: 3959309 - RNA, 21 nt, Human herpesvirus 2
ccgagccgcugugccaggugg

SEQ ID NO: 3959310 - RNA, 17 nt, Human herpesvirus 2
ccgagcgccgggcagac

SEQ ID NO: 3959311 - RNA, 22 nt, Human herpesvirus 2
ccgagcgccgggcagacagaca

SEQ ID NO: 3959312 - RNA, 19 nt, Human herpesvirus 2
gcgccaagcgccccgcgga

SEQ ID NO: 3959313 - RNA, 15 nt, Human herpesvirus 2
gcgccaccggccugg

SEQ ID NO: 3959314 - RNA, 13 nt, Human herpesvirus 2
gcgccaggucagc

SEQ ID NO: 3959315 - RNA, 21 nt, Human herpesvirus 2
gcgccauuacccuauacgcgg

SEQ ID NO: 3959316 - RNA, 17 nt, Human herpesvirus 2
gcgcccaccgguccuuc

SEQ ID NO: 3959317 - RNA, 18 nt, Human herpesvirus 2
gcgcccuuccgcguccgc

SEQ ID NO: 3959318 - RNA, 15 nt, Human herpesvirus 2
gcgccgccgucagcu

SEQ ID NO: 3959319 - RNA, 17 nt, Human herpesvirus 2
gcgccgcgacggccccg

SEQ ID NO: 3959320 - RNA, 23 nt, Human herpesvirus 2
gcgccgcgacggccccggccgcc

SEQ ID NO: 3959321 - RNA, 20 nt, Human herpesvirus 2
gcgccgucgucgcccgcccg

SEQ ID NO: 3959322 - RNA, 23 nt, Human herpesvirus 2
gcgccgucgucgcccgcccgccg

SEQ ID NO: 3959323 - RNA, 22 nt, Human herpesvirus 2
gcgccuaccugguacccacgga

SEQ ID NO: 3959324 - RNA, 14 nt, Human herpesvirus 2
gcgccucgggcggc

SEQ ID NO: 3959325 - RNA, 17 nt, Human herpesvirus 2
gcgcgacggccgagaag

SEQ ID NO: 3959326 - RNA, 18 nt, Human herpesvirus 2
gcgcgaggccgcucuccg

SEQ ID NO: 3959327 - RNA, 15 nt, Human herpesvirus 2
gcgcgcaucggaccc

SEQ ID NO: 3959328 - RNA, 16 nt, Human herpesvirus 2
gcgcgccgccgcgcgg

SEQ ID NO: 3959329 - RNA, 11 nt, Human herpesvirus 2
gcgcgcgcccc

SEQ ID NO: 3959330 - RNA, 15 nt, Human herpesvirus 2
gcgcgcuggcggaag

SEQ ID NO: 3959331 - RNA, 12 nt, Human herpesvirus 2
gcgcgcuugcac

SEQ ID NO: 3959332 - RNA, 20 nt, Human herpesvirus 2
gcgcggccacgucguccggg

SEQ ID NO: 3959333 - RNA, 16 nt, Human herpesvirus 2
gcgcgggcgacgggcg

SEQ ID NO: 3959334 - RNA, 13 nt, Human herpesvirus 2
gcgcgggcggcgc

SEQ ID NO: 3959335 - RNA, 18 nt, Human herpesvirus 2
gcgcggggguucggggcc

SEQ ID NO: 3959336 - RNA, 21 nt, Human herpesvirus 2
gcgcggggguucggggccagg

SEQ ID NO: 3959337 - RNA, 22 nt, Human herpesvirus 2
gcgcggucuagaugccagugga

SEQ ID NO: 3959338 - RNA, 13 nt, Human herpesvirus 2
gcgcgucggugcc

SEQ ID NO: 3959339 - RNA, 17 nt, Human herpesvirus 2
gcgcgugcagaacaccg

SEQ ID NO: 3959340 - RNA, 14 nt, Human herpesvirus 2
gcgcuggccccucu

SEQ ID NO: 3959341 - RNA, 19 nt, Human herpesvirus 2
gcgcuuagggugugacccc

SEQ ID NO: 3959342 - RNA, 15 nt, Human herpesvirus 2
gcggacagccagggc

SEQ ID NO: 3959343 - RNA, 12 nt, Human herpesvirus 2
gcggacuggcag

SEQ ID NO: 3959344 - RNA, 19 nt, Human herpesvirus 2
gcggagccucuuugggccg

SEQ ID NO: 3959345 - RNA, 22 nt, Human herpesvirus 2
gcggagccucuuugggccgugg

SEQ ID NO: 3959346 - RNA, 15 nt, Human herpesvirus 2
gcggaggcgugguga

SEQ ID NO: 3959347 - RNA, 22 nt, Human herpesvirus 2
gcggcacucgaagaaguuggug

SEQ ID NO: 3959348 - RNA, 22 nt, Human herpesvirus 2
gcggcauaccuccgaccggcgg

SEQ ID NO: 3959349 - RNA, 14 nt, Human herpesvirus 2
gcggccaccccgcc

SEQ ID NO: 3959350 - RNA, 18 nt, Human herpesvirus 2
gcggccauccugcccacc

SEQ ID NO: 3959351 - RNA, 16 nt, Human herpesvirus 2
gcggccccgacccaac

SEQ ID NO: 3959352 - RNA, 16 nt, Human herpesvirus 2
gcggccccggcggccc

SEQ ID NO: 3959353 - RNA, 12 nt, Human herpesvirus 2
gcggcccucucg

SEQ ID NO: 3959354 - RNA, 14 nt, Human herpesvirus 2
gcggcggggguggg

SEQ ID NO: 3959355 - RNA, 15 nt, Human herpesvirus 2
gcggcuugcgcgacc

SEQ ID NO: 3959356 - RNA, 22 nt, Human herpesvirus 2
gcgggaccccgacguggcccgc

SEQ ID NO: 3959357 - RNA, 14 nt, Human herpesvirus 2
gcgggaggggcggg

SEQ ID NO: 3959358 - RNA, 15 nt, Human herpesvirus 2
gcgggcgcggcacac

SEQ ID NO: 3959359 - RNA, 14 nt, Human herpesvirus 2
gcgggcggcgccgc

SEQ ID NO: 3959360 - RNA, 13 nt, Human herpesvirus 2
gcgggcgggauga

SEQ ID NO: 3959361 - RNA, 15 nt, Human herpesvirus 2
gcgggcgggggucgg

SEQ ID NO: 3959362 - RNA, 12 nt, Human herpesvirus 2
gcggggaugggg

SEQ ID NO: 3959363 - RNA, 16 nt, Human herpesvirus 2
gcggggcauggacccc

SEQ ID NO: 3959364 - RNA, 14 nt, Human herpesvirus 2
gcgggggccggggc

SEQ ID NO: 3959365 - RNA, 18 nt, Human herpesvirus 2
gcggggguucggggccag

SEQ ID NO: 3959366 - RNA, 19 nt, Human herpesvirus 2
gcgguagcggacgcacggc

SEQ ID NO: 3959367 - RNA, 14 nt, Human herpesvirus 2
gcggucggccagca

SEQ ID NO: 3959368 - RNA, 22 nt, Human herpesvirus 2
gcggucgucguccucacggcca

SEQ ID NO: 3959369 - RNA, 20 nt, Human herpesvirus 2
gcgguuggaggcgccucugc

SEQ ID NO: 3959370 - RNA, 16 nt, Human herpesvirus 2
gcguacguggcgucgg

SEQ ID NO: 3959371 - RNA, 19 nt, Human herpesvirus 2
gcguccggaaccccucugg

SEQ ID NO: 3959372 - RNA, 18 nt, Human herpesvirus 2
gcgucgcucucggucccg

SEQ ID NO: 3959373 - RNA, 16 nt, Human herpesvirus 2
gcgucggcggccccgg

SEQ ID NO: 3959374 - RNA, 21 nt, Human herpesvirus 2
gcgucuagcucgcggagggcg

SEQ ID NO: 3959375 - RNA, 16 nt, Human herpesvirus 2
gcgucucccgggggcg

SEQ ID NO: 3959376 - RNA, 11 nt, Human herpesvirus 2
gcgugccaacu

SEQ ID NO: 3959377 - RNA, 21 nt, Human herpesvirus 2
gcgugccaacucgcggcaccg

SEQ ID NO: 3959378 - RNA, 13 nt, Human herpesvirus 2
gcgugcugugccc

SEQ ID NO: 3959379 - RNA, 14 nt, Human herpesvirus 2
gcguggccgcgacc

SEQ ID NO: 3959380 - RNA, 18 nt, Human herpesvirus 2
gcgugguccccgagcagc

SEQ ID NO: 3959381 - RNA, 15 nt, Human herpesvirus 2
gcguugcgcuuuccg

SEQ ID NO: 3959382 - RNA, 13 nt, Human herpesvirus 2
gcguuucccuuuu

SEQ ID NO: 3959383 - RNA, 23 nt, Human herpesvirus 2
gcuaccgcggcuucuucgccgcc

SEQ ID NO: 3959384 - RNA, 20 nt, Human herpesvirus 2
gcuaguacccagaggcugga

SEQ ID NO: 3959385 - RNA, 17 nt, Human herpesvirus 2
gcucauggccggagaaa

SEQ ID NO: 3959386 - RNA, 20 nt, Human herpesvirus 2
gcucccguguaccucugggc

SEQ ID NO: 3959387 - RNA, 14 nt, Human herpesvirus 2
gcucccugcggcug

SEQ ID NO: 3959388 - RNA, 18 nt, Human herpesvirus 2
gcuccgcgugguccccga

SEQ ID NO: 3959389 - RNA, 22 nt, Human herpesvirus 2
gcuccgcgugguccccgagcag

SEQ ID NO: 3959390 - RNA, 13 nt, Human herpesvirus 2
gcucgcggggccg

SEQ ID NO: 3959391 - RNA, 18 nt, Human herpesvirus 2
gcucgcgguaauuagcag

SEQ ID NO: 3959392 - RNA, 15 nt, Human herpesvirus 2
gcucggacaccagca

SEQ ID NO: 3959393 - RNA, 13 nt, Human herpesvirus 2
gcucggucgccuu

SEQ ID NO: 3959394 - RNA, 14 nt, Human herpesvirus 2
gcucguccccuggg

SEQ ID NO: 3959395 - RNA, 17 nt, Human herpesvirus 2
gcucgucgcgacccugc

SEQ ID NO: 3959396 - RNA, 19 nt, Human herpesvirus 2
gcucugucccccgggcagc

SEQ ID NO: 3959397 - RNA, 23 nt, Human herpesvirus 2
gcucuguuucgcauaugcccugg

SEQ ID NO: 3959398 - RNA, 13 nt, Human herpesvirus 2
gcugcccccgcgc

SEQ ID NO: 3959399 - RNA, 11 nt, Human herpesvirus 2
gcugcggggac

SEQ ID NO: 3959400 - RNA, 20 nt, Human herpesvirus 2
gcugcugagcccugccccgc

SEQ ID NO: 3959401 - RNA, 16 nt, Human herpesvirus 2
gcuggagcucugccug

SEQ ID NO: 3959402 - RNA, 13 nt, Human herpesvirus 2
gcuggggaaaucu

SEQ ID NO: 3959403 - RNA, 15 nt, Human herpesvirus 2
gcugguggccgcggu

SEQ ID NO: 3959404 - RNA, 15 nt, Human herpesvirus 2
gcugguuucucugcg

SEQ ID NO: 3959405 - RNA, 18 nt, Human herpesvirus 2
gcuguggcccuggcggac

SEQ ID NO: 3959406 - RNA, 18 nt, Human herpesvirus 2
gcuuagucccggguccgg

SEQ ID NO: 3959407 - RNA, 21 nt, Human herpesvirus 2
gcuuccaccccccccccccuu

SEQ ID NO: 3959408 - RNA, 23 nt, Human herpesvirus 2
gcuugccccucccccggcccagc

SEQ ID NO: 3959409 - RNA, 12 nt, Human herpesvirus 2
gcuugcggggcu

SEQ ID NO: 3959410 - RNA, 16 nt, Human herpesvirus 2
gcuugcugcccgaagg

SEQ ID NO: 3959411 - RNA, 16 nt, Human herpesvirus 2
gcuuggacugggagcc

SEQ ID NO: 3959412 - RNA, 14 nt, Human herpesvirus 2
ggaaacgcaaaaaa

SEQ ID NO: 3959413 - RNA, 20 nt, Human herpesvirus 2
ggaaacgcaaaaaaaacaag

SEQ ID NO: 3959414 - RNA, 23 nt, Human herpesvirus 2
gggcguccugcggcagcgcgccg

SEQ ID NO: 3959415 - RNA, 11 nt, Human herpesvirus 2
gggcuccucag

SEQ ID NO: 3959416 - RNA, 19 nt, Human herpesvirus 2
gggcugggagcccuccucg

SEQ ID NO: 3959417 - RNA, 23 nt, Human herpesvirus 2
gggcuuggacugggagccgcgau

SEQ ID NO: 3959418 - RNA, 14 nt, Human herpesvirus 2
ggggaaagugggcc

SEQ ID NO: 3959419 - RNA, 21 nt, Human herpesvirus 2
ggggaaggaaucgggcgucug

SEQ ID NO: 3959420 - RNA, 13 nt, Human herpesvirus 2
ggggacagccccg

SEQ ID NO: 3959421 - RNA, 19 nt, Human herpesvirus 2
ggggacggccgggcagagc

SEQ ID NO: 3959422 - RNA, 13 nt, Human herpesvirus 2
ggggagggcgugg

SEQ ID NO: 3959423 - RNA, 15 nt, Human herpesvirus 2
ggggagggggugugg

SEQ ID NO: 3959424 - RNA, 21 nt, Human herpesvirus 2
ggggaucugucgccggcgugg

SEQ ID NO: 3959425 - RNA, 18 nt, Human herpesvirus 2
ggggaugggggggaaggg

SEQ ID NO: 3959426 - RNA, 14 nt, Human herpesvirus 2
ggggcaagugcagu

SEQ ID NO: 3959427 - RNA, 15 nt, Human herpesvirus 2
ggggcaagugcagua

SEQ ID NO: 3959428 - RNA, 18 nt, Human herpesvirus 2
ggggcaccaaaaaccagg

SEQ ID NO: 3959429 - RNA, 17 nt, Human herpesvirus 2
ggggccaggaacuccag

SEQ ID NO: 3959430 - RNA, 14 nt, Human herpesvirus 2
ggggccccagggcu

SEQ ID NO: 3959431 - RNA, 18 nt, Human herpesvirus 2
ggggccgucgcggccgcc

SEQ ID NO: 3959432 - RNA, 21 nt, Human herpesvirus 2
ggggcuccucagcgcggccgu

SEQ ID NO: 3959433 - RNA, 12 nt, Human herpesvirus 2
gggggaaacaca

SEQ ID NO: 3959434 - RNA, 21 nt, Human herpesvirus 2
gggggaacgcgcacccuugcc

SEQ ID NO: 3959435 - RNA, 20 nt, Human herpesvirus 2
gggggacccgacccuguggc

SEQ ID NO: 3959436 - RNA, 18 nt, Human herpesvirus 2
gggggcgcugguggccgc

SEQ ID NO: 3959437 - RNA, 12 nt, Human herpesvirus 2
gggggcgggcac

SEQ ID NO: 3959438 - RNA, 22 nt, Human herpesvirus 2
gggggucgggcgggcggggguc

SEQ ID NO: 3959439 - RNA, 14 nt, Human herpesvirus 2
ggggugggucgccg

SEQ ID NO: 3959440 - RNA, 14 nt, Human herpesvirus 2
ggguaggccagagc

SEQ ID NO: 3959441 - RNA, 15 nt, Human herpesvirus 2
ggguccgacgaggcc

SEQ ID NO: 3959442 - RNA, 20 nt, Human herpesvirus 2
ggguccgacgaggccuuccc

SEQ ID NO: 3959443 - RNA, 14 nt, Human herpesvirus 2
ggguccgggggccu

SEQ ID NO: 3959444 - RNA, 16 nt, Human herpesvirus 2
ggguccgggggccugg

SEQ ID NO: 3959445 - RNA, 15 nt, Human herpesvirus 2
gggugaggaagaaag

SEQ ID NO: 3959446 - RNA, 17 nt, Human herpesvirus 2
gggugugacccccccau

SEQ ID NO: 3959447 - RNA, 18 nt, Human herpesvirus 2
gggugugcugcuguuggg

SEQ ID NO: 3959448 - RNA, 17 nt, Human herpesvirus 2
ggguguguggggagggg

SEQ ID NO: 3959449 - RNA, 22 nt, Human herpesvirus 2
ggguucgcgcaucucuggcucc

SEQ ID NO: 3959450 - RNA, 20 nt, Human herpesvirus 2
ggguuuuuuaaccggcccca

SEQ ID NO: 3959451 - RNA, 14 nt, Human herpesvirus 2
gguacuggggcccc

SEQ ID NO: 3959452 - RNA, 16 nt, Human herpesvirus 2
gguagcggacgcacgg

SEQ ID NO: 3959453 - RNA, 13 nt, Human herpesvirus 2
ggucaauagauuu

SEQ ID NO: 3959454 - RNA, 19 nt, Human herpesvirus 2
ggucaauagauuuccccaa

SEQ ID NO: 3959455 - RNA, 18 nt, Human herpesvirus 2
ggucacaaaaggcacggc

SEQ ID NO: 3959456 - RNA, 21 nt, Human herpesvirus 2
gguccaauauggcccagcgca

SEQ ID NO: 3959457 - RNA, 13 nt, Human herpesvirus 2
ggucccccggacc

SEQ ID NO: 3959458 - RNA, 14 nt, Human herpesvirus 2
gguccccgaacaaa

SEQ ID NO: 3959459 - RNA, 14 nt, Human herpesvirus 2
gguccccgucggaa

SEQ ID NO: 3959460 - RNA, 15 nt, Human herpesvirus 2
ggucccgauggccgc

SEQ ID NO: 3959461 - RNA, 18 nt, Human herpesvirus 2
ggucccggccgccauccc

SEQ ID NO: 3959462 - RNA, 13 nt, Human herpesvirus 2
gguccuggugggc

SEQ ID NO: 3959463 - RNA, 19 nt, Human herpesvirus 2
ggucgaucucggggagggc

SEQ ID NO: 3959464 - RNA, 14 nt, Human herpesvirus 2
ggucgcucuguccc

SEQ ID NO: 3959465 - RNA, 20 nt, Human herpesvirus 2
ggucuuuccguggcgccugg

SEQ ID NO: 3959466 - RNA, 22 nt, Human herpesvirus 2
ggugacggaaaaccugggcggc

SEQ ID NO: 3959467 - RNA, 16 nt, Human herpesvirus 2
ggugcaguuugagcag

SEQ ID NO: 3959468 - RNA, 22 nt, Human herpesvirus 2
ggugcccaucuacguggccggg

SEQ ID NO: 3959469 - RNA, 23 nt, Human herpesvirus 2
gguggcccuuccggaccccgacc

SEQ ID NO: 3959470 - RNA, 15 nt, Human herpesvirus 2
gguguguuuggcgug

SEQ ID NO: 3959471 - RNA, 13 nt, Human herpesvirus 2
gguuggggcgggc

SEQ ID NO: 3959472 - RNA, 16 nt, Human herpesvirus 2
guacagcauguggccc

SEQ ID NO: 3959473 - RNA, 22 nt, Human herpesvirus 2
guacagccuacaucaccccagg

SEQ ID NO: 3959474 - RNA, 12 nt, Human herpesvirus 2
guacccucucaa

SEQ ID NO: 3959475 - RNA, 22 nt, Human herpesvirus 2
guacccucucaacgcccaggcc

SEQ ID NO: 3959476 - RNA, 14 nt, Human herpesvirus 2
guaccucugggccc

SEQ ID NO: 3959477 - RNA, 16 nt, Human herpesvirus 2
guacgaucgagguggc

SEQ ID NO: 3959478 - RNA, 16 nt, Human herpesvirus 2
guacuucuacaccucc

SEQ ID NO: 3959479 - RNA, 12 nt, Human herpesvirus 2
guaggccagagc

SEQ ID NO: 3959480 - RNA, 16 nt, Human herpesvirus 2
guaggguccgcggggg

SEQ ID NO: 3959481 - RNA, 20 nt, Human herpesvirus 2
guaucagugggugacagagu

SEQ ID NO: 3959482 - RNA, 12 nt, Human herpesvirus 2
guaucggccagg

SEQ ID NO: 3959483 - RNA, 13 nt, Human herpesvirus 2
guaucggccagga

SEQ ID NO: 3959484 - RNA, 15 nt, Human herpesvirus 2
guauucccccgcggg

SEQ ID NO: 3959485 - RNA, 14 nt, Human herpesvirus 2
gucaccgggggccc

SEQ ID NO: 3959486 - RNA, 15 nt, Human herpesvirus 2
gucaccuggcucgcc

SEQ ID NO: 3959487 - RNA, 16 nt, Human herpesvirus 2
guccccaggcgacgcc

SEQ ID NO: 3959488 - RNA, 16 nt, Human herpesvirus 2
guccccggugucuccg

SEQ ID NO: 3959489 - RNA, 21 nt, Human herpesvirus 2
guccccuacgccccccucggc

SEQ ID NO: 3959490 - RNA, 12 nt, Human herpesvirus 2
guccccuggggc

SEQ ID NO: 3959491 - RNA, 15 nt, Human herpesvirus 2
gucccgauggccgcc

SEQ ID NO: 3959492 - RNA, 12 nt, Human herpesvirus 2
gucccucgcgcg

SEQ ID NO: 3959493 - RNA, 19 nt, Human herpesvirus 2
gucccucgcgcgcauccac

SEQ ID NO: 3959494 - RNA, 20 nt, Human herpesvirus 2
guccuaaggcgccgacggcg

SEQ ID NO: 3959495 - RNA, 23 nt, Human herpesvirus 2
guccuaaggcgccgacggcggcg

SEQ ID NO: 3959496 - RNA, 20 nt, Human herpesvirus 2
guccuccggcgcgcacuccc

SEQ ID NO: 3959497 - RNA, 17 nt, Human herpesvirus 2
guccucgccgcuguggc

SEQ ID NO: 3959498 - RNA, 16 nt, Human herpesvirus 2
guccugcggcagcgcg

SEQ ID NO: 3959499 - RNA, 13 nt, Human herpesvirus 2
guccugcggcuca

SEQ ID NO: 3959500 - RNA, 21 nt, Human herpesvirus 2
guccuggaggggggugcugug

SEQ ID NO: 3959501 - RNA, 20 nt, Human herpesvirus 2
gucgccaacggccagcgggg

SEQ ID NO: 3959502 - RNA, 21 nt, Human herpesvirus 2
gucgcgcuuuuccgccgccgg

SEQ ID NO: 3959503 - RNA, 11 nt, Human herpesvirus 2
gucgcuaacga

SEQ ID NO: 3959504 - RNA, 16 nt, Human herpesvirus 2
gucgcuccggcucccg

SEQ ID NO: 3959505 - RNA, 20 nt, Human herpesvirus 2
gucgcuuuccacacccccuc

SEQ ID NO: 3959506 - RNA, 15 nt, Human herpesvirus 2
gucggagaggcccgc

SEQ ID NO: 3959507 - RNA, 13 nt, Human herpesvirus 2
gucggugccagac

SEQ ID NO: 3959508 - RNA, 13 nt, Human herpesvirus 2
gucguagaucggg

SEQ ID NO: 3959509 - RNA, 15 nt, Human herpesvirus 2
gucugcgccaccggc

SEQ ID NO: 3959510 - RNA, 20 nt, Human herpesvirus 2
gucugcgccaccggccuggu

SEQ ID NO: 3959511 - RNA, 21 nt, Human herpesvirus 2
gugacucgccauggcggccgc

SEQ ID NO: 3959512 - RNA, 17 nt, Human herpesvirus 2
gugcaccgaaggaggaa

SEQ ID NO: 3959513 - RNA, 13 nt, Human herpesvirus 2
gugccgcagacca

SEQ ID NO: 3959514 - RNA, 17 nt, Human herpesvirus 2
gugcgcucgcucuccgu

SEQ ID NO: 3959515 - RNA, 21 nt, Human herpesvirus 2
gugcgcucgcucuccgugccc

SEQ ID NO: 3959516 - RNA, 21 nt, Human herpesvirus 2
gugcgcuuauaagagcgggcc

SEQ ID NO: 3959517 - RNA, 15 nt, Human herpesvirus 2
gugcgugcggcccug

SEQ ID NO: 3959518 - RNA, 20 nt, Human herpesvirus 2
gugcgugcugcugagcccug

SEQ ID NO: 3959519 - RNA, 15 nt, Human herpesvirus 2
gugcucggggacaga

SEQ ID NO: 3959520 - RNA, 16 nt, Human herpesvirus 2
gugcugcugagcccug

SEQ ID NO: 3959521 - RNA, 15 nt, Human herpesvirus 2
gugcuggugguggaa

SEQ ID NO: 3959522 - RNA, 16 nt, Human herpesvirus 2
gugcugugcccugggu

SEQ ID NO: 3959523 - RNA, 21 nt, Human herpesvirus 2
gugcuguggcggucggccagc

SEQ ID NO: 3959524 - RNA, 15 nt, Human herpesvirus 2
guggacgcagcggcg

SEQ ID NO: 3959525 - RNA, 15 nt, Human herpesvirus 2
guggcccacgagcuc

SEQ ID NO: 3959526 - RNA, 16 nt, Human herpesvirus 2
guggcggucggccagc

SEQ ID NO: 3959527 - RNA, 15 nt, Human herpesvirus 2
gugggccuagccgug

SEQ ID NO: 3959528 - RNA, 16 nt, Human herpesvirus 2
guggggacgaggccca

SEQ ID NO: 3959529 - RNA, 22 nt, Human herpesvirus 2
gugggucugcgccaccggccug

SEQ ID NO: 3959530 - RNA, 14 nt, Human herpesvirus 2
gugggugggugugg

SEQ ID NO: 3959531 - RNA, 23 nt, Human herpesvirus 2
guggucguggugcuggccaaugc

SEQ ID NO: 3959532 - RNA, 16 nt, Human herpesvirus 2
cuuggcgcgcgcggcg

SEQ ID NO: 3959533 - RNA, 19 nt, Human herpesvirus 2
cuuuccacacccccucccc

SEQ ID NO: 3959534 - RNA, 20 nt, Human herpesvirus 2
cuuucccuucuccauuccug

SEQ ID NO: 3959535 - RNA, 23 nt, Human herpesvirus 2
cuuuccuuaaaaggcaccccauc

SEQ ID NO: 3959536 - RNA, 13 nt, Human herpesvirus 2
cuuucuuuccccc

SEQ ID NO: 3959537 - RNA, 18 nt, Human herpesvirus 2
cuuucuuuuugccuccca

SEQ ID NO: 3959538 - RNA, 22 nt, Human herpesvirus 2
cuuuuguuccaccgcucaccca

SEQ ID NO: 3959539 - RNA, 22 nt, Human herpesvirus 2
gaaaacggucggcgaacacaac

SEQ ID NO: 3959540 - RNA, 20 nt, Human herpesvirus 2
gaaacacgguggcgcgcugg

SEQ ID NO: 3959541 - RNA, 17 nt, Human herpesvirus 2
gaaaccgggggucgcac

SEQ ID NO: 3959542 - RNA, 22 nt, Human herpesvirus 2
gaaacuuccgggagcgggggag

SEQ ID NO: 3959543 - RNA, 22 nt, Human herpesvirus 2
gaaagcgaagacgaggccgcca

SEQ ID NO: 3959544 - RNA, 22 nt, Human herpesvirus 2
gaaagcuggcgucgggggcggg

SEQ ID NO: 3959545 - RNA, 20 nt, Human herpesvirus 2
gaaauaaagaacgagacaga

SEQ ID NO: 3959546 - RNA, 15 nt, Human herpesvirus 2
gaaaucucucugccg

SEQ ID NO: 3959547 - RNA, 14 nt, Human herpesvirus 2
gaaaugggggcggg

SEQ ID NO: 3959548 - RNA, 20 nt, Human herpesvirus 2
gaacggucuccgccaugcaa

SEQ ID NO: 3959549 - RNA, 19 nt, Human herpesvirus 2
gaacuccagcuuggccgug

SEQ ID NO: 3959550 - RNA, 19 nt, Human herpesvirus 2
gaagcccgaacggaaggcc

SEQ ID NO: 3959551 - RNA, 22 nt, Human herpesvirus 2
gaagcccgaacggaaggccucc

SEQ ID NO: 3959552 - RNA, 21 nt, Human herpesvirus 2
gaaggaacgcccgaaaccaga

SEQ ID NO: 3959553 - RNA, 22 nt, Human herpesvirus 2
gaaggaaucgggcgucugugcg

SEQ ID NO: 3959554 - RNA, 17 nt, Human herpesvirus 2
gaauugacaagcggggg

SEQ ID NO: 3959555 - RNA, 22 nt, Human herpesvirus 2
gacacacuuuguuguuggccuu

SEQ ID NO: 3959556 - RNA, 14 nt, Human herpesvirus 2
gacaccagcagcuu

SEQ ID NO: 3959557 - RNA, 21 nt, Human herpesvirus 2
gacaccagcagcuugcggggc

SEQ ID NO: 3959558 - RNA, 17 nt, Human herpesvirus 2
gacagccagggcuggga

SEQ ID NO: 3959559 - RNA, 14 nt, Human herpesvirus 2
gacagcggggaccc

SEQ ID NO: 3959560 - RNA, 18 nt, Human herpesvirus 2
gaccaaaacggaccccgc

SEQ ID NO: 3959561 - RNA, 23 nt, Human herpesvirus 2
gaccaccgcggacagccagggcu

SEQ ID NO: 3959562 - RNA, 16 nt, Human herpesvirus 2
gaccagaccguggccg

SEQ ID NO: 3959563 - RNA, 16 nt, Human herpesvirus 2
gacccaccgcaccacc

SEQ ID NO: 3959564 - RNA, 14 nt, Human herpesvirus 2
gaccccgcugcugu

SEQ ID NO: 3959565 - RNA, 15 nt, Human herpesvirus 2
gacccggcggcgguc

SEQ ID NO: 3959566 - RNA, 21 nt, Human herpesvirus 2
gacccgggcgagcuggcccug

SEQ ID NO: 3959567 - RNA, 13 nt, Human herpesvirus 2
gacccugcccccc

SEQ ID NO: 3959568 - RNA, 21 nt, Human herpesvirus 2
gaccgccccccccggcggggc

SEQ ID NO: 3959569 - RNA, 22 nt, Human herpesvirus 2
gaccggcggggcccccgaccga

SEQ ID NO: 3959570 - RNA, 22 nt, Human herpesvirus 2
gaccggucgcuuuccacacccc

SEQ ID NO: 3959571 - RNA, 22 nt, Human herpesvirus 2
gaccucgcccccgucgcccccc

SEQ ID NO: 3959572 - RNA, 14 nt, Human herpesvirus 2
gaccugcagccggc

SEQ ID NO: 3959573 - RNA, 19 nt, Human herpesvirus 2
gaccugggggauuguggga

SEQ ID NO: 3959574 - RNA, 15 nt, Human herpesvirus 2
gacgccagcugcugg

SEQ ID NO: 3959575 - RNA, 14 nt, Human herpesvirus 2
gacgcggcacaggu

SEQ ID NO: 3959576 - RNA, 20 nt, Human herpesvirus 2
gacgcggcacagguggugca

SEQ ID NO: 3959577 - RNA, 20 nt, Human herpesvirus 2
gacgcugucgacgagucuca

SEQ ID NO: 3959578 - RNA, 15 nt, Human herpesvirus 2
gacggcaauaaaaga

SEQ ID NO: 3959579 - RNA, 18 nt, Human herpesvirus 2
gacggccaugaccucgcc

SEQ ID NO: 3959580 - RNA, 21 nt, Human herpesvirus 2
gacgggaguuccgacgacgcg

SEQ ID NO: 3959581 - RNA, 13 nt, Human herpesvirus 2
gacggggaggaga

SEQ ID NO: 3959582 - RNA, 23 nt, Human herpesvirus 2
gacgggugggccuagccgugggc

SEQ ID NO: 3959583 - RNA, 17 nt, Human herpesvirus 2
gacgucggcggacacgc

SEQ ID NO: 3959584 - RNA, 15 nt, Human herpesvirus 2
gacuagaaaaacaaa

SEQ ID NO: 3959585 - RNA, 23 nt, Human herpesvirus 2
gacucacucguggaugccggggc

SEQ ID NO: 3959586 - RNA, 21 nt, Human herpesvirus 2
gacuccgccccggcgaccgcc

SEQ ID NO: 3959587 - RNA, 20 nt, Human herpesvirus 2
gacugcagccccgguccccc

SEQ ID NO: 3959588 - RNA, 23 nt, Human herpesvirus 2
gacugccuccacgcccugcugua

SEQ ID NO: 3959589 - RNA, 18 nt, Human herpesvirus 2
gacuggccgugcugggcg

SEQ ID NO: 3959590 - RNA, 15 nt, Human herpesvirus 2
gacuuccgugccccu

SEQ ID NO: 3959591 - RNA, 16 nt, Human herpesvirus 2
gacuuggugcgccgcc

SEQ ID NO: 3959592 - RNA, 21 nt, Human herpesvirus 2
gagagagggggggaaagaaag

SEQ ID NO: 3959593 - RNA, 14 nt, Human herpesvirus 2
gagagggggaagga

SEQ ID NO: 3959594 - RNA, 20 nt, Human herpesvirus 2
gagaguucaauagauuuccc

SEQ ID NO: 3959595 - RNA, 13 nt, Human herpesvirus 2
gagcagcacggcg

SEQ ID NO: 3959596 - RNA, 17 nt, Human herpesvirus 2
gagcagcacggcggcca

SEQ ID NO: 3959597 - RNA, 17 nt, Human herpesvirus 2
gagccccccacgugggc

SEQ ID NO: 3959598 - RNA, 21 nt, Human herpesvirus 2
gagcccucacgucuucgccca

SEQ ID NO: 3959599 - RNA, 23 nt, Human herpesvirus 2
gagcccugccccgcccccucucc

SEQ ID NO: 3959600 - RNA, 22 nt, Human herpesvirus 2
gagccgcccauccgaggaccgc

SEQ ID NO: 3959601 - RNA, 14 nt, Human herpesvirus 2
gagccgcugugcca

SEQ ID NO: 3959602 - RNA, 15 nt, Human herpesvirus 2
gagcgggcccggggc

SEQ ID NO: 3959603 - RNA, 17 nt, Human herpesvirus 2
gagcguaucggccagga

SEQ ID NO: 3959604 - RNA, 19 nt, Human herpesvirus 2
gaggaccacgugcacagcc

SEQ ID NO: 3959605 - RNA, 17 nt, Human herpesvirus 2
gaggagagcgucagcgc

SEQ ID NO: 3959606 - RNA, 22 nt, Human herpesvirus 2
gaggaggcggcgccugcgcccc

SEQ ID NO: 3959607 - RNA, 18 nt, Human herpesvirus 2
gaggcccggaacgagguu

SEQ ID NO: 3959608 - RNA, 17 nt, Human herpesvirus 2
gaggcccucugggacac

SEQ ID NO: 3959609 - RNA, 16 nt, Human herpesvirus 2
gaggcuggagcgcugg

SEQ ID NO: 3959610 - RNA, 19 nt, Human herpesvirus 2
gagggcucaucgggaaucu

SEQ ID NO: 3959611 - RNA, 13 nt, Human herpesvirus 2
gaggggcuccuca

SEQ ID NO: 3959612 - RNA, 16 nt, Human herpesvirus 2
gagucccccggcuccg

SEQ ID NO: 3959613 - RNA, 17 nt, Human herpesvirus 2
gagugggggggggggac

SEQ ID NO: 3959614 - RNA, 14 nt, Human herpesvirus 2
gauacaacacaccc

SEQ ID NO: 3959615 - RNA, 11 nt, Human herpesvirus 2
gauagcaaacg

SEQ ID NO: 3959616 - RNA, 19 nt, Human herpesvirus 2
gauccgaacggcgcacgcc

SEQ ID NO: 3959617 - RNA, 17 nt, Human herpesvirus 2
gaucguugacgacggcc

SEQ ID NO: 3959618 - RNA, 22 nt, Human herpesvirus 2
gaucuggcgaccgucuuugggc

SEQ ID NO: 3959619 - RNA, 17 nt, Human herpesvirus 2
gaugaagcgccaggggg

SEQ ID NO: 3959620 - RNA, 19 nt, Human herpesvirus 2
gaugagccgguagugcagg

SEQ ID NO: 3959621 - RNA, 15 nt, Human herpesvirus 2
gaugcagcucccccg

SEQ ID NO: 3959622 - RNA, 24 nt, Human herpesvirus 2
gaugcagcucccccgcgcaggggg

SEQ ID NO: 3959623 - RNA, 14 nt, Human herpesvirus 2
gaugcgccuggugg

SEQ ID NO: 3959624 - RNA, 21 nt, Human herpesvirus 2
gaugcgcgccgguacuggggc

SEQ ID NO: 3959625 - RNA, 13 nt, Human herpesvirus 2
gaugggcgggggg

SEQ ID NO: 3959626 - RNA, 13 nt, Human herpesvirus 2
gauggggguccug

SEQ ID NO: 3959627 - RNA, 16 nt, Human herpesvirus 2
gaugugucgcggggac

SEQ ID NO: 3959628 - RNA, 11 nt, Human herpesvirus 2
gauugauuuua

SEQ ID NO: 3959629 - RNA, 17 nt, Human herpesvirus 2
gauuuacgagggggcaa

SEQ ID NO: 3959630 - RNA, 15 nt, Human herpesvirus 2
gcaaacgugggauga

SEQ ID NO: 3959631 - RNA, 17 nt, Human herpesvirus 2
gcaaccaaaucaccccc

SEQ ID NO: 3959632 - RNA, 20 nt, Human herpesvirus 2
gcaaccaaaucacccccaga

SEQ ID NO: 3959633 - RNA, 15 nt, Human herpesvirus 2
gcaccacgugucccc

SEQ ID NO: 3959634 - RNA, 20 nt, Human herpesvirus 2
gcaccagcucgggggccagg

SEQ ID NO: 3959635 - RNA, 18 nt, Human herpesvirus 2
gcaccgcgggaggaaggc

SEQ ID NO: 3959636 - RNA, 16 nt, Human herpesvirus 2
gcaccggacgcgcacg

SEQ ID NO: 3959637 - RNA, 23 nt, Human herpesvirus 2
gcaccugcagaugcugcccgcgg

SEQ ID NO: 3959638 - RNA, 18 nt, Human herpesvirus 2
gcacgccgcgugggcucc

SEQ ID NO: 3959639 - RNA, 16 nt, Human herpesvirus 2
gcacgcggggacccgc

SEQ ID NO: 3959640 - RNA, 18 nt, Human herpesvirus 2
gcacgcguuuguggcgag

SEQ ID NO: 3959641 - RNA, 22 nt, Human herpesvirus 2
gcacguacguucugccccgcgu

SEQ ID NO: 3959642 - RNA, 17 nt, Human herpesvirus 2
gcacgugcgucuuccca

SEQ ID NO: 3959643 - RNA, 22 nt, Human herpesvirus 2
gcacucgggcguagagcucggc

SEQ ID NO: 3959644 - RNA, 14 nt, Human herpesvirus 2
gcagagagauuucc

SEQ ID NO: 3959645 - RNA, 13 nt, Human herpesvirus 2
gcagccgcgccgc

SEQ ID NO: 3959646 - RNA, 19 nt, Human herpesvirus 2
gcgcaugggccgccagcag

SEQ ID NO: 3959647 - RNA, 15 nt, Human herpesvirus 2
gcgccaagcgccccg

SEQ ID NO: 3959648 - RNA, 14 nt, Human herpesvirus 2
gcgccagggggauc

SEQ ID NO: 3959649 - RNA, 17 nt, Human herpesvirus 2
gcgcccccggccgcggu

SEQ ID NO: 3959650 - RNA, 16 nt, Human herpesvirus 2
gcgccguccucgugga

SEQ ID NO: 3959651 - RNA, 15 nt, Human herpesvirus 2
gcgccgucgggcccc

SEQ ID NO: 3959652 - RNA, 13 nt, Human herpesvirus 2
gcgcgcacucccg

SEQ ID NO: 3959653 - RNA, 14 nt, Human herpesvirus 2
gcgcgcccccgccg

SEQ ID NO: 3959654 - RNA, 13 nt, Human herpesvirus 2
gcgcgcguccgua

SEQ ID NO: 3959655 - RNA, 13 nt, Human herpesvirus 2
gcgcgcuucgcgg

SEQ ID NO: 3959656 - RNA, 19 nt, Human herpesvirus 2
gcgcgugugugagaaauaa

SEQ ID NO: 3959657 - RNA, 20 nt, Human herpesvirus 2
gcgcucgcucuccgugcccc

SEQ ID NO: 3959658 - RNA, 17 nt, Human herpesvirus 2
gcgcucggcaugcgcgg

SEQ ID NO: 3959659 - RNA, 17 nt, Human herpesvirus 2
gcggaacccgcgggcgc

SEQ ID NO: 3959660 - RNA, 19 nt, Human herpesvirus 2
gcggacccagaccugccgu

SEQ ID NO: 3959661 - RNA, 17 nt, Human herpesvirus 2
gcggaccggcccccgga

SEQ ID NO: 3959662 - RNA, 16 nt, Human herpesvirus 2
gcggacgaccugguga

SEQ ID NO: 3959663 - RNA, 19 nt, Human herpesvirus 2
gcggacuggcagccgggac

SEQ ID NO: 3959664 - RNA, 16 nt, Human herpesvirus 2
gcggagggcggccagc

SEQ ID NO: 3959665 - RNA, 23 nt, Human herpesvirus 2
gcggaggggaucagcaaccaggc

SEQ ID NO: 3959666 - RNA, 20 nt, Human herpesvirus 2
gcggaguaugaccgucggug

SEQ ID NO: 3959667 - RNA, 22 nt, Human herpesvirus 2
gcggcaccauaacaccgucccc

SEQ ID NO: 3959668 - RNA, 20 nt, Human herpesvirus 2
gcggccagccgcccccgccg

SEQ ID NO: 3959669 - RNA, 15 nt, Human herpesvirus 2
gcggccauccugccc

SEQ ID NO: 3959670 - RNA, 19 nt, Human herpesvirus 2
gcggccccuguuggagccg

SEQ ID NO: 3959671 - RNA, 22 nt, Human herpesvirus 2
gcggcccugagccgcgcggcca

SEQ ID NO: 3959672 - RNA, 21 nt, Human herpesvirus 2
gcggccgccgcaacacccggc

SEQ ID NO: 3959673 - RNA, 16 nt, Human herpesvirus 2
gcggcgacggcaccgc

SEQ ID NO: 3959674 - RNA, 14 nt, Human herpesvirus 2
gcggcgcgagcucc

SEQ ID NO: 3959675 - RNA, 18 nt, Human herpesvirus 2
gcggcuucuucgccgccc

SEQ ID NO: 3959676 - RNA, 17 nt, Human herpesvirus 2
gcgggaaaucaaggucg

SEQ ID NO: 3959677 - RNA, 14 nt, Human herpesvirus 2
gcgggaagcgccgc

SEQ ID NO: 3959678 - RNA, 16 nt, Human herpesvirus 2
gcgggcaggccgcggc

SEQ ID NO: 3959679 - RNA, 21 nt, Human herpesvirus 2
gcgggcguccccgagcggcgc

SEQ ID NO: 3959680 - RNA, 13 nt, Human herpesvirus 2
gcggggccccggg

SEQ ID NO: 3959681 - RNA, 20 nt, Human herpesvirus 2
gcggggggggggcugcgggc

SEQ ID NO: 3959682 - RNA, 15 nt, Human herpesvirus 2
gcgggucccuuccca

SEQ ID NO: 3959683 - RNA, 20 nt, Human herpesvirus 2
gcgggugcccauggcgucgg

SEQ ID NO: 3959684 - RNA, 19 nt, Human herpesvirus 2
gcgguauggcugcccccgc

SEQ ID NO: 3959685 - RNA, 14 nt, Human herpesvirus 2
gcggugcgccccgc

SEQ ID NO: 3959686 - RNA, 19 nt, Human herpesvirus 2
gcgguucgcgugcggccag

SEQ ID NO: 3959687 - RNA, 14 nt, Human herpesvirus 2
gcguaccccuuuga

SEQ ID NO: 3959688 - RNA, 21 nt, Human herpesvirus 2
gcguauaaaggcaggcgcgcg

SEQ ID NO: 3959689 - RNA, 18 nt, Human herpesvirus 2
gcguccgacacccgggcc

SEQ ID NO: 3959690 - RNA, 17 nt, Human herpesvirus 2
gcgucguccaggguggg

SEQ ID NO: 3959691 - RNA, 15 nt, Human herpesvirus 2
gcgugcggcccugcc

SEQ ID NO: 3959692 - RNA, 17 nt, Human herpesvirus 2
gcgugcguucuggcggc

SEQ ID NO: 3959693 - RNA, 15 nt, Human herpesvirus 2
gcgugcugcugagcc

SEQ ID NO: 3959694 - RNA, 18 nt, Human herpesvirus 2
gcguugcguuggggcacg

SEQ ID NO: 3959695 - RNA, 21 nt, Human herpesvirus 2
gcguugguucucguacccccu

SEQ ID NO: 3959696 - RNA, 15 nt, Human herpesvirus 2
gcuacccgcauccgc

SEQ ID NO: 3959697 - RNA, 18 nt, Human herpesvirus 2
gcuacccgcauccgcacg

SEQ ID NO: 3959698 - RNA, 15 nt, Human herpesvirus 2
gcuaguacccagagg

SEQ ID NO: 3959699 - RNA, 13 nt, Human herpesvirus 2
gcuccaggccgcc

SEQ ID NO: 3959700 - RNA, 21 nt, Human herpesvirus 2
gcuccagguacugcugcacgu

SEQ ID NO: 3959701 - RNA, 12 nt, Human herpesvirus 2
gcuccauccuga

SEQ ID NO: 3959702 - RNA, 13 nt, Human herpesvirus 2
gcuccccuucagc

SEQ ID NO: 3959703 - RNA, 19 nt, Human herpesvirus 2
gcuccccuucagccuggac

SEQ ID NO: 3959704 - RNA, 15 nt, Human herpesvirus 2
gcuccggcucccggc

SEQ ID NO: 3959705 - RNA, 16 nt, Human herpesvirus 2
gcuccucagcgcggcc

SEQ ID NO: 3959706 - RNA, 19 nt, Human herpesvirus 2
gcucgccagcgacccgcac

SEQ ID NO: 3959707 - RNA, 17 nt, Human herpesvirus 2
gcucgcggagggcggcc

SEQ ID NO: 3959708 - RNA, 15 nt, Human herpesvirus 2
gcucgucccccgagg

SEQ ID NO: 3959709 - RNA, 23 nt, Human herpesvirus 2
gcucugccugcacgagcgccguc

SEQ ID NO: 3959710 - RNA, 16 nt, Human herpesvirus 2
gcugcggggaccagcc

SEQ ID NO: 3959711 - RNA, 15 nt, Human herpesvirus 2
gcugcugccccgcgu

SEQ ID NO: 3959712 - RNA, 18 nt, Human herpesvirus 2
gcuggagcgcugguggga

SEQ ID NO: 3959713 - RNA, 13 nt, Human herpesvirus 2
gcuggccccucug

SEQ ID NO: 3959714 - RNA, 14 nt, Human herpesvirus 2
gcuggcgccgccgg

SEQ ID NO: 3959715 - RNA, 20 nt, Human herpesvirus 2
gcuguuguuucugggcccgc

SEQ ID NO: 3959716 - RNA, 18 nt, Human herpesvirus 2
gcuuagggugugaccccc

SEQ ID NO: 3959717 - RNA, 16 nt, Human herpesvirus 2
gcuucgggacccgccu

SEQ ID NO: 3959718 - RNA, 17 nt, Human herpesvirus 2
gcuucgucaacagggcg

SEQ ID NO: 3959719 - RNA, 23 nt, Human herpesvirus 2
gcuucucgccucucuucuucccc

SEQ ID NO: 3959720 - RNA, 23 nt, Human herpesvirus 2
ggaaaucuauugaacucucccgg

SEQ ID NO: 3959721 - RNA, 18 nt, Human herpesvirus 2
ggaacugggguacugcac

SEQ ID NO: 3959722 - RNA, 19 nt, Human herpesvirus 2
ggaacuguguuuccccccc

SEQ ID NO: 3959723 - RNA, 21 nt, Human herpesvirus 2
ggaacuguguuucccccccua

SEQ ID NO: 3959724 - RNA, 18 nt, Human herpesvirus 2
ggaagaggcggacccagu

SEQ ID NO: 3959725 - RNA, 19 nt, Human herpesvirus 2
ggacagccagggcugggag

SEQ ID NO: 3959726 - RNA, 15 nt, Human herpesvirus 2
ggacgcagcggcguc

SEQ ID NO: 3959727 - RNA, 11 nt, Human herpesvirus 2
ggacgcccccu

SEQ ID NO: 3959728 - RNA, 14 nt, Human herpesvirus 2
ggacgcccccuccc

SEQ ID NO: 3959729 - RNA, 19 nt, Human herpesvirus 2
ggagagggggaaggaaucg

SEQ ID NO: 3959730 - RNA, 14 nt, Human herpesvirus 2
ggagauggggagag

SEQ ID NO: 3959731 - RNA, 17 nt, Human herpesvirus 2
ggagccgcggccccgcc

SEQ ID NO: 3959732 - RNA, 11 nt, Human herpesvirus 2
ggagccucuuu

SEQ ID NO: 3959733 - RNA, 14 nt, Human herpesvirus 2
ggagcggcgaacac

SEQ ID NO: 3959734 - RNA, 18 nt, Human herpesvirus 2
ggaggaaacgcgcgcccc

SEQ ID NO: 3959735 - RNA, 19 nt, Human herpesvirus 2
ggaggggaugggggcgcgc

SEQ ID NO: 3959736 - RNA, 13 nt, Human herpesvirus 2
ggaggggcgggag

SEQ ID NO: 3959737 - RNA, 18 nt, Human herpesvirus 2
ggaggggggcagugcagu

SEQ ID NO: 3959738 - RNA, 14 nt, Human herpesvirus 2
ggagucccccggcu

SEQ ID NO: 3959739 - RNA, 17 nt, Human herpesvirus 2
ggaugcccgccagggcc

SEQ ID NO: 3959740 - RNA, 16 nt, Human herpesvirus 2
ggauguguucuccugg

SEQ ID NO: 3959741 - RNA, 22 nt, Human herpesvirus 2
ggauguguucuccuggacgcgg

SEQ ID NO: 3959742 - RNA, 17 nt, Human herpesvirus 2
ggcaacccccgggcguc

SEQ ID NO: 3959743 - RNA, 12 nt, Human herpesvirus 2
ggcaagugcagu

SEQ ID NO: 3959744 - RNA, 18 nt, Human herpesvirus 2
ggcaccgcgcggaccggc

SEQ ID NO: 3959745 - RNA, 19 nt, Human herpesvirus 2
ggcaccgcgggaggaaggc

SEQ ID NO: 3959746 - RNA, 20 nt, Human herpesvirus 2
ggcacgagaagccgccccca

SEQ ID NO: 3959747 - RNA, 15 nt, Human herpesvirus 2
ggcagcucgcccccg

SEQ ID NO: 3959748 - RNA, 22 nt, Human herpesvirus 2
ggcagcucgcccccgugccugu

SEQ ID NO: 3959749 - RNA, 14 nt, Human herpesvirus 2
ggcaggcgacccgc

SEQ ID NO: 3959750 - RNA, 22 nt, Human herpesvirus 2
ggccaauucuucccggagcgcc

SEQ ID NO: 3959751 - RNA, 13 nt, Human herpesvirus 2
ggccacacagaga

SEQ ID NO: 3959752 - RNA, 13 nt, Human herpesvirus 2
ggccaccccgccg

SEQ ID NO: 3959753 - RNA, 15 nt, Human herpesvirus 2
ggccacucgucgcca

SEQ ID NO: 3959754 - RNA, 15 nt, Human herpesvirus 2
ggccagauggggccc

SEQ ID NO: 3959755 - RNA, 20 nt, Human herpesvirus 2
ggccagccgcccccgccggc

SEQ ID NO: 3959756 - RNA, 12 nt, Human herpesvirus 2
ggccagcggggg

SEQ ID NO: 3959757 - RNA, 22 nt, Human herpesvirus 2
ggccaggggggcaggcgggccc

SEQ ID NO: 3959758 - RNA, 18 nt, Human herpesvirus 2
ggccauccccggcgccau

SEQ ID NO: 3959759 - RNA, 22 nt, Human herpesvirus 2
ggccaucgccggggaccgcagu

SEQ ID NO: 3959760 - RNA, 22 nt, Human herpesvirus 2
ggcccaaggcgcugcgccugcc

SEQ ID NO: 3959761 - RNA, 14 nt, Human herpesvirus 2
gggggcugcugccc

SEQ ID NO: 3959762 - RNA, 11 nt, Human herpesvirus 2
ggggggccucg

SEQ ID NO: 3959763 - RNA, 12 nt, Human herpesvirus 2
ggggggggcuug

SEQ ID NO: 3959764 - RNA, 12 nt, Human herpesvirus 2
gggggguggugg

SEQ ID NO: 3959765 - RNA, 21 nt, Human herpesvirus 2
ggguaauggaugggcggggcc

SEQ ID NO: 3959766 - RNA, 22 nt, Human herpesvirus 2
ggguaauggaugggcggggccc

SEQ ID NO: 3959767 - RNA, 19 nt, Human herpesvirus 2
ggguacggcgaggugcagu

SEQ ID NO: 3959768 - RNA, 21 nt, Human herpesvirus 2
gggucccgccucccggccgcc

SEQ ID NO: 3959769 - RNA, 12 nt, Human herpesvirus 2
gggucgagcgcg

SEQ ID NO: 3959770 - RNA, 13 nt, Human herpesvirus 2
gggucgggcgggc

SEQ ID NO: 3959771 - RNA, 14 nt, Human herpesvirus 2
gggucgggcgggcg

SEQ ID NO: 3959772 - RNA, 12 nt, Human herpesvirus 2
gggugggacuug

SEQ ID NO: 3959773 - RNA, 13 nt, Human herpesvirus 2
gggugucgaccgc

SEQ ID NO: 3959774 - RNA, 13 nt, Human herpesvirus 2
ggguguggucgug

SEQ ID NO: 3959775 - RNA, 17 nt, Human herpesvirus 2
ggguuccccgagagccc

SEQ ID NO: 3959776 - RNA, 19 nt, Human herpesvirus 2
gguaauuagaaacuuuuaa

SEQ ID NO: 3959777 - RNA, 18 nt, Human herpesvirus 2
gguacugcacugcccccc

SEQ ID NO: 3959778 - RNA, 13 nt, Human herpesvirus 2
gguauggcugccc

SEQ ID NO: 3959779 - RNA, 18 nt, Human herpesvirus 2
gguauuugggugggacuu

SEQ ID NO: 3959780 - RNA, 21 nt, Human herpesvirus 2
ggucacaaaaggcacggcgcc

SEQ ID NO: 3959781 - RNA, 18 nt, Human herpesvirus 2
gguccaauauggcccagc

SEQ ID NO: 3959782 - RNA, 16 nt, Human herpesvirus 2
gguccgcggggggcac

SEQ ID NO: 3959783 - RNA, 21 nt, Human herpesvirus 2
gguccgcguauaaaggcaggc

SEQ ID NO: 3959784 - RNA, 15 nt, Human herpesvirus 2
gguccgcugcagcug

SEQ ID NO: 3959785 - RNA, 17 nt, Human herpesvirus 2
gguccggguaaaaaaga

SEQ ID NO: 3959786 - RNA, 20 nt, Human herpesvirus 2
ggucgaucucggggagggcg

SEQ ID NO: 3959787 - RNA, 23 nt, Human herpesvirus 2
ggucgggggccacuucgucguag

SEQ ID NO: 3959788 - RNA, 16 nt, Human herpesvirus 2
ggucgugggggcgcug

SEQ ID NO: 3959789 - RNA, 20 nt, Human herpesvirus 2
ggucuagaugccaguggagc

SEQ ID NO: 3959790 - RNA, 14 nt, Human herpesvirus 2
ggucuguggguggu

SEQ ID NO: 3959791 - RNA, 13 nt, Human herpesvirus 2
ggugacugggacc

SEQ ID NO: 3959792 - RNA, 21 nt, Human herpesvirus 2
ggugccguacgucugcccgug

SEQ ID NO: 3959793 - RNA, 16 nt, Human herpesvirus 2
ggugcgccccgccggg

SEQ ID NO: 3959794 - RNA, 16 nt, Human herpesvirus 2
ggugcgugcggcccug

SEQ ID NO: 3959795 - RNA, 16 nt, Human herpesvirus 2
ggugcguuccagcgcg

SEQ ID NO: 3959796 - RNA, 21 nt, Human herpesvirus 2
gguggguguggucguggugcu

SEQ ID NO: 3959797 - RNA, 15 nt, Human herpesvirus 2
ggugugaccccccca

SEQ ID NO: 3959798 - RNA, 21 nt, Human herpesvirus 2
gguguuuuuggcaccuugccg

SEQ ID NO: 3959799 - RNA, 13 nt, Human herpesvirus 2
gguuacugcacuu

SEQ ID NO: 3959800 - RNA, 19 nt, Human herpesvirus 2
gguuacugcacuugccccc

SEQ ID NO: 3959801 - RNA, 19 nt, Human herpesvirus 2
gguuccccgagagcccagg

SEQ ID NO: 3959802 - RNA, 18 nt, Human herpesvirus 2
gguuccuauaacccacaa

SEQ ID NO: 3959803 - RNA, 22 nt, Human herpesvirus 2
gguucgcgugcggccagccgcc

SEQ ID NO: 3959804 - RNA, 13 nt, Human herpesvirus 2
gguuguguuuugu

SEQ ID NO: 3959805 - RNA, 18 nt, Human herpesvirus 2
guacccaccacaccccac

SEQ ID NO: 3959806 - RNA, 22 nt, Human herpesvirus 2
guaccggcgcgcaucggacccc

SEQ ID NO: 3959807 - RNA, 14 nt, Human herpesvirus 2
guaggcccgggggg

SEQ ID NO: 3959808 - RNA, 14 nt, Human herpesvirus 2
guaguguguccccc

SEQ ID NO: 3959809 - RNA, 15 nt, Human herpesvirus 2
gucaaaggccagcag

SEQ ID NO: 3959810 - RNA, 16 nt, Human herpesvirus 2
gucaauagauuucccc

SEQ ID NO: 3959811 - RNA, 19 nt, Human herpesvirus 2
gucacgcaggccgccccca

SEQ ID NO: 3959812 - RNA, 14 nt, Human herpesvirus 2
gucaggcccgccga

SEQ ID NO: 3959813 - RNA, 21 nt, Human herpesvirus 2
gucccccgggcagccgggccc

SEQ ID NO: 3959814 - RNA, 14 nt, Human herpesvirus 2
guccccgagcggcg

SEQ ID NO: 3959815 - RNA, 10 nt, Human herpesvirus 2
guccccuuuc

SEQ ID NO: 3959816 - RNA, 15 nt, Human herpesvirus 2
gucccgccugugugc

SEQ ID NO: 3959817 - RNA, 21 nt, Human herpesvirus 2
gucccgccugugugcucucaa

SEQ ID NO: 3959818 - RNA, 14 nt, Human herpesvirus 2
guccgcgcggggcg

SEQ ID NO: 3959819 - RNA, 17 nt, Human herpesvirus 2
guccgcgcggggcgcgc

SEQ ID NO: 3959820 - RNA, 20 nt, Human herpesvirus 2
guccgcgggaagcgccgcgc

SEQ ID NO: 3959821 - RNA, 21 nt, Human herpesvirus 2
guccgcuaccgccucuguucc

SEQ ID NO: 3959822 - RNA, 20 nt, Human herpesvirus 2
guccggcggccaccccgccg

SEQ ID NO: 3959823 - RNA, 23 nt, Human herpesvirus 2
guccggcggccaccccgccgcag

SEQ ID NO: 3959824 - RNA, 13 nt, Human herpesvirus 2
guccggggggacg

SEQ ID NO: 3959825 - RNA, 17 nt, Human herpesvirus 2
guccucaccgagccgcu

SEQ ID NO: 3959826 - RNA, 22 nt, Human herpesvirus 2
guccucaccgagccgcugugcc

SEQ ID NO: 3959827 - RNA, 23 nt, Human herpesvirus 2
guccucgccgcuguggcccuggc

SEQ ID NO: 3959828 - RNA, 18 nt, Human herpesvirus 2
guccugcggcagcgcgcc

SEQ ID NO: 3959829 - RNA, 20 nt, Human herpesvirus 2
guccugcggcagcgcgccga

SEQ ID NO: 3959830 - RNA, 20 nt, Human herpesvirus 2
guccuucgcgggggccgggg

SEQ ID NO: 3959831 - RNA, 19 nt, Human herpesvirus 2
gucgccgacuccaggagcu

SEQ ID NO: 3959832 - RNA, 19 nt, Human herpesvirus 2
gucgcgcuuuuccgccgcc

SEQ ID NO: 3959833 - RNA, 20 nt, Human herpesvirus 2
gucgcggggacagccccggg

SEQ ID NO: 3959834 - RNA, 18 nt, Human herpesvirus 2
gucgcuaacgagcgcgcu

SEQ ID NO: 3959835 - RNA, 15 nt, Human herpesvirus 2
gucgcuccccuucag

SEQ ID NO: 3959836 - RNA, 19 nt, Human herpesvirus 2
gucgcucugucccccgggc

SEQ ID NO: 3959837 - RNA, 20 nt, Human herpesvirus 2
gucggcggccccggcggccc

SEQ ID NO: 3959838 - RNA, 17 nt, Human herpesvirus 2
gucgggagcaggacagc

SEQ ID NO: 3959839 - RNA, 18 nt, Human herpesvirus 2
gucgguugguuucuguau

SEQ ID NO: 3959840 - RNA, 16 nt, Human herpesvirus 2
gucguuggccagcgcg

SEQ ID NO: 3959841 - RNA, 14 nt, Human herpesvirus 2
gucugcggccgaca

SEQ ID NO: 3959842 - RNA, 19 nt, Human herpesvirus 2
gucugcgucguccagggug

SEQ ID NO: 3959843 - RNA, 15 nt, Human herpesvirus 2
gucugugggugguga

SEQ ID NO: 3959844 - RNA, 23 nt, Human herpesvirus 2
gucuucccgggaaaccacacaca

SEQ ID NO: 3959845 - RNA, 19 nt, Human herpesvirus 2
gucuugauuuacgaggggg

SEQ ID NO: 3959846 - RNA, 15 nt, Human herpesvirus 2
gugaccacgcgcacg

SEQ ID NO: 3959847 - RNA, 19 nt, Human herpesvirus 2
gugacuuggugcgccgccg

SEQ ID NO: 3959848 - RNA, 22 nt, Human herpesvirus 2
gugaucuuggcguuauuuccaa

SEQ ID NO: 3959849 - RNA, 13 nt, Human herpesvirus 2
gugcagggccuga

SEQ ID NO: 3959850 - RNA, 19 nt, Human herpesvirus 2
gugccaacucgcggcaccg

SEQ ID NO: 3959851 - RNA, 17 nt, Human herpesvirus 2
gugccccacccccgagc

SEQ ID NO: 3959852 - RNA, 14 nt, Human herpesvirus 2
gugccccuggacug

SEQ ID NO: 3959853 - RNA, 13 nt, Human herpesvirus 2
gugcccgcccccg

SEQ ID NO: 3959854 - RNA, 20 nt, Human herpesvirus 2
gugcccuggguccgggggcc

SEQ ID NO: 3959855 - RNA, 20 nt, Human herpesvirus 2
gugccggggauaaaagccaa

SEQ ID NO: 3959856 - RNA, 17 nt, Human herpesvirus 2
gugcgaccgggcggcgc

SEQ ID NO: 3959857 - RNA, 20 nt, Human herpesvirus 2
gugcgaccgggcggcgcgcc

SEQ ID NO: 3959858 - RNA, 22 nt, Human herpesvirus 2
gugcgcucuucgcggcggccgc

SEQ ID NO: 3959859 - RNA, 22 nt, Human herpesvirus 2
gugcgggaugugucgcggggac

SEQ ID NO: 3959860 - RNA, 15 nt, Human herpesvirus 2
gugcugcgcgagccg

SEQ ID NO: 3959861 - RNA, 17 nt, Human herpesvirus 2
gugcugcugagcccugc

SEQ ID NO: 3959862 - RNA, 20 nt, Human herpesvirus 2
gugcugggcgcgagccaggc

SEQ ID NO: 3959863 - RNA, 16 nt, Human herpesvirus 2
guggcccuuccggacc

SEQ ID NO: 3959864 - RNA, 14 nt, Human herpesvirus 2
guggcggaggccug

SEQ ID NO: 3959865 - RNA, 17 nt, Human herpesvirus 2
gugggccgacgugccgg

SEQ ID NO: 3959866 - RNA, 19 nt, Human herpesvirus 2
gugggcguugccgggggcc

SEQ ID NO: 3959867 - RNA, 15 nt, Human herpesvirus 2
guggggugggucgcc

SEQ ID NO: 3959868 - RNA, 19 nt, Human herpesvirus 2
guggucguggugcuggcca

SEQ ID NO: 3959869 - RNA, 20 nt, Human herpesvirus 2
gugucgaccgcugucgcccc

SEQ ID NO: 3959870 - RNA, 21 nt, Human herpesvirus 2
gugucuucccgggaaaccaca

SEQ ID NO: 3959871 - RNA, 15 nt, Human herpesvirus 2
gugugcccgcccccg

SEQ ID NO: 3959872 - RNA, 21 nt, Human herpesvirus 2
gugugggaggguggcuggggu

SEQ ID NO: 3959873 - RNA, 13 nt, Human herpesvirus 2
guguucuccugga

SEQ ID NO: 3959874 - RNA, 16 nt, Human herpesvirus 2
guucggcaggcccgcc

SEQ ID NO: 3959875 - RNA, 13 nt, Human herpesvirus 2
guucggggccagg

SEQ ID NO: 3959876 - RNA, 18 nt, Human herpesvirus 2
ugccccgcccccucuccc

SEQ ID NO: 3959877 - RNA, 15 nt, Human herpesvirus 2
ugcccgaccuguuaa

SEQ ID NO: 3959878 - RNA, 14 nt, Human herpesvirus 2
ugcccgcgggucug

SEQ ID NO: 3959879 - RNA, 16 nt, Human herpesvirus 2
ugccgcagaccaccuc

SEQ ID NO: 3959880 - RNA, 18 nt, Human herpesvirus 2
ugccguucggaccugggg

SEQ ID NO: 3959881 - RNA, 13 nt, Human herpesvirus 2
ugccuccacgccc

SEQ ID NO: 3959882 - RNA, 19 nt, Human herpesvirus 2
ugccuccacgcccugcugu

SEQ ID NO: 3959883 - RNA, 22 nt, Human herpesvirus 2
ugccucuguuucuccaggcgcu

SEQ ID NO: 3959884 - RNA, 14 nt, Human herpesvirus 2
ugccugacccucuc

SEQ ID NO: 3959885 - RNA, 16 nt, Human herpesvirus 2
ugcgcagguccgagac

SEQ ID NO: 3959886 - RNA, 17 nt, Human herpesvirus 2
ugcgccccgccggggcg

SEQ ID NO: 3959887 - RNA, 13 nt, Human herpesvirus 2
ugcgccggcacca

SEQ ID NO: 3959888 - RNA, 21 nt, Human herpesvirus 2
ugcgcgcggcgacggcaccgc

SEQ ID NO: 3959889 - RNA, 15 nt, Human herpesvirus 2
ugcgcucgcucuccg

SEQ ID NO: 3959890 - RNA, 20 nt, Human herpesvirus 2
ugcgcuuuccggcccucccg

SEQ ID NO: 3959891 - RNA, 23 nt, Human herpesvirus 2
ugcggccgacacggucggaauuu

SEQ ID NO: 3959892 - RNA, 23 nt, Human herpesvirus 2
ugcguccgucucaauaaagccag

SEQ ID NO: 3959893 - RNA, 14 nt, Human herpesvirus 2
ugcgucguccaggg

SEQ ID NO: 3959894 - RNA, 19 nt, Human herpesvirus 2
ugcucgaccagcggcccca

SEQ ID NO: 3959895 - RNA, 19 nt, Human herpesvirus 2
ugcugggcgcgagccaggc

SEQ ID NO: 3959896 - RNA, 18 nt, Human herpesvirus 2
ugcuggugguggaaagac

SEQ ID NO: 3959897 - RNA, 14 nt, Human herpesvirus 2
ugcuucccccgccc

SEQ ID NO: 3959898 - RNA, 23 nt, Human herpesvirus 2
uggacauguuacaccccccugac

SEQ ID NO: 3959899 - RNA, 15 nt, Human herpesvirus 2
uggaccccccacgcc

SEQ ID NO: 3959900 - RNA, 16 nt, Human herpesvirus 2
uggaccccccacgccc

SEQ ID NO: 3959901 - RNA, 16 nt, Human herpesvirus 2
uggacgcgccucccgg

SEQ ID NO: 3959902 - RNA, 22 nt, Human herpesvirus 2
uggagaagggaaaggaacagag

SEQ ID NO: 3959903 - RNA, 19 nt, Human herpesvirus 2
uggagcucugccugcacga

SEQ ID NO: 3959904 - RNA, 17 nt, Human herpesvirus 2
uggaggggggggcuggu

SEQ ID NO: 3959905 - RNA, 21 nt, Human herpesvirus 2
uggcacaaaaagcgacacucc

SEQ ID NO: 3959906 - RNA, 17 nt, Human herpesvirus 2
uggccagagccucaucg

SEQ ID NO: 3959907 - RNA, 15 nt, Human herpesvirus 2
uggccggggagggca

SEQ ID NO: 3959908 - RNA, 15 nt, Human herpesvirus 2
uggccgugcgcggcc

SEQ ID NO: 3959909 - RNA, 13 nt, Human herpesvirus 2
uggcggaagugcc

SEQ ID NO: 3959910 - RNA, 13 nt, Human herpesvirus 2
uggcggccgccgc

SEQ ID NO: 3959911 - RNA, 13 nt, Human herpesvirus 2
uggcggcugggga

SEQ ID NO: 3959912 - RNA, 19 nt, Human herpesvirus 2
uggcguccccaggcgacgc

SEQ ID NO: 3959913 - RNA, 18 nt, Human herpesvirus 2
uggcuggaggcaaacacg

SEQ ID NO: 3959914 - RNA, 14 nt, Human herpesvirus 2
ugggaaaucuauug

SEQ ID NO: 3959915 - RNA, 12 nt, Human herpesvirus 2
ugggagccccgc

SEQ ID NO: 3959916 - RNA, 12 nt, Human herpesvirus 2
ugggcacagugg

SEQ ID NO: 3959917 - RNA, 11 nt, Human herpesvirus 2
ugggccgacgu

SEQ ID NO: 3959918 - RNA, 19 nt, Human herpesvirus 2
uggggaggggggggugagg

SEQ ID NO: 3959919 - RNA, 16 nt, Human herpesvirus 2
uggggagucgggcccc

SEQ ID NO: 3959920 - RNA, 16 nt, Human herpesvirus 2
ugggggaacgcgcacc

SEQ ID NO: 3959921 - RNA, 11 nt, Human herpesvirus 2
ugggggaagaa

SEQ ID NO: 3959922 - RNA, 17 nt, Human herpesvirus 2
ugggggcccaggucccc

SEQ ID NO: 3959923 - RNA, 17 nt, Human herpesvirus 2
ugggggcgcugguggcc

SEQ ID NO: 3959924 - RNA, 15 nt, Human herpesvirus 2
ugggugacugggacc

SEQ ID NO: 3959925 - RNA, 23 nt, Human herpesvirus 2
uggugcgucuccggucccuuccc

SEQ ID NO: 3959926 - RNA, 22 nt, Human herpesvirus 2
uguacccucucaacgcccaggc

SEQ ID NO: 3959927 - RNA, 21 nt, Human herpesvirus 2
uguacgacagcggggacccgg

SEQ ID NO: 3959928 - RNA, 19 nt, Human herpesvirus 2
ugugcaccgaaggaggaaa

SEQ ID NO: 3959929 - RNA, 11 nt, Human herpesvirus 2
ugugccaggug

SEQ ID NO: 3959930 - RNA, 15 nt, Human herpesvirus 2
ugugcguaugugaua

SEQ ID NO: 3959931 - RNA, 14 nt, Human herpesvirus 2
uguguuuuguggga

SEQ ID NO: 3959932 - RNA, 12 nt, Human herpesvirus 2
uguuccaccgcu

SEQ ID NO: 3959933 - RNA, 22 nt, Human herpesvirus 2
uguuguggcuggaggcaaacac

SEQ ID NO: 3959934 - RNA, 14 nt, Human herpesvirus 2
uguuguuucugggc

SEQ ID NO: 3959935 - RNA, 14 nt, Human herpesvirus 2
uguuuugguugguu

SEQ ID NO: 3959936 - RNA, 16 nt, Human herpesvirus 2
uuacgcaggcccucgc

SEQ ID NO: 3959937 - RNA, 14 nt, Human herpesvirus 2
uuacgugacgucaa

SEQ ID NO: 3959938 - RNA, 13 nt, Human herpesvirus 2
uuagcaacuuuua

SEQ ID NO: 3959939 - RNA, 20 nt, Human herpesvirus 2
uuagucccggguccggggcg

SEQ ID NO: 3959940 - RNA, 19 nt, Human herpesvirus 2
uucaccgaccccccccucg

SEQ ID NO: 3959941 - RNA, 22 nt, Human herpesvirus 2
uucccaaacacugaggaacugg

SEQ ID NO: 3959942 - RNA, 21 nt, Human herpesvirus 2
uucccaacacgccugcccccg

SEQ ID NO: 3959943 - RNA, 11 nt, Human herpesvirus 2
uucccccggga

SEQ ID NO: 3959944 - RNA, 16 nt, Human herpesvirus 2
uucccuuuugguccuu

SEQ ID NO: 3959945 - RNA, 17 nt, Human herpesvirus 2
uuccgcggacgccgggc

SEQ ID NO: 3959946 - RNA, 15 nt, Human herpesvirus 2
uuccgcguccgcugg

SEQ ID NO: 3959947 - RNA, 20 nt, Human herpesvirus 2
uuccucaguguuugggaaau

SEQ ID NO: 3959948 - RNA, 11 nt, Human herpesvirus 2
uucucuucccc

SEQ ID NO: 3959949 - RNA, 21 nt, Human herpesvirus 2
uucuggccaagcauccucacc

SEQ ID NO: 3959950 - RNA, 12 nt, Human herpesvirus 2
uugaacucuccc

SEQ ID NO: 3959951 - RNA, 15 nt, Human herpesvirus 2
uugcgcucgucgccg

SEQ ID NO: 3959952 - RNA, 20 nt, Human herpesvirus 2
uuggaggcccucugggacac

SEQ ID NO: 3959953 - RNA, 16 nt, Human herpesvirus 2
uugggcggcccccggc

SEQ ID NO: 3959954 - RNA, 14 nt, Human herpesvirus 2
uugggggggggugg

SEQ ID NO: 3959955 - RNA, 14 nt, Human herpesvirus 2
uuggggggggugug

SEQ ID NO: 3959956 - RNA, 14 nt, Human herpesvirus 2
uugguccgggggcg

SEQ ID NO: 3959957 - RNA, 19 nt, Human herpesvirus 2
uugugcuuuuacccucacc

SEQ ID NO: 3959958 - RNA, 12 nt, Human herpesvirus 2
uuguuggaugau

SEQ ID NO: 3959959 - RNA, 14 nt, Human herpesvirus 2
uuucagguuccggg

SEQ ID NO: 3959960 - RNA, 12 nt, Human herpesvirus 2
uuuccgccgccg

SEQ ID NO: 3959961 - RNA, 16 nt, Human herpesvirus 2
uuuccgccgccgggaa

SEQ ID NO: 3959962 - RNA, 18 nt, Human herpesvirus 2
uuuugcuggcgccgccgg

SEQ ID NO: 3959963 - RNA, 20 nt, Human herpesvirus 2
ucgcggacgcacgcggggac

SEQ ID NO: 3959964 - RNA, 19 nt, Human herpesvirus 2
ucgcggccgcccgcgccgc

SEQ ID NO: 3959965 - RNA, 21 nt, Human herpesvirus 2
ucgcgugcggccagccgcccc

SEQ ID NO: 3959966 - RNA, 15 nt, Human herpesvirus 2
ucgcucccucagcau

SEQ ID NO: 3959967 - RNA, 18 nt, Human herpesvirus 2
ucgcucucggucccgcau

SEQ ID NO: 3959968 - RNA, 15 nt, Human herpesvirus 2
ucggacaccagcagc

SEQ ID NO: 3959969 - RNA, 17 nt, Human herpesvirus 2
ucggagaggcccgccgc

SEQ ID NO: 3959970 - RNA, 14 nt, Human herpesvirus 2
ucggaggggugagg

SEQ ID NO: 3959971 - RNA, 13 nt, Human herpesvirus 2
ucggcaggcccgc

SEQ ID NO: 3959972 - RNA, 18 nt, Human herpesvirus 2
ucggccggcggagccccg

SEQ ID NO: 3959973 - RNA, 19 nt, Human herpesvirus 2
ucggccggcggagccccgg

SEQ ID NO: 3959974 - RNA, 20 nt, Human herpesvirus 2
ucggcgauguccggggcggu

SEQ ID NO: 3959975 - RNA, 21 nt, Human herpesvirus 2
ucgggaggggaugggggcgcg

SEQ ID NO: 3959976 - RNA, 20 nt, Human herpesvirus 2
ucgggauccauaacgcgccc

SEQ ID NO: 3959977 - RNA, 23 nt, Human herpesvirus 2
ucgggcggacguccaggggugcg

SEQ ID NO: 3959978 - RNA, 15 nt, Human herpesvirus 2
ucgggcgucugugcg

SEQ ID NO: 3959979 - RNA, 12 nt, Human herpesvirus 2
ucgggcugcugg

SEQ ID NO: 3959980 - RNA, 12 nt, Human herpesvirus 2
ucggggccaggg

SEQ ID NO: 3959981 - RNA, 14 nt, Human herpesvirus 2
ucgggggccaggaa

SEQ ID NO: 3959982 - RNA, 17 nt, Human herpesvirus 2
ucggucgacgaggccug

SEQ ID NO: 3959983 - RNA, 13 nt, Human herpesvirus 2
ucgugcacagagc

SEQ ID NO: 3959984 - RNA, 18 nt, Human herpesvirus 2
ucguggugcuggccaaug

SEQ ID NO: 3959985 - RNA, 15 nt, Human herpesvirus 2
ucucccgggggcgcu

SEQ ID NO: 3959986 - RNA, 12 nt, Human herpesvirus 2
ucucggggaggg

SEQ ID NO: 3959987 - RNA, 13 nt, Human herpesvirus 2
ucucugccuccuu

SEQ ID NO: 3959988 - RNA, 23 nt, Human herpesvirus 2
ucucuucuuuccccccccccucc

SEQ ID NO: 3959989 - RNA, 19 nt, Human herpesvirus 2
ucugcccguggguggccac

SEQ ID NO: 3959990 - RNA, 19 nt, Human herpesvirus 2
ucugcgucguccagggugg

SEQ ID NO: 3959991 - RNA, 14 nt, Human herpesvirus 2
ucuggaagagcucc

SEQ ID NO: 3959992 - RNA, 19 nt, Human herpesvirus 2
ucuguuuugguugguucuc

SEQ ID NO: 3959993 - RNA, 20 nt, Human herpesvirus 2
ucuuacccuuuucugcauuu

SEQ ID NO: 3959994 - RNA, 21 nt, Human herpesvirus 2
ucuucgcgggcaggccgcggc

SEQ ID NO: 3959995 - RNA, 14 nt, Human herpesvirus 2
ucuuguagggcguu

SEQ ID NO: 3959996 - RNA, 23 nt, Human herpesvirus 2
ucuuucggccaccaccccccucc

SEQ ID NO: 3959997 - RNA, 12 nt, Human herpesvirus 2
ugaagggcacuc

SEQ ID NO: 3959998 - RNA, 16 nt, Human herpesvirus 2
ugacgacggccccggc

SEQ ID NO: 3959999 - RNA, 20 nt, Human herpesvirus 2
ugacggucgccacucuccug

SEQ ID NO: 3960000 - RNA, 11 nt, Human herpesvirus 2
ugacuccuggg

SEQ ID NO: 3960001 - RNA, 14 nt, Human herpesvirus 2
ugacuccuggguca

SEQ ID NO: 3960002 - RNA, 20 nt, Human herpesvirus 2
ugagagggggggguggagug

SEQ ID NO: 3960003 - RNA, 24 nt, Human herpesvirus 2
ugaggaacuggguuacugcacuug

SEQ ID NO: 3960004 - RNA, 14 nt, Human herpesvirus 2
ugauacuuaaaugc

SEQ ID NO: 3960005 - RNA, 19 nt, Human herpesvirus 2
ugauggggacgacgggcgc

SEQ ID NO: 3960006 - RNA, 14 nt, Human herpesvirus 2
ugauggggguccug

SEQ ID NO: 3960007 - RNA, 14 nt, Human herpesvirus 2
ugcaagcgggcggg

SEQ ID NO: 3960008 - RNA, 23 nt, Human herpesvirus 2
ugcaagcgggcgggguggggagg

SEQ ID NO: 3960009 - RNA, 15 nt, Human herpesvirus 2
ugcacuugccccccc

SEQ ID NO: 3960010 - RNA, 20 nt, Human herpesvirus 2
ugcacuugcccccccccggg

SEQ ID NO: 3960011 - RNA, 12 nt, Human herpesvirus 2
ugcagccccggu

SEQ ID NO: 3960012 - RNA, 11 nt, Human herpesvirus 2
ugcagggccug

SEQ ID NO: 3960013 - RNA, 21 nt, Human herpesvirus 2
ugcaguaacccaguuccucag

SEQ ID NO: 3960014 - RNA, 18 nt, Human herpesvirus 2
ugcccaucuacguggccg

SEQ ID NO: 3960015 - RNA, 14 nt, Human herpesvirus 2
ugcccccccccggg

SEQ ID NO: 3960016 - RNA, 13 nt, Human herpesvirus 2
ugccccgcccccu

SEQ ID NO: 3960017 - RNA, 14 nt, Human herpesvirus 2
ugcccgccagggcc

SEQ ID NO: 3960018 - RNA, 15 nt, Human herpesvirus 2
ugcccgcuuccaccc

SEQ ID NO: 3960019 - RNA, 12 nt, Human herpesvirus 2
ugccgcagacca

SEQ ID NO: 3960020 - RNA, 15 nt, Human herpesvirus 2
ugccgggggccauga

SEQ ID NO: 3960021 - RNA, 22 nt, Human herpesvirus 2
ugccugacccucucgggcaugg

SEQ ID NO: 3960022 - RNA, 13 nt, Human herpesvirus 2
guccccuggggcg

SEQ ID NO: 3960023 - RNA, 13 nt, Human herpesvirus 2
gucccgacgcccg

SEQ ID NO: 3960024 - RNA, 19 nt, Human herpesvirus 2
gucccgccucccggccgcc

SEQ ID NO: 3960025 - RNA, 12 nt, Human herpesvirus 2
gucccggccgcc

SEQ ID NO: 3960026 - RNA, 14 nt, Human herpesvirus 2
gucccugcgucgcc

SEQ ID NO: 3960027 - RNA, 14 nt, Human herpesvirus 2
gucccuuccccacc

SEQ ID NO: 3960028 - RNA, 14 nt, Human herpesvirus 2
guccgaccugcagg

SEQ ID NO: 3960029 - RNA, 15 nt, Human herpesvirus 2
guccgaccugcagga

SEQ ID NO: 3960030 - RNA, 20 nt, Human herpesvirus 2
guccgacgaggccuucccga

SEQ ID NO: 3960031 - RNA, 22 nt, Human herpesvirus 2
guccgcgggaagcgccgcgcgg

SEQ ID NO: 3960032 - RNA, 19 nt, Human herpesvirus 2
gucgcccauacaaauuaaa

SEQ ID NO: 3960033 - RNA, 20 nt, Human herpesvirus 2
gucgcccuagaggcuguccg

SEQ ID NO: 3960034 - RNA, 14 nt, Human herpesvirus 2
gucgcccuucacca

SEQ ID NO: 3960035 - RNA, 20 nt, Human herpesvirus 2
gucgccgccggccacgccac

SEQ ID NO: 3960036 - RNA, 19 nt, Human herpesvirus 2
gucgccggcgacacccacc

SEQ ID NO: 3960037 - RNA, 19 nt, Human herpesvirus 2
gucgcuaaacagggggauc

SEQ ID NO: 3960038 - RNA, 19 nt, Human herpesvirus 2
gucgggccagauggggccc

SEQ ID NO: 3960039 - RNA, 13 nt, Human herpesvirus 2
gucgggccccggg

SEQ ID NO: 3960040 - RNA, 18 nt, Human herpesvirus 2
gucgggcgugggggaaga

SEQ ID NO: 3960041 - RNA, 20 nt, Human herpesvirus 2
gucgggggggauccagggga

SEQ ID NO: 3960042 - RNA, 17 nt, Human herpesvirus 2
gucguugggcggccccc

SEQ ID NO: 3960043 - RNA, 16 nt, Human herpesvirus 2
gucucaauaaagccag

SEQ ID NO: 3960044 - RNA, 12 nt, Human herpesvirus 2
gucucggccccc

SEQ ID NO: 3960045 - RNA, 19 nt, Human herpesvirus 2
gucugcgccaccggccugg

SEQ ID NO: 3960046 - RNA, 17 nt, Human herpesvirus 2
gucugguuuuucugggg

SEQ ID NO: 3960047 - RNA, 14 nt, Human herpesvirus 2
gucugucugcccgg

SEQ ID NO: 3960048 - RNA, 18 nt, Human herpesvirus 2
gugacccccccauggcau

SEQ ID NO: 3960049 - RNA, 17 nt, Human herpesvirus 2
gugagucacggcaaccc

SEQ ID NO: 3960050 - RNA, 18 nt, Human herpesvirus 2
gugcacagccuggccgug

SEQ ID NO: 3960051 - RNA, 14 nt, Human herpesvirus 2
gugccaguccgcuc

SEQ ID NO: 3960052 - RNA, 23 nt, Human herpesvirus 2
gugcccccccucguucugcugca

SEQ ID NO: 3960053 - RNA, 16 nt, Human herpesvirus 2
gugcccuggguccggg

SEQ ID NO: 3960054 - RNA, 23 nt, Human herpesvirus 2
gugccgcuuuaccccgcggccuc

SEQ ID NO: 3960055 - RNA, 18 nt, Human herpesvirus 2
gugccucacgguccucac

SEQ ID NO: 3960056 - RNA, 17 nt, Human herpesvirus 2
gugcgcaugggccgcca

SEQ ID NO: 3960057 - RNA, 14 nt, Human herpesvirus 2
gugcucgcagcagu

SEQ ID NO: 3960058 - RNA, 21 nt, Human herpesvirus 2
gugcugcgcgagccguccggg

SEQ ID NO: 3960059 - RNA, 15 nt, Human herpesvirus 2
guggcccuccacgcc

SEQ ID NO: 3960060 - RNA, 20 nt, Human herpesvirus 2
guggcggaggccugucccug

SEQ ID NO: 3960061 - RNA, 14 nt, Human herpesvirus 2
gugguuagggggac

SEQ ID NO: 3960062 - RNA, 18 nt, Human herpesvirus 2
gugucgaaucugggaaga

SEQ ID NO: 3960063 - RNA, 21 nt, Human herpesvirus 2
gugucgcuccccuucagccug

SEQ ID NO: 3960064 - RNA, 16 nt, Human herpesvirus 2
gugucggagaggcccg

SEQ ID NO: 3960065 - RNA, 15 nt, Human herpesvirus 2
gugucucgcggcccg

SEQ ID NO: 3960066 - RNA, 18 nt, Human herpesvirus 2
guuagguugggagguggc

SEQ ID NO: 3960067 - RNA, 19 nt, Human herpesvirus 2
guuauaggccacacagucc

SEQ ID NO: 3960068 - RNA, 13 nt, Human herpesvirus 2
guuauccugcggc

SEQ ID NO: 3960069 - RNA, 16 nt, Human herpesvirus 2
guucgcgggcgacgcc

SEQ ID NO: 3960070 - RNA, 12 nt, Human herpesvirus 2
guucggcaggcc

SEQ ID NO: 3960071 - RNA, 14 nt, Human herpesvirus 2
guucggcaggcccg

SEQ ID NO: 3960072 - RNA, 21 nt, Human herpesvirus 2
guucgggcggcggaaacaaca

SEQ ID NO: 3960073 - RNA, 13 nt, Human herpesvirus 2
guucuccuggacg

SEQ ID NO: 3960074 - RNA, 19 nt, Human herpesvirus 2
guugcguuggggcacggcg

SEQ ID NO: 3960075 - RNA, 15 nt, Human herpesvirus 2
guuguagggccgcgg

SEQ ID NO: 3960076 - RNA, 11 nt, Human herpesvirus 2
guuuuucuguu

SEQ ID NO: 3960077 - RNA, 15 nt, Human herpesvirus 2
uaaauaaacaaacaa

SEQ ID NO: 3960078 - RNA, 18 nt, Human herpesvirus 2
uaacagcuacccgcaucc

SEQ ID NO: 3960079 - RNA, 21 nt, Human herpesvirus 2
uaacagcuacccgcauccgca

SEQ ID NO: 3960080 - RNA, 22 nt, Human herpesvirus 2
uaacuaaaccacagcacggccg

SEQ ID NO: 3960081 - RNA, 16 nt, Human herpesvirus 2
uaagcgcugcggggac

SEQ ID NO: 3960082 - RNA, 17 nt, Human herpesvirus 2
uaagcgcugcggggacc

SEQ ID NO: 3960083 - RNA, 10 nt, Human herpesvirus 2
uaaggcaggg

SEQ ID NO: 3960084 - RNA, 22 nt, Human herpesvirus 2
uaauaggcggucccggccgcca

SEQ ID NO: 3960085 - RNA, 12 nt, Human herpesvirus 2
uacaccccaccc

SEQ ID NO: 3960086 - RNA, 12 nt, Human herpesvirus 2
uaccagccccuc

SEQ ID NO: 3960087 - RNA, 15 nt, Human herpesvirus 2
uacccggcagagaga

SEQ ID NO: 3960088 - RNA, 15 nt, Human herpesvirus 2
cagcaaccaggcgcu

SEQ ID NO: 3960089 - RNA, 12 nt, Human herpesvirus 2
cagcaccccacc

SEQ ID NO: 3960090 - RNA, 22 nt, Human herpesvirus 2
cagcauccgaucgaugagccgg

SEQ ID NO: 3960091 - RNA, 16 nt, Human herpesvirus 2
cagccccgcaggcagg

SEQ ID NO: 3960092 - RNA, 21 nt, Human herpesvirus 2
cagccccucgcccccgcggcc

SEQ ID NO: 3960093 - RNA, 17 nt, Human herpesvirus 2
cagccgcccccgccggc

SEQ ID NO: 3960094 - RNA, 19 nt, Human herpesvirus 2
cagccuggaccagaccgug

SEQ ID NO: 3960095 - RNA, 24 nt, Human herpesvirus 2
cagcucucgcgaauugacaagcgg

SEQ ID NO: 3960096 - RNA, 21 nt, Human herpesvirus 2
cagcuuggccguguggucgcc

SEQ ID NO: 3960097 - RNA, 18 nt, Human herpesvirus 2
cagcuuuuaacgggccgc

SEQ ID NO: 3960098 - RNA, 21 nt, Human herpesvirus 2
caggagggcgggccacgucgg

SEQ ID NO: 3960099 - RNA, 23 nt, Human herpesvirus 2
caggcaggcgucgaucucaucaa

SEQ ID NO: 3960100 - RNA, 17 nt, Human herpesvirus 2
caggccaucgccgggga

SEQ ID NO: 3960101 - RNA, 14 nt, Human herpesvirus 2
caggccccccggga

SEQ ID NO: 3960102 - RNA, 15 nt, Human herpesvirus 2
caggcccucgcugcu

SEQ ID NO: 3960103 - RNA, 21 nt, Human herpesvirus 2
caggcgcuccagguacugcug

SEQ ID NO: 3960104 - RNA, 17 nt, Human herpesvirus 2
caggcguguugggaagg

SEQ ID NO: 3960105 - RNA, 13 nt, Human herpesvirus 2
caggcuggagcuc

SEQ ID NO: 3960106 - RNA, 17 nt, Human herpesvirus 2
caggcuggagcucugcc

SEQ ID NO: 3960107 - RNA, 23 nt, Human herpesvirus 2
cagggacgucacgcccgucaggc

SEQ ID NO: 3960108 - RNA, 17 nt, Human herpesvirus 2
cagggaguccucgccgc

SEQ ID NO: 3960109 - RNA, 23 nt, Human herpesvirus 2
cagggaguccucgccgcuguggc

SEQ ID NO: 3960110 - RNA, 18 nt, Human herpesvirus 2
cagggggcggcgccggcc

SEQ ID NO: 3960111 - RNA, 15 nt, Human herpesvirus 2
cagguggcccuuccg

SEQ ID NO: 3960112 - RNA, 20 nt, Human herpesvirus 2
caggugggccgacgugccgg

SEQ ID NO: 3960113 - RNA, 22 nt, Human herpesvirus 2
caggugggugcuucggggacuu

SEQ ID NO: 3960114 - RNA, 17 nt, Human herpesvirus 2
cagugcaguaccccagu

SEQ ID NO: 3960115 - RNA, 21 nt, Human herpesvirus 2
cauaggccgggagcguggggc

SEQ ID NO: 3960116 - RNA, 13 nt, Human herpesvirus 2
caucaccccaggg

SEQ ID NO: 3960117 - RNA, 12 nt, Human herpesvirus 2
caucaggcucau

SEQ ID NO: 3960118 - RNA, 15 nt, Human herpesvirus 2
caucccacaaugggg

SEQ ID NO: 3960119 - RNA, 17 nt, Human herpesvirus 2
cauccgacggcaugcag

SEQ ID NO: 3960120 - RNA, 18 nt, Human herpesvirus 2
cauccgacggcaugcagc

SEQ ID NO: 3960121 - RNA, 12 nt, Human herpesvirus 2
caucgccgggga

SEQ ID NO: 3960122 - RNA, 15 nt, Human herpesvirus 2
caucgcguacagccu

SEQ ID NO: 3960123 - RNA, 14 nt, Human herpesvirus 2
caucgggcugcugg

SEQ ID NO: 3960124 - RNA, 13 nt, Human herpesvirus 2
caucucuguuuca

SEQ ID NO: 3960125 - RNA, 21 nt, Human herpesvirus 2
caugacgacacgucccgccac

SEQ ID NO: 3960126 - RNA, 15 nt, Human herpesvirus 2
caugagccgccgggu

SEQ ID NO: 3960127 - RNA, 17 nt, Human herpesvirus 2
cauggaagcccccggca

SEQ ID NO: 3960128 - RNA, 23 nt, Human herpesvirus 2
cauggcauccgggguuuccccgg

SEQ ID NO: 3960129 - RNA, 15 nt, Human herpesvirus 2
caugucuuuccacca

SEQ ID NO: 3960130 - RNA, 19 nt, Human herpesvirus 2
caugucuuuccaccaccag

SEQ ID NO: 3960131 - RNA, 21 nt, Human herpesvirus 2
caugugcuaacgggaaaacca

SEQ ID NO: 3960132 - RNA, 14 nt, Human herpesvirus 2
cauguucggcgucg

SEQ ID NO: 3960133 - RNA, 21 nt, Human herpesvirus 2
cauuguugucguguggugugu

SEQ ID NO: 3960134 - RNA, 11 nt, Human herpesvirus 2
ccaaaaaccag

SEQ ID NO: 3960135 - RNA, 14 nt, Human herpesvirus 2
ccaacgacggcguu

SEQ ID NO: 3960136 - RNA, 18 nt, Human herpesvirus 2
ccaacucgcggcaccgcg

SEQ ID NO: 3960137 - RNA, 21 nt, Human herpesvirus 2
ccaacucgcggcaccgcgcgg

SEQ ID NO: 3960138 - RNA, 12 nt, Human herpesvirus 2
ccacacccccuc

SEQ ID NO: 3960139 - RNA, 24 nt, Human herpesvirus 2
ccacagcaauaaacauuggcaagc

SEQ ID NO: 3960140 - RNA, 17 nt, Human herpesvirus 2
ccacagcacggccgggu

SEQ ID NO: 3960141 - RNA, 17 nt, Human herpesvirus 2
ccacaucgauuccgcca

SEQ ID NO: 3960142 - RNA, 18 nt, Human herpesvirus 2
ccaccccccccccccuuc

SEQ ID NO: 3960143 - RNA, 21 nt, Human herpesvirus 2
ccaccgcccccgcuggcggga

SEQ ID NO: 3960144 - RNA, 14 nt, Human herpesvirus 2
ccaccgucagccgc

SEQ ID NO: 3960145 - RNA, 17 nt, Human herpesvirus 2
ccaccuggaagcugccu

SEQ ID NO: 3960146 - RNA, 20 nt, Human herpesvirus 2
ccaccuucgcucccucagca

SEQ ID NO: 3960147 - RNA, 13 nt, Human herpesvirus 2
ccacguccaccuu

SEQ ID NO: 3960148 - RNA, 19 nt, Human herpesvirus 2
ccacguccaccuuggcccg

SEQ ID NO: 3960149 - RNA, 17 nt, Human herpesvirus 2
ccacguguccccaggga

SEQ ID NO: 3960150 - RNA, 18 nt, Human herpesvirus 2
ccacuccaccccccccuc

SEQ ID NO: 3960151 - RNA, 18 nt, Human herpesvirus 2
ccagaccgaagaggugcu

SEQ ID NO: 3960152 - RNA, 16 nt, Human herpesvirus 2
ccagacggcgggaccc

SEQ ID NO: 3960153 - RNA, 11 nt, Human herpesvirus 2
ccagagccuca

SEQ ID NO: 3960154 - RNA, 15 nt, Human herpesvirus 2
ccagauggggccccg

SEQ ID NO: 3960155 - RNA, 22 nt, Human herpesvirus 2
ccagcauguguguuaacgcaac

SEQ ID NO: 3960156 - RNA, 12 nt, Human herpesvirus 2
ccagccccgcag

SEQ ID NO: 3960157 - RNA, 14 nt, Human herpesvirus 2
ccagcuuucccucc

SEQ ID NO: 3960158 - RNA, 22 nt, Human herpesvirus 2
ccaggaggggggcagugcagua

SEQ ID NO: 3960159 - RNA, 17 nt, Human herpesvirus 2
ccaggauuaccgacccc

SEQ ID NO: 3960160 - RNA, 14 nt, Human herpesvirus 2
ccaggcgcugcugc

SEQ ID NO: 3960161 - RNA, 17 nt, Human herpesvirus 2
ccaggcuauuaaacagc

SEQ ID NO: 3960162 - RNA, 17 nt, Human herpesvirus 2
ccagggcugggagcccu

SEQ ID NO: 3960163 - RNA, 16 nt, Human herpesvirus 2
ccagggggcggcgccg

SEQ ID NO: 3960164 - RNA, 17 nt, Human herpesvirus 2
ccaggucuuuccguggc

SEQ ID NO: 3960165 - RNA, 13 nt, Human herpesvirus 2
ccaguuccucagu

SEQ ID NO: 3960166 - RNA, 16 nt, Human herpesvirus 2
ccauaaacaggccccg

SEQ ID NO: 3960167 - RNA, 17 nt, Human herpesvirus 2
ccaucgacccggacugc

SEQ ID NO: 3960168 - RNA, 12 nt, Human herpesvirus 2
ccaucgccgggg

SEQ ID NO: 3960169 - RNA, 17 nt, Human herpesvirus 2
ccaucgccggggaccgc

SEQ ID NO: 3960170 - RNA, 16 nt, Human herpesvirus 2
ccaugagccgccgggu

SEQ ID NO: 3960171 - RNA, 13 nt, Human herpesvirus 2
cccacccccgagg

SEQ ID NO: 3960172 - RNA, 17 nt, Human herpesvirus 2
cccacccccgcacccca

SEQ ID NO: 3960173 - RNA, 16 nt, Human herpesvirus 2
cccaccgcccccgcug

SEQ ID NO: 3960174 - RNA, 20 nt, Human herpesvirus 2
cccacgacauccgcggcuuu

SEQ ID NO: 3960175 - RNA, 12 nt, Human herpesvirus 2
ggccggggcggc

SEQ ID NO: 3960176 - RNA, 18 nt, Human herpesvirus 2
ggccgggucggcugucca

SEQ ID NO: 3960177 - RNA, 19 nt, Human herpesvirus 2
ggccggguuuuuggcccug

SEQ ID NO: 3960178 - RNA, 11 nt, Human herpesvirus 2
ggccugguggc

SEQ ID NO: 3960179 - RNA, 15 nt, Human herpesvirus 2
ggcgacccgccgccc

SEQ ID NO: 3960180 - RNA, 14 nt, Human herpesvirus 2
ggcgaccgccccgc

SEQ ID NO: 3960181 - RNA, 20 nt, Human herpesvirus 2
ggcgacgccaggccccccgg

SEQ ID NO: 3960182 - RNA, 15 nt, Human herpesvirus 2
ggcgagcuggcccug

SEQ ID NO: 3960183 - RNA, 17 nt, Human herpesvirus 2
ggcgagcuggcccugga

SEQ ID NO: 3960184 - RNA, 22 nt, Human herpesvirus 2
ggcgagcuggcccuggacccag

SEQ ID NO: 3960185 - RNA, 14 nt, Human herpesvirus 2
ggcgaggggcggga

SEQ ID NO: 3960186 - RNA, 14 nt, Human herpesvirus 2
ggcgccccccccga

SEQ ID NO: 3960187 - RNA, 18 nt, Human herpesvirus 2
ggcgccccgaaacgcggg

SEQ ID NO: 3960188 - RNA, 14 nt, Human herpesvirus 2
ggcgccggccaacc

SEQ ID NO: 3960189 - RNA, 20 nt, Human herpesvirus 2
ggcgccuaccugguacccac

SEQ ID NO: 3960190 - RNA, 20 nt, Human herpesvirus 2
ggcgcgcggcgcgagcuccc

SEQ ID NO: 3960191 - RNA, 15 nt, Human herpesvirus 2
ggcgcgcuggcggaa

SEQ ID NO: 3960192 - RNA, 12 nt, Human herpesvirus 2
ggcgcgggcggc

SEQ ID NO: 3960193 - RNA, 23 nt, Human herpesvirus 2
ggcgcggugccugacgccggcca

SEQ ID NO: 3960194 - RNA, 22 nt, Human herpesvirus 2
ggcgcucgguuguccguucugu

SEQ ID NO: 3960195 - RNA, 15 nt, Human herpesvirus 2
ggcgcugagggcggc

SEQ ID NO: 3960196 - RNA, 14 nt, Human herpesvirus 2
ggcgcugcgccugc

SEQ ID NO: 3960197 - RNA, 14 nt, Human herpesvirus 2
ggcggaagugccgc

SEQ ID NO: 3960198 - RNA, 17 nt, Human herpesvirus 2
ggcggacguccaggggu

SEQ ID NO: 3960199 - RNA, 13 nt, Human herpesvirus 2
ggcggaggccugu

SEQ ID NO: 3960200 - RNA, 14 nt, Human herpesvirus 2
ggcggcccuggagc

SEQ ID NO: 3960201 - RNA, 23 nt, Human herpesvirus 2
ggcgggaccccgacguggcccgc

SEQ ID NO: 3960202 - RNA, 11 nt, Human herpesvirus 2
ggcgggagcca

SEQ ID NO: 3960203 - RNA, 19 nt, Human herpesvirus 2
ggcgggccccguggguggg

SEQ ID NO: 3960204 - RNA, 12 nt, Human herpesvirus 2
ggcggggcaugg

SEQ ID NO: 3960205 - RNA, 16 nt, Human herpesvirus 2
ggcgugcugugcccug

SEQ ID NO: 3960206 - RNA, 13 nt, Human herpesvirus 2
ggcguggacgccg

SEQ ID NO: 3960207 - RNA, 17 nt, Human herpesvirus 2
ggcguuccuucccuuuc

SEQ ID NO: 3960208 - RNA, 21 nt, Human herpesvirus 2
ggcguuucugaccggcgccga

SEQ ID NO: 3960209 - RNA, 14 nt, Human herpesvirus 2
ggcuccaggccgcc

SEQ ID NO: 3960210 - RNA, 15 nt, Human herpesvirus 2
ggcuggcgcggugcc

SEQ ID NO: 3960211 - RNA, 12 nt, Human herpesvirus 2
ggcuggcggcgc

SEQ ID NO: 3960212 - RNA, 23 nt, Human herpesvirus 2
gggaaacacaguuccgggaaggc

SEQ ID NO: 3960213 - RNA, 12 nt, Human herpesvirus 2
gggacgaacagg

SEQ ID NO: 3960214 - RNA, 15 nt, Human herpesvirus 2
gggacuccccucuac

SEQ ID NO: 3960215 - RNA, 13 nt, Human herpesvirus 2
gggaggagacagg

SEQ ID NO: 3960216 - RNA, 14 nt, Human herpesvirus 2
gggaggagacagga

SEQ ID NO: 3960217 - RNA, 22 nt, Human herpesvirus 2
gggaggaggggggugguggccg

SEQ ID NO: 3960218 - RNA, 11 nt, Human herpesvirus 2
gggaugugucu

SEQ ID NO: 3960219 - RNA, 14 nt, Human herpesvirus 2
gggcaagugcagua

SEQ ID NO: 3960220 - RNA, 23 nt, Human herpesvirus 2
gggcaagugcaguaacccaguuc

SEQ ID NO: 3960221 - RNA, 20 nt, Human herpesvirus 2
gggcaccaaaaaccaggucu

SEQ ID NO: 3960222 - RNA, 12 nt, Human herpesvirus 2
gggcagugcagu

SEQ ID NO: 3960223 - RNA, 21 nt, Human herpesvirus 2
gggcaugggcuacuaccuggg

SEQ ID NO: 3960224 - RNA, 18 nt, Human herpesvirus 2
gggccaacagggaguccu

SEQ ID NO: 3960225 - RNA, 14 nt, Human herpesvirus 2
gggcccguguggga

SEQ ID NO: 3960226 - RNA, 16 nt, Human herpesvirus 2
gggccgacgugccggg

SEQ ID NO: 3960227 - RNA, 13 nt, Human herpesvirus 2
gggccgcccggag

SEQ ID NO: 3960228 - RNA, 17 nt, Human herpesvirus 2
gggccgcugggggggcg

SEQ ID NO: 3960229 - RNA, 12 nt, Human herpesvirus 2
gggccgggugac

SEQ ID NO: 3960230 - RNA, 17 nt, Human herpesvirus 2
gggccggguugguguuu

SEQ ID NO: 3960231 - RNA, 20 nt, Human herpesvirus 2
gggccguggggccccagggc

SEQ ID NO: 3960232 - RNA, 15 nt, Human herpesvirus 2
gggccgugucccucc

SEQ ID NO: 3960233 - RNA, 20 nt, Human herpesvirus 2
gggccucccgcaagagccug

SEQ ID NO: 3960234 - RNA, 14 nt, Human herpesvirus 2
gggcggcgaaccgg

SEQ ID NO: 3960235 - RNA, 20 nt, Human herpesvirus 2
gggcguagagcucggccucg

SEQ ID NO: 3960236 - RNA, 14 nt, Human herpesvirus 2
gggcguccugcggc

SEQ ID NO: 3960237 - RNA, 22 nt, Human herpesvirus 2
gggcgugauguuuuccgcaucu

SEQ ID NO: 3960238 - RNA, 17 nt, Human herpesvirus 2
gggcgugcugugcccug

SEQ ID NO: 3960239 - RNA, 13 nt, Human herpesvirus 2
gggcgugugacua

SEQ ID NO: 3960240 - RNA, 22 nt, Human herpesvirus 2
gggcuuguguauaaauaaaaag

SEQ ID NO: 3960241 - RNA, 19 nt, Human herpesvirus 2
gggcuuuagucccggcccg

SEQ ID NO: 3960242 - RNA, 20 nt, Human herpesvirus 2
ggggaagcccuacggcggcc

SEQ ID NO: 3960243 - RNA, 22 nt, Human herpesvirus 2
ggggacccgggcgagcuggccc

SEQ ID NO: 3960244 - RNA, 16 nt, Human herpesvirus 2
ggggaugggggggaag

SEQ ID NO: 3960245 - RNA, 14 nt, Human herpesvirus 2
ggggaugguggugg

SEQ ID NO: 3960246 - RNA, 15 nt, Human herpesvirus 2
ggggcaccggcaccg

SEQ ID NO: 3960247 - RNA, 15 nt, Human herpesvirus 2
ggggccccagggcuu

SEQ ID NO: 3960248 - RNA, 12 nt, Human herpesvirus 2
ggggcccccgac

SEQ ID NO: 3960249 - RNA, 17 nt, Human herpesvirus 2
ggggccgucgcggccgc

SEQ ID NO: 3960250 - RNA, 14 nt, Human herpesvirus 2
ggggccugcugugg

SEQ ID NO: 3960251 - RNA, 18 nt, Human herpesvirus 2
ggggcgcugguggccgcg

SEQ ID NO: 3960252 - RNA, 22 nt, Human herpesvirus 2
ggggcugguuggauguuuuugc

SEQ ID NO: 3960253 - RNA, 19 nt, Human herpesvirus 2
ggggcuugugcccucguag

SEQ ID NO: 3960254 - RNA, 17 nt, Human herpesvirus 2
gggggcaagugcaguaa

SEQ ID NO: 3960255 - RNA, 14 nt, Human herpesvirus 2
gggggcaggcgggc

SEQ ID NO: 3960256 - RNA, 16 nt, Human herpesvirus 2
gggggccggggcucuu

SEQ ID NO: 3960257 - RNA, 14 nt, Human herpesvirus 2
gggggcggcgccgg

SEQ ID NO: 3960258 - RNA, 14 nt, Human herpesvirus 2
gggggcgggggugc

SEQ ID NO: 3960259 - RNA, 12 nt, Human herpesvirus 2
gggggggcuggu

SEQ ID NO: 3960260 - RNA, 13 nt, Human herpesvirus 2
ggggggggugugu

SEQ ID NO: 3960261 - RNA, 12 nt, Human herpesvirus 2
ggggguggcggc

SEQ ID NO: 3960262 - RNA, 15 nt, Human herpesvirus 2
gggggugguggugcu

SEQ ID NO: 3960263 - RNA, 14 nt, Human herpesvirus 2
ggggugaggaagaa

SEQ ID NO: 3960264 - RNA, 12 nt, Human herpesvirus 2
gggucgcacgcc

SEQ ID NO: 3960265 - RNA, 19 nt, Human herpesvirus 2
gggucugcgucguccaggg

SEQ ID NO: 3960266 - RNA, 13 nt, Human herpesvirus 2
ggguucggggcca

SEQ ID NO: 3960267 - RNA, 21 nt, Human herpesvirus 2
gguaacuucuacgugcccccc

SEQ ID NO: 3960268 - RNA, 19 nt, Human herpesvirus 2
gguaauuagcagcuuuuaa

SEQ ID NO: 3960269 - RNA, 19 nt, Human herpesvirus 2
ggucaauaaagagcucugu

SEQ ID NO: 3960270 - RNA, 15 nt, Human herpesvirus 2
ggucaccggggcgcc

SEQ ID NO: 3960271 - RNA, 22 nt, Human herpesvirus 2
ggucaccgguguucggaaccag

SEQ ID NO: 3960272 - RNA, 22 nt, Human herpesvirus 2
ggucccgcgcucauggccggag

SEQ ID NO: 3960273 - RNA, 22 nt, Human herpesvirus 2
ggucccuuccccaccaccaacc

SEQ ID NO: 3960274 - RNA, 17 nt, Human herpesvirus 2
ggucggguguccccgga

SEQ ID NO: 3960275 - RNA, 14 nt, Human herpesvirus 2
ggucggugcccccc

SEQ ID NO: 3960276 - RNA, 21 nt, Human herpesvirus 2
ggugcccaucuacguggccgg

SEQ ID NO: 3960277 - RNA, 18 nt, Human herpesvirus 2
gguggcaaaauccaaaaa

SEQ ID NO: 3960278 - RNA, 13 nt, Human herpesvirus 2
gguggggggcgag

SEQ ID NO: 3960279 - RNA, 17 nt, Human herpesvirus 2
gguuggggcgggcagcc

SEQ ID NO: 3960280 - RNA, 14 nt, Human herpesvirus 2
gguuuccggccccu

SEQ ID NO: 3960281 - RNA, 17 nt, Human herpesvirus 2
gguuucgguuccacucu

SEQ ID NO: 3960282 - RNA, 11 nt, Human herpesvirus 2
guaaaaaagaa

SEQ ID NO: 3960283 - RNA, 20 nt, Human herpesvirus 2
guagacgggcucgccagcga

SEQ ID NO: 3960284 - RNA, 23 nt, Human herpesvirus 2
guagccuaucuugaucccccgga

SEQ ID NO: 3960285 - RNA, 22 nt, Human herpesvirus 2
guaugucuguuucaauaaaaag

SEQ ID NO: 3960286 - RNA, 18 nt, Human herpesvirus 2
gucaccggggcgcccccc

SEQ ID NO: 3960287 - RNA, 22 nt, Human herpesvirus 2
gucacgagccccugggccgcuc

SEQ ID NO: 3960288 - RNA, 21 nt, Human herpesvirus 2
gucccccgaagcggccccgac

SEQ ID NO: 3960289 - RNA, 14 nt, Human herpesvirus 2
gucccccggacccc

SEQ ID NO: 3960290 - RNA, 19 nt, Human herpesvirus 2
gucccccggaccccgaccc

SEQ ID NO: 3960291 - RNA, 23 nt, Human herpesvirus 2
gucccgacgauuagccaccgcgc

SEQ ID NO: 3960292 - RNA, 12 nt, Human herpesvirus 2
gucccgcccgcc

SEQ ID NO: 3960293 - RNA, 18 nt, Human herpesvirus 2
cuugccccucccccggcc

SEQ ID NO: 3960294 - RNA, 19 nt, Human herpesvirus 2
cuuggccguguggucgccc

SEQ ID NO: 3960295 - RNA, 13 nt, Human herpesvirus 2
cuuggccuucccg

SEQ ID NO: 3960296 - RNA, 15 nt, Human herpesvirus 2
cuugggggggcgucc

SEQ ID NO: 3960297 - RNA, 15 nt, Human herpesvirus 2
cuuuccaccccccuu

SEQ ID NO: 3960298 - RNA, 21 nt, Human herpesvirus 2
cuuucccccccacuccacccc

SEQ ID NO: 3960299 - RNA, 13 nt, Human herpesvirus 2
cuuugacuccugg

SEQ ID NO: 3960300 - RNA, 16 nt, Human herpesvirus 2
gaaaaggcccggcccg

SEQ ID NO: 3960301 - RNA, 15 nt, Human herpesvirus 2
gaaaccgcaggcgcg

SEQ ID NO: 3960302 - RNA, 19 nt, Human herpesvirus 2
gaaagacggggaggagaca

SEQ ID NO: 3960303 - RNA, 16 nt, Human herpesvirus 2
gaacacgagccgcagg

SEQ ID NO: 3960304 - RNA, 17 nt, Human herpesvirus 2
gaaccaacugccgaaag

SEQ ID NO: 3960305 - RNA, 16 nt, Human herpesvirus 2
gaacgccucaccgcgc

SEQ ID NO: 3960306 - RNA, 15 nt, Human herpesvirus 2
gaacgggggucccgc

SEQ ID NO: 3960307 - RNA, 19 nt, Human herpesvirus 2
gaacucucccggcuccucc

SEQ ID NO: 3960308 - RNA, 20 nt, Human herpesvirus 2
gaagcugccucccccccgga

SEQ ID NO: 3960309 - RNA, 22 nt, Human herpesvirus 2
gaaggcguuuauugcggagaga

SEQ ID NO: 3960310 - RNA, 16 nt, Human herpesvirus 2
gaagggaaaggaacag

SEQ ID NO: 3960311 - RNA, 20 nt, Human herpesvirus 2
gaagucucuuggggaaaucu

SEQ ID NO: 3960312 - RNA, 19 nt, Human herpesvirus 2
gaagugccgcacggccgug

SEQ ID NO: 3960313 - RNA, 16 nt, Human herpesvirus 2
gacaacugccugaccc

SEQ ID NO: 3960314 - RNA, 14 nt, Human herpesvirus 2
gacacacacacccc

SEQ ID NO: 3960315 - RNA, 15 nt, Human herpesvirus 2
gacacgcggcggguc

SEQ ID NO: 3960316 - RNA, 21 nt, Human herpesvirus 2
gacagcgcgaugaggggcacc

SEQ ID NO: 3960317 - RNA, 14 nt, Human herpesvirus 2
gacaggaggcgcag

SEQ ID NO: 3960318 - RNA, 18 nt, Human herpesvirus 2
gaccaccgcgaccacccc

SEQ ID NO: 3960319 - RNA, 22 nt, Human herpesvirus 2
gaccaccucgcggcggcucccc

SEQ ID NO: 3960320 - RNA, 22 nt, Human herpesvirus 2
gaccacgcgcacgucggggggc

SEQ ID NO: 3960321 - RNA, 15 nt, Human herpesvirus 2
gacccaacagccuag

SEQ ID NO: 3960322 - RNA, 13 nt, Human herpesvirus 2
gacccccagcgcg

SEQ ID NO: 3960323 - RNA, 16 nt, Human herpesvirus 2
gaccccccgggaggag

SEQ ID NO: 3960324 - RNA, 22 nt, Human herpesvirus 2
gacccccgaacagccccugggg

SEQ ID NO: 3960325 - RNA, 17 nt, Human herpesvirus 2
gaccccgauaguccccc

SEQ ID NO: 3960326 - RNA, 15 nt, Human herpesvirus 2
gacccgccgggggcg

SEQ ID NO: 3960327 - RNA, 19 nt, Human herpesvirus 2
gacccggacugcagccccg

SEQ ID NO: 3960328 - RNA, 11 nt, Human herpesvirus 2
gacccggggcc

SEQ ID NO: 3960329 - RNA, 16 nt, Human herpesvirus 2
gacccggggcccgaag

SEQ ID NO: 3960330 - RNA, 20 nt, Human herpesvirus 2
gaccgccugccccgcggagg

SEQ ID NO: 3960331 - RNA, 14 nt, Human herpesvirus 2
gaccggggacuccc

SEQ ID NO: 3960332 - RNA, 15 nt, Human herpesvirus 2
gaccugcagccggcg

SEQ ID NO: 3960333 - RNA, 11 nt, Human herpesvirus 2
gaccugcagga

SEQ ID NO: 3960334 - RNA, 23 nt, Human herpesvirus 2
gacgacagacaauaaagcaucac

SEQ ID NO: 3960335 - RNA, 19 nt, Human herpesvirus 2
gacgacgaccaugggcccc

SEQ ID NO: 3960336 - RNA, 14 nt, Human herpesvirus 2
gacgauuagccacc

SEQ ID NO: 3960337 - RNA, 18 nt, Human herpesvirus 2
gacgccaacgcgaccguc

SEQ ID NO: 3960338 - RNA, 14 nt, Human herpesvirus 2
gacgcccggcccau

SEQ ID NO: 3960339 - RNA, 13 nt, Human herpesvirus 2
gacgcggccagaa

SEQ ID NO: 3960340 - RNA, 16 nt, Human herpesvirus 2
gacgcggcgauggccg

SEQ ID NO: 3960341 - RNA, 19 nt, Human herpesvirus 2
gacgcuguuguuucugggc

SEQ ID NO: 3960342 - RNA, 19 nt, Human herpesvirus 2
gacggcaauaaaagaacag

SEQ ID NO: 3960343 - RNA, 18 nt, Human herpesvirus 2
gacggcaugcagcccaga

SEQ ID NO: 3960344 - RNA, 17 nt, Human herpesvirus 2
gacgggccggugggccc

SEQ ID NO: 3960345 - RNA, 13 nt, Human herpesvirus 2
gacgggcucgcca

SEQ ID NO: 3960346 - RNA, 18 nt, Human herpesvirus 2
gacgucaaauucgugggc

SEQ ID NO: 3960347 - RNA, 17 nt, Human herpesvirus 2
gacgucaaucgcccgag

SEQ ID NO: 3960348 - RNA, 24 nt, Human herpesvirus 2
gacgucccccacggucaggaccag

SEQ ID NO: 3960349 - RNA, 18 nt, Human herpesvirus 2
gagaagccgcccccaccc

SEQ ID NO: 3960350 - RNA, 21 nt, Human herpesvirus 2
gagacggccaugaccucgccc

SEQ ID NO: 3960351 - RNA, 13 nt, Human herpesvirus 2
gagagcccaggga

SEQ ID NO: 3960352 - RNA, 17 nt, Human herpesvirus 2
gagaggcccgccgcgca

SEQ ID NO: 3960353 - RNA, 12 nt, Human herpesvirus 2
gagauggggaga

SEQ ID NO: 3960354 - RNA, 12 nt, Human herpesvirus 2
gagaugugccuu

SEQ ID NO: 3960355 - RNA, 15 nt, Human herpesvirus 2
gagaugugccuucca

SEQ ID NO: 3960356 - RNA, 16 nt, Human herpesvirus 2
gagaugugccuuccag

SEQ ID NO: 3960357 - RNA, 19 nt, Human herpesvirus 2
gagcagcacggcggccaga

SEQ ID NO: 3960358 - RNA, 20 nt, Human herpesvirus 2
gagccaaaccagccccgcag

SEQ ID NO: 3960359 - RNA, 18 nt, Human herpesvirus 2
gagccaccgucccgcccg

SEQ ID NO: 3960360 - RNA, 12 nt, Human herpesvirus 2
gagcccagggaa

SEQ ID NO: 3960361 - RNA, 22 nt, Human herpesvirus 2
gagccccgcgaccaccaaggcc

SEQ ID NO: 3960362 - RNA, 16 nt, Human herpesvirus 2
gagccccugggggacc

SEQ ID NO: 3960363 - RNA, 17 nt, Human herpesvirus 2
gagcccguggcccacga

SEQ ID NO: 3960364 - RNA, 14 nt, Human herpesvirus 2
gagcccugccccgc

SEQ ID NO: 3960365 - RNA, 13 nt, Human herpesvirus 2
gagccgcaggaac

SEQ ID NO: 3960366 - RNA, 15 nt, Human herpesvirus 2
gagccgcugugccag

SEQ ID NO: 3960367 - RNA, 16 nt, Human herpesvirus 2
gagccgcugugccagg

SEQ ID NO: 3960368 - RNA, 14 nt, Human herpesvirus 2
gagccucuuugggc

SEQ ID NO: 3960369 - RNA, 18 nt, Human herpesvirus 2
gagcggacacgcuugaag

SEQ ID NO: 3960370 - RNA, 18 nt, Human herpesvirus 2
gagcguaucggccaggag

SEQ ID NO: 3960371 - RNA, 18 nt, Human herpesvirus 2
gaggagacaggaaguggg

SEQ ID NO: 3960372 - RNA, 14 nt, Human herpesvirus 2
gaggagccgggaga

SEQ ID NO: 3960373 - RNA, 15 nt, Human herpesvirus 2
gaggaggaggagggg

SEQ ID NO: 3960374 - RNA, 18 nt, Human herpesvirus 2
gaggauguguucuccugg

SEQ ID NO: 3960375 - RNA, 12 nt, Human herpesvirus 2
gaggauuacuuu

SEQ ID NO: 3960376 - RNA, 16 nt, Human herpesvirus 2
gaggcccucugggaca

SEQ ID NO: 3960377 - RNA, 21 nt, Human herpesvirus 2
gaggccucauccggcccgcca

SEQ ID NO: 3960378 - RNA, 23 nt, Human herpesvirus 2
gaggccugucccugcgucgcccc

SEQ ID NO: 3960379 - RNA, 13 nt, Human herpesvirus 2
gaggcggacccag

SEQ ID NO: 3960380 - RNA, 17 nt, Human herpesvirus 2
gaggggaugggggcgcg

SEQ ID NO: 3960381 - RNA, 15 nt, Human herpesvirus 2
gaggggggcagugca

SEQ ID NO: 3960382 - RNA, 18 nt, Human herpesvirus 2
gaggucaauagauuuccc

SEQ ID NO: 3960383 - RNA, 21 nt, Human herpesvirus 2
gaggucaauagauuuccccaa

SEQ ID NO: 3960384 - RNA, 21 nt, Human herpesvirus 2
gaguucaauagauuucccaaa

SEQ ID NO: 3960385 - RNA, 23 nt, Human herpesvirus 2
gaguuucggaaagccggccccgg

SEQ ID NO: 3960386 - RNA, 22 nt, Human herpesvirus 2
gauagucccccgaagcggcccc

SEQ ID NO: 3960387 - RNA, 13 nt, Human herpesvirus 2
gaucccccggaag

SEQ ID NO: 3960388 - RNA, 14 nt, Human herpesvirus 2
gauccugggccugu

SEQ ID NO: 3960389 - RNA, 22 nt, Human herpesvirus 2
gaucucggggagggcggcaccg

SEQ ID NO: 3960390 - RNA, 20 nt, Human herpesvirus 2
gaugauggggacgacgggcg

SEQ ID NO: 3960391 - RNA, 13 nt, Human herpesvirus 2
gaugcgacgccgc

SEQ ID NO: 3960392 - RNA, 23 nt, Human herpesvirus 2
gauggccgcgcgcgugugugaga

SEQ ID NO: 3960393 - RNA, 15 nt, Human herpesvirus 2
gauggcggggauggg

SEQ ID NO: 3960394 - RNA, 22 nt, Human herpesvirus 2
gauggggagagggggaaggaau

SEQ ID NO: 3960395 - RNA, 15 nt, Human herpesvirus 2
gauguauggcgccuu

SEQ ID NO: 3960396 - RNA, 17 nt, Human herpesvirus 2
gauuccggugugcccca

SEQ ID NO: 3960397 - RNA, 15 nt, Human herpesvirus 2
gcaagccacccuggg

SEQ ID NO: 3960398 - RNA, 15 nt, Human herpesvirus 2
gcacacgccaucgac

SEQ ID NO: 3960399 - RNA, 17 nt, Human herpesvirus 2
gcacccacgacauccgc

SEQ ID NO: 3960400 - RNA, 19 nt, Human herpesvirus 2
gcacccauccaucugggag

SEQ ID NO: 3960401 - RNA, 16 nt, Human herpesvirus 2
gcacccccgcgccgcc

SEQ ID NO: 3960402 - RNA, 21 nt, Human herpesvirus 2
gcgcuccgaucggggucaggc

SEQ ID NO: 3960403 - RNA, 20 nt, Human herpesvirus 2
gcgcugcugcgcauggccug

SEQ ID NO: 3960404 - RNA, 11 nt, Human herpesvirus 2
gcgcugguggc

SEQ ID NO: 3960405 - RNA, 18 nt, Human herpesvirus 2
gcgcuggugggacgccca

SEQ ID NO: 3960406 - RNA, 15 nt, Human herpesvirus 2
gcgcuuggccgggga

SEQ ID NO: 3960407 - RNA, 21 nt, Human herpesvirus 2
gcgcuuuccggcccucccgca

SEQ ID NO: 3960408 - RNA, 20 nt, Human herpesvirus 2
gcggacaaacccgccggggc

SEQ ID NO: 3960409 - RNA, 13 nt, Human herpesvirus 2
gcggaccccgccc

SEQ ID NO: 3960410 - RNA, 19 nt, Human herpesvirus 2
gcggaccccgcccgcgacc

SEQ ID NO: 3960411 - RNA, 12 nt, Human herpesvirus 2
gcggaggcgugg

SEQ ID NO: 3960412 - RNA, 12 nt, Human herpesvirus 2
gcggaugugggc

SEQ ID NO: 3960413 - RNA, 23 nt, Human herpesvirus 2
gcggccccuguuggagccggagc

SEQ ID NO: 3960414 - RNA, 21 nt, Human herpesvirus 2
gcgggaugugucgcggggaca

SEQ ID NO: 3960415 - RNA, 18 nt, Human herpesvirus 2
gcgggcaggccgcggcgc

SEQ ID NO: 3960416 - RNA, 15 nt, Human herpesvirus 2
gcgggcccggggccc

SEQ ID NO: 3960417 - RNA, 21 nt, Human herpesvirus 2
gcgggcgggaugaugcggggc

SEQ ID NO: 3960418 - RNA, 15 nt, Human herpesvirus 2
gcgggcgggggcgcg

SEQ ID NO: 3960419 - RNA, 12 nt, Human herpesvirus 2
gcggggccccgg

SEQ ID NO: 3960420 - RNA, 22 nt, Human herpesvirus 2
gcggggguucggggccagggcu

SEQ ID NO: 3960421 - RNA, 22 nt, Human herpesvirus 2
gcggggucgagcgcgccaggac

SEQ ID NO: 3960422 - RNA, 16 nt, Human herpesvirus 2
gcggguaggccagagc

SEQ ID NO: 3960423 - RNA, 16 nt, Human herpesvirus 2
gcgggucccuucccaa

SEQ ID NO: 3960424 - RNA, 18 nt, Human herpesvirus 2
gcgguaauuagcagcuuu

SEQ ID NO: 3960425 - RNA, 14 nt, Human herpesvirus 2
gcggugcagggccu

SEQ ID NO: 3960426 - RNA, 23 nt, Human herpesvirus 2
gcggugcgagaguuucuucgcgg

SEQ ID NO: 3960427 - RNA, 15 nt, Human herpesvirus 2
gcgguucguucugga

SEQ ID NO: 3960428 - RNA, 20 nt, Human herpesvirus 2
gcguacagccuacaucaccc

SEQ ID NO: 3960429 - RNA, 16 nt, Human herpesvirus 2
gcguccgacacccggg

SEQ ID NO: 3960430 - RNA, 15 nt, Human herpesvirus 2
gcgucggcggccccg

SEQ ID NO: 3960431 - RNA, 23 nt, Human herpesvirus 2
gcgucguggcauggaagcccccg

SEQ ID NO: 3960432 - RNA, 14 nt, Human herpesvirus 2
gcgugcggcccugc

SEQ ID NO: 3960433 - RNA, 21 nt, Human herpesvirus 2
gcgugcggcccugccuccgga

SEQ ID NO: 3960434 - RNA, 21 nt, Human herpesvirus 2
gcguggucacccgggcgccgg

SEQ ID NO: 3960435 - RNA, 21 nt, Human herpesvirus 2
gcgugucguugggcggccccc

SEQ ID NO: 3960436 - RNA, 20 nt, Human herpesvirus 2
gcgugugugagaaauaaaga

SEQ ID NO: 3960437 - RNA, 19 nt, Human herpesvirus 2
gcguuccuucccuuucccc

SEQ ID NO: 3960438 - RNA, 17 nt, Human herpesvirus 2
gcguucuggcggcccug

SEQ ID NO: 3960439 - RNA, 18 nt, Human herpesvirus 2
gcuacacgacccuggaga

SEQ ID NO: 3960440 - RNA, 19 nt, Human herpesvirus 2
gcuccagguacugcugcac

SEQ ID NO: 3960441 - RNA, 17 nt, Human herpesvirus 2
gcucccggcccgggccc

SEQ ID NO: 3960442 - RNA, 22 nt, Human herpesvirus 2
gcucccguguaccucugggccc

SEQ ID NO: 3960443 - RNA, 14 nt, Human herpesvirus 2
gcucgccagcgacc

SEQ ID NO: 3960444 - RNA, 19 nt, Human herpesvirus 2
gcucgcugcagggccuggc

SEQ ID NO: 3960445 - RNA, 13 nt, Human herpesvirus 2
gcucguggcgggc

SEQ ID NO: 3960446 - RNA, 15 nt, Human herpesvirus 2
gcucugccugcacga

SEQ ID NO: 3960447 - RNA, 13 nt, Human herpesvirus 2
gcugcugccccgc

SEQ ID NO: 3960448 - RNA, 21 nt, Human herpesvirus 2
gcuggcaccguaucagcaccc

SEQ ID NO: 3960449 - RNA, 23 nt, Human herpesvirus 2
gcuggcugcggggggcggugggu

SEQ ID NO: 3960450 - RNA, 22 nt, Human herpesvirus 2
gcugggcuuguguauaaauaaa

SEQ ID NO: 3960451 - RNA, 18 nt, Human herpesvirus 2
gcuguauucccuugcccg

SEQ ID NO: 3960452 - RNA, 16 nt, Human herpesvirus 2
gcuguucugccgcgcg

SEQ ID NO: 3960453 - RNA, 19 nt, Human herpesvirus 2
gcuguuuauuacgggacca

SEQ ID NO: 3960454 - RNA, 23 nt, Human herpesvirus 2
gcuucaccgagagcgccgucggg

SEQ ID NO: 3960455 - RNA, 14 nt, Human herpesvirus 2
gcuucaucaccccc

SEQ ID NO: 3960456 - RNA, 15 nt, Human herpesvirus 2
gcuucuucgccgccc

SEQ ID NO: 3960457 - RNA, 12 nt, Human herpesvirus 2
ggaaagaaagaa

SEQ ID NO: 3960458 - RNA, 23 nt, Human herpesvirus 2
ggaaagcgucauccgcccgacca

SEQ ID NO: 3960459 - RNA, 17 nt, Human herpesvirus 2
ggaaaggaaaggaaaca

SEQ ID NO: 3960460 - RNA, 14 nt, Human herpesvirus 2
ggaacgacaaaaaa

SEQ ID NO: 3960461 - RNA, 18 nt, Human herpesvirus 2
ggaacuguguuucccccc

SEQ ID NO: 3960462 - RNA, 17 nt, Human herpesvirus 2
ggaagaggcggacccag

SEQ ID NO: 3960463 - RNA, 13 nt, Human herpesvirus 2
ggaaggaaauggg

SEQ ID NO: 3960464 - RNA, 21 nt, Human herpesvirus 2
ggaagggacccgcggaggaaa

SEQ ID NO: 3960465 - RNA, 20 nt, Human herpesvirus 2
ggaagggugggggugguggu

SEQ ID NO: 3960466 - RNA, 16 nt, Human herpesvirus 2
ggacaaacccgccggg

SEQ ID NO: 3960467 - RNA, 16 nt, Human herpesvirus 2
ggacacgcggcggguc

SEQ ID NO: 3960468 - RNA, 12 nt, Human herpesvirus 2
ggaccacgugca

SEQ ID NO: 3960469 - RNA, 19 nt, Human herpesvirus 2
ggaccacgugcacagccug

SEQ ID NO: 3960470 - RNA, 14 nt, Human herpesvirus 2
ggaccgcagucugg

SEQ ID NO: 3960471 - RNA, 20 nt, Human herpesvirus 2
ggacgacgaccaugggcccc

SEQ ID NO: 3960472 - RNA, 22 nt, Human herpesvirus 2
ggacgagccaaaccagccccgc

SEQ ID NO: 3960473 - RNA, 11 nt, Human herpesvirus 2
ggacgcgcagc

SEQ ID NO: 3960474 - RNA, 18 nt, Human herpesvirus 2
ggacgcggcauaccuccg

SEQ ID NO: 3960475 - RNA, 20 nt, Human herpesvirus 2
ggacgcggccagaaacccgg

SEQ ID NO: 3960476 - RNA, 17 nt, Human herpesvirus 2
ggacuggcagccgggac

SEQ ID NO: 3960477 - RNA, 21 nt, Human herpesvirus 2
ggagaguucaauagauuuccc

SEQ ID NO: 3960478 - RNA, 18 nt, Human herpesvirus 2
ggagauggggagaggggg

SEQ ID NO: 3960479 - RNA, 14 nt, Human herpesvirus 2
ggagccacucccgc

SEQ ID NO: 3960480 - RNA, 18 nt, Human herpesvirus 2
ggagccccggagcuccga

SEQ ID NO: 3960481 - RNA, 23 nt, Human herpesvirus 2
ggagcgggggaggggggagaugg

SEQ ID NO: 3960482 - RNA, 13 nt, Human herpesvirus 2
ggagcgucccgac

SEQ ID NO: 3960483 - RNA, 23 nt, Human herpesvirus 2
ggaggcccucugggacacccaga

SEQ ID NO: 3960484 - RNA, 16 nt, Human herpesvirus 2
ggaggcgccucugccc

SEQ ID NO: 3960485 - RNA, 21 nt, Human herpesvirus 2
ggaggggcuccucagcgcggc

SEQ ID NO: 3960486 - RNA, 13 nt, Human herpesvirus 2
ggaggggggagau

SEQ ID NO: 3960487 - RNA, 16 nt, Human herpesvirus 2
ggaggggggagauggg

SEQ ID NO: 3960488 - RNA, 15 nt, Human herpesvirus 2
ggaggguucggggca

SEQ ID NO: 3960489 - RNA, 19 nt, Human herpesvirus 2
ggagguggucggcggccaa

SEQ ID NO: 3960490 - RNA, 13 nt, Human herpesvirus 2
ggagucgccgccc

SEQ ID NO: 3960491 - RNA, 16 nt, Human herpesvirus 2
ggagugcgcucuucgc

SEQ ID NO: 3960492 - RNA, 24 nt, Human herpesvirus 2
ggaguuccgacgacgcguacgugg

SEQ ID NO: 3960493 - RNA, 19 nt, Human herpesvirus 2
ggauccuccgccagcucgg

SEQ ID NO: 3960494 - RNA, 16 nt, Human herpesvirus 2
ggaucgggggcugcug

SEQ ID NO: 3960495 - RNA, 14 nt, Human herpesvirus 2
ggaugauggggacg

SEQ ID NO: 3960496 - RNA, 21 nt, Human herpesvirus 2
ggaugccccgagccagcaggu

SEQ ID NO: 3960497 - RNA, 19 nt, Human herpesvirus 2
ggaugugucgcggggacag

SEQ ID NO: 3960498 - RNA, 17 nt, Human herpesvirus 2
ggauguguucuccugga

SEQ ID NO: 3960499 - RNA, 20 nt, Human herpesvirus 2
ggcaaacacgaucgugcugc

SEQ ID NO: 3960500 - RNA, 13 nt, Human herpesvirus 2
ggcaagugcagua

SEQ ID NO: 3960501 - RNA, 19 nt, Human herpesvirus 2
ggcacagugggugcucggg

SEQ ID NO: 3960502 - RNA, 10 nt, Human herpesvirus 2
ggcaccccau

SEQ ID NO: 3960503 - RNA, 21 nt, Human herpesvirus 2
ggcaccguaucagcaccccac

SEQ ID NO: 3960504 - RNA, 17 nt, Human herpesvirus 2
ggcacgggcccggggcg

SEQ ID NO: 3960505 - RNA, 19 nt, Human herpesvirus 2
ggcacgggcccggggcgaa

SEQ ID NO: 3960506 - RNA, 23 nt, Human herpesvirus 2
ggcagcgcgccgacgaccugcag

SEQ ID NO: 3960507 - RNA, 21 nt, Human herpesvirus 2
ggcaucguuuggguggaggag

SEQ ID NO: 3960508 - RNA, 16 nt, Human herpesvirus 2
ggccagcacgaccagg

SEQ ID NO: 3960509 - RNA, 12 nt, Human herpesvirus 2
ggccaggggggc

SEQ ID NO: 3960510 - RNA, 14 nt, Human herpesvirus 2
ggccauccugccca

SEQ ID NO: 3960511 - RNA, 14 nt, Human herpesvirus 2
ggcccacccccaaa

SEQ ID NO: 3960512 - RNA, 13 nt, Human herpesvirus 2
ggcccaccugcac

SEQ ID NO: 3960513 - RNA, 20 nt, Human herpesvirus 2
ggcccccgcaccggggcggc

SEQ ID NO: 3960514 - RNA, 18 nt, Human herpesvirus 2
ggccccgacuccgcgaau

SEQ ID NO: 3960515 - RNA, 17 nt, Human herpesvirus 2
ggccccgccccgcccca

SEQ ID NO: 3960516 - RNA, 22 nt, Human herpesvirus 2
cccacggucagucuggucucag

SEQ ID NO: 3960517 - RNA, 12 nt, Human herpesvirus 2
cccagcuuuccc

SEQ ID NO: 3960518 - RNA, 13 nt, Human herpesvirus 2
cccaggcccuggc

SEQ ID NO: 3960519 - RNA, 12 nt, Human herpesvirus 2
cccagggcacca

SEQ ID NO: 3960520 - RNA, 21 nt, Human herpesvirus 2
cccagggggcggcgccggcca

SEQ ID NO: 3960521 - RNA, 16 nt, Human herpesvirus 2
cccaggucccccauac

SEQ ID NO: 3960522 - RNA, 16 nt, Human herpesvirus 2
cccaguaccggcgcgc

SEQ ID NO: 3960523 - RNA, 15 nt, Human herpesvirus 2
cccaguuccucagug

SEQ ID NO: 3960524 - RNA, 15 nt, Human herpesvirus 2
cccaguuccuccgug

SEQ ID NO: 3960525 - RNA, 14 nt, Human herpesvirus 2
cccauccccucccg

SEQ ID NO: 3960526 - RNA, 20 nt, Human herpesvirus 2
ccccaacucauacacgcgcu

SEQ ID NO: 3960527 - RNA, 14 nt, Human herpesvirus 2
ccccagcuuucccu

SEQ ID NO: 3960528 - RNA, 17 nt, Human herpesvirus 2
ccccagggagccccggg

SEQ ID NO: 3960529 - RNA, 13 nt, Human herpesvirus 2
cccccaccccauc

SEQ ID NO: 3960530 - RNA, 22 nt, Human herpesvirus 2
cccccggaccccgcugcugugc

SEQ ID NO: 3960531 - RNA, 17 nt, Human herpesvirus 2
cccccgggacuucugga

SEQ ID NO: 3960532 - RNA, 22 nt, Human herpesvirus 2
cccccuuuacgccuuuccuccc

SEQ ID NO: 3960533 - RNA, 19 nt, Human herpesvirus 2
ccccgaauaccaccggcgu

SEQ ID NO: 3960534 - RNA, 23 nt, Human herpesvirus 2
ccccgaauaccaccggcguguga

SEQ ID NO: 3960535 - RNA, 14 nt, Human herpesvirus 2
ccccgacgcgcgcg

SEQ ID NO: 3960536 - RNA, 21 nt, Human herpesvirus 2
ccccgauuccggugugcccca

SEQ ID NO: 3960537 - RNA, 13 nt, Human herpesvirus 2
ccccgcgcacgcg

SEQ ID NO: 3960538 - RNA, 15 nt, Human herpesvirus 2
ccccgcgcacgcgcg

SEQ ID NO: 3960539 - RNA, 12 nt, Human herpesvirus 2
ccccgcgccgcc

SEQ ID NO: 3960540 - RNA, 14 nt, Human herpesvirus 2
ccccgcggaccccg

SEQ ID NO: 3960541 - RNA, 14 nt, Human herpesvirus 2
ccccgcuggcggga

SEQ ID NO: 3960542 - RNA, 22 nt, Human herpesvirus 2
ccccggcggggcauggaccccc

SEQ ID NO: 3960543 - RNA, 17 nt, Human herpesvirus 2
aaaagggacgcgcagcg

SEQ ID NO: 3960544 - RNA, 18 nt, Human herpesvirus 2
aaacacaaaccacacgcu

SEQ ID NO: 3960545 - RNA, 11 nt, Human herpesvirus 2
aaaccacacac

SEQ ID NO: 3960546 - RNA, 22 nt, Human herpesvirus 2
aaacgcgcgcccccauccccuc

SEQ ID NO: 3960547 - RNA, 17 nt, Human herpesvirus 2
aaaucgugcacagagcc

SEQ ID NO: 3960548 - RNA, 14 nt, Human herpesvirus 2
aaaucuauugaacu

SEQ ID NO: 3960549 - RNA, 14 nt, Human herpesvirus 2
aacaccguccccga

SEQ ID NO: 3960550 - RNA, 18 nt, Human herpesvirus 2
aacacgagccgcaggaac

SEQ ID NO: 3960551 - RNA, 20 nt, Human herpesvirus 2
aacacguucgccccgcagcc

SEQ ID NO: 3960552 - RNA, 21 nt, Human herpesvirus 2
aacaugacaacgacgccccuc

SEQ ID NO: 3960553 - RNA, 18 nt, Human herpesvirus 2
aaccacccaaccaacgga

SEQ ID NO: 3960554 - RNA, 21 nt, Human herpesvirus 2
aacccaagugguuccguguga

SEQ ID NO: 3960555 - RNA, 18 nt, Human herpesvirus 2
aaccccgcggcccugagc

SEQ ID NO: 3960556 - RNA, 23 nt, Human herpesvirus 2
aacgguaagcagcgcguccaggu

SEQ ID NO: 3960557 - RNA, 17 nt, Human herpesvirus 2
aacucgcggcaccgcgc

SEQ ID NO: 3960558 - RNA, 14 nt, Human herpesvirus 2
aacuguguuucccc

SEQ ID NO: 3960559 - RNA, 23 nt, Human herpesvirus 2
aagacucggugcguuccagcgcg

SEQ ID NO: 3960560 - RNA, 17 nt, Human herpesvirus 2
aagagacgaugggagcc

SEQ ID NO: 3960561 - RNA, 22 nt, Human herpesvirus 2
aagagugguuugccguggagcu

SEQ ID NO: 3960562 - RNA, 19 nt, Human herpesvirus 2
aaggaacgcccgaaaccag

SEQ ID NO: 3960563 - RNA, 13 nt, Human herpesvirus 2
aaggcgcugcgcc

SEQ ID NO: 3960564 - RNA, 17 nt, Human herpesvirus 2
aagugcaguaacccagu

SEQ ID NO: 3960565 - RNA, 19 nt, Human herpesvirus 2
aagugggggggugguggug

SEQ ID NO: 3960566 - RNA, 12 nt, Human herpesvirus 2
aauaaacacaaa

SEQ ID NO: 3960567 - RNA, 12 nt, Human herpesvirus 2
acaacugccuga

SEQ ID NO: 3960568 - RNA, 21 nt, Human herpesvirus 2
acacacaccagcauuuuguua

SEQ ID NO: 3960569 - RNA, 17 nt, Human herpesvirus 2
acacaggcccaccacca

SEQ ID NO: 3960570 - RNA, 16 nt, Human herpesvirus 2
acacgacccgccucgg

SEQ ID NO: 3960571 - RNA, 20 nt, Human herpesvirus 2
acacgcgcuggccccucugc

SEQ ID NO: 3960572 - RNA, 22 nt, Human herpesvirus 2
gcaccggacgcgcacguggggc

SEQ ID NO: 3960573 - RNA, 13 nt, Human herpesvirus 2
gcaccggggcggc

SEQ ID NO: 3960574 - RNA, 19 nt, Human herpesvirus 2
gcaccugcagaugcugccc

SEQ ID NO: 3960575 - RNA, 14 nt, Human herpesvirus 2
gcacgcggucagca

SEQ ID NO: 3960576 - RNA, 15 nt, Human herpesvirus 2
gcacggcggacacaa

SEQ ID NO: 3960577 - RNA, 18 nt, Human herpesvirus 2
gcacgggcccggggcgaa

SEQ ID NO: 3960578 - RNA, 17 nt, Human herpesvirus 2
gcacguacguucugccc

SEQ ID NO: 3960579 - RNA, 20 nt, Human herpesvirus 2
gcacucccgaaaccgcaggc

SEQ ID NO: 3960580 - RNA, 19 nt, Human herpesvirus 2
gcacuggggugauacuuaa

SEQ ID NO: 3960581 - RNA, 20 nt, Human herpesvirus 2
gcagcagucguggagcgucc

SEQ ID NO: 3960582 - RNA, 15 nt, Human herpesvirus 2
gcagccccggucccc

SEQ ID NO: 3960583 - RNA, 12 nt, Human herpesvirus 2
gcagccgggccc

SEQ ID NO: 3960584 - RNA, 17 nt, Human herpesvirus 2
gcagccuauguucgcgg

SEQ ID NO: 3960585 - RNA, 12 nt, Human herpesvirus 2
gcagcgcgccga

SEQ ID NO: 3960586 - RNA, 22 nt, Human herpesvirus 2
gcagcgugucaaaggccagcag

SEQ ID NO: 3960587 - RNA, 15 nt, Human herpesvirus 2
gcagcuucaccgaga

SEQ ID NO: 3960588 - RNA, 13 nt, Human herpesvirus 2
gcaggcaggcguc

SEQ ID NO: 3960589 - RNA, 21 nt, Human herpesvirus 2
gcaggcccucgcugcucuccc

SEQ ID NO: 3960590 - RNA, 12 nt, Human herpesvirus 2
gcagggccuggc

SEQ ID NO: 3960591 - RNA, 12 nt, Human herpesvirus 2
gcaggggagggg

SEQ ID NO: 3960592 - RNA, 15 nt, Human herpesvirus 2
gcagggggagguggg

SEQ ID NO: 3960593 - RNA, 20 nt, Human herpesvirus 2
gcaggggggccggggauggg

SEQ ID NO: 3960594 - RNA, 19 nt, Human herpesvirus 2
gcagucuggucgagguggc

SEQ ID NO: 3960595 - RNA, 18 nt, Human herpesvirus 2
gcagugcaguaccccagu

SEQ ID NO: 3960596 - RNA, 15 nt, Human herpesvirus 2
gcaguugauucgcga

SEQ ID NO: 3960597 - RNA, 18 nt, Human herpesvirus 2
gcaucccagacgcccgcg

SEQ ID NO: 3960598 - RNA, 11 nt, Human herpesvirus 2
gcaucgcugua

SEQ ID NO: 3960599 - RNA, 20 nt, Human herpesvirus 2
gcaugguaauuagcaacuuu

SEQ ID NO: 3960600 - RNA, 18 nt, Human herpesvirus 2
gccaaaccagccccgcag

SEQ ID NO: 3960601 - RNA, 19 nt, Human herpesvirus 2
gccaaaccagccccgcagg

SEQ ID NO: 3960602 - RNA, 13 nt, Human herpesvirus 2
gccaacagggagu

SEQ ID NO: 3960603 - RNA, 22 nt, Human herpesvirus 2
gccaacucgcggcaccgcgcgg

SEQ ID NO: 3960604 - RNA, 20 nt, Human herpesvirus 2
gccacccgaacauggcucgc

SEQ ID NO: 3960605 - RNA, 13 nt, Human herpesvirus 2
gccaccggccugg

SEQ ID NO: 3960606 - RNA, 21 nt, Human herpesvirus 2
gccaccgucccgcccgccagu

SEQ ID NO: 3960607 - RNA, 20 nt, Human herpesvirus 2
gccacguccaccuuggcccg

SEQ ID NO: 3960608 - RNA, 21 nt, Human herpesvirus 2
gccagagacccugccccccgg

SEQ ID NO: 3960609 - RNA, 20 nt, Human herpesvirus 2
gccagcacgaccagggaggc

SEQ ID NO: 3960610 - RNA, 13 nt, Human herpesvirus 2
gccagcgcccuuc

SEQ ID NO: 3960611 - RNA, 14 nt, Human herpesvirus 2
gccaggccccccgg

SEQ ID NO: 3960612 - RNA, 14 nt, Human herpesvirus 2
gccaggggggcagg

SEQ ID NO: 3960613 - RNA, 21 nt, Human herpesvirus 2
gccauccccggcgccaugagc

SEQ ID NO: 3960614 - RNA, 16 nt, Human herpesvirus 2
gccaugagccgccggg

SEQ ID NO: 3960615 - RNA, 16 nt, Human herpesvirus 2
gccauggcggccgcgc

SEQ ID NO: 3960616 - RNA, 14 nt, Human herpesvirus 2
gcccaccggcucca

SEQ ID NO: 3960617 - RNA, 19 nt, Human herpesvirus 2
gccccacgucaccgggggc

SEQ ID NO: 3960618 - RNA, 15 nt, Human herpesvirus 2
gccccagagcccccc

SEQ ID NO: 3960619 - RNA, 18 nt, Human herpesvirus 2
gccccagggggcggcgcc

SEQ ID NO: 3960620 - RNA, 13 nt, Human herpesvirus 2
gcccccagcaggu

SEQ ID NO: 3960621 - RNA, 16 nt, Human herpesvirus 2
gcccccauccccuccc

SEQ ID NO: 3960622 - RNA, 14 nt, Human herpesvirus 2
gccccccccccacc

SEQ ID NO: 3960623 - RNA, 18 nt, Human herpesvirus 2
gccccccgucccgagccc

SEQ ID NO: 3960624 - RNA, 15 nt, Human herpesvirus 2
gcccccgacgggcgc

SEQ ID NO: 3960625 - RNA, 12 nt, Human herpesvirus 2
gcccccggggcc

SEQ ID NO: 3960626 - RNA, 21 nt, Human herpesvirus 2
gccccgauauucaagcccgcg

SEQ ID NO: 3960627 - RNA, 22 nt, Human herpesvirus 2
gccccgauauucaagcccgcgg

SEQ ID NO: 3960628 - RNA, 13 nt, Human herpesvirus 2
gccccgccccacc

SEQ ID NO: 3960629 - RNA, 16 nt, Human herpesvirus 2
gccccgccgggucacc

SEQ ID NO: 3960630 - RNA, 20 nt, Human herpesvirus 2
gccccgccucaccuccgucu

SEQ ID NO: 3960631 - RNA, 14 nt, Human herpesvirus 2
gccccgcgugcagc

SEQ ID NO: 3960632 - RNA, 17 nt, Human herpesvirus 2
gccccgcgugcagcgcg

SEQ ID NO: 3960633 - RNA, 17 nt, Human herpesvirus 2
gccccucgcuccccgcg

SEQ ID NO: 3960634 - RNA, 17 nt, Human herpesvirus 2
gcccgaaccccgcggcc

SEQ ID NO: 3960635 - RNA, 17 nt, Human herpesvirus 2
gcccgaaggaagccgcc

SEQ ID NO: 3960636 - RNA, 21 nt, Human herpesvirus 2
gcccgacggggagggacaagg

SEQ ID NO: 3960637 - RNA, 19 nt, Human herpesvirus 2
gcccgcagcuucgggggcu

SEQ ID NO: 3960638 - RNA, 14 nt, Human herpesvirus 2
gcccgccagggccg

SEQ ID NO: 3960639 - RNA, 22 nt, Human herpesvirus 2
gcccgccaugcgcggggggggc

SEQ ID NO: 3960640 - RNA, 17 nt, Human herpesvirus 2
gcccgcccccgacgggc

SEQ ID NO: 3960641 - RNA, 15 nt, Human herpesvirus 2
gcccgcgaccccccg

SEQ ID NO: 3960642 - RNA, 20 nt, Human herpesvirus 2
gcccgcgccgcgacggcccc

SEQ ID NO: 3960643 - RNA, 23 nt, Human herpesvirus 2
gcccggaccccucaucgccgcgc

SEQ ID NO: 3960644 - RNA, 19 nt, Human herpesvirus 2
gcccggcccauaaacaggc

SEQ ID NO: 3960645 - RNA, 19 nt, Human herpesvirus 2
gcccggcgccgccccgccg

SEQ ID NO: 3960646 - RNA, 21 nt, Human herpesvirus 2
gcccgggugaccacgcgcacg

SEQ ID NO: 3960647 - RNA, 15 nt, Human herpesvirus 2
gccgacaacugccug

SEQ ID NO: 3960648 - RNA, 16 nt, Human herpesvirus 2
gccgacggcggcgcac

SEQ ID NO: 3960649 - RNA, 13 nt, Human herpesvirus 2
gccgacuuccgug

SEQ ID NO: 3960650 - RNA, 21 nt, Human herpesvirus 2
gccgacuuccgugccccugga

SEQ ID NO: 3960651 - RNA, 18 nt, Human herpesvirus 2
gccgagcgucaggcccgc

SEQ ID NO: 3960652 - RNA, 22 nt, Human herpesvirus 2
gccgcauauacugcugggccau

SEQ ID NO: 3960653 - RNA, 14 nt, Human herpesvirus 2
gccgccauccccgc

SEQ ID NO: 3960654 - RNA, 15 nt, Human herpesvirus 2
gccgccauccccgcg

SEQ ID NO: 3960655 - RNA, 18 nt, Human herpesvirus 2
gccgcccaagcggcccga

SEQ ID NO: 3960656 - RNA, 20 nt, Human herpesvirus 2
gccgcccccgccggcccgcg

SEQ ID NO: 3960657 - RNA, 22 nt, Human herpesvirus 2
gccgccgagcgucaggcccgcc

SEQ ID NO: 3960658 - RNA, 16 nt, Human herpesvirus 2
gccgccgcgcgggccc

SEQ ID NO: 3960659 - RNA, 22 nt, Human herpesvirus 2
gccgcgacaagacccggcggcg

SEQ ID NO: 3960660 - RNA, 13 nt, Human herpesvirus 2
gccgcgacccacg

SEQ ID NO: 3960661 - RNA, 17 nt, Human herpesvirus 2
gccgcgccgcugcccga

SEQ ID NO: 3960662 - RNA, 14 nt, Human herpesvirus 2
gccgcggccauccu

SEQ ID NO: 3960663 - RNA, 13 nt, Human herpesvirus 2
gccgcggccccgc

SEQ ID NO: 3960664 - RNA, 21 nt, Human herpesvirus 2
gccgcucgcugcagggccugg

SEQ ID NO: 3960665 - RNA, 20 nt, Human herpesvirus 2
gccgcugugccagguggccc

SEQ ID NO: 3960666 - RNA, 13 nt, Human herpesvirus 2
gccgcuguggccc

SEQ ID NO: 3960667 - RNA, 17 nt, Human herpesvirus 2
gccgcuguggcccuggc

SEQ ID NO: 3960668 - RNA, 13 nt, Human herpesvirus 2
gccggaccgggau

SEQ ID NO: 3960669 - RNA, 22 nt, Human herpesvirus 2
gccggcggagccccggagcucc

SEQ ID NO: 3960670 - RNA, 20 nt, Human herpesvirus 2
gccggggagggcagggccgc

SEQ ID NO: 3960671 - RNA, 17 nt, Human herpesvirus 2
gccggggcggccccgau

SEQ ID NO: 3960672 - RNA, 21 nt, Human herpesvirus 2
gccgguagugcaggugggccg

SEQ ID NO: 3960673 - RNA, 16 nt, Human herpesvirus 2
gccguacgucugcccg

SEQ ID NO: 3960674 - RNA, 17 nt, Human herpesvirus 2
gccgucgcacgcgcgca

SEQ ID NO: 3960675 - RNA, 15 nt, Human herpesvirus 2
gccgucuuggccgug

SEQ ID NO: 3960676 - RNA, 18 nt, Human herpesvirus 2
gccguggggccccagggc

SEQ ID NO: 3960677 - RNA, 22 nt, Human herpesvirus 2
gccuagccgugggccugugggg

SEQ ID NO: 3960678 - RNA, 17 nt, Human herpesvirus 2
gccucauccggcccgcc

SEQ ID NO: 3960679 - RNA, 22 nt, Human herpesvirus 2
gccucccgcaagagccugccgu

SEQ ID NO: 3960680 - RNA, 21 nt, Human herpesvirus 2
gccuccggaagagagcgcccc

SEQ ID NO: 3960681 - RNA, 23 nt, Human herpesvirus 2
gccucggccggcggagccccgga

SEQ ID NO: 3960682 - RNA, 13 nt, Human herpesvirus 2
gccugcacgagcg

SEQ ID NO: 3960683 - RNA, 14 nt, Human herpesvirus 2
gccugcccccgccu

SEQ ID NO: 3960684 - RNA, 16 nt, Human herpesvirus 2
gccugcgccccgacgg

SEQ ID NO: 3960685 - RNA, 20 nt, Human herpesvirus 2
gccugugggucugcgccacc

SEQ ID NO: 3960686 - RNA, 14 nt, Human herpesvirus 2
gccugugucagcuc

SEQ ID NO: 3960687 - RNA, 17 nt, Human herpesvirus 2
gccuguucggggcgugu

SEQ ID NO: 3960688 - RNA, 20 nt, Human herpesvirus 2
gccuugcggaugugggccgu

SEQ ID NO: 3960689 - RNA, 19 nt, Human herpesvirus 2
gcgaaccgguagccggggc

SEQ ID NO: 3960690 - RNA, 22 nt, Human herpesvirus 2
gcgaccccgccccccgacgcca

SEQ ID NO: 3960691 - RNA, 20 nt, Human herpesvirus 2
gcgaccgggcggcgcgcccc

SEQ ID NO: 3960692 - RNA, 18 nt, Human herpesvirus 2
gcgacgccgccccugccg

SEQ ID NO: 3960693 - RNA, 11 nt, Human herpesvirus 2
gcgagccaggc

SEQ ID NO: 3960694 - RNA, 12 nt, Human herpesvirus 2
gcgagcgacagc

SEQ ID NO: 3960695 - RNA, 18 nt, Human herpesvirus 2
gcgagcgguuggaggcgc

SEQ ID NO: 3960696 - RNA, 16 nt, Human herpesvirus 2
gcgaggccgcucuccg

SEQ ID NO: 3960697 - RNA, 17 nt, Human herpesvirus 2
gcgagggcccggcgccg

SEQ ID NO: 3960698 - RNA, 20 nt, Human herpesvirus 2
gcgaugacggcaauaaaaga

SEQ ID NO: 3960699 - RNA, 18 nt, Human herpesvirus 2
gcgcacacgccaucgacc

SEQ ID NO: 3960700 - RNA, 16 nt, Human herpesvirus 2
gcgcagcgcaucgccg

SEQ ID NO: 3960701 - RNA, 20 nt, Human herpesvirus 2
gcgcagcgcaucgccgccga

SEQ ID NO: 3960702 - RNA, 16 nt, Human herpesvirus 2
gcgcaggcuggagcuc

SEQ ID NO: 3960703 - RNA, 12 nt, Human herpesvirus 2
gcgcauaaaggu

SEQ ID NO: 3960704 - RNA, 17 nt, Human herpesvirus 2
gcgccaacgcgggcguc

SEQ ID NO: 3960705 - RNA, 18 nt, Human herpesvirus 2
ucggggggguacggcgag

SEQ ID NO: 3960706 - RNA, 15 nt, Human herpesvirus 2
ucguccucacggcca

SEQ ID NO: 3960707 - RNA, 13 nt, Human herpesvirus 2
ucguggcccuccu

SEQ ID NO: 3960708 - RNA, 14 nt, Human herpesvirus 2
ucguguucgugggg

SEQ ID NO: 3960709 - RNA, 19 nt, Human herpesvirus 2
ucucaaacaaaaacacaag

SEQ ID NO: 3960710 - RNA, 17 nt, Human herpesvirus 2
ucuccauuccuguuucc

SEQ ID NO: 3960711 - RNA, 11 nt, Human herpesvirus 2
ucucccacacg

SEQ ID NO: 3960712 - RNA, 21 nt, Human herpesvirus 2
ucucccucuuucccucccucg

SEQ ID NO: 3960713 - RNA, 13 nt, Human herpesvirus 2
ucucgaaggaggg

SEQ ID NO: 3960714 - RNA, 15 nt, Human herpesvirus 2
ucugcuugccccucc

SEQ ID NO: 3960715 - RNA, 18 nt, Human herpesvirus 2
ucuggcguccccaggcga

SEQ ID NO: 3960716 - RNA, 16 nt, Human herpesvirus 2
ucugugcggcccucuc

SEQ ID NO: 3960717 - RNA, 13 nt, Human herpesvirus 2
ucuuccccagcuu

SEQ ID NO: 3960718 - RNA, 12 nt, Human herpesvirus 2
ucuuuuugccuc

SEQ ID NO: 3960719 - RNA, 16 nt, Human herpesvirus 2
ugaacucucccggcuc

SEQ ID NO: 3960720 - RNA, 14 nt, Human herpesvirus 2
ugaccggcgccgau

SEQ ID NO: 3960721 - RNA, 13 nt, Human herpesvirus 2
ugacgacggcccc

SEQ ID NO: 3960722 - RNA, 14 nt, Human herpesvirus 2
ugcacgaaaaagag

SEQ ID NO: 3960723 - RNA, 20 nt, Human herpesvirus 2
ugcacgccaucgcucccagg

SEQ ID NO: 3960724 - RNA, 20 nt, Human herpesvirus 2
ugcacugccccccuccuggg

SEQ ID NO: 3960725 - RNA, 17 nt, Human herpesvirus 2
ugcaguaacccaguucc

SEQ ID NO: 3960726 - RNA, 20 nt, Human herpesvirus 2
ugcaucccagacgcccgcga

SEQ ID NO: 3960727 - RNA, 15 nt, Human herpesvirus 2
ugccacacgugggcg

SEQ ID NO: 3960728 - RNA, 18 nt, Human herpesvirus 2
ugccagguggcccuuccg

SEQ ID NO: 3960729 - RNA, 14 nt, Human herpesvirus 2
ugccaguggagcca

SEQ ID NO: 3960730 - RNA, 12 nt, Human herpesvirus 2
ugccccgaccga

SEQ ID NO: 3960731 - RNA, 15 nt, Human herpesvirus 2
ugccccucccccggc

SEQ ID NO: 3960732 - RNA, 13 nt, Human herpesvirus 2
ugcgagaucuucc

SEQ ID NO: 3960733 - RNA, 19 nt, Human herpesvirus 2
ugcgcacgacagaccuccc

SEQ ID NO: 3960734 - RNA, 21 nt, Human herpesvirus 2
ugcgcacgacagaccuccccg

SEQ ID NO: 3960735 - RNA, 16 nt, Human herpesvirus 2
ugcgccguccucgugg

SEQ ID NO: 3960736 - RNA, 21 nt, Human herpesvirus 2
ugcgggaugugucgcggggac

SEQ ID NO: 3960737 - RNA, 11 nt, Human herpesvirus 2
ugcggggaccg

SEQ ID NO: 3960738 - RNA, 18 nt, Human herpesvirus 2
ugcugcugagcccugccc

SEQ ID NO: 3960739 - RNA, 18 nt, Human herpesvirus 2
ugcugggcgcgagccagg

SEQ ID NO: 3960740 - RNA, 15 nt, Human herpesvirus 2
uggacgaucccgggc

SEQ ID NO: 3960741 - RNA, 23 nt, Human herpesvirus 2
uggacgcagcggcguccacgccc

SEQ ID NO: 3960742 - RNA, 15 nt, Human herpesvirus 2
uggacgcgccucccg

SEQ ID NO: 3960743 - RNA, 13 nt, Human herpesvirus 2
uggacugggccgc

SEQ ID NO: 3960744 - RNA, 17 nt, Human herpesvirus 2
uggagaagggaaaggaa

SEQ ID NO: 3960745 - RNA, 19 nt, Human herpesvirus 2
uggagaagggaaaggaaca

SEQ ID NO: 3960746 - RNA, 19 nt, Human herpesvirus 2
uggauaacagcuacccgca

SEQ ID NO: 3960747 - RNA, 17 nt, Human herpesvirus 2
uggcaccguaucagcac

SEQ ID NO: 3960748 - RNA, 15 nt, Human herpesvirus 2
uggcccuccacgccg

SEQ ID NO: 3960749 - RNA, 20 nt, Human herpesvirus 2
uggccggguuuuuggcccug

SEQ ID NO: 3960750 - RNA, 20 nt, Human herpesvirus 2
uggcgaguccugggugggug

SEQ ID NO: 3960751 - RNA, 13 nt, Human herpesvirus 2
uggcgccucugcg

SEQ ID NO: 3960752 - RNA, 22 nt, Human herpesvirus 2
uggcgcgucguucggggggacg

SEQ ID NO: 3960753 - RNA, 19 nt, Human herpesvirus 2
uggcgucggcggccccggc

SEQ ID NO: 3960754 - RNA, 16 nt, Human herpesvirus 2
uggcgugugucucuga

SEQ ID NO: 3960755 - RNA, 14 nt, Human herpesvirus 2
uggcugucgugugu

SEQ ID NO: 3960756 - RNA, 20 nt, Human herpesvirus 2
ugggccgacgugccggggaa

SEQ ID NO: 3960757 - RNA, 16 nt, Human herpesvirus 2
ugggcggcccccggcc

SEQ ID NO: 3960758 - RNA, 20 nt, Human herpesvirus 2
ugggcggggggguucgggcg

SEQ ID NO: 3960759 - RNA, 22 nt, Human herpesvirus 2
ugggcgugucguugggcggccc

SEQ ID NO: 3960760 - RNA, 17 nt, Human herpesvirus 2
ugggugcucggggacag

SEQ ID NO: 3960761 - RNA, 16 nt, Human herpesvirus 2
uggucgugggggcgcu

SEQ ID NO: 3960762 - RNA, 21 nt, Human herpesvirus 2
uggugacggaaaaccugggcg

SEQ ID NO: 3960763 - RNA, 14 nt, Human herpesvirus 2
uggugguggggugu

SEQ ID NO: 3960764 - RNA, 13 nt, Human herpesvirus 2
uguaccucugggc

SEQ ID NO: 3960765 - RNA, 17 nt, Human herpesvirus 2
ugucgaaucugggaaga

SEQ ID NO: 3960766 - RNA, 16 nt, Human herpesvirus 2
ugucugucugcccggc

SEQ ID NO: 3960767 - RNA, 21 nt, Human herpesvirus 2
ugugcgggaggggcuuggccu

SEQ ID NO: 3960768 - RNA, 15 nt, Human herpesvirus 2
uguggcuggaggcaa

SEQ ID NO: 3960769 - RNA, 15 nt, Human herpesvirus 2
ugugggacugggggc

SEQ ID NO: 3960770 - RNA, 12 nt, Human herpesvirus 2
uguucuccugga

SEQ ID NO: 3960771 - RNA, 11 nt, Human herpesvirus 2
uguugggaagg

SEQ ID NO: 3960772 - RNA, 13 nt, Human herpesvirus 2
uguugucugucug

SEQ ID NO: 3960773 - RNA, 15 nt, Human herpesvirus 2
uguuguuuucccggg

SEQ ID NO: 3960774 - RNA, 19 nt, Human herpesvirus 2
uguuuuuacgggccccgga

SEQ ID NO: 3960775 - RNA, 19 nt, Human herpesvirus 2
uuaagcggaacccgcgggc

SEQ ID NO: 3960776 - RNA, 13 nt, Human herpesvirus 2
uuagaaacuuuua

SEQ ID NO: 3960777 - RNA, 17 nt, Human herpesvirus 2
uuagccaccgcgcccac

SEQ ID NO: 3960778 - RNA, 13 nt, Human herpesvirus 2
uucagggaaacag

SEQ ID NO: 3960779 - RNA, 16 nt, Human herpesvirus 2
uuccccccccccuccc

SEQ ID NO: 3960780 - RNA, 13 nt, Human herpesvirus 2
uucccucccucgc

SEQ ID NO: 3960781 - RNA, 22 nt, Human herpesvirus 2
uucccuccgaguccguaugcaa

SEQ ID NO: 3960782 - RNA, 14 nt, Human herpesvirus 2
uuccgugccccugg

SEQ ID NO: 3960783 - RNA, 20 nt, Human herpesvirus 2
uucgccgacgccuucccugu

SEQ ID NO: 3960784 - RNA, 18 nt, Human herpesvirus 2
uucuggcggcccuggagc

SEQ ID NO: 3960785 - RNA, 17 nt, Human herpesvirus 2
uucuggucauggcccuu

SEQ ID NO: 3960786 - RNA, 17 nt, Human herpesvirus 2
uucuucgccgcccucgc

SEQ ID NO: 3960787 - RNA, 14 nt, Human herpesvirus 2
uugcccccccgggg

SEQ ID NO: 3960788 - RNA, 13 nt, Human herpesvirus 2
uuggggaaaucua

SEQ ID NO: 3960789 - RNA, 17 nt, Human herpesvirus 2
uugggucugcgucgucc

SEQ ID NO: 3960790 - RNA, 19 nt, Human herpesvirus 2
uugguuguguuuuguggga

SEQ ID NO: 3960791 - RNA, 21 nt, Human herpesvirus 2
uuguuauggacuuucuggccu

SEQ ID NO: 3960792 - RNA, 13 nt, Human herpesvirus 2
uuguuguuggccu

SEQ ID NO: 3960793 - RNA, 13 nt, Human herpesvirus 2
uuuaagcgcugcg

SEQ ID NO: 3960794 - RNA, 19 nt, Human herpesvirus 2
uuuacgccuuuccuccccu

SEQ ID NO: 3960795 - RNA, 21 nt, Human herpesvirus 2
uuucggaaagccggccccggu

SEQ ID NO: 3960796 - RNA, 18 nt, Human herpesvirus 2
uuucggcacccguccucg

SEQ ID NO: 3960797 - RNA, 12 nt, Human herpesvirus 2
uuucucuucccc

SEQ ID NO: 3960798 - RNA, 20 nt, Human herpesvirus 2
uuucugggcccgccgaccgc

SEQ ID NO: 3960799 - RNA, 22 nt, Human herpesvirus 2
uuuugccucccaacgcccccuu

SEQ ID NO: 3960800 - RNA, 14 nt, Human herpesvirus 2
uuuuguuuguuugu

SEQ ID NO: 3960801 - RNA, 20 nt, Human herpesvirus 2
uuuuuggcaccuugccgccc

SEQ ID NO: 3960802 - RNA, 19 nt, Human herpesvirus 2
caacgccgggcgcgcggcg

SEQ ID NO: 3960803 - RNA, 16 nt, Human herpesvirus 2
caagcuaagcgagaag

SEQ ID NO: 3960804 - RNA, 17 nt, Human herpesvirus 2
caauaaaccugugacgu

SEQ ID NO: 3960805 - RNA, 14 nt, Human herpesvirus 2
caaucgcccgaggc

SEQ ID NO: 3960806 - RNA, 18 nt, Human herpesvirus 2
caauucgucaccuggcuc

SEQ ID NO: 3960807 - RNA, 20 nt, Human herpesvirus 2
cacaagacacacacacaggc

SEQ ID NO: 3960808 - RNA, 14 nt, Human herpesvirus 2
cacacccccugucc

SEQ ID NO: 3960809 - RNA, 17 nt, Human herpesvirus 2
cacaggcccaccaccau

SEQ ID NO: 3960810 - RNA, 17 nt, Human herpesvirus 2
cacagguggugcacgug

SEQ ID NO: 3960811 - RNA, 16 nt, Human herpesvirus 2
caccaaccuggcacag

SEQ ID NO: 3960812 - RNA, 23 nt, Human herpesvirus 2
caccagacggcgggaccccgacg

SEQ ID NO: 3960813 - RNA, 21 nt, Human herpesvirus 2
cacccaccccccccccaacuc

SEQ ID NO: 3960814 - RNA, 12 nt, Human herpesvirus 2
caccccacccua

SEQ ID NO: 3960815 - RNA, 16 nt, Human herpesvirus 2
cacccccccacuuucc

SEQ ID NO: 3960816 - RNA, 12 nt, Human herpesvirus 2
caccccccuucu

SEQ ID NO: 3960817 - RNA, 21 nt, Human herpesvirus 2
cacccuaaggaugcccgccag

SEQ ID NO: 3960818 - RNA, 21 nt, Human herpesvirus 2
caccgagccgcugugccaggu

SEQ ID NO: 3960819 - RNA, 13 nt, Human herpesvirus 2
caccgcacccggg

SEQ ID NO: 3960820 - RNA, 15 nt, Human herpesvirus 2
caccgccccagcacc

SEQ ID NO: 3960821 - RNA, 13 nt, Human herpesvirus 2
caccgggcugggg

SEQ ID NO: 3960822 - RNA, 17 nt, Human herpesvirus 2
caccgguccuucgcggg

SEQ ID NO: 3960823 - RNA, 18 nt, Human herpesvirus 2
cacgaaaaagagcucggg

SEQ ID NO: 3960824 - RNA, 14 nt, Human herpesvirus 2
cacgacccgccucg

SEQ ID NO: 3960825 - RNA, 19 nt, Human herpesvirus 2
cacgaggccguaaacugcu

SEQ ID NO: 3960826 - RNA, 22 nt, Human herpesvirus 2
cacgcaggccgcccccagcagg

SEQ ID NO: 3960827 - RNA, 13 nt, Human herpesvirus 2
cacggacccgccc

SEQ ID NO: 3960828 - RNA, 18 nt, Human herpesvirus 2
cacggcaaccccaccuuc

SEQ ID NO: 3960829 - RNA, 19 nt, Human herpesvirus 2
cacggcaaccccagggcgu

SEQ ID NO: 3960830 - RNA, 21 nt, Human herpesvirus 2
cacggcacaccggcggggcgg

SEQ ID NO: 3960831 - RNA, 23 nt, Human herpesvirus 2
cacggcacccccggcgauucccu

SEQ ID NO: 3960832 - RNA, 13 nt, Human herpesvirus 2
cacgggcgucccc

SEQ ID NO: 3960833 - RNA, 23 nt, Human herpesvirus 2
cacguccguauguuaauugcaau

SEQ ID NO: 3960834 - RNA, 19 nt, Human herpesvirus 2
cacgugggcggcgaaccgg

SEQ ID NO: 3960835 - RNA, 18 nt, Human herpesvirus 2
cacguucgccccgcagcc

SEQ ID NO: 3960836 - RNA, 21 nt, Human herpesvirus 2
cacucgaagaaguuggugugu

SEQ ID NO: 3960837 - RNA, 19 nt, Human herpesvirus 2
cacucguggaugccggggc

SEQ ID NO: 3960838 - RNA, 20 nt, Human herpesvirus 2
cacuuccuauaaacucuccc

SEQ ID NO: 3960839 - RNA, 22 nt, Human herpesvirus 2
cagagacccugccccccggcgc

SEQ ID NO: 3960840 - RNA, 21 nt, Human herpesvirus 2
cagaggcuggagcgcuggugg

SEQ ID NO: 3960841 - RNA, 12 nt, Human herpesvirus 2
cagaugcugccc

SEQ ID NO: 3960842 - RNA, 18 nt, Human herpesvirus 2
cagcacggaggaacuggg

SEQ ID NO: 3960843 - RNA, 16 nt, Human herpesvirus 2
cagcacggccggguga

SEQ ID NO: 3960844 - RNA, 14 nt, Human herpesvirus 2
cagccccuggggcu

SEQ ID NO: 3960845 - RNA, 13 nt, Human herpesvirus 2
cagccgcgccgcu

SEQ ID NO: 3960846 - RNA, 14 nt, Human herpesvirus 2
cagccgcgccgcug

SEQ ID NO: 3960847 - RNA, 15 nt, Human herpesvirus 2
cagcgcacccuggcc

SEQ ID NO: 3960848 - RNA, 17 nt, Human herpesvirus 2
cagcgccggguggcgcc

SEQ ID NO: 3960849 - RNA, 18 nt, Human herpesvirus 2
cagcgcgaugaggggcac

SEQ ID NO: 3960850 - RNA, 21 nt, Human herpesvirus 2
cagcguaacgcacccccggac

SEQ ID NO: 3960851 - RNA, 21 nt, Human herpesvirus 2
cagcguccggcuggcggcgcg

SEQ ID NO: 3960852 - RNA, 17 nt, Human herpesvirus 2
cagcucgggggccagga

SEQ ID NO: 3960853 - RNA, 14 nt, Human herpesvirus 2
cagcugcuggccaa

SEQ ID NO: 3960854 - RNA, 23 nt, Human herpesvirus 2
cagcugguucauacccaauggcu

SEQ ID NO: 3960855 - RNA, 21 nt, Human herpesvirus 2
cagcuuucccuccacccgccc

SEQ ID NO: 3960856 - RNA, 20 nt, Human herpesvirus 2
caggaggggggcagugcagu

SEQ ID NO: 3960857 - RNA, 14 nt, Human herpesvirus 2
caggcccaccacca

SEQ ID NO: 3960858 - RNA, 22 nt, Human herpesvirus 2
cagggccuggcgauccugggcc

SEQ ID NO: 3960859 - RNA, 20 nt, Human herpesvirus 2
cagggcuucguggaagagga

SEQ ID NO: 3960860 - RNA, 23 nt, Human herpesvirus 2
caggggcagcucgcccccgugcc

SEQ ID NO: 3960861 - RNA, 17 nt, Human herpesvirus 2
cagggggcggcgccggc

SEQ ID NO: 3960862 - RNA, 15 nt, Human herpesvirus 2
cagugccccgacauc

SEQ ID NO: 3960863 - RNA, 17 nt, Human herpesvirus 2
caguguuugggaaaucu

SEQ ID NO: 3960864 - RNA, 15 nt, Human herpesvirus 2
cauauacugcugggc

SEQ ID NO: 3960865 - RNA, 12 nt, Human herpesvirus 2
cauaugcccugg

SEQ ID NO: 3960866 - RNA, 16 nt, Human herpesvirus 2
caucaucgucccgguu

SEQ ID NO: 3960867 - RNA, 14 nt, Human herpesvirus 2
cauccuuuggcccg

SEQ ID NO: 3960868 - RNA, 17 nt, Human herpesvirus 2
caucgccaacucugucu

SEQ ID NO: 3960869 - RNA, 20 nt, Human herpesvirus 2
caucgucgccgacuccagga

SEQ ID NO: 3960870 - RNA, 15 nt, Human herpesvirus 2
caugacaacgacgcc

SEQ ID NO: 3960871 - RNA, 15 nt, Human herpesvirus 2
caugcaacgccgggc

SEQ ID NO: 3960872 - RNA, 22 nt, Human herpesvirus 2
gaccaccgcggacagccagggc

SEQ ID NO: 3960873 - RNA, 16 nt, Human herpesvirus 2
gaccaccggccgaggc

SEQ ID NO: 3960874 - RNA, 12 nt, Human herpesvirus 2
gaccaccgggcc

SEQ ID NO: 3960875 - RNA, 15 nt, Human herpesvirus 2
gaccacgugcacagc

SEQ ID NO: 3960876 - RNA, 16 nt, Human herpesvirus 2
gaccccgaccccgagc

SEQ ID NO: 3960877 - RNA, 12 nt, Human herpesvirus 2
gaccccgcgugc

SEQ ID NO: 3960878 - RNA, 18 nt, Human herpesvirus 2
gacccuguggcgggcgcu

SEQ ID NO: 3960879 - RNA, 14 nt, Human herpesvirus 2
gaccgacgggcccc

SEQ ID NO: 3960880 - RNA, 13 nt, Human herpesvirus 2
gaccgaucuggag

SEQ ID NO: 3960881 - RNA, 23 nt, Human herpesvirus 2
gaccggcgccgaucgcagcgucc

SEQ ID NO: 3960882 - RNA, 15 nt, Human herpesvirus 2
gaccggcggggcccc

SEQ ID NO: 3960883 - RNA, 13 nt, Human herpesvirus 2
gaccuuccccucc

SEQ ID NO: 3960884 - RNA, 12 nt, Human herpesvirus 2
gacgaaaacgua

SEQ ID NO: 3960885 - RNA, 17 nt, Human herpesvirus 2
gacgaacuggggcgccg

SEQ ID NO: 3960886 - RNA, 22 nt, Human herpesvirus 2
gacgaugcauguucggcgucgu

SEQ ID NO: 3960887 - RNA, 12 nt, Human herpesvirus 2
gacgcagcggcg

SEQ ID NO: 3960888 - RNA, 20 nt, Human herpesvirus 2
gacgcccggcccauaaacag

SEQ ID NO: 3960889 - RNA, 23 nt, Human herpesvirus 2
gacgcgcgcgcccccgacccggg

SEQ ID NO: 3960890 - RNA, 23 nt, Human herpesvirus 2
gacgcgcuaguacccagaggcug

SEQ ID NO: 3960891 - RNA, 14 nt, Human herpesvirus 2
gacgcggccagaaa

SEQ ID NO: 3960892 - RNA, 18 nt, Human herpesvirus 2
gacgcggggucgagcgcg

SEQ ID NO: 3960893 - RNA, 23 nt, Human herpesvirus 2
gacgcggggucgagcgcgccagg

SEQ ID NO: 3960894 - RNA, 22 nt, Human herpesvirus 2
gacgcgguuauccugcggcagg

SEQ ID NO: 3960895 - RNA, 21 nt, Human herpesvirus 2
gacgcuguuguuucugggccc

SEQ ID NO: 3960896 - RNA, 16 nt, Human herpesvirus 2
gacggcaccgccgggc

SEQ ID NO: 3960897 - RNA, 20 nt, Human herpesvirus 2
gacggccccucgcuccccgc

SEQ ID NO: 3960898 - RNA, 13 nt, Human herpesvirus 2
gacggcgggaccc

SEQ ID NO: 3960899 - RNA, 14 nt, Human herpesvirus 2
gacggggaggagac

SEQ ID NO: 3960900 - RNA, 19 nt, Human herpesvirus 2
gacgugcgaugacgugggu

SEQ ID NO: 3960901 - RNA, 22 nt, Human herpesvirus 2
gacuccccucuacccccaccca

SEQ ID NO: 3960902 - RNA, 14 nt, Human herpesvirus 2
gacuccgccccggc

SEQ ID NO: 3960903 - RNA, 21 nt, Human herpesvirus 2
gacucggugcguuccagcgcg

SEQ ID NO: 3960904 - RNA, 11 nt, Human herpesvirus 2
gacuggccgug

SEQ ID NO: 3960905 - RNA, 22 nt, Human herpesvirus 2
gacuugacggucgccacucucc

SEQ ID NO: 3960906 - RNA, 14 nt, Human herpesvirus 2
gacuuucuggccuu

SEQ ID NO: 3960907 - RNA, 17 nt, Human herpesvirus 2
gagacccugccccccgg

SEQ ID NO: 3960908 - RNA, 21 nt, Human herpesvirus 2
gagacccugccccccggcgcg

SEQ ID NO: 3960909 - RNA, 18 nt, Human herpesvirus 2
gagagaugacacgacagg

SEQ ID NO: 3960910 - RNA, 15 nt, Human herpesvirus 2
gagagccggaccggg

SEQ ID NO: 3960911 - RNA, 20 nt, Human herpesvirus 2
gagaggucaauagauuuccc

SEQ ID NO: 3960912 - RNA, 20 nt, Human herpesvirus 2
gagaguuucuucgcgggcag

SEQ ID NO: 3960913 - RNA, 14 nt, Human herpesvirus 2
gagcaggacagccg

SEQ ID NO: 3960914 - RNA, 11 nt, Human herpesvirus 2
gagccccgcgu

SEQ ID NO: 3960915 - RNA, 20 nt, Human herpesvirus 2
gagccccggguuccccgaga

SEQ ID NO: 3960916 - RNA, 19 nt, Human herpesvirus 2
gagcccugccccgcccccu

SEQ ID NO: 3960917 - RNA, 15 nt, Human herpesvirus 2
gagccgcggccccgc

SEQ ID NO: 3960918 - RNA, 13 nt, Human herpesvirus 2
gagcgcgccagga

SEQ ID NO: 3960919 - RNA, 21 nt, Human herpesvirus 2
gagcucggcuugauggagccu

SEQ ID NO: 3960920 - RNA, 18 nt, Human herpesvirus 2
gagcugggcuuguguaua

SEQ ID NO: 3960921 - RNA, 16 nt, Human herpesvirus 2
gaggaggaggaggggg

SEQ ID NO: 3960922 - RNA, 13 nt, Human herpesvirus 2
gaggcccccggcc

SEQ ID NO: 3960923 - RNA, 21 nt, Human herpesvirus 2
gaggccuggcguuugggggcg

SEQ ID NO: 3960924 - RNA, 14 nt, Human herpesvirus 2
gaggcgaccccgcc

SEQ ID NO: 3960925 - RNA, 18 nt, Human herpesvirus 2
gaggcgccucgggggcag

SEQ ID NO: 3960926 - RNA, 17 nt, Human herpesvirus 2
gaggcuguccgccgggc

SEQ ID NO: 3960927 - RNA, 16 nt, Human herpesvirus 2
gagggcccggcgccgc

SEQ ID NO: 3960928 - RNA, 18 nt, Human herpesvirus 2
gagggcccggcgccgccc

SEQ ID NO: 3960929 - RNA, 11 nt, Human herpesvirus 2
gaggggggcag

SEQ ID NO: 3960930 - RNA, 18 nt, Human herpesvirus 2
gaggggggcagugcagua

SEQ ID NO: 3960931 - RNA, 12 nt, Human herpesvirus 2
gagggggggcgg

SEQ ID NO: 3960932 - RNA, 14 nt, Human herpesvirus 2
gaggggggggugag

SEQ ID NO: 3960933 - RNA, 22 nt, Human herpesvirus 2
gaggugcgccaggucagcgauc

SEQ ID NO: 3960934 - RNA, 21 nt, Human herpesvirus 2
gaguaugaccgucggugccag

SEQ ID NO: 3960935 - RNA, 18 nt, Human herpesvirus 2
gaguucaauagauuuccc

SEQ ID NO: 3960936 - RNA, 20 nt, Human herpesvirus 2
gaguucaauagauuucccaa

SEQ ID NO: 3960937 - RNA, 18 nt, Human herpesvirus 2
gauccugggccugugggu

SEQ ID NO: 3960938 - RNA, 18 nt, Human herpesvirus 2
gaucgcagcguccggcug

SEQ ID NO: 3960939 - RNA, 21 nt, Human herpesvirus 2
gaugcagcucccccgcgcagg

SEQ ID NO: 3960940 - RNA, 15 nt, Human herpesvirus 2
gaugcggggcggggu

SEQ ID NO: 3960941 - RNA, 10 nt, Human herpesvirus 2
gauggggaga

SEQ ID NO: 3960942 - RNA, 22 nt, Human herpesvirus 2
gauguugucgggggggauccag

SEQ ID NO: 3960943 - RNA, 18 nt, Human herpesvirus 2
gauucucaccuggggcuc

SEQ ID NO: 3960944 - RNA, 17 nt, Human herpesvirus 2
gcaaacgguaagcagcg

SEQ ID NO: 3960945 - RNA, 15 nt, Human herpesvirus 2
gcaacacccggcgcc

SEQ ID NO: 3960946 - RNA, 20 nt, Human herpesvirus 2
gcaaccaggcgcugcugcgc

SEQ ID NO: 3960947 - RNA, 22 nt, Human herpesvirus 2
gcaaccccaccuucgccuccgc

SEQ ID NO: 3960948 - RNA, 20 nt, Human herpesvirus 2
gcaacccgacggcggggccc

SEQ ID NO: 3960949 - RNA, 15 nt, Human herpesvirus 2
gcaaccuccggggcu

SEQ ID NO: 3960950 - RNA, 18 nt, Human herpesvirus 2
gcaacuuuuaaugggccg

SEQ ID NO: 3960951 - RNA, 21 nt, Human herpesvirus 2
gcaagagccugccgucgcacg

SEQ ID NO: 3960952 - RNA, 22 nt, Human herpesvirus 2
gcaagcgggcgggguggggagg

SEQ ID NO: 3960953 - RNA, 12 nt, Human herpesvirus 2
gcaagugcagua

SEQ ID NO: 3960954 - RNA, 19 nt, Human herpesvirus 2
gcacaaacgugcucugcca

SEQ ID NO: 3960955 - RNA, 20 nt, Human herpesvirus 2
gcacaagacacacacacagg

SEQ ID NO: 3960956 - RNA, 11 nt, Human herpesvirus 2
gcacacaugau

SEQ ID NO: 3960957 - RNA, 21 nt, Human herpesvirus 2
gcaccacguguccccagggag

SEQ ID NO: 3960958 - RNA, 11 nt, Human herpesvirus 2
gcaccccaccg

SEQ ID NO: 3960959 - RNA, 20 nt, Human herpesvirus 2
gcaccgcgcggaccggcccc

SEQ ID NO: 3960960 - RNA, 13 nt, Human herpesvirus 2
agagcccagggaa

SEQ ID NO: 3960961 - RNA, 14 nt, Human herpesvirus 2
agagccgauccggc

SEQ ID NO: 3960962 - RNA, 15 nt, Human herpesvirus 2
agagcgccgucgggc

SEQ ID NO: 3960963 - RNA, 11 nt, Human herpesvirus 2
agaggcugucc

SEQ ID NO: 3960964 - RNA, 20 nt, Human herpesvirus 2
agaguucaauagauuuccca

SEQ ID NO: 3960965 - RNA, 14 nt, Human herpesvirus 2
agccaaaccagccc

SEQ ID NO: 3960966 - RNA, 22 nt, Human herpesvirus 2
agccacccugggucgggagcag

SEQ ID NO: 3960967 - RNA, 18 nt, Human herpesvirus 2
agccaccgucccgcccgc

SEQ ID NO: 3960968 - RNA, 14 nt, Human herpesvirus 2
agccagggcuggga

SEQ ID NO: 3960969 - RNA, 15 nt, Human herpesvirus 2
agccagggcugggag

SEQ ID NO: 3960970 - RNA, 13 nt, Human herpesvirus 2
agccccccccccu

SEQ ID NO: 3960971 - RNA, 21 nt, Human herpesvirus 2
agccccgcgaccaccaaggcc

SEQ ID NO: 3960972 - RNA, 14 nt, Human herpesvirus 2
agccccuggggcug

SEQ ID NO: 3960973 - RNA, 22 nt, Human herpesvirus 2
agcccugccccgcccccucucc

SEQ ID NO: 3960974 - RNA, 17 nt, Human herpesvirus 2
agccgauccggccucgg

SEQ ID NO: 3960975 - RNA, 12 nt, Human herpesvirus 2
agccgcccaagc

SEQ ID NO: 3960976 - RNA, 12 nt, Human herpesvirus 2
agccgcgcgacc

SEQ ID NO: 3960977 - RNA, 13 nt, Human herpesvirus 2
agccgcugugcca

SEQ ID NO: 3960978 - RNA, 14 nt, Human herpesvirus 2
agccuucggccacc

SEQ ID NO: 3960979 - RNA, 20 nt, Human herpesvirus 2
agcgaccggucgcagggaga

SEQ ID NO: 3960980 - RNA, 17 nt, Human herpesvirus 2
agcgccagacgggccgg

SEQ ID NO: 3960981 - RNA, 16 nt, Human herpesvirus 2
agcgccgggccucccg

SEQ ID NO: 3960982 - RNA, 17 nt, Human herpesvirus 2
agcgccggguggcgccu

SEQ ID NO: 3960983 - RNA, 17 nt, Human herpesvirus 2
agcggcccgaggcgacc

SEQ ID NO: 3960984 - RNA, 23 nt, Human herpesvirus 2
agcggcuuaagauuuuucggugc

SEQ ID NO: 3960985 - RNA, 16 nt, Human herpesvirus 2
agcguaucggccagga

SEQ ID NO: 3960986 - RNA, 17 nt, Human herpesvirus 2
agcguggggcgcgcacc

SEQ ID NO: 3960987 - RNA, 13 nt, Human herpesvirus 2
agcucccugcggc

SEQ ID NO: 3960988 - RNA, 15 nt, Human herpesvirus 2
agcucgccgugaaga

SEQ ID NO: 3960989 - RNA, 18 nt, Human herpesvirus 2
agcugaugucccgcaucu

SEQ ID NO: 3960990 - RNA, 17 nt, Human herpesvirus 2
agcugccucccccccgg

SEQ ID NO: 3960991 - RNA, 11 nt, Human herpesvirus 2
agcuggcccug

SEQ ID NO: 3960992 - RNA, 17 nt, Human herpesvirus 2
agcugguaucggcgacc

SEQ ID NO: 3960993 - RNA, 23 nt, Human herpesvirus 2
aggacaguucauaggccgggagc

SEQ ID NO: 3960994 - RNA, 16 nt, Human herpesvirus 2
aggaccaaaagggaaa

SEQ ID NO: 3960995 - RNA, 18 nt, Human herpesvirus 2
aggacccauacauuuccc

SEQ ID NO: 3960996 - RNA, 19 nt, Human herpesvirus 2
aggagggaaacuaggacag

SEQ ID NO: 3960997 - RNA, 14 nt, Human herpesvirus 2
aggaggggggccuc

SEQ ID NO: 3960998 - RNA, 18 nt, Human herpesvirus 2
aggauguguucuccugga

SEQ ID NO: 3960999 - RNA, 15 nt, Human herpesvirus 2
aggcaccccauccga

SEQ ID NO: 3961000 - RNA, 15 nt, Human herpesvirus 2
aggcccaccaccauc

SEQ ID NO: 3961001 - RNA, 12 nt, Human herpesvirus 2
aggcccccggcc

SEQ ID NO: 3961002 - RNA, 21 nt, Human herpesvirus 2
aggcccgccccaccgccccca

SEQ ID NO: 3961003 - RNA, 23 nt, Human herpesvirus 2
aggccgggagcguggggcgcgca

SEQ ID NO: 3961004 - RNA, 19 nt, Human herpesvirus 2
aggccucauccggcccgcc

SEQ ID NO: 3961005 - RNA, 19 nt, Human herpesvirus 2
aggcgacgccaggcccccc

SEQ ID NO: 3961006 - RNA, 15 nt, Human herpesvirus 2
aggcgcccgccccug

SEQ ID NO: 3961007 - RNA, 16 nt, Human herpesvirus 2
aggcgcgccaccgccc

SEQ ID NO: 3961008 - RNA, 20 nt, Human herpesvirus 2
aggcggucccggccgccauc

SEQ ID NO: 3961009 - RNA, 18 nt, Human herpesvirus 2
aggcuggagcucugccug

SEQ ID NO: 3961010 - RNA, 11 nt, Human herpesvirus 2
agggcaggucc

SEQ ID NO: 3961011 - RNA, 22 nt, Human herpesvirus 2
agggccuggcgauccugggccu

SEQ ID NO: 3961012 - RNA, 21 nt, Human herpesvirus 2
agggcgucgcuaacgagcgcg

SEQ ID NO: 3961013 - RNA, 15 nt, Human herpesvirus 2
aggggcgggaggggc

SEQ ID NO: 3961014 - RNA, 14 nt, Human herpesvirus 2
aggggggggcuggu

SEQ ID NO: 3961015 - RNA, 13 nt, Human herpesvirus 2
agggucggacagg

SEQ ID NO: 3961016 - RNA, 13 nt, Human herpesvirus 2
aggguggggcuga

SEQ ID NO: 3961017 - RNA, 13 nt, Human herpesvirus 2
aguaccccaguuc

SEQ ID NO: 3961018 - RNA, 21 nt, Human herpesvirus 2
agucgcccauacaaauuaaau

SEQ ID NO: 3961019 - RNA, 15 nt, Human herpesvirus 2
agucucuuggggaaa

SEQ ID NO: 3961020 - RNA, 20 nt, Human herpesvirus 2
agugggggggggggacggac

SEQ ID NO: 3961021 - RNA, 20 nt, Human herpesvirus 2
aguuccuccgugcuggggaa

SEQ ID NO: 3961022 - RNA, 15 nt, Human herpesvirus 2
aguuugagcagccgc

SEQ ID NO: 3961023 - RNA, 11 nt, Human herpesvirus 2
auaaacaggcc

SEQ ID NO: 3961024 - RNA, 19 nt, Human herpesvirus 2
auaaccgcccgcagcugcu

SEQ ID NO: 3961025 - RNA, 15 nt, Human herpesvirus 2
auacaaauuaaauac

SEQ ID NO: 3961026 - RNA, 14 nt, Human herpesvirus 2
auaggccacacagu

SEQ ID NO: 3961027 - RNA, 21 nt, Human herpesvirus 2
auagucccccguauaggcaua

SEQ ID NO: 3961028 - RNA, 20 nt, Human herpesvirus 2
aucaucgaaggucgggccgu

SEQ ID NO: 3961029 - RNA, 15 nt, Human herpesvirus 2
aucccccggaaggac

SEQ ID NO: 3961030 - RNA, 20 nt, Human herpesvirus 2
auccgaucgaugagccggua

SEQ ID NO: 3961031 - RNA, 21 nt, Human herpesvirus 2
auccugggccugugggucugc

SEQ ID NO: 3961032 - RNA, 13 nt, Human herpesvirus 2
aucgacccggacu

SEQ ID NO: 3961033 - RNA, 18 nt, Human herpesvirus 2
aucgaguccgaagaagag

SEQ ID NO: 3961034 - RNA, 24 nt, Human herpesvirus 2
aucgccaacucugucuucgugugg

SEQ ID NO: 3961035 - RNA, 16 nt, Human herpesvirus 2
aucgcuguauucccuu

SEQ ID NO: 3961036 - RNA, 19 nt, Human herpesvirus 2
aucuuggcguuauuuccaa

SEQ ID NO: 3961037 - RNA, 20 nt, Human herpesvirus 2
augaccucccggcccgccga

SEQ ID NO: 3961038 - RNA, 12 nt, Human herpesvirus 2
augagccgccgg

SEQ ID NO: 3961039 - RNA, 22 nt, Human herpesvirus 2
augaggggcaccaaaaaccagg

SEQ ID NO: 3961040 - RNA, 15 nt, Human herpesvirus 2
augcaacgccgggcg

SEQ ID NO: 3961041 - RNA, 13 nt, Human herpesvirus 2
augcaagcgggcg

SEQ ID NO: 3961042 - RNA, 16 nt, Human herpesvirus 2
augcuaauuaaauaca

SEQ ID NO: 3961043 - RNA, 16 nt, Human herpesvirus 2
auggagaagggaaagg

SEQ ID NO: 3961044 - RNA, 16 nt, Human herpesvirus 2
auggccgcuccugccc

SEQ ID NO: 3961045 - RNA, 17 nt, Human herpesvirus 2
auggccgcuccugcccg

SEQ ID NO: 3961046 - RNA, 23 nt, Human herpesvirus 2
augucuguuucaauaaaaaguaa

SEQ ID NO: 3961047 - RNA, 15 nt, Human herpesvirus 2
auucgucaccuggcu

SEQ ID NO: 3961048 - RNA, 18 nt, Human herpesvirus 2
auugaccucucgcccccc

SEQ ID NO: 3961049 - RNA, 16 nt, Human herpesvirus 2
auugccaucgcggacg

SEQ ID NO: 3961050 - RNA, 23 nt, Human herpesvirus 2
auuuacgcggugcgccccgccgg

SEQ ID NO: 3961051 - RNA, 15 nt, Human herpesvirus 2
auuuccaaacagggc

SEQ ID NO: 3961052 - RNA, 22 nt, Human herpesvirus 2
auuuccccagcacggaggaacu

SEQ ID NO: 3961053 - RNA, 12 nt, Human herpesvirus 2
caaaaacacaag

SEQ ID NO: 3961054 - RNA, 13 nt, Human herpesvirus 2
caaaaaccagguc

SEQ ID NO: 3961055 - RNA, 22 nt, Human herpesvirus 2
caaaaauacacaugacuucugg

SEQ ID NO: 3961056 - RNA, 20 nt, Human herpesvirus 2
caaaccccgguuggggcggg

SEQ ID NO: 3961057 - RNA, 17 nt, Human herpesvirus 2
caaagaaauagaagaaa

SEQ ID NO: 3961058 - RNA, 18 nt, Human herpesvirus 2
caaccaggcgcugcugcg

SEQ ID NO: 3961059 - RNA, 17 nt, Human herpesvirus 2
caacccaucccacaaug

SEQ ID NO: 3961060 - RNA, 23 nt, Human herpesvirus 2
caacgcgaccgucgccgccggcc

SEQ ID NO: 3961061 - RNA, 15 nt, Human herpesvirus 2
caacggcgggccccg

SEQ ID NO: 3961062 - RNA, 14 nt, Human herpesvirus 2
caagccacccuggg

SEQ ID NO: 3961063 - RNA, 20 nt, Human herpesvirus 2
caagugcaguaacccaguuc

SEQ ID NO: 3961064 - RNA, 13 nt, Human herpesvirus 2
caauaauaaagcu

SEQ ID NO: 3961065 - RNA, 13 nt, Human herpesvirus 2
caauauggcccag

SEQ ID NO: 3961066 - RNA, 18 nt, Human herpesvirus 2
caauggccgcuccugccc

SEQ ID NO: 3961067 - RNA, 14 nt, Human herpesvirus 2
caauuagcuguuua

SEQ ID NO: 3961068 - RNA, 12 nt, Human herpesvirus 2
cacacacccccu

SEQ ID NO: 3961069 - RNA, 21 nt, Human herpesvirus 2
cacacaggcccaccaccaucc

SEQ ID NO: 3961070 - RNA, 17 nt, Human herpesvirus 2
cacaccagacggcggga

SEQ ID NO: 3961071 - RNA, 21 nt, Human herpesvirus 2
caccagagccgaacgcagguc

SEQ ID NO: 3961072 - RNA, 22 nt, Human herpesvirus 2
caccagagccgaacgcaggucc

SEQ ID NO: 3961073 - RNA, 18 nt, Human herpesvirus 2
caccagcucgggggccag

SEQ ID NO: 3961074 - RNA, 21 nt, Human herpesvirus 2
cacccccgaguucccccggga

SEQ ID NO: 3961075 - RNA, 15 nt, Human herpesvirus 2
cgccgcaacacccgg

SEQ ID NO: 3961076 - RNA, 17 nt, Human herpesvirus 2
cgccgcgggggaggcgc

SEQ ID NO: 3961077 - RNA, 15 nt, Human herpesvirus 2
cgccgcgugggcucc

SEQ ID NO: 3961078 - RNA, 16 nt, Human herpesvirus 2
cgccgcuacugcgcca

SEQ ID NO: 3961079 - RNA, 21 nt, Human herpesvirus 2
cgccgcucgucccccgaggcc

SEQ ID NO: 3961080 - RNA, 21 nt, Human herpesvirus 2
cgccgcuguggcccuggcgga

SEQ ID NO: 3961081 - RNA, 22 nt, Human herpesvirus 2
cgccgcuguggcccuggcggac

SEQ ID NO: 3961082 - RNA, 22 nt, Human herpesvirus 2
cgccggcccgaaccccgcggcc

SEQ ID NO: 3961083 - RNA, 23 nt, Human herpesvirus 2
cgccggccgguccucgggccuac

SEQ ID NO: 3961084 - RNA, 20 nt, Human herpesvirus 2
cgccgggcgcgcccaccggu

SEQ ID NO: 3961085 - RNA, 22 nt, Human herpesvirus 2
cgccgucaaccccgcccuccgc

SEQ ID NO: 3961086 - RNA, 19 nt, Human herpesvirus 2
cgccgucgcuaccgcggcu

SEQ ID NO: 3961087 - RNA, 15 nt, Human herpesvirus 2
cgccucccggccgcc

SEQ ID NO: 3961088 - RNA, 18 nt, Human herpesvirus 2
cgccucccggggggucgg

SEQ ID NO: 3961089 - RNA, 21 nt, Human herpesvirus 2
cgccucgcgucgggccagaug

SEQ ID NO: 3961090 - RNA, 21 nt, Human herpesvirus 2
cgccucucccuuuuuuccccc

SEQ ID NO: 3961091 - RNA, 15 nt, Human herpesvirus 2
cgccugcgccccgac

SEQ ID NO: 3961092 - RNA, 22 nt, Human herpesvirus 2
cgccuuuccuccccucgccugu

SEQ ID NO: 3961093 - RNA, 22 nt, Human herpesvirus 2
cgcgagcucccugcggcuggcg

SEQ ID NO: 3961094 - RNA, 18 nt, Human herpesvirus 2
cgcgagggcccggcgccg

SEQ ID NO: 3961095 - RNA, 11 nt, Human herpesvirus 2
cgcgcagcgca

SEQ ID NO: 3961096 - RNA, 17 nt, Human herpesvirus 2
cgcgcaggcuggagcuc

SEQ ID NO: 3961097 - RNA, 15 nt, Human herpesvirus 2
cgcgcaucacggccc

SEQ ID NO: 3961098 - RNA, 21 nt, Human herpesvirus 2
cgcgccgccgcgcgggcccgg

SEQ ID NO: 3961099 - RNA, 23 nt, Human herpesvirus 2
cgcgccuacgagcccgcggucgu

SEQ ID NO: 3961100 - RNA, 12 nt, Human herpesvirus 2
cgcgccucccgg

SEQ ID NO: 3961101 - RNA, 23 nt, Human herpesvirus 2
cgcgcgcccccgacccggggccc

SEQ ID NO: 3961102 - RNA, 19 nt, Human herpesvirus 2
cgcgcggcgcgagcucccu

SEQ ID NO: 3961103 - RNA, 20 nt, Human herpesvirus 2
cgcggaccccgcccgcgacc

SEQ ID NO: 3961104 - RNA, 15 nt, Human herpesvirus 2
cgcggacgccgggcg

SEQ ID NO: 3961105 - RNA, 17 nt, Human herpesvirus 2
cgcggccgugggcgucc

SEQ ID NO: 3961106 - RNA, 11 nt, Human herpesvirus 2
cgcggcgccaa

SEQ ID NO: 3961107 - RNA, 13 nt, Human herpesvirus 2
cgcggcggcuccc

SEQ ID NO: 3961108 - RNA, 13 nt, Human herpesvirus 2
cgcgggcggcgcc

SEQ ID NO: 3961109 - RNA, 18 nt, Human herpesvirus 2
cgcgggcggcgccgcgcc

SEQ ID NO: 3961110 - RNA, 23 nt, Human herpesvirus 2
cgcggggacccgccagagacccu

SEQ ID NO: 3961111 - RNA, 20 nt, Human herpesvirus 2
cgcggggguucggggccagg

SEQ ID NO: 3961112 - RNA, 23 nt, Human herpesvirus 2
cgcggugcgccccgccggggcgc

SEQ ID NO: 3961113 - RNA, 22 nt, Human herpesvirus 2
cgcgguucugacgcggggucga

SEQ ID NO: 3961114 - RNA, 17 nt, Human herpesvirus 2
cgcuacacgacccugga

SEQ ID NO: 3961115 - RNA, 22 nt, Human herpesvirus 2
cgcucugucccccgggcagccg

SEQ ID NO: 3961116 - RNA, 16 nt, Human herpesvirus 2
cgcugcagggccuggc

SEQ ID NO: 3961117 - RNA, 19 nt, Human herpesvirus 2
cgcugcucucccguacccc

SEQ ID NO: 3961118 - RNA, 12 nt, Human herpesvirus 2
cgcuggccccuc

SEQ ID NO: 3961119 - RNA, 19 nt, Human herpesvirus 2
cgcuggcggaagugccgca

SEQ ID NO: 3961120 - RNA, 15 nt, Human herpesvirus 2
cgcuggugggacgcc

SEQ ID NO: 3961121 - RNA, 20 nt, Human herpesvirus 2
cgcuuauaagagcgggcccg

SEQ ID NO: 3961122 - RNA, 23 nt, Human herpesvirus 2
cgcuuauaagagcgggcccgggg

SEQ ID NO: 3961123 - RNA, 16 nt, Human herpesvirus 2
cgcuuuauaggacgcg

SEQ ID NO: 3961124 - RNA, 13 nt, Human herpesvirus 2
cggaccccgaccc

SEQ ID NO: 3961125 - RNA, 15 nt, Human herpesvirus 2
cggacgagcccgugg

SEQ ID NO: 3961126 - RNA, 21 nt, Human herpesvirus 2
cggacgcacgcggggacccgc

SEQ ID NO: 3961127 - RNA, 17 nt, Human herpesvirus 2
cggacgcggcacaggug

SEQ ID NO: 3961128 - RNA, 10 nt, Human herpesvirus 2
cggagaccca

SEQ ID NO: 3961129 - RNA, 14 nt, Human herpesvirus 2
cggagaggcccgcc

SEQ ID NO: 3961130 - RNA, 19 nt, Human herpesvirus 2
cggagcgccgucgucgccc

SEQ ID NO: 3961131 - RNA, 19 nt, Human herpesvirus 2
cggagcucgacgcacagcg

SEQ ID NO: 3961132 - RNA, 19 nt, Human herpesvirus 2
cggaggaaacccccgaccc

SEQ ID NO: 3961133 - RNA, 19 nt, Human herpesvirus 2
cggauaccgacagugacag

SEQ ID NO: 3961134 - RNA, 18 nt, Human herpesvirus 2
cggcaacaaagggccucc

SEQ ID NO: 3961135 - RNA, 17 nt, Human herpesvirus 2
cggcaaccccaccuucg

SEQ ID NO: 3961136 - RNA, 17 nt, Human herpesvirus 2
cggcaaccccagggcgu

SEQ ID NO: 3961137 - RNA, 13 nt, Human herpesvirus 2
cggcaacccuccu

SEQ ID NO: 3961138 - RNA, 14 nt, Human herpesvirus 2
cggcaauaaaagaa

SEQ ID NO: 3961139 - RNA, 19 nt, Human herpesvirus 2
cggcaauaaaagaacagaa

SEQ ID NO: 3961140 - RNA, 23 nt, Human herpesvirus 2
cggcaauaaaagaacagaauaaa

SEQ ID NO: 3961141 - RNA, 18 nt, Human herpesvirus 2
cggccaacgaggaccacg

SEQ ID NO: 3961142 - RNA, 24 nt, Human herpesvirus 2
cggccaauucuucccggagcgccg

SEQ ID NO: 3961143 - RNA, 17 nt, Human herpesvirus 2
cggccaccccgccgcag

SEQ ID NO: 3961144 - RNA, 17 nt, Human herpesvirus 2
cggccagcacgaccagg

SEQ ID NO: 3961145 - RNA, 15 nt, Human herpesvirus 2
cggccccacggucag

SEQ ID NO: 3961146 - RNA, 14 nt, Human herpesvirus 2
cggcccgccaaccc

SEQ ID NO: 3961147 - RNA, 15 nt, Human herpesvirus 2
cggcccugcggccaa

SEQ ID NO: 3961148 - RNA, 13 nt, Human herpesvirus 2
cggcccuggagcg

SEQ ID NO: 3961149 - RNA, 13 nt, Human herpesvirus 2
cggccgccccccg

SEQ ID NO: 3961150 - RNA, 16 nt, Human herpesvirus 2
cggccgcucgcugcag

SEQ ID NO: 3961151 - RNA, 12 nt, Human herpesvirus 2
cggccucuccgg

SEQ ID NO: 3961152 - RNA, 21 nt, Human herpesvirus 2
cggcgauggccgcgcgcgugu

SEQ ID NO: 3961153 - RNA, 18 nt, Human herpesvirus 2
cggcgccaagcgccccgc

SEQ ID NO: 3961154 - RNA, 22 nt, Human herpesvirus 2
cggcgccgccccgccgcuccgc

SEQ ID NO: 3961155 - RNA, 21 nt, Human herpesvirus 2
cggcgcgcguuucugaucgac

SEQ ID NO: 3961156 - RNA, 18 nt, Human herpesvirus 2
cggcgcgggcggcgccgc

SEQ ID NO: 3961157 - RNA, 20 nt, Human herpesvirus 2
cggcggccaccccgccgcag

SEQ ID NO: 3961158 - RNA, 23 nt, Human herpesvirus 2
cggcggccaccccgccgcagcuc

SEQ ID NO: 3961159 - RNA, 19 nt, Human herpesvirus 2
cggcggcucccccgcggcc

SEQ ID NO: 3961160 - RNA, 16 nt, Human herpesvirus 2
cggcggggccccgggc

SEQ ID NO: 3961161 - RNA, 20 nt, Human herpesvirus 2
cggcgggucccuccgcggcc

SEQ ID NO: 3961162 - RNA, 19 nt, Human herpesvirus 2
cggcgugcgcgugggagga

SEQ ID NO: 3961163 - RNA, 12 nt, Human herpesvirus 2
cgggacgcccgg

SEQ ID NO: 3961164 - RNA, 19 nt, Human herpesvirus 2
cgggacgcccggcccauaa

SEQ ID NO: 3961165 - RNA, 12 nt, Human herpesvirus 2
cgggagcaggac

SEQ ID NO: 3961166 - RNA, 14 nt, Human herpesvirus 2
cgggagcaggacag

SEQ ID NO: 3961167 - RNA, 14 nt, Human herpesvirus 2
cgggagccgcggcc

SEQ ID NO: 3961168 - RNA, 20 nt, Human herpesvirus 2
cgggaggggcgggaggggcg

SEQ ID NO: 3961169 - RNA, 19 nt, Human herpesvirus 2
cgggaggggcuuggccuuc

SEQ ID NO: 3961170 - RNA, 19 nt, Human herpesvirus 2
cgggauccuccgccagcuc

SEQ ID NO: 3961171 - RNA, 23 nt, Human herpesvirus 2
cgggcacucuggcguccccaggc

SEQ ID NO: 3961172 - RNA, 18 nt, Human herpesvirus 2
cgggccagauggggcccc

SEQ ID NO: 3961173 - RNA, 21 nt, Human herpesvirus 2
cgggcggacguccaggggugc

SEQ ID NO: 3961174 - RNA, 23 nt, Human herpesvirus 2
cgggcgggguggggaggaaagaa

SEQ ID NO: 3961175 - RNA, 23 nt, Human herpesvirus 2
cgggcggugcccaucuacguggc

SEQ ID NO: 3961176 - RNA, 21 nt, Human herpesvirus 2
cggggaagaugacguacagca

SEQ ID NO: 3961177 - RNA, 16 nt, Human herpesvirus 2
cggggauaaaagccaa

SEQ ID NO: 3961178 - RNA, 12 nt, Human herpesvirus 2
cggggcccgcag

SEQ ID NO: 3961179 - RNA, 18 nt, Human herpesvirus 2
cggggccguggggcccca

SEQ ID NO: 3961180 - RNA, 18 nt, Human herpesvirus 2
cgggggcggugacgcccg

SEQ ID NO: 3961181 - RNA, 14 nt, Human herpesvirus 2
cggggggggccucg

SEQ ID NO: 3961182 - RNA, 19 nt, Human herpesvirus 2
cggggugguggacgcgaga

SEQ ID NO: 3961183 - RNA, 16 nt, Human herpesvirus 2
cggguggcgccucugc

SEQ ID NO: 3961184 - RNA, 13 nt, Human herpesvirus 2
cggguggggcgga

SEQ ID NO: 3961185 - RNA, 14 nt, Human herpesvirus 2
cggucaggaccagg

SEQ ID NO: 3961186 - RNA, 17 nt, Human herpesvirus 2
cggucgcuuuccacacc

SEQ ID NO: 3961187 - RNA, 18 nt, Human herpesvirus 2
cggucggccagcacgacc

SEQ ID NO: 3961188 - RNA, 19 nt, Human herpesvirus 2
cggugccucacgguccuca

SEQ ID NO: 3961189 - RNA, 22 nt, Human herpesvirus 2
cgguggcgucggcggccccggc

SEQ ID NO: 3961190 - RNA, 20 nt, Human herpesvirus 2
cgguuggaggcgccucugcc

SEQ ID NO: 3961191 - RNA, 15 nt, Human herpesvirus 2
cgguuuugcggucgu

SEQ ID NO: 3961192 - RNA, 12 nt, Human herpesvirus 2
cguaaacaccaa

SEQ ID NO: 3961193 - RNA, 13 nt, Human herpesvirus 2
cguaccccgccgg

SEQ ID NO: 3961194 - RNA, 17 nt, Human herpesvirus 2
cguacgucugcccgugg

SEQ ID NO: 3961195 - RNA, 14 nt, Human herpesvirus 2
cguaucggccagga

SEQ ID NO: 3961196 - RNA, 17 nt, Human herpesvirus 2
cgucaccgggggccccg

SEQ ID NO: 3961197 - RNA, 22 nt, Human herpesvirus 2
cgucacgagccccugggccgcu

SEQ ID NO: 3961198 - RNA, 22 nt, Human herpesvirus 2
cgucacgcccgucaggcgcgcg

SEQ ID NO: 3961199 - RNA, 14 nt, Human herpesvirus 2
cguccccuggggcg

SEQ ID NO: 3961200 - RNA, 12 nt, Human herpesvirus 2
cguccgacaccc

SEQ ID NO: 3961201 - RNA, 15 nt, Human herpesvirus 2
cguccgaccugcagg

SEQ ID NO: 3961202 - RNA, 15 nt, Human herpesvirus 2
cguccucacggccaa

SEQ ID NO: 3961203 - RNA, 22 nt, Human herpesvirus 2
cguccucacggccaacgaggac

SEQ ID NO: 3961204 - RNA, 15 nt, Human herpesvirus 2
cgucgcccuagaggc

SEQ ID NO: 3961205 - RNA, 20 nt, Human herpesvirus 2
cgucgcuccggcucccggcc

SEQ ID NO: 3961206 - RNA, 21 nt, Human herpesvirus 2
cgucgcucucggucccgcaua

SEQ ID NO: 3961207 - RNA, 18 nt, Human herpesvirus 2
cgugccaacucgcggcac

SEQ ID NO: 3961208 - RNA, 14 nt, Human herpesvirus 2
cgugccccuggacu

SEQ ID NO: 3961209 - RNA, 15 nt, Human herpesvirus 2
cgugcgcgugggagg

SEQ ID NO: 3961210 - RNA, 20 nt, Human herpesvirus 2
cgugcgugcugcugagcccu

SEQ ID NO: 3961211 - RNA, 22 nt, Human herpesvirus 2
cgugcuuccgcacccccgccua

SEQ ID NO: 3961212 - RNA, 20 nt, Human herpesvirus 2
cguggaugccggggccgugg

SEQ ID NO: 3961213 - RNA, 16 nt, Human herpesvirus 2
cguggccagagccuca

SEQ ID NO: 3961214 - RNA, 22 nt, Human herpesvirus 2
cguggugauacaacacaccccc

SEQ ID NO: 3961215 - RNA, 18 nt, Human herpesvirus 2
cguguacaaacacgggga

SEQ ID NO: 3961216 - RNA, 21 nt, Human herpesvirus 2
cgugugugagaaauaaagaac

SEQ ID NO: 3961217 - RNA, 18 nt, Human herpesvirus 2
cguguuguggcuggaggc

SEQ ID NO: 3961218 - RNA, 20 nt, Human herpesvirus 2
cguucagcgcaucaggcuca

SEQ ID NO: 3961219 - RNA, 16 nt, Human herpesvirus 2
cguucggaccuggggg

SEQ ID NO: 3961220 - RNA, 13 nt, Human herpesvirus 2
cguucggacggcc

SEQ ID NO: 3961221 - RNA, 20 nt, Human herpesvirus 2
cguugccgggggccaugaca

SEQ ID NO: 3961222 - RNA, 23 nt, Human herpesvirus 2
cguuggccagcgcguugguccgg

SEQ ID NO: 3961223 - RNA, 11 nt, Human herpesvirus 2
cguuuggccaa

SEQ ID NO: 3961224 - RNA, 19 nt, Human herpesvirus 2
cuaaccgcgcgccuccucg

SEQ ID NO: 3961225 - RNA, 17 nt, Human herpesvirus 2
cuacgugccccccgacg

SEQ ID NO: 3961226 - RNA, 17 nt, Human herpesvirus 2
cuagucacacgcccccc

SEQ ID NO: 3961227 - RNA, 17 nt, Human herpesvirus 2
cucaaacaaaaacacaa

SEQ ID NO: 3961228 - RNA, 18 nt, Human herpesvirus 2
cucacaccgcgucuguuu

SEQ ID NO: 3961229 - RNA, 18 nt, Human herpesvirus 2
cucaccgagccgcugugc

SEQ ID NO: 3961230 - RNA, 16 nt, Human herpesvirus 2
cucaccgcgcccgggc

SEQ ID NO: 3961231 - RNA, 21 nt, Human herpesvirus 2
cucacgucuucgcccaccgau

SEQ ID NO: 3961232 - RNA, 16 nt, Human herpesvirus 2
cucccagugccccgac

SEQ ID NO: 3961233 - RNA, 14 nt, Human herpesvirus 2
cuccccgcuggagc

SEQ ID NO: 3961234 - RNA, 16 nt, Human herpesvirus 2
cucccggcccgccgac

SEQ ID NO: 3961235 - RNA, 16 nt, Human herpesvirus 2
cucccggcccgggccc

SEQ ID NO: 3961236 - RNA, 20 nt, Human herpesvirus 2
cucccuuuuuucccccccuc

SEQ ID NO: 3961237 - RNA, 22 nt, Human herpesvirus 2
cuccgaagagacgaugggagcc

SEQ ID NO: 3961238 - RNA, 18 nt, Human herpesvirus 2
cuccgcaauaaacgccuu

SEQ ID NO: 3961239 - RNA, 17 nt, Human herpesvirus 2
cuccgcgggucccuucc

SEQ ID NO: 3961240 - RNA, 19 nt, Human herpesvirus 2
cuccgcgggucccuuccca

SEQ ID NO: 3961241 - RNA, 19 nt, Human herpesvirus 2
cuccgugcuggggaaaucu

SEQ ID NO: 3961242 - RNA, 19 nt, Human herpesvirus 2
cuccucgcggaguaugacc

SEQ ID NO: 3961243 - RNA, 18 nt, Human herpesvirus 2
cuccugcgagcccucacg

SEQ ID NO: 3961244 - RNA, 16 nt, Human herpesvirus 2
cucgaacacgagccgc

SEQ ID NO: 3961245 - RNA, 17 nt, Human herpesvirus 2
cucgaacacgagccgca

SEQ ID NO: 3961246 - RNA, 23 nt, Human herpesvirus 2
cucgaacacgagccgcaggaacg

SEQ ID NO: 3961247 - RNA, 16 nt, Human herpesvirus 2
cucgaacauggacccg

SEQ ID NO: 3961248 - RNA, 16 nt, Human herpesvirus 2
cucgaccagcggcccc

SEQ ID NO: 3961249 - RNA, 17 nt, Human herpesvirus 2
cucgcugcagggccugg

SEQ ID NO: 3961250 - RNA, 19 nt, Human herpesvirus 2
cucggggacagaggacgcc

SEQ ID NO: 3961251 - RNA, 18 nt, Human herpesvirus 2
cucguccccuggggcggc

SEQ ID NO: 3961252 - RNA, 20 nt, Human herpesvirus 2
cucguccccuggggcggcgg

SEQ ID NO: 3961253 - RNA, 19 nt, Human herpesvirus 2
cucgugcucgcgugguaca

SEQ ID NO: 3961254 - RNA, 15 nt, Human herpesvirus 2
cucguggugcugggg

SEQ ID NO: 3961255 - RNA, 23 nt, Human herpesvirus 2
cucguuuuguuuucucuucuuuc

SEQ ID NO: 3961256 - RNA, 18 nt, Human herpesvirus 2
cucucccuuuuuuccccc

SEQ ID NO: 3961257 - RNA, 17 nt, Human herpesvirus 2
cucugccugcacgagcg

SEQ ID NO: 3961258 - RNA, 15 nt, Human herpesvirus 2
cucuggcguccccag

SEQ ID NO: 3961259 - RNA, 14 nt, Human herpesvirus 2
cucuggcuccaggc

SEQ ID NO: 3961260 - RNA, 16 nt, Human herpesvirus 2
cucuucgggcaccccg

SEQ ID NO: 3961261 - RNA, 15 nt, Human herpesvirus 2
cucuuggggaaaucu

SEQ ID NO: 3961262 - RNA, 20 nt, Human herpesvirus 2
cucuuuauugaccggggccc

SEQ ID NO: 3961263 - RNA, 20 nt, Human herpesvirus 2
cugaucgacgacgccuggcg

SEQ ID NO: 3961264 - RNA, 21 nt, Human herpesvirus 2
cugaucgacgacgccuggcgg

SEQ ID NO: 3961265 - RNA, 12 nt, Human herpesvirus 2
cugcacgagguc

SEQ ID NO: 3961266 - RNA, 15 nt, Human herpesvirus 2
cugcagggccuggcg

SEQ ID NO: 3961267 - RNA, 22 nt, Human herpesvirus 2
cugccccgcggaggcgugguga

SEQ ID NO: 3961268 - RNA, 17 nt, Human herpesvirus 2
cugcccgcggaccaccg

SEQ ID NO: 3961269 - RNA, 18 nt, Human herpesvirus 2
cugcccguggguggccac

SEQ ID NO: 3961270 - RNA, 16 nt, Human herpesvirus 2
cugccggacgcggcac

SEQ ID NO: 3961271 - RNA, 18 nt, Human herpesvirus 2
cugccguaugcuaauuaa

SEQ ID NO: 3961272 - RNA, 14 nt, Human herpesvirus 2
cugcgcgaggccgc

SEQ ID NO: 3961273 - RNA, 14 nt, Human herpesvirus 2
cugcggggaccagc

SEQ ID NO: 3961274 - RNA, 18 nt, Human herpesvirus 2
cugcgucguccagggugg

SEQ ID NO: 3961275 - RNA, 13 nt, Human herpesvirus 2
cugcugggccaug

SEQ ID NO: 3961276 - RNA, 20 nt, Human herpesvirus 2
cuggagccccugggggaccc

SEQ ID NO: 3961277 - RNA, 15 nt, Human herpesvirus 2
cuggccgugcugggc

SEQ ID NO: 3961278 - RNA, 14 nt, Human herpesvirus 2
cuggcgauccuggg

SEQ ID NO: 3961279 - RNA, 16 nt, Human herpesvirus 2
cuggcgauccugggcc

SEQ ID NO: 3961280 - RNA, 21 nt, Human herpesvirus 2
cuggcggaagugccgcacggc

SEQ ID NO: 3961281 - RNA, 21 nt, Human herpesvirus 2
cugggacacccagaugcgccu

SEQ ID NO: 3961282 - RNA, 16 nt, Human herpesvirus 2
cugggagcccuccucg

SEQ ID NO: 3961283 - RNA, 19 nt, Human herpesvirus 2
cugggcgaagucccgcacg

SEQ ID NO: 3961284 - RNA, 15 nt, Human herpesvirus 2
cugggcgcgagccag

SEQ ID NO: 3961285 - RNA, 22 nt, Human herpesvirus 2
cuggggcuuccguugcgcgaca

SEQ ID NO: 3961286 - RNA, 18 nt, Human herpesvirus 2
cuggguccgggggccugg

SEQ ID NO: 3961287 - RNA, 19 nt, Human herpesvirus 2
cuggguuacugcacuugcc

SEQ ID NO: 3961288 - RNA, 15 nt, Human herpesvirus 2
cugguacccacggac

SEQ ID NO: 3961289 - RNA, 22 nt, Human herpesvirus 2
cuggugacggaaaaccugggcg

SEQ ID NO: 3961290 - RNA, 22 nt, Human herpesvirus 2
cugucaucguauaccagccgcc

SEQ ID NO: 3961291 - RNA, 11 nt, Human herpesvirus 2
cuguccccgcc

SEQ ID NO: 3961292 - RNA, 22 nt, Human herpesvirus 2
cugucccgacgauuagccaccg

SEQ ID NO: 3961293 - RNA, 14 nt, Human herpesvirus 2
cuguccgccgggcg

SEQ ID NO: 3961294 - RNA, 13 nt, Human herpesvirus 2
cuguggcggucgg

SEQ ID NO: 3961295 - RNA, 15 nt, Human herpesvirus 2
cuucagccuggacca

SEQ ID NO: 3961296 - RNA, 15 nt, Human herpesvirus 2
cuucccccccccuac

SEQ ID NO: 3961297 - RNA, 20 nt, Human herpesvirus 2
cuucccgggaaaccacacac

SEQ ID NO: 3961298 - RNA, 16 nt, Human herpesvirus 2
cuuccuguaccugacg

SEQ ID NO: 3961299 - RNA, 22 nt, Human herpesvirus 2
cuucgaucgacgaacuggggcg

SEQ ID NO: 3961300 - RNA, 18 nt, Human herpesvirus 2
cuucgcugucagcacgcg

SEQ ID NO: 3961301 - RNA, 18 nt, Human herpesvirus 2
cuugcuugggggggcguc

SEQ ID NO: 3961302 - RNA, 18 nt, Human herpesvirus 2
cuuggccggggagggcag

SEQ ID NO: 3961303 - RNA, 17 nt, Human herpesvirus 2
gcagccgcgccgcugcc

SEQ ID NO: 3961304 - RNA, 21 nt, Human herpesvirus 2
gcagcgugucaaaggccagca

SEQ ID NO: 3961305 - RNA, 19 nt, Human herpesvirus 2
gcagcuuuuaacgggccgc

SEQ ID NO: 3961306 - RNA, 11 nt, Human herpesvirus 2
gcagggccuga

SEQ ID NO: 3961307 - RNA, 13 nt, Human herpesvirus 2
gcauaaagggagu

SEQ ID NO: 3961308 - RNA, 17 nt, Human herpesvirus 2
gcauacaccccacccua

SEQ ID NO: 3961309 - RNA, 23 nt, Human herpesvirus 2
gcauccgaucgaugagccgguag

SEQ ID NO: 3961310 - RNA, 18 nt, Human herpesvirus 2
gcaucgcaagccacccug

SEQ ID NO: 3961311 - RNA, 16 nt, Human herpesvirus 2
gcaucucuggcuccag

SEQ ID NO: 3961312 - RNA, 14 nt, Human herpesvirus 2
gcaugcaaauuaaa

SEQ ID NO: 3961313 - RNA, 17 nt, Human herpesvirus 2
gcaugcgacggcgucuc

SEQ ID NO: 3961314 - RNA, 12 nt, Human herpesvirus 2
gccaacaccagg

SEQ ID NO: 3961315 - RNA, 16 nt, Human herpesvirus 2
gccaacgcgaccgucg

SEQ ID NO: 3961316 - RNA, 16 nt, Human herpesvirus 2
gccaagcgccccgcgg

SEQ ID NO: 3961317 - RNA, 15 nt, Human herpesvirus 2
gccacacaguccgug

SEQ ID NO: 3961318 - RNA, 13 nt, Human herpesvirus 2
gccacaccacccu

SEQ ID NO: 3961319 - RNA, 9 nt, Human herpesvirus 2
gccagcgcc

SEQ ID NO: 3961320 - RNA, 20 nt, Human herpesvirus 2
gccagcucggacaccagcag

SEQ ID NO: 3961321 - RNA, 19 nt, Human herpesvirus 2
gccaggagguccuggaggg

SEQ ID NO: 3961322 - RNA, 21 nt, Human herpesvirus 2
gccagguggcccuuccggacc

SEQ ID NO: 3961323 - RNA, 18 nt, Human herpesvirus 2
gccagugcaucccagacg

SEQ ID NO: 3961324 - RNA, 14 nt, Human herpesvirus 2
gccaguggagccaa

SEQ ID NO: 3961325 - RNA, 21 nt, Human herpesvirus 2
gccauccucaaacaggccauc

SEQ ID NO: 3961326 - RNA, 15 nt, Human herpesvirus 2
gccaucgccggggac

SEQ ID NO: 3961327 - RNA, 15 nt, Human herpesvirus 2
gcccacccccccacc

SEQ ID NO: 3961328 - RNA, 21 nt, Human herpesvirus 2
gcccacgaauuugacgucgug

SEQ ID NO: 3961329 - RNA, 24 nt, Human herpesvirus 2
gcccacuuucccccccacuccacc

SEQ ID NO: 3961330 - RNA, 12 nt, Human herpesvirus 2
gcccagcacagg

SEQ ID NO: 3961331 - RNA, 14 nt, Human herpesvirus 2
gcccagcacaggca

SEQ ID NO: 3961332 - RNA, 17 nt, Human herpesvirus 2
gcccagcacaggcaggc

SEQ ID NO: 3961333 - RNA, 15 nt, Human herpesvirus 2
gcccaggcccuggcg

SEQ ID NO: 3961334 - RNA, 10 nt, Human herpesvirus 2
gccccacgga

SEQ ID NO: 3961335 - RNA, 18 nt, Human herpesvirus 2
gcccccgccguggcggag

SEQ ID NO: 3961336 - RNA, 18 nt, Human herpesvirus 2
gcccccggagucccccgg

SEQ ID NO: 3961337 - RNA, 17 nt, Human herpesvirus 2
gcccccggcccugcggc

SEQ ID NO: 3961338 - RNA, 20 nt, Human herpesvirus 2
gcccccggccuuugcuuccu

SEQ ID NO: 3961339 - RNA, 24 nt, Human herpesvirus 2
gcccccggggccgucgcggccgcc

SEQ ID NO: 3961340 - RNA, 16 nt, Human herpesvirus 2
gccccgacggcccaca

SEQ ID NO: 3961341 - RNA, 15 nt, Human herpesvirus 2
gccccgcaggcaggc

SEQ ID NO: 3961342 - RNA, 14 nt, Human herpesvirus 2
gccccgccgcuccg

SEQ ID NO: 3961343 - RNA, 22 nt, Human herpesvirus 2
gccccgccgggucaccggggcg

SEQ ID NO: 3961344 - RNA, 23 nt, Human herpesvirus 2
gccccggccgccuccccgcugga

SEQ ID NO: 3961345 - RNA, 23 nt, Human herpesvirus 2
gccccggguuccccgagagccca

SEQ ID NO: 3961346 - RNA, 18 nt, Human herpesvirus 2
gccccggucccccggacc

SEQ ID NO: 3961347 - RNA, 20 nt, Human herpesvirus 2
gcccgaacggaaggccuccc

SEQ ID NO: 3961348 - RNA, 23 nt, Human herpesvirus 2
gcccgaccagcgccggguggcgc

SEQ ID NO: 3961349 - RNA, 22 nt, Human herpesvirus 2
gcccgccauuuaggauggcugc

SEQ ID NO: 3961350 - RNA, 18 nt, Human herpesvirus 2
gcccgcccccgacgggcg

SEQ ID NO: 3961351 - RNA, 14 nt, Human herpesvirus 2
gcccgccccugcgc

SEQ ID NO: 3961352 - RNA, 15 nt, Human herpesvirus 2
gcccggaacgagguu

SEQ ID NO: 3961353 - RNA, 12 nt, Human herpesvirus 2
gcccggcgccgc

SEQ ID NO: 3961354 - RNA, 16 nt, Human herpesvirus 2
gcccgggguucugggg

SEQ ID NO: 3961355 - RNA, 17 nt, Human herpesvirus 2
gcccgggguucuggggg

SEQ ID NO: 3961356 - RNA, 15 nt, Human herpesvirus 2
gcccguggcccacga

SEQ ID NO: 3961357 - RNA, 21 nt, Human herpesvirus 2
gcccuggguccgggggccugg

SEQ ID NO: 3961358 - RNA, 21 nt, Human herpesvirus 2
gccgacccgucuagcggccgg

SEQ ID NO: 3961359 - RNA, 22 nt, Human herpesvirus 2
gccgacuuccgugccccuggac

SEQ ID NO: 3961360 - RNA, 17 nt, Human herpesvirus 2
gccgcacauccccuccg

SEQ ID NO: 3961361 - RNA, 13 nt, Human herpesvirus 2
gccgcacccacga

SEQ ID NO: 3961362 - RNA, 19 nt, Human herpesvirus 2
gccgcacggccgugucgcu

SEQ ID NO: 3961363 - RNA, 19 nt, Human herpesvirus 2
gccgcaucaguccgcgcgg

SEQ ID NO: 3961364 - RNA, 19 nt, Human herpesvirus 2
gccgccaccccccuccccu

SEQ ID NO: 3961365 - RNA, 17 nt, Human herpesvirus 2
gccgccccccgucccga

SEQ ID NO: 3961366 - RNA, 23 nt, Human herpesvirus 2
gccgccccgcaguuucaccgccc

SEQ ID NO: 3961367 - RNA, 14 nt, Human herpesvirus 2
gccgccgcgcgggc

SEQ ID NO: 3961368 - RNA, 13 nt, Human herpesvirus 2
gccgccggggggc

SEQ ID NO: 3961369 - RNA, 20 nt, Human herpesvirus 2
gccgcgacaagacccggcgg

SEQ ID NO: 3961370 - RNA, 19 nt, Human herpesvirus 2
gccgcgaccgucgcggcga

SEQ ID NO: 3961371 - RNA, 16 nt, Human herpesvirus 2
gccgcgacggccccgg

SEQ ID NO: 3961372 - RNA, 17 nt, Human herpesvirus 2
gccgcgacggccccggc

SEQ ID NO: 3961373 - RNA, 22 nt, Human herpesvirus 2
gccgcgcggccacgucguccgg

SEQ ID NO: 3961374 - RNA, 16 nt, Human herpesvirus 2
gccgcgguggcgucgg

SEQ ID NO: 3961375 - RNA, 22 nt, Human herpesvirus 2
gccgcgguggcgucggcggccc

SEQ ID NO: 3961376 - RNA, 14 nt, Human herpesvirus 2
gccgcugugccagg

SEQ ID NO: 3961377 - RNA, 16 nt, Human herpesvirus 2
gccgcuuuaccccgcg

SEQ ID NO: 3961378 - RNA, 23 nt, Human herpesvirus 2
gccgcuuuaccccgcggccucgc

SEQ ID NO: 3961379 - RNA, 19 nt, Human herpesvirus 2
gccggaaaccgagacggug

SEQ ID NO: 3961380 - RNA, 17 nt, Human herpesvirus 2
gccggcggagccccgga

SEQ ID NO: 3961381 - RNA, 23 nt, Human herpesvirus 2
gccggcgugggugacugggaccg

SEQ ID NO: 3961382 - RNA, 19 nt, Human herpesvirus 2
gccgggaaccccggcgugg

SEQ ID NO: 3961383 - RNA, 23 nt, Human herpesvirus 2
gccgggacgacgaccaugggccc

SEQ ID NO: 3961384 - RNA, 12 nt, Human herpesvirus 2
gccgggcagaca

SEQ ID NO: 3961385 - RNA, 16 nt, Human herpesvirus 2
gccgggccucccgcaa

SEQ ID NO: 3961386 - RNA, 19 nt, Human herpesvirus 2
gccggggagggcagggccg

SEQ ID NO: 3961387 - RNA, 12 nt, Human herpesvirus 2
gccgggggccau

SEQ ID NO: 3961388 - RNA, 14 nt, Human herpesvirus 2
gccgggggcggacg

SEQ ID NO: 3961389 - RNA, 16 nt, Human herpesvirus 2
gccgucaaccccgccc

SEQ ID NO: 3961390 - RNA, 23 nt, Human herpesvirus 2
gccgucgcacgcgcgcaggcugg

SEQ ID NO: 3961391 - RNA, 15 nt, Human herpesvirus 2
gccgugcgcggcccc

SEQ ID NO: 3961392 - RNA, 12 nt, Human herpesvirus 2
gccguggccaga

SEQ ID NO: 3961393 - RNA, 21 nt, Human herpesvirus 2
gccguggggccccagggcuuc

SEQ ID NO: 3961394 - RNA, 19 nt, Human herpesvirus 2
gccgugucgcuaaacaggg

SEQ ID NO: 3961395 - RNA, 18 nt, Human herpesvirus 2
gccguucggaccuggggg

SEQ ID NO: 3961396 - RNA, 20 nt, Human herpesvirus 2
gccguuggggauacgggggc

SEQ ID NO: 3961397 - RNA, 19 nt, Human herpesvirus 2
gccuaucuugaucccccgg

SEQ ID NO: 3961398 - RNA, 21 nt, Human herpesvirus 2
gccuccgcccuccgccagcgc

SEQ ID NO: 3961399 - RNA, 17 nt, Human herpesvirus 2
gccucugcccgaccggg

SEQ ID NO: 3961400 - RNA, 12 nt, Human herpesvirus 2
gccugcacgagc

SEQ ID NO: 3961401 - RNA, 13 nt, Human herpesvirus 2
gccugcugugggu

SEQ ID NO: 3961402 - RNA, 17 nt, Human herpesvirus 2
gccuggaucggcgucgg

SEQ ID NO: 3961403 - RNA, 14 nt, Human herpesvirus 2
gccuggcggcagca

SEQ ID NO: 3961404 - RNA, 19 nt, Human herpesvirus 2
gccuggcguuugggggcgg

SEQ ID NO: 3961405 - RNA, 20 nt, Human herpesvirus 2
gccuguuugcaacgagcugc

SEQ ID NO: 3961406 - RNA, 18 nt, Human herpesvirus 2
gcgaacacaagcucgccg

SEQ ID NO: 3961407 - RNA, 16 nt, Human herpesvirus 2
gcgaacccccuaaccg

SEQ ID NO: 3961408 - RNA, 20 nt, Human herpesvirus 2
gcgaagguguuguagggccg

SEQ ID NO: 3961409 - RNA, 13 nt, Human herpesvirus 2
gcgacgccgcggc

SEQ ID NO: 3961410 - RNA, 22 nt, Human herpesvirus 2
gcgagaaggaggggggccucgg

SEQ ID NO: 3961411 - RNA, 23 nt, Human herpesvirus 2
gcgagaugucaguccucggggac

SEQ ID NO: 3961412 - RNA, 14 nt, Human herpesvirus 2
gcgagcuggcccug

SEQ ID NO: 3961413 - RNA, 13 nt, Human herpesvirus 2
gcgauccccaagc

SEQ ID NO: 3961414 - RNA, 16 nt, Human herpesvirus 2
gcgcacccuggccguc

SEQ ID NO: 3961415 - RNA, 20 nt, Human herpesvirus 2
gcgcacccuggccguccggg

SEQ ID NO: 3961416 - RNA, 16 nt, Human herpesvirus 2
gcgcaucgccaacucu

SEQ ID NO: 3961417 - RNA, 23 nt, Human herpesvirus 2
gcgcaucuucgccgggugucugc

SEQ ID NO: 3961418 - RNA, 19 nt, Human herpesvirus 2
ggcccaccugcacgagguc

SEQ ID NO: 3961419 - RNA, 22 nt, Human herpesvirus 2
ggccccccgcgccucgggcggc

SEQ ID NO: 3961420 - RNA, 19 nt, Human herpesvirus 2
ggcccccgaauccggggcg

SEQ ID NO: 3961421 - RNA, 12 nt, Human herpesvirus 2
ggccccucugcu

SEQ ID NO: 3961422 - RNA, 14 nt, Human herpesvirus 2
ggcccgaggcgacc

SEQ ID NO: 3961423 - RNA, 21 nt, Human herpesvirus 2
ggcccgcuucauagcgcgucc

SEQ ID NO: 3961424 - RNA, 13 nt, Human herpesvirus 2
ggcccggccgccg

SEQ ID NO: 3961425 - RNA, 14 nt, Human herpesvirus 2
ggcccggcgccgcc

SEQ ID NO: 3961426 - RNA, 23 nt, Human herpesvirus 2
ggcccggggcccuucgcagcuuc

SEQ ID NO: 3961427 - RNA, 16 nt, Human herpesvirus 2
ggcccuggcggacggc

SEQ ID NO: 3961428 - RNA, 22 nt, Human herpesvirus 2
ggccgaacgccucaccgcgccc

SEQ ID NO: 3961429 - RNA, 14 nt, Human herpesvirus 2
ggccgagaagagcg

SEQ ID NO: 3961430 - RNA, 23 nt, Human herpesvirus 2
ggccgcacccacgacauccgcgg

SEQ ID NO: 3961431 - RNA, 16 nt, Human herpesvirus 2
ggccgccauucccgcu

SEQ ID NO: 3961432 - RNA, 21 nt, Human herpesvirus 2
ggccgcccaacccgagcgacc

SEQ ID NO: 3961433 - RNA, 19 nt, Human herpesvirus 2
ggccgcugggggggcgggc

SEQ ID NO: 3961434 - RNA, 13 nt, Human herpesvirus 2
ggccgugcccccc

SEQ ID NO: 3961435 - RNA, 19 nt, Human herpesvirus 2
ggccguguggucgccccca

SEQ ID NO: 3961436 - RNA, 16 nt, Human herpesvirus 2
ggccucauccggcccg

SEQ ID NO: 3961437 - RNA, 15 nt, Human herpesvirus 2
ggccucguggucggg

SEQ ID NO: 3961438 - RNA, 20 nt, Human herpesvirus 2
ggccuggcguuugggggcgg

SEQ ID NO: 3961439 - RNA, 22 nt, Human herpesvirus 2
ggccuggcguuugggggcggac

SEQ ID NO: 3961440 - RNA, 11 nt, Human herpesvirus 2
ggccuucccga

SEQ ID NO: 3961441 - RNA, 14 nt, Human herpesvirus 2
ggcgaccccgcccc

SEQ ID NO: 3961442 - RNA, 20 nt, Human herpesvirus 2
ggcgacccgccgggggcgga

SEQ ID NO: 3961443 - RNA, 16 nt, Human herpesvirus 2
ggcgaccgccccgcgc

SEQ ID NO: 3961444 - RNA, 22 nt, Human herpesvirus 2
ggcgagaagcgggaccgucgga

SEQ ID NO: 3961445 - RNA, 15 nt, Human herpesvirus 2
ggcgauccugggccu

SEQ ID NO: 3961446 - RNA, 17 nt, Human herpesvirus 2
ggcgccacgguggugca

SEQ ID NO: 3961447 - RNA, 12 nt, Human herpesvirus 2
ggcgccgaucgc

SEQ ID NO: 3961448 - RNA, 22 nt, Human herpesvirus 2
ggcgccggccaaccgcgcgccg

SEQ ID NO: 3961449 - RNA, 14 nt, Human herpesvirus 2
ggcgcgagccaggc

SEQ ID NO: 3961450 - RNA, 15 nt, Human herpesvirus 2
ggcgcgagccaggca

SEQ ID NO: 3961451 - RNA, 12 nt, Human herpesvirus 2
ggcggacccaga

SEQ ID NO: 3961452 - RNA, 18 nt, Human herpesvirus 2
ggcggacguccaggggug

SEQ ID NO: 3961453 - RNA, 19 nt, Human herpesvirus 2
ggcggaggccugucccugc

SEQ ID NO: 3961454 - RNA, 12 nt, Human herpesvirus 2
ggcggccagaaa

SEQ ID NO: 3961455 - RNA, 15 nt, Human herpesvirus 2
ggcggccccccgcgc

SEQ ID NO: 3961456 - RNA, 14 nt, Human herpesvirus 2
ggcggcccccggcc

SEQ ID NO: 3961457 - RNA, 21 nt, Human herpesvirus 2
ggcggccgcacccacgacauc

SEQ ID NO: 3961458 - RNA, 15 nt, Human herpesvirus 2
ggcggcgccgcgccc

SEQ ID NO: 3961459 - RNA, 12 nt, Human herpesvirus 2
ggcggcggcguc

SEQ ID NO: 3961460 - RNA, 13 nt, Human herpesvirus 2
ggcggcggggaag

SEQ ID NO: 3961461 - RNA, 13 nt, Human herpesvirus 2
ggcggcguggccg

SEQ ID NO: 3961462 - RNA, 15 nt, Human herpesvirus 2
ggcggcguggccgcg

SEQ ID NO: 3961463 - RNA, 14 nt, Human herpesvirus 2
ggcggggggugugg

SEQ ID NO: 3961464 - RNA, 21 nt, Human herpesvirus 2
ggcgugauguuuuccgcaucu

SEQ ID NO: 3961465 - RNA, 15 nt, Human herpesvirus 2
ggcguugcugcgcug

SEQ ID NO: 3961466 - RNA, 13 nt, Human herpesvirus 2
ggcguuuggccaa

SEQ ID NO: 3961467 - RNA, 19 nt, Human herpesvirus 2
ggcuccaaacgccuccgga

SEQ ID NO: 3961468 - RNA, 17 nt, Human herpesvirus 2
ggcucccccgcggccuu

SEQ ID NO: 3961469 - RNA, 21 nt, Human herpesvirus 2
ggcuccuagccccccccccuc

SEQ ID NO: 3961470 - RNA, 22 nt, Human herpesvirus 2
ggcucucgccuccuuguggugg

SEQ ID NO: 3961471 - RNA, 13 nt, Human herpesvirus 2
ggcugcgggcgug

SEQ ID NO: 3961472 - RNA, 15 nt, Human herpesvirus 2
ggcuggagcucugcc

SEQ ID NO: 3961473 - RNA, 15 nt, Human herpesvirus 2
ggcuggcggcgcggc

SEQ ID NO: 3961474 - RNA, 15 nt, Human herpesvirus 2
ggcuucgggccaaca

SEQ ID NO: 3961475 - RNA, 21 nt, Human herpesvirus 2
ggcuucuucuuccccagcuuu

SEQ ID NO: 3961476 - RNA, 19 nt, Human herpesvirus 2
ggcuuugguguuuuuggca

SEQ ID NO: 3961477 - RNA, 21 nt, Human herpesvirus 2
gggaaggaaaugggggcgggg

SEQ ID NO: 3961478 - RNA, 18 nt, Human herpesvirus 2
gggaaucucgggucgccc

SEQ ID NO: 3961479 - RNA, 13 nt, Human herpesvirus 2
gggacgcgagccu

SEQ ID NO: 3961480 - RNA, 9 nt, Human herpesvirus 2
gggacggcg

SEQ ID NO: 3961481 - RNA, 16 nt, Human herpesvirus 2
gggagagggggaagga

SEQ ID NO: 3961482 - RNA, 21 nt, Human herpesvirus 2
gggagauggggagagggggaa

SEQ ID NO: 3961483 - RNA, 22 nt, Human herpesvirus 2
gggagccacucccgcggccccc

SEQ ID NO: 3961484 - RNA, 15 nt, Human herpesvirus 2
gggagggcagggccg

SEQ ID NO: 3961485 - RNA, 23 nt, Human herpesvirus 2
gggagucgggccccuacucgcca

SEQ ID NO: 3961486 - RNA, 20 nt, Human herpesvirus 2
gggagugggggggggggacg

SEQ ID NO: 3961487 - RNA, 12 nt, Human herpesvirus 2
gggaucagcaac

SEQ ID NO: 3961488 - RNA, 13 nt, Human herpesvirus 2
gggcagugcagua

SEQ ID NO: 3961489 - RNA, 16 nt, Human herpesvirus 2
gggcauggacccccca

SEQ ID NO: 3961490 - RNA, 12 nt, Human herpesvirus 2
gggcccaggucc

SEQ ID NO: 3961491 - RNA, 13 nt, Human herpesvirus 2
gggccccagggcu

SEQ ID NO: 3961492 - RNA, 16 nt, Human herpesvirus 2
gggcccgaagccgacc

SEQ ID NO: 3961493 - RNA, 17 nt, Human herpesvirus 2
gggccgacgugccgggg

SEQ ID NO: 3961494 - RNA, 14 nt, Human herpesvirus 2
gggccguggggccc

SEQ ID NO: 3961495 - RNA, 17 nt, Human herpesvirus 2
gggccguucggcaggcc

SEQ ID NO: 3961496 - RNA, 19 nt, Human herpesvirus 2
gggccuuuuuucggacggu

SEQ ID NO: 3961497 - RNA, 17 nt, Human herpesvirus 2
gggcgcgcggcgcgagc

SEQ ID NO: 3961498 - RNA, 14 nt, Human herpesvirus 2
gggcgcugagggcg

SEQ ID NO: 3961499 - RNA, 22 nt, Human herpesvirus 2
gggcguccugcggcagcgcgcc

SEQ ID NO: 3961500 - RNA, 14 nt, Human herpesvirus 2
gggcgugcugugcc

SEQ ID NO: 3961501 - RNA, 14 nt, Human herpesvirus 2
gggcguugccgggg

SEQ ID NO: 3961502 - RNA, 15 nt, Human herpesvirus 2
gggcguugccggggg

SEQ ID NO: 3961503 - RNA, 19 nt, Human herpesvirus 2
gggcucgccagcgacccgc

SEQ ID NO: 3961504 - RNA, 15 nt, Human herpesvirus 2
gggcucguccccugg

SEQ ID NO: 3961505 - RNA, 18 nt, Human herpesvirus 2
gggcuucguggaagagga

SEQ ID NO: 3961506 - RNA, 22 nt, Human herpesvirus 2
gggcuucguggaagaggaccug

SEQ ID NO: 3961507 - RNA, 13 nt, Human herpesvirus 2
ggggaaagaaaga

SEQ ID NO: 3961508 - RNA, 18 nt, Human herpesvirus 2
ggggaaagcuggcgucgg

SEQ ID NO: 3961509 - RNA, 23 nt, Human herpesvirus 2
ggggacccgacccuguggcgggc

SEQ ID NO: 3961510 - RNA, 21 nt, Human herpesvirus 2
ggggacccgccagagacccug

SEQ ID NO: 3961511 - RNA, 21 nt, Human herpesvirus 2
ggggacgaggcccaccccccc

SEQ ID NO: 3961512 - RNA, 21 nt, Human herpesvirus 2
ggggacuccccucuaccccca

SEQ ID NO: 3961513 - RNA, 23 nt, Human herpesvirus 2
ggggagcuucauuuugugggggc

SEQ ID NO: 3961514 - RNA, 13 nt, Human herpesvirus 2
ggggagggcggca

SEQ ID NO: 3961515 - RNA, 14 nt, Human herpesvirus 2
ggggagggcggcac

SEQ ID NO: 3961516 - RNA, 16 nt, Human herpesvirus 2
ggggaugguggugggc

SEQ ID NO: 3961517 - RNA, 18 nt, Human herpesvirus 2
ggggcaccggcaccggga

SEQ ID NO: 3961518 - RNA, 13 nt, Human herpesvirus 2
ggggcagugcagu

SEQ ID NO: 3961519 - RNA, 14 nt, Human herpesvirus 2
ggggcagugcagua

SEQ ID NO: 3961520 - RNA, 13 nt, Human herpesvirus 2
ggggcauggaccc

SEQ ID NO: 3961521 - RNA, 21 nt, Human herpesvirus 2
ggggccccaguaccggcgcgc

SEQ ID NO: 3961522 - RNA, 14 nt, Human herpesvirus 2
ggggccccggcccg

SEQ ID NO: 3961523 - RNA, 11 nt, Human herpesvirus 2
ggggcgccccc

SEQ ID NO: 3961524 - RNA, 13 nt, Human herpesvirus 2
ggggcgccccccc

SEQ ID NO: 3961525 - RNA, 19 nt, Human herpesvirus 2
ggggcgcgcaccgcugucc

SEQ ID NO: 3961526 - RNA, 21 nt, Human herpesvirus 2
ggggcgugccuguuguuuugg

SEQ ID NO: 3961527 - RNA, 20 nt, Human herpesvirus 2
ggggcgugugacuagaaaaa

SEQ ID NO: 3961528 - RNA, 21 nt, Human herpesvirus 2
ggggcugcgggcgugucgucc

SEQ ID NO: 3961529 - RNA, 14 nt, Human herpesvirus 2
ggggcugguuuugc

SEQ ID NO: 3961530 - RNA, 16 nt, Human herpesvirus 2
gggggaucucgaacac

SEQ ID NO: 3961531 - RNA, 19 nt, Human herpesvirus 2
gggggaugguggugggccu

SEQ ID NO: 3961532 - RNA, 18 nt, Human herpesvirus 2
gggggcgggggugccgug

SEQ ID NO: 3961533 - RNA, 14 nt, Human herpesvirus 2
gggggcuaggagcc

SEQ ID NO: 3961534 - RNA, 16 nt, Human herpesvirus 2
guugacgacggccccg

SEQ ID NO: 3961535 - RNA, 18 nt, Human herpesvirus 2
guugcgcuuuccggcccu

SEQ ID NO: 3961536 - RNA, 15 nt, Human herpesvirus 2
guuggaagaggcgga

SEQ ID NO: 3961537 - RNA, 22 nt, Human herpesvirus 2
guugguucguccgaccugcagg

SEQ ID NO: 3961538 - RNA, 18 nt, Human herpesvirus 2
guuguaguuguccgcggg

SEQ ID NO: 3961539 - RNA, 20 nt, Human herpesvirus 2
guuuccccggcccaccccca

SEQ ID NO: 3961540 - RNA, 13 nt, Human herpesvirus 2
guuucgccccacg

SEQ ID NO: 3961541 - RNA, 20 nt, Human herpesvirus 2
guuucucuuucuuucccccc

SEQ ID NO: 3961542 - RNA, 20 nt, Human herpesvirus 2
guuugagcagccgcgccgcu

SEQ ID NO: 3961543 - RNA, 11 nt, Human herpesvirus 2
guuuggggcau

SEQ ID NO: 3961544 - RNA, 19 nt, Human herpesvirus 2
guuuggggcggcacugggg

SEQ ID NO: 3961545 - RNA, 17 nt, Human herpesvirus 2
uaaccgcgagcgccgcu

SEQ ID NO: 3961546 - RNA, 18 nt, Human herpesvirus 2
uaaccgcgcgccuccucg

SEQ ID NO: 3961547 - RNA, 15 nt, Human herpesvirus 2
uacacgacccgccuc

SEQ ID NO: 3961548 - RNA, 19 nt, Human herpesvirus 2
uacacggcaacccccgggc

SEQ ID NO: 3961549 - RNA, 12 nt, Human herpesvirus 2
uacauuucccca

SEQ ID NO: 3961550 - RNA, 13 nt, Human herpesvirus 2
uaccacggggagg

SEQ ID NO: 3961551 - RNA, 23 nt, Human herpesvirus 2
uacguggccggguuuuuggcccu

SEQ ID NO: 3961552 - RNA, 15 nt, Human herpesvirus 2
uacgugugcccgccc

SEQ ID NO: 3961553 - RNA, 14 nt, Human herpesvirus 2
uagaagaaaaccac

SEQ ID NO: 3961554 - RNA, 18 nt, Human herpesvirus 2
uagaaguuacccucuucu

SEQ ID NO: 3961555 - RNA, 20 nt, Human herpesvirus 2
uaggcguugcguuggggcac

SEQ ID NO: 3961556 - RNA, 23 nt, Human herpesvirus 2
uaguccgcgccuccugcucgacc

SEQ ID NO: 3961557 - RNA, 19 nt, Human herpesvirus 2
uaugcguguguuggauccc

SEQ ID NO: 3961558 - RNA, 21 nt, Human herpesvirus 2
uauucaccacacagaaacaca

SEQ ID NO: 3961559 - RNA, 13 nt, Human herpesvirus 2
ucaaacgcggaca

SEQ ID NO: 3961560 - RNA, 15 nt, Human herpesvirus 2
ucaauagauuucccc

SEQ ID NO: 3961561 - RNA, 17 nt, Human herpesvirus 2
ucaccgagccgcugugc

SEQ ID NO: 3961562 - RNA, 22 nt, Human herpesvirus 2
ucaccgagccgcugugccaggu

SEQ ID NO: 3961563 - RNA, 16 nt, Human herpesvirus 2
ucaccgccccagcacc

SEQ ID NO: 3961564 - RNA, 19 nt, Human herpesvirus 2
ucaugucuuuccaccacca

SEQ ID NO: 3961565 - RNA, 22 nt, Human herpesvirus 2
uccacgccguggacgcccccuc

SEQ ID NO: 3961566 - RNA, 18 nt, Human herpesvirus 2
uccagcagcuucccauga

SEQ ID NO: 3961567 - RNA, 22 nt, Human herpesvirus 2
ucccacacucgcgucuggcugu

SEQ ID NO: 3961568 - RNA, 14 nt, Human herpesvirus 2
ucccauuggcccca

SEQ ID NO: 3961569 - RNA, 17 nt, Human herpesvirus 2
uccccagggagccccgg

SEQ ID NO: 3961570 - RNA, 12 nt, Human herpesvirus 2
ucccccccucaa

SEQ ID NO: 3961571 - RNA, 13 nt, Human herpesvirus 2
uccccgccccccc

SEQ ID NO: 3961572 - RNA, 17 nt, Human herpesvirus 2
uccccgcuggagccccu

SEQ ID NO: 3961573 - RNA, 15 nt, Human herpesvirus 2
uccccggcccucucu

SEQ ID NO: 3961574 - RNA, 12 nt, Human herpesvirus 2
uccccugcguaa

SEQ ID NO: 3961575 - RNA, 21 nt, Human herpesvirus 2
ucccgaaaccgcaggcgcgcc

SEQ ID NO: 3961576 - RNA, 20 nt, Human herpesvirus 2
ucccgacgauuagccaccgc

SEQ ID NO: 3961577 - RNA, 15 nt, Human herpesvirus 2
ucccgcacccccgcg

SEQ ID NO: 3961578 - RNA, 15 nt, Human herpesvirus 2
ucccgcagaaccucg

SEQ ID NO: 3961579 - RNA, 19 nt, Human herpesvirus 2
ucccgcucgcgguaauuag

SEQ ID NO: 3961580 - RNA, 15 nt, Human herpesvirus 2
ucccggcccgggccc

SEQ ID NO: 3961581 - RNA, 13 nt, Human herpesvirus 2
ucccguggcccuc

SEQ ID NO: 3961582 - RNA, 18 nt, Human herpesvirus 2
ucccugcggcuggcgcgg

SEQ ID NO: 3961583 - RNA, 19 nt, Human herpesvirus 2
ucccugcggcuggcgcggu

SEQ ID NO: 3961584 - RNA, 17 nt, Human herpesvirus 2
ucccuucuccauuccug

SEQ ID NO: 3961585 - RNA, 14 nt, Human herpesvirus 2
uccgaccugcagga

SEQ ID NO: 3961586 - RNA, 18 nt, Human herpesvirus 2
uccgacgaggccuucccg

SEQ ID NO: 3961587 - RNA, 17 nt, Human herpesvirus 2
uccgacuuccgcauaca

SEQ ID NO: 3961588 - RNA, 22 nt, Human herpesvirus 2
uccggcggccaccccgccgcag

SEQ ID NO: 3961589 - RNA, 13 nt, Human herpesvirus 2
uccggcuggcggc

SEQ ID NO: 3961590 - RNA, 18 nt, Human herpesvirus 2
uccggggguugggucugc

SEQ ID NO: 3961591 - RNA, 23 nt, Human herpesvirus 2
uccgggguuuccccggcccaccc

SEQ ID NO: 3961592 - RNA, 22 nt, Human herpesvirus 2
uccggugugccccacccccgag

SEQ ID NO: 3961593 - RNA, 22 nt, Human herpesvirus 2
uccguguccgcggucuguuugu

SEQ ID NO: 3961594 - RNA, 23 nt, Human herpesvirus 2
uccgugugauguucuuggcgcgc

SEQ ID NO: 3961595 - RNA, 21 nt, Human herpesvirus 2
uccuagccccccccccucacc

SEQ ID NO: 3961596 - RNA, 22 nt, Human herpesvirus 2
uccuauaaacucucccccgcaa

SEQ ID NO: 3961597 - RNA, 19 nt, Human herpesvirus 2
uccugcgcacgacagaccu

SEQ ID NO: 3961598 - RNA, 15 nt, Human herpesvirus 2
uccuugaugguuccg

SEQ ID NO: 3961599 - RNA, 16 nt, Human herpesvirus 2
ucgccaucgugcgcuc

SEQ ID NO: 3961600 - RNA, 20 nt, Human herpesvirus 2
ucgccccacacgccuuccag

SEQ ID NO: 3961601 - RNA, 17 nt, Human herpesvirus 2
ucgcccuaccgcuccga

SEQ ID NO: 3961602 - RNA, 16 nt, Human herpesvirus 2
ucgcccuagaggcugu

SEQ ID NO: 3961603 - RNA, 18 nt, Human herpesvirus 2
ucgccgacuccaggagcu

SEQ ID NO: 3961604 - RNA, 13 nt, Human herpesvirus 2
ucgccggggaccg

SEQ ID NO: 3961605 - RNA, 21 nt, Human herpesvirus 2
ucgccgggugucugcucccca

SEQ ID NO: 3961606 - RNA, 23 nt, Human herpesvirus 2
ucgcggacgagcccguggcccac

SEQ ID NO: 3961607 - RNA, 15 nt, Human herpesvirus 2
ucgcgucgggccaga

SEQ ID NO: 3961608 - RNA, 12 nt, Human herpesvirus 2
ucgcuccccgcg

SEQ ID NO: 3961609 - RNA, 20 nt, Human herpesvirus 2
ucgcuuuccacacccccucc

SEQ ID NO: 3961610 - RNA, 15 nt, Human herpesvirus 2
ucggaauuucacccc

SEQ ID NO: 3961611 - RNA, 23 nt, Human herpesvirus 2
ucggccaccuggaagcugccucc

SEQ ID NO: 3961612 - RNA, 18 nt, Human herpesvirus 2
ucgggagcaggacagccg

SEQ ID NO: 3961613 - RNA, 10 nt, Human herpesvirus 2
ucgggccccu

SEQ ID NO: 3961614 - RNA, 15 nt, Human herpesvirus 2
ucgggcugcugguga

SEQ ID NO: 3961615 - RNA, 17 nt, Human herpesvirus 2
ucggggccagggcuggc

SEQ ID NO: 3961616 - RNA, 15 nt, Human herpesvirus 2
ucgggggccggggcg

SEQ ID NO: 3961617 - RNA, 20 nt, Human herpesvirus 2
ucggugccccccaucucugu

SEQ ID NO: 3961618 - RNA, 20 nt, Human herpesvirus 2
ucggugccgcuuuaccccgc

SEQ ID NO: 3961619 - RNA, 22 nt, Human herpesvirus 2
ucgucgggccgucguuggccag

SEQ ID NO: 3961620 - RNA, 21 nt, Human herpesvirus 2
ucgucuggagcccguacccgg

SEQ ID NO: 3961621 - RNA, 18 nt, Human herpesvirus 2
ucguggcauggaagcccc

SEQ ID NO: 3961622 - RNA, 15 nt, Human herpesvirus 2
ucgugggggagugcg

SEQ ID NO: 3961623 - RNA, 21 nt, Human herpesvirus 2
ucuccgcaauaaacgccuucc

SEQ ID NO: 3961624 - RNA, 16 nt, Human herpesvirus 2
ucucugguuucgggcg

SEQ ID NO: 3961625 - RNA, 12 nt, Human herpesvirus 2
ucugaggccuca

SEQ ID NO: 3961626 - RNA, 13 nt, Human herpesvirus 2
ucugccaggaggg

SEQ ID NO: 3961627 - RNA, 20 nt, Human herpesvirus 2
ucugccccgcgucgggaucc

SEQ ID NO: 3961628 - RNA, 21 nt, Human herpesvirus 2
ucugcuuuuggugcgucuccg

SEQ ID NO: 3961629 - RNA, 21 nt, Human herpesvirus 2
ucuggaggguucggggcacuu

SEQ ID NO: 3961630 - RNA, 11 nt, Human herpesvirus 2
ucuucuucccc

SEQ ID NO: 3961631 - RNA, 15 nt, Human herpesvirus 2
ucuuuccguggcgcc

SEQ ID NO: 3961632 - RNA, 18 nt, Human herpesvirus 2
ucuuucggccaccacccc

SEQ ID NO: 3961633 - RNA, 20 nt, Human herpesvirus 2
ugaacugauugccaucgcgg

SEQ ID NO: 3961634 - RNA, 21 nt, Human herpesvirus 2
ugacgcggcccaaggcgcugc

SEQ ID NO: 3961635 - RNA, 13 nt, Human herpesvirus 2
ugacuccuggguc

SEQ ID NO: 3961636 - RNA, 14 nt, Human herpesvirus 2
ugaggaacuggguu

SEQ ID NO: 3961637 - RNA, 13 nt, Human herpesvirus 2
ugaggaagaaaga

SEQ ID NO: 3961638 - RNA, 17 nt, Human herpesvirus 2
ugaggggaaagcuggcg

SEQ ID NO: 3961639 - RNA, 21 nt, Human herpesvirus 2
ugaggggcaccaaaaaccagg

SEQ ID NO: 3961640 - RNA, 13 nt, Human herpesvirus 2
ugaucccccggaa

SEQ ID NO: 3961641 - RNA, 10 nt, Human herpesvirus 2
ugauccuggc

SEQ ID NO: 3961642 - RNA, 20 nt, Human herpesvirus 2
ugaucuuggcguuauuucca

SEQ ID NO: 3961643 - RNA, 17 nt, Human herpesvirus 2
ugauucucaccuggggc

SEQ ID NO: 3961644 - RNA, 21 nt, Human herpesvirus 2
ugcagcgcgggcgacgggcgg

SEQ ID NO: 3961645 - RNA, 15 nt, Human herpesvirus 2
ugccagguggcccuu

SEQ ID NO: 3961646 - RNA, 17 nt, Human herpesvirus 2
ugccaucgcucgggggu

SEQ ID NO: 3961647 - RNA, 23 nt, Human herpesvirus 2
ugcccccccucguucugcugcac

SEQ ID NO: 3961648 - RNA, 15 nt, Human herpesvirus 2
ugccccccuccuggg

SEQ ID NO: 3961649 - RNA, 19 nt, Human herpesvirus 2
aaaagacaccgauguucaa

SEQ ID NO: 3961650 - RNA, 14 nt, Human herpesvirus 2
aaaaucguuauuau

SEQ ID NO: 3961651 - RNA, 17 nt, Human herpesvirus 2
aaacaggaauggagaag

SEQ ID NO: 3961652 - RNA, 12 nt, Human herpesvirus 2
aaacaggcaccg

SEQ ID NO: 3961653 - RNA, 22 nt, Human herpesvirus 2
aaacaggcaccgcgggaggaag

SEQ ID NO: 3961654 - RNA, 20 nt, Human herpesvirus 2
aaacccgccggggcuucgug

SEQ ID NO: 3961655 - RNA, 22 nt, Human herpesvirus 2
aacagcucgcggacgagcccgu

SEQ ID NO: 3961656 - RNA, 13 nt, Human herpesvirus 2
aacgacugcacuu

SEQ ID NO: 3961657 - RNA, 10 nt, Human herpesvirus 2
aacgcccccu

SEQ ID NO: 3961658 - RNA, 17 nt, Human herpesvirus 2
aacgcgaccgucgccgc

SEQ ID NO: 3961659 - RNA, 23 nt, Human herpesvirus 2
aacgcgcuguggcgcgcccccgc

SEQ ID NO: 3961660 - RNA, 17 nt, Human herpesvirus 2
aacgcgggcguccccga

SEQ ID NO: 3961661 - RNA, 16 nt, Human herpesvirus 2
aacuaggacaguucau

SEQ ID NO: 3961662 - RNA, 23 nt, Human herpesvirus 2
aacuggguuacugcacuugcccc

SEQ ID NO: 3961663 - RNA, 23 nt, Human herpesvirus 2
aagccacccugggucgggagcag

SEQ ID NO: 3961664 - RNA, 23 nt, Human herpesvirus 2
aaggcaggggcagcucgcccccg

SEQ ID NO: 3961665 - RNA, 23 nt, Human herpesvirus 2
aaggcauuguugucguguggugu

SEQ ID NO: 3961666 - RNA, 22 nt, Human herpesvirus 2
aaggggguagugucggagaggc

SEQ ID NO: 3961667 - RNA, 14 nt, Human herpesvirus 2
aauacaccagagcc

SEQ ID NO: 3961668 - RNA, 13 nt, Human herpesvirus 2
aauuccagcagcu

SEQ ID NO: 3961669 - RNA, 14 nt, Human herpesvirus 2
aauugaaaucgcuu

SEQ ID NO: 3961670 - RNA, 14 nt, Human herpesvirus 2
aauuuuugugucau

SEQ ID NO: 3961671 - RNA, 17 nt, Human herpesvirus 2
acaaaaaugggacgcac

SEQ ID NO: 3961672 - RNA, 13 nt, Human herpesvirus 2
acacacacacagg

SEQ ID NO: 3961673 - RNA, 17 nt, Human herpesvirus 2
acacaccccccuucucc

SEQ ID NO: 3961674 - RNA, 15 nt, Human herpesvirus 2
acacacccccugucc

SEQ ID NO: 3961675 - RNA, 17 nt, Human herpesvirus 2
acacaccgggcuggggg

SEQ ID NO: 3961676 - RNA, 14 nt, Human herpesvirus 2
acacagacuggccg

SEQ ID NO: 3961677 - RNA, 20 nt, Human herpesvirus 2
acaccagacggcgggacccc

SEQ ID NO: 3961678 - RNA, 21 nt, Human herpesvirus 2
acaccagcagcuugcggggcu

SEQ ID NO: 3961679 - RNA, 22 nt, Human herpesvirus 2
acacccccuguccccgcccccc

SEQ ID NO: 3961680 - RNA, 18 nt, Human herpesvirus 2
acacgccugcccccgccu

SEQ ID NO: 3961681 - RNA, 13 nt, Human herpesvirus 2
acagcaacacaca

SEQ ID NO: 3961682 - RNA, 19 nt, Human herpesvirus 2
acagccccuggggcugucg

SEQ ID NO: 3961683 - RNA, 22 nt, Human herpesvirus 2
acaggccaucgccggggaccgc

SEQ ID NO: 3961684 - RNA, 14 nt, Human herpesvirus 2
acauuccccucucg

SEQ ID NO: 3961685 - RNA, 19 nt, Human herpesvirus 2
accacggucugguggcgcu

SEQ ID NO: 3961686 - RNA, 21 nt, Human herpesvirus 2
accaggucuuuccguggcgcc

SEQ ID NO: 3961687 - RNA, 22 nt, Human herpesvirus 2
accaggucuuuccguggcgccu

SEQ ID NO: 3961688 - RNA, 14 nt, Human herpesvirus 2
acccacacacaccc

SEQ ID NO: 3961689 - RNA, 15 nt, Human herpesvirus 2
accccaccuucgccu

SEQ ID NO: 3961690 - RNA, 16 nt, Human herpesvirus 2
acccccaucgggcugc

SEQ ID NO: 3961691 - RNA, 12 nt, Human herpesvirus 2
acccccccgccg

SEQ ID NO: 3961692 - RNA, 18 nt, Human herpesvirus 2
accccccuucccccuccu

SEQ ID NO: 3961693 - RNA, 18 nt, Human herpesvirus 2
acccccgggggggggcaa

SEQ ID NO: 3961694 - RNA, 13 nt, Human herpesvirus 2
acccccuccccgu

SEQ ID NO: 3961695 - RNA, 21 nt, Human herpesvirus 2
accccuaccugcgcgugcaga

SEQ ID NO: 3961696 - RNA, 17 nt, Human herpesvirus 2
acccgacaacagccccu

SEQ ID NO: 3961697 - RNA, 20 nt, Human herpesvirus 2
acccgccuaccagccccucg

SEQ ID NO: 3961698 - RNA, 19 nt, Human herpesvirus 2
acccgggcgagcuggcccu

SEQ ID NO: 3961699 - RNA, 20 nt, Human herpesvirus 2
acccucaccccaccccaucc

SEQ ID NO: 3961700 - RNA, 20 nt, Human herpesvirus 2
accgcacccgggccggguga

SEQ ID NO: 3961701 - RNA, 18 nt, Human herpesvirus 2
accgcaccggacgcgcac

SEQ ID NO: 3961702 - RNA, 21 nt, Human herpesvirus 2
accgcagucuggucgaggugg

SEQ ID NO: 3961703 - RNA, 21 nt, Human herpesvirus 2
accgccucuguuccuuucccu

SEQ ID NO: 3961704 - RNA, 14 nt, Human herpesvirus 2
accgcgcgccgccg

SEQ ID NO: 3961705 - RNA, 21 nt, Human herpesvirus 2
accgcgcgccgccgcgcgggc

SEQ ID NO: 3961706 - RNA, 12 nt, Human herpesvirus 2
accggggcggcg

SEQ ID NO: 3961707 - RNA, 20 nt, Human herpesvirus 2
accggucgcuuuccacaccc

SEQ ID NO: 3961708 - RNA, 21 nt, Human herpesvirus 2
accguggccgacaacugccug

SEQ ID NO: 3961709 - RNA, 21 nt, Human herpesvirus 2
accucgucgcgcgcaucgcca

SEQ ID NO: 3961710 - RNA, 22 nt, Human herpesvirus 2
accugccguaugcuaauuaaau

SEQ ID NO: 3961711 - RNA, 18 nt, Human herpesvirus 2
accuguuuuuacgggccc

SEQ ID NO: 3961712 - RNA, 21 nt, Human herpesvirus 2
acgacagcggggacccgggcg

SEQ ID NO: 3961713 - RNA, 18 nt, Human herpesvirus 2
acgaccaucgcguacagc

SEQ ID NO: 3961714 - RNA, 23 nt, Human herpesvirus 2
acgacccccgaacagccccuggg

SEQ ID NO: 3961715 - RNA, 17 nt, Human herpesvirus 2
acgacccgccucgggcc

SEQ ID NO: 3961716 - RNA, 17 nt, Human herpesvirus 2
acgagaagccgccccca

SEQ ID NO: 3961717 - RNA, 20 nt, Human herpesvirus 2
acgagccaaaccagccccgc

SEQ ID NO: 3961718 - RNA, 15 nt, Human herpesvirus 2
acgagcgcgcugccg

SEQ ID NO: 3961719 - RNA, 24 nt, Human herpesvirus 2
acgaggccgccaacgacuuccucg

SEQ ID NO: 3961720 - RNA, 20 nt, Human herpesvirus 2
acgaugggagccccgcguau

SEQ ID NO: 3961721 - RNA, 14 nt, Human herpesvirus 2
acgccagcugcugg

SEQ ID NO: 3961722 - RNA, 21 nt, Human herpesvirus 2
acgccgcggccauccugccca

SEQ ID NO: 3961723 - RNA, 19 nt, Human herpesvirus 2
acgcgcacguggggccucu

SEQ ID NO: 3961724 - RNA, 19 nt, Human herpesvirus 2
acgcgcgcaggcuggagcu

SEQ ID NO: 3961725 - RNA, 15 nt, Human herpesvirus 2
acgcgcgcgcccccg

SEQ ID NO: 3961726 - RNA, 21 nt, Human herpesvirus 2
acgcgcuguggcgcgcccccg

SEQ ID NO: 3961727 - RNA, 22 nt, Human herpesvirus 2
acgcgggcguccccgagcggcg

SEQ ID NO: 3961728 - RNA, 20 nt, Human herpesvirus 2
acgcgucgggggccggggcg

SEQ ID NO: 3961729 - RNA, 22 nt, Human herpesvirus 2
acggacaaccgagcgccgggca

SEQ ID NO: 3961730 - RNA, 20 nt, Human herpesvirus 2
acggacacccccccccaucu

SEQ ID NO: 3961731 - RNA, 15 nt, Human herpesvirus 2
acggccaggaugggu

SEQ ID NO: 3961732 - RNA, 15 nt, Human herpesvirus 2
acggccucgugcucg

SEQ ID NO: 3961733 - RNA, 15 nt, Human herpesvirus 2
acggcgucucccggg

SEQ ID NO: 3961734 - RNA, 17 nt, Human herpesvirus 2
acgggggucccgccucc

SEQ ID NO: 3961735 - RNA, 13 nt, Human herpesvirus 2
acgguccucaccg

SEQ ID NO: 3961736 - RNA, 17 nt, Human herpesvirus 2
acggucgccacucuccu

SEQ ID NO: 3961737 - RNA, 17 nt, Human herpesvirus 2
acgucacgcaggccgcc

SEQ ID NO: 3961738 - RNA, 15 nt, Human herpesvirus 2
acguccaccuuggcc

SEQ ID NO: 3961739 - RNA, 17 nt, Human herpesvirus 2
acgucgcaugcaaauua

SEQ ID NO: 3961740 - RNA, 18 nt, Human herpesvirus 2
acgugcacagccuggccg

SEQ ID NO: 3961741 - RNA, 15 nt, Human herpesvirus 2
acgugcgucuuccca

SEQ ID NO: 3961742 - RNA, 13 nt, Human herpesvirus 2
acgugugcccgcc

SEQ ID NO: 3961743 - RNA, 19 nt, Human herpesvirus 2
acguucggacggccccucg

SEQ ID NO: 3961744 - RNA, 19 nt, Human herpesvirus 2
acuacucggaaagcgaaga

SEQ ID NO: 3961745 - RNA, 14 nt, Human herpesvirus 2
acuagaaaaacaaa

SEQ ID NO: 3961746 - RNA, 22 nt, Human herpesvirus 2
acuauccuugccucguggggcu

SEQ ID NO: 3961747 - RNA, 22 nt, Human herpesvirus 2
acucccuccguguccgcggucu

SEQ ID NO: 3961748 - RNA, 20 nt, Human herpesvirus 2
acucuccugcgagcccucac

SEQ ID NO: 3961749 - RNA, 20 nt, Human herpesvirus 2
acugcacugccccccuccug

SEQ ID NO: 3961750 - RNA, 13 nt, Human herpesvirus 2
acugcacuugccc

SEQ ID NO: 3961751 - RNA, 23 nt, Human herpesvirus 2
acugcacuugcccccccccgggg

SEQ ID NO: 3961752 - RNA, 15 nt, Human herpesvirus 2
acugccuccacgccc

SEQ ID NO: 3961753 - RNA, 17 nt, Human herpesvirus 2
acuggcagccgggacga

SEQ ID NO: 3961754 - RNA, 23 nt, Human herpesvirus 2
acuuccuauaaacucucccccgc

SEQ ID NO: 3961755 - RNA, 15 nt, Human herpesvirus 2
acuuggacuccgcau

SEQ ID NO: 3961756 - RNA, 14 nt, Human herpesvirus 2
agaaauaaagaacg

SEQ ID NO: 3961757 - RNA, 23 nt, Human herpesvirus 2
agaacggacaaccgagcgccggg

SEQ ID NO: 3961758 - RNA, 19 nt, Human herpesvirus 2
agacacggugcgugcggcc

SEQ ID NO: 3961759 - RNA, 20 nt, Human herpesvirus 2
agacauggggaacccccaga

SEQ ID NO: 3961760 - RNA, 19 nt, Human herpesvirus 2
agaccaccucgcggcggcu

SEQ ID NO: 3961761 - RNA, 20 nt, Human herpesvirus 2
agacgcccgcgagccgcaca

SEQ ID NO: 3961762 - RNA, 20 nt, Human herpesvirus 2
agagaaaaagaaaaaaggag

SEQ ID NO: 3961763 - RNA, 19 nt, Human herpesvirus 2
agagacgaugggagccccg

SEQ ID NO: 3961764 - RNA, 16 nt, Human herpesvirus 2
agagcgggcccggggc

SEQ ID NO: 3961765 - RNA, 17 nt, Human herpesvirus 2
agaggcccggaacgagg

SEQ ID NO: 3961766 - RNA, 19 nt, Human herpesvirus 2
agagggggggaaagaaaga

SEQ ID NO: 3961767 - RNA, 14 nt, Human herpesvirus 2
agauggggagaggg

SEQ ID NO: 3961768 - RNA, 22 nt, Human herpesvirus 2
agauggggagagggggaaggaa

SEQ ID NO: 3961769 - RNA, 23 nt, Human herpesvirus 2
agcacggaggaacugggguacug

SEQ ID NO: 3961770 - RNA, 19 nt, Human herpesvirus 2
agccaccgucccgcccgcc

SEQ ID NO: 3961771 - RNA, 20 nt, Human herpesvirus 2
agccagggucggacaggagg

SEQ ID NO: 3961772 - RNA, 18 nt, Human herpesvirus 2
agccccccccccucaccc

SEQ ID NO: 3961773 - RNA, 20 nt, Human herpesvirus 2
agccccccccccucaccccu

SEQ ID NO: 3961774 - RNA, 13 nt, Human herpesvirus 2
agccccuggggcu

SEQ ID NO: 3961775 - RNA, 22 nt, Human herpesvirus 2
agccgacccgucuagcggccgg

SEQ ID NO: 3961776 - RNA, 21 nt, Human herpesvirus 2
agccuaucuugaucccccgga

SEQ ID NO: 3961777 - RNA, 23 nt, Human herpesvirus 2
agccuccgaggugcggagccucu

SEQ ID NO: 3961778 - RNA, 17 nt, Human herpesvirus 2
agcgccccgcggacccc

SEQ ID NO: 3961779 - RNA, 15 nt, Human herpesvirus 2
agcgcggccgugggc

SEQ ID NO: 3961780 - RNA, 13 nt, Human herpesvirus 2
agcggcgagugcu

SEQ ID NO: 3961781 - RNA, 21 nt, Human herpesvirus 2
agcgggggaggggggagaugg

SEQ ID NO: 3961782 - RNA, 17 nt, Human herpesvirus 2
agcguccggcuggcggc

SEQ ID NO: 3961783 - RNA, 12 nt, Human herpesvirus 2
agcguggggcgc

SEQ ID NO: 3961784 - RNA, 15 nt, Human herpesvirus 2
agcuaaggcgcccgc

SEQ ID NO: 3961785 - RNA, 23 nt, Human herpesvirus 2
agcucgcggacgagcccguggcc

SEQ ID NO: 3961786 - RNA, 13 nt, Human herpesvirus 2
agcucgggggcca

SEQ ID NO: 3961787 - RNA, 13 nt, Human herpesvirus 2
agcucugccugca

SEQ ID NO: 3961788 - RNA, 15 nt, Human herpesvirus 2
agcugcucgcgcacc

SEQ ID NO: 3961789 - RNA, 17 nt, Human herpesvirus 2
agcugcuggccaaacau

SEQ ID NO: 3961790 - RNA, 14 nt, Human herpesvirus 2
aggaaacgcaaaaa

SEQ ID NO: 3961791 - RNA, 13 nt, Human herpesvirus 2
aggaacagaggcg

SEQ ID NO: 3961792 - RNA, 21 nt, Human herpesvirus 2
aggaacccaauggccgcuccu

SEQ ID NO: 3961793 - RNA, 21 nt, Human herpesvirus 2
aggaacugggguacugcacug

SEQ ID NO: 3961794 - RNA, 22 nt, Human herpesvirus 2
aggaggcggcgccugcgccccg

SEQ ID NO: 3961795 - RNA, 12 nt, Human herpesvirus 2
aggagggcgggc

SEQ ID NO: 3961796 - RNA, 20 nt, Human herpesvirus 2
aggaggggggcagugcagua

SEQ ID NO: 3961797 - RNA, 12 nt, Human herpesvirus 2
aggcacggcgcc

SEQ ID NO: 3961798 - RNA, 14 nt, Human herpesvirus 2
aggcccggcccgcg

SEQ ID NO: 3961799 - RNA, 21 nt, Human herpesvirus 2
aggcccuggcgcaccugcaga

SEQ ID NO: 3961800 - RNA, 16 nt, Human herpesvirus 2
aggccucauccggccc

SEQ ID NO: 3961801 - RNA, 13 nt, Human herpesvirus 2
aggcgaccccgcc

SEQ ID NO: 3961802 - RNA, 23 nt, Human herpesvirus 2
aggcgcauaaagguccggcggcc

SEQ ID NO: 3961803 - RNA, 14 nt, Human herpesvirus 2
aggcgcugcgccug

SEQ ID NO: 3961804 - RNA, 13 nt, Human herpesvirus 2
aggcgcugcugcg

SEQ ID NO: 3961805 - RNA, 15 nt, Human herpesvirus 2
aggcuucccccccgc

SEQ ID NO: 3961806 - RNA, 17 nt, Human herpesvirus 2
aggcuucccccccgcca

SEQ ID NO: 3961807 - RNA, 23 nt, Human herpesvirus 2
agggccuggcgauccugggccug

SEQ ID NO: 3961808 - RNA, 15 nt, Human herpesvirus 2
agggcgagcucggcu

SEQ ID NO: 3961809 - RNA, 23 nt, Human herpesvirus 2
agggcggccucggccggcggagc

SEQ ID NO: 3961810 - RNA, 17 nt, Human herpesvirus 2
agggcuucguggaagag

SEQ ID NO: 3961811 - RNA, 15 nt, Human herpesvirus 2
aggggggcagugcag

SEQ ID NO: 3961812 - RNA, 19 nt, Human herpesvirus 2
aggggggcuuggacuggga

SEQ ID NO: 3961813 - RNA, 14 nt, Human herpesvirus 2
aggggugggcgugu

SEQ ID NO: 3961814 - RNA, 14 nt, Human herpesvirus 2
aggucaauagauuu

SEQ ID NO: 3961815 - RNA, 19 nt, Human herpesvirus 2
aggucugcgcgaggccgcu

SEQ ID NO: 3961816 - RNA, 21 nt, Human herpesvirus 2
aggucugcgcgaggccgcucu

SEQ ID NO: 3961817 - RNA, 16 nt, Human herpesvirus 2
aggugcaguugauucg

SEQ ID NO: 3961818 - RNA, 12 nt, Human herpesvirus 2
aggugcggagcc

SEQ ID NO: 3961819 - RNA, 13 nt, Human herpesvirus 2
aguaacccaguuc

SEQ ID NO: 3961820 - RNA, 14 nt, Human herpesvirus 2
aguaacccaguucc

SEQ ID NO: 3961821 - RNA, 21 nt, Human herpesvirus 2
agucacgcccccugaguugcg

SEQ ID NO: 3961822 - RNA, 20 nt, Human herpesvirus 2
aguccucggggacgcacggc

SEQ ID NO: 3961823 - RNA, 18 nt, Human herpesvirus 2
agucgcccauacaaauua

SEQ ID NO: 3961824 - RNA, 13 nt, Human herpesvirus 2
aguuugagcagcc

SEQ ID NO: 3961825 - RNA, 11 nt, Human herpesvirus 2
auaaaagccaa

SEQ ID NO: 3961826 - RNA, 23 nt, Human herpesvirus 2
auaacuuugguugucgccacacg

SEQ ID NO: 3961827 - RNA, 20 nt, Human herpesvirus 2
auaccggucgaucucggcgu

SEQ ID NO: 3961828 - RNA, 13 nt, Human herpesvirus 2
auauaaggcaggg

SEQ ID NO: 3961829 - RNA, 20 nt, Human herpesvirus 2
auaugcggaucgcgagcucc

SEQ ID NO: 3961830 - RNA, 21 nt, Human herpesvirus 2
aucacaguuccguuggggaac

SEQ ID NO: 3961831 - RNA, 12 nt, Human herpesvirus 2
aucauuucuguc

SEQ ID NO: 3961832 - RNA, 17 nt, Human herpesvirus 2
auccguggguuagaaaa

SEQ ID NO: 3961833 - RNA, 11 nt, Human herpesvirus 2
aucggaccccc

SEQ ID NO: 3961834 - RNA, 15 nt, Human herpesvirus 2
aucucaucaaacacg

SEQ ID NO: 3961835 - RNA, 17 nt, Human herpesvirus 2
aucucuggcuccaggcc

SEQ ID NO: 3961836 - RNA, 20 nt, Human herpesvirus 2
augcacguaaaacacgggcg

SEQ ID NO: 3961837 - RNA, 14 nt, Human herpesvirus 2
augcgacgccgccc

SEQ ID NO: 3961838 - RNA, 18 nt, Human herpesvirus 2
augcgacgccgccccugc

SEQ ID NO: 3961839 - RNA, 15 nt, Human herpesvirus 2
augcggggcgggguu

SEQ ID NO: 3961840 - RNA, 21 nt, Human herpesvirus 2
auggcgccuucuucgccccca

SEQ ID NO: 3961841 - RNA, 14 nt, Human herpesvirus 2
auggcggccgccgc

SEQ ID NO: 3961842 - RNA, 16 nt, Human herpesvirus 2
auggggggggaaagga

SEQ ID NO: 3961843 - RNA, 16 nt, Human herpesvirus 2
auguguucuccuggac

SEQ ID NO: 3961844 - RNA, 23 nt, Human herpesvirus 2
auuaauaaagagugagaaccaac

SEQ ID NO: 3961845 - RNA, 20 nt, Human herpesvirus 2
auuagcagcuuuuaacgggc

SEQ ID NO: 3961846 - RNA, 21 nt, Human herpesvirus 2
auucccgcuuaugguaauuaa

SEQ ID NO: 3961847 - RNA, 19 nt, Human herpesvirus 2
auuccgagggcagguccca

SEQ ID NO: 3961848 - RNA, 16 nt, Human herpesvirus 2
auucgggggucgggcg

SEQ ID NO: 3961849 - RNA, 16 nt, Human herpesvirus 2
auucucaccuggggcu

SEQ ID NO: 3961850 - RNA, 16 nt, Human herpesvirus 2
auugggauaucucaca

SEQ ID NO: 3961851 - RNA, 19 nt, Human herpesvirus 2
auugugggaauccucgggu

SEQ ID NO: 3961852 - RNA, 17 nt, Human herpesvirus 2
auuucuuuguucccucu

SEQ ID NO: 3961853 - RNA, 19 nt, Human herpesvirus 2
auuuuaaauaaacaaacaa

SEQ ID NO: 3961854 - RNA, 22 nt, Human herpesvirus 2
caaccccuaccugcgcgugcag

SEQ ID NO: 3961855 - RNA, 20 nt, Human herpesvirus 2
caacgagcugccccgcgguc

SEQ ID NO: 3961856 - RNA, 20 nt, Human herpesvirus 2
caagcgggcgggguggggag

SEQ ID NO: 3961857 - RNA, 21 nt, Human herpesvirus 2
caaggaacccaauggccgcuc

SEQ ID NO: 3961858 - RNA, 14 nt, Human herpesvirus 2
cacaaacacacggg

SEQ ID NO: 3961859 - RNA, 13 nt, Human herpesvirus 2
cacacacaggccc

SEQ ID NO: 3961860 - RNA, 23 nt, Human herpesvirus 2
cacacggucggugccccccaucu

SEQ ID NO: 3961861 - RNA, 12 nt, Human herpesvirus 2
cacaggcccacc

SEQ ID NO: 3961862 - RNA, 16 nt, Human herpesvirus 2
cacaggcccaccacca

SEQ ID NO: 3961863 - RNA, 15 nt, Human herpesvirus 2
cacaugacuucuggu

SEQ ID NO: 3961864 - RNA, 16 nt, Human herpesvirus 2
caccaacuccgcccuc

SEQ ID NO: 3961865 - RNA, 13 nt, Human herpesvirus 2
caccaccaaccug

SEQ ID NO: 3961866 - RNA, 21 nt, Human herpesvirus 2
caccacguguccccagggagc

SEQ ID NO: 3961867 - RNA, 20 nt, Human herpesvirus 2
caccagacggcgggaccccg

SEQ ID NO: 3961868 - RNA, 23 nt, Human herpesvirus 2
caccagagccgaacgcagguccu

SEQ ID NO: 3961869 - RNA, 18 nt, Human herpesvirus 2
cacccagaugcgccuggu

SEQ ID NO: 3961870 - RNA, 18 nt, Human herpesvirus 2
cacccccaaaccccgguu

SEQ ID NO: 3961871 - RNA, 14 nt, Human herpesvirus 2
cacccccagagggg

SEQ ID NO: 3961872 - RNA, 12 nt, Human herpesvirus 2
caccccccccuc

SEQ ID NO: 3961873 - RNA, 14 nt, Human herpesvirus 2
caccccccuccccu

SEQ ID NO: 3961874 - RNA, 13 nt, Human herpesvirus 2
caccccccugacu

SEQ ID NO: 3961875 - RNA, 15 nt, Human herpesvirus 2
cacccccgcgccgcc

SEQ ID NO: 3961876 - RNA, 12 nt, Human herpesvirus 2
cacccgcccguc

SEQ ID NO: 3961877 - RNA, 14 nt, Human herpesvirus 2
caccgaaggaggaa

SEQ ID NO: 3961878 - RNA, 13 nt, Human herpesvirus 2
caccgcaccacca

SEQ ID NO: 3961879 - RNA, 16 nt, Human herpesvirus 2
caccgcccccgcuggc

SEQ ID NO: 3961880 - RNA, 19 nt, Human herpesvirus 2
caccggaaaauccucggcc

SEQ ID NO: 3961881 - RNA, 18 nt, Human herpesvirus 2
cgguucgcgugcggccag

SEQ ID NO: 3961882 - RNA, 21 nt, Human herpesvirus 2
cgguuggacgaucccgggccc

SEQ ID NO: 3961883 - RNA, 15 nt, Human herpesvirus 2
cgucaacagggcgcu

SEQ ID NO: 3961884 - RNA, 12 nt, Human herpesvirus 2
cguccggcuggc

SEQ ID NO: 3961885 - RNA, 21 nt, Human herpesvirus 2
cguccggcuggcggcgcggca

SEQ ID NO: 3961886 - RNA, 14 nt, Human herpesvirus 2
cgucgcuaucacau

SEQ ID NO: 3961887 - RNA, 10 nt, Human herpesvirus 2
cgucgcuguu

SEQ ID NO: 3961888 - RNA, 20 nt, Human herpesvirus 2
cgucguggcauggaagcccc

SEQ ID NO: 3961889 - RNA, 19 nt, Human herpesvirus 2
cgucugcccguggguggcc

SEQ ID NO: 3961890 - RNA, 17 nt, Human herpesvirus 2
cgugccgcagaccaccu

SEQ ID NO: 3961891 - RNA, 19 nt, Human herpesvirus 2
cgugcuuuuguuccaccgc

SEQ ID NO: 3961892 - RNA, 21 nt, Human herpesvirus 2
cguggaugccggggccguggg

SEQ ID NO: 3961893 - RNA, 19 nt, Human herpesvirus 2
cguggccgacaacugccug

SEQ ID NO: 3961894 - RNA, 22 nt, Human herpesvirus 2
cguggccggguuuuuggcccug

SEQ ID NO: 3961895 - RNA, 17 nt, Human herpesvirus 2
cguggggccccagggcu

SEQ ID NO: 3961896 - RNA, 13 nt, Human herpesvirus 2
cgugguccacccg

SEQ ID NO: 3961897 - RNA, 21 nt, Human herpesvirus 2
cgugguccccgagcagcacgg

SEQ ID NO: 3961898 - RNA, 16 nt, Human herpesvirus 2
cguguccccagggagc

SEQ ID NO: 3961899 - RNA, 17 nt, Human herpesvirus 2
cgugucccucccggcca

SEQ ID NO: 3961900 - RNA, 18 nt, Human herpesvirus 2
cguguuugagucagggac

SEQ ID NO: 3961901 - RNA, 12 nt, Human herpesvirus 2
cguuauuuccaa

SEQ ID NO: 3961902 - RNA, 21 nt, Human herpesvirus 2
cguuauuuccaaacagggccu

SEQ ID NO: 3961903 - RNA, 14 nt, Human herpesvirus 2
cguucccaccgcac

SEQ ID NO: 3961904 - RNA, 16 nt, Human herpesvirus 2
cguucggcaggcccgc

SEQ ID NO: 3961905 - RNA, 12 nt, Human herpesvirus 2
cguucugcugca

SEQ ID NO: 3961906 - RNA, 18 nt, Human herpesvirus 2
cguuugggggcggacgug

SEQ ID NO: 3961907 - RNA, 21 nt, Human herpesvirus 2
cuaaccgcgcgccuccucgcg

SEQ ID NO: 3961908 - RNA, 15 nt, Human herpesvirus 2
cuaaggcgccgacgg

SEQ ID NO: 3961909 - RNA, 22 nt, Human herpesvirus 2
cuaccgcggcuucuucgccgcc

SEQ ID NO: 3961910 - RNA, 20 nt, Human herpesvirus 2
cuacgccccccucggcagcc

SEQ ID NO: 3961911 - RNA, 22 nt, Human herpesvirus 2
cuacugcgccaccguccaccuc

SEQ ID NO: 3961912 - RNA, 20 nt, Human herpesvirus 2
cuagccccccccccucaccc

SEQ ID NO: 3961913 - RNA, 23 nt, Human herpesvirus 2
cuagcggccgggucggcugucca

SEQ ID NO: 3961914 - RNA, 22 nt, Human herpesvirus 2
cuagcucgcggagggcggccag

SEQ ID NO: 3961915 - RNA, 22 nt, Human herpesvirus 2
cuagucuccgaucugccccgac

SEQ ID NO: 3961916 - RNA, 15 nt, Human herpesvirus 2
cuauaaacucucccc

SEQ ID NO: 3961917 - RNA, 12 nt, Human herpesvirus 2
cucaccccaccc

SEQ ID NO: 3961918 - RNA, 15 nt, Human herpesvirus 2
cucaccccaccccau

SEQ ID NO: 3961919 - RNA, 19 nt, Human herpesvirus 2
cucaccuggggcuccugcg

SEQ ID NO: 3961920 - RNA, 19 nt, Human herpesvirus 2
cucaguguuugggaaaucu

SEQ ID NO: 3961921 - RNA, 20 nt, Human herpesvirus 2
cucauaaaaaucgugaguca

SEQ ID NO: 3961922 - RNA, 19 nt, Human herpesvirus 2
cucaucgggacgcccggcc

SEQ ID NO: 3961923 - RNA, 16 nt, Human herpesvirus 2
cuccacccgcccgucu

SEQ ID NO: 3961924 - RNA, 22 nt, Human herpesvirus 2
cuccacgcccugcuguaucugg

SEQ ID NO: 3961925 - RNA, 17 nt, Human herpesvirus 2
cuccagguacugcugca

SEQ ID NO: 3961926 - RNA, 17 nt, Human herpesvirus 2
cucccccgacgucucgg

SEQ ID NO: 3961927 - RNA, 20 nt, Human herpesvirus 2
cuccccuucagccuggacca

SEQ ID NO: 3961928 - RNA, 18 nt, Human herpesvirus 2
cucccgaaaccgcaggcg

SEQ ID NO: 3961929 - RNA, 13 nt, Human herpesvirus 2
cucccgcaccccc

SEQ ID NO: 3961930 - RNA, 13 nt, Human herpesvirus 2
cucccggcuccuc

SEQ ID NO: 3961931 - RNA, 18 nt, Human herpesvirus 2
cucccguguaccucuggg

SEQ ID NO: 3961932 - RNA, 15 nt, Human herpesvirus 2
cucccugcggcuggc

SEQ ID NO: 3961933 - RNA, 22 nt, Human herpesvirus 2
cuccgcagcguaacgcaccccc

SEQ ID NO: 3961934 - RNA, 18 nt, Human herpesvirus 2
cuccgccagcgcccuucc

SEQ ID NO: 3961935 - RNA, 20 nt, Human herpesvirus 2
cuccgcccucgccgucuugg

SEQ ID NO: 3961936 - RNA, 15 nt, Human herpesvirus 2
cuccggucccuuccc

SEQ ID NO: 3961937 - RNA, 17 nt, Human herpesvirus 2
cucgaccagcggcccca

SEQ ID NO: 3961938 - RNA, 18 nt, Human herpesvirus 2
cucgacggagagccggac

SEQ ID NO: 3961939 - RNA, 17 nt, Human herpesvirus 2
cucgccagcgacccgca

SEQ ID NO: 3961940 - RNA, 14 nt, Human herpesvirus 2
cucgcggcaccgcg

SEQ ID NO: 3961941 - RNA, 14 nt, Human herpesvirus 2
cucgcggcggcucc

SEQ ID NO: 3961942 - RNA, 13 nt, Human herpesvirus 2
cucgcgguaauua

SEQ ID NO: 3961943 - RNA, 21 nt, Human herpesvirus 2
cucggccggcggagccccgga

SEQ ID NO: 3961944 - RNA, 17 nt, Human herpesvirus 2
cucgggggccaggaacu

SEQ ID NO: 3961945 - RNA, 14 nt, Human herpesvirus 2
cucggucgacgagg

SEQ ID NO: 3961946 - RNA, 14 nt, Human herpesvirus 2
cucguggggcugga

SEQ ID NO: 3961947 - RNA, 18 nt, Human herpesvirus 2
cucucaaacaaaaacaca

SEQ ID NO: 3961948 - RNA, 22 nt, Human herpesvirus 2
cucuccgcaauaaacgccuucc

SEQ ID NO: 3961949 - RNA, 15 nt, Human herpesvirus 2
cucugccacacgugg

SEQ ID NO: 3961950 - RNA, 16 nt, Human herpesvirus 2
cucuggcguccccagg

SEQ ID NO: 3961951 - RNA, 13 nt, Human herpesvirus 2
cucuggcuccagg

SEQ ID NO: 3961952 - RNA, 17 nt, Human herpesvirus 2
cucuggcuccaggccgc

SEQ ID NO: 3961953 - RNA, 19 nt, Human herpesvirus 2
cugaaccgcuggcuggaga

SEQ ID NO: 3961954 - RNA, 15 nt, Human herpesvirus 2
cugacggaccucggg

SEQ ID NO: 3961955 - RNA, 20 nt, Human herpesvirus 2
cugcacugccccccuccugg

SEQ ID NO: 3961956 - RNA, 20 nt, Human herpesvirus 2
cugcacuugcccccccccgg

SEQ ID NO: 3961957 - RNA, 13 nt, Human herpesvirus 2
cugcacuuuauug

SEQ ID NO: 3961958 - RNA, 15 nt, Human herpesvirus 2
cugcagaugcugccc

SEQ ID NO: 3961959 - RNA, 14 nt, Human herpesvirus 2
cugcagccccgguc

SEQ ID NO: 3961960 - RNA, 23 nt, Human herpesvirus 2
cugcccaccggcuccauccugag

SEQ ID NO: 3961961 - RNA, 19 nt, Human herpesvirus 2
cugcccgcggaccaccggg

SEQ ID NO: 3961962 - RNA, 19 nt, Human herpesvirus 2
cugcgcauggccugcgagg

SEQ ID NO: 3961963 - RNA, 20 nt, Human herpesvirus 2
cugcgccaccggccuggucg

SEQ ID NO: 3961964 - RNA, 20 nt, Human herpesvirus 2
cugcggcagcgcgccgacga

SEQ ID NO: 3961965 - RNA, 12 nt, Human herpesvirus 2
cugcggccgaca

SEQ ID NO: 3961966 - RNA, 19 nt, Human herpesvirus 2
cugcggccgacacggucgg

SEQ ID NO: 3961967 - RNA, 15 nt, Human herpesvirus 2
cugcgucguccaggg

SEQ ID NO: 3961968 - RNA, 19 nt, Human herpesvirus 2
cugcucgcgcaccugcgcg

SEQ ID NO: 3961969 - RNA, 18 nt, Human herpesvirus 2
cugcuuaagcggaacccg

SEQ ID NO: 3961970 - RNA, 20 nt, Human herpesvirus 2
cuggagauccccggggcccg

SEQ ID NO: 3961971 - RNA, 15 nt, Human herpesvirus 2
cuggccccucugcuu

SEQ ID NO: 3961972 - RNA, 19 nt, Human herpesvirus 2
cuggccuugcccccacccc

SEQ ID NO: 3961973 - RNA, 12 nt, Human herpesvirus 2
cuggcgggagcc

SEQ ID NO: 3961974 - RNA, 22 nt, Human herpesvirus 2
cuggcuggagaccgagcucgug

SEQ ID NO: 3961975 - RNA, 22 nt, Human herpesvirus 2
cugggcccgccgaccgcccccc

SEQ ID NO: 3961976 - RNA, 16 nt, Human herpesvirus 2
cugggggauuguggga

SEQ ID NO: 3961977 - RNA, 14 nt, Human herpesvirus 2
cugggucagcucau

SEQ ID NO: 3961978 - RNA, 15 nt, Human herpesvirus 2
cugggucgggagcag

SEQ ID NO: 3961979 - RNA, 20 nt, Human herpesvirus 2
cugggucgggagcaggacag

SEQ ID NO: 3961980 - RNA, 13 nt, Human herpesvirus 2
cugggugucgacc

SEQ ID NO: 3961981 - RNA, 14 nt, Human herpesvirus 2
cuggguuacugcac

SEQ ID NO: 3961982 - RNA, 19 nt, Human herpesvirus 2
cuguccagcgucgucgccc

SEQ ID NO: 3961983 - RNA, 20 nt, Human herpesvirus 2
cugugccagguggcccuucc

SEQ ID NO: 3961984 - RNA, 13 nt, Human herpesvirus 2
cuguggcgggcgc

SEQ ID NO: 3961985 - RNA, 16 nt, Human herpesvirus 2
cuguggguggugaugg

SEQ ID NO: 3961986 - RNA, 15 nt, Human herpesvirus 2
cuguuccuuucccuu

SEQ ID NO: 3961987 - RNA, 17 nt, Human herpesvirus 2
cuguuguuucugggccc

SEQ ID NO: 3961988 - RNA, 13 nt, Human herpesvirus 2
cuuaugguaauua

SEQ ID NO: 3961989 - RNA, 21 nt, Human herpesvirus 2
cuucauuuugugggggcccag

SEQ ID NO: 3961990 - RNA, 14 nt, Human herpesvirus 2
cuucccccgcccac

SEQ ID NO: 3961991 - RNA, 22 nt, Human herpesvirus 2
cuuccggaccccgaccccgagc

SEQ ID NO: 3961992 - RNA, 16 nt, Human herpesvirus 2
cuuccgugccccugga

SEQ ID NO: 3961993 - RNA, 21 nt, Human herpesvirus 2
cuucgaucgacgaacuggggc

SEQ ID NO: 3961994 - RNA, 17 nt, Human herpesvirus 2
cuucgccuccgcccucc

SEQ ID NO: 3961995 - RNA, 16 nt, Human herpesvirus 2
cuucggcggggcaccg

SEQ ID NO: 3961996 - RNA, 17 nt, Human herpesvirus 2
cuucucgccucucuucu

SEQ ID NO: 3961997 - RNA, 14 nt, Human herpesvirus 2
cuucuucgccgccc

SEQ ID NO: 3961998 - RNA, 20 nt, Human herpesvirus 2
cgcgaccaccaaggcccgga

SEQ ID NO: 3961999 - RNA, 17 nt, Human herpesvirus 2
cgcgacccaaggucccg

SEQ ID NO: 3962000 - RNA, 16 nt, Human herpesvirus 2
cgcgacggccccggcc

SEQ ID NO: 3962001 - RNA, 18 nt, Human herpesvirus 2
cgcgaugaccucccggcc

SEQ ID NO: 3962002 - RNA, 22 nt, Human herpesvirus 2
cgcgcaggcuggagcucugccu

SEQ ID NO: 3962003 - RNA, 20 nt, Human herpesvirus 2
cgcgcaucggaccccccauc

SEQ ID NO: 3962004 - RNA, 20 nt, Human herpesvirus 2
cgcgcaucucuggcuccagg

SEQ ID NO: 3962005 - RNA, 19 nt, Human herpesvirus 2
cgcgccaccgcccgcacca

SEQ ID NO: 3962006 - RNA, 21 nt, Human herpesvirus 2
cgcgcccccgacccggggccc

SEQ ID NO: 3962007 - RNA, 22 nt, Human herpesvirus 2
cgcgcgcccccgacccggggcc

SEQ ID NO: 3962008 - RNA, 18 nt, Human herpesvirus 2
cgcgcgguucugacgcgg

SEQ ID NO: 3962009 - RNA, 17 nt, Human herpesvirus 2
cgcgcuggcggaagugc

SEQ ID NO: 3962010 - RNA, 19 nt, Human herpesvirus 2
cgcggacgagcccguggcc

SEQ ID NO: 3962011 - RNA, 15 nt, Human herpesvirus 2
cgcggaguaugaccg

SEQ ID NO: 3962012 - RNA, 13 nt, Human herpesvirus 2
cgcggccccacgg

SEQ ID NO: 3962013 - RNA, 18 nt, Human herpesvirus 2
cgcgggcgacgccgcggc

SEQ ID NO: 3962014 - RNA, 17 nt, Human herpesvirus 2
cgcgggcgacgggcggc

SEQ ID NO: 3962015 - RNA, 16 nt, Human herpesvirus 2
cgcgggggacgggccg

SEQ ID NO: 3962016 - RNA, 17 nt, Human herpesvirus 2
cgcgggggacgggccgc

SEQ ID NO: 3962017 - RNA, 12 nt, Human herpesvirus 2
cgcgggggccgg

SEQ ID NO: 3962018 - RNA, 20 nt, Human herpesvirus 2
cgcggggggcacgggcccgg

SEQ ID NO: 3962019 - RNA, 21 nt, Human herpesvirus 2
cgcggggucgagcgcgccagg

SEQ ID NO: 3962020 - RNA, 18 nt, Human herpesvirus 2
cgcguccagguacccggc

SEQ ID NO: 3962021 - RNA, 15 nt, Human herpesvirus 2
cgcgucgggggccgg

SEQ ID NO: 3962022 - RNA, 17 nt, Human herpesvirus 2
cgcgugcagcgcgggcg

SEQ ID NO: 3962023 - RNA, 17 nt, Human herpesvirus 2
cgcgugccgcagaccac

SEQ ID NO: 3962024 - RNA, 15 nt, Human herpesvirus 2
cgcgugcggccagcc

SEQ ID NO: 3962025 - RNA, 23 nt, Human herpesvirus 2
cgcguugguccgggggcgggcgg

SEQ ID NO: 3962026 - RNA, 21 nt, Human herpesvirus 2
cgcucgcugcagggccuggcg

SEQ ID NO: 3962027 - RNA, 21 nt, Human herpesvirus 2
cgcucuccgugccccugguga

SEQ ID NO: 3962028 - RNA, 15 nt, Human herpesvirus 2
cgcugccggacgcgg

SEQ ID NO: 3962029 - RNA, 18 nt, Human herpesvirus 2
cgcugcgcgcgcaccugc

SEQ ID NO: 3962030 - RNA, 18 nt, Human herpesvirus 2
cgcuuacggcaacaaagg

SEQ ID NO: 3962031 - RNA, 19 nt, Human herpesvirus 2
cgcuuuccacacccccucc

SEQ ID NO: 3962032 - RNA, 16 nt, Human herpesvirus 2
cggaaaauccucggcc

SEQ ID NO: 3962033 - RNA, 19 nt, Human herpesvirus 2
cggaaagccggccccgguc

SEQ ID NO: 3962034 - RNA, 14 nt, Human herpesvirus 2
cggaacgccccggg

SEQ ID NO: 3962035 - RNA, 17 nt, Human herpesvirus 2
cggacagccagggcugg

SEQ ID NO: 3962036 - RNA, 20 nt, Human herpesvirus 2
cggacaggaggcgcagcugg

SEQ ID NO: 3962037 - RNA, 16 nt, Human herpesvirus 2
cggacaucacccacgu

SEQ ID NO: 3962038 - RNA, 16 nt, Human herpesvirus 2
cggacgucggcgauga

SEQ ID NO: 3962039 - RNA, 16 nt, Human herpesvirus 2
cggacuccgccccggc

SEQ ID NO: 3962040 - RNA, 17 nt, Human herpesvirus 2
cggacuccgccccggcg

SEQ ID NO: 3962041 - RNA, 16 nt, Human herpesvirus 2
cggacucggagggaag

SEQ ID NO: 3962042 - RNA, 16 nt, Human herpesvirus 2
cggacugcagccccgg

SEQ ID NO: 3962043 - RNA, 16 nt, Human herpesvirus 2
cggagaggcccgccgc

SEQ ID NO: 3962044 - RNA, 18 nt, Human herpesvirus 2
cggagcggugcagggccu

SEQ ID NO: 3962045 - RNA, 20 nt, Human herpesvirus 2
cggagcucgacgcacagcgg

SEQ ID NO: 3962046 - RNA, 16 nt, Human herpesvirus 2
cggaggaacuggggua

SEQ ID NO: 3962047 - RNA, 14 nt, Human herpesvirus 2
cggaggggcuccuc

SEQ ID NO: 3962048 - RNA, 23 nt, Human herpesvirus 2
cggagucccccggcuccgaguug

SEQ ID NO: 3962049 - RNA, 19 nt, Human herpesvirus 2
cggcaagaccugccccggc

SEQ ID NO: 3962050 - RNA, 18 nt, Human herpesvirus 2
cggcacaccggcggggcg

SEQ ID NO: 3962051 - RNA, 14 nt, Human herpesvirus 2
cggcacugggguga

SEQ ID NO: 3962052 - RNA, 20 nt, Human herpesvirus 2
cggcaggcgacccgccgccc

SEQ ID NO: 3962053 - RNA, 21 nt, Human herpesvirus 2
cggcaucguuuggguggagga

SEQ ID NO: 3962054 - RNA, 16 nt, Human herpesvirus 2
cggccaacgaggacca

SEQ ID NO: 3962055 - RNA, 23 nt, Human herpesvirus 2
cggccaccaccccccuccucccc

SEQ ID NO: 3962056 - RNA, 16 nt, Human herpesvirus 2
cggccacgccacgcug

SEQ ID NO: 3962057 - RNA, 22 nt, Human herpesvirus 2
cggccagcgggggcccgggguu

SEQ ID NO: 3962058 - RNA, 22 nt, Human herpesvirus 2
cggcccaaggcgcugcgccugc

SEQ ID NO: 3962059 - RNA, 12 nt, Human herpesvirus 2
cggcccccggcc

SEQ ID NO: 3962060 - RNA, 21 nt, Human herpesvirus 2
cggccccgccgggucaccggg

SEQ ID NO: 3962061 - RNA, 21 nt, Human herpesvirus 2
cggccccuguuggagccggag

SEQ ID NO: 3962062 - RNA, 21 nt, Human herpesvirus 2
cggcccgauucuuacggcgcg

SEQ ID NO: 3962063 - RNA, 12 nt, Human herpesvirus 2
cggcccuggagc

SEQ ID NO: 3962064 - RNA, 15 nt, Human herpesvirus 2
cggccgaauggcugc

SEQ ID NO: 3962065 - RNA, 22 nt, Human herpesvirus 2
cggccgccuccccgcuggagcc

SEQ ID NO: 3962066 - RNA, 14 nt, Human herpesvirus 2
cggccgggcagagc

SEQ ID NO: 3962067 - RNA, 14 nt, Human herpesvirus 2
cggccuggucgucc

SEQ ID NO: 3962068 - RNA, 16 nt, Human herpesvirus 2
cggccuuucccguggc

SEQ ID NO: 3962069 - RNA, 15 nt, Human herpesvirus 2
cggcgaacacugccu

SEQ ID NO: 3962070 - RNA, 14 nt, Human herpesvirus 2
cggcgaccaccgcg

SEQ ID NO: 3962071 - RNA, 14 nt, Human herpesvirus 2
cggcgagggcggcc

SEQ ID NO: 3962072 - RNA, 15 nt, Human herpesvirus 2
cggcgccgccccgcc

SEQ ID NO: 3962073 - RNA, 17 nt, Human herpesvirus 2
cggcgccgccccgccgc

SEQ ID NO: 3962074 - RNA, 16 nt, Human herpesvirus 2
cggcgcgagcucccug

SEQ ID NO: 3962075 - RNA, 12 nt, Human herpesvirus 2
cggcggccaccc

SEQ ID NO: 3962076 - RNA, 17 nt, Human herpesvirus 2
cggcggccccggcggcc

SEQ ID NO: 3962077 - RNA, 23 nt, Human herpesvirus 2
cggcgggucggguguccccggac

SEQ ID NO: 3962078 - RNA, 16 nt, Human herpesvirus 2
cggcguggccgcgacc

SEQ ID NO: 3962079 - RNA, 15 nt, Human herpesvirus 2
cggcuggcgcggugc

SEQ ID NO: 3962080 - RNA, 22 nt, Human herpesvirus 2
cgggaccacggucugguggcgc

SEQ ID NO: 3962081 - RNA, 14 nt, Human herpesvirus 2
cgggacgcccggcc

SEQ ID NO: 3962082 - RNA, 16 nt, Human herpesvirus 2
cgggaggggcuuggcc

SEQ ID NO: 3962083 - RNA, 16 nt, Human herpesvirus 2
cgggaguuccgacgac

SEQ ID NO: 3962084 - RNA, 17 nt, Human herpesvirus 2
cgggauccuccgccagc

SEQ ID NO: 3962085 - RNA, 12 nt, Human herpesvirus 2
cgggccucccgc

SEQ ID NO: 3962086 - RNA, 17 nt, Human herpesvirus 2
cgggcgaaaaggcccgg

SEQ ID NO: 3962087 - RNA, 19 nt, Human herpesvirus 2
cgggcgaaaaggcccggcc

SEQ ID NO: 3962088 - RNA, 15 nt, Human herpesvirus 2
cgggcgacgccgcgg

SEQ ID NO: 3962089 - RNA, 14 nt, Human herpesvirus 2
cgggcgggggcgcg

SEQ ID NO: 3962090 - RNA, 20 nt, Human herpesvirus 2
cgggcgggggucgggcgggc

SEQ ID NO: 3962091 - RNA, 12 nt, Human herpesvirus 2
cgggcggugccc

SEQ ID NO: 3962092 - RNA, 14 nt, Human herpesvirus 2
cgggcugcugguga

SEQ ID NO: 3962093 - RNA, 11 nt, Human herpesvirus 2
cggggaaacag

SEQ ID NO: 3962094 - RNA, 22 nt, Human herpesvirus 2
cggggaccgcaccggacgcgca

SEQ ID NO: 3962095 - RNA, 13 nt, Human herpesvirus 2
cggggacgcacgg

SEQ ID NO: 3962096 - RNA, 15 nt, Human herpesvirus 2
cggggacuccccucu

SEQ ID NO: 3962097 - RNA, 19 nt, Human herpesvirus 2
cggggaugggggggaaggg

SEQ ID NO: 3962098 - RNA, 14 nt, Human herpesvirus 2
cggggcauggaccc

SEQ ID NO: 3962099 - RNA, 19 nt, Human herpesvirus 2
cggggccguggggccccag

SEQ ID NO: 3962100 - RNA, 20 nt, Human herpesvirus 2
cggggcgcgccucugaccca

SEQ ID NO: 3962101 - RNA, 19 nt, Human herpesvirus 2
cgggggacgggccgcccgg

SEQ ID NO: 3962102 - RNA, 17 nt, Human herpesvirus 2
cgggggaggggggagau

SEQ ID NO: 3962103 - RNA, 14 nt, Human herpesvirus 2
cgggggcugcugcc

SEQ ID NO: 3962104 - RNA, 20 nt, Human herpesvirus 2
cgggggggggcaagugcagu

SEQ ID NO: 3962105 - RNA, 15 nt, Human herpesvirus 2
cgggggucccgccuc

SEQ ID NO: 3962106 - RNA, 15 nt, Human herpesvirus 2
cgggguucugggggu

SEQ ID NO: 3962107 - RNA, 15 nt, Human herpesvirus 2
cggguauaagggcag

SEQ ID NO: 3962108 - RNA, 16 nt, Human herpesvirus 2
cggguauaagggcagc

SEQ ID NO: 3962109 - RNA, 14 nt, Human herpesvirus 2
cgguaugcguggcc

SEQ ID NO: 3962110 - RNA, 12 nt, Human herpesvirus 2
cggucaggacca

SEQ ID NO: 3962111 - RNA, 12 nt, Human herpesvirus 2
cgguggacauga

SEQ ID NO: 3962112 - RNA, 13 nt, Human herpesvirus 2
cgguggacaugag

SEQ ID NO: 3962113 - RNA, 13 nt, Human herpesvirus 2
cgguggggccggc

SEQ ID NO: 3962114 - RNA, 19 nt, Human herpesvirus 2
cgguggggccggcggucgc

SEQ ID NO: 3962115 - RNA, 23 nt, Human herpesvirus 2
uuccuccgugcuggggaaaucuc

SEQ ID NO: 3962116 - RNA, 20 nt, Human herpesvirus 2
uugaccgccgccggggggcg

SEQ ID NO: 3962117 - RNA, 20 nt, Human herpesvirus 2
uugagcggaacgccccgggc

SEQ ID NO: 3962118 - RNA, 20 nt, Human herpesvirus 2
uugaugggcggggggguucg

SEQ ID NO: 3962119 - RNA, 22 nt, Human herpesvirus 2
uugcacaaaaagacgcggcccu

SEQ ID NO: 3962120 - RNA, 22 nt, Human herpesvirus 2
uugcgcgacacgcgcccggggc

SEQ ID NO: 3962121 - RNA, 22 nt, Human herpesvirus 2
uuggccggggagggcagggccg

SEQ ID NO: 3962122 - RNA, 17 nt, Human herpesvirus 2
uuggggauacgggggcg

SEQ ID NO: 3962123 - RNA, 18 nt, Human herpesvirus 2
uugggggggggggaagag

SEQ ID NO: 3962124 - RNA, 15 nt, Human herpesvirus 2
uuggugcgccgccgu

SEQ ID NO: 3962125 - RNA, 21 nt, Human herpesvirus 2
uugucgccggcgacacccacc

SEQ ID NO: 3962126 - RNA, 22 nt, Human herpesvirus 2
uugugcgggaggggcuuggccu

SEQ ID NO: 3962127 - RNA, 17 nt, Human herpesvirus 2
uugugggacugggggcg

SEQ ID NO: 3962128 - RNA, 15 nt, Human herpesvirus 2
uuuccguggcgccug

SEQ ID NO: 3962129 - RNA, 11 nt, Human herpesvirus 2
uuuccuccccu

SEQ ID NO: 3962130 - RNA, 17 nt, Human herpesvirus 2
uuucggcacccguccuc

SEQ ID NO: 3962131 - RNA, 16 nt, Human herpesvirus 2
uuucuggucuuccggg

SEQ ID NO: 3962132 - RNA, 22 nt, Human herpesvirus 2
uuugugaugcuuuugacacacu

SEQ ID NO: 3962133 - RNA, 13 nt, Human herpesvirus 2
uuuucggacggug

SEQ ID NO: 3962134 - RNA, 11 nt, Human herpesvirus 2
uuuuggcccug

SEQ ID NO: 3962135 - RNA, 15 nt, Human herpesvirus 2
guccgacacccgggc

SEQ ID NO: 3962136 - RNA, 13 nt, Human herpesvirus 2
guccgacgaggcc

SEQ ID NO: 3962137 - RNA, 13 nt, Human herpesvirus 2
guccgcggggggc

SEQ ID NO: 3962138 - RNA, 14 nt, Human herpesvirus 2
guccgggggcgggc

SEQ ID NO: 3962139 - RNA, 14 nt, Human herpesvirus 2
guccucaccgagcc

SEQ ID NO: 3962140 - RNA, 14 nt, Human herpesvirus 2
guccucacggccaa

SEQ ID NO: 3962141 - RNA, 16 nt, Human herpesvirus 2
guccucgggccuacgu

SEQ ID NO: 3962142 - RNA, 20 nt, Human herpesvirus 2
gucgcccccaaagucacgcc

SEQ ID NO: 3962143 - RNA, 20 nt, Human herpesvirus 2
gucgcccccgucugucgccu

SEQ ID NO: 3962144 - RNA, 17 nt, Human herpesvirus 2
gucgccggaugcgggcg

SEQ ID NO: 3962145 - RNA, 15 nt, Human herpesvirus 2
gucgccggcgugggu

SEQ ID NO: 3962146 - RNA, 14 nt, Human herpesvirus 2
gucgcgacccugcu

SEQ ID NO: 3962147 - RNA, 19 nt, Human herpesvirus 2
gucgcgggcgggagcggcg

SEQ ID NO: 3962148 - RNA, 21 nt, Human herpesvirus 2
gucgcuccccuucagccugga

SEQ ID NO: 3962149 - RNA, 20 nt, Human herpesvirus 2
gucggacgccagcugcuggc

SEQ ID NO: 3962150 - RNA, 16 nt, Human herpesvirus 2
gucgggcacaggcccg

SEQ ID NO: 3962151 - RNA, 14 nt, Human herpesvirus 2
gucgggcguggggg

SEQ ID NO: 3962152 - RNA, 18 nt, Human herpesvirus 2
gucguccgcggccccacg

SEQ ID NO: 3962153 - RNA, 12 nt, Human herpesvirus 2
gucguuggccag

SEQ ID NO: 3962154 - RNA, 17 nt, Human herpesvirus 2
gucugaccacgagcaca

SEQ ID NO: 3962155 - RNA, 14 nt, Human herpesvirus 2
gucugcgcgaggcc

SEQ ID NO: 3962156 - RNA, 19 nt, Human herpesvirus 2
gucugcguggggacgaggc

SEQ ID NO: 3962157 - RNA, 21 nt, Human herpesvirus 2
gucuggugugacgcgaugggg

SEQ ID NO: 3962158 - RNA, 15 nt, Human herpesvirus 2
gucugucgcgacgcc

SEQ ID NO: 3962159 - RNA, 19 nt, Human herpesvirus 2
gucugucgcgacgccgcgg

SEQ ID NO: 3962160 - RNA, 23 nt, Human herpesvirus 2
gucuuccggggacacgcggcggg

SEQ ID NO: 3962161 - RNA, 15 nt, Human herpesvirus 2
gucuuugggccccgc

SEQ ID NO: 3962162 - RNA, 16 nt, Human herpesvirus 2
gucuuugggccccgcc

SEQ ID NO: 3962163 - RNA, 17 nt, Human herpesvirus 2
gucuuuuuuuuuccugu

SEQ ID NO: 3962164 - RNA, 21 nt, Human herpesvirus 2
gugaaauuccgagaauuucuu

SEQ ID NO: 3962165 - RNA, 17 nt, Human herpesvirus 2
gugaggcguugugcggg

SEQ ID NO: 3962166 - RNA, 16 nt, Human herpesvirus 2
gugauggggguccugg

SEQ ID NO: 3962167 - RNA, 23 nt, Human herpesvirus 2
gugcacguguuugagucagggac

SEQ ID NO: 3962168 - RNA, 13 nt, Human herpesvirus 2
gugccgcacggcc

SEQ ID NO: 3962169 - RNA, 15 nt, Human herpesvirus 2
gugccgucgccgcgc

SEQ ID NO: 3962170 - RNA, 23 nt, Human herpesvirus 2
gugccucacgguccucaccgagc

SEQ ID NO: 3962171 - RNA, 15 nt, Human herpesvirus 2
gugcgccuuuaagac

SEQ ID NO: 3962172 - RNA, 18 nt, Human herpesvirus 2
gugcucgcagcagucgug

SEQ ID NO: 3962173 - RNA, 21 nt, Human herpesvirus 2
gugcugggcgcgagccaggca

SEQ ID NO: 3962174 - RNA, 22 nt, Human herpesvirus 2
gugcuguggcggucggccagca

SEQ ID NO: 3962175 - RNA, 21 nt, Human herpesvirus 2
gugcuuuuacccucaccccac

SEQ ID NO: 3962176 - RNA, 20 nt, Human herpesvirus 2
guggagcgccgggccucccg

SEQ ID NO: 3962177 - RNA, 19 nt, Human herpesvirus 2
guggaugccggggccgugg

SEQ ID NO: 3962178 - RNA, 21 nt, Human herpesvirus 2
guggccggguuuuuggcccug

SEQ ID NO: 3962179 - RNA, 13 nt, Human herpesvirus 2
guggcgcgccccc

SEQ ID NO: 3962180 - RNA, 12 nt, Human herpesvirus 2
guggcuggaggc

SEQ ID NO: 3962181 - RNA, 12 nt, Human herpesvirus 2
gugggggcccag

SEQ ID NO: 3962182 - RNA, 15 nt, Human herpesvirus 2
guggggggguggugg

SEQ ID NO: 3962183 - RNA, 15 nt, Human herpesvirus 2
gugggucucggggcc

SEQ ID NO: 3962184 - RNA, 23 nt, Human herpesvirus 2
guggugauggggguccugguggg

SEQ ID NO: 3962185 - RNA, 22 nt, Human herpesvirus 2
guggugcaguuugagcagccgc

SEQ ID NO: 3962186 - RNA, 21 nt, Human herpesvirus 2
gugguggccgaaagaaaagga

SEQ ID NO: 3962187 - RNA, 20 nt, Human herpesvirus 2
gugucugguuuuucuggggg

SEQ ID NO: 3962188 - RNA, 19 nt, Human herpesvirus 2
guucagcgcaucaggcuca

SEQ ID NO: 3962189 - RNA, 14 nt, Human herpesvirus 2
guuccguagacagc

SEQ ID NO: 3962190 - RNA, 17 nt, Human herpesvirus 2
guucgcgcaucucuggc

SEQ ID NO: 3962191 - RNA, 14 nt, Human herpesvirus 2
guucggaccugggg

SEQ ID NO: 3962192 - RNA, 13 nt, Human herpesvirus 2
guucggggggacg

SEQ ID NO: 3962193 - RNA, 18 nt, Human herpesvirus 2
guucguguuguggcugga

SEQ ID NO: 3962194 - RNA, 12 nt, Human herpesvirus 2
guucugccccgc

SEQ ID NO: 3962195 - RNA, 17 nt, Human herpesvirus 2
guucuggcggcccugga

SEQ ID NO: 3962196 - RNA, 23 nt, Human herpesvirus 2
guugaaccggcgagggcggccuc

SEQ ID NO: 3962197 - RNA, 16 nt, Human herpesvirus 2
guuucugaccggcgcc

SEQ ID NO: 3962198 - RNA, 15 nt, Human herpesvirus 2
guuucugggcccgcc

SEQ ID NO: 3962199 - RNA, 19 nt, Human herpesvirus 2
guuugugcgggugcccaug

SEQ ID NO: 3962200 - RNA, 14 nt, Human herpesvirus 2
uaaaacccacccuc

SEQ ID NO: 3962201 - RNA, 19 nt, Human herpesvirus 2
uaaaacccagacccgagcu

SEQ ID NO: 3962202 - RNA, 12 nt, Human herpesvirus 2
uaaaggcaggcg

SEQ ID NO: 3962203 - RNA, 13 nt, Human herpesvirus 2
uaacgggccgcca

SEQ ID NO: 3962204 - RNA, 12 nt, Human herpesvirus 2
uaagacagacgc

SEQ ID NO: 3962205 - RNA, 14 nt, Human herpesvirus 2
uacaccccacccua

SEQ ID NO: 3962206 - RNA, 15 nt, Human herpesvirus 2
uaccccaguuccucc

SEQ ID NO: 3962207 - RNA, 19 nt, Human herpesvirus 2
uacgacccccgaacagccc

SEQ ID NO: 3962208 - RNA, 12 nt, Human herpesvirus 2
uacgggggcggg

SEQ ID NO: 3962209 - RNA, 23 nt, Human herpesvirus 2
uagaggguucgcaaccacagcaa

SEQ ID NO: 3962210 - RNA, 15 nt, Human herpesvirus 2
uagccccccccccuc

SEQ ID NO: 3962211 - RNA, 16 nt, Human herpesvirus 2
uaggcauauccuccuu

SEQ ID NO: 3962212 - RNA, 14 nt, Human herpesvirus 2
uaggccagagcguu

SEQ ID NO: 3962213 - RNA, 19 nt, Human herpesvirus 2
uaggcccggggggggccuc

SEQ ID NO: 3962214 - RNA, 22 nt, Human herpesvirus 2
uagugucggagaggcccgccgc

SEQ ID NO: 3962215 - RNA, 13 nt, Human herpesvirus 2
uauaaaggccagg

SEQ ID NO: 3962216 - RNA, 20 nt, Human herpesvirus 2
uaugcaagcgggcggggugg

SEQ ID NO: 3962217 - RNA, 21 nt, Human herpesvirus 2
uauuuuccccccaccccuucc

SEQ ID NO: 3962218 - RNA, 13 nt, Human herpesvirus 2
ucaauagauuucc

SEQ ID NO: 3962219 - RNA, 17 nt, Human herpesvirus 2
ucaccgagagcgccguc

SEQ ID NO: 3962220 - RNA, 20 nt, Human herpesvirus 2
ucacggcaaccccagggcgu

SEQ ID NO: 3962221 - RNA, 13 nt, Human herpesvirus 2
ucagcaccccacc

SEQ ID NO: 3962222 - RNA, 23 nt, Human herpesvirus 2
ucagcaccccaccgaaaaacgga

SEQ ID NO: 3962223 - RNA, 13 nt, Human herpesvirus 2
ucagccuggacca

SEQ ID NO: 3962224 - RNA, 21 nt, Human herpesvirus 2
ucagcuccucuucgggcaccc

SEQ ID NO: 3962225 - RNA, 13 nt, Human herpesvirus 2
ucaggaccaggga

SEQ ID NO: 3962226 - RNA, 12 nt, Human herpesvirus 2
uccacacccccu

SEQ ID NO: 3962227 - RNA, 16 nt, Human herpesvirus 2
uccacccgggacgagc

SEQ ID NO: 3962228 - RNA, 19 nt, Human herpesvirus 2
uccagcgcgucggugccgc

SEQ ID NO: 3962229 - RNA, 23 nt, Human herpesvirus 2
ucccacacggucggugcccccca

SEQ ID NO: 3962230 - RNA, 13 nt, Human herpesvirus 2
ucccagggcacca

SEQ ID NO: 3962231 - RNA, 21 nt, Human herpesvirus 2
uccccggauggcaugggaggc

SEQ ID NO: 3962232 - RNA, 13 nt, Human herpesvirus 2
ucccgagccccgc

SEQ ID NO: 3962233 - RNA, 20 nt, Human herpesvirus 2
ucccgauggccgccccgcag

SEQ ID NO: 3962234 - RNA, 19 nt, Human herpesvirus 2
ucccgcaagagccugccgu

SEQ ID NO: 3962235 - RNA, 20 nt, Human herpesvirus 2
ucccggccgccauccccgcg

SEQ ID NO: 3962236 - RNA, 18 nt, Human herpesvirus 2
ucccgguaugguaauuag

SEQ ID NO: 3962237 - RNA, 15 nt, Human herpesvirus 2
ucccguaccccgccg

SEQ ID NO: 3962238 - RNA, 15 nt, Human herpesvirus 2
ucccguggcccucca

SEQ ID NO: 3962239 - RNA, 16 nt, Human herpesvirus 2
uccgacacccgggccc

SEQ ID NO: 3962240 - RNA, 19 nt, Human herpesvirus 2
uccgaggugcggagccucu

SEQ ID NO: 3962241 - RNA, 19 nt, Human herpesvirus 2
uccgcacgggcguccccgg

SEQ ID NO: 3962242 - RNA, 18 nt, Human herpesvirus 2
uccgccagcgcccuuccg

SEQ ID NO: 3962243 - RNA, 13 nt, Human herpesvirus 2
uccgcgagggccc

SEQ ID NO: 3962244 - RNA, 22 nt, Human herpesvirus 2
uccgcggcuuuaucaccccgcu

SEQ ID NO: 3962245 - RNA, 14 nt, Human herpesvirus 2
uccgcuaccgccuc

SEQ ID NO: 3962246 - RNA, 17 nt, Human herpesvirus 2
uccggaguuagcaaaac

SEQ ID NO: 3962247 - RNA, 14 nt, Human herpesvirus 2
uccggcggccaccc

SEQ ID NO: 3962248 - RNA, 22 nt, Human herpesvirus 2
uccgggggccugguggcaccuc

SEQ ID NO: 3962249 - RNA, 18 nt, Human herpesvirus 2
uccguuucgaccccuuua

SEQ ID NO: 3962250 - RNA, 16 nt, Human herpesvirus 2
uccucaccgagccgcu

SEQ ID NO: 3962251 - RNA, 19 nt, Human herpesvirus 2
uccuccgugcuggggaaau

SEQ ID NO: 3962252 - RNA, 14 nt, Human herpesvirus 2
uccugcggcucaug

SEQ ID NO: 3962253 - RNA, 18 nt, Human herpesvirus 2
uccuuggaauuccagcag

SEQ ID NO: 3962254 - RNA, 20 nt, Human herpesvirus 2
uccuuggaauuccagcagcu

SEQ ID NO: 3962255 - RNA, 18 nt, Human herpesvirus 2
uccuuuccaccccccuuc

SEQ ID NO: 3962256 - RNA, 23 nt, Human herpesvirus 2
ucgagguggcggaggggaucagc

SEQ ID NO: 3962257 - RNA, 15 nt, Human herpesvirus 2
ucgauugcggggacc

SEQ ID NO: 3962258 - RNA, 19 nt, Human herpesvirus 2
ucgcacgcgcgcaggcugg

SEQ ID NO: 3962259 - RNA, 22 nt, Human herpesvirus 2
ucgccccacggaccuccgggac

SEQ ID NO: 3962260 - RNA, 13 nt, Human herpesvirus 2
ucgcggcggcucc

SEQ ID NO: 3962261 - RNA, 13 nt, Human herpesvirus 2
ucgcggggacagc

SEQ ID NO: 3962262 - RNA, 13 nt, Human herpesvirus 2
ucgcgucacagaa

SEQ ID NO: 3962263 - RNA, 22 nt, Human herpesvirus 2
ucgcugcucucccguaccccgc

SEQ ID NO: 3962264 - RNA, 14 nt, Human herpesvirus 2
ucggagaggcccgc

SEQ ID NO: 3962265 - RNA, 19 nt, Human herpesvirus 2
ucgggaaucucgggucgcc

SEQ ID NO: 3962266 - RNA, 18 nt, Human herpesvirus 2
ucgggccgugucccuccc

SEQ ID NO: 3962267 - RNA, 14 nt, Human herpesvirus 2
ucgggcggacgucc

SEQ ID NO: 3962268 - RNA, 22 nt, Human herpesvirus 2
ucgggggguggcggucgcgucc

SEQ ID NO: 3962269 - RNA, 21 nt, Human herpesvirus 2
ucgggugacuuggugcgccgc

SEQ ID NO: 3962270 - RNA, 19 nt, Human herpesvirus 2
ucgguggacaugaggcuga

SEQ ID NO: 3962271 - RNA, 22 nt, Human herpesvirus 2
ucgugggggagugcgcucuucg

SEQ ID NO: 3962272 - RNA, 16 nt, Human herpesvirus 2
ucucaauaaagccagg

SEQ ID NO: 3962273 - RNA, 15 nt, Human herpesvirus 2
ucucugccuccuucg

SEQ ID NO: 3962274 - RNA, 17 nt, Human herpesvirus 2
ucugaucgacgacgccu

SEQ ID NO: 3962275 - RNA, 20 nt, Human herpesvirus 2
ucugcgcgaggccgcucucc

SEQ ID NO: 3962276 - RNA, 12 nt, Human herpesvirus 2
ucuggaagagcu

SEQ ID NO: 3962277 - RNA, 18 nt, Human herpesvirus 2
ucuggcggcccuggagcg

SEQ ID NO: 3962278 - RNA, 21 nt, Human herpesvirus 2
ucuggcggcccuggagcgcca

SEQ ID NO: 3962279 - RNA, 14 nt, Human herpesvirus 2
ucuuccuguaccug

SEQ ID NO: 3962280 - RNA, 15 nt, Human herpesvirus 2
ucuucuuccccagcu

SEQ ID NO: 3962281 - RNA, 20 nt, Human herpesvirus 2
ucuuuccaccaccagcacca

SEQ ID NO: 3962282 - RNA, 14 nt, Human herpesvirus 2
ucuuugggccccgc

SEQ ID NO: 3962283 - RNA, 18 nt, Human herpesvirus 2
ugaagccguccgaccauc

SEQ ID NO: 3962284 - RNA, 13 nt, Human herpesvirus 2
ugacauucacccc

SEQ ID NO: 3962285 - RNA, 13 nt, Human herpesvirus 2
ugacccucucggg

SEQ ID NO: 3962286 - RNA, 19 nt, Human herpesvirus 2
ugagcagccgcgccgcugc

SEQ ID NO: 3962287 - RNA, 14 nt, Human herpesvirus 2
ugagccgcgcggcc

SEQ ID NO: 3962288 - RNA, 18 nt, Human herpesvirus 2
ugagcggaacgccccggg

SEQ ID NO: 3962289 - RNA, 15 nt, Human herpesvirus 2
ugaucgacgacgccu

SEQ ID NO: 3962290 - RNA, 20 nt, Human herpesvirus 2
ugauuucgcccuaccgcucc

SEQ ID NO: 3962291 - RNA, 14 nt, Human herpesvirus 2
ugcaacgagcugcc

SEQ ID NO: 3962292 - RNA, 14 nt, Human herpesvirus 2
ugcacugccccccu

SEQ ID NO: 3962293 - RNA, 12 nt, Human herpesvirus 2
ugcagggccugg

SEQ ID NO: 3962294 - RNA, 17 nt, Human herpesvirus 2
ugcaguaccccaguucc

SEQ ID NO: 3962295 - RNA, 21 nt, Human herpesvirus 2
ugcaguaccccaguuccuccg

SEQ ID NO: 3962296 - RNA, 21 nt, Human herpesvirus 2
ugcaucgcaagccacccuggg

SEQ ID NO: 3962297 - RNA, 14 nt, Human herpesvirus 2
ugccagguggcccu

SEQ ID NO: 3962298 - RNA, 17 nt, Human herpesvirus 2
ugcccauggcgucggcg

SEQ ID NO: 3962299 - RNA, 13 nt, Human herpesvirus 2
ugccccccaucuc

SEQ ID NO: 3962300 - RNA, 18 nt, Human herpesvirus 2
ugccccccggcgcgggcg

SEQ ID NO: 3962301 - RNA, 21 nt, Human herpesvirus 2
ugcccgcgggucugcgugggg

SEQ ID NO: 3962302 - RNA, 17 nt, Human herpesvirus 2
ugccugacccucucggg

SEQ ID NO: 3962303 - RNA, 12 nt, Human herpesvirus 2
ugcgaaacagag

SEQ ID NO: 3962304 - RNA, 14 nt, Human herpesvirus 2
ugcgcaugggccgc

SEQ ID NO: 3962305 - RNA, 19 nt, Human herpesvirus 2
ugcgccuccguccuuucca

SEQ ID NO: 3962306 - RNA, 18 nt, Human herpesvirus 2
ugcgcggcguuggcgcgc

SEQ ID NO: 3962307 - RNA, 21 nt, Human herpesvirus 2
ugcgcuuauaagagcgggccc

SEQ ID NO: 3962308 - RNA, 19 nt, Human herpesvirus 2
ugcgcuuuccggcccuccc

SEQ ID NO: 3962309 - RNA, 12 nt, Human herpesvirus 2
ugcggcaggcga

SEQ ID NO: 3962310 - RNA, 19 nt, Human herpesvirus 2
ugcggggaccgcaccggac

SEQ ID NO: 3962311 - RNA, 22 nt, Human herpesvirus 2
ugcucguaaaaauggcggccgc

SEQ ID NO: 3962312 - RNA, 17 nt, Human herpesvirus 2
ugcucucccguaccccg

SEQ ID NO: 3962313 - RNA, 21 nt, Human herpesvirus 2
ugcugcugagcccugccccgc

SEQ ID NO: 3962314 - RNA, 12 nt, Human herpesvirus 2
ugcugggguccg

SEQ ID NO: 3962315 - RNA, 20 nt, Human herpesvirus 2
ugcuuggaggcccucuggga

SEQ ID NO: 3962316 - RNA, 23 nt, Human herpesvirus 2
uggaagaggaccugcguguuuuc

SEQ ID NO: 3962317 - RNA, 15 nt, Human herpesvirus 2
uggaagcccccggca

SEQ ID NO: 3962318 - RNA, 16 nt, Human herpesvirus 2
uggacgaucccgggcc

SEQ ID NO: 3962319 - RNA, 17 nt, Human herpesvirus 2
uggacgcgccucccggg

SEQ ID NO: 3962320 - RNA, 15 nt, Human herpesvirus 2
uggacugggagccgc

SEQ ID NO: 3962321 - RNA, 20 nt, Human herpesvirus 2
uggagaacggauaccgacag

SEQ ID NO: 3962322 - RNA, 17 nt, Human herpesvirus 2
uggaggggggugcugug

SEQ ID NO: 3962323 - RNA, 13 nt, Human herpesvirus 2
uggcccagcgcac

SEQ ID NO: 3962324 - RNA, 23 nt, Human herpesvirus 2
uggcccguuucuucggggggccc

SEQ ID NO: 3962325 - RNA, 15 nt, Human herpesvirus 2
uggccgcuccugccc

SEQ ID NO: 3962326 - RNA, 16 nt, Human herpesvirus 2
uggccgcuccugcccg

SEQ ID NO: 3962327 - RNA, 14 nt, Human herpesvirus 2
uggcgaggggcggg

SEQ ID NO: 3962328 - RNA, 17 nt, Human herpesvirus 2
uggcgcuugggcgucgc

SEQ ID NO: 3962329 - RNA, 18 nt, Human herpesvirus 2
uggcggucgcguccggaa

SEQ ID NO: 3962330 - RNA, 12 nt, Human herpesvirus 2
uggcguccccag

SEQ ID NO: 3962331 - RNA, 11 nt, Human herpesvirus 2
uggcgucggag

SEQ ID NO: 3962332 - RNA, 16 nt, Human herpesvirus 2
uggcuucgggccaaca

SEQ ID NO: 3962333 - RNA, 16 nt, Human herpesvirus 2
ugggaaaucuauugaa

SEQ ID NO: 3962334 - RNA, 16 nt, Human herpesvirus 2
ugggcccgccgaccgc

SEQ ID NO: 3962335 - RNA, 23 nt, Human herpesvirus 2
ugggcccgugugggaggguggcu

SEQ ID NO: 3962336 - RNA, 23 nt, Human herpesvirus 2
ugggccugugggucugcgccacc

SEQ ID NO: 3962337 - RNA, 17 nt, Human herpesvirus 2
ugggcgcgagccaggca

SEQ ID NO: 3962338 - RNA, 14 nt, Human herpesvirus 2
uggggaaagggaag

SEQ ID NO: 3962339 - RNA, 20 nt, Human herpesvirus 2
uggggacgacgggcgccccc

SEQ ID NO: 3962340 - RNA, 11 nt, Human herpesvirus 2
uggggagaggg

SEQ ID NO: 3962341 - RNA, 20 nt, Human herpesvirus 2
uggggccucucgacggagag

SEQ ID NO: 3962342 - RNA, 15 nt, Human herpesvirus 2
ugggggauuguggga

SEQ ID NO: 3962343 - RNA, 17 nt, Human herpesvirus 2
ugggggggggggaagag

SEQ ID NO: 3962344 - RNA, 16 nt, Human herpesvirus 2
ugggggggggggggcg

SEQ ID NO: 3962345 - RNA, 17 nt, Human herpesvirus 2
uggggugggggaagaag

SEQ ID NO: 3962346 - RNA, 16 nt, Human herpesvirus 2
ugggguuuuggcggcc

SEQ ID NO: 3962347 - RNA, 24 nt, Human herpesvirus 2
ugguggcaccuccccggcggccgc

SEQ ID NO: 3962348 - RNA, 19 nt, Human herpesvirus 2
ugguguguuuggcgugugu

SEQ ID NO: 3962349 - RNA, 23 nt, Human herpesvirus 2
uguaauggggccgcaguguuuuu

SEQ ID NO: 3962350 - RNA, 21 nt, Human herpesvirus 2
uguacaaacacggggacggcc

SEQ ID NO: 3962351 - RNA, 16 nt, Human herpesvirus 2
ugucggagaggcccgc

SEQ ID NO: 3962352 - RNA, 16 nt, Human herpesvirus 2
ugucucgcggcccggc

SEQ ID NO: 3962353 - RNA, 20 nt, Human herpesvirus 2
ugugccagguggcccuuccg

SEQ ID NO: 3962354 - RNA, 17 nt, Human herpesvirus 2
uguggcggucggccagc

SEQ ID NO: 3962355 - RNA, 14 nt, Human herpesvirus 2
uguggggccccggc

SEQ ID NO: 3962356 - RNA, 16 nt, Human herpesvirus 2
ugugucgcggggacag

SEQ ID NO: 3962357 - RNA, 13 nt, Human herpesvirus 2
uguguuaacgcaa

SEQ ID NO: 3962358 - RNA, 20 nt, Human herpesvirus 2
uguguuuugugggacugggg

SEQ ID NO: 3962359 - RNA, 22 nt, Human herpesvirus 2
uguuacaccccccugacucagg

SEQ ID NO: 3962360 - RNA, 22 nt, Human herpesvirus 2
uguucgcgggcgacgccgcggc

SEQ ID NO: 3962361 - RNA, 17 nt, Human herpesvirus 2
uguuggaucccuuugug

SEQ ID NO: 3962362 - RNA, 16 nt, Human herpesvirus 2
uguuguguuugcuggg

SEQ ID NO: 3962363 - RNA, 11 nt, Human herpesvirus 2
uguuucaucau

SEQ ID NO: 3962364 - RNA, 11 nt, Human herpesvirus 2
uuacccacaca

SEQ ID NO: 3962365 - RNA, 12 nt, Human herpesvirus 2
uuacccacacac

SEQ ID NO: 3962366 - RNA, 16 nt, Human herpesvirus 2
uucaauagauuuccca

SEQ ID NO: 3962367 - RNA, 23 nt, Human herpesvirus 2
uuccccgcucccguguaccucug

SEQ ID NO: 3962368 - RNA, 16 nt, Human herpesvirus 2
uuccuccccucgccug

SEQ ID NO: 3962369 - RNA, 20 nt, Human herpesvirus 2
aaaccccgguuggggcgggc

SEQ ID NO: 3962370 - RNA, 16 nt, Human herpesvirus 2
aaacguucggacggcc

SEQ ID NO: 3962371 - RNA, 14 nt, Human herpesvirus 2
aaagaacguggugu

SEQ ID NO: 3962372 - RNA, 13 nt, Human herpesvirus 2
aaaggccagcaga

SEQ ID NO: 3962373 - RNA, 12 nt, Human herpesvirus 2
aaagguuggugu

SEQ ID NO: 3962374 - RNA, 13 nt, Human herpesvirus 2
aacacaccgggcu

SEQ ID NO: 3962375 - RNA, 13 nt, Human herpesvirus 2
aacacccggcgcc

SEQ ID NO: 3962376 - RNA, 23 nt, Human herpesvirus 2
aacaccguccccgagagccugau

SEQ ID NO: 3962377 - RNA, 13 nt, Human herpesvirus 2
aacagagcucuuu

SEQ ID NO: 3962378 - RNA, 21 nt, Human herpesvirus 2
aacaguccguuucgaccccuu

SEQ ID NO: 3962379 - RNA, 17 nt, Human herpesvirus 2
aacaucgggaaaacgga

SEQ ID NO: 3962380 - RNA, 22 nt, Human herpesvirus 2
aacaugacaacgacgccccucu

SEQ ID NO: 3962381 - RNA, 14 nt, Human herpesvirus 2
aacauuggcaagca

SEQ ID NO: 3962382 - RNA, 18 nt, Human herpesvirus 2
aaccggcgagggcggccu

SEQ ID NO: 3962383 - RNA, 15 nt, Human herpesvirus 2
aacgagcgugugguu

SEQ ID NO: 3962384 - RNA, 21 nt, Human herpesvirus 2
aacgcacccccggaccccgcu

SEQ ID NO: 3962385 - RNA, 15 nt, Human herpesvirus 2
aacgcgggcgggggc

SEQ ID NO: 3962386 - RNA, 11 nt, Human herpesvirus 2
aagaagguuuc

SEQ ID NO: 3962387 - RNA, 15 nt, Human herpesvirus 2
aagagagcgccccgc

SEQ ID NO: 3962388 - RNA, 16 nt, Human herpesvirus 2
aagaggcggacccagu

SEQ ID NO: 3962389 - RNA, 19 nt, Human herpesvirus 2
aagcgaagacgaggccgcc

SEQ ID NO: 3962390 - RNA, 20 nt, Human herpesvirus 2
aagcgggccguucggcaggc

SEQ ID NO: 3962391 - RNA, 22 nt, Human herpesvirus 2
aaggucccgauggccgccccgc

SEQ ID NO: 3962392 - RNA, 19 nt, Human herpesvirus 2
aagucucuuggggaaaucu

SEQ ID NO: 3962393 - RNA, 21 nt, Human herpesvirus 2
aagugcaguaacccaguuccu

SEQ ID NO: 3962394 - RNA, 12 nt, Human herpesvirus 2
aauagauuuccc

SEQ ID NO: 3962395 - RNA, 18 nt, Human herpesvirus 2
aauguggggccccggccc

SEQ ID NO: 3962396 - RNA, 15 nt, Human herpesvirus 2
aauuagaaacuuuua

SEQ ID NO: 3962397 - RNA, 19 nt, Human herpesvirus 2
acaacaguacucaucggga

SEQ ID NO: 3962398 - RNA, 14 nt, Human herpesvirus 2
acacacaccccccu

SEQ ID NO: 3962399 - RNA, 20 nt, Human herpesvirus 2
acacacaggcccaccaccau

SEQ ID NO: 3962400 - RNA, 15 nt, Human herpesvirus 2
acacaccgggcuggg

SEQ ID NO: 3962401 - RNA, 21 nt, Human herpesvirus 2
acaccagacggcgggaccccg

SEQ ID NO: 3962402 - RNA, 12 nt, Human herpesvirus 2
acacccccuccc

SEQ ID NO: 3962403 - RNA, 18 nt, Human herpesvirus 2
acaccucccagugccccg

SEQ ID NO: 3962404 - RNA, 19 nt, Human herpesvirus 2
acacggugcgugcggcccu

SEQ ID NO: 3962405 - RNA, 22 nt, Human herpesvirus 2
acacucgcgucuggcuguguuu

SEQ ID NO: 3962406 - RNA, 20 nt, Human herpesvirus 2
acagagaaaggcccccagac

SEQ ID NO: 3962407 - RNA, 16 nt, Human herpesvirus 2
acagcacggccgggug

SEQ ID NO: 3962408 - RNA, 16 nt, Human herpesvirus 2
acagccccuggggcug

SEQ ID NO: 3962409 - RNA, 14 nt, Human herpesvirus 2
acaucaagcccaca

SEQ ID NO: 3962410 - RNA, 11 nt, Human herpesvirus 2
accaaccuggc

SEQ ID NO: 3962411 - RNA, 11 nt, Human herpesvirus 2
accaccaaggc

SEQ ID NO: 3962412 - RNA, 13 nt, Human herpesvirus 2
accaccaaggccc

SEQ ID NO: 3962413 - RNA, 21 nt, Human herpesvirus 2
accacccccccacuuuccucc

SEQ ID NO: 3962414 - RNA, 15 nt, Human herpesvirus 2
accaccgccccgccu

SEQ ID NO: 3962415 - RNA, 16 nt, Human herpesvirus 2
accacguguccccagg

SEQ ID NO: 3962416 - RNA, 18 nt, Human herpesvirus 2
accagccccucgcccccg

SEQ ID NO: 3962417 - RNA, 13 nt, Human herpesvirus 2
accccccacgccc

SEQ ID NO: 3962418 - RNA, 17 nt, Human herpesvirus 2
accccccggccccccgc

SEQ ID NO: 3962419 - RNA, 18 nt, Human herpesvirus 2
acccccggcgauucccuu

SEQ ID NO: 3962420 - RNA, 18 nt, Human herpesvirus 2
acccgacaacagccccug

SEQ ID NO: 3962421 - RNA, 17 nt, Human herpesvirus 2
acccguccgaucccggu

SEQ ID NO: 3962422 - RNA, 19 nt, Human herpesvirus 2
acccucaccccaccccauc

SEQ ID NO: 3962423 - RNA, 13 nt, Human herpesvirus 2
accgaagaggugc

SEQ ID NO: 3962424 - RNA, 16 nt, Human herpesvirus 2
accgagccgcugugcc

SEQ ID NO: 3962425 - RNA, 16 nt, Human herpesvirus 2
accgcacccgggccgg

SEQ ID NO: 3962426 - RNA, 18 nt, Human herpesvirus 2
accgccaacaccagggca

SEQ ID NO: 3962427 - RNA, 20 nt, Human herpesvirus 2
accgcgccucgcgucgggcc

SEQ ID NO: 3962428 - RNA, 13 nt, Human herpesvirus 2
accgcgcgccucc

SEQ ID NO: 3962429 - RNA, 19 nt, Human herpesvirus 2
accgcgcgccuccucgcgg

SEQ ID NO: 3962430 - RNA, 16 nt, Human herpesvirus 2
accggggaaacaggca

SEQ ID NO: 3962431 - RNA, 12 nt, Human herpesvirus 2
accgguagccgg

SEQ ID NO: 3962432 - RNA, 13 nt, Human herpesvirus 2
accguccaccucc

SEQ ID NO: 3962433 - RNA, 14 nt, Human herpesvirus 2
accucgcggcggcu

SEQ ID NO: 3962434 - RNA, 20 nt, Human herpesvirus 2
accucggggugacccacgcc

SEQ ID NO: 3962435 - RNA, 20 nt, Human herpesvirus 2
accugggggauugugggaau

SEQ ID NO: 3962436 - RNA, 20 nt, Human herpesvirus 2
accuuccccucccacuuccc

SEQ ID NO: 3962437 - RNA, 20 nt, Human herpesvirus 2
accuucgccuccgcccuccg

SEQ ID NO: 3962438 - RNA, 15 nt, Human herpesvirus 2
acgacccgccucggg

SEQ ID NO: 3962439 - RNA, 15 nt, Human herpesvirus 2
acgagccaaaccagc

SEQ ID NO: 3962440 - RNA, 16 nt, Human herpesvirus 2
acgaggcccacccccc

SEQ ID NO: 3962441 - RNA, 16 nt, Human herpesvirus 2
acgccaggccccccgg

SEQ ID NO: 3962442 - RNA, 14 nt, Human herpesvirus 2
acgcccauauguac

SEQ ID NO: 3962443 - RNA, 15 nt, Human herpesvirus 2
acgccccccucggca

SEQ ID NO: 3962444 - RNA, 12 nt, Human herpesvirus 2
acgcccgcgucu

SEQ ID NO: 3962445 - RNA, 16 nt, Human herpesvirus 2
acgcccuacaagaaag

SEQ ID NO: 3962446 - RNA, 19 nt, Human herpesvirus 2
acgccuuuccuccccucgc

SEQ ID NO: 3962447 - RNA, 14 nt, Human herpesvirus 2
acgcgcccgcgucc

SEQ ID NO: 3962448 - RNA, 15 nt, Human herpesvirus 2
acgcgcuggccccuc

SEQ ID NO: 3962449 - RNA, 18 nt, Human herpesvirus 2
acgcucucugccuccuuc

SEQ ID NO: 3962450 - RNA, 16 nt, Human herpesvirus 2
acggcaccgccgggcg

SEQ ID NO: 3962451 - RNA, 15 nt, Human herpesvirus 2
acggccagcgggggc

SEQ ID NO: 3962452 - RNA, 21 nt, Human herpesvirus 2
acggcccaccugcacgagguc

SEQ ID NO: 3962453 - RNA, 18 nt, Human herpesvirus 2
acggccccggccgccucc

SEQ ID NO: 3962454 - RNA, 15 nt, Human herpesvirus 2
acggccccucgcucc

SEQ ID NO: 3962455 - RNA, 17 nt, Human herpesvirus 2
acggcgccuaccuggua

SEQ ID NO: 3962456 - RNA, 18 nt, Human herpesvirus 2
acggucggcgaacacaac

SEQ ID NO: 3962457 - RNA, 14 nt, Human herpesvirus 2
acggucuccgccau

SEQ ID NO: 3962458 - RNA, 21 nt, Human herpesvirus 2
acgucgguuuauuaaaacgaa

SEQ ID NO: 3962459 - RNA, 21 nt, Human herpesvirus 2
acgucguccggggggugccac

SEQ ID NO: 3962460 - RNA, 16 nt, Human herpesvirus 2
acuagaaaaacaaaug

SEQ ID NO: 3962461 - RNA, 20 nt, Human herpesvirus 2
acuauggggggggaaaggaa

SEQ ID NO: 3962462 - RNA, 13 nt, Human herpesvirus 2
acucggagggaag

SEQ ID NO: 3962463 - RNA, 17 nt, Human herpesvirus 2
acugcacugccccccuc

SEQ ID NO: 3962464 - RNA, 20 nt, Human herpesvirus 2
acugggguacugcacugccc

SEQ ID NO: 3962465 - RNA, 15 nt, Human herpesvirus 2
acuuccgggagcggg

SEQ ID NO: 3962466 - RNA, 19 nt, Human herpesvirus 2
acuuccgugccccuggacu

SEQ ID NO: 3962467 - RNA, 23 nt, Human herpesvirus 2
acuugacggucgccacucuccug

SEQ ID NO: 3962468 - RNA, 21 nt, Human herpesvirus 2
acuuucuggccuuguugaaaa

SEQ ID NO: 3962469 - RNA, 18 nt, Human herpesvirus 2
agaaaagcgacgaggucc

SEQ ID NO: 3962470 - RNA, 16 nt, Human herpesvirus 2
agaaggaggggggccu

SEQ ID NO: 3962471 - RNA, 16 nt, Human herpesvirus 2
agaagggaaaggaaca

SEQ ID NO: 3962472 - RNA, 18 nt, Human herpesvirus 2
agaauucccagggcacca

SEQ ID NO: 3962473 - RNA, 18 nt, Human herpesvirus 2
agacaauaaagcaucacg

SEQ ID NO: 3962474 - RNA, 23 nt, Human herpesvirus 2
agacccugccccccggcgcgggc

SEQ ID NO: 3962475 - RNA, 14 nt, Human herpesvirus 2
agacgaggccgcca

SEQ ID NO: 3962476 - RNA, 19 nt, Human herpesvirus 2
agacgcccgcgagccgcac

SEQ ID NO: 3962477 - RNA, 19 nt, Human herpesvirus 2
agacuggccgugcugggcg

SEQ ID NO: 3962478 - RNA, 16 nt, Human herpesvirus 2
ccguguggucgccccc

SEQ ID NO: 3962479 - RNA, 18 nt, Human herpesvirus 2
ccguuucuucggggggcc

SEQ ID NO: 3962480 - RNA, 23 nt, Human herpesvirus 2
ccuacgccccccucggcagcccg

SEQ ID NO: 3962481 - RNA, 14 nt, Human herpesvirus 2
ccuagaggcugucc

SEQ ID NO: 3962482 - RNA, 17 nt, Human herpesvirus 2
ccuagccccccccccuc

SEQ ID NO: 3962483 - RNA, 20 nt, Human herpesvirus 2
ccuagccuucggccaccugg

SEQ ID NO: 3962484 - RNA, 19 nt, Human herpesvirus 2
ccucagcauccugaaccgc

SEQ ID NO: 3962485 - RNA, 17 nt, Human herpesvirus 2
ccuccacgcccugcugu

SEQ ID NO: 3962486 - RNA, 12 nt, Human herpesvirus 2
ccucccacuucc

SEQ ID NO: 3962487 - RNA, 18 nt, Human herpesvirus 2
ccucccucgccgccuucc

SEQ ID NO: 3962488 - RNA, 23 nt, Human herpesvirus 2
ccuccgcagcguaacgcaccccc

SEQ ID NO: 3962489 - RNA, 12 nt, Human herpesvirus 2
ccuccgcggccg

SEQ ID NO: 3962490 - RNA, 21 nt, Human herpesvirus 2
ccuccggaagagagcgccccg

SEQ ID NO: 3962491 - RNA, 13 nt, Human herpesvirus 2
ccucgacccgucc

SEQ ID NO: 3962492 - RNA, 20 nt, Human herpesvirus 2
ccucgcccagacgcccuccg

SEQ ID NO: 3962493 - RNA, 13 nt, Human herpesvirus 2
ccucgccgccuuc

SEQ ID NO: 3962494 - RNA, 19 nt, Human herpesvirus 2
ccucggccggcggagcccc

SEQ ID NO: 3962495 - RNA, 24 nt, Human herpesvirus 2
ccucgugcgcaugggccgccagca

SEQ ID NO: 3962496 - RNA, 21 nt, Human herpesvirus 2
ccucguuuuguuuucucuucu

SEQ ID NO: 3962497 - RNA, 12 nt, Human herpesvirus 2
ccucuaccccca

SEQ ID NO: 3962498 - RNA, 21 nt, Human herpesvirus 2
ccucucgaucccgaagccauc

SEQ ID NO: 3962499 - RNA, 13 nt, Human herpesvirus 2
ccucugggcccgu

SEQ ID NO: 3962500 - RNA, 19 nt, Human herpesvirus 2
ccucuguuucuccaggcgc

SEQ ID NO: 3962501 - RNA, 17 nt, Human herpesvirus 2
ccugaguugcgccggca

SEQ ID NO: 3962502 - RNA, 18 nt, Human herpesvirus 2
ccugcagaugcugcccgc

SEQ ID NO: 3962503 - RNA, 23 nt, Human herpesvirus 2
ccugccacccgaacauggcucgc

SEQ ID NO: 3962504 - RNA, 21 nt, Human herpesvirus 2
ccugccgacuuccgugccccu

SEQ ID NO: 3962505 - RNA, 20 nt, Human herpesvirus 2
ccugcgaaucccccaaggaa

SEQ ID NO: 3962506 - RNA, 16 nt, Human herpesvirus 2
ccuggcgauccugggc

SEQ ID NO: 3962507 - RNA, 18 nt, Human herpesvirus 2
ccuggcgauccugggccu

SEQ ID NO: 3962508 - RNA, 14 nt, Human herpesvirus 2
ccuggcucgccgug

SEQ ID NO: 3962509 - RNA, 15 nt, Human herpesvirus 2
ccuggcucgccgugc

SEQ ID NO: 3962510 - RNA, 15 nt, Human herpesvirus 2
ccuguggggccugcu

SEQ ID NO: 3962511 - RNA, 19 nt, Human herpesvirus 2
ccuguuuuuacgggccccg

SEQ ID NO: 3962512 - RNA, 18 nt, Human herpesvirus 2
ccuucgccgacgccuucc

SEQ ID NO: 3962513 - RNA, 13 nt, Human herpesvirus 2
ccuucgucuggag

SEQ ID NO: 3962514 - RNA, 16 nt, Human herpesvirus 2
ccuugcccccacccca

SEQ ID NO: 3962515 - RNA, 16 nt, Human herpesvirus 2
ccuugcggaugugggc

SEQ ID NO: 3962516 - RNA, 20 nt, Human herpesvirus 2
ccuuggguuccgcggacgcc

SEQ ID NO: 3962517 - RNA, 17 nt, Human herpesvirus 2
ccuuguuuucggucugg

SEQ ID NO: 3962518 - RNA, 15 nt, Human herpesvirus 2
ccuuuaagacagacg

SEQ ID NO: 3962519 - RNA, 19 nt, Human herpesvirus 2
ccuuucccguggcccucca

SEQ ID NO: 3962520 - RNA, 16 nt, Human herpesvirus 2
cgaacagccccugggg

SEQ ID NO: 3962521 - RNA, 23 nt, Human herpesvirus 2
cgaacgggggucccgccucccgg

SEQ ID NO: 3962522 - RNA, 21 nt, Human herpesvirus 2
cgaagagacgaugggagcccc

SEQ ID NO: 3962523 - RNA, 17 nt, Human herpesvirus 2
cgaagcggccccgaccc

SEQ ID NO: 3962524 - RNA, 15 nt, Human herpesvirus 2
cgaaggaagccgccc

SEQ ID NO: 3962525 - RNA, 13 nt, Human herpesvirus 2
cgaaggucugcgc

SEQ ID NO: 3962526 - RNA, 16 nt, Human herpesvirus 2
cgaaucccccaaggaa

SEQ ID NO: 3962527 - RNA, 14 nt, Human herpesvirus 2
cgaaucugggaaga

SEQ ID NO: 3962528 - RNA, 13 nt, Human herpesvirus 2
cgacaacagcccc

SEQ ID NO: 3962529 - RNA, 15 nt, Human herpesvirus 2
cgacacccgggcccc

SEQ ID NO: 3962530 - RNA, 15 nt, Human herpesvirus 2
cgacagcggggaccc

SEQ ID NO: 3962531 - RNA, 20 nt, Human herpesvirus 2
cgacagcggggacccgggcg

SEQ ID NO: 3962532 - RNA, 14 nt, Human herpesvirus 2
cgaccaccaaggcc

SEQ ID NO: 3962533 - RNA, 13 nt, Human herpesvirus 2
cgaccagcggccc

SEQ ID NO: 3962534 - RNA, 14 nt, Human herpesvirus 2
cgaccaugggcccc

SEQ ID NO: 3962535 - RNA, 15 nt, Human herpesvirus 2
cgacccccgaacagc

SEQ ID NO: 3962536 - RNA, 16 nt, Human herpesvirus 2
cgaccggcggggcccc

SEQ ID NO: 3962537 - RNA, 23 nt, Human herpesvirus 2
cgaccgguuucgguuccacucua

SEQ ID NO: 3962538 - RNA, 18 nt, Human herpesvirus 2
cgaccgucgccgccggcc

SEQ ID NO: 3962539 - RNA, 18 nt, Human herpesvirus 2
cgaccgucuuugggcccc

SEQ ID NO: 3962540 - RNA, 13 nt, Human herpesvirus 2
cgaccucgucgcg

SEQ ID NO: 3962541 - RNA, 12 nt, Human herpesvirus 2
cgaccugcagga

SEQ ID NO: 3962542 - RNA, 20 nt, Human herpesvirus 2
cgacgacgccuggcggcccc

SEQ ID NO: 3962543 - RNA, 20 nt, Human herpesvirus 2
cgacgauuagccaccgcgcc

SEQ ID NO: 3962544 - RNA, 16 nt, Human herpesvirus 2
cgacgcguacguggcg

SEQ ID NO: 3962545 - RNA, 22 nt, Human herpesvirus 2
cgacggcaugcagcccagagga

SEQ ID NO: 3962546 - RNA, 15 nt, Human herpesvirus 2
cgacggcggggcccc

SEQ ID NO: 3962547 - RNA, 17 nt, Human herpesvirus 2
cgacggcgucucccggg

SEQ ID NO: 3962548 - RNA, 14 nt, Human herpesvirus 2
cgacugucgugccg

SEQ ID NO: 3962549 - RNA, 17 nt, Human herpesvirus 2
cgacuuccucgugcgca

SEQ ID NO: 3962550 - RNA, 13 nt, Human herpesvirus 2
cgagaagccgccc

SEQ ID NO: 3962551 - RNA, 15 nt, Human herpesvirus 2
cgagaagccgccccc

SEQ ID NO: 3962552 - RNA, 18 nt, Human herpesvirus 2
cgagaagcgggaccgucg

SEQ ID NO: 3962553 - RNA, 11 nt, Human herpesvirus 2
cgagacagacg

SEQ ID NO: 3962554 - RNA, 15 nt, Human herpesvirus 2
cgagagcccagggaa

SEQ ID NO: 3962555 - RNA, 21 nt, Human herpesvirus 2
cgagagcgccgucgggccccg

SEQ ID NO: 3962556 - RNA, 16 nt, Human herpesvirus 2
cgagcaccgacccccu

SEQ ID NO: 3962557 - RNA, 17 nt, Human herpesvirus 2
cgagccaccgucccgcc

SEQ ID NO: 3962558 - RNA, 14 nt, Human herpesvirus 2
cgaggcccccggcc

SEQ ID NO: 3962559 - RNA, 17 nt, Human herpesvirus 2
cgagggcggccucggcc

SEQ ID NO: 3962560 - RNA, 16 nt, Human herpesvirus 2
cgagugcucgcagcag

SEQ ID NO: 3962561 - RNA, 23 nt, Human herpesvirus 2
cgaguucccccgggacuucugga

SEQ ID NO: 3962562 - RNA, 17 nt, Human herpesvirus 2
cgauagccuccgaggug

SEQ ID NO: 3962563 - RNA, 14 nt, Human herpesvirus 2
cgaucugccccgac

SEQ ID NO: 3962564 - RNA, 20 nt, Human herpesvirus 2
cgaugcgacgccgccccugc

SEQ ID NO: 3962565 - RNA, 19 nt, Human herpesvirus 2
cgcaacaacggcgggcccc

SEQ ID NO: 3962566 - RNA, 14 nt, Human herpesvirus 2
cgcaccccaccccu

SEQ ID NO: 3962567 - RNA, 23 nt, Human herpesvirus 2
cgcacccccgcgccgccucgggg

SEQ ID NO: 3962568 - RNA, 18 nt, Human herpesvirus 2
cgcacccgggccggguga

SEQ ID NO: 3962569 - RNA, 13 nt, Human herpesvirus 2
cgcacgcggugcg

SEQ ID NO: 3962570 - RNA, 21 nt, Human herpesvirus 2
cgcacguacguucugccccgc

SEQ ID NO: 3962571 - RNA, 12 nt, Human herpesvirus 2
cgcagaccaccu

SEQ ID NO: 3962572 - RNA, 16 nt, Human herpesvirus 2
cgcagaccaccucgcg

SEQ ID NO: 3962573 - RNA, 13 nt, Human herpesvirus 2
cgcagcggcgucc

SEQ ID NO: 3962574 - RNA, 22 nt, Human herpesvirus 2
cgcaggcccucgcugcucuccc

SEQ ID NO: 3962575 - RNA, 19 nt, Human herpesvirus 2
cgcauauacugcugggcca

SEQ ID NO: 3962576 - RNA, 16 nt, Human herpesvirus 2
cgcaucuucgccgggu

SEQ ID NO: 3962577 - RNA, 22 nt, Human herpesvirus 2
cgccacucuccugcgagcccuc

SEQ ID NO: 3962578 - RNA, 14 nt, Human herpesvirus 2
cgccaucgugcgcu

SEQ ID NO: 3962579 - RNA, 22 nt, Human herpesvirus 2
cgcccaacccaaccgacucccu

SEQ ID NO: 3962580 - RNA, 22 nt, Human herpesvirus 2
cgcccaacccgagcgaccuucc

SEQ ID NO: 3962581 - RNA, 15 nt, Human herpesvirus 2
cgcccaggcccuggc

SEQ ID NO: 3962582 - RNA, 19 nt, Human herpesvirus 2
cgcccaggcccuggcgcac

SEQ ID NO: 3962583 - RNA, 17 nt, Human herpesvirus 2
cgcccauacaaauuaaa

SEQ ID NO: 3962584 - RNA, 12 nt, Human herpesvirus 2
cgccccccccga

SEQ ID NO: 3962585 - RNA, 13 nt, Human herpesvirus 2
cgccccccucggc

SEQ ID NO: 3962586 - RNA, 14 nt, Human herpesvirus 2
cgcccccgccucgc

SEQ ID NO: 3962587 - RNA, 18 nt, Human herpesvirus 2
cgcccccucucccacacg

SEQ ID NO: 3962588 - RNA, 16 nt, Human herpesvirus 2
cgcccgccgcccucga

SEQ ID NO: 3962589 - RNA, 22 nt, Human herpesvirus 2
cgcccucgcccagacgcccucc

SEQ ID NO: 3962590 - RNA, 12 nt, Human herpesvirus 2
cgccgaccagaa

SEQ ID NO: 3962591 - RNA, 17 nt, Human herpesvirus 2
cgccgacggcggcgcac

SEQ ID NO: 3962592 - RNA, 17 nt, Human herpesvirus 2
cgccgagcgucaggccc

SEQ ID NO: 3962593 - RNA, 16 nt, Human herpesvirus 2
cgggcgcccccgccuc

SEQ ID NO: 3962594 - RNA, 14 nt, Human herpesvirus 2
cgggcgggggucgg

SEQ ID NO: 3962595 - RNA, 22 nt, Human herpesvirus 2
cgggcguuauaagccgccgcac

SEQ ID NO: 3962596 - RNA, 16 nt, Human herpesvirus 2
cgggcguuccuucccu

SEQ ID NO: 3962597 - RNA, 19 nt, Human herpesvirus 2
cgggcugguuaucgccugu

SEQ ID NO: 3962598 - RNA, 24 nt, Human herpesvirus 2
cggggacuugacggucgccacucu

SEQ ID NO: 3962599 - RNA, 13 nt, Human herpesvirus 2
cggggagcuucau

SEQ ID NO: 3962600 - RNA, 9 nt, Human herpesvirus 2
cggggagga

SEQ ID NO: 3962601 - RNA, 14 nt, Human herpesvirus 2
cggggccagggcug

SEQ ID NO: 3962602 - RNA, 16 nt, Human herpesvirus 2
cggggcgugcugugcc

SEQ ID NO: 3962603 - RNA, 16 nt, Human herpesvirus 2
cggggcgugucugucc

SEQ ID NO: 3962604 - RNA, 21 nt, Human herpesvirus 2
cggggcuuggacgcgccuccc

SEQ ID NO: 3962605 - RNA, 15 nt, Human herpesvirus 2
cgggggcgggcgggc

SEQ ID NO: 3962606 - RNA, 13 nt, Human herpesvirus 2
cggggggcggugg

SEQ ID NO: 3962607 - RNA, 10 nt, Human herpesvirus 2
cgggggucgg

SEQ ID NO: 3962608 - RNA, 17 nt, Human herpesvirus 2
cgggggucgggcgggcg

SEQ ID NO: 3962609 - RNA, 18 nt, Human herpesvirus 2
cgggugucugcuccccac

SEQ ID NO: 3962610 - RNA, 20 nt, Human herpesvirus 2
cggguuccccgagagcccag

SEQ ID NO: 3962611 - RNA, 19 nt, Human herpesvirus 2
cgguccuaaggcgccgacg

SEQ ID NO: 3962612 - RNA, 16 nt, Human herpesvirus 2
cggucggccagcacga

SEQ ID NO: 3962613 - RNA, 18 nt, Human herpesvirus 2
cggugcgugcggcccugc

SEQ ID NO: 3962614 - RNA, 17 nt, Human herpesvirus 2
cgguggggccggcgguc

SEQ ID NO: 3962615 - RNA, 23 nt, Human herpesvirus 2
cgguuuuuuuuuguugucugucu

SEQ ID NO: 3962616 - RNA, 13 nt, Human herpesvirus 2
cguacgaggugcu

SEQ ID NO: 3962617 - RNA, 15 nt, Human herpesvirus 2
cguaugucuguuuca

SEQ ID NO: 3962618 - RNA, 19 nt, Human herpesvirus 2
cguauucaccgaccccccc

SEQ ID NO: 3962619 - RNA, 15 nt, Human herpesvirus 2
cgucacgcaggccgc

SEQ ID NO: 3962620 - RNA, 15 nt, Human herpesvirus 2
cguccaccuuggccc

SEQ ID NO: 3962621 - RNA, 18 nt, Human herpesvirus 2
cgucccccacggucagga

SEQ ID NO: 3962622 - RNA, 20 nt, Human herpesvirus 2
cguccccuuucuuuuccccc

SEQ ID NO: 3962623 - RNA, 15 nt, Human herpesvirus 2
cguccgcggccccac

SEQ ID NO: 3962624 - RNA, 22 nt, Human herpesvirus 2
cguccggcuggcggcgcggcac

SEQ ID NO: 3962625 - RNA, 22 nt, Human herpesvirus 2
cguccugcggcagcgcgccgac

SEQ ID NO: 3962626 - RNA, 14 nt, Human herpesvirus 2
cguccugcggcuca

SEQ ID NO: 3962627 - RNA, 18 nt, Human herpesvirus 2
cgucuccggucccuuccc

SEQ ID NO: 3962628 - RNA, 18 nt, Human herpesvirus 2
cgucugucgccucucccu

SEQ ID NO: 3962629 - RNA, 22 nt, Human herpesvirus 2
cgugcgcaugggccgccagcag

SEQ ID NO: 3962630 - RNA, 16 nt, Human herpesvirus 2
cgugcgcucgcucucc

SEQ ID NO: 3962631 - RNA, 15 nt, Human herpesvirus 2
cgugcgucuucccag

SEQ ID NO: 3962632 - RNA, 12 nt, Human herpesvirus 2
cgugcucugcca

SEQ ID NO: 3962633 - RNA, 16 nt, Human herpesvirus 2
cgugcuuccgcacccc

SEQ ID NO: 3962634 - RNA, 17 nt, Human herpesvirus 2
cguggagcgccgggccu

SEQ ID NO: 3962635 - RNA, 18 nt, Human herpesvirus 2
cguggagcgccgggccuc

SEQ ID NO: 3962636 - RNA, 12 nt, Human herpesvirus 2
cguggcccucca

SEQ ID NO: 3962637 - RNA, 18 nt, Human herpesvirus 2
cguggccggcgacccgcc

SEQ ID NO: 3962638 - RNA, 14 nt, Human herpesvirus 2
cgugggugacuggg

SEQ ID NO: 3962639 - RNA, 22 nt, Human herpesvirus 2
cguguccgcgggaagcgccgcg

SEQ ID NO: 3962640 - RNA, 20 nt, Human herpesvirus 2
cgugucggagcucgacgcac

SEQ ID NO: 3962641 - RNA, 14 nt, Human herpesvirus 2
cguuacugaugugu

SEQ ID NO: 3962642 - RNA, 15 nt, Human herpesvirus 2
cguucgucgggccgu

SEQ ID NO: 3962643 - RNA, 23 nt, Human herpesvirus 2
cguuuccuccgcgggucccuucc

SEQ ID NO: 3962644 - RNA, 12 nt, Human herpesvirus 2
cuacccccaccc

SEQ ID NO: 3962645 - RNA, 17 nt, Human herpesvirus 2
cuaguacccagaggcug

SEQ ID NO: 3962646 - RNA, 19 nt, Human herpesvirus 2
cuauggggggggaaaggaa

SEQ ID NO: 3962647 - RNA, 19 nt, Human herpesvirus 2
cucaccgagccgcugugcc

SEQ ID NO: 3962648 - RNA, 13 nt, Human herpesvirus 2
cucacucuuuauu

SEQ ID NO: 3962649 - RNA, 14 nt, Human herpesvirus 2
cuccagcuuggccg

SEQ ID NO: 3962650 - RNA, 20 nt, Human herpesvirus 2
cucccaauucgucaccuggc

SEQ ID NO: 3962651 - RNA, 20 nt, Human herpesvirus 2
cucccccgcgagcaccgacc

SEQ ID NO: 3962652 - RNA, 16 nt, Human herpesvirus 2
cucccccgcuucuggc

SEQ ID NO: 3962653 - RNA, 17 nt, Human herpesvirus 2
cuccccgaaagccacca

SEQ ID NO: 3962654 - RNA, 21 nt, Human herpesvirus 2
cuccccgaaagccaccaauac

SEQ ID NO: 3962655 - RNA, 15 nt, Human herpesvirus 2
cuccccgcuggagcc

SEQ ID NO: 3962656 - RNA, 14 nt, Human herpesvirus 2
cucccgccuccggc

SEQ ID NO: 3962657 - RNA, 18 nt, Human herpesvirus 2
cucccggcccgccgacca

SEQ ID NO: 3962658 - RNA, 17 nt, Human herpesvirus 2
cucccucuuucccuccc

SEQ ID NO: 3962659 - RNA, 16 nt, Human herpesvirus 2
cuccgaccggcggggc

SEQ ID NO: 3962660 - RNA, 22 nt, Human herpesvirus 2
cuccgccaugcaacgccgggcg

SEQ ID NO: 3962661 - RNA, 21 nt, Human herpesvirus 2
cuccugcccgcgaccccccgg

SEQ ID NO: 3962662 - RNA, 20 nt, Human herpesvirus 2
cuccuuuuuucuuuuucucu

SEQ ID NO: 3962663 - RNA, 12 nt, Human herpesvirus 2
cucgaaggaggg

SEQ ID NO: 3962664 - RNA, 17 nt, Human herpesvirus 2
cucgcggcggcuccccc

SEQ ID NO: 3962665 - RNA, 20 nt, Human herpesvirus 2
cucgcugcgccgggcgcgcc

SEQ ID NO: 3962666 - RNA, 18 nt, Human herpesvirus 2
cucgucgccaacggccag

SEQ ID NO: 3962667 - RNA, 24 nt, Human herpesvirus 2
cucgucgcgcgcaucgccaacucu

SEQ ID NO: 3962668 - RNA, 14 nt, Human herpesvirus 2
cucgucguggcccu

SEQ ID NO: 3962669 - RNA, 17 nt, Human herpesvirus 2
cucgucguggcccuccu

SEQ ID NO: 3962670 - RNA, 16 nt, Human herpesvirus 2
cucguuccucacgggg

SEQ ID NO: 3962671 - RNA, 14 nt, Human herpesvirus 2
cucguucugcugca

SEQ ID NO: 3962672 - RNA, 20 nt, Human herpesvirus 2
cucucgggggaugguggugg

SEQ ID NO: 3962673 - RNA, 17 nt, Human herpesvirus 2
cucugcccgaccgggcg

SEQ ID NO: 3962674 - RNA, 14 nt, Human herpesvirus 2
cucuguuccuuucc

SEQ ID NO: 3962675 - RNA, 21 nt, Human herpesvirus 2
cucuguuccuuucccuucucc

SEQ ID NO: 3962676 - RNA, 18 nt, Human herpesvirus 2
cugcaucgcaagccaccc

SEQ ID NO: 3962677 - RNA, 15 nt, Human herpesvirus 2
cugcccgcgaccccc

SEQ ID NO: 3962678 - RNA, 11 nt, Human herpesvirus 2
cugcgaggugc

SEQ ID NO: 3962679 - RNA, 23 nt, Human herpesvirus 2
cugcgcacgacagaccuccccgu

SEQ ID NO: 3962680 - RNA, 12 nt, Human herpesvirus 2
cugcgcaggucc

SEQ ID NO: 3962681 - RNA, 16 nt, Human herpesvirus 2
cugcgccaccggccug

SEQ ID NO: 3962682 - RNA, 19 nt, Human herpesvirus 2
cugcgcgcgcaccugcggg

SEQ ID NO: 3962683 - RNA, 16 nt, Human herpesvirus 2
cugcggacuggcagcc

SEQ ID NO: 3962684 - RNA, 16 nt, Human herpesvirus 2
cugcggcaggcgaccc

SEQ ID NO: 3962685 - RNA, 20 nt, Human herpesvirus 2
cugcggggaccagccgacgu

SEQ ID NO: 3962686 - RNA, 20 nt, Human herpesvirus 2
cuggacccagacacggugcg

SEQ ID NO: 3962687 - RNA, 14 nt, Human herpesvirus 2
cuggaggcaaacac

SEQ ID NO: 3962688 - RNA, 17 nt, Human herpesvirus 2
cuggaggggggugcugu

SEQ ID NO: 3962689 - RNA, 22 nt, Human herpesvirus 2
cuggccgagcguaucggccagg

SEQ ID NO: 3962690 - RNA, 13 nt, Human herpesvirus 2
cuggcgcaccugc

SEQ ID NO: 3962691 - RNA, 19 nt, Human herpesvirus 2
cuggcggaagugccgcacg

SEQ ID NO: 3962692 - RNA, 14 nt, Human herpesvirus 2
cuggcggccccugu

SEQ ID NO: 3962693 - RNA, 16 nt, Human herpesvirus 2
cugggaacucgcccgc

SEQ ID NO: 3962694 - RNA, 16 nt, Human herpesvirus 2
cugggcgcgagccagg

SEQ ID NO: 3962695 - RNA, 17 nt, Human herpesvirus 2
cuggggcggcggcgucu

SEQ ID NO: 3962696 - RNA, 14 nt, Human herpesvirus 2
cugggguacugcac

SEQ ID NO: 3962697 - RNA, 18 nt, Human herpesvirus 2
cugggguacugcacugcc

SEQ ID NO: 3962698 - RNA, 22 nt, Human herpesvirus 2
cugggguauuugggugggacuu

SEQ ID NO: 3962699 - RNA, 17 nt, Human herpesvirus 2
cugggucgggagcagga

SEQ ID NO: 3962700 - RNA, 21 nt, Human herpesvirus 2
cugguacucccuuugugcuuu

SEQ ID NO: 3962701 - RNA, 15 nt, Human herpesvirus 2
cugguggcaccuccc

SEQ ID NO: 3962702 - RNA, 11 nt, Human herpesvirus 2
cugguggugga

SEQ ID NO: 3962703 - RNA, 14 nt, Human herpesvirus 2
cuguacgacagcgg

SEQ ID NO: 3962704 - RNA, 23 nt, Human herpesvirus 2
cuguccccgccccccccaggggg

SEQ ID NO: 3962705 - RNA, 16 nt, Human herpesvirus 2
cugugccagguggccc

SEQ ID NO: 3962706 - RNA, 19 nt, Human herpesvirus 2
cuguuuuuacgggccccgg

SEQ ID NO: 3962707 - RNA, 21 nt, Human herpesvirus 2
cuucccgguaugguaauuaga

SEQ ID NO: 3962708 - RNA, 16 nt, Human herpesvirus 2
cuucgccgacgccuuc

SEQ ID NO: 3962709 - RNA, 21 nt, Human herpesvirus 2
cuucggggacuugacggucgc

SEQ ID NO: 3962710 - RNA, 17 nt, Human herpesvirus 2
cuucuuuaaccgcgagc

SEQ ID NO: 3962711 - RNA, 12 nt, Human herpesvirus 2
cuucuuuccccc

SEQ ID NO: 3962712 - RNA, 17 nt, Human herpesvirus 2
cuuggaggcccucuggg

SEQ ID NO: 3962713 - RNA, 19 nt, Human herpesvirus 2
cuuggggaaaucuauugac

SEQ ID NO: 3962714 - RNA, 19 nt, Human herpesvirus 2
cuuuccaccccccuucccc

SEQ ID NO: 3962715 - RNA, 20 nt, Human herpesvirus 2
cuuucggccaccaccccccu

SEQ ID NO: 3962716 - RNA, 14 nt, Human herpesvirus 2
cuuucuuucccccc

SEQ ID NO: 3962717 - RNA, 11 nt, Human herpesvirus 2
cuuugacuccu

SEQ ID NO: 3962718 - RNA, 17 nt, Human herpesvirus 2
cuuuuaaugggccggcg

SEQ ID NO: 3962719 - RNA, 20 nt, Human herpesvirus 2
cuuuucccccuacccuuccc

SEQ ID NO: 3962720 - RNA, 15 nt, Human herpesvirus 2
gaaaacuugaggaaa

SEQ ID NO: 3962721 - RNA, 15 nt, Human herpesvirus 2
gaaacggcaagaaag

SEQ ID NO: 3962722 - RNA, 20 nt, Human herpesvirus 2
gaaacuuccgggagcggggg

SEQ ID NO: 3962723 - RNA, 16 nt, Human herpesvirus 2
gaaagaaagagaaaca

SEQ ID NO: 3962724 - RNA, 17 nt, Human herpesvirus 2
gaaaggaaaggaaacag

SEQ ID NO: 3962725 - RNA, 18 nt, Human herpesvirus 2
gaacccgguaaauaccac

SEQ ID NO: 3962726 - RNA, 13 nt, Human herpesvirus 2
gaacggucuccgc

SEQ ID NO: 3962727 - RNA, 17 nt, Human herpesvirus 2
gaacucucccggcuccu

SEQ ID NO: 3962728 - RNA, 16 nt, Human herpesvirus 2
gaacuguguuuccccc

SEQ ID NO: 3962729 - RNA, 12 nt, Human herpesvirus 2
gaagagcuccaa

SEQ ID NO: 3962730 - RNA, 14 nt, Human herpesvirus 2
gaaggcggacccag

SEQ ID NO: 3962731 - RNA, 15 nt, Human herpesvirus 2
gaagggacccgcgga

SEQ ID NO: 3962732 - RNA, 14 nt, Human herpesvirus 2
gaagucacccgggu

SEQ ID NO: 3962733 - RNA, 15 nt, Human herpesvirus 2
gaaugacacaaaaau

SEQ ID NO: 3962734 - RNA, 19 nt, Human herpesvirus 2
gacacaauaacaaacagac

SEQ ID NO: 3962735 - RNA, 18 nt, Human herpesvirus 2
gacacacacaccccccuu

SEQ ID NO: 3962736 - RNA, 16 nt, Human herpesvirus 2
gacacgcgcccggggc

SEQ ID NO: 3962737 - RNA, 17 nt, Human herpesvirus 2
gacagacaauaaagcau

SEQ ID NO: 3962738 - RNA, 17 nt, Human herpesvirus 2
gacaugauagagggaac

SEQ ID NO: 3962739 - RNA, 17 nt, Human herpesvirus 2
aggucccgauggccgcc

SEQ ID NO: 3962740 - RNA, 15 nt, Human herpesvirus 2
aggugcugccgccgc

SEQ ID NO: 3962741 - RNA, 14 nt, Human herpesvirus 2
aguaccccaguucc

SEQ ID NO: 3962742 - RNA, 18 nt, Human herpesvirus 2
agucaaacgucccaaacu

SEQ ID NO: 3962743 - RNA, 13 nt, Human herpesvirus 2
agucucgaaggag

SEQ ID NO: 3962744 - RNA, 13 nt, Human herpesvirus 2
agugccgcacggc

SEQ ID NO: 3962745 - RNA, 14 nt, Human herpesvirus 2
aguucaauagauuu

SEQ ID NO: 3962746 - RNA, 15 nt, Human herpesvirus 2
auaaagacuguugau

SEQ ID NO: 3962747 - RNA, 15 nt, Human herpesvirus 2
auaacgcgcccgcgu

SEQ ID NO: 3962748 - RNA, 13 nt, Human herpesvirus 2
auacucuguuuau

SEQ ID NO: 3962749 - RNA, 18 nt, Human herpesvirus 2
auacuugcgcggcuugcg

SEQ ID NO: 3962750 - RNA, 18 nt, Human herpesvirus 2
auccaggauuaccgaccc

SEQ ID NO: 3962751 - RNA, 23 nt, Human herpesvirus 2
aucccgaagccaucugaagccgu

SEQ ID NO: 3962752 - RNA, 22 nt, Human herpesvirus 2
auccgacggcaugcagcccaga

SEQ ID NO: 3962753 - RNA, 22 nt, Human herpesvirus 2
auccgcgagggcccggcgccgc

SEQ ID NO: 3962754 - RNA, 23 nt, Human herpesvirus 2
auccgcgagggcccggcgccgcc

SEQ ID NO: 3962755 - RNA, 20 nt, Human herpesvirus 2
auccggcggcggggaaacgu

SEQ ID NO: 3962756 - RNA, 21 nt, Human herpesvirus 2
aucgcacccauccaucuggga

SEQ ID NO: 3962757 - RNA, 21 nt, Human herpesvirus 2
aucggccaggagguccuggag

SEQ ID NO: 3962758 - RNA, 19 nt, Human herpesvirus 2
aucgucccgguugcguugc

SEQ ID NO: 3962759 - RNA, 18 nt, Human herpesvirus 2
aucuuggcguuauuucca

SEQ ID NO: 3962760 - RNA, 13 nt, Human herpesvirus 2
augacacaaaaau

SEQ ID NO: 3962761 - RNA, 13 nt, Human herpesvirus 2
augcaaauuaaaa

SEQ ID NO: 3962762 - RNA, 19 nt, Human herpesvirus 2
augccguucggaccugggg

SEQ ID NO: 3962763 - RNA, 16 nt, Human herpesvirus 2
augcgccugguggucg

SEQ ID NO: 3962764 - RNA, 15 nt, Human herpesvirus 2
augcuaauuaaauac

SEQ ID NO: 3962765 - RNA, 17 nt, Human herpesvirus 2
auggagaagggaaagga

SEQ ID NO: 3962766 - RNA, 14 nt, Human herpesvirus 2
auggccgccccgca

SEQ ID NO: 3962767 - RNA, 15 nt, Human herpesvirus 2
auggcggccgcgccc

SEQ ID NO: 3962768 - RNA, 14 nt, Human herpesvirus 2
auggcguacccggg

SEQ ID NO: 3962769 - RNA, 22 nt, Human herpesvirus 2
augggccggcguucccgcucgc

SEQ ID NO: 3962770 - RNA, 19 nt, Human herpesvirus 2
auggggggggaaaggaaag

SEQ ID NO: 3962771 - RNA, 19 nt, Human herpesvirus 2
augucaggggcccgccgcc

SEQ ID NO: 3962772 - RNA, 16 nt, Human herpesvirus 2
augucaguccucgggg

SEQ ID NO: 3962773 - RNA, 15 nt, Human herpesvirus 2
auguguucuccugga

SEQ ID NO: 3962774 - RNA, 16 nt, Human herpesvirus 2
auuaccgaccccccgg

SEQ ID NO: 3962775 - RNA, 20 nt, Human herpesvirus 2
auuagcaacuuuuaaugggc

SEQ ID NO: 3962776 - RNA, 15 nt, Human herpesvirus 2
auuccagcagcuucc

SEQ ID NO: 3962777 - RNA, 19 nt, Human herpesvirus 2
auugaccggggccccaucu

SEQ ID NO: 3962778 - RNA, 17 nt, Human herpesvirus 2
auuuaaggagucgccgc

SEQ ID NO: 3962779 - RNA, 20 nt, Human herpesvirus 2
auuuacgcggugcgccccgc

SEQ ID NO: 3962780 - RNA, 22 nt, Human herpesvirus 2
auuucccaaacacugaggaacu

SEQ ID NO: 3962781 - RNA, 17 nt, Human herpesvirus 2
auuuuccccccaccccu

SEQ ID NO: 3962782 - RNA, 15 nt, Human herpesvirus 2
caaaaaaaagaaaca

SEQ ID NO: 3962783 - RNA, 18 nt, Human herpesvirus 2
caaaagaaacggcaagaa

SEQ ID NO: 3962784 - RNA, 14 nt, Human herpesvirus 2
caaacaaaaacaca

SEQ ID NO: 3962785 - RNA, 14 nt, Human herpesvirus 2
caaccuggcacagc

SEQ ID NO: 3962786 - RNA, 16 nt, Human herpesvirus 2
acacugaggaacuggg

SEQ ID NO: 3962787 - RNA, 15 nt, Human herpesvirus 2
acagacaauaaagca

SEQ ID NO: 3962788 - RNA, 13 nt, Human herpesvirus 2
acagccccugggg

SEQ ID NO: 3962789 - RNA, 17 nt, Human herpesvirus 2
acagcgggcacucuggc

SEQ ID NO: 3962790 - RNA, 23 nt, Human herpesvirus 2
acagcggggacccgggcgagcug

SEQ ID NO: 3962791 - RNA, 12 nt, Human herpesvirus 2
accaaaagggaa

SEQ ID NO: 3962792 - RNA, 13 nt, Human herpesvirus 2
accaaaagggaaa

SEQ ID NO: 3962793 - RNA, 16 nt, Human herpesvirus 2
accaccccccuccucc

SEQ ID NO: 3962794 - RNA, 11 nt, Human herpesvirus 2
accagccgccu

SEQ ID NO: 3962795 - RNA, 16 nt, Human herpesvirus 2
accagcggccccaucc

SEQ ID NO: 3962796 - RNA, 17 nt, Human herpesvirus 2
accaucgcguacagccu

SEQ ID NO: 3962797 - RNA, 18 nt, Human herpesvirus 2
acccaaccgacucccucc

SEQ ID NO: 3962798 - RNA, 14 nt, Human herpesvirus 2
acccacccucggug

SEQ ID NO: 3962799 - RNA, 13 nt, Human herpesvirus 2
acccagaggcugg

SEQ ID NO: 3962800 - RNA, 13 nt, Human herpesvirus 2
accccaaaccaac

SEQ ID NO: 3962801 - RNA, 16 nt, Human herpesvirus 2
acccccagcgcggacg

SEQ ID NO: 3962802 - RNA, 19 nt, Human herpesvirus 2
acccccaucgggcugcugg

SEQ ID NO: 3962803 - RNA, 12 nt, Human herpesvirus 2
accccccccucu

SEQ ID NO: 3962804 - RNA, 16 nt, Human herpesvirus 2
acccccgaacagcccc

SEQ ID NO: 3962805 - RNA, 24 nt, Human herpesvirus 2
acccccgaacagccccuggggcug

SEQ ID NO: 3962806 - RNA, 15 nt, Human herpesvirus 2
acccccuguccccgc

SEQ ID NO: 3962807 - RNA, 16 nt, Human herpesvirus 2
accccgccgcagcuca

SEQ ID NO: 3962808 - RNA, 15 nt, Human herpesvirus 2
accccuuugacuccu

SEQ ID NO: 3962809 - RNA, 16 nt, Human herpesvirus 2
acccuagccuucggcc

SEQ ID NO: 3962810 - RNA, 15 nt, Human herpesvirus 2
accgaaggaggaaag

SEQ ID NO: 3962811 - RNA, 19 nt, Human herpesvirus 2
accgcacccgggccgggug

SEQ ID NO: 3962812 - RNA, 22 nt, Human herpesvirus 2
accgcgaccagcguccugcgcg

SEQ ID NO: 3962813 - RNA, 15 nt, Human herpesvirus 2
accgcgcccacagcc

SEQ ID NO: 3962814 - RNA, 15 nt, Human herpesvirus 2
accgcgcggaccggc

SEQ ID NO: 3962815 - RNA, 17 nt, Human herpesvirus 2
accggcccccggagucc

SEQ ID NO: 3962816 - RNA, 15 nt, Human herpesvirus 2
accggggacuccccu

SEQ ID NO: 3962817 - RNA, 14 nt, Human herpesvirus 2
accgucgccgccgg

SEQ ID NO: 3962818 - RNA, 15 nt, Human herpesvirus 2
accucgcggcggcuc

SEQ ID NO: 3962819 - RNA, 14 nt, Human herpesvirus 2
acgacgaugcaugu

SEQ ID NO: 3962820 - RNA, 13 nt, Human herpesvirus 2
acgagacagacga

SEQ ID NO: 3962821 - RNA, 14 nt, Human herpesvirus 2
acgagcugccccgc

SEQ ID NO: 3962822 - RNA, 16 nt, Human herpesvirus 2
acgccaauaucaucga

SEQ ID NO: 3962823 - RNA, 19 nt, Human herpesvirus 2
acgcccaggcccuggcgca

SEQ ID NO: 3962824 - RNA, 17 nt, Human herpesvirus 2
acgccuggcggccccug

SEQ ID NO: 3962825 - RNA, 17 nt, Human herpesvirus 2
acgcgaccgucgccgcc

SEQ ID NO: 3962826 - RNA, 19 nt, Human herpesvirus 2
acgcgguauuguacccccg

SEQ ID NO: 3962827 - RNA, 13 nt, Human herpesvirus 2
acgcguuucccuu

SEQ ID NO: 3962828 - RNA, 14 nt, Human herpesvirus 2
acgcucucugccuc

SEQ ID NO: 3962829 - RNA, 13 nt, Human herpesvirus 2
acggcaagaaaga

SEQ ID NO: 3962830 - RNA, 15 nt, Human herpesvirus 2
acggccccgaacagc

SEQ ID NO: 3962831 - RNA, 12 nt, Human herpesvirus 2
acggucagucug

SEQ ID NO: 3962832 - RNA, 19 nt, Human herpesvirus 2
acgguccucaccgagccgc

SEQ ID NO: 3962833 - RNA, 16 nt, Human herpesvirus 2
acggucgauuuaacca

SEQ ID NO: 3962834 - RNA, 22 nt, Human herpesvirus 2
acggugcgugcggcccugccuc

SEQ ID NO: 3962835 - RNA, 22 nt, Human herpesvirus 2
acguacguucugccccgcgucg

SEQ ID NO: 3962836 - RNA, 16 nt, Human herpesvirus 2
acguccugcggcucau

SEQ ID NO: 3962837 - RNA, 13 nt, Human herpesvirus 2
acgucgccccccc

SEQ ID NO: 3962838 - RNA, 18 nt, Human herpesvirus 2
acgugggaugacggaggc

SEQ ID NO: 3962839 - RNA, 23 nt, Human herpesvirus 2
acucacucguggaugccggggcc

SEQ ID NO: 3962840 - RNA, 19 nt, Human herpesvirus 2
acuccaccccccccucuca

SEQ ID NO: 3962841 - RNA, 17 nt, Human herpesvirus 2
acugcacuugccccccc

SEQ ID NO: 3962842 - RNA, 17 nt, Human herpesvirus 2
acugccugacccucucg

SEQ ID NO: 3962843 - RNA, 22 nt, Human herpesvirus 2
acuggagguggucggcggccaa

SEQ ID NO: 3962844 - RNA, 21 nt, Human herpesvirus 2
acuuccgugccccuggacugg

SEQ ID NO: 3962845 - RNA, 16 nt, Human herpesvirus 2
agaaauaaagaacgag

SEQ ID NO: 3962846 - RNA, 13 nt, Human herpesvirus 2
agaacgagacaga

SEQ ID NO: 3962847 - RNA, 16 nt, Human herpesvirus 2
agaagccuacuacucg

SEQ ID NO: 3962848 - RNA, 11 nt, Human herpesvirus 2
agaauaaaagg

SEQ ID NO: 3962849 - RNA, 13 nt, Human herpesvirus 2
agacacaaaagcu

SEQ ID NO: 3962850 - RNA, 13 nt, Human herpesvirus 2
agaccuccccgug

SEQ ID NO: 3962851 - RNA, 23 nt, Human herpesvirus 2
agaccuccccgugcgugcugcug

SEQ ID NO: 3962852 - RNA, 16 nt, Human herpesvirus 2
agagacccugcccccc

SEQ ID NO: 3962853 - RNA, 12 nt, Human herpesvirus 2
agagauuucccc

SEQ ID NO: 3962854 - RNA, 18 nt, Human herpesvirus 2
agagcggcgagugcucgc

SEQ ID NO: 3962855 - RNA, 19 nt, Human herpesvirus 2
agaggcccggaacgagguu

SEQ ID NO: 3962856 - RNA, 16 nt, Human herpesvirus 2
agagggggggaaagaa

SEQ ID NO: 3962857 - RNA, 20 nt, Human herpesvirus 2
agaggucaauagauuucccc

SEQ ID NO: 3962858 - RNA, 21 nt, Human herpesvirus 2
agaguucaauagauuucccaa

SEQ ID NO: 3962859 - RNA, 18 nt, Human herpesvirus 2
agauccccggggcccgca

SEQ ID NO: 3962860 - RNA, 13 nt, Human herpesvirus 2
agaugccagugga

SEQ ID NO: 3962861 - RNA, 16 nt, Human herpesvirus 2
agauggggagaggggg

SEQ ID NO: 3962862 - RNA, 20 nt, Human herpesvirus 2
agcaaccgccgcgcgacggc

SEQ ID NO: 3962863 - RNA, 14 nt, Human herpesvirus 2
agcacgaccaggga

SEQ ID NO: 3962864 - RNA, 15 nt, Human herpesvirus 2
agcacgaccagggag

SEQ ID NO: 3962865 - RNA, 13 nt, Human herpesvirus 2
agccacccugggu

SEQ ID NO: 3962866 - RNA, 22 nt, Human herpesvirus 2
agccaggcaaacgguaagcagc

SEQ ID NO: 3962867 - RNA, 21 nt, Human herpesvirus 2
agcccgaacggaaggccuccc

SEQ ID NO: 3962868 - RNA, 14 nt, Human herpesvirus 2
agcccguggcccac

SEQ ID NO: 3962869 - RNA, 21 nt, Human herpesvirus 2
agccgcgccgcugcccgacgc

SEQ ID NO: 3962870 - RNA, 20 nt, Human herpesvirus 2
agccugcgaaucccccaagg

SEQ ID NO: 3962871 - RNA, 24 nt, Human herpesvirus 2
agcgcccuuccgcguccgcgauga

SEQ ID NO: 3962872 - RNA, 19 nt, Human herpesvirus 2
agcgccgcuacugcgccac

SEQ ID NO: 3962873 - RNA, 19 nt, Human herpesvirus 2
agcgcgggggacgggccgc

SEQ ID NO: 3962874 - RNA, 14 nt, Human herpesvirus 2
agcggccccgaccc

SEQ ID NO: 3962875 - RNA, 17 nt, Human herpesvirus 2
agcggcgaacacugccu

SEQ ID NO: 3962876 - RNA, 16 nt, Human herpesvirus 2
agcggcguccacgccc

SEQ ID NO: 3962877 - RNA, 20 nt, Human herpesvirus 2
agcguaacgcacccccggac

SEQ ID NO: 3962878 - RNA, 14 nt, Human herpesvirus 2
agcgucaggcccgc

SEQ ID NO: 3962879 - RNA, 18 nt, Human herpesvirus 2
agcguccggcuggcggcg

SEQ ID NO: 3962880 - RNA, 15 nt, Human herpesvirus 2
agcucaucgcacggc

SEQ ID NO: 3962881 - RNA, 18 nt, Human herpesvirus 2
agcuccucuucgggcacc

SEQ ID NO: 3962882 - RNA, 18 nt, Human herpesvirus 2
agcucgcggagggcggcc

SEQ ID NO: 3962883 - RNA, 22 nt, Human herpesvirus 2
agcuuggccguguggucgcccc

SEQ ID NO: 3962884 - RNA, 21 nt, Human herpesvirus 2
aggaacuggguuacugcacuu

SEQ ID NO: 3962885 - RNA, 18 nt, Human herpesvirus 2
aggacagccgacccgucu

SEQ ID NO: 3962886 - RNA, 18 nt, Human herpesvirus 2
aggacgcgagcgacagcg

SEQ ID NO: 3962887 - RNA, 20 nt, Human herpesvirus 2
aggacgcgcuaguacccaga

SEQ ID NO: 3962888 - RNA, 21 nt, Human herpesvirus 2
aggauggguccgacgaggccu

SEQ ID NO: 3962889 - RNA, 15 nt, Human herpesvirus 2
aggcccccggcccug

SEQ ID NO: 3962890 - RNA, 14 nt, Human herpesvirus 2
aggcggucccggcc

SEQ ID NO: 3962891 - RNA, 17 nt, Human herpesvirus 2
aggcggucccggccgcc

SEQ ID NO: 3962892 - RNA, 23 nt, Human herpesvirus 2
aggcguggugauacaacacaccc

SEQ ID NO: 3962893 - RNA, 14 nt, Human herpesvirus 2
aggcuggagcucug

SEQ ID NO: 3962894 - RNA, 20 nt, Human herpesvirus 2
aggcuguccgccgggcguga

SEQ ID NO: 3962895 - RNA, 12 nt, Human herpesvirus 2
agggcagggccg

SEQ ID NO: 3962896 - RNA, 17 nt, Human herpesvirus 2
agggcccggcgccgccc

SEQ ID NO: 3962897 - RNA, 18 nt, Human herpesvirus 2
agggcuucguggaagagg

SEQ ID NO: 3962898 - RNA, 12 nt, Human herpesvirus 2
agggggaaggaa

SEQ ID NO: 3962899 - RNA, 23 nt, Human herpesvirus 2
agggggcaauuaauaaagacugu

SEQ ID NO: 3962900 - RNA, 12 nt, Human herpesvirus 2
agggggcggcgc

SEQ ID NO: 3962901 - RNA, 14 nt, Human herpesvirus 2
aggguggcuggggu

SEQ ID NO: 3962902 - RNA, 12 nt, Human herpesvirus 2
aggguggggcug

SEQ ID NO: 3962903 - RNA, 18 nt, Human herpesvirus 2
agggugugacccccccau

SEQ ID NO: 3962904 - RNA, 13 nt, Human herpesvirus 2
caccgggggcccc

SEQ ID NO: 3962905 - RNA, 15 nt, Human herpesvirus 2
caccguccaccuccg

SEQ ID NO: 3962906 - RNA, 17 nt, Human herpesvirus 2
caccuccccggcggccg

SEQ ID NO: 3962907 - RNA, 19 nt, Human herpesvirus 2
caccucgcggcggcucccc

SEQ ID NO: 3962908 - RNA, 14 nt, Human herpesvirus 2
cacgacaggugggg

SEQ ID NO: 3962909 - RNA, 19 nt, Human herpesvirus 2
cacgaccaaaacggacccc

SEQ ID NO: 3962910 - RNA, 20 nt, Human herpesvirus 2
cacgagcacaaacgugcucu

SEQ ID NO: 3962911 - RNA, 21 nt, Human herpesvirus 2
cacgauaccguuuaucgugua

SEQ ID NO: 3962912 - RNA, 20 nt, Human herpesvirus 2
cacgcaacaacggcgggccc

SEQ ID NO: 3962913 - RNA, 20 nt, Human herpesvirus 2
cacgcaggccgcccccagca

SEQ ID NO: 3962914 - RNA, 17 nt, Human herpesvirus 2
cacgccguggacgcccc

SEQ ID NO: 3962915 - RNA, 12 nt, Human herpesvirus 2
cacgcgcuggcc

SEQ ID NO: 3962916 - RNA, 15 nt, Human herpesvirus 2
cacgcgcuggccccu

SEQ ID NO: 3962917 - RNA, 22 nt, Human herpesvirus 2
cacgcggggacccgccagagac

SEQ ID NO: 3962918 - RNA, 21 nt, Human herpesvirus 2
cacgcugcgcgcgcaccugcg

SEQ ID NO: 3962919 - RNA, 14 nt, Human herpesvirus 2
cacggacacggccc

SEQ ID NO: 3962920 - RNA, 22 nt, Human herpesvirus 2
cacggccgugucgcuaaacagg

SEQ ID NO: 3962921 - RNA, 18 nt, Human herpesvirus 2
cacggucggugcccccca

SEQ ID NO: 3962922 - RNA, 14 nt, Human herpesvirus 2
cacggucugguggc

SEQ ID NO: 3962923 - RNA, 17 nt, Human herpesvirus 2
cacggucugguggcgcu

SEQ ID NO: 3962924 - RNA, 13 nt, Human herpesvirus 2
cacgucgcaugca

SEQ ID NO: 3962925 - RNA, 19 nt, Human herpesvirus 2
cacgucggacgccagcugc

SEQ ID NO: 3962926 - RNA, 18 nt, Human herpesvirus 2
cacugccccccuccuggg

SEQ ID NO: 3962927 - RNA, 21 nt, Human herpesvirus 2
cagaacccccguaaacaccag

SEQ ID NO: 3962928 - RNA, 16 nt, Human herpesvirus 2
cagaauaaaaggcauu

SEQ ID NO: 3962929 - RNA, 20 nt, Human herpesvirus 2
cagacccgagcuccggggga

SEQ ID NO: 3962930 - RNA, 21 nt, Human herpesvirus 2
cagaccgaagaggugcugccg

SEQ ID NO: 3962931 - RNA, 13 nt, Human herpesvirus 2
cagacgacagaca

SEQ ID NO: 3962932 - RNA, 19 nt, Human herpesvirus 2
cagacuggccgugcugggc

SEQ ID NO: 3962933 - RNA, 22 nt, Human herpesvirus 2
cagaugcugcccgcggaccacc

SEQ ID NO: 3962934 - RNA, 19 nt, Human herpesvirus 3
cggucgcguguacgaaaac

SEQ ID NO: 3962935 - RNA, 16 nt, Human herpesvirus 3
cguaauacaugcuuug

SEQ ID NO: 3962936 - RNA, 22 nt, Human herpesvirus 3
cguacaaucgaaaaaaggugua

SEQ ID NO: 3962937 - RNA, 20 nt, Human herpesvirus 3
cguauuuuuauuuaaaugug

SEQ ID NO: 3962938 - RNA, 18 nt, Human herpesvirus 3
cgucaacugcaacaugca

SEQ ID NO: 3962939 - RNA, 14 nt, Human herpesvirus 3
cguguauacaauua

SEQ ID NO: 3962940 - RNA, 15 nt, Human herpesvirus 3
cguguuaaacacugu

SEQ ID NO: 3962941 - RNA, 17 nt, Human herpesvirus 3
cguguuuuuaauagaga

SEQ ID NO: 3962942 - RNA, 16 nt, Human herpesvirus 3
cguuacgggggugugg

SEQ ID NO: 3962943 - RNA, 16 nt, Human herpesvirus 3
cguuauacaagguguu

SEQ ID NO: 3962944 - RNA, 22 nt, Human herpesvirus 3
cguuauagcaggggucuccaga

SEQ ID NO: 3962945 - RNA, 16 nt, Human herpesvirus 3
cguuauggaguucaaa

SEQ ID NO: 3962946 - RNA, 15 nt, Human herpesvirus 3
cuaacaacucuggag

SEQ ID NO: 3962947 - RNA, 22 nt, Human herpesvirus 3
cuacuauuugugaagacuuuau

SEQ ID NO: 3962948 - RNA, 18 nt, Human herpesvirus 3
cuacuuagcggacaugcu

SEQ ID NO: 3962949 - RNA, 14 nt, Human herpesvirus 3
cuauacgcauuucg

SEQ ID NO: 3962950 - RNA, 19 nt, Human herpesvirus 3
cuauauaacgccucccagc

SEQ ID NO: 3962951 - RNA, 21 nt, Human herpesvirus 3
cucacugcuauagccgucaga

SEQ ID NO: 3962952 - RNA, 13 nt, Human herpesvirus 3
cucacuguuuucg

SEQ ID NO: 3962953 - RNA, 19 nt, Human herpesvirus 3
cuccaagcucguuuuauga

SEQ ID NO: 3962954 - RNA, 17 nt, Human herpesvirus 3
cuccacuucgucugugg

SEQ ID NO: 3962955 - RNA, 14 nt, Human herpesvirus 3
cucccacccacugu

SEQ ID NO: 3962956 - RNA, 16 nt, Human herpesvirus 3
cuccgcgccuguuaau

SEQ ID NO: 3962957 - RNA, 16 nt, Human herpesvirus 3
cuccucagccaugcgg

SEQ ID NO: 3962958 - RNA, 15 nt, Human herpesvirus 3
cuccuuuucucguga

SEQ ID NO: 3962959 - RNA, 19 nt, Human herpesvirus 3
cucgaacccccgugacucc

SEQ ID NO: 3962960 - RNA, 20 nt, Human herpesvirus 3
cucgcaguuuucuuguuccc

SEQ ID NO: 3962961 - RNA, 12 nt, Human herpesvirus 3
cucguauauaca

SEQ ID NO: 3962962 - RNA, 12 nt, Human herpesvirus 3
cucgugagcgcc

SEQ ID NO: 3962963 - RNA, 18 nt, Human herpesvirus 3
cucgugagcgccacuggc

SEQ ID NO: 3962964 - RNA, 18 nt, Human herpesvirus 3
cucuggagucuccaaaug

SEQ ID NO: 3962965 - RNA, 13 nt, Human herpesvirus 3
cucuguuacauuc

SEQ ID NO: 3962966 - RNA, 18 nt, Human herpesvirus 3
cugcauaagcucuguaug

SEQ ID NO: 3962967 - RNA, 17 nt, Human herpesvirus 3
cugccacggccucggcg

SEQ ID NO: 3962968 - RNA, 21 nt, Human herpesvirus 3
cugccuuuggggguuaagcua

SEQ ID NO: 3962969 - RNA, 21 nt, Human herpesvirus 3
cugcuaaccauagacuguucu

SEQ ID NO: 3962970 - RNA, 22 nt, Human herpesvirus 3
cugcugaagcugacgaagagaa

SEQ ID NO: 3962971 - RNA, 23 nt, Human herpesvirus 3
cuggaauaaaacguuuuaaaagc

SEQ ID NO: 3962972 - RNA, 21 nt, Human herpesvirus 3
cuggcuggcgugguuauuaca

SEQ ID NO: 3962973 - RNA, 20 nt, Human herpesvirus 3
cuggucaccguguggacauc

SEQ ID NO: 3962974 - RNA, 23 nt, Human herpesvirus 3
cuguaagacccgucgguaaauga

SEQ ID NO: 3962975 - RNA, 21 nt, Human herpesvirus 3
cugugcgggcgggcgacgggc

SEQ ID NO: 3962976 - RNA, 15 nt, Human herpesvirus 3
cuguuacauuucgaa

SEQ ID NO: 3962977 - RNA, 20 nt, Human herpesvirus 3
cuuaaaccgugugugcggag

SEQ ID NO: 3962978 - RNA, 20 nt, Human herpesvirus 3
cuuaaugguucauuguuuua

SEQ ID NO: 3962979 - RNA, 19 nt, Human herpesvirus 3
cuucugucaaguugcaugu

SEQ ID NO: 3962980 - RNA, 19 nt, Human herpesvirus 3
cuugacgcgaacaccgcug

SEQ ID NO: 3962981 - RNA, 14 nt, Human herpesvirus 3
cuuucaauauucca

SEQ ID NO: 3962982 - RNA, 19 nt, Human herpesvirus 3
gaaaauagcguugaugcaa

SEQ ID NO: 3962983 - RNA, 19 nt, Human herpesvirus 3
gaaaaucuauuaucaggag

SEQ ID NO: 3962984 - RNA, 15 nt, Human herpesvirus 3
gaaauacuaauauaa

SEQ ID NO: 3962985 - RNA, 14 nt, Human herpesvirus 3
gaaaugugcuguca

SEQ ID NO: 3962986 - RNA, 20 nt, Human herpesvirus 3
gaacuaauauucuacagauu

SEQ ID NO: 3962987 - RNA, 21 nt, Human herpesvirus 3
gaauaauuuuaaggcaaggaa

SEQ ID NO: 3962988 - RNA, 22 nt, Human herpesvirus 3
gaaucacggccgugcggucucc

SEQ ID NO: 3962989 - RNA, 15 nt, Human herpesvirus 3
gaauuacuccuuuaa

SEQ ID NO: 3962990 - RNA, 15 nt, Human herpesvirus 3
gacaauuaacacaga

SEQ ID NO: 3962991 - RNA, 19 nt, Human herpesvirus 3
gacaucaaccaguggaaua

SEQ ID NO: 3962992 - RNA, 18 nt, Human herpesvirus 3
gacaucguuuguuucuuu

SEQ ID NO: 3962993 - RNA, 12 nt, Human herpesvirus 3
gacaugcacugc

SEQ ID NO: 3962994 - RNA, 12 nt, Human herpesvirus 3
gacccaccccac

SEQ ID NO: 3962995 - RNA, 13 nt, Human herpesvirus 3
gacccccccccga

SEQ ID NO: 3962996 - RNA, 20 nt, Human herpesvirus 3
gacgacauuaaacguauucu

SEQ ID NO: 3962997 - RNA, 17 nt, Human herpesvirus 3
gacgccuuucuccggga

SEQ ID NO: 3962998 - RNA, 21 nt, Human herpesvirus 3
gacgcgugaaauguaacuaga

SEQ ID NO: 3962999 - RNA, 19 nt, Human herpesvirus 3
gacggaugugcggggagcu

SEQ ID NO: 3963000 - RNA, 22 nt, Human herpesvirus 3
gacguccacacagccucaggag

SEQ ID NO: 3963001 - RNA, 17 nt, Human herpesvirus 3
gacuguuuguuguuaau

SEQ ID NO: 3963002 - RNA, 18 nt, Human herpesvirus 3
gacuugacgcgaacaccg

SEQ ID NO: 3963003 - RNA, 13 nt, Human herpesvirus 3
gagacauaaaagu

SEQ ID NO: 3963004 - RNA, 14 nt, Human herpesvirus 3
gagacguauguucu

SEQ ID NO: 3963005 - RNA, 23 nt, Human herpesvirus 3
gagcaucucuggacccccaacga

SEQ ID NO: 3963006 - RNA, 17 nt, Human herpesvirus 3
gagcauuucgaaucguu

SEQ ID NO: 3963007 - RNA, 16 nt, Human herpesvirus 3
gagccgcggccagugc

SEQ ID NO: 3963008 - RNA, 20 nt, Human herpesvirus 3
gaggguccaucaaacacaca

SEQ ID NO: 3963009 - RNA, 19 nt, Human herpesvirus 3
gagugaaucuuaaaccuga

SEQ ID NO: 3963010 - RNA, 22 nt, Human herpesvirus 3
gaucccgccgucgcgcccaccu

SEQ ID NO: 3963011 - RNA, 23 nt, Human herpesvirus 3
gaucgguuagaugcauauuugga

SEQ ID NO: 3963012 - RNA, 21 nt, Human herpesvirus 3
gaugguaguuaccaaaguuuu

SEQ ID NO: 3963013 - RNA, 22 nt, Human herpesvirus 3
gauguuuuuaauccaauguuug

SEQ ID NO: 3963014 - RNA, 20 nt, Human herpesvirus 3
gauucaagugagguguccug

SEQ ID NO: 3963015 - RNA, 14 nt, Human herpesvirus 3
gauucuauauuaau

SEQ ID NO: 3963016 - RNA, 20 nt, Human herpesvirus 3
gauuuuaucauugaagauga

SEQ ID NO: 3963017 - RNA, 19 nt, Human herpesvirus 3
gauuuuuuuaaacaaauac

SEQ ID NO: 3963018 - RNA, 18 nt, Human herpesvirus 3
gcaacugcaaacacgcaa

SEQ ID NO: 3963019 - RNA, 23 nt, Human herpesvirus 3
gcacuaucgucucaaaacuuaag

SEQ ID NO: 3963020 - RNA, 16 nt, Human herpesvirus 3
gcaguccaugguuuua

SEQ ID NO: 3963021 - RNA, 21 nt, Human herpesvirus 3
gcaucccccauuguaugaauu

SEQ ID NO: 3963022 - RNA, 13 nt, Human herpesvirus 3
gcccacaccuacc

SEQ ID NO: 3963023 - RNA, 17 nt, Human herpesvirus 3
gcccggcggaccccggg

SEQ ID NO: 3963024 - RNA, 21 nt, Human herpesvirus 3
gccgagaagggggauuuacaa

SEQ ID NO: 3963025 - RNA, 13 nt, Human herpesvirus 3
gccgcgcuaugcg

SEQ ID NO: 3963026 - RNA, 14 nt, Human herpesvirus 3
gccgcuacccgaaa

SEQ ID NO: 3963027 - RNA, 20 nt, Human herpesvirus 3
gccggacuuuacugcacacg

SEQ ID NO: 3963028 - RNA, 18 nt, Human herpesvirus 3
gccgucgcgcccaccucg

SEQ ID NO: 3963029 - RNA, 16 nt, Human herpesvirus 3
gcgagcgcgugaggga

SEQ ID NO: 3963030 - RNA, 13 nt, Human herpesvirus 3
gcgaucgaacagg

SEQ ID NO: 3963031 - RNA, 12 nt, Human herpesvirus 3
gcgcauggccaa

SEQ ID NO: 3963032 - RNA, 15 nt, Human herpesvirus 3
gcggaccccgggaga

SEQ ID NO: 3963033 - RNA, 16 nt, Human herpesvirus 3
gcguccucuguuacau

SEQ ID NO: 3963034 - RNA, 13 nt, Human herpesvirus 3
gcugaagggugca

SEQ ID NO: 3963035 - RNA, 15 nt, Human herpesvirus 3
gcugcaagcccuccg

SEQ ID NO: 3963036 - RNA, 18 nt, Human herpesvirus 3
gcuguaggucaacauaca

SEQ ID NO: 3963037 - RNA, 16 nt, Human herpesvirus 3
gcuguccaugaugaaa

SEQ ID NO: 3963038 - RNA, 22 nt, Human herpesvirus 3
gcuucaagucucaaugaaacag

SEQ ID NO: 3963039 - RNA, 18 nt, Human herpesvirus 3
gcuucccgaaagcccgau

SEQ ID NO: 3963040 - RNA, 23 nt, Human herpesvirus 3
ggaacccaagguguaaauacugc

SEQ ID NO: 3963041 - RNA, 14 nt, Human herpesvirus 3
ggacauaugucugc

SEQ ID NO: 3963042 - RNA, 18 nt, Human herpesvirus 3
ggacuaacaaaguuggaa

SEQ ID NO: 3963043 - RNA, 20 nt, Human herpesvirus 3
ggacuaggcacuuuggcggu

SEQ ID NO: 3963044 - RNA, 23 nt, Human herpesvirus 3
ggccgugugguaugaaucucugc

SEQ ID NO: 3963045 - RNA, 17 nt, Human herpesvirus 3
ggcgacgggcgggcugg

SEQ ID NO: 3963046 - RNA, 18 nt, Human herpesvirus 3
ggcuguaggucaacauac

SEQ ID NO: 3963047 - RNA, 21 nt, Human herpesvirus 3
gggguacuugcaccacaccau

SEQ ID NO: 3963048 - RNA, 22 nt, Human herpesvirus 3
ggguacaaacgcgcaauguuuu

SEQ ID NO: 3963049 - RNA, 23 nt, Human herpesvirus 3
gggucagaaccgacccaggacau

SEQ ID NO: 3963050 - RNA, 20 nt, Human herpesvirus 3
gguagacaacugacagaaac

SEQ ID NO: 3963051 - RNA, 14 nt, Human herpesvirus 3
gguauacacaccca

SEQ ID NO: 3963052 - RNA, 18 nt, Human herpesvirus 3
gguggacguuuuuccaca

SEQ ID NO: 3963053 - RNA, 12 nt, Human herpesvirus 3
guacacccagcu

SEQ ID NO: 3963054 - RNA, 14 nt, Human herpesvirus 3
guacacccagcugu

SEQ ID NO: 3963055 - RNA, 13 nt, Human herpesvirus 3
guacgauuagaac

SEQ ID NO: 3963056 - RNA, 19 nt, Human herpesvirus 3
guacguaaccauauauaag

SEQ ID NO: 3963057 - RNA, 17 nt, Human herpesvirus 3
guagaggguccaucaaa

SEQ ID NO: 3963058 - RNA, 20 nt, Human herpesvirus 3
guauacacacccaccccaga

SEQ ID NO: 3963059 - RNA, 23 nt, Human herpesvirus 3
guauauaaaauuaaaacauugcu

SEQ ID NO: 3963060 - RNA, 12 nt, Human herpesvirus 3
gucagaaacacu

SEQ ID NO: 3963061 - RNA, 13 nt, Human herpesvirus 3
gucgggucauuau

SEQ ID NO: 3963062 - RNA, 17 nt, Human herpesvirus 3
gucgugugcuccuugga

SEQ ID NO: 3963063 - RNA, 12 nt, Human herpesvirus 3
gucugcccaccg

SEQ ID NO: 3963064 - RNA, 19 nt, Human herpesvirus 3
gucuuuuuuugaugucugu

SEQ ID NO: 3963065 - RNA, 21 nt, Human herpesvirus 3
gugagggugaccggcgggguc

SEQ ID NO: 3963066 - RNA, 18 nt, Human herpesvirus 3
gugcgacaaaggcauuug

SEQ ID NO: 3963067 - RNA, 17 nt, Human herpesvirus 3
gugguaccaaaaacaca

SEQ ID NO: 3963068 - RNA, 17 nt, Human herpesvirus 3
guggugaagaaggacag

SEQ ID NO: 3963069 - RNA, 13 nt, Human herpesvirus 3
guguuaaacacug

SEQ ID NO: 3963070 - RNA, 16 nt, Human herpesvirus 3
guuaauaaaagcggaa

SEQ ID NO: 3963071 - RNA, 15 nt, Human herpesvirus 3
guuacaucuauagca

SEQ ID NO: 3963072 - RNA, 15 nt, Human herpesvirus 3
guuacucaugugucu

SEQ ID NO: 3963073 - RNA, 20 nt, Human herpesvirus 3
guuaucuuuauuuggaaugc

SEQ ID NO: 3963074 - RNA, 22 nt, Human herpesvirus 3
guugcacguaacaagcucguug

SEQ ID NO: 3963075 - RNA, 17 nt, Human herpesvirus 3
guugguuacugugaaug

SEQ ID NO: 3963076 - RNA, 13 nt, Human herpesvirus 3
guuucccagagac

SEQ ID NO: 3963077 - RNA, 21 nt, Human herpesvirus 3
guuuucguuuugguguuacau

SEQ ID NO: 3963078 - RNA, 19 nt, Human herpesvirus 3
guuuuucuaaauuacagau

SEQ ID NO: 3963079 - RNA, 17 nt, Human herpesvirus 3
uaaaacaaguggaugau

SEQ ID NO: 3963080 - RNA, 17 nt, Human herpesvirus 3
uaaacagagaucucugu

SEQ ID NO: 3963081 - RNA, 19 nt, Human herpesvirus 3
uaaagucguuuauaucugu

SEQ ID NO: 3963082 - RNA, 16 nt, Human herpesvirus 3
uaaauaacauaaccaa

SEQ ID NO: 3963083 - RNA, 17 nt, Human herpesvirus 3
uaaccauagacuguucu

SEQ ID NO: 3963084 - RNA, 16 nt, Human herpesvirus 3
uaauaaaucuuacgua

SEQ ID NO: 3963085 - RNA, 21 nt, Human herpesvirus 3
uaauauuaacaggauuugcuu

SEQ ID NO: 3963086 - RNA, 11 nt, Human herpesvirus 3
uaaucuuuuau

SEQ ID NO: 3963087 - RNA, 22 nt, Human herpesvirus 3
uaauuccaauauuuuguuaaua

SEQ ID NO: 3963088 - RNA, 21 nt, Human herpesvirus 3
uacacauccuggacacagucc

SEQ ID NO: 3963089 - RNA, 18 nt, Human herpesvirus 3
uacacauuuaaauaaaaa

SEQ ID NO: 3963090 - RNA, 18 nt, Human herpesvirus 3
uacaccagaaacguuuuu

SEQ ID NO: 3963091 - RNA, 16 nt, Human herpesvirus 3
uacaccggauaaaagc

SEQ ID NO: 3963092 - RNA, 18 nt, Human herpesvirus 3
uacacugguaaaugguca

SEQ ID NO: 3963093 - RNA, 17 nt, Human herpesvirus 3
uacaggcaacugcaaac

SEQ ID NO: 3963094 - RNA, 20 nt, Human herpesvirus 3
uacuccacggggucuacacc

SEQ ID NO: 3963095 - RNA, 13 nt, Human herpesvirus 3
uacuuggacuguu

SEQ ID NO: 3963096 - RNA, 20 nt, Human herpesvirus 3
uagcauccaaauuaacccaa

SEQ ID NO: 3963097 - RNA, 22 nt, Human herpesvirus 3
uaggcgaccgcgggucaaugga

SEQ ID NO: 3963098 - RNA, 22 nt, Human herpesvirus 3
uaggcggguucuucacuggacu

SEQ ID NO: 3963099 - RNA, 16 nt, Human herpesvirus 3
uaguaccacgugguau

SEQ ID NO: 3963100 - RNA, 13 nt, Human herpesvirus 3
uaguauuuacgua

SEQ ID NO: 3963101 - RNA, 20 nt, Human herpesvirus 3
uauaaauccguaucucggag

SEQ ID NO: 3963102 - RNA, 22 nt, Human herpesvirus 3
uauaauaaaaagucacuauaaa

SEQ ID NO: 3963103 - RNA, 19 nt, Human herpesvirus 3
uauaucauuuuauuacauu

SEQ ID NO: 3963104 - RNA, 20 nt, Human herpesvirus 3
uauaugggcgggauuacauu

SEQ ID NO: 3963105 - RNA, 16 nt, Human herpesvirus 3
uauauuuuuaaucauu

SEQ ID NO: 3963106 - RNA, 15 nt, Human herpesvirus 3
uauccucuuaacguu

SEQ ID NO: 3963107 - RNA, 13 nt, Human herpesvirus 3
uaugaaucucugc

SEQ ID NO: 3963108 - RNA, 20 nt, Human herpesvirus 3
uaugaucauuaaacgugcau

SEQ ID NO: 3963109 - RNA, 20 nt, Human herpesvirus 3
uaugaucguccuucaacaca

SEQ ID NO: 3963110 - RNA, 22 nt, Human herpesvirus 3
uaugguauaccgcucguguaaa

SEQ ID NO: 3963111 - RNA, 16 nt, Human herpesvirus 3
uauguuuuuauuuugu

SEQ ID NO: 3963112 - RNA, 15 nt, Human herpesvirus 3
uauuaccaacuguau

SEQ ID NO: 3963113 - RNA, 15 nt, Human herpesvirus 3
uauucuauuaacaau

SEQ ID NO: 3963114 - RNA, 16 nt, Human herpesvirus 3
uauucucccaaaacau

SEQ ID NO: 3963115 - RNA, 14 nt, Human herpesvirus 3
uauuuaaauuuaca

SEQ ID NO: 3963116 - RNA, 15 nt, Human herpesvirus 3
uauuuaauaggcaua

SEQ ID NO: 3963117 - RNA, 23 nt, Human herpesvirus 3
uauuucccaacgcauaaccagcg

SEQ ID NO: 3963118 - RNA, 16 nt, Human herpesvirus 3
uauuugugaagacuuu

SEQ ID NO: 3963119 - RNA, 13 nt, Human herpesvirus 3
ucaacugcuuuua

SEQ ID NO: 3963120 - RNA, 21 nt, Human herpesvirus 3
ucagaaagauugcagucauuu

SEQ ID NO: 3963121 - RNA, 14 nt, Human herpesvirus 3
ucagauauuuugca

SEQ ID NO: 3963122 - RNA, 23 nt, Human herpesvirus 3
ucagguuauccaacuguuuacau

SEQ ID NO: 3963123 - RNA, 19 nt, Human herpesvirus 3
ucauacgccgacaugccug

SEQ ID NO: 3963124 - RNA, 16 nt, Human herpesvirus 3
ucauguaauuguaaau

SEQ ID NO: 3963125 - RNA, 13 nt, Human herpesvirus 3
ucauuuauuacca

SEQ ID NO: 3963126 - RNA, 18 nt, Human herpesvirus 3
uccauaucgcaauguuuu

SEQ ID NO: 3963127 - RNA, 14 nt, Human herpesvirus 3
ucccgauuuggaaa

SEQ ID NO: 3963128 - RNA, 14 nt, Human herpesvirus 3
uccgaauaaaugug

SEQ ID NO: 3963129 - RNA, 18 nt, Human herpesvirus 3
uccgccuauagcugucac

SEQ ID NO: 3963130 - RNA, 13 nt, Human herpesvirus 3
uccgcgcucaauc

SEQ ID NO: 3963131 - RNA, 14 nt, Human herpesvirus 3
ucgauguaacacca

SEQ ID NO: 3963132 - RNA, 23 nt, Human herpesvirus 3
ucgcgcccaccucggccgcuucc

SEQ ID NO: 3963133 - RNA, 15 nt, Human herpesvirus 3
ucgcguacccccuuc

SEQ ID NO: 3963134 - RNA, 14 nt, Human herpesvirus 3
ucgcuacuccaggc

SEQ ID NO: 3963135 - RNA, 22 nt, Human herpesvirus 3
ucggacccccccccgaaaauaa

SEQ ID NO: 3963136 - RNA, 19 nt, Human herpesvirus 3
ucgucguuuaaagccccuc

SEQ ID NO: 3963137 - RNA, 15 nt, Human herpesvirus 3
ucgugagcgccacug

SEQ ID NO: 3963138 - RNA, 23 nt, Human herpesvirus 3
ucguuuaaagccccucgaagaac

SEQ ID NO: 3963139 - RNA, 23 nt, Human herpesvirus 3
ucuaucggacauaugucugcucu

SEQ ID NO: 3963140 - RNA, 18 nt, Human herpesvirus 3
ucucgugagcgccacugg

SEQ ID NO: 3963141 - RNA, 14 nt, Human herpesvirus 3
ucugauugguugau

SEQ ID NO: 3963142 - RNA, 24 nt, Human herpesvirus 3
ucugucgaugauacacauaugcac

SEQ ID NO: 3963143 - RNA, 16 nt, Human herpesvirus 3
ucuucaaauuaaaagc

SEQ ID NO: 3963144 - RNA, 14 nt, Human herpesvirus 3
ucuuccgugugguc

SEQ ID NO: 3963145 - RNA, 12 nt, Human herpesvirus 3
ugaaagcuacca

SEQ ID NO: 3963146 - RNA, 22 nt, Human herpesvirus 3
ugaacuuaccuccgaagacuuu

SEQ ID NO: 3963147 - RNA, 13 nt, Human herpesvirus 3
ugaccauuuacca

SEQ ID NO: 3963148 - RNA, 19 nt, Human herpesvirus 3
ugacggcgacuuuaagaau

SEQ ID NO: 3963149 - RNA, 14 nt, Human herpesvirus 3
ugaguuuaggguuu

SEQ ID NO: 3963150 - RNA, 15 nt, Human herpesvirus 3
ugauauaagguguua

SEQ ID NO: 3963151 - RNA, 22 nt, Human herpesvirus 3
uggaaacacccauacauauguu

SEQ ID NO: 3963152 - RNA, 19 nt, Human herpesvirus 3
uggacaucgcugaugccag

SEQ ID NO: 3963153 - RNA, 18 nt, Human herpesvirus 3
uggauggccuaucuggau

SEQ ID NO: 3963154 - RNA, 16 nt, Human herpesvirus 3
uggcaacgcuggcauu

SEQ ID NO: 3963155 - RNA, 16 nt, Human herpesvirus 3
uggcgcgcggacuguu

SEQ ID NO: 3963156 - RNA, 17 nt, Human herpesvirus 3
uggcgcgcggacuguuu

SEQ ID NO: 3963157 - RNA, 13 nt, Human herpesvirus 3
ugggucagacagu

SEQ ID NO: 3963158 - RNA, 12 nt, Human herpesvirus 3
ugguaagguuuu

SEQ ID NO: 3963159 - RNA, 18 nt, Human herpesvirus 3
uguagucuuugaucccag

SEQ ID NO: 3963160 - RNA, 15 nt, Human herpesvirus 3
uguccggacuccagc

SEQ ID NO: 3963161 - RNA, 23 nt, Human herpesvirus 3
uguucauuuuauuaucccagcac

SEQ ID NO: 3963162 - RNA, 15 nt, Human herpesvirus 3
uguuggcucggucug

SEQ ID NO: 3963163 - RNA, 21 nt, Human herpesvirus 3
uguuguagccacaauuuacau

SEQ ID NO: 3963164 - RNA, 21 nt, Human herpesvirus 3
uuaaagccccucgaagaacaa

SEQ ID NO: 3963165 - RNA, 20 nt, Human herpesvirus 3
uuaacaacucgugucucugg

SEQ ID NO: 3963166 - RNA, 22 nt, Human herpesvirus 3
uuaagaccaacgguuggcuuaa

SEQ ID NO: 3963167 - RNA, 14 nt, Human herpesvirus 3
uuaaguguauuugg

SEQ ID NO: 3963168 - RNA, 18 nt, Human herpesvirus 3
uuacaggacaaaccccac

SEQ ID NO: 3963169 - RNA, 16 nt, Human herpesvirus 3
uuacauugcuuucaaa

SEQ ID NO: 3963170 - RNA, 19 nt, Human herpesvirus 3
uuagacguucaaaauaucu

SEQ ID NO: 3963171 - RNA, 19 nt, Human herpesvirus 3
uuagcggugguaauucuuc

SEQ ID NO: 3963172 - RNA, 19 nt, Human herpesvirus 3
uuaugaaaaaagugucugu

SEQ ID NO: 3963173 - RNA, 15 nt, Human herpesvirus 3
uuauuagaacguuua

SEQ ID NO: 3963174 - RNA, 17 nt, Human herpesvirus 3
uucaaaccaauaucuuu

SEQ ID NO: 3963175 - RNA, 18 nt, Human herpesvirus 3
uucagcaaguuuaacauu

SEQ ID NO: 3963176 - RNA, 15 nt, Human herpesvirus 3
uuccacacucuucaa

SEQ ID NO: 3963177 - RNA, 16 nt, Human herpesvirus 3
uuccacacucuucaau

SEQ ID NO: 3963178 - RNA, 14 nt, Human herpesvirus 3
uucuacaccuuugc

SEQ ID NO: 3963179 - RNA, 16 nt, Human herpesvirus 3
uugacuuuguuugcug

SEQ ID NO: 3963180 - RNA, 19 nt, Human herpesvirus 3
uugcugcagacaccaugac

SEQ ID NO: 3963181 - RNA, 14 nt, Human herpesvirus 3
uuggagaaacauua

SEQ ID NO: 3963182 - RNA, 16 nt, Human herpesvirus 3
uugucgaucauacgcc

SEQ ID NO: 3963183 - RNA, 17 nt, Human herpesvirus 3
uugugaucuauuaacag

SEQ ID NO: 3963184 - RNA, 23 nt, Human herpesvirus 3
uuguguuuauaacguauaacccg

SEQ ID NO: 3963185 - RNA, 20 nt, Human herpesvirus 3
uuuacggcagucugaccauu

SEQ ID NO: 3963186 - RNA, 15 nt, Human herpesvirus 3
uuuaggaaucaagac

SEQ ID NO: 3963187 - RNA, 12 nt, Human herpesvirus 3
uuuaucccccuu

SEQ ID NO: 3963188 - RNA, 18 nt, Human herpesvirus 3
uuuaugaaaaaagugucu

SEQ ID NO: 3963189 - RNA, 22 nt, Human herpesvirus 3
uuuauuuugcucguauauacau

SEQ ID NO: 3963190 - RNA, 16 nt, Human herpesvirus 3
uuucugggcgcccggc

SEQ ID NO: 3963191 - RNA, 20 nt, Human herpesvirus 3
uuuuuaugaaaaaagugucu

SEQ ID NO: 3963192 - RNA, 18 nt, Human herpesvirus 3
acucaugugucuccauua

SEQ ID NO: 3963193 - RNA, 16 nt, Human herpesvirus 3
acucuacgcauuuacg

SEQ ID NO: 3963194 - RNA, 19 nt, Human herpesvirus 3
acuuggcguguuaaacacu

SEQ ID NO: 3963195 - RNA, 24 nt, Human herpesvirus 3
acuugggcggagacaauuaaccga

SEQ ID NO: 3963196 - RNA, 18 nt, Human herpesvirus 3
acuuguguguaccauaga

SEQ ID NO: 3963197 - RNA, 14 nt, Human herpesvirus 3
agaaacuuaauaca

SEQ ID NO: 3963198 - RNA, 16 nt, Human herpesvirus 3
agaauaccaaaaagaa

SEQ ID NO: 3963199 - RNA, 18 nt, Human herpesvirus 3
agaaucuccuaacuauaa

SEQ ID NO: 3963200 - RNA, 16 nt, Human herpesvirus 3
agaauuaaaaaagccg

SEQ ID NO: 3963201 - RNA, 22 nt, Human herpesvirus 3
agacuugauacccucaaacacg

SEQ ID NO: 3963202 - RNA, 16 nt, Human herpesvirus 3
agaucaauggcgguga

SEQ ID NO: 3963203 - RNA, 21 nt, Human herpesvirus 3
agaucgucguuuaaagccccu

SEQ ID NO: 3963204 - RNA, 12 nt, Human herpesvirus 3
agaucuuacacc

SEQ ID NO: 3963205 - RNA, 15 nt, Human herpesvirus 3
agaugagaaaaauaa

SEQ ID NO: 3963206 - RNA, 14 nt, Human herpesvirus 3
agauguguuauuau

SEQ ID NO: 3963207 - RNA, 19 nt, Human herpesvirus 3
agauucaagacuaacauuu

SEQ ID NO: 3963208 - RNA, 15 nt, Human herpesvirus 3
agauuccgaguccuc

SEQ ID NO: 3963209 - RNA, 17 nt, Human herpesvirus 3
agcacccuuuuguaaaa

SEQ ID NO: 3963210 - RNA, 15 nt, Human herpesvirus 3
agcaucuauaugauu

SEQ ID NO: 3963211 - RNA, 12 nt, Human herpesvirus 3
agcccgaucccg

SEQ ID NO: 3963212 - RNA, 20 nt, Human herpesvirus 3
agccgcucgcugagcuccag

SEQ ID NO: 3963213 - RNA, 16 nt, Human herpesvirus 3
agcuguccaugaugaa

SEQ ID NO: 3963214 - RNA, 18 nt, Human herpesvirus 3
aggauaggugucuucaaa

SEQ ID NO: 3963215 - RNA, 18 nt, Human herpesvirus 3
aggaucauuuuuugaaac

SEQ ID NO: 3963216 - RNA, 16 nt, Human herpesvirus 3
aggcauuuguguccca

SEQ ID NO: 3963217 - RNA, 18 nt, Human herpesvirus 3
aggcgugaaagcuaccac

SEQ ID NO: 3963218 - RNA, 13 nt, Human herpesvirus 3
aggggagcgugga

SEQ ID NO: 3963219 - RNA, 21 nt, Human herpesvirus 3
aggggguauuuauacccgaua

SEQ ID NO: 3963220 - RNA, 18 nt, Human herpesvirus 3
agguacgcgucaaaaagc

SEQ ID NO: 3963221 - RNA, 21 nt, Human herpesvirus 3
agguguuaauaaaaacacaac

SEQ ID NO: 3963222 - RNA, 15 nt, Human herpesvirus 3
agguuagauguguua

SEQ ID NO: 3963223 - RNA, 23 nt, Human herpesvirus 3
agguuuauuuacuuuacaacccg

SEQ ID NO: 3963224 - RNA, 13 nt, Human herpesvirus 3
agucauuuucaua

SEQ ID NO: 3963225 - RNA, 18 nt, Human herpesvirus 3
auacaccguguaacucga

SEQ ID NO: 3963226 - RNA, 23 nt, Human herpesvirus 3
auagagguauuguuaccaggaga

SEQ ID NO: 3963227 - RNA, 14 nt, Human herpesvirus 3
auaguaaauaccua

SEQ ID NO: 3963228 - RNA, 17 nt, Human herpesvirus 3
auauacacggacauaau

SEQ ID NO: 3963229 - RNA, 16 nt, Human herpesvirus 3
auauacgagcaaaaua

SEQ ID NO: 3963230 - RNA, 13 nt, Human herpesvirus 3
auauauucacaac

SEQ ID NO: 3963231 - RNA, 15 nt, Human herpesvirus 3
auaucauaaauauua

SEQ ID NO: 3963232 - RNA, 17 nt, Human herpesvirus 3
auaucucauacucaugc

SEQ ID NO: 3963233 - RNA, 21 nt, Human herpesvirus 3
auaugagccguauaacccacu

SEQ ID NO: 3963234 - RNA, 14 nt, Human herpesvirus 3
aucaaacacacaga

SEQ ID NO: 3963235 - RNA, 12 nt, Human herpesvirus 3
aucagaagauau

SEQ ID NO: 3963236 - RNA, 16 nt, Human herpesvirus 3
aucauacgcauuuacg

SEQ ID NO: 3963237 - RNA, 21 nt, Human herpesvirus 3
aucaugguugguuacugugaa

SEQ ID NO: 3963238 - RNA, 15 nt, Human herpesvirus 3
aucauuuuauuacau

SEQ ID NO: 3963239 - RNA, 15 nt, Human herpesvirus 3
auccaauuaaagccc

SEQ ID NO: 3963240 - RNA, 17 nt, Human herpesvirus 3
aucccgccgacagcgga

SEQ ID NO: 3963241 - RNA, 22 nt, Human herpesvirus 3
aucccgccgucgcgcccaccuc

SEQ ID NO: 3963242 - RNA, 15 nt, Human herpesvirus 3
aucggcauuaacaac

SEQ ID NO: 3963243 - RNA, 15 nt, Human herpesvirus 3
aucuaauaacaauuu

SEQ ID NO: 3963244 - RNA, 18 nt, Human herpesvirus 3
augaacugccaauauaca

SEQ ID NO: 3963245 - RNA, 19 nt, Human herpesvirus 3
augacggcgacuuuaagaa

SEQ ID NO: 3963246 - RNA, 23 nt, Human herpesvirus 3
augauucaaguaaauaugugcau

SEQ ID NO: 3963247 - RNA, 15 nt, Human herpesvirus 3
augcacugaaccaca

SEQ ID NO: 3963248 - RNA, 13 nt, Human herpesvirus 3
augccagaagcau

SEQ ID NO: 3963249 - RNA, 14 nt, Human herpesvirus 3
augcuuguaaaaca

SEQ ID NO: 3963250 - RNA, 18 nt, Human herpesvirus 3
auggguuuuuagaauuuc

SEQ ID NO: 3963251 - RNA, 17 nt, Human herpesvirus 3
auggugcgauuuaacca

SEQ ID NO: 3963252 - RNA, 14 nt, Human herpesvirus 3
auguaauuguaaau

SEQ ID NO: 3963253 - RNA, 19 nt, Human herpesvirus 3
auguacugugucucucaaa

SEQ ID NO: 3963254 - RNA, 17 nt, Human herpesvirus 3
auguuuuucuaaauuac

SEQ ID NO: 3963255 - RNA, 15 nt, Human herpesvirus 3
auuaaagguuaaauu

SEQ ID NO: 3963256 - RNA, 16 nt, Human herpesvirus 3
auuacgaguacuaaaa

SEQ ID NO: 3963257 - RNA, 22 nt, Human herpesvirus 3
auuauuaagacgaccccuguca

SEQ ID NO: 3963258 - RNA, 19 nt, Human herpesvirus 3
auucccaguaaacaacagu

SEQ ID NO: 3963259 - RNA, 17 nt, Human herpesvirus 3
auucgacgcaaaaauuc

SEQ ID NO: 3963260 - RNA, 13 nt, Human herpesvirus 3
auuguauauacaa

SEQ ID NO: 3963261 - RNA, 22 nt, Human herpesvirus 3
auuuaaaaauccauuaaagagc

SEQ ID NO: 3963262 - RNA, 21 nt, Human herpesvirus 3
auuuauaaaacacucacguuu

SEQ ID NO: 3963263 - RNA, 20 nt, Human herpesvirus 3
auuuccacaaccagguuaaa

SEQ ID NO: 3963264 - RNA, 15 nt, Human herpesvirus 3
auuugcauuuucagu

SEQ ID NO: 3963265 - RNA, 12 nt, Human herpesvirus 3
auuuucauagac

SEQ ID NO: 3963266 - RNA, 18 nt, Human herpesvirus 3
auuuucgguggaagcaau

SEQ ID NO: 3963267 - RNA, 17 nt, Human herpesvirus 3
auuuuuauuuaaaugug

SEQ ID NO: 3963268 - RNA, 16 nt, Human herpesvirus 3
caaaauaaaaacauac

SEQ ID NO: 3963269 - RNA, 20 nt, Human herpesvirus 3
caaauuaacccaagacgaca

SEQ ID NO: 3963270 - RNA, 17 nt, Human herpesvirus 3
caacacacccauacagu

SEQ ID NO: 3963271 - RNA, 17 nt, Human herpesvirus 3
caacugauuacauuuca

SEQ ID NO: 3963272 - RNA, 17 nt, Human herpesvirus 3
caacuggaaaugugcug

SEQ ID NO: 3963273 - RNA, 16 nt, Human herpesvirus 3
caagguguaaauacug

SEQ ID NO: 3963274 - RNA, 14 nt, Human herpesvirus 3
caauacguaaaugu

SEQ ID NO: 3963275 - RNA, 20 nt, Human herpesvirus 3
caauaucagccgcucgcuga

SEQ ID NO: 3963276 - RNA, 15 nt, Human herpesvirus 3
caauuguuuauguga

SEQ ID NO: 3963277 - RNA, 19 nt, Human herpesvirus 3
cacaucuacugucuugaca

SEQ ID NO: 3963278 - RNA, 18 nt, Human herpesvirus 3
cacccauaaaaacgccuu

SEQ ID NO: 3963279 - RNA, 21 nt, Human herpesvirus 3
caccucggccgcuucccgaaa

SEQ ID NO: 3963280 - RNA, 20 nt, Human herpesvirus 3
cacggaaggcgugaaagcua

SEQ ID NO: 3963281 - RNA, 18 nt, Human herpesvirus 3
cacgggguccccacacgg

SEQ ID NO: 3963282 - RNA, 18 nt, Human herpesvirus 3
cacuaaaaucacuuugau

SEQ ID NO: 3963283 - RNA, 14 nt, Human herpesvirus 3
cacucuacgcauuu

SEQ ID NO: 3963284 - RNA, 22 nt, Human herpesvirus 3
cacuuuaauuccucuaaacgug

SEQ ID NO: 3963285 - RNA, 15 nt, Human herpesvirus 3
cagagaagcuauaca

SEQ ID NO: 3963286 - RNA, 13 nt, Human herpesvirus 3
cagauucuucacc

SEQ ID NO: 3963287 - RNA, 18 nt, Human herpesvirus 3
cagcccgauaacauggaa

SEQ ID NO: 3963288 - RNA, 14 nt, Human herpesvirus 3
cagcgccaauaaaa

SEQ ID NO: 3963289 - RNA, 15 nt, Human herpesvirus 3
caggagggguugcgg

SEQ ID NO: 3963290 - RNA, 15 nt, Human herpesvirus 3
cauaguccgccgaca

SEQ ID NO: 3963291 - RNA, 16 nt, Human herpesvirus 3
caucucuggaccccca

SEQ ID NO: 3963292 - RNA, 19 nt, Human herpesvirus 3
cauggccgugaauggugaa

SEQ ID NO: 3963293 - RNA, 18 nt, Human herpesvirus 3
caugggccaauccgucaa

SEQ ID NO: 3963294 - RNA, 22 nt, Human herpesvirus 3
cauggugcgauuuaaccaccaa

SEQ ID NO: 3963295 - RNA, 17 nt, Human herpesvirus 3
cauuaggaugaaaagaa

SEQ ID NO: 3963296 - RNA, 21 nt, Human herpesvirus 3
cauucagcuuacaguccagug

SEQ ID NO: 3963297 - RNA, 13 nt, Human herpesvirus 3
cauuuggacacua

SEQ ID NO: 3963298 - RNA, 17 nt, Human herpesvirus 3
cauuuuaaaaauaccug

SEQ ID NO: 3963299 - RNA, 16 nt, Human herpesvirus 3
ccaaacacgccuuuua

SEQ ID NO: 3963300 - RNA, 16 nt, Human herpesvirus 3
ccaccucggccgcuuc

SEQ ID NO: 3963301 - RNA, 17 nt, Human herpesvirus 3
ccacgugagcuugcaag

SEQ ID NO: 3963302 - RNA, 23 nt, Human herpesvirus 3
ccagacucucgcggcuucuguaa

SEQ ID NO: 3963303 - RNA, 12 nt, Human herpesvirus 3
ccagaguacagg

SEQ ID NO: 3963304 - RNA, 21 nt, Human herpesvirus 3
ccagaguacaggguaucuaag

SEQ ID NO: 3963305 - RNA, 17 nt, Human herpesvirus 3
ccagcuaaaauuuggaa

SEQ ID NO: 3963306 - RNA, 15 nt, Human herpesvirus 3
ccaucauuuaaauuc

SEQ ID NO: 3963307 - RNA, 15 nt, Human herpesvirus 3
ccauccgccgcagcu

SEQ ID NO: 3963308 - RNA, 18 nt, Human herpesvirus 3
ccauuacaacaaggauaa

SEQ ID NO: 3963309 - RNA, 14 nt, Human herpesvirus 3
cccaauagccgcca

SEQ ID NO: 3963310 - RNA, 16 nt, Human herpesvirus 3
cccaccucggccgcuu

SEQ ID NO: 3963311 - RNA, 20 nt, Human herpesvirus 3
cccacgggguccccacacgg

SEQ ID NO: 3963312 - RNA, 22 nt, Human herpesvirus 3
cccagcuguccggacuccagca

SEQ ID NO: 3963313 - RNA, 22 nt, Human herpesvirus 3
ccccauacuccgauacccugga

SEQ ID NO: 3963314 - RNA, 14 nt, Human herpesvirus 3
cccgaaagcccgau

SEQ ID NO: 3963315 - RNA, 19 nt, Human herpesvirus 3
cccgcggugagcacccggg

SEQ ID NO: 3963316 - RNA, 14 nt, Human herpesvirus 3
cccgguuucugggc

SEQ ID NO: 3963317 - RNA, 22 nt, Human herpesvirus 3
cccuccuuuucucgugagcgcc

SEQ ID NO: 3963318 - RNA, 23 nt, Human herpesvirus 3
cccucuuuauccaauuaaagccc

SEQ ID NO: 3963319 - RNA, 21 nt, Human herpesvirus 3
ccgaaaauaacccccccccgg

SEQ ID NO: 3963320 - RNA, 18 nt, Human herpesvirus 3
ccgcgcguuugcggggcg

SEQ ID NO: 3963321 - RNA, 13 nt, Human herpesvirus 3
ccgcggccagugc

SEQ ID NO: 3963322 - RNA, 23 nt, Human herpesvirus 3
ccgcuagacuguuuuucugcuca

SEQ ID NO: 3963323 - RNA, 16 nt, Human herpesvirus 3
ccggcggaccccggga

SEQ ID NO: 3963324 - RNA, 24 nt, Human herpesvirus 3
ccgguucggugaucaccgggucuu

SEQ ID NO: 3963325 - RNA, 22 nt, Human herpesvirus 3
ccgucucugauucggguaaaac

SEQ ID NO: 3963326 - RNA, 12 nt, Human herpesvirus 3
ccguuaaggcaa

SEQ ID NO: 3963327 - RNA, 19 nt, Human herpesvirus 3
ccguuuccacccccucuua

SEQ ID NO: 3963328 - RNA, 14 nt, Human herpesvirus 3
ccuacacaacaccc

SEQ ID NO: 3963329 - RNA, 13 nt, Human herpesvirus 3
ccucaaacacggg

SEQ ID NO: 3963330 - RNA, 20 nt, Human herpesvirus 3
ccuccucgaccgcuggauga

SEQ ID NO: 3963331 - RNA, 17 nt, Human herpesvirus 3
ccuccuuuucucgugag

SEQ ID NO: 3963332 - RNA, 12 nt, Human herpesvirus 3
ccugaugauggu

SEQ ID NO: 3963333 - RNA, 13 nt, Human herpesvirus 3
ccuuaaaauuugu

SEQ ID NO: 3963334 - RNA, 18 nt, Human herpesvirus 3
cgaaaacgugcaugcguu

SEQ ID NO: 3963335 - RNA, 20 nt, Human herpesvirus 3
cgaaccuucggaugacuuug

SEQ ID NO: 3963336 - RNA, 14 nt, Human herpesvirus 3
cgauaacugcgaua

SEQ ID NO: 3963337 - RNA, 23 nt, Human herpesvirus 3
cgaugcguguacgcuccagaacg

SEQ ID NO: 3963338 - RNA, 18 nt, Human herpesvirus 3
cgcccggcggaccccggg

SEQ ID NO: 3963339 - RNA, 17 nt, Human herpesvirus 3
cgccgucgcgcccaccu

SEQ ID NO: 3963340 - RNA, 13 nt, Human herpesvirus 3
cgcgauauucucc

SEQ ID NO: 3963341 - RNA, 12 nt, Human herpesvirus 3
cgcgcaccaggc

SEQ ID NO: 3963342 - RNA, 22 nt, Human herpesvirus 3
cgcguguacgaaaaccgcagcc

SEQ ID NO: 3963343 - RNA, 22 nt, Human herpesvirus 3
cgcucgaugugauacaaugagc

SEQ ID NO: 3963344 - RNA, 14 nt, Human herpesvirus 3
cggauaucgucuaa

SEQ ID NO: 3963345 - RNA, 14 nt, Human herpesvirus 3
cggaucaugaacaa

SEQ ID NO: 3963346 - RNA, 12 nt, Human herpesvirus 3
cggccgcuuccc

SEQ ID NO: 3963347 - RNA, 13 nt, Human herpesvirus 3
cggccgcuucccg

SEQ ID NO: 3963348 - RNA, 22 nt, Human herpesvirus 3
cggcuuuuaauuugaagacacc

SEQ ID NO: 3963349 - RNA, 15 nt, Human herpesvirus 3
cgggucuuaucuaua

SEQ ID NO: 3963350 - RNA, 17 nt, Human herpesvirus 3
cgguaugccacauuuac

SEQ ID NO: 3963351 - RNA, 14 nt, Human herpesvirus 3
auuuggacacuacu

SEQ ID NO: 3963352 - RNA, 23 nt, Human herpesvirus 3
auuuuaauguaucuggaaggcau

SEQ ID NO: 3963353 - RNA, 21 nt, Human herpesvirus 3
auuuuauauuaaauaaacuau

SEQ ID NO: 3963354 - RNA, 21 nt, Human herpesvirus 3
caaaaagaauuaaaaaagccg

SEQ ID NO: 3963355 - RNA, 15 nt, Human herpesvirus 3
caaaauucgaauugu

SEQ ID NO: 3963356 - RNA, 19 nt, Human herpesvirus 3
caaaccauucgaggaaaac

SEQ ID NO: 3963357 - RNA, 16 nt, Human herpesvirus 3
caaauaacugaacauu

SEQ ID NO: 3963358 - RNA, 15 nt, Human herpesvirus 3
caaaugaugaagcua

SEQ ID NO: 3963359 - RNA, 14 nt, Human herpesvirus 3
caacgaguguaugc

SEQ ID NO: 3963360 - RNA, 18 nt, Human herpesvirus 3
caacgaguguaugcguau

SEQ ID NO: 3963361 - RNA, 19 nt, Human herpesvirus 3
caacgccgagcguguaaau

SEQ ID NO: 3963362 - RNA, 19 nt, Human herpesvirus 3
caacguauccgaagccuuu

SEQ ID NO: 3963363 - RNA, 20 nt, Human herpesvirus 3
caacuguauguaaauuauga

SEQ ID NO: 3963364 - RNA, 13 nt, Human herpesvirus 3
caaggcguaaaau

SEQ ID NO: 3963365 - RNA, 19 nt, Human herpesvirus 3
caaugcgccguauauggua

SEQ ID NO: 3963366 - RNA, 21 nt, Human herpesvirus 3
caauuggccguuuguaucaau

SEQ ID NO: 3963367 - RNA, 16 nt, Human herpesvirus 3
cacaauccacagauuc

SEQ ID NO: 3963368 - RNA, 15 nt, Human herpesvirus 3
cacagagucuguauc

SEQ ID NO: 3963369 - RNA, 22 nt, Human herpesvirus 3
cacauuugggcggggauguuuu

SEQ ID NO: 3963370 - RNA, 14 nt, Human herpesvirus 3
cacgcgggugagug

SEQ ID NO: 3963371 - RNA, 12 nt, Human herpesvirus 3
cacgguguauau

SEQ ID NO: 3963372 - RNA, 23 nt, Human herpesvirus 3
cacugcauuuacaucuuguccaa

SEQ ID NO: 3963373 - RNA, 17 nt, Human herpesvirus 3
cacuuacaggacaaacc

SEQ ID NO: 3963374 - RNA, 11 nt, Human herpesvirus 3
cagauauuguc

SEQ ID NO: 3963375 - RNA, 13 nt, Human herpesvirus 3
cagaucccacccc

SEQ ID NO: 3963376 - RNA, 19 nt, Human herpesvirus 3
caggcuguacguaaccaua

SEQ ID NO: 3963377 - RNA, 16 nt, Human herpesvirus 3
caguaagggugagaau

SEQ ID NO: 3963378 - RNA, 20 nt, Human herpesvirus 3
cauacuaauuuguauuuuua

SEQ ID NO: 3963379 - RNA, 13 nt, Human herpesvirus 3
cauauuacauuaa

SEQ ID NO: 3963380 - RNA, 14 nt, Human herpesvirus 3
caucauacgcauuu

SEQ ID NO: 3963381 - RNA, 15 nt, Human herpesvirus 3
caucugauuugcaaa

SEQ ID NO: 3963382 - RNA, 21 nt, Human herpesvirus 3
caucuggaguacuacacccag

SEQ ID NO: 3963383 - RNA, 19 nt, Human herpesvirus 3
caugacaacggaaaacacg

SEQ ID NO: 3963384 - RNA, 14 nt, Human herpesvirus 3
caugcuuguaaaac

SEQ ID NO: 3963385 - RNA, 17 nt, Human herpesvirus 3
cauucagcuuacagucc

SEQ ID NO: 3963386 - RNA, 19 nt, Human herpesvirus 3
cauuucgaauaauuuuaag

SEQ ID NO: 3963387 - RNA, 19 nt, Human herpesvirus 3
cauuuugcgcauuuggaau

SEQ ID NO: 3963388 - RNA, 19 nt, Human herpesvirus 3
ccaccucggccgcuucccg

SEQ ID NO: 3963389 - RNA, 20 nt, Human herpesvirus 3
ccacgcccacauacccacuc

SEQ ID NO: 3963390 - RNA, 21 nt, Human herpesvirus 3
ccacuaagaacuuuauagccc

SEQ ID NO: 3963391 - RNA, 18 nt, Human herpesvirus 3
ccauagaggugugugcac

SEQ ID NO: 3963392 - RNA, 21 nt, Human herpesvirus 3
ccauuaaagagccauuuccau

SEQ ID NO: 3963393 - RNA, 21 nt, Human herpesvirus 3
cccaugucacaaaucaugcgg

SEQ ID NO: 3963394 - RNA, 15 nt, Human herpesvirus 3
ccccaggccuugaaa

SEQ ID NO: 3963395 - RNA, 14 nt, Human herpesvirus 3
cccccgaaaauaac

SEQ ID NO: 3963396 - RNA, 17 nt, Human herpesvirus 3
ccccgguuucugggcgc

SEQ ID NO: 3963397 - RNA, 12 nt, Human herpesvirus 3
cccgccaugagc

SEQ ID NO: 3963398 - RNA, 22 nt, Human herpesvirus 3
cccgccgucgcgcccaccucgg

SEQ ID NO: 3963399 - RNA, 17 nt, Human herpesvirus 3
cccgugacucccuccaa

SEQ ID NO: 3963400 - RNA, 23 nt, Human herpesvirus 3
ccgauauuguauuguaguacagg

SEQ ID NO: 3963401 - RNA, 21 nt, Human herpesvirus 3
ccgaucccgccgucgcgccca

SEQ ID NO: 3963402 - RNA, 15 nt, Human herpesvirus 3
ccgaucgcguacccc

SEQ ID NO: 3963403 - RNA, 16 nt, Human herpesvirus 3
ccgcacacguuuacac

SEQ ID NO: 3963404 - RNA, 17 nt, Human herpesvirus 3
ccgcuucccgaaagccc

SEQ ID NO: 3963405 - RNA, 20 nt, Human herpesvirus 3
ccgggauuuccacuuacagg

SEQ ID NO: 3963406 - RNA, 19 nt, Human herpesvirus 3
ccggguggguggcauuaaa

SEQ ID NO: 3963407 - RNA, 22 nt, Human herpesvirus 3
ccgucgcgcccaccucggccgc

SEQ ID NO: 3963408 - RNA, 14 nt, Human herpesvirus 3
ccguggaccccugu

SEQ ID NO: 3963409 - RNA, 21 nt, Human herpesvirus 3
ccugcaagcgguuuagcauuu

SEQ ID NO: 3963410 - RNA, 16 nt, Human herpesvirus 3
ccuuaaacaacauggc

SEQ ID NO: 3963411 - RNA, 13 nt, Human herpesvirus 3
ccuuaaacaucca

SEQ ID NO: 3963412 - RNA, 14 nt, Human herpesvirus 3
cgaaaagacugugu

SEQ ID NO: 3963413 - RNA, 13 nt, Human herpesvirus 3
cgaaacgcuuuga

SEQ ID NO: 3963414 - RNA, 22 nt, Human herpesvirus 3
cgaacgugauuugcccacaccu

SEQ ID NO: 3963415 - RNA, 15 nt, Human herpesvirus 3
cgaauaaacgacaca

SEQ ID NO: 3963416 - RNA, 14 nt, Human herpesvirus 3
cgaauaucgccaug

SEQ ID NO: 3963417 - RNA, 18 nt, Human herpesvirus 3
cgacaucguuuguuucuu

SEQ ID NO: 3963418 - RNA, 16 nt, Human herpesvirus 3
cgacuccucagccaug

SEQ ID NO: 3963419 - RNA, 15 nt, Human herpesvirus 3
cgaucaacugcuuuu

SEQ ID NO: 3963420 - RNA, 21 nt, Human herpesvirus 3
cgcaaggucccccccagaaga

SEQ ID NO: 3963421 - RNA, 22 nt, Human herpesvirus 3
cgcagucuauggggggaauaca

SEQ ID NO: 3963422 - RNA, 19 nt, Human herpesvirus 3
cgcaugccccccucccuca

SEQ ID NO: 3963423 - RNA, 22 nt, Human herpesvirus 3
cgccaaaauggaugcaagaaac

SEQ ID NO: 3963424 - RNA, 13 nt, Human herpesvirus 3
cgccacuggcgcg

SEQ ID NO: 3963425 - RNA, 23 nt, Human herpesvirus 3
cgccaguugacuuuguuugcugc

SEQ ID NO: 3963426 - RNA, 14 nt, Human herpesvirus 3
cgcccaccucggcc

SEQ ID NO: 3963427 - RNA, 19 nt, Human herpesvirus 3
cgcccggcggaccccggga

SEQ ID NO: 3963428 - RNA, 12 nt, Human herpesvirus 3
cgcgccaaacau

SEQ ID NO: 3963429 - RNA, 19 nt, Human herpesvirus 3
cgcguuccaaauuauccaa

SEQ ID NO: 3963430 - RNA, 17 nt, Human herpesvirus 3
cgcguuugcggggcgac

SEQ ID NO: 3963431 - RNA, 13 nt, Human herpesvirus 3
cgcuggcauuucc

SEQ ID NO: 3963432 - RNA, 15 nt, Human herpesvirus 3
cggacccccccccga

SEQ ID NO: 3963433 - RNA, 22 nt, Human herpesvirus 3
cggcaauccgcuagacuguuuu

SEQ ID NO: 3963434 - RNA, 14 nt, Human herpesvirus 3
cgggcgggcugguc

SEQ ID NO: 3963435 - RNA, 17 nt, Human herpesvirus 3
cgggcuggucggacccc

SEQ ID NO: 3963436 - RNA, 16 nt, Human herpesvirus 3
cgucauagcaaauaca

SEQ ID NO: 3963437 - RNA, 20 nt, Human herpesvirus 3
cgucaucgagcuucacuggu

SEQ ID NO: 3963438 - RNA, 16 nt, Human herpesvirus 3
cguccuucaacacacc

SEQ ID NO: 3963439 - RNA, 21 nt, Human herpesvirus 3
cgucuugcgauacgaugauuu

SEQ ID NO: 3963440 - RNA, 17 nt, Human herpesvirus 3
cguguuacuuggaaaca

SEQ ID NO: 3963441 - RNA, 12 nt, Human herpesvirus 3
cguuuaaagccc

SEQ ID NO: 3963442 - RNA, 21 nt, Human herpesvirus 3
cguuuagccguacagauuaaa

SEQ ID NO: 3963443 - RNA, 15 nt, Human herpesvirus 3
cuaaaaacguuucug

SEQ ID NO: 3963444 - RNA, 21 nt, Human herpesvirus 3
cuaacauuaacgcgcuacaac

SEQ ID NO: 3963445 - RNA, 23 nt, Human herpesvirus 3
cuaauaaaaauguaauauugugg

SEQ ID NO: 3963446 - RNA, 14 nt, Human herpesvirus 3
cuccagaguacagg

SEQ ID NO: 3963447 - RNA, 21 nt, Human herpesvirus 3
cuccaucgcuguuuguacaau

SEQ ID NO: 3963448 - RNA, 12 nt, Human herpesvirus 3
cuccccccgcga

SEQ ID NO: 3963449 - RNA, 19 nt, Human herpesvirus 3
cuccguaucccugucuuca

SEQ ID NO: 3963450 - RNA, 21 nt, Human herpesvirus 3
cuccguuuaucccccuucaaa

SEQ ID NO: 3963451 - RNA, 14 nt, Human herpesvirus 3
cucgugagcgccac

SEQ ID NO: 3963452 - RNA, 21 nt, Human herpesvirus 3
cugcagggcggcguccucggc

SEQ ID NO: 3963453 - RNA, 18 nt, Human herpesvirus 3
cugcguuagacgccuggc

SEQ ID NO: 3963454 - RNA, 21 nt, Human herpesvirus 3
cuggaaggccagcguaauaca

SEQ ID NO: 3963455 - RNA, 18 nt, Human herpesvirus 3
cuggcauuuccaaacaca

SEQ ID NO: 3963456 - RNA, 22 nt, Human herpesvirus 3
cuggcuauggaaccuaauuuaa

SEQ ID NO: 3963457 - RNA, 20 nt, Human herpesvirus 3
cuguaucgcuaucagauucc

SEQ ID NO: 3963458 - RNA, 22 nt, Human herpesvirus 3
cuguaugcguuaccccauguca

SEQ ID NO: 3963459 - RNA, 20 nt, Human herpesvirus 3
cugucuugacaacauuuaaa

SEQ ID NO: 3963460 - RNA, 17 nt, Human herpesvirus 3
cuguuacuuaaaccgug

SEQ ID NO: 3963461 - RNA, 19 nt, Human herpesvirus 3
cuguuguugcuaguauuuu

SEQ ID NO: 3963462 - RNA, 16 nt, Human herpesvirus 3
cuguuuaugaacagca

SEQ ID NO: 3963463 - RNA, 13 nt, Human herpesvirus 3
cuuaaaauaaaag

SEQ ID NO: 3963464 - RNA, 14 nt, Human herpesvirus 3
cuuagaaaagccag

SEQ ID NO: 3963465 - RNA, 18 nt, Human herpesvirus 3
aaaaagaggcggggagaa

SEQ ID NO: 3963466 - RNA, 22 nt, Human herpesvirus 3
aaaacacugucagaaacacuug

SEQ ID NO: 3963467 - RNA, 11 nt, Human herpesvirus 3
aaacacgcaug

SEQ ID NO: 3963468 - RNA, 23 nt, Human herpesvirus 3
aaacaucaaccggaacaguaucc

SEQ ID NO: 3963469 - RNA, 22 nt, Human herpesvirus 3
aaacauguauaauaaaaaguca

SEQ ID NO: 3963470 - RNA, 20 nt, Human herpesvirus 3
aaacauugcagcguacaagu

SEQ ID NO: 3963471 - RNA, 14 nt, Human herpesvirus 3
aaacuuuacagagg

SEQ ID NO: 3963472 - RNA, 22 nt, Human herpesvirus 3
aaagaacucugaguucaaagca

SEQ ID NO: 3963473 - RNA, 21 nt, Human herpesvirus 3
aaagaauuuuuaauacgguuc

SEQ ID NO: 3963474 - RNA, 15 nt, Human herpesvirus 3
aaaguuugaacauga

SEQ ID NO: 3963475 - RNA, 18 nt, Human herpesvirus 3
aaauacgguucaaaggca

SEQ ID NO: 3963476 - RNA, 23 nt, Human herpesvirus 3
aaauagcuguaaaaaccauggac

SEQ ID NO: 3963477 - RNA, 19 nt, Human herpesvirus 3
aacauacauuggggauuca

SEQ ID NO: 3963478 - RNA, 16 nt, Human herpesvirus 3
aaccaauaucuuugca

SEQ ID NO: 3963479 - RNA, 17 nt, Human herpesvirus 3
aaccggguggguggcau

SEQ ID NO: 3963480 - RNA, 17 nt, Human herpesvirus 3
aaccuucggaugacuuu

SEQ ID NO: 3963481 - RNA, 19 nt, Human herpesvirus 3
aacgugauuugcccacacc

SEQ ID NO: 3963482 - RNA, 22 nt, Human herpesvirus 3
aagaauuuauccgguugaaaac

SEQ ID NO: 3963483 - RNA, 23 nt, Human herpesvirus 3
aagaggccccaagguauuguccc

SEQ ID NO: 3963484 - RNA, 23 nt, Human herpesvirus 3
aagcauauacacauccuggacac

SEQ ID NO: 3963485 - RNA, 14 nt, Human herpesvirus 3
aagccucuguacaa

SEQ ID NO: 3963486 - RNA, 20 nt, Human herpesvirus 3
aagucgcaacgcugcugaca

SEQ ID NO: 3963487 - RNA, 18 nt, Human herpesvirus 3
aagucuucaaagaacucu

SEQ ID NO: 3963488 - RNA, 19 nt, Human herpesvirus 3
aauaaaacguuuuaaaagc

SEQ ID NO: 3963489 - RNA, 19 nt, Human herpesvirus 3
aauaccuauuucaugcuug

SEQ ID NO: 3963490 - RNA, 15 nt, Human herpesvirus 3
aauacuuuuauuugu

SEQ ID NO: 3963491 - RNA, 20 nt, Human herpesvirus 3
aauaguaaauaccuauuuca

SEQ ID NO: 3963492 - RNA, 22 nt, Human herpesvirus 3
aaucaaccacaccgguggaauu

SEQ ID NO: 3963493 - RNA, 20 nt, Human herpesvirus 3
aaugggguuggggauugcau

SEQ ID NO: 3963494 - RNA, 16 nt, Human herpesvirus 3
aauggucuaaauacuu

SEQ ID NO: 3963495 - RNA, 14 nt, Human herpesvirus 3
aauuaucgacugaa

SEQ ID NO: 3963496 - RNA, 19 nt, Human herpesvirus 3
acaaaggugccggguuuua

SEQ ID NO: 3963497 - RNA, 13 nt, Human herpesvirus 3
acaacccacgcua

SEQ ID NO: 3963498 - RNA, 20 nt, Human herpesvirus 3
acaaucgcccgaaaacuuug

SEQ ID NO: 3963499 - RNA, 18 nt, Human herpesvirus 3
acaccuuccgguacccca

SEQ ID NO: 3963500 - RNA, 13 nt, Human herpesvirus 3
acacgcggccugu

SEQ ID NO: 3963501 - RNA, 22 nt, Human herpesvirus 3
acaguggcggauaacugccugu

SEQ ID NO: 3963502 - RNA, 19 nt, Human herpesvirus 3
acauggccgugaaugguga

SEQ ID NO: 3963503 - RNA, 20 nt, Human herpesvirus 3
accaagcguacgaccaaaca

SEQ ID NO: 3963504 - RNA, 19 nt, Human herpesvirus 3
accaauaugccaucaauau

SEQ ID NO: 3963505 - RNA, 12 nt, Human herpesvirus 3
acccccccccgg

SEQ ID NO: 3963506 - RNA, 12 nt, Human herpesvirus 3
accucggccgcu

SEQ ID NO: 3963507 - RNA, 18 nt, Human herpesvirus 3
accucggccgcuucccga

SEQ ID NO: 3963508 - RNA, 22 nt, Human herpesvirus 3
accuguuagaauaguaaauacc

SEQ ID NO: 3963509 - RNA, 16 nt, Human herpesvirus 3
acgccgcaacaaccca

SEQ ID NO: 3963510 - RNA, 19 nt, Human herpesvirus 3
acgcgucaaaaagccugug

SEQ ID NO: 3963511 - RNA, 17 nt, Human herpesvirus 3
acggcuguggucugcuu

SEQ ID NO: 3963512 - RNA, 13 nt, Human herpesvirus 3
acgggccgugugg

SEQ ID NO: 3963513 - RNA, 19 nt, Human herpesvirus 3
acgggcgggcuggucggac

SEQ ID NO: 3963514 - RNA, 23 nt, Human herpesvirus 3
acguaauuugccccaaaccacug

SEQ ID NO: 3963515 - RNA, 20 nt, Human herpesvirus 3
acguagcaaagcuacacuuu

SEQ ID NO: 3963516 - RNA, 21 nt, Human herpesvirus 3
acgugguaccaaaaacacagu

SEQ ID NO: 3963517 - RNA, 15 nt, Human herpesvirus 3
acguuugcauuuacc

SEQ ID NO: 3963518 - RNA, 13 nt, Human herpesvirus 3
acuauaugcguuu

SEQ ID NO: 3963519 - RNA, 18 nt, Human herpesvirus 3
cuugauacccucaaacac

SEQ ID NO: 3963520 - RNA, 22 nt, Human herpesvirus 3
cuugggcuguuaggguugggag

SEQ ID NO: 3963521 - RNA, 16 nt, Human herpesvirus 3
cuuuaucugaaaagac

SEQ ID NO: 3963522 - RNA, 19 nt, Human herpesvirus 3
cuuugcauuggaagucacc

SEQ ID NO: 3963523 - RNA, 17 nt, Human herpesvirus 3
cuuugguuauacgggga

SEQ ID NO: 3963524 - RNA, 22 nt, Human herpesvirus 3
cuuuuaaacgccaguggaccuu

SEQ ID NO: 3963525 - RNA, 18 nt, Human herpesvirus 3
gaaaacgcgcgaaaugug

SEQ ID NO: 3963526 - RNA, 16 nt, Human herpesvirus 3
gaaagagcuguccaug

SEQ ID NO: 3963527 - RNA, 19 nt, Human herpesvirus 3
gaacauccuaguacagaua

SEQ ID NO: 3963528 - RNA, 21 nt, Human herpesvirus 3
gaagcugacgaagagaacugu

SEQ ID NO: 3963529 - RNA, 16 nt, Human herpesvirus 3
gaaguguucuaaaaca

SEQ ID NO: 3963530 - RNA, 23 nt, Human herpesvirus 3
gacaaaauuaacucgcguacaaa

SEQ ID NO: 3963531 - RNA, 14 nt, Human herpesvirus 3
gacaaaccccacgc

SEQ ID NO: 3963532 - RNA, 16 nt, Human herpesvirus 3
gacagucguguuuuua

SEQ ID NO: 3963533 - RNA, 18 nt, Human herpesvirus 3
gacauaauuaaugcaacc

SEQ ID NO: 3963534 - RNA, 16 nt, Human herpesvirus 3
gacauggccgugaaug

SEQ ID NO: 3963535 - RNA, 22 nt, Human herpesvirus 3
gacgcgaacaccgcugugcugu

SEQ ID NO: 3963536 - RNA, 22 nt, Human herpesvirus 3
gacgggcgggcuggucggaccc

SEQ ID NO: 3963537 - RNA, 15 nt, Human herpesvirus 3
gacguccaaguccaa

SEQ ID NO: 3963538 - RNA, 22 nt, Human herpesvirus 3
gacuccaagggacccgcagccc

SEQ ID NO: 3963539 - RNA, 19 nt, Human herpesvirus 3
gacucugcgaugcauuaac

SEQ ID NO: 3963540 - RNA, 14 nt, Human herpesvirus 3
gagcgccacuggcg

SEQ ID NO: 3963541 - RNA, 17 nt, Human herpesvirus 3
gagcugguauacacgag

SEQ ID NO: 3963542 - RNA, 22 nt, Human herpesvirus 3
gagcugguauacacgagagcag

SEQ ID NO: 3963543 - RNA, 16 nt, Human herpesvirus 3
gaggggaugaaucguu

SEQ ID NO: 3963544 - RNA, 21 nt, Human herpesvirus 3
gauauaacccggucugcucau

SEQ ID NO: 3963545 - RNA, 15 nt, Human herpesvirus 3
gauauaauuugucca

SEQ ID NO: 3963546 - RNA, 17 nt, Human herpesvirus 3
gaucauuuuuugaaaca

SEQ ID NO: 3963547 - RNA, 16 nt, Human herpesvirus 3
gaugguaguuaccaaa

SEQ ID NO: 3963548 - RNA, 19 nt, Human herpesvirus 3
gauguuuuuauuagaacgu

SEQ ID NO: 3963549 - RNA, 20 nt, Human herpesvirus 3
gauuccaucauaagcgcagu

SEQ ID NO: 3963550 - RNA, 16 nt, Human herpesvirus 3
gcaauucccaguaaac

SEQ ID NO: 3963551 - RNA, 16 nt, Human herpesvirus 3
gcaccacagucucugu

SEQ ID NO: 3963552 - RNA, 16 nt, Human herpesvirus 3
gcaguuauaacacggg

SEQ ID NO: 3963553 - RNA, 18 nt, Human herpesvirus 3
gcauagacccgaaacgcu

SEQ ID NO: 3963554 - RNA, 23 nt, Human herpesvirus 3
gcauauacacauccuggacacag

SEQ ID NO: 3963555 - RNA, 22 nt, Human herpesvirus 3
gcaucuggagaaccgcgucuau

SEQ ID NO: 3963556 - RNA, 23 nt, Human herpesvirus 3
gcaucuuccgacggugacagacu

SEQ ID NO: 3963557 - RNA, 12 nt, Human herpesvirus 3
gccacacccaca

SEQ ID NO: 3963558 - RNA, 16 nt, Human herpesvirus 3
gccaugguuucaaaac

SEQ ID NO: 3963559 - RNA, 16 nt, Human herpesvirus 3
gccgugugguaugaau

SEQ ID NO: 3963560 - RNA, 17 nt, Human herpesvirus 3
gccuguuggugggugag

SEQ ID NO: 3963561 - RNA, 17 nt, Human herpesvirus 3
gcgauacgaugauuuuc

SEQ ID NO: 3963562 - RNA, 22 nt, Human herpesvirus 3
gcgauggugaugaaaucagaga

SEQ ID NO: 3963563 - RNA, 17 nt, Human herpesvirus 3
gcgcccaccucggccgc

SEQ ID NO: 3963564 - RNA, 21 nt, Human herpesvirus 3
gcgcccggcggaccccgggag

SEQ ID NO: 3963565 - RNA, 17 nt, Human herpesvirus 3
gcgcguguaugcacaac

SEQ ID NO: 3963566 - RNA, 16 nt, Human herpesvirus 3
gcggaccccgggagag

SEQ ID NO: 3963567 - RNA, 14 nt, Human herpesvirus 3
gcucgcugagcucc

SEQ ID NO: 3963568 - RNA, 14 nt, Human herpesvirus 3
gcucugcaaauaca

SEQ ID NO: 3963569 - RNA, 21 nt, Human herpesvirus 3
gcuuacguuugcauuuaccga

SEQ ID NO: 3963570 - RNA, 22 nt, Human herpesvirus 3
gcuucccgaaagcccgaucccg

SEQ ID NO: 3963571 - RNA, 14 nt, Human herpesvirus 3
ggaaggauuaagaa

SEQ ID NO: 3963572 - RNA, 12 nt, Human herpesvirus 3
ggaauacaggca

SEQ ID NO: 3963573 - RNA, 18 nt, Human herpesvirus 3
ggaauuguggaguuuccc

SEQ ID NO: 3963574 - RNA, 19 nt, Human herpesvirus 3
ggagcguacugcagauaca

SEQ ID NO: 3963575 - RNA, 21 nt, Human herpesvirus 3
ggauaaauguuagucuugaau

SEQ ID NO: 3963576 - RNA, 14 nt, Human herpesvirus 3
ggauccucgagcag

SEQ ID NO: 3963577 - RNA, 14 nt, Human herpesvirus 3
ggaugauauuuuaa

SEQ ID NO: 3963578 - RNA, 14 nt, Human herpesvirus 3
ggcaguucagagac

SEQ ID NO: 3963579 - RNA, 12 nt, Human herpesvirus 3
ggcauugcuuca

SEQ ID NO: 3963580 - RNA, 18 nt, Human herpesvirus 3
ggcgugaaagcuaccacc

SEQ ID NO: 3963581 - RNA, 19 nt, Human herpesvirus 3
gggaauuuaggaggcugca

SEQ ID NO: 3963582 - RNA, 16 nt, Human herpesvirus 3
gggacccgcagcccag

SEQ ID NO: 3963583 - RNA, 18 nt, Human herpesvirus 3
gggucugccguauuuugc

SEQ ID NO: 3963584 - RNA, 12 nt, Human herpesvirus 3
gggugaaguaau

SEQ ID NO: 3963585 - RNA, 16 nt, Human herpesvirus 3
ggugaugaaaucagag

SEQ ID NO: 3963586 - RNA, 21 nt, Human herpesvirus 3
gguggauauagcgcugucguc

SEQ ID NO: 3963587 - RNA, 15 nt, Human herpesvirus 3
gguggucagacgaac

SEQ ID NO: 3963588 - RNA, 13 nt, Human herpesvirus 3
gguuaugcuuuuu

SEQ ID NO: 3963589 - RNA, 17 nt, Human herpesvirus 3
gguucuucacuggacuu

SEQ ID NO: 3963590 - RNA, 19 nt, Human herpesvirus 3
gguuuuuagaauuuccaaa

SEQ ID NO: 3963591 - RNA, 13 nt, Human herpesvirus 3
guaacugucccaa

SEQ ID NO: 3963592 - RNA, 21 nt, Human herpesvirus 3
guacagauacguggaaucgua

SEQ ID NO: 3963593 - RNA, 22 nt, Human herpesvirus 3
guacauaguuauuguauauaca

SEQ ID NO: 3963594 - RNA, 16 nt, Human herpesvirus 3
guaggagguccaugug

SEQ ID NO: 3963595 - RNA, 19 nt, Human herpesvirus 3
guaggggaugggggucgca

SEQ ID NO: 3963596 - RNA, 21 nt, Human herpesvirus 3
guauugcguaccgcgacccug

SEQ ID NO: 3963597 - RNA, 14 nt, Human herpesvirus 3
guauuguguaauug

SEQ ID NO: 3963598 - RNA, 17 nt, Human herpesvirus 3
guccaaguccaaucaaa

SEQ ID NO: 3963599 - RNA, 17 nt, Human herpesvirus 3
guccgccgacagccgcu

SEQ ID NO: 3963600 - RNA, 15 nt, Human herpesvirus 3
guccggacuccagca

SEQ ID NO: 3963601 - RNA, 17 nt, Human herpesvirus 3
gucugucugucugugcg

SEQ ID NO: 3963602 - RNA, 15 nt, Human herpesvirus 3
gugagcgccacuggc

SEQ ID NO: 3963603 - RNA, 16 nt, Human herpesvirus 3
gugauauuauauacug

SEQ ID NO: 3963604 - RNA, 24 nt, Human herpesvirus 3
guggacaucgcugaugccagaagc

SEQ ID NO: 3963605 - RNA, 15 nt, Human herpesvirus 3
guguguugugugggg

SEQ ID NO: 3963606 - RNA, 15 nt, Human herpesvirus 3
guguuacuuggaaac

SEQ ID NO: 3963607 - RNA, 12 nt, Human herpesvirus 3
guuaauuuuaca

SEQ ID NO: 3963608 - RNA, 21 nt, Human herpesvirus 3
guuacuacauggaguguguua

SEQ ID NO: 3963609 - RNA, 14 nt, Human herpesvirus 3
guugcaaaagccgu

SEQ ID NO: 3963610 - RNA, 18 nt, Human herpesvirus 3
guugcuuugcguauauga

SEQ ID NO: 3963611 - RNA, 15 nt, Human herpesvirus 3
guuggacaaaggugc

SEQ ID NO: 3963612 - RNA, 19 nt, Human herpesvirus 3
guuguuaauaaaagcggaa

SEQ ID NO: 3963613 - RNA, 16 nt, Human herpesvirus 3
guuucaaauaacugaa

SEQ ID NO: 3963614 - RNA, 19 nt, Human herpesvirus 3
guuugaaguguucuaaaac

SEQ ID NO: 3963615 - RNA, 19 nt, Human herpesvirus 3
uaaaauucuaacaacucug

SEQ ID NO: 3963616 - RNA, 14 nt, Human herpesvirus 3
uaacaacucuggag

SEQ ID NO: 3963617 - RNA, 19 nt, Human herpesvirus 3
uaacgaucgcguguauaca

SEQ ID NO: 3963618 - RNA, 17 nt, Human herpesvirus 3
uaacgugauuacuacaa

SEQ ID NO: 3963619 - RNA, 21 nt, Human herpesvirus 3
uaacguuuuaguaaaauacca

SEQ ID NO: 3963620 - RNA, 17 nt, Human herpesvirus 3
uaagcaacuacuuacaa

SEQ ID NO: 3963621 - RNA, 21 nt, Human herpesvirus 3
uaaucaguugggauaaauguu

SEQ ID NO: 3963622 - RNA, 15 nt, Human herpesvirus 3
uacaccgcuacgggu

SEQ ID NO: 3963623 - RNA, 20 nt, Human herpesvirus 3
uacauuucacgcgucuuguu

SEQ ID NO: 3963624 - RNA, 16 nt, Human herpesvirus 3
uaccuauuucaugcuu

SEQ ID NO: 3963625 - RNA, 15 nt, Human herpesvirus 3
uacgaccaaacauua

SEQ ID NO: 3963626 - RNA, 21 nt, Human herpesvirus 3
uagaaaaucgacaucguuugu

SEQ ID NO: 3963627 - RNA, 21 nt, Human herpesvirus 3
uagauaucacaccaauuauaa

SEQ ID NO: 3963628 - RNA, 22 nt, Human herpesvirus 3
uagaugacacgaauaggugaua

SEQ ID NO: 3963629 - RNA, 18 nt, Human herpesvirus 3
uauaacugcuacaacgga

SEQ ID NO: 3963630 - RNA, 14 nt, Human herpesvirus 3
uauauucucgaagg

SEQ ID NO: 3963631 - RNA, 11 nt, Human herpesvirus 3
uaucaauaaau

SEQ ID NO: 3963632 - RNA, 18 nt, Human herpesvirus 3
uaucuguuacauuucgaa

SEQ ID NO: 3963633 - RNA, 15 nt, Human herpesvirus 3
aaaaagugucugucu

SEQ ID NO: 3963634 - RNA, 15 nt, Human herpesvirus 3
aaacaaauacgauca

SEQ ID NO: 3963635 - RNA, 16 nt, Human herpesvirus 3
aaacaggcguguuuau

SEQ ID NO: 3963636 - RNA, 17 nt, Human herpesvirus 3
aaacgcgccaaacauug

SEQ ID NO: 3963637 - RNA, 13 nt, Human herpesvirus 3
aaacuauuccaaa

SEQ ID NO: 3963638 - RNA, 14 nt, Human herpesvirus 3
aaacucuguuguau

SEQ ID NO: 3963639 - RNA, 14 nt, Human herpesvirus 3
aaauaaacugaauu

SEQ ID NO: 3963640 - RNA, 18 nt, Human herpesvirus 3
aaauauaacauacaucau

SEQ ID NO: 3963641 - RNA, 22 nt, Human herpesvirus 3
aaaucguuuaacaaaauagucu

SEQ ID NO: 3963642 - RNA, 18 nt, Human herpesvirus 3
aaauguguauuauauguc

SEQ ID NO: 3963643 - RNA, 21 nt, Human herpesvirus 3
aaauucaucugccguuucauu

SEQ ID NO: 3963644 - RNA, 21 nt, Human herpesvirus 3
aaauugggggauuugggagaa

SEQ ID NO: 3963645 - RNA, 16 nt, Human herpesvirus 3
aacaacaguaggaggu

SEQ ID NO: 3963646 - RNA, 14 nt, Human herpesvirus 3
aacacugucagaaa

SEQ ID NO: 3963647 - RNA, 20 nt, Human herpesvirus 3
aacauccacagucugcuuua

SEQ ID NO: 3963648 - RNA, 17 nt, Human herpesvirus 3
aaccauucagcuuacag

SEQ ID NO: 3963649 - RNA, 15 nt, Human herpesvirus 3
aacgcgcaauguuuu

SEQ ID NO: 3963650 - RNA, 15 nt, Human herpesvirus 3
aacgcugcugacaaa

SEQ ID NO: 3963651 - RNA, 17 nt, Human herpesvirus 3
aacgcugcugacaaaau

SEQ ID NO: 3963652 - RNA, 15 nt, Human herpesvirus 3
aacgcuguuguugcu

SEQ ID NO: 3963653 - RNA, 22 nt, Human herpesvirus 3
aacucaaccgccguuguggaaa

SEQ ID NO: 3963654 - RNA, 22 nt, Human herpesvirus 3
aacuguauguaaauuaugauca

SEQ ID NO: 3963655 - RNA, 19 nt, Human herpesvirus 3
aacuuuacuguuagggaua

SEQ ID NO: 3963656 - RNA, 16 nt, Human herpesvirus 3
aagcagacaucccucg

SEQ ID NO: 3963657 - RNA, 21 nt, Human herpesvirus 3
aagcgcuccgcccuaaauuac

SEQ ID NO: 3963658 - RNA, 19 nt, Human herpesvirus 3
aagcguacgaccaaacauu

SEQ ID NO: 3963659 - RNA, 19 nt, Human herpesvirus 3
aagguagacaacugacaga

SEQ ID NO: 3963660 - RNA, 14 nt, Human herpesvirus 3
aagguaucccccag

SEQ ID NO: 3963661 - RNA, 15 nt, Human herpesvirus 3
aagguccauuuaaca

SEQ ID NO: 3963662 - RNA, 13 nt, Human herpesvirus 3
aaguauaacugaa

SEQ ID NO: 3963663 - RNA, 15 nt, Human herpesvirus 3
aaguguucuaaaaca

SEQ ID NO: 3963664 - RNA, 19 nt, Human herpesvirus 3
aaguguucuaaaacacugu

SEQ ID NO: 3963665 - RNA, 15 nt, Human herpesvirus 3
aauaaauguacuaua

SEQ ID NO: 3963666 - RNA, 21 nt, Human herpesvirus 3
aauagauaguuauggacuagg

SEQ ID NO: 3963667 - RNA, 13 nt, Human herpesvirus 3
aaucuuuuacaac

SEQ ID NO: 3963668 - RNA, 13 nt, Human herpesvirus 3
aauucaaaauacg

SEQ ID NO: 3963669 - RNA, 23 nt, Human herpesvirus 3
acaauggcgaccacgacagcagu

SEQ ID NO: 3963670 - RNA, 14 nt, Human herpesvirus 3
acaauuaacacaga

SEQ ID NO: 3963671 - RNA, 18 nt, Human herpesvirus 3
acacccauacagugaccc

SEQ ID NO: 3963672 - RNA, 19 nt, Human herpesvirus 3
acagcaguaagggugagaa

SEQ ID NO: 3963673 - RNA, 20 nt, Human herpesvirus 3
acagccuuuacucggcucaa

SEQ ID NO: 3963674 - RNA, 20 nt, Human herpesvirus 3
acagugauacccaauagccg

SEQ ID NO: 3963675 - RNA, 21 nt, Human herpesvirus 3
acaucauccguccaaacagug

SEQ ID NO: 3963676 - RNA, 20 nt, Human herpesvirus 3
acauuagaguguuuaacaac

SEQ ID NO: 3963677 - RNA, 22 nt, Human herpesvirus 3
accagaaacguuuuuaguuuuu

SEQ ID NO: 3963678 - RNA, 12 nt, Human herpesvirus 3
accaugggagac

SEQ ID NO: 3963679 - RNA, 22 nt, Human herpesvirus 3
acccacgggguccccacacggg

SEQ ID NO: 3963680 - RNA, 13 nt, Human herpesvirus 3
accgcacccgaua

SEQ ID NO: 3963681 - RNA, 14 nt, Human herpesvirus 3
accuuuucgccuua

SEQ ID NO: 3963682 - RNA, 21 nt, Human herpesvirus 3
acgacauacauuagaguguuu

SEQ ID NO: 3963683 - RNA, 19 nt, Human herpesvirus 3
acgacucguuggguuacau

SEQ ID NO: 3963684 - RNA, 20 nt, Human herpesvirus 3
acgagagcaguccaugguuu

SEQ ID NO: 3963685 - RNA, 17 nt, Human herpesvirus 3
acgccaguggucucucu

SEQ ID NO: 3963686 - RNA, 13 nt, Human herpesvirus 3
acgcgggugagug

SEQ ID NO: 3963687 - RNA, 16 nt, Human herpesvirus 3
acggcccccuggacau

SEQ ID NO: 3963688 - RNA, 14 nt, Human herpesvirus 3
acgggcgggcuggu

SEQ ID NO: 3963689 - RNA, 23 nt, Human herpesvirus 3
acguauguucugugggacagcua

SEQ ID NO: 3963690 - RNA, 13 nt, Human herpesvirus 3
acguuccgggguu

SEQ ID NO: 3963691 - RNA, 15 nt, Human herpesvirus 3
acuaaaaacguuucu

SEQ ID NO: 3963692 - RNA, 21 nt, Human herpesvirus 3
acuacauuggggguacaguug

SEQ ID NO: 3963693 - RNA, 14 nt, Human herpesvirus 3
acuauaauuguuca

SEQ ID NO: 3963694 - RNA, 17 nt, Human herpesvirus 3
acugcagauacagcaua

SEQ ID NO: 3963695 - RNA, 16 nt, Human herpesvirus 3
acugcuuuuauaacuu

SEQ ID NO: 3963696 - RNA, 17 nt, Human herpesvirus 3
acugcuuuuauaacuuu

SEQ ID NO: 3963697 - RNA, 20 nt, Human herpesvirus 3
agaccauguuuuuggagcaa

SEQ ID NO: 3963698 - RNA, 13 nt, Human herpesvirus 3
agagaccgugcgc

SEQ ID NO: 3963699 - RNA, 17 nt, Human herpesvirus 3
agaugccgguauugcuu

SEQ ID NO: 3963700 - RNA, 23 nt, Human herpesvirus 3
agauucgccuuuuacaugaucca

SEQ ID NO: 3963701 - RNA, 15 nt, Human herpesvirus 3
agauugucccaucgc

SEQ ID NO: 3963702 - RNA, 15 nt, Human herpesvirus 3
agcaaaauaaaacaa

SEQ ID NO: 3963703 - RNA, 14 nt, Human herpesvirus 3
agcaacguuuaaga

SEQ ID NO: 3963704 - RNA, 14 nt, Human herpesvirus 3
agccagccaaaaaa

SEQ ID NO: 3963705 - RNA, 18 nt, Human herpesvirus 3
agccucuguacaacacaa

SEQ ID NO: 3963706 - RNA, 22 nt, Human herpesvirus 3
agcggaacgguuuuuaugaaaa

SEQ ID NO: 3963707 - RNA, 19 nt, Human herpesvirus 3
aggacgaaggggaauuaaa

SEQ ID NO: 3963708 - RNA, 16 nt, Human herpesvirus 3
aggaucccgugucccc

SEQ ID NO: 3963709 - RNA, 20 nt, Human herpesvirus 3
aggcugccgccuuugcgaug

SEQ ID NO: 3963710 - RNA, 21 nt, Human herpesvirus 3
aggguggacguuuuuccacaa

SEQ ID NO: 3963711 - RNA, 17 nt, Human herpesvirus 3
agguauuguuaccagga

SEQ ID NO: 3963712 - RNA, 16 nt, Human herpesvirus 3
agguccauuuaacaau

SEQ ID NO: 3963713 - RNA, 21 nt, Human herpesvirus 3
aguacaggguaucuaaguacc

SEQ ID NO: 3963714 - RNA, 18 nt, Human herpesvirus 3
agucuaguuacauuucac

SEQ ID NO: 3963715 - RNA, 23 nt, Human herpesvirus 3
aguuuagugucguuuccaaauaa

SEQ ID NO: 3963716 - RNA, 20 nt, Human herpesvirus 3
auaaacaagucaauauuaca

SEQ ID NO: 3963717 - RNA, 16 nt, Human herpesvirus 3
auaaaccaacuccugu

SEQ ID NO: 3963718 - RNA, 17 nt, Human herpesvirus 3
auaaauucuacaacauu

SEQ ID NO: 3963719 - RNA, 14 nt, Human herpesvirus 3
auaacgcuguuguu

SEQ ID NO: 3963720 - RNA, 22 nt, Human herpesvirus 3
auaauucggcgcggaugcauuu

SEQ ID NO: 3963721 - RNA, 12 nt, Human herpesvirus 3
auaccccaggcc

SEQ ID NO: 3963722 - RNA, 19 nt, Human herpesvirus 3
auaucucauacucaugccu

SEQ ID NO: 3963723 - RNA, 14 nt, Human herpesvirus 3
auaucuguuacauu

SEQ ID NO: 3963724 - RNA, 15 nt, Human herpesvirus 3
auaugucaacauuua

SEQ ID NO: 3963725 - RNA, 21 nt, Human herpesvirus 3
auaugucaacauuuacaguaa

SEQ ID NO: 3963726 - RNA, 22 nt, Human herpesvirus 3
auauuuacacguuucauuaacu

SEQ ID NO: 3963727 - RNA, 13 nt, Human herpesvirus 3
aucaaucugagaa

SEQ ID NO: 3963728 - RNA, 14 nt, Human herpesvirus 3
aucagagaagcuau

SEQ ID NO: 3963729 - RNA, 16 nt, Human herpesvirus 3
aucagaucaucugaca

SEQ ID NO: 3963730 - RNA, 23 nt, Human herpesvirus 3
aucagccgcucgcugagcuccag

SEQ ID NO: 3963731 - RNA, 21 nt, Human herpesvirus 3
aucagcgccaauaaaagcaga

SEQ ID NO: 3963732 - RNA, 14 nt, Human herpesvirus 3
aucaggacagcagu

SEQ ID NO: 3963733 - RNA, 22 nt, Human herpesvirus 3
aucauuuaaauuccgcgguggg

SEQ ID NO: 3963734 - RNA, 16 nt, Human herpesvirus 3
aucccacauguauaaa

SEQ ID NO: 3963735 - RNA, 21 nt, Human herpesvirus 3
aucccgcggugagcacccggg

SEQ ID NO: 3963736 - RNA, 15 nt, Human herpesvirus 3
auccucuuaacguug

SEQ ID NO: 3963737 - RNA, 12 nt, Human herpesvirus 3
aucguaugccuc

SEQ ID NO: 3963738 - RNA, 13 nt, Human herpesvirus 3
aucuauagcaaaa

SEQ ID NO: 3963739 - RNA, 20 nt, Human herpesvirus 3
aucugaaaagaccgacagcc

SEQ ID NO: 3963740 - RNA, 19 nt, Human herpesvirus 3
aucuucacgcucaaugaac

SEQ ID NO: 3963741 - RNA, 21 nt, Human herpesvirus 3
aucuuguccaacuguaucugu

SEQ ID NO: 3963742 - RNA, 20 nt, Human herpesvirus 3
augaaaaaagugucugucug

SEQ ID NO: 3963743 - RNA, 16 nt, Human herpesvirus 3
augaccgcuauuuuca

SEQ ID NO: 3963744 - RNA, 17 nt, Human herpesvirus 3
augcacugcaucuggag

SEQ ID NO: 3963745 - RNA, 22 nt, Human herpesvirus 3
augcggugcuguuugaagcggc

SEQ ID NO: 3963746 - RNA, 22 nt, Human herpesvirus 3
auuaccccgccauaaacagaga

SEQ ID NO: 3963747 - RNA, 22 nt, Human herpesvirus 3
auuauuagcguaauauaacaga

SEQ ID NO: 3963748 - RNA, 18 nt, Human herpesvirus 3
auucaaguaaauaugugc

SEQ ID NO: 3963749 - RNA, 22 nt, Human herpesvirus 3
auucuacagauuuauuuuuaca

SEQ ID NO: 3963750 - RNA, 12 nt, Human herpesvirus 3
auucuauuaaca

SEQ ID NO: 3963751 - RNA, 21 nt, Human herpesvirus 3
auugcagucauuuuuuuuaca

SEQ ID NO: 3963752 - RNA, 21 nt, Human herpesvirus 3
auugguugauuggguuauaaa

SEQ ID NO: 3963753 - RNA, 18 nt, Human herpesvirus 3
auuguauuguaguacagg

SEQ ID NO: 3963754 - RNA, 19 nt, Human herpesvirus 3
auuuaggucucggagguua

SEQ ID NO: 3963755 - RNA, 14 nt, Human herpesvirus 3
auuuauaaaacacu

SEQ ID NO: 3963756 - RNA, 13 nt, Human herpesvirus 3
auuuuauuacauu

SEQ ID NO: 3963757 - RNA, 12 nt, Human herpesvirus 3
caaacagcacca

SEQ ID NO: 3963758 - RNA, 23 nt, Human herpesvirus 3
caaagaacucugaguucaaagca

SEQ ID NO: 3963759 - RNA, 15 nt, Human herpesvirus 3
caaagcaacgguuuc

SEQ ID NO: 3963760 - RNA, 23 nt, Human herpesvirus 3
caaaggcauuacccgauauugua

SEQ ID NO: 3963761 - RNA, 15 nt, Human herpesvirus 3
caacacaaagggccu

SEQ ID NO: 3963762 - RNA, 20 nt, Human herpesvirus 3
caacccccgcggcuuccgaa

SEQ ID NO: 3963763 - RNA, 18 nt, Human herpesvirus 3
caacguauucgguuggug

SEQ ID NO: 3963764 - RNA, 15 nt, Human herpesvirus 3
caacugacagaaacu

SEQ ID NO: 3963765 - RNA, 19 nt, Human herpesvirus 3
caauaaaauggauauaauu

SEQ ID NO: 3963766 - RNA, 15 nt, Human herpesvirus 3
caauauuuauacaag

SEQ ID NO: 3963767 - RNA, 15 nt, Human herpesvirus 3
caauuauaacugcua

SEQ ID NO: 3963768 - RNA, 19 nt, Human herpesvirus 3
cacacauuuuacaguaaac

SEQ ID NO: 3963769 - RNA, 15 nt, Human herpesvirus 3
caccaaaaauauacg

SEQ ID NO: 3963770 - RNA, 17 nt, Human herpesvirus 3
caccaauuauaacugcu

SEQ ID NO: 3963771 - RNA, 12 nt, Human herpesvirus 3
caccgcucugcg

SEQ ID NO: 3963772 - RNA, 20 nt, Human herpesvirus 3
caccugcauucgaauuacga

SEQ ID NO: 3963773 - RNA, 16 nt, Human herpesvirus 3
cacgccgcaacaaccc

SEQ ID NO: 3963774 - RNA, 12 nt, Human herpesvirus 3
cacgugaggaaa

SEQ ID NO: 3963775 - RNA, 13 nt, Human herpesvirus 3
cacuacugacagc

SEQ ID NO: 3963776 - RNA, 23 nt, Human herpesvirus 3
cacugguggauauagcgcugucg

SEQ ID NO: 3963777 - RNA, 18 nt, Human herpesvirus 3
cacuguacgcagaaagca

SEQ ID NO: 3963778 - RNA, 23 nt, Human herpesvirus 3
cagaaacauuaguugcgguucaa

SEQ ID NO: 3963779 - RNA, 15 nt, Human herpesvirus 3
cagacaccaugacgg

SEQ ID NO: 3963780 - RNA, 14 nt, Human herpesvirus 3
cagacgugucuacu

SEQ ID NO: 3963781 - RNA, 22 nt, Human herpesvirus 3
cagagaaaacgcgcgaaaugug

SEQ ID NO: 3963782 - RNA, 19 nt, Human herpesvirus 3
cagauguacacccagcugu

SEQ ID NO: 3963783 - RNA, 17 nt, Human herpesvirus 3
cagcaaguuuaacauuu

SEQ ID NO: 3963784 - RNA, 19 nt, Human herpesvirus 3
cagcaaguuuaacauuucc

SEQ ID NO: 3963785 - RNA, 21 nt, Human herpesvirus 3
cagcgccaauaaaagcagaca

SEQ ID NO: 3963786 - RNA, 23 nt, Human herpesvirus 3
caggucaaaacgcugacccaccc

SEQ ID NO: 3963787 - RNA, 14 nt, Human herpesvirus 3
caguaacgguuuac

SEQ ID NO: 3963788 - RNA, 20 nt, Human herpesvirus 3
caguguucuccugcaggcca

SEQ ID NO: 3963789 - RNA, 18 nt, Human herpesvirus 3
caguugaaccaaauccac

SEQ ID NO: 3963790 - RNA, 13 nt, Human herpesvirus 3
cauaaaaacgccu

SEQ ID NO: 3963791 - RNA, 12 nt, Human herpesvirus 3
cauaaaacugua

SEQ ID NO: 3963792 - RNA, 22 nt, Human herpesvirus 3
cauaguccgccgacagccgcuc

SEQ ID NO: 3963793 - RNA, 19 nt, Human herpesvirus 3
cauaguuauuguauauaca

SEQ ID NO: 3963794 - RNA, 22 nt, Human herpesvirus 3
caucgugcuugaauugccaucu

SEQ ID NO: 3963795 - RNA, 16 nt, Human herpesvirus 3
caucuucacgcucaau

SEQ ID NO: 3963796 - RNA, 21 nt, Human herpesvirus 3
caugacuuccacacucuucaa

SEQ ID NO: 3963797 - RNA, 19 nt, Human herpesvirus 3
caugaucgcccaauagcac

SEQ ID NO: 3963798 - RNA, 18 nt, Human herpesvirus 3
cauguuuucccaugucua

SEQ ID NO: 3963799 - RNA, 16 nt, Human herpesvirus 3
cauuccaacuggaaau

SEQ ID NO: 3963800 - RNA, 22 nt, Human herpesvirus 3
cauucgcaacacaucuacuguc

SEQ ID NO: 3963801 - RNA, 19 nt, Human herpesvirus 3
cauuguauaaaaacacgca

SEQ ID NO: 3963802 - RNA, 15 nt, Human herpesvirus 3
cauuuccauuuuuag

SEQ ID NO: 3963803 - RNA, 19 nt, Human herpesvirus 3
cauuuucgguggaagcaau

SEQ ID NO: 3963804 - RNA, 20 nt, Human herpesvirus 3
ccaaauaacgccuuaaaagu

SEQ ID NO: 3963805 - RNA, 19 nt, Human herpesvirus 3
ccaaccuucaaguuaaaua

SEQ ID NO: 3963806 - RNA, 22 nt, Human herpesvirus 3
ccaacuggaaaugugcugucaa

SEQ ID NO: 3963807 - RNA, 20 nt, Human herpesvirus 3
ccacacaacgccgcccacga

SEQ ID NO: 3963808 - RNA, 14 nt, Human herpesvirus 3
ccacauacaacaug

SEQ ID NO: 3963809 - RNA, 23 nt, Human herpesvirus 3
ccacguaauuugccccaaaccac

SEQ ID NO: 3963810 - RNA, 22 nt, Human herpesvirus 3
ccacguagcaaagcuacacuuu

SEQ ID NO: 3963811 - RNA, 15 nt, Human herpesvirus 3
ccacuggcgcgcgga

SEQ ID NO: 3963812 - RNA, 21 nt, Human herpesvirus 3
ccacuggcgcgcggacuguuu

SEQ ID NO: 3963813 - RNA, 20 nt, Human herpesvirus 3
ccagguacgcgucaaaaagc

SEQ ID NO: 3963814 - RNA, 20 nt, Human herpesvirus 3
ccauguggguugggauuacg

SEQ ID NO: 3963815 - RNA, 18 nt, Human herpesvirus 3
cccacgguuugugcacug

SEQ ID NO: 3963816 - RNA, 15 nt, Human herpesvirus 3
cccagcaaccccacc

SEQ ID NO: 3963817 - RNA, 21 nt, Human herpesvirus 3
cccauccgagugaaucuuaaa

SEQ ID NO: 3963818 - RNA, 19 nt, Human herpesvirus 3
cccaugucuacgugguacc

SEQ ID NO: 3963819 - RNA, 17 nt, Human herpesvirus 3
ccccaaggcccauaucc

SEQ ID NO: 3963820 - RNA, 17 nt, Human herpesvirus 3
cccggcggaccccggga

SEQ ID NO: 3963821 - RNA, 13 nt, Human herpesvirus 3
cccggucugcuca

SEQ ID NO: 3963822 - RNA, 15 nt, Human herpesvirus 3
cccugucaucagaca

SEQ ID NO: 3963823 - RNA, 14 nt, Human herpesvirus 3
ccgaaccggggcaa

SEQ ID NO: 3963824 - RNA, 16 nt, Human herpesvirus 3
ccgacaugcacugcau

SEQ ID NO: 3963825 - RNA, 17 nt, Human herpesvirus 3
ccgauguucgucgagac

SEQ ID NO: 3963826 - RNA, 17 nt, Human herpesvirus 3
ccguuuggaaacaacaa

SEQ ID NO: 3963827 - RNA, 13 nt, Human herpesvirus 3
ccuauaggcuuua

SEQ ID NO: 3963828 - RNA, 21 nt, Human herpesvirus 3
ccuugccgcguggaacacggg

SEQ ID NO: 3963829 - RNA, 14 nt, Human herpesvirus 3
ccuugguuugcaac

SEQ ID NO: 3963830 - RNA, 18 nt, Human herpesvirus 3
ccuugguuugcaaccuua

SEQ ID NO: 3963831 - RNA, 16 nt, Human herpesvirus 3
cgaagagaacugugaa

SEQ ID NO: 3963832 - RNA, 18 nt, Human herpesvirus 3
cgaauguuggaaacuguu

SEQ ID NO: 3963833 - RNA, 16 nt, Human herpesvirus 3
cgaauuguucugggaa

SEQ ID NO: 3963834 - RNA, 18 nt, Human herpesvirus 3
cgacagcaguaaggguga

SEQ ID NO: 3963835 - RNA, 18 nt, Human herpesvirus 3
cgacagcggauaucgucu

SEQ ID NO: 3963836 - RNA, 23 nt, Human herpesvirus 3
cgaccacgacagcaguaagggug

SEQ ID NO: 3963837 - RNA, 13 nt, Human herpesvirus 3
cgacgugagggug

SEQ ID NO: 3963838 - RNA, 15 nt, Human herpesvirus 3
cgaucacaacagaca

SEQ ID NO: 3963839 - RNA, 15 nt, Human herpesvirus 3
cgccgucgcgcccac

SEQ ID NO: 3963840 - RNA, 21 nt, Human herpesvirus 3
cgccgucgcgcccaccucggc

SEQ ID NO: 3963841 - RNA, 12 nt, Human herpesvirus 3
cgcgggugagug

SEQ ID NO: 3963842 - RNA, 13 nt, Human herpesvirus 3
cgcucucgcuguu

SEQ ID NO: 3963843 - RNA, 16 nt, Human herpesvirus 3
cgcuucccgaaagccc

SEQ ID NO: 3963844 - RNA, 23 nt, Human herpesvirus 3
cggcagaugaucugguaaauguu

SEQ ID NO: 3963845 - RNA, 15 nt, Human herpesvirus 3
cgggcuugcuguucu

SEQ ID NO: 3963846 - RNA, 16 nt, Human herpesvirus 3
cggugagcacccgggc

SEQ ID NO: 3963847 - RNA, 17 nt, Human herpesvirus 3
cguacauauccugcgca

SEQ ID NO: 3963848 - RNA, 15 nt, Human herpesvirus 3
cguacgaccaaacau

SEQ ID NO: 3963849 - RNA, 18 nt, Human herpesvirus 3
cguagauuccgaguccuc

SEQ ID NO: 3963850 - RNA, 20 nt, Human herpesvirus 3
cgucauauuacauuaacggu

SEQ ID NO: 3963851 - RNA, 16 nt, Human herpesvirus 3
cgugagcgccacuggc

SEQ ID NO: 3963852 - RNA, 17 nt, Human herpesvirus 3
cgugagcgccacuggcg

SEQ ID NO: 3963853 - RNA, 15 nt, Human herpesvirus 3
cgugguaagugcggc

SEQ ID NO: 3963854 - RNA, 14 nt, Human herpesvirus 3
cguguccccucugg

SEQ ID NO: 3963855 - RNA, 13 nt, Human herpesvirus 3
cguuaucggucaa

SEQ ID NO: 3963856 - RNA, 16 nt, Human herpesvirus 3
cguucuaauaaaaaca

SEQ ID NO: 3963857 - RNA, 20 nt, Human herpesvirus 3
cuaacaaugcacugaaccac

SEQ ID NO: 3963858 - RNA, 18 nt, Human herpesvirus 3
cuacugcugcaagcccuc

SEQ ID NO: 3963859 - RNA, 12 nt, Human herpesvirus 3
cuagccacaccc

SEQ ID NO: 3963860 - RNA, 22 nt, Human herpesvirus 3
cuaggcacuuuggcggucauuu

SEQ ID NO: 3963861 - RNA, 20 nt, Human herpesvirus 3
cuauagcugucacuguugcg

SEQ ID NO: 3963862 - RNA, 22 nt, Human herpesvirus 3
cucacugcuauagccgucagaa

SEQ ID NO: 3963863 - RNA, 16 nt, Human herpesvirus 3
cuccaagggacccgca

SEQ ID NO: 3963864 - RNA, 15 nt, Human herpesvirus 3
cuccaucacgauaaa

SEQ ID NO: 3963865 - RNA, 21 nt, Human herpesvirus 3
cucccaaggcggucccucgga

SEQ ID NO: 3963866 - RNA, 20 nt, Human herpesvirus 3
cucccucauaauaugauaca

SEQ ID NO: 3963867 - RNA, 17 nt, Human herpesvirus 3
aaaaacacaguugauuu

SEQ ID NO: 3963868 - RNA, 14 nt, Human herpesvirus 3
aaaacguuguguuu

SEQ ID NO: 3963869 - RNA, 19 nt, Human herpesvirus 3
aaaacuuugguuguuguau

SEQ ID NO: 3963870 - RNA, 20 nt, Human herpesvirus 3
aaaagcggaacgguuuuuau

SEQ ID NO: 3963871 - RNA, 17 nt, Human herpesvirus 3
aaaauguuaaacccuga

SEQ ID NO: 3963872 - RNA, 12 nt, Human herpesvirus 3
aaaauuugagau

SEQ ID NO: 3963873 - RNA, 16 nt, Human herpesvirus 3
aaacagguagccagcc

SEQ ID NO: 3963874 - RNA, 15 nt, Human herpesvirus 3
aaaccaaacacgccu

SEQ ID NO: 3963875 - RNA, 18 nt, Human herpesvirus 3
aaacuguuuaaauaguac

SEQ ID NO: 3963876 - RNA, 18 nt, Human herpesvirus 3
aaagguauacuuggagau

SEQ ID NO: 3963877 - RNA, 21 nt, Human herpesvirus 3
aaagguuuauuccggagccua

SEQ ID NO: 3963878 - RNA, 13 nt, Human herpesvirus 3
aaauaaacuauau

SEQ ID NO: 3963879 - RNA, 22 nt, Human herpesvirus 3
aaauaacgccuuaaaaguuaca

SEQ ID NO: 3963880 - RNA, 16 nt, Human herpesvirus 3
aaauucuacaacauug

SEQ ID NO: 3963881 - RNA, 15 nt, Human herpesvirus 3
aaauugggggauuug

SEQ ID NO: 3963882 - RNA, 17 nt, Human herpesvirus 3
aaauuuauaaaacacuc

SEQ ID NO: 3963883 - RNA, 23 nt, Human herpesvirus 3
aacaacgcguacgugccuaggaa

SEQ ID NO: 3963884 - RNA, 15 nt, Human herpesvirus 3
aacacugucagaaac

SEQ ID NO: 3963885 - RNA, 19 nt, Human herpesvirus 3
aacagucguugggaauuua

SEQ ID NO: 3963886 - RNA, 14 nt, Human herpesvirus 3
aacaguuauguuuu

SEQ ID NO: 3963887 - RNA, 20 nt, Human herpesvirus 3
aacauaccccaggccuugaa

SEQ ID NO: 3963888 - RNA, 23 nt, Human herpesvirus 3
aaccauagacuguucuacugacu

SEQ ID NO: 3963889 - RNA, 12 nt, Human herpesvirus 3
aaccgagggugg

SEQ ID NO: 3963890 - RNA, 16 nt, Human herpesvirus 3
aacgaaggcacggaag

SEQ ID NO: 3963891 - RNA, 18 nt, Human herpesvirus 3
aacgccucccagcaaaau

SEQ ID NO: 3963892 - RNA, 21 nt, Human herpesvirus 3
aacuuuugcuuauauuuuaca

SEQ ID NO: 3963893 - RNA, 22 nt, Human herpesvirus 3
aagcgcuccgcccuaaauuaca

SEQ ID NO: 3963894 - RNA, 12 nt, Human herpesvirus 3
aaggaaaugccu

SEQ ID NO: 3963895 - RNA, 14 nt, Human herpesvirus 3
aagguguaaauacu

SEQ ID NO: 3963896 - RNA, 17 nt, Human herpesvirus 3
cuccgcccuaaauuaca

SEQ ID NO: 3963897 - RNA, 17 nt, Human herpesvirus 3
cucgccuccacugcauu

SEQ ID NO: 3963898 - RNA, 13 nt, Human herpesvirus 3
cucgugucucugg

SEQ ID NO: 3963899 - RNA, 22 nt, Human herpesvirus 3
cucuguucggugaguuaaacgg

SEQ ID NO: 3963900 - RNA, 15 nt, Human herpesvirus 3
cugaucguauugcug

SEQ ID NO: 3963901 - RNA, 14 nt, Human herpesvirus 3
cugauuacauuuca

SEQ ID NO: 3963902 - RNA, 17 nt, Human herpesvirus 3
cugauucggguaaaaca

SEQ ID NO: 3963903 - RNA, 14 nt, Human herpesvirus 3
cugccguauuuugc

SEQ ID NO: 3963904 - RNA, 15 nt, Human herpesvirus 3
cugcuuuauuaccaa

SEQ ID NO: 3963905 - RNA, 19 nt, Human herpesvirus 3
cuggacauguguuuaagua

SEQ ID NO: 3963906 - RNA, 22 nt, Human herpesvirus 3
cuggcgugguuauuacauuuaa

SEQ ID NO: 3963907 - RNA, 19 nt, Human herpesvirus 3
cugggcgcccggcggaccc

SEQ ID NO: 3963908 - RNA, 14 nt, Human herpesvirus 3
cuggucggaccccc

SEQ ID NO: 3963909 - RNA, 21 nt, Human herpesvirus 3
cuguacgcagaaagcagucaa

SEQ ID NO: 3963910 - RNA, 12 nt, Human herpesvirus 3
cugucugucugu

SEQ ID NO: 3963911 - RNA, 21 nt, Human herpesvirus 3
cuuacacccccguugcuuuaa

SEQ ID NO: 3963912 - RNA, 16 nt, Human herpesvirus 3
cuuacguuugcauuua

SEQ ID NO: 3963913 - RNA, 21 nt, Human herpesvirus 3
cuucaaguuaaauaacauguc

SEQ ID NO: 3963914 - RNA, 22 nt, Human herpesvirus 3
cuucaaguuaaauaacauguca

SEQ ID NO: 3963915 - RNA, 14 nt, Human herpesvirus 3
cuugacaacauuua

SEQ ID NO: 3963916 - RNA, 14 nt, Human herpesvirus 3
cuugucaaaacaua

SEQ ID NO: 3963917 - RNA, 21 nt, Human herpesvirus 3
cuuguuuuuauuuaauaggca

SEQ ID NO: 3963918 - RNA, 18 nt, Human herpesvirus 3
cuuuaugaauuugcuacc

SEQ ID NO: 3963919 - RNA, 15 nt, Human herpesvirus 3
cuuuuaaagcaguac

SEQ ID NO: 3963920 - RNA, 11 nt, Human herpesvirus 3
cuuuuuaugca

SEQ ID NO: 3963921 - RNA, 14 nt, Human herpesvirus 3
gaaagcggacacau

SEQ ID NO: 3963922 - RNA, 15 nt, Human herpesvirus 3
gaacguuuaauuaau

SEQ ID NO: 3963923 - RNA, 12 nt, Human herpesvirus 3
gaacuaacucag

SEQ ID NO: 3963924 - RNA, 13 nt, Human herpesvirus 3
gaagacuccagua

SEQ ID NO: 3963925 - RNA, 17 nt, Human herpesvirus 3
gaagcuauuggcuccac

SEQ ID NO: 3963926 - RNA, 19 nt, Human herpesvirus 3
gaagcugacgaagagaacu

SEQ ID NO: 3963927 - RNA, 21 nt, Human herpesvirus 3
gaagggggauuuacaaugaca

SEQ ID NO: 3963928 - RNA, 17 nt, Human herpesvirus 3
gaauccggucagagcau

SEQ ID NO: 3963929 - RNA, 21 nt, Human herpesvirus 3
gaauuuauccgguugaaaaca

SEQ ID NO: 3963930 - RNA, 14 nt, Human herpesvirus 3
gacaugcacugcau

SEQ ID NO: 3963931 - RNA, 14 nt, Human herpesvirus 3
gacccgcagcccag

SEQ ID NO: 3963932 - RNA, 20 nt, Human herpesvirus 3
gacgcauuugaugaaucguu

SEQ ID NO: 3963933 - RNA, 18 nt, Human herpesvirus 3
gacgccgauaaauccaca

SEQ ID NO: 3963934 - RNA, 17 nt, Human herpesvirus 3
gacgggcgggcuggucg

SEQ ID NO: 3963935 - RNA, 20 nt, Human herpesvirus 3
gacuccagcaucaucugcug

SEQ ID NO: 3963936 - RNA, 16 nt, Human herpesvirus 3
gagauauggguucgga

SEQ ID NO: 3963937 - RNA, 18 nt, Human herpesvirus 3
gagcaaacuaaagguaua

SEQ ID NO: 3963938 - RNA, 20 nt, Human herpesvirus 3
gagcgccacuggcgcgcgga

SEQ ID NO: 3963939 - RNA, 15 nt, Human herpesvirus 3
gagcucccauuccaa

SEQ ID NO: 3963940 - RNA, 18 nt, Human herpesvirus 3
gauaaauaaaguuuuuaa

SEQ ID NO: 3963941 - RNA, 22 nt, Human herpesvirus 3
gauauaaauccguaucucggag

SEQ ID NO: 3963942 - RNA, 14 nt, Human herpesvirus 3
gaucgucaguaaau

SEQ ID NO: 3963943 - RNA, 19 nt, Human herpesvirus 3
gauggugaugaaaucagag

SEQ ID NO: 3963944 - RNA, 17 nt, Human herpesvirus 3
gauuacgcguugugaua

SEQ ID NO: 3963945 - RNA, 16 nt, Human herpesvirus 3
gauuuuacagaaaaua

SEQ ID NO: 3963946 - RNA, 13 nt, Human herpesvirus 3
gcaauuggccguu

SEQ ID NO: 3963947 - RNA, 21 nt, Human herpesvirus 3
gcacaucauccguccaaacag

SEQ ID NO: 3963948 - RNA, 14 nt, Human herpesvirus 3
gcagauacagcaua

SEQ ID NO: 3963949 - RNA, 20 nt, Human herpesvirus 3
gccacaauaacauaagggau

SEQ ID NO: 3963950 - RNA, 19 nt, Human herpesvirus 3
gccagauguacacccagcu

SEQ ID NO: 3963951 - RNA, 19 nt, Human herpesvirus 3
gccagugaaauaugacggc

SEQ ID NO: 3963952 - RNA, 23 nt, Human herpesvirus 3
gccaguggaccuuugcaaccugg

SEQ ID NO: 3963953 - RNA, 17 nt, Human herpesvirus 3
gcccacacaaucagaag

SEQ ID NO: 3963954 - RNA, 15 nt, Human herpesvirus 3
gccccaaaccacugu

SEQ ID NO: 3963955 - RNA, 14 nt, Human herpesvirus 3
gccgagaacagugg

SEQ ID NO: 3963956 - RNA, 21 nt, Human herpesvirus 3
gccgguacaauuaccccgcga

SEQ ID NO: 3963957 - RNA, 12 nt, Human herpesvirus 3
gccgucgcgccc

SEQ ID NO: 3963958 - RNA, 14 nt, Human herpesvirus 3
gcgaacaccgcugu

SEQ ID NO: 3963959 - RNA, 18 nt, Human herpesvirus 3
gcgaagcugccgucaaug

SEQ ID NO: 3963960 - RNA, 22 nt, Human herpesvirus 3
gcgcgcaaauuaacccccgagg

SEQ ID NO: 3963961 - RNA, 24 nt, Human herpesvirus 3
gcgcucaaucaauccaaggaugug

SEQ ID NO: 3963962 - RNA, 20 nt, Human herpesvirus 3
gcgcugguauguauggcuuc

SEQ ID NO: 3963963 - RNA, 19 nt, Human herpesvirus 3
gcggaucccgcggugagca

SEQ ID NO: 3963964 - RNA, 20 nt, Human herpesvirus 3
gcggccguugccgcauuaga

SEQ ID NO: 3963965 - RNA, 21 nt, Human herpesvirus 3
gcgguauauuaauuaacuggc

SEQ ID NO: 3963966 - RNA, 17 nt, Human herpesvirus 3
gcuacucccacccacug

SEQ ID NO: 3963967 - RNA, 13 nt, Human herpesvirus 3
gcucaaugaacag

SEQ ID NO: 3963968 - RNA, 15 nt, Human herpesvirus 3
gcugccgucaaugca

SEQ ID NO: 3963969 - RNA, 15 nt, Human herpesvirus 3
gcuggucggaccccc

SEQ ID NO: 3963970 - RNA, 18 nt, Human herpesvirus 3
ggaagaguuagcauccaa

SEQ ID NO: 3963971 - RNA, 18 nt, Human herpesvirus 3
ggaccuuugcaaccuggu

SEQ ID NO: 3963972 - RNA, 21 nt, Human herpesvirus 3
ggacuguuuaacggaagauga

SEQ ID NO: 3963973 - RNA, 23 nt, Human herpesvirus 3
ggccaagguuuuggauucccugg

SEQ ID NO: 3963974 - RNA, 13 nt, Human herpesvirus 3
ggccgcuucccga

SEQ ID NO: 3963975 - RNA, 13 nt, Human herpesvirus 3
ggcgcccggcgga

SEQ ID NO: 3963976 - RNA, 17 nt, Human herpesvirus 3
ggcgcugaagggugcau

SEQ ID NO: 3963977 - RNA, 13 nt, Human herpesvirus 3
ggucaucccggga

SEQ ID NO: 3963978 - RNA, 20 nt, Human herpesvirus 3
gguuaaggcgaaaagguuuc

SEQ ID NO: 3963979 - RNA, 17 nt, Human herpesvirus 3
gguucagcggacgcugc

SEQ ID NO: 3963980 - RNA, 12 nt, Human herpesvirus 3
guacaacacaaa

SEQ ID NO: 3963981 - RNA, 18 nt, Human herpesvirus 3
guacaauacguaaauguc

SEQ ID NO: 3963982 - RNA, 21 nt, Human herpesvirus 3
guacacgauucggaaugcccg

SEQ ID NO: 3963983 - RNA, 13 nt, Human herpesvirus 3
guacagauuaaaa

SEQ ID NO: 3963984 - RNA, 22 nt, Human herpesvirus 3
guccaguggacaguaacagccc

SEQ ID NO: 3963985 - RNA, 17 nt, Human herpesvirus 3
gucgaaccgaucgggcg

SEQ ID NO: 3963986 - RNA, 14 nt, Human herpesvirus 3
gucguuuaaagccc

SEQ ID NO: 3963987 - RNA, 14 nt, Human herpesvirus 3
gucugcgaagcugc

SEQ ID NO: 3963988 - RNA, 19 nt, Human herpesvirus 3
gucugugcgggcgggcgac

SEQ ID NO: 3963989 - RNA, 14 nt, Human herpesvirus 3
gugagcacccgggc

SEQ ID NO: 3963990 - RNA, 22 nt, Human herpesvirus 3
gugaggaaaaagaggcggggag

SEQ ID NO: 3963991 - RNA, 23 nt, Human herpesvirus 3
gugcaucgcauaggguguuauaa

SEQ ID NO: 3963992 - RNA, 14 nt, Human herpesvirus 3
guggguagguaggg

SEQ ID NO: 3963993 - RNA, 23 nt, Human herpesvirus 3
gugguuauuacauuuaauguuuu

SEQ ID NO: 3963994 - RNA, 10 nt, Human herpesvirus 3
gugucugucu

SEQ ID NO: 3963995 - RNA, 18 nt, Human herpesvirus 3
guguuuuuaauagagagu

SEQ ID NO: 3963996 - RNA, 12 nt, Human herpesvirus 3
guuaauaaaagc

SEQ ID NO: 3963997 - RNA, 21 nt, Human herpesvirus 3
guuaauaccauauauggacau

SEQ ID NO: 3963998 - RNA, 19 nt, Human herpesvirus 3
guuaauuaacgcgauuuua

SEQ ID NO: 3963999 - RNA, 23 nt, Human herpesvirus 3
guuacauaaauacuaagccucug

SEQ ID NO: 3964000 - RNA, 14 nt, Human herpesvirus 3
guucaguaacuuaa

SEQ ID NO: 3964001 - RNA, 22 nt, Human herpesvirus 3
guucauaacaccgcuauacgca

SEQ ID NO: 3964002 - RNA, 12 nt, Human herpesvirus 3
guuucugggcgc

SEQ ID NO: 3964003 - RNA, 20 nt, Human herpesvirus 3
uaaaaacggauauuaacacg

SEQ ID NO: 3964004 - RNA, 16 nt, Human herpesvirus 3
uaaaacauaucaauuu

SEQ ID NO: 3964005 - RNA, 13 nt, Human herpesvirus 3
uaaauauaaauuu

SEQ ID NO: 3964006 - RNA, 17 nt, Human herpesvirus 3
uaacaauagaaucggag

SEQ ID NO: 3964007 - RNA, 16 nt, Human herpesvirus 3
uaacccccccccgguu

SEQ ID NO: 3964008 - RNA, 14 nt, Human herpesvirus 3
uaagacguugcaua

SEQ ID NO: 3964009 - RNA, 22 nt, Human herpesvirus 3
uaaggggagcguggauguguca

SEQ ID NO: 3964010 - RNA, 13 nt, Human herpesvirus 3
uaagguguuaaua

SEQ ID NO: 3964011 - RNA, 14 nt, Human herpesvirus 3
uaauauggggacag

SEQ ID NO: 3964012 - RNA, 15 nt, Human herpesvirus 3
uaauugucacgcuua

SEQ ID NO: 3964013 - RNA, 21 nt, Human herpesvirus 3
uacaaacgcgcaauguuuuga

SEQ ID NO: 3964014 - RNA, 17 nt, Human herpesvirus 3
uacaauacguaaauguc

SEQ ID NO: 3964015 - RNA, 19 nt, Human herpesvirus 3
uacacgauucggaaugccc

SEQ ID NO: 3964016 - RNA, 16 nt, Human herpesvirus 3
uacagaagacaucacc

SEQ ID NO: 3964017 - RNA, 21 nt, Human herpesvirus 3
uacauauguuccacucuacau

SEQ ID NO: 3964018 - RNA, 17 nt, Human herpesvirus 3
uacgccacgcuacaucc

SEQ ID NO: 3964019 - RNA, 17 nt, Human herpesvirus 3
uacguaaaugucacuau

SEQ ID NO: 3964020 - RNA, 24 nt, Human herpesvirus 3
uacuaauuuguauuuuuaaucauu

SEQ ID NO: 3964021 - RNA, 22 nt, Human herpesvirus 3
uagacguucaaaauaucuuaca

SEQ ID NO: 3964022 - RNA, 20 nt, Human herpesvirus 3
uagauguguugcgaauguaa

SEQ ID NO: 3964023 - RNA, 22 nt, Human herpesvirus 3
uagauguguugcgaauguaaua

SEQ ID NO: 3964024 - RNA, 18 nt, Human herpesvirus 3
uagcauauguucagcagc

SEQ ID NO: 3964025 - RNA, 16 nt, Human herpesvirus 3
uagguucggcaaaucu

SEQ ID NO: 3964026 - RNA, 16 nt, Human herpesvirus 3
uaguuaccaaaguuuu

SEQ ID NO: 3964027 - RNA, 15 nt, Human herpesvirus 3
uauaucuguuacauu

SEQ ID NO: 3964028 - RNA, 18 nt, Human herpesvirus 3
uauauuaaagguuaaauu

SEQ ID NO: 3964029 - RNA, 11 nt, Human herpesvirus 3
uauccaauggg

SEQ ID NO: 3964030 - RNA, 15 nt, Human herpesvirus 3
uauccgacagagaaa

SEQ ID NO: 3964031 - RNA, 17 nt, Human herpesvirus 3
uauggaaucgucuaaca

SEQ ID NO: 3964032 - RNA, 16 nt, Human herpesvirus 3
uauuauaaauguguau

SEQ ID NO: 3964033 - RNA, 13 nt, Human herpesvirus 3
uauucuacagauu

SEQ ID NO: 3964034 - RNA, 20 nt, Human herpesvirus 3
uauucucgcuugcagcuugu

SEQ ID NO: 3964035 - RNA, 17 nt, Human herpesvirus 3
uauuuacguauguacca

SEQ ID NO: 3964036 - RNA, 20 nt, Human herpesvirus 3
ucaaaaaagcguguaaauca

SEQ ID NO: 3964037 - RNA, 13 nt, Human herpesvirus 3
ucaaguugcaugu

SEQ ID NO: 3964038 - RNA, 23 nt, Human herpesvirus 3
ucaauaugucacggagaacguau

SEQ ID NO: 3964039 - RNA, 24 nt, Human herpesvirus 3
ucaccaaacggguuuugggugcau

SEQ ID NO: 3964040 - RNA, 14 nt, Human herpesvirus 3
ucagcgccaauaaa

SEQ ID NO: 3964041 - RNA, 18 nt, Human herpesvirus 3
ucauaaaaacaagaaguu

SEQ ID NO: 3964042 - RNA, 12 nt, Human herpesvirus 3
ucauaacaccgc

SEQ ID NO: 3964043 - RNA, 14 nt, Human herpesvirus 3
ucauacgcauuuac

SEQ ID NO: 3964044 - RNA, 21 nt, Human herpesvirus 3
ucauacgccgacaugccuggc

SEQ ID NO: 3964045 - RNA, 17 nt, Human herpesvirus 3
ucaugaacaaacacucu

SEQ ID NO: 3964046 - RNA, 19 nt, Human herpesvirus 3
ucaugcuuguaaaacauau

SEQ ID NO: 3964047 - RNA, 22 nt, Human herpesvirus 3
ucauuaugagcaucuagaagau

SEQ ID NO: 3964048 - RNA, 22 nt, Human herpesvirus 3
uccccuccuuuucucgugagcg

SEQ ID NO: 3964049 - RNA, 14 nt, Human herpesvirus 3
ucgcccgaaaacuu

SEQ ID NO: 3964050 - RNA, 13 nt, Human herpesvirus 3
ucgcgcccaccuc

SEQ ID NO: 3964051 - RNA, 10 nt, Human herpesvirus 3
ucggaccccc

SEQ ID NO: 3964052 - RNA, 15 nt, Human herpesvirus 3
ucuaaaaauaauguu

SEQ ID NO: 3964053 - RNA, 16 nt, Human herpesvirus 3
ucuaacguugucgauc

SEQ ID NO: 3964054 - RNA, 14 nt, Human herpesvirus 3
ucugaccauuuacc

SEQ ID NO: 3964055 - RNA, 18 nt, Human herpesvirus 3
ucugcaaucauaaaugca

SEQ ID NO: 3964056 - RNA, 21 nt, Human herpesvirus 3
ucugcgaagcugccgucaaug

SEQ ID NO: 3964057 - RNA, 13 nt, Human herpesvirus 3
ucuggagucucca

SEQ ID NO: 3964058 - RNA, 17 nt, Human herpesvirus 3
ucuuucccgaagguuuu

SEQ ID NO: 3964059 - RNA, 20 nt, Human herpesvirus 3
ugacaaauucccccggggcg

SEQ ID NO: 3964060 - RNA, 17 nt, Human herpesvirus 3
ugacuuugaugagaaug

SEQ ID NO: 3964061 - RNA, 16 nt, Human herpesvirus 3
ugagguuuagcaacga

SEQ ID NO: 3964062 - RNA, 20 nt, Human herpesvirus 3
ugaguugcggcgcugaaggg

SEQ ID NO: 3964063 - RNA, 19 nt, Human herpesvirus 3
ugauagaacgcguaaaucu

SEQ ID NO: 3964064 - RNA, 17 nt, Human herpesvirus 3
ugaucugguaaauguua

SEQ ID NO: 3964065 - RNA, 12 nt, Human herpesvirus 3
ugcaagcucgau

SEQ ID NO: 3964066 - RNA, 16 nt, Human herpesvirus 3
ugcacugcaucuggag

SEQ ID NO: 3964067 - RNA, 19 nt, Human herpesvirus 3
ugcaucguagguauaaacg

SEQ ID NO: 3964068 - RNA, 19 nt, Human herpesvirus 3
ugcgaagcugccgucaaug

SEQ ID NO: 3964069 - RNA, 17 nt, Human herpesvirus 3
ugcgucuaucugcaggg

SEQ ID NO: 3964070 - RNA, 23 nt, Human herpesvirus 3
ugcugaguugcggcgcugaaggg

SEQ ID NO: 3964071 - RNA, 20 nt, Human herpesvirus 3
uggacguuuuuccacaauuu

SEQ ID NO: 3964072 - RNA, 19 nt, Human herpesvirus 3
uggagcaacguuuaagaac

SEQ ID NO: 3964073 - RNA, 14 nt, Human herpesvirus 3
uggauaggucaucu

SEQ ID NO: 3964074 - RNA, 14 nt, Human herpesvirus 3
uggcagaagguuua

SEQ ID NO: 3964075 - RNA, 15 nt, Human herpesvirus 3
uggcauuaaacccac

SEQ ID NO: 3964076 - RNA, 15 nt, Human herpesvirus 3
uggcgcgcggacugu

SEQ ID NO: 3964077 - RNA, 19 nt, Human herpesvirus 3
ugggcaaaugaugaagcua

SEQ ID NO: 3964078 - RNA, 21 nt, Human herpesvirus 3
ugggguucggaauuaucacgg

SEQ ID NO: 3964079 - RNA, 18 nt, Human herpesvirus 3
ugguccauuaaaaguuua

SEQ ID NO: 3964080 - RNA, 15 nt, Human herpesvirus 3
uggugaagaaggaca

SEQ ID NO: 3964081 - RNA, 16 nt, Human herpesvirus 3
uguaaccuacacaaca

SEQ ID NO: 3964082 - RNA, 11 nt, Human herpesvirus 3
uguaauuguaa

SEQ ID NO: 3964083 - RNA, 15 nt, Human herpesvirus 3
uguacaauugucugu

SEQ ID NO: 3964084 - RNA, 17 nt, Human herpesvirus 3
ugucaucagacaugauu

SEQ ID NO: 3964085 - RNA, 14 nt, Human herpesvirus 3
uguccggacuccag

SEQ ID NO: 3964086 - RNA, 18 nt, Human herpesvirus 3
ugucuacgugguaccaaa

SEQ ID NO: 3964087 - RNA, 19 nt, Human herpesvirus 3
ugucuacgugguaccaaaa

SEQ ID NO: 3964088 - RNA, 21 nt, Human herpesvirus 3
ugucuacuauuugugaagacu

SEQ ID NO: 3964089 - RNA, 14 nt, Human herpesvirus 3
ugugaugaauguaa

SEQ ID NO: 3964090 - RNA, 15 nt, Human herpesvirus 3
ugugggaggucuaca

SEQ ID NO: 3964091 - RNA, 21 nt, Human herpesvirus 3
ugugggaggucuacagcaccc

SEQ ID NO: 3964092 - RNA, 17 nt, Human herpesvirus 3
uguguuuuuaucugcaa

SEQ ID NO: 3964093 - RNA, 14 nt, Human herpesvirus 3
uguucuaaaacacu

SEQ ID NO: 3964094 - RNA, 19 nt, Human herpesvirus 3
uguucugcauaagcucugu

SEQ ID NO: 3964095 - RNA, 22 nt, Human herpesvirus 3
uguugggucagaaccgacccag

SEQ ID NO: 3964096 - RNA, 21 nt, Human herpesvirus 3
uguuuggugcacucuaccaaa

SEQ ID NO: 3964097 - RNA, 19 nt, Human herpesvirus 3
uguuuucggaguugccucc

SEQ ID NO: 3964098 - RNA, 16 nt, Human herpesvirus 3
uguuuuuaucugcaau

SEQ ID NO: 3964099 - RNA, 19 nt, Human herpesvirus 3
uuaagacguccacacagcc

SEQ ID NO: 3964100 - RNA, 19 nt, Human herpesvirus 3
uuaccccgccauaaacaga

SEQ ID NO: 3964101 - RNA, 19 nt, Human herpesvirus 3
uuauaucuguuacauuucg

SEQ ID NO: 3964102 - RNA, 22 nt, Human herpesvirus 3
uuaugaaaaaagugucugucug

SEQ ID NO: 3964103 - RNA, 13 nt, Human herpesvirus 3
uuauuuugaacau

SEQ ID NO: 3964104 - RNA, 14 nt, Human herpesvirus 3
uucaacacacccau

SEQ ID NO: 3964105 - RNA, 20 nt, Human herpesvirus 3
uucaaguuaaauaacauguc

SEQ ID NO: 3964106 - RNA, 23 nt, Human herpesvirus 3
uucaugguaucaucuauugacga

SEQ ID NO: 3964107 - RNA, 21 nt, Human herpesvirus 3
uucccaaaaggauauucacca

SEQ ID NO: 3964108 - RNA, 15 nt, Human herpesvirus 3
uuccuuuuccagcga

SEQ ID NO: 3964109 - RNA, 18 nt, Human herpesvirus 3
uucuauauuaauaaaaga

SEQ ID NO: 3964110 - RNA, 21 nt, Human herpesvirus 3
uugaaacgucguuauauucac

SEQ ID NO: 3964111 - RNA, 14 nt, Human herpesvirus 3
uugcauaugcauau

SEQ ID NO: 3964112 - RNA, 12 nt, Human herpesvirus 3
uuguaguacagg

SEQ ID NO: 3964113 - RNA, 12 nt, Human herpesvirus 3
uuguauauacaa

SEQ ID NO: 3964114 - RNA, 17 nt, Human herpesvirus 3
uuuaaaagccguucugu

SEQ ID NO: 3964115 - RNA, 16 nt, Human herpesvirus 3
uuucucuaacgcaauu

SEQ ID NO: 3964116 - RNA, 13 nt, Human herpesvirus 3
uuuuaaagcaucu

SEQ ID NO: 3964117 - RNA, 12 nt, Human herpesvirus 3
uuuuuaaucauu

SEQ ID NO: 3964118 - RNA, 23 nt, Human herpesvirus 3
aaaaacguuucugguguauguuu

SEQ ID NO: 3964119 - RNA, 20 nt, Human herpesvirus 3
aaaacacgggaucauuuucu

SEQ ID NO: 3964120 - RNA, 23 nt, Human herpesvirus 3
aaaagcggaacgguuuuuaugaa

SEQ ID NO: 3964121 - RNA, 23 nt, Human herpesvirus 3
aaaauauacgcucuucugauauu

SEQ ID NO: 3964122 - RNA, 16 nt, Human herpesvirus 3
aaacgcgccaaacauu

SEQ ID NO: 3964123 - RNA, 19 nt, Human herpesvirus 3
aaagccgguacacagcauu

SEQ ID NO: 3964124 - RNA, 20 nt, Human herpesvirus 3
aaauuaacucgcguacaaau

SEQ ID NO: 3964125 - RNA, 22 nt, Human herpesvirus 3
aaauuuguguuuuuaucugcaa

SEQ ID NO: 3964126 - RNA, 17 nt, Human herpesvirus 3
aacaaacauucacagua

SEQ ID NO: 3964127 - RNA, 14 nt, Human herpesvirus 3
aacaccgcugugcu

SEQ ID NO: 3964128 - RNA, 15 nt, Human herpesvirus 3
aacaccgcugugcug

SEQ ID NO: 3964129 - RNA, 18 nt, Human herpesvirus 3
aacacggguuccguugcu

SEQ ID NO: 3964130 - RNA, 23 nt, Human herpesvirus 3
aacacuuggcguguuaaacacug

SEQ ID NO: 3964131 - RNA, 14 nt, Human herpesvirus 3
aacauuggcggaag

SEQ ID NO: 3964132 - RNA, 17 nt, Human herpesvirus 3
aacccaagguguaaaua

SEQ ID NO: 3964133 - RNA, 15 nt, Human herpesvirus 3
aacccccccccgguu

SEQ ID NO: 3964134 - RNA, 22 nt, Human herpesvirus 3
aaccuuuuauuuuaaggauggg

SEQ ID NO: 3964135 - RNA, 19 nt, Human herpesvirus 3
aacgucuagaacuguguau

SEQ ID NO: 3964136 - RNA, 18 nt, Human herpesvirus 3
aacucgccuccacugcau

SEQ ID NO: 3964137 - RNA, 21 nt, Human herpesvirus 3
aagaaaacauugcagcguaca

SEQ ID NO: 3964138 - RNA, 14 nt, Human herpesvirus 3
aagacauggccgug

SEQ ID NO: 3964139 - RNA, 14 nt, Human herpesvirus 3
aagauaggguguau

SEQ ID NO: 3964140 - RNA, 21 nt, Human herpesvirus 3
aagauguacugugucucucaa

SEQ ID NO: 3964141 - RNA, 14 nt, Human herpesvirus 3
aagauguuuccaca

SEQ ID NO: 3964142 - RNA, 22 nt, Human herpesvirus 3
aagcgauuuuaucauugaagau

SEQ ID NO: 3964143 - RNA, 15 nt, Human herpesvirus 3
aagcuauacacaagu

SEQ ID NO: 3964144 - RNA, 17 nt, Human herpesvirus 3
aagcuauuaaugguaca

SEQ ID NO: 3964145 - RNA, 21 nt, Human herpesvirus 3
aagguguauuuuauuuaguga

SEQ ID NO: 3964146 - RNA, 15 nt, Human herpesvirus 3
aagguguuucagugg

SEQ ID NO: 3964147 - RNA, 20 nt, Human herpesvirus 3
aagguuaaauuuauaaaaca

SEQ ID NO: 3964148 - RNA, 17 nt, Human herpesvirus 3
aauaacgccuuaaaagu

SEQ ID NO: 3964149 - RNA, 19 nt, Human herpesvirus 3
aauaccuuuuucaugcuug

SEQ ID NO: 3964150 - RNA, 16 nt, Human herpesvirus 3
aauaucuuugcaauuc

SEQ ID NO: 3964151 - RNA, 17 nt, Human herpesvirus 3
cauaguuauuguauaua

SEQ ID NO: 3964152 - RNA, 20 nt, Human herpesvirus 3
cauaucaauuuauauuuuua

SEQ ID NO: 3964153 - RNA, 14 nt, Human herpesvirus 3
caucagacaugauu

SEQ ID NO: 3964154 - RNA, 16 nt, Human herpesvirus 3
caucugcauuacagaa

SEQ ID NO: 3964155 - RNA, 17 nt, Human herpesvirus 3
caugcauugcucgcgua

SEQ ID NO: 3964156 - RNA, 17 nt, Human herpesvirus 3
caugcuuguaaaacaua

SEQ ID NO: 3964157 - RNA, 20 nt, Human herpesvirus 3
caugguugugggaaacauca

SEQ ID NO: 3964158 - RNA, 14 nt, Human herpesvirus 3
cauuaaaguauuug

SEQ ID NO: 3964159 - RNA, 15 nt, Human herpesvirus 3
cauuaacccacgggg

SEQ ID NO: 3964160 - RNA, 22 nt, Human herpesvirus 3
cauuguacacccgguaugccac

SEQ ID NO: 3964161 - RNA, 19 nt, Human herpesvirus 3
cauuuccaaacacauuacg

SEQ ID NO: 3964162 - RNA, 17 nt, Human herpesvirus 3
cauuugcgaauucuuag

SEQ ID NO: 3964163 - RNA, 18 nt, Human herpesvirus 3
cauuuuauagacacgcua

SEQ ID NO: 3964164 - RNA, 16 nt, Human herpesvirus 3
ccaagguuuuggauuc

SEQ ID NO: 3964165 - RNA, 12 nt, Human herpesvirus 3
ccaccacauuuu

SEQ ID NO: 3964166 - RNA, 15 nt, Human herpesvirus 3
ccaccagacacgcuc

SEQ ID NO: 3964167 - RNA, 21 nt, Human herpesvirus 3
ccacguaauuugccccaaacc

SEQ ID NO: 3964168 - RNA, 20 nt, Human herpesvirus 3
ccacguuuuacgucugccca

SEQ ID NO: 3964169 - RNA, 12 nt, Human herpesvirus 3
ccacuuauccaa

SEQ ID NO: 3964170 - RNA, 20 nt, Human herpesvirus 3
ccagauguacacccagcugu

SEQ ID NO: 3964171 - RNA, 14 nt, Human herpesvirus 3
ccaggcucucauga

SEQ ID NO: 3964172 - RNA, 15 nt, Human herpesvirus 3
ccagguacgcgucaa

SEQ ID NO: 3964173 - RNA, 13 nt, Human herpesvirus 3
cccacccccgcag

SEQ ID NO: 3964174 - RNA, 15 nt, Human herpesvirus 3
cccaccuccccgcgc

SEQ ID NO: 3964175 - RNA, 19 nt, Human herpesvirus 3
ccccaguaaucucacuguu

SEQ ID NO: 3964176 - RNA, 15 nt, Human herpesvirus 3
cccccgguuucuggg

SEQ ID NO: 3964177 - RNA, 16 nt, Human herpesvirus 3
ccccuccuuuucucgu

SEQ ID NO: 3964178 - RNA, 19 nt, Human herpesvirus 3
cccgccgucgcgcccaccu

SEQ ID NO: 3964179 - RNA, 18 nt, Human herpesvirus 3
cccgcgcguuugcggggc

SEQ ID NO: 3964180 - RNA, 14 nt, Human herpesvirus 3
cccggcggaccccg

SEQ ID NO: 3964181 - RNA, 19 nt, Human herpesvirus 3
cccuggagacggcugcugc

SEQ ID NO: 3964182 - RNA, 23 nt, Human herpesvirus 3
cccuggagacggcugcugccgag

SEQ ID NO: 3964183 - RNA, 13 nt, Human herpesvirus 3
ccgcgcucaauca

SEQ ID NO: 3964184 - RNA, 14 nt, Human herpesvirus 3
ccgggauaucucau

SEQ ID NO: 3964185 - RNA, 14 nt, Human herpesvirus 3
ccgggaucguggcc

SEQ ID NO: 3964186 - RNA, 13 nt, Human herpesvirus 3
ccgguuuauauuc

SEQ ID NO: 3964187 - RNA, 13 nt, Human herpesvirus 3
ccgguuucugggc

SEQ ID NO: 3964188 - RNA, 16 nt, Human herpesvirus 3
ccgguuucugggcgcc

SEQ ID NO: 3964189 - RNA, 12 nt, Human herpesvirus 3
ccguucugugag

SEQ ID NO: 3964190 - RNA, 11 nt, Human herpesvirus 3
ccguugccgca

SEQ ID NO: 3964191 - RNA, 20 nt, Human herpesvirus 3
ccuaggaacgcgacaugacc

SEQ ID NO: 3964192 - RNA, 22 nt, Human herpesvirus 3
ccuccuuuucucgugagcgcca

SEQ ID NO: 3964193 - RNA, 18 nt, Human herpesvirus 3
ccuggccccuugaaccac

SEQ ID NO: 3964194 - RNA, 17 nt, Human herpesvirus 3
ccuggcuuaacagugcc

SEQ ID NO: 3964195 - RNA, 18 nt, Human herpesvirus 3
ccuuaaccgcgacagcca

SEQ ID NO: 3964196 - RNA, 15 nt, Human herpesvirus 3
ccuucaacacaccca

SEQ ID NO: 3964197 - RNA, 15 nt, Human herpesvirus 3
ccuucaaguuaaaua

SEQ ID NO: 3964198 - RNA, 18 nt, Human herpesvirus 3
ccuugggacaucaaccag

SEQ ID NO: 3964199 - RNA, 21 nt, Human herpesvirus 3
ccuuuacaagauauaauuugu

SEQ ID NO: 3964200 - RNA, 16 nt, Human herpesvirus 3
ccuuuucucgugagcg

SEQ ID NO: 3964201 - RNA, 21 nt, Human herpesvirus 3
cgagaagggggauuuacaaug

SEQ ID NO: 3964202 - RNA, 14 nt, Human herpesvirus 3
cgagcaugugcaac

SEQ ID NO: 3964203 - RNA, 22 nt, Human herpesvirus 3
cgauauuguauuguaguacagg

SEQ ID NO: 3964204 - RNA, 21 nt, Human herpesvirus 3
cgaucucugguauacuuggca

SEQ ID NO: 3964205 - RNA, 12 nt, Human herpesvirus 3
cgauggugauga

SEQ ID NO: 3964206 - RNA, 20 nt, Human herpesvirus 3
cgauuacagcugccgggaaa

SEQ ID NO: 3964207 - RNA, 12 nt, Human herpesvirus 3
cgcccaccucgg

SEQ ID NO: 3964208 - RNA, 16 nt, Human herpesvirus 3
cgcgcaauguuuugaa

SEQ ID NO: 3964209 - RNA, 16 nt, Human herpesvirus 3
cgcuacccgaaagccc

SEQ ID NO: 3964210 - RNA, 20 nt, Human herpesvirus 3
cgcuggguguggcuauuaga

SEQ ID NO: 3964211 - RNA, 15 nt, Human herpesvirus 3
cggcuuaacgagaga

SEQ ID NO: 3964212 - RNA, 21 nt, Human herpesvirus 3
cggcuuaacgagagauccaau

SEQ ID NO: 3964213 - RNA, 20 nt, Human herpesvirus 3
cgggcgggcgacgggcgggc

SEQ ID NO: 3964214 - RNA, 19 nt, Human herpesvirus 3
cgggucuuaucuauauaca

SEQ ID NO: 3964215 - RNA, 11 nt, Human herpesvirus 3
cggucauauaa

SEQ ID NO: 3964216 - RNA, 13 nt, Human herpesvirus 3
cguauuguguaau

SEQ ID NO: 3964217 - RNA, 21 nt, Human herpesvirus 3
cguccccuuauaucugccaua

SEQ ID NO: 3964218 - RNA, 18 nt, Human herpesvirus 3
cgugguaccaaaaacaca

SEQ ID NO: 3964219 - RNA, 17 nt, Human herpesvirus 3
cgugucacgacaaaaac

SEQ ID NO: 3964220 - RNA, 13 nt, Human herpesvirus 3
cguugaacaccau

SEQ ID NO: 3964221 - RNA, 20 nt, Human herpesvirus 3
cuauaaaaacauaacaccag

SEQ ID NO: 3964222 - RNA, 23 nt, Human herpesvirus 3
cuauuccgcccggauaauguccu

SEQ ID NO: 3964223 - RNA, 21 nt, Human herpesvirus 3
cuauuucaugcuuguaaaaca

SEQ ID NO: 3964224 - RNA, 18 nt, Human herpesvirus 3
cucaucaacguuaagagg

SEQ ID NO: 3964225 - RNA, 16 nt, Human herpesvirus 3
cuccagcaucaucugc

SEQ ID NO: 3964226 - RNA, 20 nt, Human herpesvirus 3
cucccacgguuugugcacug

SEQ ID NO: 3964227 - RNA, 17 nt, Human herpesvirus 3
cuccggcaucuccauca

SEQ ID NO: 3964228 - RNA, 19 nt, Human herpesvirus 3
cuccucgaccgcuggauga

SEQ ID NO: 3964229 - RNA, 17 nt, Human herpesvirus 3
cucgugagcgccacugg

SEQ ID NO: 3964230 - RNA, 22 nt, Human herpesvirus 3
cugauacauaaacacagagucu

SEQ ID NO: 3964231 - RNA, 17 nt, Human herpesvirus 3
cugaucgucaggucugu

SEQ ID NO: 3964232 - RNA, 19 nt, Human herpesvirus 3
cugauucggguaaaacaca

SEQ ID NO: 3964233 - RNA, 13 nt, Human herpesvirus 3
cugcaucuggaga

SEQ ID NO: 3964234 - RNA, 22 nt, Human herpesvirus 3
cugcguuauuuaaaggucugau

SEQ ID NO: 3964235 - RNA, 13 nt, Human herpesvirus 3
cuguacaccgcua

SEQ ID NO: 3964236 - RNA, 18 nt, Human herpesvirus 3
cugucauguuuaagaaca

SEQ ID NO: 3964237 - RNA, 16 nt, Human herpesvirus 3
cuguuuguuguuaaua

SEQ ID NO: 3964238 - RNA, 13 nt, Human herpesvirus 3
cuuacuugagauu

SEQ ID NO: 3964239 - RNA, 13 nt, Human herpesvirus 3
cuuauccaacaaa

SEQ ID NO: 3964240 - RNA, 21 nt, Human herpesvirus 3
cuuccaacaucuauuccggau

SEQ ID NO: 3964241 - RNA, 16 nt, Human herpesvirus 3
cuugaaucugucuuua

SEQ ID NO: 3964242 - RNA, 18 nt, Human herpesvirus 3
cuugagaugagcagcgca

SEQ ID NO: 3964243 - RNA, 23 nt, Human herpesvirus 3
cuuuaauaggcgcuacuuuauau

SEQ ID NO: 3964244 - RNA, 14 nt, Human herpesvirus 3
cuuugcguauauga

SEQ ID NO: 3964245 - RNA, 19 nt, Human herpesvirus 3
cuuuguuugcugcagacac

SEQ ID NO: 3964246 - RNA, 18 nt, Human herpesvirus 3
cuuuuaaagcaguaccgg

SEQ ID NO: 3964247 - RNA, 13 nt, Human herpesvirus 3
cuuuuaaagcauc

SEQ ID NO: 3964248 - RNA, 15 nt, Human herpesvirus 3
gaaaaaagugucugu

SEQ ID NO: 3964249 - RNA, 22 nt, Human herpesvirus 3
gaaaauaacccccccccgguuu

SEQ ID NO: 3964250 - RNA, 16 nt, Human herpesvirus 3
gaauaaacgacacaaa

SEQ ID NO: 3964251 - RNA, 19 nt, Human herpesvirus 3
gaauauucauaaaacugua

SEQ ID NO: 3964252 - RNA, 20 nt, Human herpesvirus 3
gaaucguugcggguacaaua

SEQ ID NO: 3964253 - RNA, 23 nt, Human herpesvirus 3
gaaucucuucauauguaauuuua

SEQ ID NO: 3964254 - RNA, 21 nt, Human herpesvirus 3
gaauguaauucgugugcaaua

SEQ ID NO: 3964255 - RNA, 18 nt, Human herpesvirus 3
gaauucuuagaaaagcca

SEQ ID NO: 3964256 - RNA, 20 nt, Human herpesvirus 3
gaauucuuagaaaagccagc

SEQ ID NO: 3964257 - RNA, 11 nt, Human herpesvirus 3
gaauuuugcuc

SEQ ID NO: 3964258 - RNA, 16 nt, Human herpesvirus 3
gacaaaccccacgcaa

SEQ ID NO: 3964259 - RNA, 18 nt, Human herpesvirus 3
gacauaccgacaguaaaa

SEQ ID NO: 3964260 - RNA, 16 nt, Human herpesvirus 3
gaccguaauaugucuc

SEQ ID NO: 3964261 - RNA, 18 nt, Human herpesvirus 3
gacguuauacaagguguu

SEQ ID NO: 3964262 - RNA, 20 nt, Human herpesvirus 3
gacuccccccgucacacaca

SEQ ID NO: 3964263 - RNA, 21 nt, Human herpesvirus 3
gacugcguuauuuaaaggucu

SEQ ID NO: 3964264 - RNA, 15 nt, Human herpesvirus 3
gagacggcugcugcc

SEQ ID NO: 3964265 - RNA, 19 nt, Human herpesvirus 3
gagugggguguuguggaua

SEQ ID NO: 3964266 - RNA, 15 nt, Human herpesvirus 3
ucaaaguauuuuccu

SEQ ID NO: 3964267 - RNA, 13 nt, Human herpesvirus 3
ucaugcaggcuuu

SEQ ID NO: 3964268 - RNA, 13 nt, Human herpesvirus 3
ucaugcuugucaa

SEQ ID NO: 3964269 - RNA, 21 nt, Human herpesvirus 3
ucaugcuugucaaaacauacu

SEQ ID NO: 3964270 - RNA, 13 nt, Human herpesvirus 3
ucaugugucucca

SEQ ID NO: 3964271 - RNA, 12 nt, Human herpesvirus 3
uccaauguuuga

SEQ ID NO: 3964272 - RNA, 13 nt, Human herpesvirus 3
uccagaguacagg

SEQ ID NO: 3964273 - RNA, 19 nt, Human herpesvirus 3
ucccccacauacaacauga

SEQ ID NO: 3964274 - RNA, 19 nt, Human herpesvirus 3
uccccuccuuuucucguga

SEQ ID NO: 3964275 - RNA, 20 nt, Human herpesvirus 3
uccccuccuuuucucgugag

SEQ ID NO: 3964276 - RNA, 22 nt, Human herpesvirus 3
uccgggaucguggccuugggac

SEQ ID NO: 3964277 - RNA, 15 nt, Human herpesvirus 3
ucguauaacagcuca

SEQ ID NO: 3964278 - RNA, 19 nt, Human herpesvirus 3
ucgucguucgaauccuaga

SEQ ID NO: 3964279 - RNA, 13 nt, Human herpesvirus 3
ucguguaaaguuu

SEQ ID NO: 3964280 - RNA, 19 nt, Human herpesvirus 3
ucguucgaauccuagaagc

SEQ ID NO: 3964281 - RNA, 13 nt, Human herpesvirus 3
ucguuuaucccac

SEQ ID NO: 3964282 - RNA, 17 nt, Human herpesvirus 3
ucguuuugguguuacau

SEQ ID NO: 3964283 - RNA, 17 nt, Human herpesvirus 3
ucuaaaacacugucaga

SEQ ID NO: 3964284 - RNA, 18 nt, Human herpesvirus 3
ucuauagcaaaauucaga

SEQ ID NO: 3964285 - RNA, 21 nt, Human herpesvirus 3
ucugccguggaccccuguauu

SEQ ID NO: 3964286 - RNA, 13 nt, Human herpesvirus 3
ucuuuuuguagau

SEQ ID NO: 3964287 - RNA, 18 nt, Human herpesvirus 3
ugaaccggaaccuacaac

SEQ ID NO: 3964288 - RNA, 13 nt, Human herpesvirus 3
ugacuuugaagac

SEQ ID NO: 3964289 - RNA, 13 nt, Human herpesvirus 3
ugagcgccacugg

SEQ ID NO: 3964290 - RNA, 22 nt, Human herpesvirus 3
ugaguugggagguuccucggga

SEQ ID NO: 3964291 - RNA, 15 nt, Human herpesvirus 3
ugauaugaggggaag

SEQ ID NO: 3964292 - RNA, 15 nt, Human herpesvirus 3
ugaugguaguuacca

SEQ ID NO: 3964293 - RNA, 13 nt, Human herpesvirus 3
ugcagguuuuacu

SEQ ID NO: 3964294 - RNA, 22 nt, Human herpesvirus 3
ugcauaaccuguccauuugcau

SEQ ID NO: 3964295 - RNA, 19 nt, Human herpesvirus 3
ugcauaacguugcggugau

SEQ ID NO: 3964296 - RNA, 17 nt, Human herpesvirus 3
ugcaucguagguauaaa

SEQ ID NO: 3964297 - RNA, 18 nt, Human herpesvirus 3
ugcauuacccuaucccag

SEQ ID NO: 3964298 - RNA, 19 nt, Human herpesvirus 3
ugcgauaacugcgauaaga

SEQ ID NO: 3964299 - RNA, 13 nt, Human herpesvirus 3
uggacggcucccg

SEQ ID NO: 3964300 - RNA, 15 nt, Human herpesvirus 3
uggauucccuggaga

SEQ ID NO: 3964301 - RNA, 19 nt, Human herpesvirus 3
uggcgcgcggacuguuugu

SEQ ID NO: 3964302 - RNA, 21 nt, Human herpesvirus 3
ugguaagguuuuauuuaaguu

SEQ ID NO: 3964303 - RNA, 21 nt, Human herpesvirus 3
uguaaaguuauuucuccggga

SEQ ID NO: 3964304 - RNA, 22 nt, Human herpesvirus 3
uguaagacccgucgguaaauga

SEQ ID NO: 3964305 - RNA, 18 nt, Human herpesvirus 3
uguaauucgugugcaaua

SEQ ID NO: 3964306 - RNA, 19 nt, Human herpesvirus 3
ugucuacuauuugugaaga

SEQ ID NO: 3964307 - RNA, 15 nt, Human herpesvirus 3
ugugcgggcgggcga

SEQ ID NO: 3964308 - RNA, 18 nt, Human herpesvirus 3
uguguuuuuaucugcaau

SEQ ID NO: 3964309 - RNA, 14 nt, Human herpesvirus 3
uguuauacuacuua

SEQ ID NO: 3964310 - RNA, 19 nt, Human herpesvirus 3
uguucaauaauuggacugc

SEQ ID NO: 3964311 - RNA, 17 nt, Human herpesvirus 3
uguugagucauuuucau

SEQ ID NO: 3964312 - RNA, 12 nt, Human herpesvirus 3
uuaaaacauaca

SEQ ID NO: 3964313 - RNA, 17 nt, Human herpesvirus 3
uuaacacgauuaacguu

SEQ ID NO: 3964314 - RNA, 22 nt, Human herpesvirus 3
uuaauaaaaacacaaccagucu

SEQ ID NO: 3964315 - RNA, 22 nt, Human herpesvirus 3
uuaaucccgccuuuaucucccu

SEQ ID NO: 3964316 - RNA, 15 nt, Human herpesvirus 3
uuaaugcaaccauca

SEQ ID NO: 3964317 - RNA, 12 nt, Human herpesvirus 3
uuaccguacaac

SEQ ID NO: 3964318 - RNA, 14 nt, Human herpesvirus 3
uuagcauccaaauu

SEQ ID NO: 3964319 - RNA, 21 nt, Human herpesvirus 3
uuauauacguagaauuuacag

SEQ ID NO: 3964320 - RNA, 22 nt, Human herpesvirus 3
uuauccaacuguuuacauagau

SEQ ID NO: 3964321 - RNA, 14 nt, Human herpesvirus 3
uuauuuuaauguau

SEQ ID NO: 3964322 - RNA, 18 nt, Human herpesvirus 3
uucaaaauaucuuacaga

SEQ ID NO: 3964323 - RNA, 18 nt, Human herpesvirus 3
uucaaaggacgaagggga

SEQ ID NO: 3964324 - RNA, 18 nt, Human herpesvirus 3
uuccacaagguacgaaaa

SEQ ID NO: 3964325 - RNA, 16 nt, Human herpesvirus 3
uucuacgagaauauuc

SEQ ID NO: 3964326 - RNA, 19 nt, Human herpesvirus 3
uucucgugagcgccacugg

SEQ ID NO: 3964327 - RNA, 16 nt, Human herpesvirus 3
uucugggcgcccggcg

SEQ ID NO: 3964328 - RNA, 18 nt, Human herpesvirus 3
uugagaaaaccaaagacg

SEQ ID NO: 3964329 - RNA, 22 nt, Human herpesvirus 3
uugauuuuuuuaaacaaauacg

SEQ ID NO: 3964330 - RNA, 17 nt, Human herpesvirus 3
uugccaugacuuccaca

SEQ ID NO: 3964331 - RNA, 23 nt, Human herpesvirus 3
uugggagggggaaggaaaugccu

SEQ ID NO: 3964332 - RNA, 16 nt, Human herpesvirus 3
uuguaaaacauaucaa

SEQ ID NO: 3964333 - RNA, 22 nt, Human herpesvirus 3
uugucuaccacuaagaacuuua

SEQ ID NO: 3964334 - RNA, 13 nt, Human herpesvirus 3
uuuaaaaauaccu

SEQ ID NO: 3964335 - RNA, 18 nt, Human herpesvirus 3
uuuaacggaagaugaacu

SEQ ID NO: 3964336 - RNA, 15 nt, Human herpesvirus 3
uuuaagguauggagu

SEQ ID NO: 3964337 - RNA, 17 nt, Human herpesvirus 3
uuuaauccaauguuuga

SEQ ID NO: 3964338 - RNA, 12 nt, Human herpesvirus 3
uuuacaguaaac

SEQ ID NO: 3964339 - RNA, 16 nt, Human herpesvirus 3
uuuaucccccuucaaa

SEQ ID NO: 3964340 - RNA, 14 nt, Human herpesvirus 3
uuuaucugaaaaga

SEQ ID NO: 3964341 - RNA, 23 nt, Human herpesvirus 3
uuuauuacauucgcaacacaucu

SEQ ID NO: 3964342 - RNA, 22 nt, Human herpesvirus 3
uuucucgugagcgccacuggcg

SEQ ID NO: 3964343 - RNA, 21 nt, Human herpesvirus 3
uuuuacgucauuucucccguu

SEQ ID NO: 3964344 - RNA, 13 nt, Human herpesvirus 3
aauccaauguuug

SEQ ID NO: 3964345 - RNA, 15 nt, Human herpesvirus 3
aaucgucuaacauua

SEQ ID NO: 3964346 - RNA, 17 nt, Human herpesvirus 3
aauucuuagaaaagcca

SEQ ID NO: 3964347 - RNA, 20 nt, Human herpesvirus 3
aauugggggauuugggagaa

SEQ ID NO: 3964348 - RNA, 20 nt, Human herpesvirus 3
aauuguucugggaacacgua

SEQ ID NO: 3964349 - RNA, 13 nt, Human herpesvirus 3
acaagaaaccaug

SEQ ID NO: 3964350 - RNA, 19 nt, Human herpesvirus 3
acacgcgggugaguguacg

SEQ ID NO: 3964351 - RNA, 21 nt, Human herpesvirus 3
acacucgauuucaacggcuuc

SEQ ID NO: 3964352 - RNA, 22 nt, Human herpesvirus 3
acaugcauggaaucaccagaac

SEQ ID NO: 3964353 - RNA, 18 nt, Human herpesvirus 3
acaugccuggcuuaacag

SEQ ID NO: 3964354 - RNA, 12 nt, Human herpesvirus 3
acccaaggugua

SEQ ID NO: 3964355 - RNA, 23 nt, Human herpesvirus 3
acccaagguguaaauacugcccc

SEQ ID NO: 3964356 - RNA, 18 nt, Human herpesvirus 3
accgguaccaugggagac

SEQ ID NO: 3964357 - RNA, 18 nt, Human herpesvirus 3
accugcgguauucuguaa

SEQ ID NO: 3964358 - RNA, 12 nt, Human herpesvirus 3
acggcugcugcc

SEQ ID NO: 3964359 - RNA, 23 nt, Human herpesvirus 3
acguacaaucgaaaaaaggugua

SEQ ID NO: 3964360 - RNA, 20 nt, Human herpesvirus 3
acguauuuuuauuuaaaugu

SEQ ID NO: 3964361 - RNA, 22 nt, Human herpesvirus 3
acuagcuaccguuagaggcuua

SEQ ID NO: 3964362 - RNA, 22 nt, Human herpesvirus 3
acucacguuuguguugugacuu

SEQ ID NO: 3964363 - RNA, 14 nt, Human herpesvirus 3
acucugcgaugcau

SEQ ID NO: 3964364 - RNA, 23 nt, Human herpesvirus 3
acugaauuauauaccucggccgc

SEQ ID NO: 3964365 - RNA, 16 nt, Human herpesvirus 3
acuguauguaaauuau

SEQ ID NO: 3964366 - RNA, 18 nt, Human herpesvirus 3
acuguuuguuguuaauaa

SEQ ID NO: 3964367 - RNA, 17 nt, Human herpesvirus 3
acuguuuuuuauuuaaa

SEQ ID NO: 3964368 - RNA, 11 nt, Human herpesvirus 3
acuuauccauu

SEQ ID NO: 3964369 - RNA, 18 nt, Human herpesvirus 3
acuugacgcgaacaccgc

SEQ ID NO: 3964370 - RNA, 22 nt, Human herpesvirus 3
agacacgcuacagaagacauca

SEQ ID NO: 3964371 - RNA, 20 nt, Human herpesvirus 3
agacaucaccgaacauggac

SEQ ID NO: 3964372 - RNA, 20 nt, Human herpesvirus 3
agacgaucucccguuuuuau

SEQ ID NO: 3964373 - RNA, 23 nt, Human herpesvirus 3
agacuuuaugaauuugcuaccag

SEQ ID NO: 3964374 - RNA, 14 nt, Human herpesvirus 3
agaucuaacguuuu

SEQ ID NO: 3964375 - RNA, 12 nt, Human herpesvirus 3
agaugacuuuga

SEQ ID NO: 3964376 - RNA, 16 nt, Human herpesvirus 3
agcaaaauucagaaac

SEQ ID NO: 3964377 - RNA, 21 nt, Human herpesvirus 3
agcaauaaaauggauauaauu

SEQ ID NO: 3964378 - RNA, 16 nt, Human herpesvirus 3
agcaucucuggacccc

SEQ ID NO: 3964379 - RNA, 23 nt, Human herpesvirus 3
agcgccacuggcgcgcggacugu

SEQ ID NO: 3964380 - RNA, 23 nt, Human herpesvirus 3
agcugaaaaucgucccauuuaaa

SEQ ID NO: 3964381 - RNA, 13 nt, Human herpesvirus 3
aggacgaagggga

SEQ ID NO: 3964382 - RNA, 15 nt, Human herpesvirus 3
aggcaacugcaaaca

SEQ ID NO: 3964383 - RNA, 15 nt, Human herpesvirus 3
aggcgaaaagguuuc

SEQ ID NO: 3964384 - RNA, 14 nt, Human herpesvirus 3
aggcuuuaucugaa

SEQ ID NO: 3964385 - RNA, 16 nt, Human herpesvirus 3
agggacccgcagccca

SEQ ID NO: 3964386 - RNA, 17 nt, Human herpesvirus 3
agggacccgcagcccag

SEQ ID NO: 3964387 - RNA, 23 nt, Human herpesvirus 3
agguauaugucaacauuuacagu

SEQ ID NO: 3964388 - RNA, 13 nt, Human herpesvirus 3
aggucuacagcac

SEQ ID NO: 3964389 - RNA, 19 nt, Human herpesvirus 3
aguaccacgugguauuaug

SEQ ID NO: 3964390 - RNA, 15 nt, Human herpesvirus 3
aguacuaaaaauccu

SEQ ID NO: 3964391 - RNA, 21 nt, Human herpesvirus 3
agucaauguuuaaagacagcc

SEQ ID NO: 3964392 - RNA, 15 nt, Human herpesvirus 3
agucugaccauuuac

SEQ ID NO: 3964393 - RNA, 18 nt, Human herpesvirus 3
aguguucuaaaacacugu

SEQ ID NO: 3964394 - RNA, 16 nt, Human herpesvirus 3
aguuaaaucguuuaac

SEQ ID NO: 3964395 - RNA, 13 nt, Human herpesvirus 3
aguuaauaaaccu

SEQ ID NO: 3964396 - RNA, 15 nt, Human herpesvirus 3
aguuuaggguuuaaa

SEQ ID NO: 3964397 - RNA, 14 nt, Human herpesvirus 3
auaaaccaacuccu

SEQ ID NO: 3964398 - RNA, 18 nt, Human herpesvirus 3
auacauaaccgauuuacc

SEQ ID NO: 3964399 - RNA, 20 nt, Human herpesvirus 3
auagaaucggagacucgugg

SEQ ID NO: 3964400 - RNA, 16 nt, Human herpesvirus 3
auauaaaauuaaaaca

SEQ ID NO: 3964401 - RNA, 24 nt, Human herpesvirus 3
auaucuuacagauucuucaccaag

SEQ ID NO: 3964402 - RNA, 17 nt, Human herpesvirus 3
auaugucaacauuuaca

SEQ ID NO: 3964403 - RNA, 18 nt, Human herpesvirus 3
auauguucagcagcuuaa

SEQ ID NO: 3964404 - RNA, 14 nt, Human herpesvirus 3
auauuaacacgauu

SEQ ID NO: 3964405 - RNA, 17 nt, Human herpesvirus 3
auauuaauaaaagacua

SEQ ID NO: 3964406 - RNA, 15 nt, Human herpesvirus 3
auauuacuuaaaacg

SEQ ID NO: 3964407 - RNA, 16 nt, Human herpesvirus 3
auauucacaacaguug

SEQ ID NO: 3964408 - RNA, 19 nt, Human herpesvirus 3
aucauuaaacgugcauuuu

SEQ ID NO: 3964409 - RNA, 22 nt, Human herpesvirus 3
aucgcugaugccagaagcauuu

SEQ ID NO: 3964410 - RNA, 15 nt, Human herpesvirus 3
aucucggagcgggcc

SEQ ID NO: 3964411 - RNA, 15 nt, Human herpesvirus 3
augaaaaccugggug

SEQ ID NO: 3964412 - RNA, 12 nt, Human herpesvirus 3
augacuuccaca

SEQ ID NO: 3964413 - RNA, 12 nt, Human herpesvirus 3
augauauacaca

SEQ ID NO: 3964414 - RNA, 14 nt, Human herpesvirus 3
augccacauuuacc

SEQ ID NO: 3964415 - RNA, 17 nt, Human herpesvirus 3
augcgcguuccaaauua

SEQ ID NO: 3964416 - RNA, 20 nt, Human herpesvirus 3
augcuugucaaaacauacua

SEQ ID NO: 3964417 - RNA, 23 nt, Human herpesvirus 3
auggcaucuuccgacggugacag

SEQ ID NO: 3964418 - RNA, 16 nt, Human herpesvirus 3
auggccgucuugaauc

SEQ ID NO: 3964419 - RNA, 14 nt, Human herpesvirus 3
auggcuacaaggaa

SEQ ID NO: 3964420 - RNA, 17 nt, Human herpesvirus 3
augggugguaagguuuu

SEQ ID NO: 3964421 - RNA, 18 nt, Human herpesvirus 3
auguaaaauaaacugaau

SEQ ID NO: 3964422 - RNA, 16 nt, Human herpesvirus 3
auuacauuuaauguuu

SEQ ID NO: 3964423 - RNA, 21 nt, Human herpesvirus 3
auuaccaacuguauguaaauu

SEQ ID NO: 3964424 - RNA, 17 nt, Human herpesvirus 3
auuagugucacuauaaa

SEQ ID NO: 3964425 - RNA, 12 nt, Human herpesvirus 3
auuauacauaac

SEQ ID NO: 3964426 - RNA, 16 nt, Human herpesvirus 3
auuaugaacaguuuau

SEQ ID NO: 3964427 - RNA, 20 nt, Human herpesvirus 3
auucaagacuaacauuuauc

SEQ ID NO: 3964428 - RNA, 16 nt, Human herpesvirus 3
auucucaucaaaguca

SEQ ID NO: 3964429 - RNA, 20 nt, Human herpesvirus 3
auuguaaauuuuaauuacga

SEQ ID NO: 3964430 - RNA, 18 nt, Human herpesvirus 3
auugucccguaaacuaau

SEQ ID NO: 3964431 - RNA, 22 nt, Human herpesvirus 3
auuguggauccggcaugcauug

SEQ ID NO: 3964432 - RNA, 14 nt, Human herpesvirus 3
auuuaggaggcugc

SEQ ID NO: 3964433 - RNA, 20 nt, Human herpesvirus 3
auuuauucucgcuugcagcu

SEQ ID NO: 3964434 - RNA, 16 nt, Human herpesvirus 3
auuuuacgucauuucu

SEQ ID NO: 3964435 - RNA, 14 nt, Human herpesvirus 3
auuuuauauacaaa

SEQ ID NO: 3964436 - RNA, 22 nt, Human herpesvirus 3
auuuuugauuuuuuuaaacaaa

SEQ ID NO: 3964437 - RNA, 22 nt, Human herpesvirus 3
caaacacacagacgcguaaaau

SEQ ID NO: 3964438 - RNA, 13 nt, Human herpesvirus 3
caaacagcaccaa

SEQ ID NO: 3964439 - RNA, 17 nt, Human herpesvirus 3
caaaccguuuguuuuga

SEQ ID NO: 3964440 - RNA, 22 nt, Human herpesvirus 3
caaccaauugguauacacaccc

SEQ ID NO: 3964441 - RNA, 19 nt, Human herpesvirus 3
caacgcuuugaucuucaag

SEQ ID NO: 3964442 - RNA, 15 nt, Human herpesvirus 3
caacgucccaaagcg

SEQ ID NO: 3964443 - RNA, 16 nt, Human herpesvirus 3
caacucuuuucccaaa

SEQ ID NO: 3964444 - RNA, 15 nt, Human herpesvirus 3
caagaaaccauguuu

SEQ ID NO: 3964445 - RNA, 13 nt, Human herpesvirus 3
caaugaaacagua

SEQ ID NO: 3964446 - RNA, 12 nt, Human herpesvirus 3
caauuaaagccc

SEQ ID NO: 3964447 - RNA, 15 nt, Human herpesvirus 3
caauugucuguauau

SEQ ID NO: 3964448 - RNA, 13 nt, Human herpesvirus 3
cacagaacggucu

SEQ ID NO: 3964449 - RNA, 13 nt, Human herpesvirus 3
caccucggccgcu

SEQ ID NO: 3964450 - RNA, 18 nt, Human herpesvirus 3
cagacaagcuuauuuuua

SEQ ID NO: 3964451 - RNA, 23 nt, Human herpesvirus 3
cagacaguggcggauaacugccu

SEQ ID NO: 3964452 - RNA, 23 nt, Human herpesvirus 3
cagacuccccccgucacacacac

SEQ ID NO: 3964453 - RNA, 16 nt, Human herpesvirus 3
cagagacucugcgaug

SEQ ID NO: 3964454 - RNA, 20 nt, Human herpesvirus 3
cagauguacacccagcuguc

SEQ ID NO: 3964455 - RNA, 12 nt, Human herpesvirus 3
cagccgcucgcu

SEQ ID NO: 3964456 - RNA, 18 nt, Human herpesvirus 3
caggcgcguuuguuuguc

SEQ ID NO: 3964457 - RNA, 14 nt, Human herpesvirus 3
cagguuauccaacu

SEQ ID NO: 3964458 - RNA, 13 nt, Human herpesvirus 3
cauaacaccgcua

SEQ ID NO: 3964459 - RNA, 13 nt, Human herpesvirus 3
gauaauguccuag

SEQ ID NO: 3964460 - RNA, 20 nt, Human herpesvirus 3
gauacacauaugcacgcauc

SEQ ID NO: 3964461 - RNA, 21 nt, Human herpesvirus 3
gaucccgccgucgcgcccacc

SEQ ID NO: 3964462 - RNA, 21 nt, Human herpesvirus 3
gaucgucguuuaaagccccuc

SEQ ID NO: 3964463 - RNA, 16 nt, Human herpesvirus 3
gaugaaauaguuucau

SEQ ID NO: 3964464 - RNA, 16 nt, Human herpesvirus 3
gaugauucagacgacu

SEQ ID NO: 3964465 - RNA, 23 nt, Human herpesvirus 3
gauggcaccacagucucuguuug

SEQ ID NO: 3964466 - RNA, 22 nt, Human herpesvirus 3
gauuauauacguagaauuuaca

SEQ ID NO: 3964467 - RNA, 20 nt, Human herpesvirus 3
gauucaaguaaauaugugca

SEQ ID NO: 3964468 - RNA, 21 nt, Human herpesvirus 3
gauuuucacaccgaugaagac

SEQ ID NO: 3964469 - RNA, 23 nt, Human herpesvirus 3
gcaacuacuuacaacccccgcgg

SEQ ID NO: 3964470 - RNA, 20 nt, Human herpesvirus 3
gcauuaccgcaaaucuuggc

SEQ ID NO: 3964471 - RNA, 16 nt, Human herpesvirus 3
gcccacacaaucagaa

SEQ ID NO: 3964472 - RNA, 19 nt, Human herpesvirus 3
gcccacacgcgggugagug

SEQ ID NO: 3964473 - RNA, 19 nt, Human herpesvirus 3
gccgcucgcugagcuccag

SEQ ID NO: 3964474 - RNA, 14 nt, Human herpesvirus 3
gccgcuucccgaaa

SEQ ID NO: 3964475 - RNA, 21 nt, Human herpesvirus 3
gccgucgcgcccaccucggcc

SEQ ID NO: 3964476 - RNA, 18 nt, Human herpesvirus 3
gccgugcggucucccgga

SEQ ID NO: 3964477 - RNA, 13 nt, Human herpesvirus 3
gccugcaagcggu

SEQ ID NO: 3964478 - RNA, 19 nt, Human herpesvirus 3
gccuucggacggaugugcg

SEQ ID NO: 3964479 - RNA, 21 nt, Human herpesvirus 3
gccuucuguuuguuuaacacg

SEQ ID NO: 3964480 - RNA, 18 nt, Human herpesvirus 3
gcgaacgugauuugccca

SEQ ID NO: 3964481 - RNA, 20 nt, Human herpesvirus 3
gcgacgguauauuacaaaga

SEQ ID NO: 3964482 - RNA, 15 nt, Human herpesvirus 3
gcgcccaccucggcc

SEQ ID NO: 3964483 - RNA, 23 nt, Human herpesvirus 3
gcgcguuuguuugucucgguuau

SEQ ID NO: 3964484 - RNA, 19 nt, Human herpesvirus 3
gcggaacgguuuuuaugaa

SEQ ID NO: 3964485 - RNA, 13 nt, Human herpesvirus 3
gcgugguuauuac

SEQ ID NO: 3964486 - RNA, 16 nt, Human herpesvirus 3
gcguguuaaacacugu

SEQ ID NO: 3964487 - RNA, 12 nt, Human herpesvirus 3
gcucaauacuug

SEQ ID NO: 3964488 - RNA, 12 nt, Human herpesvirus 3
gcucacagagcu

SEQ ID NO: 3964489 - RNA, 13 nt, Human herpesvirus 3
gcuccguguaugu

SEQ ID NO: 3964490 - RNA, 12 nt, Human herpesvirus 3
gcucucaugaac

SEQ ID NO: 3964491 - RNA, 12 nt, Human herpesvirus 3
gcugagcuccag

SEQ ID NO: 3964492 - RNA, 16 nt, Human herpesvirus 3
gcuguauugagaaaac

SEQ ID NO: 3964493 - RNA, 15 nt, Human herpesvirus 3
gcuucccgaaagccc

SEQ ID NO: 3964494 - RNA, 23 nt, Human herpesvirus 3
ggaccggcgucaggucugucaug

SEQ ID NO: 3964495 - RNA, 19 nt, Human herpesvirus 3
ggacuguuuguuguuaaua

SEQ ID NO: 3964496 - RNA, 19 nt, Human herpesvirus 3
ggcaccguagaaccgacug

SEQ ID NO: 3964497 - RNA, 19 nt, Human herpesvirus 3
ggccgcuacccgaaagccc

SEQ ID NO: 3964498 - RNA, 19 nt, Human herpesvirus 3
ggccgcuucccgaaagccc

SEQ ID NO: 3964499 - RNA, 15 nt, Human herpesvirus 3
ggcgaggacuccaca

SEQ ID NO: 3964500 - RNA, 13 nt, Human herpesvirus 3
ggcgauggccguc

SEQ ID NO: 3964501 - RNA, 22 nt, Human herpesvirus 3
ggcgcccggcggaccccgggag

SEQ ID NO: 3964502 - RNA, 18 nt, Human herpesvirus 3
ggcggaagauacaggcaa

SEQ ID NO: 3964503 - RNA, 13 nt, Human herpesvirus 3
ggcggaccccggg

SEQ ID NO: 3964504 - RNA, 22 nt, Human herpesvirus 3
ggcgggcuggucggaccccccc

SEQ ID NO: 3964505 - RNA, 14 nt, Human herpesvirus 3
ggcuucaccagagu

SEQ ID NO: 3964506 - RNA, 13 nt, Human herpesvirus 3
ggggguacaguug

SEQ ID NO: 3964507 - RNA, 19 nt, Human herpesvirus 3
ggguaaaacacacaccaga

SEQ ID NO: 3964508 - RNA, 19 nt, Human herpesvirus 3
ggucauuuccacaaccagg

SEQ ID NO: 3964509 - RNA, 14 nt, Human herpesvirus 3
ggucgccuguaaua

SEQ ID NO: 3964510 - RNA, 19 nt, Human herpesvirus 3
ggucucuccaagcucguuu

SEQ ID NO: 3964511 - RNA, 16 nt, Human herpesvirus 3
ggugacguuccggggu

SEQ ID NO: 3964512 - RNA, 23 nt, Human herpesvirus 3
ggugagcacccgggcggugaaua

SEQ ID NO: 3964513 - RNA, 17 nt, Human herpesvirus 3
gguguucuauuucccaa

SEQ ID NO: 3964514 - RNA, 13 nt, Human herpesvirus 3
gguucggugauca

SEQ ID NO: 3964515 - RNA, 19 nt, Human herpesvirus 3
gguugcguuucccagagac

SEQ ID NO: 3964516 - RNA, 21 nt, Human herpesvirus 3
guacaauacguaaaugucacu

SEQ ID NO: 3964517 - RNA, 12 nt, Human herpesvirus 3
guagagcccaca

SEQ ID NO: 3964518 - RNA, 13 nt, Human herpesvirus 3
gucccaggucggc

SEQ ID NO: 3964519 - RNA, 13 nt, Human herpesvirus 3
gucgcgcccaccu

SEQ ID NO: 3964520 - RNA, 13 nt, Human herpesvirus 3
gugaaagagcugu

SEQ ID NO: 3964521 - RNA, 14 nt, Human herpesvirus 3
gugacagacuuugu

SEQ ID NO: 3964522 - RNA, 23 nt, Human herpesvirus 3
gugagcgccacuggcgcgcggac

SEQ ID NO: 3964523 - RNA, 19 nt, Human herpesvirus 3
gugcauaacguugcgguga

SEQ ID NO: 3964524 - RNA, 16 nt, Human herpesvirus 3
guguggauuauaucca

SEQ ID NO: 3964525 - RNA, 15 nt, Human herpesvirus 3
guguucauaacaccg

SEQ ID NO: 3964526 - RNA, 16 nt, Human herpesvirus 3
guguucuaaaacacug

SEQ ID NO: 3964527 - RNA, 12 nt, Human herpesvirus 3
guuagacagaga

SEQ ID NO: 3964528 - RNA, 15 nt, Human herpesvirus 3
guuauacuacuuauu

SEQ ID NO: 3964529 - RNA, 17 nt, Human herpesvirus 3
guuauuguauauacaac

SEQ ID NO: 3964530 - RNA, 14 nt, Human herpesvirus 3
guuccguuuggaaa

SEQ ID NO: 3964531 - RNA, 18 nt, Human herpesvirus 3
guuuaucccccuucaaac

SEQ ID NO: 3964532 - RNA, 17 nt, Human herpesvirus 3
guuuccgaauaaaugug

SEQ ID NO: 3964533 - RNA, 18 nt, Human herpesvirus 3
guuucugggcgcccggcg

SEQ ID NO: 3964534 - RNA, 17 nt, Human herpesvirus 3
guuuuacgucugcccac

SEQ ID NO: 3964535 - RNA, 23 nt, Human herpesvirus 3
uaaaaaauaccuuuuucaugcuu

SEQ ID NO: 3964536 - RNA, 21 nt, Human herpesvirus 3
uaaacguauucuauuaacaau

SEQ ID NO: 3964537 - RNA, 15 nt, Human herpesvirus 3
uaaagguuaaauuua

SEQ ID NO: 3964538 - RNA, 19 nt, Human herpesvirus 3
uaaauccguaucucggagc

SEQ ID NO: 3964539 - RNA, 15 nt, Human herpesvirus 3
uaacagugccagugc

SEQ ID NO: 3964540 - RNA, 16 nt, Human herpesvirus 3
uaagccucuguacaac

SEQ ID NO: 3964541 - RNA, 15 nt, Human herpesvirus 3
uaaggggggggcgcg

SEQ ID NO: 3964542 - RNA, 17 nt, Human herpesvirus 3
uaauaaaaagucacuau

SEQ ID NO: 3964543 - RNA, 18 nt, Human herpesvirus 3
uaaugcaacccugucauc

SEQ ID NO: 3964544 - RNA, 14 nt, Human herpesvirus 3
uacaaguacaaccc

SEQ ID NO: 3964545 - RNA, 19 nt, Human herpesvirus 3
uacaaucgucuuuuaaauu

SEQ ID NO: 3964546 - RNA, 11 nt, Human herpesvirus 3
uacacaacacc

SEQ ID NO: 3964547 - RNA, 13 nt, Human herpesvirus 3
uacauaaauacua

SEQ ID NO: 3964548 - RNA, 21 nt, Human herpesvirus 3
uacaucggcauuaacaacgcg

SEQ ID NO: 3964549 - RNA, 18 nt, Human herpesvirus 3
uaccauauauggacaucc

SEQ ID NO: 3964550 - RNA, 15 nt, Human herpesvirus 3
uaccucugucagguu

SEQ ID NO: 3964551 - RNA, 14 nt, Human herpesvirus 3
uacgaccaaacauu

SEQ ID NO: 3964552 - RNA, 22 nt, Human herpesvirus 3
uacgacuuuuaaacgccagugg

SEQ ID NO: 3964553 - RNA, 14 nt, Human herpesvirus 3
uacuacauugaaca

SEQ ID NO: 3964554 - RNA, 20 nt, Human herpesvirus 3
uagaaacgcgccaaacauug

SEQ ID NO: 3964555 - RNA, 19 nt, Human herpesvirus 3
uagacuguucuacugacuu

SEQ ID NO: 3964556 - RNA, 16 nt, Human herpesvirus 3
uagauuuaaaaccaau

SEQ ID NO: 3964557 - RNA, 16 nt, Human herpesvirus 3
uaggggaugggggucg

SEQ ID NO: 3964558 - RNA, 17 nt, Human herpesvirus 3
uagguucggcaaaucua

SEQ ID NO: 3964559 - RNA, 20 nt, Human herpesvirus 3
uaguccuuacccauaugacc

SEQ ID NO: 3964560 - RNA, 22 nt, Human herpesvirus 3
uauaaaccgauuaugucaacau

SEQ ID NO: 3964561 - RNA, 20 nt, Human herpesvirus 3
uauaaacggccgaaaacgga

SEQ ID NO: 3964562 - RNA, 13 nt, Human herpesvirus 3
uauaacugcuaca

SEQ ID NO: 3964563 - RNA, 18 nt, Human herpesvirus 3
uauaagggagucuacaau

SEQ ID NO: 3964564 - RNA, 17 nt, Human herpesvirus 3
uauaccuuaacucaacc

SEQ ID NO: 3964565 - RNA, 14 nt, Human herpesvirus 3
uauagucaaauuca

SEQ ID NO: 3964566 - RNA, 14 nt, Human herpesvirus 3
uauaugucaacauu

SEQ ID NO: 3964567 - RNA, 16 nt, Human herpesvirus 3
uaucaaguggucguuu

SEQ ID NO: 3964568 - RNA, 14 nt, Human herpesvirus 3
uaucaauuguuuau

SEQ ID NO: 3964569 - RNA, 20 nt, Human herpesvirus 3
uaucaguugaaccaaaucca

SEQ ID NO: 3964570 - RNA, 17 nt, Human herpesvirus 3
uauuacauucauaaaag

SEQ ID NO: 3964571 - RNA, 23 nt, Human herpesvirus 3
uauuauacauaaccgauuuaccg

SEQ ID NO: 3964572 - RNA, 14 nt, Human herpesvirus 3
uauuuuugucuacc

SEQ ID NO: 3964573 - RNA, 22 nt, Human herpesvirus 3
ucaaaacauacuaauuuguauu

SEQ ID NO: 3964574 - RNA, 23 nt, Human herpesvirus 3
aagguuaaauuuauaaaacacuc

SEQ ID NO: 3964575 - RNA, 19 nt, Human herpesvirus 3
aaguaugcagucgggucau

SEQ ID NO: 3964576 - RNA, 22 nt, Human herpesvirus 3
aagucgcaacgcugcugacaaa

SEQ ID NO: 3964577 - RNA, 19 nt, Human herpesvirus 3
aagucucaaugaaacagua

SEQ ID NO: 3964578 - RNA, 18 nt, Human herpesvirus 3
aaguguucuaaaacacug

SEQ ID NO: 3964579 - RNA, 23 nt, Human herpesvirus 3
aaguuuauacguacaucuuucag

SEQ ID NO: 3964580 - RNA, 13 nt, Human herpesvirus 3
aauaaaaaacagu

SEQ ID NO: 3964581 - RNA, 20 nt, Human herpesvirus 3
aauaaaacguuuuaaaagcc

SEQ ID NO: 3964582 - RNA, 14 nt, Human herpesvirus 3
aauaaccccccccc

SEQ ID NO: 3964583 - RNA, 18 nt, Human herpesvirus 3
aauacuaagccucuguac

SEQ ID NO: 3964584 - RNA, 19 nt, Human herpesvirus 3
aauaugcuauauaacgccu

SEQ ID NO: 3964585 - RNA, 18 nt, Human herpesvirus 3
aauauuuuguuaauacag

SEQ ID NO: 3964586 - RNA, 20 nt, Human herpesvirus 3
aaucggagacucguggucag

SEQ ID NO: 3964587 - RNA, 16 nt, Human herpesvirus 3
aaugguucauuguuuu

SEQ ID NO: 3964588 - RNA, 16 nt, Human herpesvirus 3
aauucgugugcaauaa

SEQ ID NO: 3964589 - RNA, 15 nt, Human herpesvirus 3
aauugcgcgaguucc

SEQ ID NO: 3964590 - RNA, 15 nt, Human herpesvirus 3
aauugggggauuugg

SEQ ID NO: 3964591 - RNA, 19 nt, Human herpesvirus 3
acaaauuucugauguuccc

SEQ ID NO: 3964592 - RNA, 12 nt, Human herpesvirus 3
acaacauuuaaa

SEQ ID NO: 3964593 - RNA, 19 nt, Human herpesvirus 3
acacuuggcguguuaaaca

SEQ ID NO: 3964594 - RNA, 23 nt, Human herpesvirus 3
acacuuggcguguuaaacacugu

SEQ ID NO: 3964595 - RNA, 21 nt, Human herpesvirus 3
acaucgaucaucgaaaagacu

SEQ ID NO: 3964596 - RNA, 18 nt, Human herpesvirus 3
acaucgugcuugaauugc

SEQ ID NO: 3964597 - RNA, 22 nt, Human herpesvirus 3
acaugcacugcaucuggagaac

SEQ ID NO: 3964598 - RNA, 19 nt, Human herpesvirus 3
acccaguacguugcauaac

SEQ ID NO: 3964599 - RNA, 13 nt, Human herpesvirus 3
acccgguauuaug

SEQ ID NO: 3964600 - RNA, 22 nt, Human herpesvirus 3
acccuggacauugcggauccca

SEQ ID NO: 3964601 - RNA, 19 nt, Human herpesvirus 3
acccuugccgcguggaaca

SEQ ID NO: 3964602 - RNA, 18 nt, Human herpesvirus 3
accgaacauggacugucg

SEQ ID NO: 3964603 - RNA, 20 nt, Human herpesvirus 3
acgccagccagcaauguuuu

SEQ ID NO: 3964604 - RNA, 14 nt, Human herpesvirus 3
acgccgagcgugua

SEQ ID NO: 3964605 - RNA, 23 nt, Human herpesvirus 3
acggauauuaacacgauuaacgu

SEQ ID NO: 3964606 - RNA, 22 nt, Human herpesvirus 3
acguaauuugccccaaaccacu

SEQ ID NO: 3964607 - RNA, 16 nt, Human herpesvirus 3
acguagcaaagcuaca

SEQ ID NO: 3964608 - RNA, 16 nt, Human herpesvirus 3
acgugaggaaaaagag

SEQ ID NO: 3964609 - RNA, 23 nt, Human herpesvirus 3
acuagcuaccguuagaggcuuaa

SEQ ID NO: 3964610 - RNA, 17 nt, Human herpesvirus 3
acucacguuuguguugu

SEQ ID NO: 3964611 - RNA, 21 nt, Human herpesvirus 3
acugaauuauauaccucggcc

SEQ ID NO: 3964612 - RNA, 16 nt, Human herpesvirus 3
acugcagauacagcau

SEQ ID NO: 3964613 - RNA, 17 nt, Human herpesvirus 3
acuguacagcugagaug

SEQ ID NO: 3964614 - RNA, 17 nt, Human herpesvirus 3
acuuauccaacaaauug

SEQ ID NO: 3964615 - RNA, 18 nt, Human herpesvirus 3
acuuggucacaaauuacu

SEQ ID NO: 3964616 - RNA, 18 nt, Human herpesvirus 3
acuuguaaacccccaagc

SEQ ID NO: 3964617 - RNA, 18 nt, Human herpesvirus 3
acuuuguuugcugcagac

SEQ ID NO: 3964618 - RNA, 21 nt, Human herpesvirus 3
agaaacguuuuuaguuuuuau

SEQ ID NO: 3964619 - RNA, 20 nt, Human herpesvirus 3
agaaacuauccgacagagaa

SEQ ID NO: 3964620 - RNA, 20 nt, Human herpesvirus 3
agaaacuuaauacagaguca

SEQ ID NO: 3964621 - RNA, 14 nt, Human herpesvirus 3
agaagggggauuua

SEQ ID NO: 3964622 - RNA, 22 nt, Human herpesvirus 3
agacaguggcggauaacugccu

SEQ ID NO: 3964623 - RNA, 21 nt, Human herpesvirus 3
agacaucccucguuuauggaa

SEQ ID NO: 3964624 - RNA, 21 nt, Human herpesvirus 3
agacuuaguacgauagaauuu

SEQ ID NO: 3964625 - RNA, 18 nt, Human herpesvirus 3
agaguguuuaacaaccau

SEQ ID NO: 3964626 - RNA, 22 nt, Human herpesvirus 3
agaguuuucuccaaaagaacaa

SEQ ID NO: 3964627 - RNA, 19 nt, Human herpesvirus 3
agaugaucugguaaauguu

SEQ ID NO: 3964628 - RNA, 22 nt, Human herpesvirus 3
agaugguuaauaauagugacaa

SEQ ID NO: 3964629 - RNA, 21 nt, Human herpesvirus 3
agauucaagacuaacauuuau

SEQ ID NO: 3964630 - RNA, 19 nt, Human herpesvirus 3
agauucgccuuuuacauga

SEQ ID NO: 3964631 - RNA, 15 nt, Human herpesvirus 3
agcaacguuuaagaa

SEQ ID NO: 3964632 - RNA, 23 nt, Human herpesvirus 3
agccaacgucgccaucuggagua

SEQ ID NO: 3964633 - RNA, 16 nt, Human herpesvirus 3
agccagcaauguuuua

SEQ ID NO: 3964634 - RNA, 22 nt, Human herpesvirus 3
agccgccagauguacacccagc

SEQ ID NO: 3964635 - RNA, 20 nt, Human herpesvirus 3
agcugccgucaaugcaacua

SEQ ID NO: 3964636 - RNA, 22 nt, Human herpesvirus 3
aggugggguguuaaauaguuuu

SEQ ID NO: 3964637 - RNA, 14 nt, Human herpesvirus 3
aguaacuuaacaaa

SEQ ID NO: 3964638 - RNA, 13 nt, Human herpesvirus 3
aguccaguggaca

SEQ ID NO: 3964639 - RNA, 16 nt, Human herpesvirus 3
aguccccuccuuuucu

SEQ ID NO: 3964640 - RNA, 19 nt, Human herpesvirus 3
aguccccuccuuuucucgu

SEQ ID NO: 3964641 - RNA, 23 nt, Human herpesvirus 3
aguggaccuuugcaaccugguca

SEQ ID NO: 3964642 - RNA, 18 nt, Human herpesvirus 3
aguuagcauccaaauuaa

SEQ ID NO: 3964643 - RNA, 15 nt, Human herpesvirus 3
aguuuuagcgguggu

SEQ ID NO: 3964644 - RNA, 12 nt, Human herpesvirus 3
auaaagggaugg

SEQ ID NO: 3964645 - RNA, 14 nt, Human herpesvirus 3
auaacugccugucg

SEQ ID NO: 3964646 - RNA, 13 nt, Human herpesvirus 3
auaagggagucua

SEQ ID NO: 3964647 - RNA, 17 nt, Human herpesvirus 3
auaauaugauacauaaa

SEQ ID NO: 3964648 - RNA, 20 nt, Human herpesvirus 3
auaauuuguccauaucgcaa

SEQ ID NO: 3964649 - RNA, 15 nt, Human herpesvirus 3
auacacauccuggac

SEQ ID NO: 3964650 - RNA, 17 nt, Human herpesvirus 3
auacacauccuggacac

SEQ ID NO: 3964651 - RNA, 15 nt, Human herpesvirus 3
auacaccggauaaaa

SEQ ID NO: 3964652 - RNA, 14 nt, Human herpesvirus 3
auacguaaauguca

SEQ ID NO: 3964653 - RNA, 14 nt, Human herpesvirus 3
auacuaauuuguau

SEQ ID NO: 3964654 - RNA, 17 nt, Human herpesvirus 3
auacuaauuuguauuuu

SEQ ID NO: 3964655 - RNA, 12 nt, Human herpesvirus 3
auagcugucacu

SEQ ID NO: 3964656 - RNA, 13 nt, Human herpesvirus 3
auaggugucuuca

SEQ ID NO: 3964657 - RNA, 21 nt, Human herpesvirus 3
auauaaaagaagccccaacga

SEQ ID NO: 3964658 - RNA, 15 nt, Human herpesvirus 3
auaucccaaggcaaa

SEQ ID NO: 3964659 - RNA, 14 nt, Human herpesvirus 3
auaucgcaauguuu

SEQ ID NO: 3964660 - RNA, 15 nt, Human herpesvirus 3
auaugauucaaguaa

SEQ ID NO: 3964661 - RNA, 21 nt, Human herpesvirus 3
auauuaacacgauuaacguug

SEQ ID NO: 3964662 - RNA, 14 nt, Human herpesvirus 3
aucacguccggguu

SEQ ID NO: 3964663 - RNA, 21 nt, Human herpesvirus 3
auccauuaaagagccauuucc

SEQ ID NO: 3964664 - RNA, 21 nt, Human herpesvirus 3
auccucgcgguccguuucaua

SEQ ID NO: 3964665 - RNA, 20 nt, Human herpesvirus 3
aucggccguuauauuuuaca

SEQ ID NO: 3964666 - RNA, 18 nt, Human herpesvirus 3
aucguaguaaaacggaac

SEQ ID NO: 3964667 - RNA, 14 nt, Human herpesvirus 3
aucguuuaacaaaa

SEQ ID NO: 3964668 - RNA, 17 nt, Human herpesvirus 3
aucuauuaacaggaccu

SEQ ID NO: 3964669 - RNA, 18 nt, Human herpesvirus 3
aucucuucauauguaauu

SEQ ID NO: 3964670 - RNA, 13 nt, Human herpesvirus 3
aucugguaaaugu

SEQ ID NO: 3964671 - RNA, 14 nt, Human herpesvirus 3
augaaaucagagaa

SEQ ID NO: 3964672 - RNA, 17 nt, Human herpesvirus 3
augcaacccugucauca

SEQ ID NO: 3964673 - RNA, 22 nt, Human herpesvirus 3
augcaccgguccaacacuccgc

SEQ ID NO: 3964674 - RNA, 15 nt, Human herpesvirus 3
augccauuugagaua

SEQ ID NO: 3964675 - RNA, 20 nt, Human herpesvirus 3
augccuggcuuaacagugcc

SEQ ID NO: 3964676 - RNA, 15 nt, Human herpesvirus 3
augcuuguaaaacau

SEQ ID NO: 3964677 - RNA, 16 nt, Human herpesvirus 3
augcuugucaaaacau

SEQ ID NO: 3964678 - RNA, 16 nt, Human herpesvirus 3
auggaguucaaaagaa

SEQ ID NO: 3964679 - RNA, 13 nt, Human herpesvirus 3
auguacacccagc

SEQ ID NO: 3964680 - RNA, 14 nt, Human herpesvirus 3
augucacaaaucau

SEQ ID NO: 3964681 - RNA, 22 nt, Human herpesvirus 3
augugauacaaugagcgguggu

SEQ ID NO: 3964682 - RNA, 20 nt, Human herpesvirus 3
auguuuuuggagcaacguuu

SEQ ID NO: 3964683 - RNA, 15 nt, Human herpesvirus 3
auuagaucuaacguu

SEQ ID NO: 3964684 - RNA, 15 nt, Human herpesvirus 3
auuuaaauaaaaaac

SEQ ID NO: 3964685 - RNA, 15 nt, Human herpesvirus 3
auuuaggaaccgaac

SEQ ID NO: 3964686 - RNA, 17 nt, Human herpesvirus 3
auuugccccaaaccacu

SEQ ID NO: 3964687 - RNA, 20 nt, Human herpesvirus 3
auuuggaaugggagcucuuu

SEQ ID NO: 3964688 - RNA, 21 nt, Human herpesvirus 3
uaugaaaaaagugucugucug

SEQ ID NO: 3964689 - RNA, 16 nt, Human herpesvirus 3
uaugccacauuuaccg

SEQ ID NO: 3964690 - RNA, 19 nt, Human herpesvirus 3
uaugcgcauggaauuaaug

SEQ ID NO: 3964691 - RNA, 17 nt, Human herpesvirus 3
uauguaacguuuguaaa

SEQ ID NO: 3964692 - RNA, 14 nt, Human herpesvirus 3
uauguacauuaaag

SEQ ID NO: 3964693 - RNA, 23 nt, Human herpesvirus 3
uauguggggugcuuguuguauuu

SEQ ID NO: 3964694 - RNA, 13 nt, Human herpesvirus 3
uauuacauuuaau

SEQ ID NO: 3964695 - RNA, 18 nt, Human herpesvirus 3
uauuaucgggcgacaauc

SEQ ID NO: 3964696 - RNA, 19 nt, Human herpesvirus 3
uauucgcguaugaaaugua

SEQ ID NO: 3964697 - RNA, 13 nt, Human herpesvirus 3
uauuucuccggga

SEQ ID NO: 3964698 - RNA, 22 nt, Human herpesvirus 3
ucaaaccaauaucuuugcaauu

SEQ ID NO: 3964699 - RNA, 19 nt, Human herpesvirus 3
ucacgcgucuuguuuuuau

SEQ ID NO: 3964700 - RNA, 16 nt, Human herpesvirus 3
ucaggguuuaacauuu

SEQ ID NO: 3964701 - RNA, 13 nt, Human herpesvirus 3
ucaggucugucau

SEQ ID NO: 3964702 - RNA, 16 nt, Human herpesvirus 3
ucaucuggguggcagc

SEQ ID NO: 3964703 - RNA, 13 nt, Human herpesvirus 3
uccacacaacgcc

SEQ ID NO: 3964704 - RNA, 14 nt, Human herpesvirus 3
uccacugcauuuac

SEQ ID NO: 3964705 - RNA, 23 nt, Human herpesvirus 3
uccauccugaccgauccccgggu

SEQ ID NO: 3964706 - RNA, 15 nt, Human herpesvirus 3
ucccccgaucucugg

SEQ ID NO: 3964707 - RNA, 18 nt, Human herpesvirus 3
uccccguucgcugggugu

SEQ ID NO: 3964708 - RNA, 21 nt, Human herpesvirus 3
ucccgccgucgcgcccaccuc

SEQ ID NO: 3964709 - RNA, 22 nt, Human herpesvirus 3
ucccgccgucgcgcccaccucg

SEQ ID NO: 3964710 - RNA, 15 nt, Human herpesvirus 3
uccgauacccuggac

SEQ ID NO: 3964711 - RNA, 17 nt, Human herpesvirus 3
uccguuuaucccccuuc

SEQ ID NO: 3964712 - RNA, 17 nt, Human herpesvirus 3
uccuauauacagugcuu

SEQ ID NO: 3964713 - RNA, 16 nt, Human herpesvirus 3
ucgccaugguuucaaa

SEQ ID NO: 3964714 - RNA, 15 nt, Human herpesvirus 3
ucggaugacuuugca

SEQ ID NO: 3964715 - RNA, 13 nt, Human herpesvirus 3
ucguauauacaug

SEQ ID NO: 3964716 - RNA, 17 nt, Human herpesvirus 3
ucuaacccggugacaga

SEQ ID NO: 3964717 - RNA, 22 nt, Human herpesvirus 3
ucuacaauauuguagaacuaac

SEQ ID NO: 3964718 - RNA, 13 nt, Human herpesvirus 3
ucuacgcauuuac

SEQ ID NO: 3964719 - RNA, 21 nt, Human herpesvirus 3
ucucaucaaagucaaagucuu

SEQ ID NO: 3964720 - RNA, 23 nt, Human herpesvirus 3
ucucuuauauauguaacguuugu

SEQ ID NO: 3964721 - RNA, 12 nt, Human herpesvirus 3
ugaaaaaagugu

SEQ ID NO: 3964722 - RNA, 18 nt, Human herpesvirus 3
ugaagauaggguguauac

SEQ ID NO: 3964723 - RNA, 21 nt, Human herpesvirus 3
ugaaucguugcggguacaaua

SEQ ID NO: 3964724 - RNA, 14 nt, Human herpesvirus 3
ugaauuugcuacca

SEQ ID NO: 3964725 - RNA, 13 nt, Human herpesvirus 3
ugacaaaaugaca

SEQ ID NO: 3964726 - RNA, 16 nt, Human herpesvirus 3
ugaccgauccccgggu

SEQ ID NO: 3964727 - RNA, 23 nt, Human herpesvirus 3
ugagggugaccggcgggguccca

SEQ ID NO: 3964728 - RNA, 19 nt, Human herpesvirus 3
ugaucaccgaaccggggca

SEQ ID NO: 3964729 - RNA, 22 nt, Human herpesvirus 3
ugauucaagugagguguccugu

SEQ ID NO: 3964730 - RNA, 12 nt, Human herpesvirus 3
ugcauuggaagu

SEQ ID NO: 3964731 - RNA, 23 nt, Human herpesvirus 3
ugcuauagccgucagaagguuca

SEQ ID NO: 3964732 - RNA, 15 nt, Human herpesvirus 3
uggaucagaaagauu

SEQ ID NO: 3964733 - RNA, 23 nt, Human herpesvirus 3
ugggucagaaccgacccaggaca

SEQ ID NO: 3964734 - RNA, 16 nt, Human herpesvirus 3
uggguuuuuagaauuu

SEQ ID NO: 3964735 - RNA, 11 nt, Human herpesvirus 3
ugguuaacacc

SEQ ID NO: 3964736 - RNA, 18 nt, Human herpesvirus 3
uguaaaaaccauggacag

SEQ ID NO: 3964737 - RNA, 15 nt, Human herpesvirus 3
uguaaaauaaaaucu

SEQ ID NO: 3964738 - RNA, 22 nt, Human herpesvirus 3
uguacaacacaaagggccucua

SEQ ID NO: 3964739 - RNA, 23 nt, Human herpesvirus 3
uguauguggagcguacugcagau

SEQ ID NO: 3964740 - RNA, 12 nt, Human herpesvirus 3
uguauguuuuua

SEQ ID NO: 3964741 - RNA, 15 nt, Human herpesvirus 3
uguauuaaaucgacu

SEQ ID NO: 3964742 - RNA, 15 nt, Human herpesvirus 3
uguauuauaugucac

SEQ ID NO: 3964743 - RNA, 14 nt, Human herpesvirus 3
uguauucuggugau

SEQ ID NO: 3964744 - RNA, 14 nt, Human herpesvirus 3
ugucugucugugcg

SEQ ID NO: 3964745 - RNA, 11 nt, Human herpesvirus 3
ugugacaaauu

SEQ ID NO: 3964746 - RNA, 17 nt, Human herpesvirus 3
ugugguccauuaaaagu

SEQ ID NO: 3964747 - RNA, 14 nt, Human herpesvirus 3
uguuaaacaaacag

SEQ ID NO: 3964748 - RNA, 14 nt, Human herpesvirus 3
uguucuauuuccca

SEQ ID NO: 3964749 - RNA, 17 nt, Human herpesvirus 3
uguucucggucuggaau

SEQ ID NO: 3964750 - RNA, 15 nt, Human herpesvirus 3
uguugauauuuucca

SEQ ID NO: 3964751 - RNA, 16 nt, Human herpesvirus 3
uguuuaagaacaucuu

SEQ ID NO: 3964752 - RNA, 14 nt, Human herpesvirus 3
uguuuuaauuccaa

SEQ ID NO: 3964753 - RNA, 14 nt, Human herpesvirus 3
uuaaauacacccgc

SEQ ID NO: 3964754 - RNA, 21 nt, Human herpesvirus 3
uuaaauaguuuugguacauua

SEQ ID NO: 3964755 - RNA, 19 nt, Human herpesvirus 3
uuaacauaccccaggccuu

SEQ ID NO: 3964756 - RNA, 14 nt, Human herpesvirus 3
uuaaugguucauug

SEQ ID NO: 3964757 - RNA, 20 nt, Human herpesvirus 3
uuaauucagggcuuacguuu

SEQ ID NO: 3964758 - RNA, 18 nt, Human herpesvirus 3
uuaauuccaauauuuugu

SEQ ID NO: 3964759 - RNA, 20 nt, Human herpesvirus 3
uuacacgggaaacuauucca

SEQ ID NO: 3964760 - RNA, 15 nt, Human herpesvirus 3
uuaccuuauguguua

SEQ ID NO: 3964761 - RNA, 21 nt, Human herpesvirus 3
uuaggguugggagaguggguc

SEQ ID NO: 3964762 - RNA, 20 nt, Human herpesvirus 3
uuaucccaacugauuacauu

SEQ ID NO: 3964763 - RNA, 23 nt, Human herpesvirus 3
uuaugaacgccugugaaauaacg

SEQ ID NO: 3964764 - RNA, 22 nt, Human herpesvirus 3
uuauuaccgguaccaugggaga

SEQ ID NO: 3964765 - RNA, 18 nt, Human herpesvirus 3
uucaugcuugucaaaaca

SEQ ID NO: 3964766 - RNA, 17 nt, Human herpesvirus 3
uuccacccccucuuaaa

SEQ ID NO: 3964767 - RNA, 21 nt, Human herpesvirus 3
uucccaacgcauaaccagcga

SEQ ID NO: 3964768 - RNA, 19 nt, Human herpesvirus 3
uucuacaccuuugcaugac

SEQ ID NO: 3964769 - RNA, 21 nt, Human herpesvirus 3
uugaaaacauagaccauguuu

SEQ ID NO: 3964770 - RNA, 10 nt, Human herpesvirus 3
uugaaccacu

SEQ ID NO: 3964771 - RNA, 15 nt, Human herpesvirus 3
uugcauuggaaguca

SEQ ID NO: 3964772 - RNA, 14 nt, Human herpesvirus 3
uugcgucuguuuug

SEQ ID NO: 3964773 - RNA, 11 nt, Human herpesvirus 3
uugcuggcugg

SEQ ID NO: 3964774 - RNA, 17 nt, Human herpesvirus 3
uugggggauuugggaga

SEQ ID NO: 3964775 - RNA, 21 nt, Human herpesvirus 3
uuguaaaccacucaacguuuu

SEQ ID NO: 3964776 - RNA, 20 nt, Human herpesvirus 3
uugucauaaaaacaagaagu

SEQ ID NO: 3964777 - RNA, 14 nt, Human herpesvirus 3
uuuacacuugaauc

SEQ ID NO: 3964778 - RNA, 18 nt, Human herpesvirus 3
uuuacaggccggaguguc

SEQ ID NO: 3964779 - RNA, 16 nt, Human herpesvirus 3
uuuagacguucaaaau

SEQ ID NO: 3964780 - RNA, 19 nt, Human herpesvirus 3
uuuaugaaaaaagugucug

SEQ ID NO: 3964781 - RNA, 20 nt, Human herpesvirus 3
uuuaugaaaaaagugucugu

SEQ ID NO: 3964782 - RNA, 21 nt, Human herpesvirus 3
uuucagcaaguuuaacauuuc

SEQ ID NO: 3964783 - RNA, 19 nt, Human herpesvirus 3
uuucauuaggaugaaaaga

SEQ ID NO: 3964784 - RNA, 11 nt, Human herpesvirus 3
uuucugggcgc

SEQ ID NO: 3964785 - RNA, 11 nt, Human herpesvirus 3
uuugaagccac

SEQ ID NO: 3964786 - RNA, 21 nt, Human herpesvirus 3
uuugaaguguucuaaaacacu

SEQ ID NO: 3964787 - RNA, 15 nt, Human herpesvirus 3
uuugcuuccccacac

SEQ ID NO: 3964788 - RNA, 19 nt, Human herpesvirus 3
uuugucuaccacuaagaac

SEQ ID NO: 3964789 - RNA, 13 nt, Human herpesvirus 3
uuuuuaauucagg

SEQ ID NO: 3964790 - RNA, 10 nt, Human herpesvirus 4 (Epstein-Barr virus)
aaaauucagu

SEQ ID NO: 3964791 - RNA, 14 nt, Human herpesvirus 4 (Epstein-Barr virus)
aaacaauuacagau

SEQ ID NO: 3964792 - RNA, 16 nt, Human herpesvirus 4 (Epstein-Barr virus)
aaaccagucuacgacc

SEQ ID NO: 3964793 - RNA, 15 nt, Human herpesvirus 4 (Epstein-Barr virus)
aaacucgacuucuga

SEQ ID NO: 3964794 - RNA, 15 nt, Human herpesvirus 4 (Epstein-Barr virus)
aaaggaagggggccc

SEQ ID NO: 3964795 - RNA, 10 nt, Human herpesvirus 4 (Epstein-Barr virus)
aaaggagaaa

SEQ ID NO: 3964796 - RNA, 16 nt, Human herpesvirus 4 (Epstein-Barr virus)
aaagggcauguggugg

SEQ ID NO: 3964797 - RNA, 16 nt, Human herpesvirus 4 (Epstein-Barr virus)
aaagucccgagcggcc

SEQ ID NO: 3964798 - RNA, 23 nt, Human herpesvirus 4 (Epstein-Barr virus)
aaaguguaacauuuaauguggga

SEQ ID NO: 3964799 - RNA, 16 nt, Human herpesvirus 4 (Epstein-Barr virus)
aacacucuuuuuucaa

SEQ ID NO: 3964800 - RNA, 11 nt, Human herpesvirus 4 (Epstein-Barr virus)
caccaccccac

SEQ ID NO: 3964801 - RNA, 17 nt, Human herpesvirus 4 (Epstein-Barr virus)
caccagucccaacaacu

SEQ ID NO: 3964802 - RNA, 13 nt, Human herpesvirus 4 (Epstein-Barr virus)
cacccaggcagcc

SEQ ID NO: 3964803 - RNA, 13 nt, Human herpesvirus 4 (Epstein-Barr virus)
caccccugugcag

SEQ ID NO: 3964804 - RNA, 17 nt, Human herpesvirus 4 (Epstein-Barr virus)
cacccgucccggguaca

SEQ ID NO: 3964805 - RNA, 21 nt, Human herpesvirus 4 (Epstein-Barr virus)
cacccuaaaacguaugaccuc

SEQ ID NO: 3964806 - RNA, 16 nt, Human herpesvirus 4 (Epstein-Barr virus)
caccggggaggccagg

SEQ ID NO: 3964807 - RNA, 16 nt, Human herpesvirus 4 (Epstein-Barr virus)
caccugcacagaucug

SEQ ID NO: 3964808 - RNA, 23 nt, Human herpesvirus 4 (Epstein-Barr virus)
caccugcacgagaccccugggcu

SEQ ID NO: 3964809 - RNA, 21 nt, Human herpesvirus 4 (Epstein-Barr virus)
cacgaccucgggagggacggg

SEQ ID NO: 3964810 - RNA, 15 nt, Human herpesvirus 4 (Epstein-Barr virus)
cacgagauggcccag

SEQ ID NO: 3964811 - RNA, 13 nt, Human herpesvirus 4 (Epstein-Barr virus)
cacgggccugggg

SEQ ID NO: 3964812 - RNA, 20 nt, Human herpesvirus 4 (Epstein-Barr virus)
cacguccccggccucccgcu

SEQ ID NO: 3964813 - RNA, 13 nt, Human herpesvirus 4 (Epstein-Barr virus)
cacuauauucucc

SEQ ID NO: 3964814 - RNA, 19 nt, Human herpesvirus 4 (Epstein-Barr virus)
cacucaggaagcuggccag

SEQ ID NO: 3964815 - RNA, 18 nt, Human herpesvirus 4 (Epstein-Barr virus)
cacucuggggucucaggc

SEQ ID NO: 3964816 - RNA, 20 nt, Human herpesvirus 4 (Epstein-Barr virus)
cacucuggggucucaggccu

SEQ ID NO: 3964817 - RNA, 21 nt, Human herpesvirus 4 (Epstein-Barr virus)
cacugauaauacgcccgacaa

SEQ ID NO: 3964818 - RNA, 22 nt, Human herpesvirus 4 (Epstein-Barr virus)
cacuggaugcaggaccuagaau

SEQ ID NO: 3964819 - RNA, 14 nt, Human herpesvirus 4 (Epstein-Barr virus)
cacugggacggggu

SEQ ID NO: 3964820 - RNA, 21 nt, Human herpesvirus 4 (Epstein-Barr virus)
cacugugcacucucucccccg

SEQ ID NO: 3964821 - RNA, 19 nt, Human herpesvirus 4 (Epstein-Barr virus)
cacuugugguucuccugau

SEQ ID NO: 3964822 - RNA, 16 nt, Human herpesvirus 4 (Epstein-Barr virus)
cagaaaaucgcagcag

SEQ ID NO: 3964823 - RNA, 13 nt, Human herpesvirus 4 (Epstein-Barr virus)
cagaagcccccaa

SEQ ID NO: 3964824 - RNA, 23 nt, Human herpesvirus 4 (Epstein-Barr virus)
cagacaugguguagacagauccc

SEQ ID NO: 3964825 - RNA, 19 nt, Human herpesvirus 4 (Epstein-Barr virus)
cagaccucugcacaacaca

SEQ ID NO: 3964826 - RNA, 16 nt, Human herpesvirus 4 (Epstein-Barr virus)
cagaccugugugcugu

SEQ ID NO: 3964827 - RNA, 17 nt, Human herpesvirus 4 (Epstein-Barr virus)
cagacucugcuuucugc

SEQ ID NO: 3964828 - RNA, 18 nt, Human herpesvirus 4 (Epstein-Barr virus)
cagagagccacauucugg

SEQ ID NO: 3964829 - RNA, 23 nt, Human herpesvirus 4 (Epstein-Barr virus)
cagagaggcgggaauggccgcca

SEQ ID NO: 3964830 - RNA, 14 nt, Human herpesvirus 4 (Epstein-Barr virus)
cagagccucugcca

SEQ ID NO: 3964831 - RNA, 17 nt, Human herpesvirus 4 (Epstein-Barr virus)
cagaggacacgcugguc

SEQ ID NO: 3964832 - RNA, 17 nt, Human herpesvirus 4 (Epstein-Barr virus)
cagaggaggccccggcc

SEQ ID NO: 3964833 - RNA, 15 nt, Human herpesvirus 4 (Epstein-Barr virus)
cagauccagggcccg

SEQ ID NO: 3964834 - RNA, 12 nt, Human herpesvirus 4 (Epstein-Barr virus)
cagauuucuagu

SEQ ID NO: 3964835 - RNA, 20 nt, Human herpesvirus 4 (Epstein-Barr virus)
cagcaccucagcuguuccca

SEQ ID NO: 3964836 - RNA, 16 nt, Human herpesvirus 4 (Epstein-Barr virus)
cagcagacaaggacag

SEQ ID NO: 3964837 - RNA, 16 nt, Human herpesvirus 4 (Epstein-Barr virus)
cagcagcagugguguu

SEQ ID NO: 3964838 - RNA, 15 nt, Human herpesvirus 4 (Epstein-Barr virus)
cagcauggcagccgg

SEQ ID NO: 3964839 - RNA, 20 nt, Human herpesvirus 4 (Epstein-Barr virus)
cagccacacaaucagccggg

SEQ ID NO: 3964840 - RNA, 17 nt, Human herpesvirus 4 (Epstein-Barr virus)
cagcccgacccccgggc

SEQ ID NO: 3964841 - RNA, 18 nt, Human herpesvirus 4 (Epstein-Barr virus)
cagcccuuuuuccagugg

SEQ ID NO: 3964842 - RNA, 19 nt, Human herpesvirus 4 (Epstein-Barr virus)
cagcgccagcagggcacag

SEQ ID NO: 3964843 - RNA, 18 nt, Human herpesvirus 4 (Epstein-Barr virus)
cagcgcggcagaggccuc

SEQ ID NO: 3964844 - RNA, 14 nt, Human herpesvirus 4 (Epstein-Barr virus)
cagcgcuggcucca

SEQ ID NO: 3964845 - RNA, 17 nt, Human herpesvirus 4 (Epstein-Barr virus)
cagcuccagggacaggg

SEQ ID NO: 3964846 - RNA, 13 nt, Human herpesvirus 4 (Epstein-Barr virus)
cagcuggcccacc

SEQ ID NO: 3964847 - RNA, 22 nt, Human herpesvirus 4 (Epstein-Barr virus)
caggaccuggaaauggccuagg

SEQ ID NO: 3964848 - RNA, 16 nt, Human herpesvirus 4 (Epstein-Barr virus)
caggagacacacgugg

SEQ ID NO: 3964849 - RNA, 18 nt, Human herpesvirus 4 (Epstein-Barr virus)
caggagguacaugggcca

SEQ ID NO: 3964850 - RNA, 19 nt, Human herpesvirus 4 (Epstein-Barr virus)
caggccccccgcaccaggg

SEQ ID NO: 3964851 - RNA, 21 nt, Human herpesvirus 4 (Epstein-Barr virus)
caggccgccaugcucagggcc

SEQ ID NO: 3964852 - RNA, 22 nt, Human herpesvirus 4 (Epstein-Barr virus)
caggccucagcgucaggagagg

SEQ ID NO: 3964853 - RNA, 17 nt, Human herpesvirus 4 (Epstein-Barr virus)
caggcgacgcucccggg

SEQ ID NO: 3964854 - RNA, 19 nt, Human herpesvirus 4 (Epstein-Barr virus)
caggcuacaacaggcugcu

SEQ ID NO: 3964855 - RNA, 15 nt, Human herpesvirus 4 (Epstein-Barr virus)
cagggcccagugcac

SEQ ID NO: 3964856 - RNA, 23 nt, Human herpesvirus 4 (Epstein-Barr virus)
cagggccggaaccugagccugag

SEQ ID NO: 3964857 - RNA, 12 nt, Human herpesvirus 4 (Epstein-Barr virus)
cagggcggagga

SEQ ID NO: 3964858 - RNA, 18 nt, Human herpesvirus 4 (Epstein-Barr virus)
cagggcuucguccagggg

SEQ ID NO: 3964859 - RNA, 14 nt, Human herpesvirus 4 (Epstein-Barr virus)
caggguccaggaga

SEQ ID NO: 3964860 - RNA, 18 nt, Human herpesvirus 4 (Epstein-Barr virus)
cagggugcacagacuagc

SEQ ID NO: 3964861 - RNA, 22 nt, Human herpesvirus 4 (Epstein-Barr virus)
caggguuucuaggacgcugucc

SEQ ID NO: 3964862 - RNA, 12 nt, Human herpesvirus 4 (Epstein-Barr virus)
caggucaggucc

SEQ ID NO: 3964863 - RNA, 17 nt, Human herpesvirus 4 (Epstein-Barr virus)
caggucgcggaccaggg

SEQ ID NO: 3964864 - RNA, 21 nt, Human herpesvirus 4 (Epstein-Barr virus)
caggugcccgagccccgccug

SEQ ID NO: 3964865 - RNA, 18 nt, Human herpesvirus 4 (Epstein-Barr virus)
caguccacagccaccggc

SEQ ID NO: 3964866 - RNA, 18 nt, Human herpesvirus 4 (Epstein-Barr virus)
caguccaggggccacaca

SEQ ID NO: 3964867 - RNA, 18 nt, Human herpesvirus 4 (Epstein-Barr virus)
cagugccuccgccugagc

SEQ ID NO: 3964868 - RNA, 15 nt, Human herpesvirus 4 (Epstein-Barr virus)
cagugucuggcggcc

SEQ ID NO: 3964869 - RNA, 13 nt, Human herpesvirus 4 (Epstein-Barr virus)
caguguggcccga

SEQ ID NO: 3964870 - RNA, 23 nt, Human herpesvirus 4 (Epstein-Barr virus)
cauaacugagcagggcaaagcca

SEQ ID NO: 3964871 - RNA, 22 nt, Human herpesvirus 4 (Epstein-Barr virus)
cauauccagagcugagugccca

SEQ ID NO: 3964872 - RNA, 16 nt, Human herpesvirus 4 (Epstein-Barr virus)
caucaaccagugggua

SEQ ID NO: 3964873 - RNA, 14 nt, Human herpesvirus 4 (Epstein-Barr virus)
caucgccgccccag

SEQ ID NO: 3964874 - RNA, 15 nt, Human herpesvirus 4 (Epstein-Barr virus)
caucucauccccaga

SEQ ID NO: 3964875 - RNA, 22 nt, Human herpesvirus 4 (Epstein-Barr virus)
caucugaaaaugacaggcugcg

SEQ ID NO: 3964876 - RNA, 17 nt, Human herpesvirus 4 (Epstein-Barr virus)
caucuggaccagaaggc

SEQ ID NO: 3964877 - RNA, 15 nt, Human herpesvirus 4 (Epstein-Barr virus)
caugacgcugcugcu

SEQ ID NO: 3964878 - RNA, 20 nt, Human herpesvirus 4 (Epstein-Barr virus)
caugcaaguggaugcaucua

SEQ ID NO: 3964879 - RNA, 13 nt, Human herpesvirus 4 (Epstein-Barr virus)
caugcaggccugg

SEQ ID NO: 3964880 - RNA, 19 nt, Human herpesvirus 4 (Epstein-Barr virus)
caugcuauggugccggggc

SEQ ID NO: 3964881 - RNA, 18 nt, Human herpesvirus 4 (Epstein-Barr virus)
caugcuccuauggacacu

SEQ ID NO: 3964882 - RNA, 12 nt, Human herpesvirus 4 (Epstein-Barr virus)
cauggccugggc

SEQ ID NO: 3964883 - RNA, 12 nt, Human herpesvirus 4 (Epstein-Barr virus)
cauggggcucug

SEQ ID NO: 3964884 - RNA, 22 nt, Human herpesvirus 4 (Epstein-Barr virus)
cauguaacaagaacugggauga

SEQ ID NO: 3964885 - RNA, 22 nt, Human herpesvirus 4 (Epstein-Barr virus)
cauucccaaguguuuccagaca

SEQ ID NO: 3964886 - RNA, 17 nt, Human herpesvirus 4 (Epstein-Barr virus)
cauucgugaguccaggg

SEQ ID NO: 3964887 - RNA, 21 nt, Human herpesvirus 4 (Epstein-Barr virus)
cauucgugaguccagggcccu

SEQ ID NO: 3964888 - RNA, 22 nt, Human herpesvirus 4 (Epstein-Barr virus)
ccaaagcgggugcaguaacagg

SEQ ID NO: 3964889 - RNA, 19 nt, Human herpesvirus 4 (Epstein-Barr virus)
ccaacuccggcccacgcca

SEQ ID NO: 3964890 - RNA, 14 nt, Human herpesvirus 4 (Epstein-Barr virus)
ccaagcggcacaga

SEQ ID NO: 3964891 - RNA, 21 nt, Human herpesvirus 4 (Epstein-Barr virus)
ccaaggacccccgcgucacug

SEQ ID NO: 3964892 - RNA, 14 nt, Human herpesvirus 4 (Epstein-Barr virus)
ccaaugugcauggg

SEQ ID NO: 3964893 - RNA, 16 nt, Human herpesvirus 4 (Epstein-Barr virus)
ccacacucccuccaga

SEQ ID NO: 3964894 - RNA, 14 nt, Human herpesvirus 4 (Epstein-Barr virus)
ccacagccccacuc

SEQ ID NO: 3964895 - RNA, 14 nt, Human herpesvirus 4 (Epstein-Barr virus)
ccaccaccuccacc

SEQ ID NO: 3964896 - RNA, 15 nt, Human herpesvirus 4 (Epstein-Barr virus)
ccaccauaugaugac

SEQ ID NO: 3964897 - RNA, 21 nt, Human herpesvirus 4 (Epstein-Barr virus)
ccacggcccggggguggcagc

SEQ ID NO: 3964898 - RNA, 17 nt, Human herpesvirus 4 (Epstein-Barr virus)
ccacggccguagcccag

SEQ ID NO: 3964899 - RNA, 20 nt, Human herpesvirus 4 (Epstein-Barr virus)
ccagaaggcuccggcggcag

SEQ ID NO: 3964900 - RNA, 21 nt, Human herpesvirus 4 (Epstein-Barr virus)
ccagauguccagggguccccg

SEQ ID NO: 3964901 - RNA, 21 nt, Human herpesvirus 4 (Epstein-Barr virus)
ccagcaaaaccagcccgggga

SEQ ID NO: 3964902 - RNA, 22 nt, Human herpesvirus 4 (Epstein-Barr virus)
ccagcaggcucaggccgccgca

SEQ ID NO: 3964903 - RNA, 14 nt, Human herpesvirus 4 (Epstein-Barr virus)
ccagcauggcagcc

SEQ ID NO: 3964904 - RNA, 20 nt, Human herpesvirus 4 (Epstein-Barr virus)
ccagcccccucccgccccug

SEQ ID NO: 3964905 - RNA, 13 nt, Human herpesvirus 4 (Epstein-Barr virus)
ccagcccgacccc

SEQ ID NO: 3964906 - RNA, 23 nt, Human herpesvirus 4 (Epstein-Barr virus)
ccagcgccuccucgcaggccccc

SEQ ID NO: 3964907 - RNA, 23 nt, Human herpesvirus 4 (Epstein-Barr virus)
ccaggaccuggaugcuguagugg

SEQ ID NO: 3964908 - RNA, 22 nt, Human herpesvirus 4 (Epstein-Barr virus)
ccaggagccccgggcggcucag

SEQ ID NO: 3964909 - RNA, 19 nt, Human herpesvirus 4 (Epstein-Barr virus)
ccaggagucugcugcggcu

SEQ ID NO: 3964910 - RNA, 14 nt, Human herpesvirus 4 (Epstein-Barr virus)
ccaggcacaucugg

SEQ ID NO: 3964911 - RNA, 19 nt, Human herpesvirus 4 (Epstein-Barr virus)
ccaggcagaugaggccccu

SEQ ID NO: 3964912 - RNA, 19 nt, Human herpesvirus 4 (Epstein-Barr virus)
ccaggcccccgggugggcu

SEQ ID NO: 3964913 - RNA, 17 nt, Human herpesvirus 4 (Epstein-Barr virus)
ccaggccucagcgucag

SEQ ID NO: 3964914 - RNA, 15 nt, Human herpesvirus 4 (Epstein-Barr virus)
ccagggacagggcgc

SEQ ID NO: 3964915 - RNA, 13 nt, Human herpesvirus 4 (Epstein-Barr virus)
ccagggguccccg

SEQ ID NO: 3964916 - RNA, 18 nt, Human herpesvirus 4 (Epstein-Barr virus)
ccaggguuucuaggacgc

SEQ ID NO: 3964917 - RNA, 17 nt, Human herpesvirus 4 (Epstein-Barr virus)
ccaguuccccccagccu

SEQ ID NO: 3964918 - RNA, 18 nt, Human herpesvirus 4 (Epstein-Barr virus)
ccaucugcuucuggcucu

SEQ ID NO: 3964919 - RNA, 13 nt, Human herpesvirus 4 (Epstein-Barr virus)
ccaugcagcggcg

SEQ ID NO: 3964920 - RNA, 22 nt, Human herpesvirus 4 (Epstein-Barr virus)
ccaugcgcgcccugucaccagg

SEQ ID NO: 3964921 - RNA, 21 nt, Human herpesvirus 4 (Epstein-Barr virus)
ccaugucugggggacucuucu

SEQ ID NO: 3964922 - RNA, 13 nt, Human herpesvirus 4 (Epstein-Barr virus)
ccauucacagggg

SEQ ID NO: 3964923 - RNA, 17 nt, Human herpesvirus 4 (Epstein-Barr virus)
ccauucgugaguccagg

SEQ ID NO: 3964924 - RNA, 16 nt, Human herpesvirus 4 (Epstein-Barr virus)
cccaaagcgggugcag

SEQ ID NO: 3964925 - RNA, 15 nt, Human herpesvirus 4 (Epstein-Barr virus)
cccaccacccccacc

SEQ ID NO: 3964926 - RNA, 21 nt, Human herpesvirus 4 (Epstein-Barr virus)
cccaccagaucgccugccacu

SEQ ID NO: 3964927 - RNA, 18 nt, Human herpesvirus 4 (Epstein-Barr virus)
cccaccgacuccgaugcc

SEQ ID NO: 3964928 - RNA, 21 nt, Human herpesvirus 4 (Epstein-Barr virus)
cccacugaaaaaccagacacg

SEQ ID NO: 3964929 - RNA, 21 nt, Human herpesvirus 4 (Epstein-Barr virus)
cccagcuccgugguccugagg

SEQ ID NO: 3964930 - RNA, 20 nt, Human herpesvirus 4 (Epstein-Barr virus)
cccagggcagacugcacagg

SEQ ID NO: 3964931 - RNA, 14 nt, Human herpesvirus 4 (Epstein-Barr virus)
cccaguccgcgacc

SEQ ID NO: 3964932 - RNA, 19 nt, Human herpesvirus 4 (Epstein-Barr virus)
cccauccccagcccagccg

SEQ ID NO: 3964933 - RNA, 12 nt, Human herpesvirus 4 (Epstein-Barr virus)
ccccagccacag

SEQ ID NO: 3964934 - RNA, 20 nt, Human herpesvirus 4 (Epstein-Barr virus)
ccccagcgcuggcuccaggg

SEQ ID NO: 3964935 - RNA, 20 nt, Human herpesvirus 4 (Epstein-Barr virus)
cccccguaaaacuccacaga

SEQ ID NO: 3964936 - RNA, 21 nt, Human herpesvirus 4 (Epstein-Barr virus)
ccccgacaucgccgccccagg

SEQ ID NO: 3964937 - RNA, 19 nt, Human herpesvirus 4 (Epstein-Barr virus)
ccccgccuuugggcacccc

SEQ ID NO: 3964938 - RNA, 13 nt, Human herpesvirus 4 (Epstein-Barr virus)
ccccuccacggga

SEQ ID NO: 3964939 - RNA, 19 nt, Human herpesvirus 4 (Epstein-Barr virus)
ccccuccauuccacccacu

SEQ ID NO: 3964940 - RNA, 22 nt, Human herpesvirus 4 (Epstein-Barr virus)
cccgagaccggcuccggauuca

SEQ ID NO: 3964941 - RNA, 15 nt, Human herpesvirus 4 (Epstein-Barr virus)
cccgcccuccccauc

SEQ ID NO: 3964942 - RNA, 19 nt, Human herpesvirus 4 (Epstein-Barr virus)
cccggagucuggacguggc

SEQ ID NO: 3964943 - RNA, 15 nt, Human herpesvirus 4 (Epstein-Barr virus)
cccggcccucuuccg

SEQ ID NO: 3964944 - RNA, 16 nt, Human herpesvirus 4 (Epstein-Barr virus)
cccgggggaggagaag

SEQ ID NO: 3964945 - RNA, 22 nt, Human herpesvirus 4 (Epstein-Barr virus)
cccggggguggaggcugcgccu

SEQ ID NO: 3964946 - RNA, 20 nt, Human herpesvirus 4 (Epstein-Barr virus)
cccguugguggucagcagca

SEQ ID NO: 3964947 - RNA, 21 nt, Human herpesvirus 4 (Epstein-Barr virus)
cccuagccaccguggccaggc

SEQ ID NO: 3964948 - RNA, 16 nt, Human herpesvirus 4 (Epstein-Barr virus)
cccuccgcauccuagg

SEQ ID NO: 3964949 - RNA, 14 nt, Human herpesvirus 4 (Epstein-Barr virus)
cccucuccagcaac

SEQ ID NO: 3964950 - RNA, 22 nt, Human herpesvirus 4 (Epstein-Barr virus)
cccugcaaacugacacacaggc

SEQ ID NO: 3964951 - RNA, 14 nt, Human herpesvirus 4 (Epstein-Barr virus)
cccuggcugacgga

SEQ ID NO: 3964952 - RNA, 17 nt, Human herpesvirus 4 (Epstein-Barr virus)
cccuugcccucuccagc

SEQ ID NO: 3964953 - RNA, 13 nt, Human herpesvirus 4 (Epstein-Barr virus)
cccuuucuaccag

SEQ ID NO: 3964954 - RNA, 21 nt, Human herpesvirus 4 (Epstein-Barr virus)
cccuuucuaccaggggcgagc

SEQ ID NO: 3964955 - RNA, 15 nt, Human herpesvirus 4 (Epstein-Barr virus)
cccuuugccuggggc

SEQ ID NO: 3964956 - RNA, 13 nt, Human herpesvirus 4 (Epstein-Barr virus)
ccgaacaugggua

SEQ ID NO: 3964957 - RNA, 20 nt, Human herpesvirus 4 (Epstein-Barr virus)
ccgaggcagacaaggccccg

SEQ ID NO: 3964958 - RNA, 16 nt, Human herpesvirus 4 (Epstein-Barr virus)
ccgcaccagggccagg

SEQ ID NO: 3964959 - RNA, 15 nt, Human herpesvirus 4 (Epstein-Barr virus)
ccgcagggguggugg

SEQ ID NO: 3964960 - RNA, 12 nt, Human herpesvirus 4 (Epstein-Barr virus)
ccgccgccgcag

SEQ ID NO: 3964961 - RNA, 14 nt, Human herpesvirus 4 (Epstein-Barr virus)
ccggcauccagugc

SEQ ID NO: 3964962 - RNA, 18 nt, Human herpesvirus 4 (Epstein-Barr virus)
ccggcccuuugccugggg

SEQ ID NO: 3964963 - RNA, 18 nt, Human herpesvirus 4 (Epstein-Barr virus)
ccggcgcuguguggcuga

SEQ ID NO: 3964964 - RNA, 18 nt, Human herpesvirus 4 (Epstein-Barr virus)
ccggcuggccgccguggc

SEQ ID NO: 3964965 - RNA, 22 nt, Human herpesvirus 4 (Epstein-Barr virus)
ccgggagaggcagccccaaagc

SEQ ID NO: 3964966 - RNA, 12 nt, Human herpesvirus 4 (Epstein-Barr virus)
ccggggcccacg

SEQ ID NO: 3964967 - RNA, 22 nt, Human herpesvirus 4 (Epstein-Barr virus)
ccggguuugauguuucuguggc

SEQ ID NO: 3964968 - RNA, 19 nt, Human herpesvirus 4 (Epstein-Barr virus)
ccgguccccccagaagccc

SEQ ID NO: 3964969 - RNA, 22 nt, Human herpesvirus 4 (Epstein-Barr virus)
ccggucguagucauccgaggcu

SEQ ID NO: 3964970 - RNA, 15 nt, Human herpesvirus 4 (Epstein-Barr virus)
ccgucagccagggug

SEQ ID NO: 3964971 - RNA, 18 nt, Human herpesvirus 4 (Epstein-Barr virus)
ccguccuuguccaggaga

SEQ ID NO: 3964972 - RNA, 21 nt, Human herpesvirus 4 (Epstein-Barr virus)
ccgugcuuuuugccaggccug

SEQ ID NO: 3964973 - RNA, 10 nt, Human herpesvirus 4 (Epstein-Barr virus)
ccguggccuu

SEQ ID NO: 3964974 - RNA, 16 nt, Human herpesvirus 4 (Epstein-Barr virus)
ccguguuucucccacu

SEQ ID NO: 3964975 - RNA, 15 nt, Human herpesvirus 4 (Epstein-Barr virus)
ccucgguggugggcu

SEQ ID NO: 3964976 - RNA, 16 nt, Human herpesvirus 4 (Epstein-Barr virus)
ccucugaugguggccg

SEQ ID NO: 3964977 - RNA, 15 nt, Human herpesvirus 4 (Epstein-Barr virus)
ccucugcacaacaca

SEQ ID NO: 3964978 - RNA, 22 nt, Human herpesvirus 4 (Epstein-Barr virus)
ccucuggcacgccguggcccug

SEQ ID NO: 3964979 - RNA, 14 nt, Human herpesvirus 4 (Epstein-Barr virus)
ccugaccaucacau

SEQ ID NO: 3964980 - RNA, 16 nt, Human herpesvirus 4 (Epstein-Barr virus)
ccugacugacucuccc

SEQ ID NO: 3964981 - RNA, 16 nt, Human herpesvirus 4 (Epstein-Barr virus)
ccugagacuggacccu

SEQ ID NO: 3964982 - RNA, 20 nt, Human herpesvirus 4 (Epstein-Barr virus)
ccugagcauggcggccuggc

SEQ ID NO: 3964983 - RNA, 20 nt, Human herpesvirus 4 (Epstein-Barr virus)
ccugagccacacccaccuau

SEQ ID NO: 3964984 - RNA, 18 nt, Human herpesvirus 4 (Epstein-Barr virus)
ccugagccugagccacac

SEQ ID NO: 3964985 - RNA, 23 nt, Human herpesvirus 4 (Epstein-Barr virus)
ccugccucucuuaugccuguggc

SEQ ID NO: 3964986 - RNA, 13 nt, Human herpesvirus 4 (Epstein-Barr virus)
ccugcggcccacu

SEQ ID NO: 3964987 - RNA, 17 nt, Human herpesvirus 4 (Epstein-Barr virus)
ccugcucauaccuccac

SEQ ID NO: 3964988 - RNA, 14 nt, Human herpesvirus 4 (Epstein-Barr virus)
ccuggccagggcgg

SEQ ID NO: 3964989 - RNA, 20 nt, Human herpesvirus 4 (Epstein-Barr virus)
ccugggccccccggaggggc

SEQ ID NO: 3964990 - RNA, 13 nt, Human herpesvirus 4 (Epstein-Barr virus)
ccugggccuuggc

SEQ ID NO: 3964991 - RNA, 18 nt, Human herpesvirus 4 (Epstein-Barr virus)
ccugucaccaggccugcc

SEQ ID NO: 3964992 - RNA, 15 nt, Human herpesvirus 4 (Epstein-Barr virus)
ccugucucccaccca

SEQ ID NO: 3964993 - RNA, 13 nt, Human herpesvirus 4 (Epstein-Barr virus)
ccuugaucuucuu

SEQ ID NO: 3964994 - RNA, 19 nt, Human herpesvirus 4 (Epstein-Barr virus)
ccuugcccucuccagcaac

SEQ ID NO: 3964995 - RNA, 17 nt, Human herpesvirus 4 (Epstein-Barr virus)
ccuuggaacugacgggc

SEQ ID NO: 3964996 - RNA, 18 nt, Human herpesvirus 4 (Epstein-Barr virus)
ccuuggggguggugggcu

SEQ ID NO: 3964997 - RNA, 17 nt, Human herpesvirus 4 (Epstein-Barr virus)
ccuuguccacuggggug

SEQ ID NO: 3964998 - RNA, 15 nt, Human herpesvirus 4 (Epstein-Barr virus)
ccuuguccgcugggc

SEQ ID NO: 3964999 - RNA, 16 nt, Human herpesvirus 4 (Epstein-Barr virus)
ccuuguccgcugggcc

SEQ ID NO: 3965000 - RNA, 14 nt, Human herpesvirus 4 (Epstein-Barr virus)
ccuuuacccagccc

SEQ ID NO: 3965001 - RNA, 20 nt, Human herpesvirus 4 (Epstein-Barr virus)
ccuuugggcaccccacgggg

SEQ ID NO: 3965002 - RNA, 21 nt, Human herpesvirus 4 (Epstein-Barr virus)
ccuuuugucuccccucugcag

SEQ ID NO: 3965003 - RNA, 19 nt, Human herpesvirus 4 (Epstein-Barr virus)
cugccaacuuugagcuggg

SEQ ID NO: 3965004 - RNA, 22 nt, Human herpesvirus 4 (Epstein-Barr virus)
cugccagagccucugccacaag

SEQ ID NO: 3965005 - RNA, 20 nt, Human herpesvirus 4 (Epstein-Barr virus)
cugccccgguccccccagaa

SEQ ID NO: 3965006 - RNA, 16 nt, Human herpesvirus 4 (Epstein-Barr virus)
cugccccucagccugc

SEQ ID NO: 3965007 - RNA, 21 nt, Human herpesvirus 4 (Epstein-Barr virus)
cugccucgaguaggugccucc

SEQ ID NO: 3965008 - RNA, 15 nt, Human herpesvirus 4 (Epstein-Barr virus)
cugcuccagugccuc

SEQ ID NO: 3965009 - RNA, 13 nt, Human herpesvirus 4 (Epstein-Barr virus)
cuggaccagaagg

SEQ ID NO: 3965010 - RNA, 18 nt, Human herpesvirus 4 (Epstein-Barr virus)
cuggagaugauucauggg

SEQ ID NO: 3965011 - RNA, 14 nt, Human herpesvirus 4 (Epstein-Barr virus)
cuggagccagcgcu

SEQ ID NO: 3965012 - RNA, 13 nt, Human herpesvirus 4 (Epstein-Barr virus)
cuggaggccucag

SEQ ID NO: 3965013 - RNA, 19 nt, Human herpesvirus 4 (Epstein-Barr virus)
cuggaugcuguaguggccu

SEQ ID NO: 3965014 - RNA, 17 nt, Human herpesvirus 4 (Epstein-Barr virus)
cuggcacgacuguuccu

SEQ ID NO: 3965015 - RNA, 13 nt, Human herpesvirus 4 (Epstein-Barr virus)
cuggcagcggccu

SEQ ID NO: 3965016 - RNA, 17 nt, Human herpesvirus 4 (Epstein-Barr virus)
cuggccggccgcccccu

SEQ ID NO: 3965017 - RNA, 22 nt, Human herpesvirus 4 (Epstein-Barr virus)
cuggccggcuaucugcuucugg

SEQ ID NO: 3965018 - RNA, 12 nt, Human herpesvirus 4 (Epstein-Barr virus)
cuggcucagcuu

SEQ ID NO: 3965019 - RNA, 17 nt, Human herpesvirus 4 (Epstein-Barr virus)
cuggucgcccccucugc

SEQ ID NO: 3965020 - RNA, 18 nt, Human herpesvirus 4 (Epstein-Barr virus)
cugucucuuucuggccaa

SEQ ID NO: 3965021 - RNA, 14 nt, Human herpesvirus 4 (Epstein-Barr virus)
cuguguccugggca

SEQ ID NO: 3965022 - RNA, 18 nt, Human herpesvirus 4 (Epstein-Barr virus)
cuuagagucccugcgcca

SEQ ID NO: 3965023 - RNA, 19 nt, Human herpesvirus 4 (Epstein-Barr virus)
cuucacagagcagcagcua

SEQ ID NO: 3965024 - RNA, 20 nt, Human herpesvirus 4 (Epstein-Barr virus)
cuucuggcacgacuguuccu

SEQ ID NO: 3965025 - RNA, 14 nt, Human herpesvirus 4 (Epstein-Barr virus)
cuucuggcucuucu

SEQ ID NO: 3965026 - RNA, 19 nt, Human herpesvirus 4 (Epstein-Barr virus)
cuugccguggcgccugggg

SEQ ID NO: 3965027 - RNA, 13 nt, Human herpesvirus 4 (Epstein-Barr virus)
cuuggaggcugcu

SEQ ID NO: 3965028 - RNA, 21 nt, Human herpesvirus 4 (Epstein-Barr virus)
cuugguaaguuuucccuuccu

SEQ ID NO: 3965029 - RNA, 15 nt, Human herpesvirus 4 (Epstein-Barr virus)
cuugugcuccugaua

SEQ ID NO: 3965030 - RNA, 19 nt, Human herpesvirus 4 (Epstein-Barr virus)
cuuuguccagauguccagg

SEQ ID NO: 3965031 - RNA, 22 nt, Human herpesvirus 4 (Epstein-Barr virus)
cuuuguggccuuccucugccug

SEQ ID NO: 3965032 - RNA, 14 nt, Human herpesvirus 4 (Epstein-Barr virus)
cuuuugucugccug

SEQ ID NO: 3965033 - RNA, 12 nt, Human herpesvirus 4 (Epstein-Barr virus)
gaaaagagacug

SEQ ID NO: 3965034 - RNA, 22 nt, Human herpesvirus 4 (Epstein-Barr virus)
gaaaagagagcugauggaggcc

SEQ ID NO: 3965035 - RNA, 17 nt, Human herpesvirus 4 (Epstein-Barr virus)
gaaaaugagccaugacu

SEQ ID NO: 3965036 - RNA, 15 nt, Human herpesvirus 4 (Epstein-Barr virus)
gaaagugcuggccau

SEQ ID NO: 3965037 - RNA, 19 nt, Human herpesvirus 4 (Epstein-Barr virus)
gaaaguuguugggugaaag

SEQ ID NO: 3965038 - RNA, 22 nt, Human herpesvirus 4 (Epstein-Barr virus)
gaaauaucuagcacggcacccu

SEQ ID NO: 3965039 - RNA, 17 nt, Human herpesvirus 4 (Epstein-Barr virus)
gaacacuugggcacgga

SEQ ID NO: 3965040 - RNA, 15 nt, Human herpesvirus 4 (Epstein-Barr virus)
gaacaggagcaggag

SEQ ID NO: 3965041 - RNA, 13 nt, Human herpesvirus 4 (Epstein-Barr virus)
gaacccuggggca

SEQ ID NO: 3965042 - RNA, 12 nt, Human herpesvirus 4 (Epstein-Barr virus)
gaaccugagccu

SEQ ID NO: 3965043 - RNA, 14 nt, Human herpesvirus 4 (Epstein-Barr virus)
gaacgugacaggca

SEQ ID NO: 3965044 - RNA, 16 nt, Human herpesvirus 4 (Epstein-Barr virus)
gaacgugacaggcaca

SEQ ID NO: 3965045 - RNA, 13 nt, Human herpesvirus 4 (Epstein-Barr virus)
gaagaagauugaa

SEQ ID NO: 3965046 - RNA, 17 nt, Human herpesvirus 4 (Epstein-Barr virus)
gaagauugucacagcug

SEQ ID NO: 3965047 - RNA, 22 nt, Human herpesvirus 4 (Epstein-Barr virus)
gaagcagauagccggccaggca

SEQ ID NO: 3965048 - RNA, 23 nt, Human herpesvirus 4 (Epstein-Barr virus)
gaagcccaagaagaagcccaccu

SEQ ID NO: 3965049 - RNA, 21 nt, Human herpesvirus 4 (Epstein-Barr virus)
gaauccaguaugccugccugu

SEQ ID NO: 3965050 - RNA, 13 nt, Human herpesvirus 4 (Epstein-Barr virus)
gaauccgcgcagc

SEQ ID NO: 3965051 - RNA, 16 nt, Human herpesvirus 4 (Epstein-Barr virus)
gaaucuaguaugaagg

SEQ ID NO: 3965052 - RNA, 16 nt, Human herpesvirus 4 (Epstein-Barr virus)
gaaucugacauuucuc

SEQ ID NO: 3965053 - RNA, 17 nt, Human herpesvirus 4 (Epstein-Barr virus)
gaaugcccccgggggcg

SEQ ID NO: 3965054 - RNA, 18 nt, Human herpesvirus 4 (Epstein-Barr virus)
gacaauaaaguugaugau

SEQ ID NO: 3965055 - RNA, 18 nt, Human herpesvirus 4 (Epstein-Barr virus)
gacacuuuagagcucugg

SEQ ID NO: 3965056 - RNA, 19 nt, Human herpesvirus 4 (Epstein-Barr virus)
gacagguacuaacacgcaa

SEQ ID NO: 3965057 - RNA, 14 nt, Human herpesvirus 4 (Epstein-Barr virus)
gacccgucgggcca

SEQ ID NO: 3965058 - RNA, 17 nt, Human herpesvirus 4 (Epstein-Barr virus)
gacccuauggagggcag

SEQ ID NO: 3965059 - RNA, 14 nt, Human herpesvirus 4 (Epstein-Barr virus)
gaccuggaugcugu

SEQ ID NO: 3965060 - RNA, 16 nt, Human herpesvirus 4 (Epstein-Barr virus)
gacucaggcccucauu

SEQ ID NO: 3965061 - RNA, 21 nt, Human herpesvirus 4 (Epstein-Barr virus)
gacucuauugguugaucuccu

SEQ ID NO: 3965062 - RNA, 17 nt, Human herpesvirus 4 (Epstein-Barr virus)
gagacaaggcaggcgcu

SEQ ID NO: 3965063 - RNA, 17 nt, Human herpesvirus 4 (Epstein-Barr virus)
gagacucaggcccucau

SEQ ID NO: 3965064 - RNA, 20 nt, Human herpesvirus 4 (Epstein-Barr virus)
gcagcacacgaagccugccu

SEQ ID NO: 3965065 - RNA, 14 nt, Human herpesvirus 4 (Epstein-Barr virus)
gcagcaccuguccc

SEQ ID NO: 3965066 - RNA, 22 nt, Human herpesvirus 4 (Epstein-Barr virus)
gcagccacguccagacuccggg

SEQ ID NO: 3965067 - RNA, 18 nt, Human herpesvirus 4 (Epstein-Barr virus)
gcagcccccuccuccagg

SEQ ID NO: 3965068 - RNA, 23 nt, Human herpesvirus 4 (Epstein-Barr virus)
gcagccuugcguggugcuguccu

SEQ ID NO: 3965069 - RNA, 20 nt, Human herpesvirus 4 (Epstein-Barr virus)
gcagcucaccuauggucacu

SEQ ID NO: 3965070 - RNA, 17 nt, Human herpesvirus 4 (Epstein-Barr virus)
gcaggagcaggaggagg

SEQ ID NO: 3965071 - RNA, 17 nt, Human herpesvirus 4 (Epstein-Barr virus)
gcaggagcgggaggggc

SEQ ID NO: 3965072 - RNA, 14 nt, Human herpesvirus 4 (Epstein-Barr virus)
gcagucgcugcugc

SEQ ID NO: 3965073 - RNA, 21 nt, Human herpesvirus 4 (Epstein-Barr virus)
gcaucaugcgugaccaccugg

SEQ ID NO: 3965074 - RNA, 12 nt, Human herpesvirus 4 (Epstein-Barr virus)
gcaugugguggc

SEQ ID NO: 3965075 - RNA, 21 nt, Human herpesvirus 4 (Epstein-Barr virus)
gccaagguugaagagcagauu

SEQ ID NO: 3965076 - RNA, 17 nt, Human herpesvirus 4 (Epstein-Barr virus)
gccaccggcuuggcccu

SEQ ID NO: 3965077 - RNA, 21 nt, Human herpesvirus 4 (Epstein-Barr virus)
gccacgcugggaguccggccc

SEQ ID NO: 3965078 - RNA, 21 nt, Human herpesvirus 4 (Epstein-Barr virus)
gccagcgccuccucgcaggcc

SEQ ID NO: 3965079 - RNA, 13 nt, Human herpesvirus 4 (Epstein-Barr virus)
gccaggcucggca

SEQ ID NO: 3965080 - RNA, 18 nt, Human herpesvirus 4 (Epstein-Barr virus)
gccaguguggcuggggcu

SEQ ID NO: 3965081 - RNA, 21 nt, Human herpesvirus 4 (Epstein-Barr virus)
gccaucgcaagcuccuuugcc

SEQ ID NO: 3965082 - RNA, 16 nt, Human herpesvirus 4 (Epstein-Barr virus)
gccauucgacaggcca

SEQ ID NO: 3965083 - RNA, 16 nt, Human herpesvirus 4 (Epstein-Barr virus)
gcccacacagcgccag

SEQ ID NO: 3965084 - RNA, 22 nt, Human herpesvirus 4 (Epstein-Barr virus)
gcccaccccacacucccuccag

SEQ ID NO: 3965085 - RNA, 18 nt, Human herpesvirus 4 (Epstein-Barr virus)
gcccagcuccgugguccu

SEQ ID NO: 3965086 - RNA, 21 nt, Human herpesvirus 4 (Epstein-Barr virus)
gccccgaaagcggcccagcag

SEQ ID NO: 3965087 - RNA, 23 nt, Human herpesvirus 4 (Epstein-Barr virus)
gccccgguccccccagaagcccc

SEQ ID NO: 3965088 - RNA, 14 nt, Human herpesvirus 4 (Epstein-Barr virus)
gcccgagccccgcc

SEQ ID NO: 3965089 - RNA, 16 nt, Human herpesvirus 4 (Epstein-Barr virus)
gcccggccgaggccug

SEQ ID NO: 3965090 - RNA, 21 nt, Human herpesvirus 4 (Epstein-Barr virus)
gcccgucuuacugcccagccu

SEQ ID NO: 3965091 - RNA, 12 nt, Human herpesvirus 4 (Epstein-Barr virus)
gcccucuccagc

SEQ ID NO: 3965092 - RNA, 15 nt, Human herpesvirus 4 (Epstein-Barr virus)
gccuacgcagaggcc

SEQ ID NO: 3965093 - RNA, 23 nt, Human herpesvirus 4 (Epstein-Barr virus)
gccucgaguaggugccuccagag

SEQ ID NO: 3965094 - RNA, 15 nt, Human herpesvirus 4 (Epstein-Barr virus)
gccucggccuggggu

SEQ ID NO: 3965095 - RNA, 20 nt, Human herpesvirus 4 (Epstein-Barr virus)
gccucuggcacgccguggcc

SEQ ID NO: 3965096 - RNA, 16 nt, Human herpesvirus 4 (Epstein-Barr virus)
gccugaguccaacauu

SEQ ID NO: 3965097 - RNA, 19 nt, Human herpesvirus 4 (Epstein-Barr virus)
gccugauauugucccccua

SEQ ID NO: 3965098 - RNA, 22 nt, Human herpesvirus 4 (Epstein-Barr virus)
gccuguggccccggcuggccau

SEQ ID NO: 3965099 - RNA, 16 nt, Human herpesvirus 4 (Epstein-Barr virus)
gccuuccucugccugg

SEQ ID NO: 3965100 - RNA, 18 nt, Human herpesvirus 4 (Epstein-Barr virus)
gccuuccucugccuggcc

SEQ ID NO: 3965101 - RNA, 17 nt, Human herpesvirus 4 (Epstein-Barr virus)
gccuugguuucagccuc

SEQ ID NO: 3965102 - RNA, 14 nt, Human herpesvirus 4 (Epstein-Barr virus)
gcgacgcucccggg

SEQ ID NO: 3965103 - RNA, 14 nt, Human herpesvirus 4 (Epstein-Barr virus)
gcgagaaaaugagc

SEQ ID NO: 3965104 - RNA, 15 nt, Human herpesvirus 4 (Epstein-Barr virus)
gcgccagcagggcac

SEQ ID NO: 3965105 - RNA, 18 nt, Human herpesvirus 4 (Epstein-Barr virus)
gcgcccugucaccaggcc

SEQ ID NO: 3965106 - RNA, 12 nt, Human herpesvirus 4 (Epstein-Barr virus)
gcgcggcagagg

SEQ ID NO: 3965107 - RNA, 15 nt, Human herpesvirus 4 (Epstein-Barr virus)
gcgcuggcuccaggg

SEQ ID NO: 3965108 - RNA, 13 nt, Human herpesvirus 4 (Epstein-Barr virus)
gcggacugcgccu

SEQ ID NO: 3965109 - RNA, 12 nt, Human herpesvirus 4 (Epstein-Barr virus)
gcggagauggau

SEQ ID NO: 3965110 - RNA, 15 nt, Human herpesvirus 4 (Epstein-Barr virus)
gcggcacuguggggg

SEQ ID NO: 3965111 - RNA, 20 nt, Human herpesvirus 4 (Epstein-Barr virus)
gcggcccagcagauccaggg

SEQ ID NO: 3965112 - RNA, 15 nt, Human herpesvirus 4 (Epstein-Barr virus)
gcgggaggggcagga

SEQ ID NO: 3965113 - RNA, 21 nt, Human herpesvirus 4 (Epstein-Barr virus)
gcguaggucuauggggacccu

SEQ ID NO: 3965114 - RNA, 19 nt, Human herpesvirus 4 (Epstein-Barr virus)
gcgugaagucgguguccag

SEQ ID NO: 3965115 - RNA, 21 nt, Human herpesvirus 4 (Epstein-Barr virus)
gcuaaucgcugguggcaguau

SEQ ID NO: 3965116 - RNA, 15 nt, Human herpesvirus 4 (Epstein-Barr virus)
gcuacuugcucaggu

SEQ ID NO: 3965117 - RNA, 17 nt, Human herpesvirus 4 (Epstein-Barr virus)
gcucaccccugugcagg

SEQ ID NO: 3965118 - RNA, 22 nt, Human herpesvirus 4 (Epstein-Barr virus)
gcucagacuuagggccggggcc

SEQ ID NO: 3965119 - RNA, 19 nt, Human herpesvirus 4 (Epstein-Barr virus)
gcucaugcacaccuuggcg

SEQ ID NO: 3965120 - RNA, 20 nt, Human herpesvirus 4 (Epstein-Barr virus)
gcucccgggcaaacagggca

SEQ ID NO: 3965121 - RNA, 16 nt, Human herpesvirus 4 (Epstein-Barr virus)
gcucgaauaugaugag

SEQ ID NO: 3965122 - RNA, 19 nt, Human herpesvirus 4 (Epstein-Barr virus)
gcucuggucgcccccucug

SEQ ID NO: 3965123 - RNA, 17 nt, Human herpesvirus 4 (Epstein-Barr virus)
gcucuucaaccuuggca

SEQ ID NO: 3965124 - RNA, 13 nt, Human herpesvirus 4 (Epstein-Barr virus)
gcugacccuucug

SEQ ID NO: 3965125 - RNA, 18 nt, Human herpesvirus 4 (Epstein-Barr virus)
gcugaugugcugccccaa

SEQ ID NO: 3965126 - RNA, 14 nt, Human herpesvirus 4 (Epstein-Barr virus)
gcugcugcugguca

SEQ ID NO: 3965127 - RNA, 21 nt, Human herpesvirus 4 (Epstein-Barr virus)
gcuggacgugaaccucccccc

SEQ ID NO: 3965128 - RNA, 14 nt, Human herpesvirus 4 (Epstein-Barr virus)
aauggaauauuaau

SEQ ID NO: 3965129 - RNA, 22 nt, Human herpesvirus 4 (Epstein-Barr virus)
acaaaauggggguuggagaaag

SEQ ID NO: 3965130 - RNA, 23 nt, Human herpesvirus 4 (Epstein-Barr virus)
acaaacaccaguguccagagagg

SEQ ID NO: 3965131 - RNA, 13 nt, Human herpesvirus 4 (Epstein-Barr virus)
acaacggccgaga

SEQ ID NO: 3965132 - RNA, 22 nt, Human herpesvirus 4 (Epstein-Barr virus)
acaaggagugccucugggugcu

SEQ ID NO: 3965133 - RNA, 16 nt, Human herpesvirus 4 (Epstein-Barr virus)
acacagcgccagcagg

SEQ ID NO: 3965134 - RNA, 19 nt, Human herpesvirus 4 (Epstein-Barr virus)
acacaucuggaccagaagg

SEQ ID NO: 3965135 - RNA, 18 nt, Human herpesvirus 4 (Epstein-Barr virus)
acacccccacuuuuccaa

SEQ ID NO: 3965136 - RNA, 17 nt, Human herpesvirus 4 (Epstein-Barr virus)
acacuuuagagcucugg

SEQ ID NO: 3965137 - RNA, 18 nt, Human herpesvirus 4 (Epstein-Barr virus)
acagcagcguccuggccc

SEQ ID NO: 3965138 - RNA, 16 nt, Human herpesvirus 4 (Epstein-Barr virus)
acagcagcuggaugua

SEQ ID NO: 3965139 - RNA, 23 nt, Human herpesvirus 4 (Epstein-Barr virus)
acaggagacguggguccccucug

SEQ ID NO: 3965140 - RNA, 17 nt, Human herpesvirus 4 (Epstein-Barr virus)
acaggcugcugaaaacc

SEQ ID NO: 3965141 - RNA, 19 nt, Human herpesvirus 4 (Epstein-Barr virus)
acauuacggugcuggagau

SEQ ID NO: 3965142 - RNA, 23 nt, Human herpesvirus 4 (Epstein-Barr virus)
acauucguacaucuccaggcgac

SEQ ID NO: 3965143 - RNA, 14 nt, Human herpesvirus 4 (Epstein-Barr virus)
accaguggcugccc

SEQ ID NO: 3965144 - RNA, 13 nt, Human herpesvirus 4 (Epstein-Barr virus)
accauccacagcc

SEQ ID NO: 3965145 - RNA, 14 nt, Human herpesvirus 4 (Epstein-Barr virus)
acccaucugagggc

SEQ ID NO: 3965146 - RNA, 12 nt, Human herpesvirus 4 (Epstein-Barr virus)
accccccucuga

SEQ ID NO: 3965147 - RNA, 14 nt, Human herpesvirus 4 (Epstein-Barr virus)
acccgaucagagcc

SEQ ID NO: 3965148 - RNA, 18 nt, Human herpesvirus 4 (Epstein-Barr virus)
acccggguucgggcacgc

SEQ ID NO: 3965149 - RNA, 22 nt, Human herpesvirus 4 (Epstein-Barr virus)
acccucgcgccccaucuuggcc

SEQ ID NO: 3965150 - RNA, 16 nt, Human herpesvirus 4 (Epstein-Barr virus)
acccuucugcugcugc

SEQ ID NO: 3965151 - RNA, 18 nt, Human herpesvirus 4 (Epstein-Barr virus)
accgcgaccaagacucaa

SEQ ID NO: 3965152 - RNA, 18 nt, Human herpesvirus 4 (Epstein-Barr virus)
accggcaccgccaggugg

SEQ ID NO: 3965153 - RNA, 15 nt, Human herpesvirus 4 (Epstein-Barr virus)
accgucagccacaca

SEQ ID NO: 3965154 - RNA, 15 nt, Human herpesvirus 4 (Epstein-Barr virus)
accucuguuccuucu

SEQ ID NO: 3965155 - RNA, 15 nt, Human herpesvirus 4 (Epstein-Barr virus)
accuggacuggggug

SEQ ID NO: 3965156 - RNA, 20 nt, Human herpesvirus 4 (Epstein-Barr virus)
accuguccuugucugcugcc

SEQ ID NO: 3965157 - RNA, 19 nt, Human herpesvirus 4 (Epstein-Barr virus)
accuuaacuggcacacacu

SEQ ID NO: 3965158 - RNA, 20 nt, Human herpesvirus 4 (Epstein-Barr virus)
accuucugucuguaaacuau

SEQ ID NO: 3965159 - RNA, 19 nt, Human herpesvirus 4 (Epstein-Barr virus)
accuuuugucuccccucug

SEQ ID NO: 3965160 - RNA, 20 nt, Human herpesvirus 4 (Epstein-Barr virus)
acgcagaggccugcaccagu

SEQ ID NO: 3965161 - RNA, 21 nt, Human herpesvirus 4 (Epstein-Barr virus)
acgcccaguaugcagucucaa

SEQ ID NO: 3965162 - RNA, 17 nt, Human herpesvirus 4 (Epstein-Barr virus)
acgccugcuucacgccu

SEQ ID NO: 3965163 - RNA, 16 nt, Human herpesvirus 4 (Epstein-Barr virus)
acgcgcagugccaaga

SEQ ID NO: 3965164 - RNA, 16 nt, Human herpesvirus 4 (Epstein-Barr virus)
acgcuguccgccagga

SEQ ID NO: 3965165 - RNA, 23 nt, Human herpesvirus 4 (Epstein-Barr virus)
acgcuuuugucugccuggauucu

SEQ ID NO: 3965166 - RNA, 14 nt, Human herpesvirus 4 (Epstein-Barr virus)
acgggggucaagca

SEQ ID NO: 3965167 - RNA, 17 nt, Human herpesvirus 4 (Epstein-Barr virus)
acgucuuguaaaacuug

SEQ ID NO: 3965168 - RNA, 21 nt, Human herpesvirus 4 (Epstein-Barr virus)
acguggcugcgguggugcgca

SEQ ID NO: 3965169 - RNA, 17 nt, Human herpesvirus 4 (Epstein-Barr virus)
acguuggcgggacuggc

SEQ ID NO: 3965170 - RNA, 11 nt, Human herpesvirus 4 (Epstein-Barr virus)
acguuggcuuc

SEQ ID NO: 3965171 - RNA, 19 nt, Human herpesvirus 4 (Epstein-Barr virus)
acuaaaguuggucaggcug

SEQ ID NO: 3965172 - RNA, 14 nt, Human herpesvirus 4 (Epstein-Barr virus)
acucaucucaaggg

SEQ ID NO: 3965173 - RNA, 17 nt, Human herpesvirus 4 (Epstein-Barr virus)
acucccccaaacauguc

SEQ ID NO: 3965174 - RNA, 23 nt, Human herpesvirus 4 (Epstein-Barr virus)
acuccccucuccauucccagccc

SEQ ID NO: 3965175 - RNA, 18 nt, Human herpesvirus 4 (Epstein-Barr virus)
acuccggacgcagaggcc

SEQ ID NO: 3965176 - RNA, 17 nt, Human herpesvirus 4 (Epstein-Barr virus)
acuccggggguccagcc

SEQ ID NO: 3965177 - RNA, 14 nt, Human herpesvirus 4 (Epstein-Barr virus)
acuccucuuacacc

SEQ ID NO: 3965178 - RNA, 17 nt, Human herpesvirus 4 (Epstein-Barr virus)
acucucucccccgggcg

SEQ ID NO: 3965179 - RNA, 20 nt, Human herpesvirus 4 (Epstein-Barr virus)
acucuggggucucaggccuc

SEQ ID NO: 3965180 - RNA, 17 nt, Human herpesvirus 4 (Epstein-Barr virus)
acuggugcuuguggugu

SEQ ID NO: 3965181 - RNA, 13 nt, Human herpesvirus 4 (Epstein-Barr virus)
acuuagggccggg

SEQ ID NO: 3965182 - RNA, 20 nt, Human herpesvirus 4 (Epstein-Barr virus)
acuuauuggagaugcucugg

SEQ ID NO: 3965183 - RNA, 22 nt, Human herpesvirus 4 (Epstein-Barr virus)
acuucauucucaaacagucccg

SEQ ID NO: 3965184 - RNA, 16 nt, Human herpesvirus 4 (Epstein-Barr virus)
acuucuggaacauuug

SEQ ID NO: 3965185 - RNA, 18 nt, Human herpesvirus 4 (Epstein-Barr virus)
acuuuguuuagggacaga

SEQ ID NO: 3965186 - RNA, 17 nt, Human herpesvirus 4 (Epstein-Barr virus)
agaacggacugcggaga

SEQ ID NO: 3965187 - RNA, 13 nt, Human herpesvirus 4 (Epstein-Barr virus)
agaagcccaccua

SEQ ID NO: 3965188 - RNA, 21 nt, Human herpesvirus 4 (Epstein-Barr virus)
agaaguuaccugguauuucug

SEQ ID NO: 3965189 - RNA, 14 nt, Human herpesvirus 4 (Epstein-Barr virus)
agaccugaucaggg

SEQ ID NO: 3965190 - RNA, 23 nt, Human herpesvirus 4 (Epstein-Barr virus)
agacguguguggcuguagccacc

SEQ ID NO: 3965191 - RNA, 23 nt, Human herpesvirus 4 (Epstein-Barr virus)
agagauucgagaggaugaggcug

SEQ ID NO: 3965192 - RNA, 18 nt, Human herpesvirus 4 (Epstein-Barr virus)
agagauuucauccucaga

SEQ ID NO: 3965193 - RNA, 22 nt, Human herpesvirus 4 (Epstein-Barr virus)
agaggccucugggguccaggag

SEQ ID NO: 3965194 - RNA, 13 nt, Human herpesvirus 4 (Epstein-Barr virus)
agaggcucaggcc

SEQ ID NO: 3965195 - RNA, 23 nt, Human herpesvirus 4 (Epstein-Barr virus)
agaggcucaggccaugcgcgccc

SEQ ID NO: 3965196 - RNA, 16 nt, Human herpesvirus 4 (Epstein-Barr virus)
agaguaauugcagugg

SEQ ID NO: 3965197 - RNA, 20 nt, Human herpesvirus 4 (Epstein-Barr virus)
agagucuaucaggaccuggg

SEQ ID NO: 3965198 - RNA, 22 nt, Human herpesvirus 4 (Epstein-Barr virus)
agauccaacuccggcccacgcc

SEQ ID NO: 3965199 - RNA, 12 nt, Human herpesvirus 4 (Epstein-Barr virus)
agauccuucugg

SEQ ID NO: 3965200 - RNA, 13 nt, Human herpesvirus 4 (Epstein-Barr virus)
agaugcugccgcu

SEQ ID NO: 3965201 - RNA, 15 nt, Human herpesvirus 4 (Epstein-Barr virus)
agcaaacggccuggc

SEQ ID NO: 3965202 - RNA, 13 nt, Human herpesvirus 4 (Epstein-Barr virus)
agcaacugcugca

SEQ ID NO: 3965203 - RNA, 20 nt, Human herpesvirus 4 (Epstein-Barr virus)
agcacaagugauuaggagca

SEQ ID NO: 3965204 - RNA, 17 nt, Human herpesvirus 4 (Epstein-Barr virus)
agcagaaggccauggag

SEQ ID NO: 3965205 - RNA, 16 nt, Human herpesvirus 4 (Epstein-Barr virus)
agcaggacggggggcu

SEQ ID NO: 3965206 - RNA, 13 nt, Human herpesvirus 4 (Epstein-Barr virus)
agcaggaggaggg

SEQ ID NO: 3965207 - RNA, 16 nt, Human herpesvirus 4 (Epstein-Barr virus)
agcaggauuccugauu

SEQ ID NO: 3965208 - RNA, 13 nt, Human herpesvirus 4 (Epstein-Barr virus)
agcagggcccagu

SEQ ID NO: 3965209 - RNA, 15 nt, Human herpesvirus 4 (Epstein-Barr virus)
agccacauucuggaa

SEQ ID NO: 3965210 - RNA, 22 nt, Human herpesvirus 4 (Epstein-Barr virus)
agccacccgucccggguacaag

SEQ ID NO: 3965211 - RNA, 15 nt, Human herpesvirus 4 (Epstein-Barr virus)
agccagcgcacccgg

SEQ ID NO: 3965212 - RNA, 15 nt, Human herpesvirus 4 (Epstein-Barr virus)
agccccagccccucc

SEQ ID NO: 3965213 - RNA, 12 nt, Human herpesvirus 4 (Epstein-Barr virus)
agcccccucucg

SEQ ID NO: 3965214 - RNA, 22 nt, Human herpesvirus 4 (Epstein-Barr virus)
agcccgacccccgggcgccccc

SEQ ID NO: 3965215 - RNA, 15 nt, Human herpesvirus 4 (Epstein-Barr virus)
agccugagccacacc

SEQ ID NO: 3965216 - RNA, 23 nt, Human herpesvirus 4 (Epstein-Barr virus)
auagcgugaagucgguguccagg

SEQ ID NO: 3965217 - RNA, 15 nt, Human herpesvirus 4 (Epstein-Barr virus)
aucaauggaacccua

SEQ ID NO: 3965218 - RNA, 23 nt, Human herpesvirus 4 (Epstein-Barr virus)
aucaucucgcuggcucgccucau

SEQ ID NO: 3965219 - RNA, 12 nt, Human herpesvirus 4 (Epstein-Barr virus)
aucucagggaca

SEQ ID NO: 3965220 - RNA, 16 nt, Human herpesvirus 4 (Epstein-Barr virus)
aucucuugcgcccagg

SEQ ID NO: 3965221 - RNA, 14 nt, Human herpesvirus 4 (Epstein-Barr virus)
aucugaccacggcc

SEQ ID NO: 3965222 - RNA, 18 nt, Human herpesvirus 4 (Epstein-Barr virus)
augaccaacaugagggca

SEQ ID NO: 3965223 - RNA, 13 nt, Human herpesvirus 4 (Epstein-Barr virus)
augacgcugcugc

SEQ ID NO: 3965224 - RNA, 13 nt, Human herpesvirus 4 (Epstein-Barr virus)
augaggcugauga

SEQ ID NO: 3965225 - RNA, 17 nt, Human herpesvirus 4 (Epstein-Barr virus)
augcagaaggggcccug

SEQ ID NO: 3965226 - RNA, 23 nt, Human herpesvirus 4 (Epstein-Barr virus)
augccccccguaaaacuccacag

SEQ ID NO: 3965227 - RNA, 17 nt, Human herpesvirus 4 (Epstein-Barr virus)
auggagaggggaguggg

SEQ ID NO: 3965228 - RNA, 16 nt, Human herpesvirus 4 (Epstein-Barr virus)
auggcacgggcagagg

SEQ ID NO: 3965229 - RNA, 23 nt, Human herpesvirus 4 (Epstein-Barr virus)
auggccuauggguuaccaggcau

SEQ ID NO: 3965230 - RNA, 23 nt, Human herpesvirus 4 (Epstein-Barr virus)
augggggcucggggcuggggaga

SEQ ID NO: 3965231 - RNA, 18 nt, Human herpesvirus 4 (Epstein-Barr virus)
augguguccggagacccc

SEQ ID NO: 3965232 - RNA, 18 nt, Human herpesvirus 4 (Epstein-Barr virus)
auguaucccaaauaaaug

SEQ ID NO: 3965233 - RNA, 20 nt, Human herpesvirus 4 (Epstein-Barr virus)
auguaucccaaauaaauguu

SEQ ID NO: 3965234 - RNA, 17 nt, Human herpesvirus 4 (Epstein-Barr virus)
augucggggcugcuggc

SEQ ID NO: 3965235 - RNA, 16 nt, Human herpesvirus 4 (Epstein-Barr virus)
auucaucagaagcuac

SEQ ID NO: 3965236 - RNA, 22 nt, Human herpesvirus 4 (Epstein-Barr virus)
auuggacgucccuuuggaggac

SEQ ID NO: 3965237 - RNA, 17 nt, Human herpesvirus 4 (Epstein-Barr virus)
auugguguuccacagcc

SEQ ID NO: 3965238 - RNA, 15 nt, Human herpesvirus 4 (Epstein-Barr virus)
auugguugaucuccu

SEQ ID NO: 3965239 - RNA, 22 nt, Human herpesvirus 4 (Epstein-Barr virus)
caaaccaugacaucacagagga

SEQ ID NO: 3965240 - RNA, 22 nt, Human herpesvirus 4 (Epstein-Barr virus)
caaaccuccaaucaccagccac

SEQ ID NO: 3965241 - RNA, 18 nt, Human herpesvirus 4 (Epstein-Barr virus)
caaacugcgagggggccu

SEQ ID NO: 3965242 - RNA, 15 nt, Human herpesvirus 4 (Epstein-Barr virus)
caaauaaauguuacu

SEQ ID NO: 3965243 - RNA, 22 nt, Human herpesvirus 4 (Epstein-Barr virus)
caaauaaauguuacuucuuuug

SEQ ID NO: 3965244 - RNA, 16 nt, Human herpesvirus 4 (Epstein-Barr virus)
caacaggugcccgagc

SEQ ID NO: 3965245 - RNA, 21 nt, Human herpesvirus 4 (Epstein-Barr virus)
caacccccggcucucaggccu

SEQ ID NO: 3965246 - RNA, 19 nt, Human herpesvirus 4 (Epstein-Barr virus)
caaccugauucccccugcu

SEQ ID NO: 3965247 - RNA, 14 nt, Human herpesvirus 4 (Epstein-Barr virus)
caacugcgggcucc

SEQ ID NO: 3965248 - RNA, 14 nt, Human herpesvirus 4 (Epstein-Barr virus)
ggagucuggacgug

SEQ ID NO: 3965249 - RNA, 21 nt, Human herpesvirus 4 (Epstein-Barr virus)
ggcaccccacggggugcuccc

SEQ ID NO: 3965250 - RNA, 19 nt, Human herpesvirus 4 (Epstein-Barr virus)
ggcagacaccaccugcucg

SEQ ID NO: 3965251 - RNA, 18 nt, Human herpesvirus 4 (Epstein-Barr virus)
ggccaaccugccucucuu

SEQ ID NO: 3965252 - RNA, 21 nt, Human herpesvirus 4 (Epstein-Barr virus)
ggcccacgccauaccugcacg

SEQ ID NO: 3965253 - RNA, 17 nt, Human herpesvirus 4 (Epstein-Barr virus)
ggcccagugcacccagg

SEQ ID NO: 3965254 - RNA, 21 nt, Human herpesvirus 4 (Epstein-Barr virus)
ggccccccgcaccagggccag

SEQ ID NO: 3965255 - RNA, 22 nt, Human herpesvirus 4 (Epstein-Barr virus)
ggcccugaucugggagaugaga

SEQ ID NO: 3965256 - RNA, 18 nt, Human herpesvirus 4 (Epstein-Barr virus)
ggcccuuugccuggggcu

SEQ ID NO: 3965257 - RNA, 12 nt, Human herpesvirus 4 (Epstein-Barr virus)
ggccugagagcc

SEQ ID NO: 3965258 - RNA, 15 nt, Human herpesvirus 4 (Epstein-Barr virus)
ggccugcuggccgag

SEQ ID NO: 3965259 - RNA, 20 nt, Human herpesvirus 4 (Epstein-Barr virus)
ggccugggaggugcugaggc

SEQ ID NO: 3965260 - RNA, 11 nt, Human herpesvirus 4 (Epstein-Barr virus)
ggccuggugcc

SEQ ID NO: 3965261 - RNA, 17 nt, Human herpesvirus 4 (Epstein-Barr virus)
ggcggagaagacgggcu

SEQ ID NO: 3965262 - RNA, 23 nt, Human herpesvirus 4 (Epstein-Barr virus)
ggcguaacuugucuacaucccau

SEQ ID NO: 3965263 - RNA, 15 nt, Human herpesvirus 4 (Epstein-Barr virus)
ggcgucucaggcuau

SEQ ID NO: 3965264 - RNA, 18 nt, Human herpesvirus 4 (Epstein-Barr virus)
ggcuccuggaucuggggc

SEQ ID NO: 3965265 - RNA, 15 nt, Human herpesvirus 4 (Epstein-Barr virus)
ggcucgacgcgggcc

SEQ ID NO: 3965266 - RNA, 19 nt, Human herpesvirus 4 (Epstein-Barr virus)
ggcuggcaaagauccccag

SEQ ID NO: 3965267 - RNA, 21 nt, Human herpesvirus 4 (Epstein-Barr virus)
ggcuguacgccgccgccagca

SEQ ID NO: 3965268 - RNA, 16 nt, Human herpesvirus 4 (Epstein-Barr virus)
gggaacgugacaggca

SEQ ID NO: 3965269 - RNA, 12 nt, Human herpesvirus 4 (Epstein-Barr virus)
gggacugccugg

SEQ ID NO: 3965270 - RNA, 15 nt, Human herpesvirus 4 (Epstein-Barr virus)
gggaucaugaagccc

SEQ ID NO: 3965271 - RNA, 21 nt, Human herpesvirus 4 (Epstein-Barr virus)
gggaucuuuacguggguggau

SEQ ID NO: 3965272 - RNA, 21 nt, Human herpesvirus 4 (Epstein-Barr virus)
gggaugggcuugauggcccug

SEQ ID NO: 3965273 - RNA, 18 nt, Human herpesvirus 4 (Epstein-Barr virus)
gggccuagguacucuugg

SEQ ID NO: 3965274 - RNA, 17 nt, Human herpesvirus 4 (Epstein-Barr virus)
gggccuuccagagcucu

SEQ ID NO: 3965275 - RNA, 12 nt, Human herpesvirus 4 (Epstein-Barr virus)
ggggaagaggac

SEQ ID NO: 3965276 - RNA, 14 nt, Human herpesvirus 4 (Epstein-Barr virus)
ggggagggagcccg

SEQ ID NO: 3965277 - RNA, 22 nt, Human herpesvirus 4 (Epstein-Barr virus)
ggggaguaaggccgcugccagg

SEQ ID NO: 3965278 - RNA, 18 nt, Human herpesvirus 4 (Epstein-Barr virus)
ggggauuacccgacccag

SEQ ID NO: 3965279 - RNA, 19 nt, Human herpesvirus 4 (Epstein-Barr virus)
ggggcaggaggggcaggag

SEQ ID NO: 3965280 - RNA, 21 nt, Human herpesvirus 4 (Epstein-Barr virus)
ggggcgauaccuugggcauca

SEQ ID NO: 3965281 - RNA, 13 nt, Human herpesvirus 4 (Epstein-Barr virus)
gggggaaugaggg

SEQ ID NO: 3965282 - RNA, 13 nt, Human herpesvirus 4 (Epstein-Barr virus)
gggugggcugguu

SEQ ID NO: 3965283 - RNA, 21 nt, Human herpesvirus 4 (Epstein-Barr virus)
gguaaggcucuucgggcaaga

SEQ ID NO: 3965284 - RNA, 18 nt, Human herpesvirus 4 (Epstein-Barr virus)
gguagccuugggggccug

SEQ ID NO: 3965285 - RNA, 16 nt, Human herpesvirus 4 (Epstein-Barr virus)
ggucaccccagaugcc

SEQ ID NO: 3965286 - RNA, 19 nt, Human herpesvirus 4 (Epstein-Barr virus)
gguccaucuuaggagcccg

SEQ ID NO: 3965287 - RNA, 15 nt, Human herpesvirus 4 (Epstein-Barr virus)
gguccugaggggcgg

SEQ ID NO: 3965288 - RNA, 16 nt, Human herpesvirus 4 (Epstein-Barr virus)
ggugccuccagagccc

SEQ ID NO: 3965289 - RNA, 23 nt, Human herpesvirus 4 (Epstein-Barr virus)
ggugccugagacagaggugcuca

SEQ ID NO: 3965290 - RNA, 13 nt, Human herpesvirus 4 (Epstein-Barr virus)
ggugcucccccug

SEQ ID NO: 3965291 - RNA, 15 nt, Human herpesvirus 4 (Epstein-Barr virus)
ggugcuguccugcug

SEQ ID NO: 3965292 - RNA, 16 nt, Human herpesvirus 4 (Epstein-Barr virus)
gguggcuugggcugug

SEQ ID NO: 3965293 - RNA, 21 nt, Human herpesvirus 4 (Epstein-Barr virus)
ggugggacaaaauggggucug

SEQ ID NO: 3965294 - RNA, 17 nt, Human herpesvirus 4 (Epstein-Barr virus)
gguguagugggugggca

SEQ ID NO: 3965295 - RNA, 21 nt, Human herpesvirus 4 (Epstein-Barr virus)
gguuugcccaacucuuauucu

SEQ ID NO: 3965296 - RNA, 22 nt, Human herpesvirus 4 (Epstein-Barr virus)
guaaaauuuacaccugacccau

SEQ ID NO: 3965297 - RNA, 16 nt, Human herpesvirus 4 (Epstein-Barr virus)
guaacuugucuacauc

SEQ ID NO: 3965298 - RNA, 23 nt, Human herpesvirus 4 (Epstein-Barr virus)
guacccuuucuaccaggggcgag

SEQ ID NO: 3965299 - RNA, 17 nt, Human herpesvirus 4 (Epstein-Barr virus)
guagaggcgcgggucug

SEQ ID NO: 3965300 - RNA, 14 nt, Human herpesvirus 4 (Epstein-Barr virus)
guauccaccuagaa

SEQ ID NO: 3965301 - RNA, 14 nt, Human herpesvirus 4 (Epstein-Barr virus)
gucaccugcacaga

SEQ ID NO: 3965302 - RNA, 16 nt, Human herpesvirus 4 (Epstein-Barr virus)
gucaccugcacagauc

SEQ ID NO: 3965303 - RNA, 18 nt, Human herpesvirus 4 (Epstein-Barr virus)
gucacuaaaguuggucag

SEQ ID NO: 3965304 - RNA, 20 nt, Human herpesvirus 4 (Epstein-Barr virus)
gucauucuaucaauuaaaca

SEQ ID NO: 3965305 - RNA, 22 nt, Human herpesvirus 4 (Epstein-Barr virus)
gucauuuauuaggcacaaacuu

SEQ ID NO: 3965306 - RNA, 21 nt, Human herpesvirus 4 (Epstein-Barr virus)
guccagaagcagauagccggc

SEQ ID NO: 3965307 - RNA, 14 nt, Human herpesvirus 4 (Epstein-Barr virus)
guccaggagucugc

SEQ ID NO: 3965308 - RNA, 18 nt, Human herpesvirus 4 (Epstein-Barr virus)
guccaggggccacacagc

SEQ ID NO: 3965309 - RNA, 17 nt, Human herpesvirus 4 (Epstein-Barr virus)
guccaggguccaggaga

SEQ ID NO: 3965310 - RNA, 14 nt, Human herpesvirus 4 (Epstein-Barr virus)
guccgcugggccag

SEQ ID NO: 3965311 - RNA, 19 nt, Human herpesvirus 4 (Epstein-Barr virus)
guccugaauccgcgcagcc

SEQ ID NO: 3965312 - RNA, 21 nt, Human herpesvirus 4 (Epstein-Barr virus)
gucgaugggcagcuauauuca

SEQ ID NO: 3965313 - RNA, 16 nt, Human herpesvirus 4 (Epstein-Barr virus)
gucgcccccucugccu

SEQ ID NO: 3965314 - RNA, 19 nt, Human herpesvirus 4 (Epstein-Barr virus)
gucuagccacauagcaggu

SEQ ID NO: 3965315 - RNA, 14 nt, Human herpesvirus 4 (Epstein-Barr virus)
gucuccgggucagg

SEQ ID NO: 3965316 - RNA, 16 nt, Human herpesvirus 4 (Epstein-Barr virus)
gucucuuucuggccaa

SEQ ID NO: 3965317 - RNA, 15 nt, Human herpesvirus 4 (Epstein-Barr virus)
gucuggcagggggcc

SEQ ID NO: 3965318 - RNA, 22 nt, Human herpesvirus 4 (Epstein-Barr virus)
gucugugguugucuucccagac

SEQ ID NO: 3965319 - RNA, 23 nt, Human herpesvirus 4 (Epstein-Barr virus)
gucuucugucucggccuccuggc

SEQ ID NO: 3965320 - RNA, 21 nt, Human herpesvirus 4 (Epstein-Barr virus)
gugacgaagacccaucugagg

SEQ ID NO: 3965321 - RNA, 18 nt, Human herpesvirus 4 (Epstein-Barr virus)
gugaugaaaacagaggcu

SEQ ID NO: 3965322 - RNA, 15 nt, Human herpesvirus 4 (Epstein-Barr virus)
gugccucugggugcu

SEQ ID NO: 3965323 - RNA, 14 nt, Human herpesvirus 4 (Epstein-Barr virus)
guggaacaggagca

SEQ ID NO: 3965324 - RNA, 20 nt, Human herpesvirus 4 (Epstein-Barr virus)
guggccucuacgccaggcuc

SEQ ID NO: 3965325 - RNA, 13 nt, Human herpesvirus 4 (Epstein-Barr virus)
guggcugcggugg

SEQ ID NO: 3965326 - RNA, 19 nt, Human herpesvirus 4 (Epstein-Barr virus)
gugucuggcggccgcugcg

SEQ ID NO: 3965327 - RNA, 14 nt, Human herpesvirus 4 (Epstein-Barr virus)
gugucuguaaucuc

SEQ ID NO: 3965328 - RNA, 19 nt, Human herpesvirus 4 (Epstein-Barr virus)
guucacugcguagaugagc

SEQ ID NO: 3965329 - RNA, 17 nt, Human herpesvirus 4 (Epstein-Barr virus)
guucagggacuuguccu

SEQ ID NO: 3965330 - RNA, 23 nt, Human herpesvirus 4 (Epstein-Barr virus)
guugagcccgacgaacuccucca

SEQ ID NO: 3965331 - RNA, 22 nt, Human herpesvirus 4 (Epstein-Barr virus)
guuggcuucugcugcugcuugu

SEQ ID NO: 3965332 - RNA, 16 nt, Human herpesvirus 4 (Epstein-Barr virus)
guugucuucccagacu

SEQ ID NO: 3965333 - RNA, 23 nt, Human herpesvirus 4 (Epstein-Barr virus)
guuucggcgccgcccgggggcca

SEQ ID NO: 3965334 - RNA, 14 nt, Human herpesvirus 4 (Epstein-Barr virus)
guuugcauugcugg

SEQ ID NO: 3965335 - RNA, 13 nt, Human herpesvirus 4 (Epstein-Barr virus)
guuuuaacaccug

SEQ ID NO: 3965336 - RNA, 16 nt, Human herpesvirus 4 (Epstein-Barr virus)
uaacggguggaagcau

SEQ ID NO: 3965337 - RNA, 16 nt, Human herpesvirus 4 (Epstein-Barr virus)
uaagucaugacaauuu

SEQ ID NO: 3965338 - RNA, 14 nt, Human herpesvirus 4 (Epstein-Barr virus)
uaauacgcccgaca

SEQ ID NO: 3965339 - RNA, 20 nt, Human herpesvirus 4 (Epstein-Barr virus)
uaaugauucaucagaagcua

SEQ ID NO: 3965340 - RNA, 20 nt, Human herpesvirus 4 (Epstein-Barr virus)
uaauucucuucuguuugcau

SEQ ID NO: 3965341 - RNA, 21 nt, Human herpesvirus 4 (Epstein-Barr virus)
uacaacucagccccaucuucc

SEQ ID NO: 3965342 - RNA, 23 nt, Human herpesvirus 4 (Epstein-Barr virus)
uacagcuacaccgaucaccagac

SEQ ID NO: 3965343 - RNA, 15 nt, Human herpesvirus 4 (Epstein-Barr virus)
uacauuccaguuucc

SEQ ID NO: 3965344 - RNA, 17 nt, Human herpesvirus 4 (Epstein-Barr virus)
uacccggucgcauggug

SEQ ID NO: 3965345 - RNA, 23 nt, Human herpesvirus 4 (Epstein-Barr virus)
uacccucauugugcugaagccca

SEQ ID NO: 3965346 - RNA, 15 nt, Human herpesvirus 4 (Epstein-Barr virus)
uaccuggucaagagc

SEQ ID NO: 3965347 - RNA, 16 nt, Human herpesvirus 4 (Epstein-Barr virus)
uacgcugcccuagagg

SEQ ID NO: 3965348 - RNA, 23 nt, Human herpesvirus 4 (Epstein-Barr virus)
uacugcagugggccucucuggcu

SEQ ID NO: 3965349 - RNA, 23 nt, Human herpesvirus 4 (Epstein-Barr virus)
uagcccaggcacaucuggcaccu

SEQ ID NO: 3965350 - RNA, 13 nt, Human herpesvirus 4 (Epstein-Barr virus)
uagccccuaggcc

SEQ ID NO: 3965351 - RNA, 19 nt, Human herpesvirus 4 (Epstein-Barr virus)
uagccucgcgacucguggg

SEQ ID NO: 3965352 - RNA, 18 nt, Human herpesvirus 4 (Epstein-Barr virus)
uagccuugggggccugga

SEQ ID NO: 3965353 - RNA, 19 nt, Human herpesvirus 4 (Epstein-Barr virus)
uagcguagaauccagccag

SEQ ID NO: 3965354 - RNA, 16 nt, Human herpesvirus 4 (Epstein-Barr virus)
uaggagacgcccucaa

SEQ ID NO: 3965355 - RNA, 14 nt, Human herpesvirus 4 (Epstein-Barr virus)
uagugcagggggcu

SEQ ID NO: 3965356 - RNA, 21 nt, Human herpesvirus 4 (Epstein-Barr virus)
uaguggcaguucgacggccuc

SEQ ID NO: 3965357 - RNA, 17 nt, Human herpesvirus 4 (Epstein-Barr virus)
uaucccaaauaaauguu

SEQ ID NO: 3965358 - RNA, 16 nt, Human herpesvirus 4 (Epstein-Barr virus)
uaugcagaaggggccc

SEQ ID NO: 3965359 - RNA, 13 nt, Human herpesvirus 4 (Epstein-Barr virus)
uaugcagucucaa

SEQ ID NO: 3965360 - RNA, 23 nt, Human herpesvirus 4 (Epstein-Barr virus)
uaugguaaggcucuucgggcaag

SEQ ID NO: 3965361 - RNA, 15 nt, Human herpesvirus 4 (Epstein-Barr virus)
uauugccauguccaa

SEQ ID NO: 3965362 - RNA, 14 nt, Human herpesvirus 4 (Epstein-Barr virus)
uauuuacaaacacu

SEQ ID NO: 3965363 - RNA, 12 nt, Human herpesvirus 4 (Epstein-Barr virus)
uauuuacagcca

SEQ ID NO: 3965364 - RNA, 14 nt, Human herpesvirus 4 (Epstein-Barr virus)
ucaaaaucaaagua

SEQ ID NO: 3965365 - RNA, 16 nt, Human herpesvirus 4 (Epstein-Barr virus)
ucacagaccagccccu

SEQ ID NO: 3965366 - RNA, 23 nt, Human herpesvirus 4 (Epstein-Barr virus)
ucacagcugcugguuuggagaaa

SEQ ID NO: 3965367 - RNA, 17 nt, Human herpesvirus 4 (Epstein-Barr virus)
ucacauauccagagcug

SEQ ID NO: 3965368 - RNA, 17 nt, Human herpesvirus 4 (Epstein-Barr virus)
ucaccuuccagacuaug

SEQ ID NO: 3965369 - RNA, 11 nt, Human herpesvirus 4 (Epstein-Barr virus)
ucagagagcau

SEQ ID NO: 3965370 - RNA, 19 nt, Human herpesvirus 4 (Epstein-Barr virus)
ucagcacuuugccagcaac

SEQ ID NO: 3965371 - RNA, 21 nt, Human herpesvirus 4 (Epstein-Barr virus)
ucagccaccuccccuguggcc

SEQ ID NO: 3965372 - RNA, 23 nt, Human herpesvirus 4 (Epstein-Barr virus)
ucagcgagguuaagcugcaccug

SEQ ID NO: 3965373 - RNA, 12 nt, Human herpesvirus 4 (Epstein-Barr virus)
ucagcuccaggg

SEQ ID NO: 3965374 - RNA, 16 nt, Human herpesvirus 4 (Epstein-Barr virus)
ucagcuucgaggucuc

SEQ ID NO: 3965375 - RNA, 20 nt, Human herpesvirus 4 (Epstein-Barr virus)
ucaggagguacaugggccac

SEQ ID NO: 3965376 - RNA, 13 nt, Human herpesvirus 4 (Epstein-Barr virus)
ucaggccucccag

SEQ ID NO: 3965377 - RNA, 20 nt, Human herpesvirus 4 (Epstein-Barr virus)
ucagggaaaaacuggccaug

SEQ ID NO: 3965378 - RNA, 18 nt, Human herpesvirus 4 (Epstein-Barr virus)
ucaugcagggugcacaga

SEQ ID NO: 3965379 - RNA, 14 nt, Human herpesvirus 4 (Epstein-Barr virus)
ucaugcgugaccac

SEQ ID NO: 3965380 - RNA, 23 nt, Human herpesvirus 4 (Epstein-Barr virus)
ucaugcgugaccaccuggccagg

SEQ ID NO: 3965381 - RNA, 17 nt, Human herpesvirus 4 (Epstein-Barr virus)
ucaugggggaaugaggg

SEQ ID NO: 3965382 - RNA, 22 nt, Human herpesvirus 4 (Epstein-Barr virus)
uccaacauuaaagccuccucgc

SEQ ID NO: 3965383 - RNA, 15 nt, Human herpesvirus 4 (Epstein-Barr virus)
uccacucccagucca

SEQ ID NO: 3965384 - RNA, 21 nt, Human herpesvirus 4 (Epstein-Barr virus)
uccagagaggcgcagcccagc

SEQ ID NO: 3965385 - RNA, 18 nt, Human herpesvirus 4 (Epstein-Barr virus)
uccagggcccuggucagg

SEQ ID NO: 3965386 - RNA, 15 nt, Human herpesvirus 4 (Epstein-Barr virus)
uccaggugacagcag

SEQ ID NO: 3965387 - RNA, 22 nt, Human herpesvirus 4 (Epstein-Barr virus)
uccaugcaaguggaugcaucua

SEQ ID NO: 3965388 - RNA, 21 nt, Human herpesvirus 4 (Epstein-Barr virus)
ucccaaguguuuccagacacc

SEQ ID NO: 3965389 - RNA, 19 nt, Human herpesvirus 4 (Epstein-Barr virus)
ucccaccaccccccccacc

SEQ ID NO: 3965390 - RNA, 19 nt, Human herpesvirus 4 (Epstein-Barr virus)
uccccauagacucccaugu

SEQ ID NO: 3965391 - RNA, 18 nt, Human herpesvirus 4 (Epstein-Barr virus)
ucccgcgccgcaagcaug

SEQ ID NO: 3965392 - RNA, 16 nt, Human herpesvirus 4 (Epstein-Barr virus)
ucccggcacaccagac

SEQ ID NO: 3965393 - RNA, 18 nt, Human herpesvirus 4 (Epstein-Barr virus)
ucccgucauucuuucggg

SEQ ID NO: 3965394 - RNA, 16 nt, Human herpesvirus 4 (Epstein-Barr virus)
ucccucaccagggcug

SEQ ID NO: 3965395 - RNA, 15 nt, Human herpesvirus 4 (Epstein-Barr virus)
uccgaugcccaccag

SEQ ID NO: 3965396 - RNA, 19 nt, Human herpesvirus 4 (Epstein-Barr virus)
ucgagaaccccagcaacau

SEQ ID NO: 3965397 - RNA, 21 nt, Human herpesvirus 4 (Epstein-Barr virus)
ucgcacucuuguugcuagccu

SEQ ID NO: 3965398 - RNA, 22 nt, Human herpesvirus 4 (Epstein-Barr virus)
ucgcagcucuaacuuggcaucu

SEQ ID NO: 3965399 - RNA, 18 nt, Human herpesvirus 4 (Epstein-Barr virus)
ucgcagcuggaggaaugc

SEQ ID NO: 3965400 - RNA, 13 nt, Human herpesvirus 4 (Epstein-Barr virus)
ucgcaggcccccc

SEQ ID NO: 3965401 - RNA, 14 nt, Human herpesvirus 4 (Epstein-Barr virus)
ucgcccccucuuug

SEQ ID NO: 3965402 - RNA, 16 nt, Human herpesvirus 4 (Epstein-Barr virus)
uuauucuugauugccu

SEQ ID NO: 3965403 - RNA, 18 nt, Human herpesvirus 4 (Epstein-Barr virus)
uucagcuccagggccagc

SEQ ID NO: 3965404 - RNA, 20 nt, Human herpesvirus 4 (Epstein-Barr virus)
uuccacccccuggagccagc

SEQ ID NO: 3965405 - RNA, 16 nt, Human herpesvirus 4 (Epstein-Barr virus)
uuccccccagccugag

SEQ ID NO: 3965406 - RNA, 15 nt, Human herpesvirus 4 (Epstein-Barr virus)
uucccgacgccaaug

SEQ ID NO: 3965407 - RNA, 15 nt, Human herpesvirus 4 (Epstein-Barr virus)
uuccgucagccaggg

SEQ ID NO: 3965408 - RNA, 17 nt, Human herpesvirus 4 (Epstein-Barr virus)
uucuggccaaccugccu

SEQ ID NO: 3965409 - RNA, 21 nt, Human herpesvirus 4 (Epstein-Barr virus)
uucuggcgauuuuaaucugga

SEQ ID NO: 3965410 - RNA, 14 nt, Human herpesvirus 4 (Epstein-Barr virus)
uugaucuucuucuc

SEQ ID NO: 3965411 - RNA, 13 nt, Human herpesvirus 4 (Epstein-Barr virus)
uugcuagggagga

SEQ ID NO: 3965412 - RNA, 20 nt, Human herpesvirus 4 (Epstein-Barr virus)
uugcucuucgugcucuucau

SEQ ID NO: 3965413 - RNA, 22 nt, Human herpesvirus 4 (Epstein-Barr virus)
uuguauugugaggaaaggccuu

SEQ ID NO: 3965414 - RNA, 22 nt, Human herpesvirus 4 (Epstein-Barr virus)
uugucuucccagacucugcuuu

SEQ ID NO: 3965415 - RNA, 17 nt, Human herpesvirus 4 (Epstein-Barr virus)
aaagucccgagcggccu

SEQ ID NO: 3965416 - RNA, 14 nt, Human herpesvirus 4 (Epstein-Barr virus)
aacaagggaagagg

SEQ ID NO: 3965417 - RNA, 20 nt, Human herpesvirus 4 (Epstein-Barr virus)
aacccuugcccucuccagca

SEQ ID NO: 3965418 - RNA, 17 nt, Human herpesvirus 4 (Epstein-Barr virus)
aacgccggccugcuggc

SEQ ID NO: 3965419 - RNA, 17 nt, Human herpesvirus 4 (Epstein-Barr virus)
aacggcgagcaggguga

SEQ ID NO: 3965420 - RNA, 21 nt, Human herpesvirus 4 (Epstein-Barr virus)
aacucugcccuucagugucug

SEQ ID NO: 3965421 - RNA, 16 nt, Human herpesvirus 4 (Epstein-Barr virus)
aacugcgagggggccu

SEQ ID NO: 3965422 - RNA, 19 nt, Human herpesvirus 4 (Epstein-Barr virus)
aacuggccaugcaggccug

SEQ ID NO: 3965423 - RNA, 16 nt, Human herpesvirus 4 (Epstein-Barr virus)
aacugggcaucgggcu

SEQ ID NO: 3965424 - RNA, 21 nt, Human herpesvirus 4 (Epstein-Barr virus)
aacuggggcugguggccuggg

SEQ ID NO: 3965425 - RNA, 17 nt, Human herpesvirus 4 (Epstein-Barr virus)
aacugucacaccagucc

SEQ ID NO: 3965426 - RNA, 20 nt, Human herpesvirus 4 (Epstein-Barr virus)
aagaacacuccacagaugga

SEQ ID NO: 3965427 - RNA, 13 nt, Human herpesvirus 4 (Epstein-Barr virus)
aagacuccugccu

SEQ ID NO: 3965428 - RNA, 17 nt, Human herpesvirus 4 (Epstein-Barr virus)
aagaucgugaggccuga

SEQ ID NO: 3965429 - RNA, 13 nt, Human herpesvirus 4 (Epstein-Barr virus)
aagcaauaaagua

SEQ ID NO: 3965430 - RNA, 15 nt, Human herpesvirus 4 (Epstein-Barr virus)
aagccugccucaucc

SEQ ID NO: 3965431 - RNA, 22 nt, Human herpesvirus 4 (Epstein-Barr virus)
aagcuacaaacacgggccuggg

SEQ ID NO: 3965432 - RNA, 21 nt, Human herpesvirus 4 (Epstein-Barr virus)
aagcuggacgugaaccucccc

SEQ ID NO: 3965433 - RNA, 14 nt, Human herpesvirus 4 (Epstein-Barr virus)
aagcuugcuggggc

SEQ ID NO: 3965434 - RNA, 14 nt, Human herpesvirus 4 (Epstein-Barr virus)
aaggcaguccaggg

SEQ ID NO: 3965435 - RNA, 15 nt, Human herpesvirus 4 (Epstein-Barr virus)
aaggccacaaagagg

SEQ ID NO: 3965436 - RNA, 15 nt, Human herpesvirus 4 (Epstein-Barr virus)
aaggcggagaagacg

SEQ ID NO: 3965437 - RNA, 18 nt, Human herpesvirus 4 (Epstein-Barr virus)
aagucaggauucucuaau

SEQ ID NO: 3965438 - RNA, 20 nt, Human herpesvirus 4 (Epstein-Barr virus)
aagucuauacggccacaacc

SEQ ID NO: 3965439 - RNA, 15 nt, Human herpesvirus 4 (Epstein-Barr virus)
aagugauuaggagca

SEQ ID NO: 3965440 - RNA, 20 nt, Human herpesvirus 4 (Epstein-Barr virus)
aagugauuaggagcagggcc

SEQ ID NO: 3965441 - RNA, 16 nt, Human herpesvirus 4 (Epstein-Barr virus)
aaucaaaacuuuagag

SEQ ID NO: 3965442 - RNA, 12 nt, Human herpesvirus 4 (Epstein-Barr virus)
aaugaacacuca

SEQ ID NO: 3965443 - RNA, 16 nt, Human herpesvirus 4 (Epstein-Barr virus)
agccuuauuuggacau

SEQ ID NO: 3965444 - RNA, 19 nt, Human herpesvirus 4 (Epstein-Barr virus)
agcgaagcagcuccgcccu

SEQ ID NO: 3965445 - RNA, 18 nt, Human herpesvirus 4 (Epstein-Barr virus)
agcgaggauaaucugggc

SEQ ID NO: 3965446 - RNA, 21 nt, Human herpesvirus 4 (Epstein-Barr virus)
agcgcccugucccuggagcug

SEQ ID NO: 3965447 - RNA, 21 nt, Human herpesvirus 4 (Epstein-Barr virus)
agcgccucgcucagcccacua

SEQ ID NO: 3965448 - RNA, 15 nt, Human herpesvirus 4 (Epstein-Barr virus)
agcgcggcagaggcc

SEQ ID NO: 3965449 - RNA, 15 nt, Human herpesvirus 4 (Epstein-Barr virus)
agcggccuccgccgu

SEQ ID NO: 3965450 - RNA, 20 nt, Human herpesvirus 4 (Epstein-Barr virus)
agcucauaugccgcugcaca

SEQ ID NO: 3965451 - RNA, 15 nt, Human herpesvirus 4 (Epstein-Barr virus)
agcucuaacuuggca

SEQ ID NO: 3965452 - RNA, 21 nt, Human herpesvirus 4 (Epstein-Barr virus)
agcuggugguccgcauguuuu

SEQ ID NO: 3965453 - RNA, 16 nt, Human herpesvirus 4 (Epstein-Barr virus)
agcuuugaugaggcug

SEQ ID NO: 3965454 - RNA, 22 nt, Human herpesvirus 4 (Epstein-Barr virus)
agcuuuugaccaagcuaccaga

SEQ ID NO: 3965455 - RNA, 14 nt, Human herpesvirus 4 (Epstein-Barr virus)
aggaagcuggccag

SEQ ID NO: 3965456 - RNA, 19 nt, Human herpesvirus 4 (Epstein-Barr virus)
aggaaguuuuaacaccuga

SEQ ID NO: 3965457 - RNA, 18 nt, Human herpesvirus 4 (Epstein-Barr virus)
aggacacccaccaccagg

SEQ ID NO: 3965458 - RNA, 13 nt, Human herpesvirus 4 (Epstein-Barr virus)
aggacuaauguuc

SEQ ID NO: 3965459 - RNA, 15 nt, Human herpesvirus 4 (Epstein-Barr virus)
aggagaagagaggcu

SEQ ID NO: 3965460 - RNA, 12 nt, Human herpesvirus 4 (Epstein-Barr virus)
aggagagcugga

SEQ ID NO: 3965461 - RNA, 16 nt, Human herpesvirus 4 (Epstein-Barr virus)
aggagcaggaggggca

SEQ ID NO: 3965462 - RNA, 20 nt, Human herpesvirus 4 (Epstein-Barr virus)
aggauggcacgggcagagga

SEQ ID NO: 3965463 - RNA, 20 nt, Human herpesvirus 4 (Epstein-Barr virus)
aggauggcccugcaaacuga

SEQ ID NO: 3965464 - RNA, 19 nt, Human herpesvirus 4 (Epstein-Barr virus)
aggcaaacauacaggagga

SEQ ID NO: 3965465 - RNA, 15 nt, Human herpesvirus 4 (Epstein-Barr virus)
aggcacggccgggcu

SEQ ID NO: 3965466 - RNA, 18 nt, Human herpesvirus 4 (Epstein-Barr virus)
aggcacggccucgugcaa

SEQ ID NO: 3965467 - RNA, 20 nt, Human herpesvirus 4 (Epstein-Barr virus)
aggcagaugaggccccuuac

SEQ ID NO: 3965468 - RNA, 14 nt, Human herpesvirus 4 (Epstein-Barr virus)
aggccccggccgcc

SEQ ID NO: 3965469 - RNA, 16 nt, Human herpesvirus 4 (Epstein-Barr virus)
aggccccggccgccgu

SEQ ID NO: 3965470 - RNA, 19 nt, Human herpesvirus 4 (Epstein-Barr virus)
aggcccgggggccuugucc

SEQ ID NO: 3965471 - RNA, 14 nt, Human herpesvirus 4 (Epstein-Barr virus)
aggccucaggcaac

SEQ ID NO: 3965472 - RNA, 16 nt, Human herpesvirus 4 (Epstein-Barr virus)
aggcggcuguggccuc

SEQ ID NO: 3965473 - RNA, 23 nt, Human herpesvirus 4 (Epstein-Barr virus)
aggcuccuggaucuggggcuggc

SEQ ID NO: 3965474 - RNA, 17 nt, Human herpesvirus 4 (Epstein-Barr virus)
aggcuggugccuuggcu

SEQ ID NO: 3965475 - RNA, 22 nt, Human herpesvirus 4 (Epstein-Barr virus)
aggcuguugacaugagcaugga

SEQ ID NO: 3965476 - RNA, 11 nt, Human herpesvirus 4 (Epstein-Barr virus)
agggcaaagac

SEQ ID NO: 3965477 - RNA, 15 nt, Human herpesvirus 4 (Epstein-Barr virus)
agggcgccagggauc

SEQ ID NO: 3965478 - RNA, 22 nt, Human herpesvirus 4 (Epstein-Barr virus)
agggcucaccagggaggccugg

SEQ ID NO: 3965479 - RNA, 18 nt, Human herpesvirus 4 (Epstein-Barr virus)
agggcugguuggggagcu

SEQ ID NO: 3965480 - RNA, 16 nt, Human herpesvirus 4 (Epstein-Barr virus)
agggugagcccaccug

SEQ ID NO: 3965481 - RNA, 14 nt, Human herpesvirus 4 (Epstein-Barr virus)
agguccaucccgga

SEQ ID NO: 3965482 - RNA, 16 nt, Human herpesvirus 4 (Epstein-Barr virus)
aggucuccagagggca

SEQ ID NO: 3965483 - RNA, 12 nt, Human herpesvirus 4 (Epstein-Barr virus)
aggugccacaga

SEQ ID NO: 3965484 - RNA, 14 nt, Human herpesvirus 4 (Epstein-Barr virus)
agguguccagcgcu

SEQ ID NO: 3965485 - RNA, 22 nt, Human herpesvirus 4 (Epstein-Barr virus)
agguuugagaaucugggcuggg

SEQ ID NO: 3965486 - RNA, 18 nt, Human herpesvirus 4 (Epstein-Barr virus)
aguaagcauggggcucug

SEQ ID NO: 3965487 - RNA, 19 nt, Human herpesvirus 4 (Epstein-Barr virus)
agucaccuuccagacuaug

SEQ ID NO: 3965488 - RNA, 16 nt, Human herpesvirus 4 (Epstein-Barr virus)
agucagauugccuucu

SEQ ID NO: 3965489 - RNA, 15 nt, Human herpesvirus 4 (Epstein-Barr virus)
agucccuccucacca

SEQ ID NO: 3965490 - RNA, 15 nt, Human herpesvirus 4 (Epstein-Barr virus)
agugcuccggcugcc

SEQ ID NO: 3965491 - RNA, 15 nt, Human herpesvirus 4 (Epstein-Barr virus)
agugucccugcugcc

SEQ ID NO: 3965492 - RNA, 21 nt, Human herpesvirus 4 (Epstein-Barr virus)
aguugaugaaaggggccgagg

SEQ ID NO: 3965493 - RNA, 16 nt, Human herpesvirus 4 (Epstein-Barr virus)
auaaauaucuuccugu

SEQ ID NO: 3965494 - RNA, 20 nt, Human herpesvirus 4 (Epstein-Barr virus)
auacaggcccgcaauuucca

SEQ ID NO: 3965495 - RNA, 19 nt, Human herpesvirus 4 (Epstein-Barr virus)
uuucagacccaccauggaa

SEQ ID NO: 3965496 - RNA, 16 nt, Human herpesvirus 4 (Epstein-Barr virus)
ucgcucaccccugugc

SEQ ID NO: 3965497 - RNA, 14 nt, Human herpesvirus 4 (Epstein-Barr virus)
ucgcugucgagcug

SEQ ID NO: 3965498 - RNA, 19 nt, Human herpesvirus 4 (Epstein-Barr virus)
ucggcaccuagcccacucc

SEQ ID NO: 3965499 - RNA, 14 nt, Human herpesvirus 4 (Epstein-Barr virus)
ucggcccuccgcau

SEQ ID NO: 3965500 - RNA, 20 nt, Human herpesvirus 4 (Epstein-Barr virus)
ucgugcaaccaggcccacug

SEQ ID NO: 3965501 - RNA, 19 nt, Human herpesvirus 4 (Epstein-Barr virus)
ucuaaaaaucaaaacuuua

SEQ ID NO: 3965502 - RNA, 20 nt, Human herpesvirus 4 (Epstein-Barr virus)
ucuacugccuuguccacugg

SEQ ID NO: 3965503 - RNA, 18 nt, Human herpesvirus 4 (Epstein-Barr virus)
ucucaggcuaugaagaag

SEQ ID NO: 3965504 - RNA, 22 nt, Human herpesvirus 4 (Epstein-Barr virus)
ucuccagcgucauuucuuccaa

SEQ ID NO: 3965505 - RNA, 15 nt, Human herpesvirus 4 (Epstein-Barr virus)
ucuccaucagggcca

SEQ ID NO: 3965506 - RNA, 18 nt, Human herpesvirus 4 (Epstein-Barr virus)
ucucccccgggcgcugcc

SEQ ID NO: 3965507 - RNA, 14 nt, Human herpesvirus 4 (Epstein-Barr virus)
ucucccgcgccgca

SEQ ID NO: 3965508 - RNA, 14 nt, Human herpesvirus 4 (Epstein-Barr virus)
ucucucaucuccaa

SEQ ID NO: 3965509 - RNA, 21 nt, Human herpesvirus 4 (Epstein-Barr virus)
ucugagagauugguaccagaa

SEQ ID NO: 3965510 - RNA, 21 nt, Human herpesvirus 4 (Epstein-Barr virus)
ucugcacaggcuuggaaacac

SEQ ID NO: 3965511 - RNA, 21 nt, Human herpesvirus 4 (Epstein-Barr virus)
ucugcgccagccccgcccucc

SEQ ID NO: 3965512 - RNA, 11 nt, Human herpesvirus 4 (Epstein-Barr virus)
ucugcuucugg

SEQ ID NO: 3965513 - RNA, 20 nt, Human herpesvirus 4 (Epstein-Barr virus)
ucugggcagccagagccagc

SEQ ID NO: 3965514 - RNA, 18 nt, Human herpesvirus 4 (Epstein-Barr virus)
ucugggccgcccggccuc

SEQ ID NO: 3965515 - RNA, 23 nt, Human herpesvirus 4 (Epstein-Barr virus)
ucuggucacuaaaguuggucagg

SEQ ID NO: 3965516 - RNA, 13 nt, Human herpesvirus 4 (Epstein-Barr virus)
ucuggugaaacug

SEQ ID NO: 3965517 - RNA, 17 nt, Human herpesvirus 4 (Epstein-Barr virus)
ucuuacaccagaggcca

SEQ ID NO: 3965518 - RNA, 14 nt, Human herpesvirus 4 (Epstein-Barr virus)
ucuucugggaacac

SEQ ID NO: 3965519 - RNA, 21 nt, Human herpesvirus 4 (Epstein-Barr virus)
ucuugccguggcgccugggga

SEQ ID NO: 3965520 - RNA, 17 nt, Human herpesvirus 4 (Epstein-Barr virus)
ugaagauugucacagcu

SEQ ID NO: 3965521 - RNA, 12 nt, Human herpesvirus 4 (Epstein-Barr virus)
ugaaggagggcu

SEQ ID NO: 3965522 - RNA, 13 nt, Human herpesvirus 4 (Epstein-Barr virus)
ugacacagacuug

SEQ ID NO: 3965523 - RNA, 20 nt, Human herpesvirus 4 (Epstein-Barr virus)
ugacuguaaucacuggcaaa

SEQ ID NO: 3965524 - RNA, 14 nt, Human herpesvirus 4 (Epstein-Barr virus)
ugagccacacccac

SEQ ID NO: 3965525 - RNA, 15 nt, Human herpesvirus 4 (Epstein-Barr virus)
ugaggcccagccccc

SEQ ID NO: 3965526 - RNA, 12 nt, Human herpesvirus 4 (Epstein-Barr virus)
ugagggaaaagg

SEQ ID NO: 3965527 - RNA, 14 nt, Human herpesvirus 4 (Epstein-Barr virus)
ugaugguggccggc

SEQ ID NO: 3965528 - RNA, 17 nt, Human herpesvirus 4 (Epstein-Barr virus)
ugcacgagaccccuggg

SEQ ID NO: 3965529 - RNA, 17 nt, Human herpesvirus 4 (Epstein-Barr virus)
ugcacgccaacagcgac

SEQ ID NO: 3965530 - RNA, 14 nt, Human herpesvirus 4 (Epstein-Barr virus)
ugcacucugaccag

SEQ ID NO: 3965531 - RNA, 15 nt, Human herpesvirus 4 (Epstein-Barr virus)
ugcagcaccucagcu

SEQ ID NO: 3965532 - RNA, 22 nt, Human herpesvirus 4 (Epstein-Barr virus)
ugcagcugaguccccuccuugg

SEQ ID NO: 3965533 - RNA, 13 nt, Human herpesvirus 4 (Epstein-Barr virus)
ugcccaagccugg

SEQ ID NO: 3965534 - RNA, 16 nt, Human herpesvirus 4 (Epstein-Barr virus)
ugcccagggcagacug

SEQ ID NO: 3965535 - RNA, 20 nt, Human herpesvirus 4 (Epstein-Barr virus)
ugcccucaugcgccagagcg

SEQ ID NO: 3965536 - RNA, 14 nt, Human herpesvirus 4 (Epstein-Barr virus)
ugccggaguuuucu

SEQ ID NO: 3965537 - RNA, 16 nt, Human herpesvirus 4 (Epstein-Barr virus)
ugccgucccagggccg

SEQ ID NO: 3965538 - RNA, 19 nt, Human herpesvirus 4 (Epstein-Barr virus)
ugccuggggcucagacuua

SEQ ID NO: 3965539 - RNA, 13 nt, Human herpesvirus 4 (Epstein-Barr virus)
ugccugugccucg

SEQ ID NO: 3965540 - RNA, 17 nt, Human herpesvirus 4 (Epstein-Barr virus)
ugcgagcucuccagcca

SEQ ID NO: 3965541 - RNA, 20 nt, Human herpesvirus 4 (Epstein-Barr virus)
ugcgaggaacuggcucagcu

SEQ ID NO: 3965542 - RNA, 19 nt, Human herpesvirus 4 (Epstein-Barr virus)
ugcgaugaggcggugggug

SEQ ID NO: 3965543 - RNA, 17 nt, Human herpesvirus 4 (Epstein-Barr virus)
ugcgcaacgccggccug

SEQ ID NO: 3965544 - RNA, 23 nt, Human herpesvirus 4 (Epstein-Barr virus)
ugcucaaggcagucuccaccuuu

SEQ ID NO: 3965545 - RNA, 18 nt, Human herpesvirus 4 (Epstein-Barr virus)
ugcucuucaaccuuggca

SEQ ID NO: 3965546 - RNA, 20 nt, Human herpesvirus 4 (Epstein-Barr virus)
ugcugccagagccucugcca

SEQ ID NO: 3965547 - RNA, 15 nt, Human herpesvirus 4 (Epstein-Barr virus)
ugcugccgcuacugc

SEQ ID NO: 3965548 - RNA, 20 nt, Human herpesvirus 4 (Epstein-Barr virus)
ugcugcgauuuucugaccuu

SEQ ID NO: 3965549 - RNA, 20 nt, Human herpesvirus 4 (Epstein-Barr virus)
ugcugcuacuggcuuucguc

SEQ ID NO: 3965550 - RNA, 16 nt, Human herpesvirus 4 (Epstein-Barr virus)
ugcuggccgcagcugg

SEQ ID NO: 3965551 - RNA, 18 nt, Human herpesvirus 4 (Epstein-Barr virus)
ugcuguacaugggaccuc

SEQ ID NO: 3965552 - RNA, 22 nt, Human herpesvirus 4 (Epstein-Barr virus)
ugcuucgcauuacaccauccca

SEQ ID NO: 3965553 - RNA, 19 nt, Human herpesvirus 4 (Epstein-Barr virus)
uggacgagggggcgcggcu

SEQ ID NO: 3965554 - RNA, 23 nt, Human herpesvirus 4 (Epstein-Barr virus)
uggagagauuucauccucagagg

SEQ ID NO: 3965555 - RNA, 23 nt, Human herpesvirus 4 (Epstein-Barr virus)
uggcacacgccagagacaaggca

SEQ ID NO: 3965556 - RNA, 23 nt, Human herpesvirus 4 (Epstein-Barr virus)
uggcauacuuuuugccacccagg

SEQ ID NO: 3965557 - RNA, 16 nt, Human herpesvirus 4 (Epstein-Barr virus)
uggccggcagccuggc

SEQ ID NO: 3965558 - RNA, 14 nt, Human herpesvirus 4 (Epstein-Barr virus)
uggcuacuuugugu

SEQ ID NO: 3965559 - RNA, 18 nt, Human herpesvirus 4 (Epstein-Barr virus)
uggcuguagccacccguc

SEQ ID NO: 3965560 - RNA, 16 nt, Human herpesvirus 4 (Epstein-Barr virus)
ugggaggcgaauguag

SEQ ID NO: 3965561 - RNA, 14 nt, Human herpesvirus 4 (Epstein-Barr virus)
ugggccaggucaca

SEQ ID NO: 3965562 - RNA, 22 nt, Human herpesvirus 4 (Epstein-Barr virus)
ugggcuucgggggccugugugc

SEQ ID NO: 3965563 - RNA, 13 nt, Human herpesvirus 4 (Epstein-Barr virus)
uggggcaggcccc

SEQ ID NO: 3965564 - RNA, 15 nt, Human herpesvirus 4 (Epstein-Barr virus)
uggugcaccugcuag

SEQ ID NO: 3965565 - RNA, 14 nt, Human herpesvirus 4 (Epstein-Barr virus)
uggugggacugaga

SEQ ID NO: 3965566 - RNA, 18 nt, Human herpesvirus 4 (Epstein-Barr virus)
uggugggggcggaugagg

SEQ ID NO: 3965567 - RNA, 18 nt, Human herpesvirus 4 (Epstein-Barr virus)
uguacgugccucagauag

SEQ ID NO: 3965568 - RNA, 17 nt, Human herpesvirus 4 (Epstein-Barr virus)
ugucccuuucagugguc

SEQ ID NO: 3965569 - RNA, 20 nt, Human herpesvirus 4 (Epstein-Barr virus)
ugucggcucucuuugaagug

SEQ ID NO: 3965570 - RNA, 17 nt, Human herpesvirus 4 (Epstein-Barr virus)
ugucuccugacgccaau

SEQ ID NO: 3965571 - RNA, 22 nt, Human herpesvirus 4 (Epstein-Barr virus)
ugucucuuucuggccaaccugc

SEQ ID NO: 3965572 - RNA, 21 nt, Human herpesvirus 4 (Epstein-Barr virus)
ugucugugguugucuucccag

SEQ ID NO: 3965573 - RNA, 17 nt, Human herpesvirus 4 (Epstein-Barr virus)
ugucuuugccaaccugc

SEQ ID NO: 3965574 - RNA, 19 nt, Human herpesvirus 4 (Epstein-Barr virus)
uguucacugcguagaugag

SEQ ID NO: 3965575 - RNA, 15 nt, Human herpesvirus 4 (Epstein-Barr virus)
uguucuacuccuggc

SEQ ID NO: 3965576 - RNA, 22 nt, Human herpesvirus 4 (Epstein-Barr virus)
uguugagaugagucaucccgug

SEQ ID NO: 3965577 - RNA, 23 nt, Human herpesvirus 4 (Epstein-Barr virus)
uguugcgcccuaccucuuuuggc

SEQ ID NO: 3965578 - RNA, 17 nt, Human herpesvirus 4 (Epstein-Barr virus)
uguuucccgacgccaau

SEQ ID NO: 3965579 - RNA, 15 nt, Human herpesvirus 4 (Epstein-Barr virus)
uuaacauggacaugc

SEQ ID NO: 3965580 - RNA, 11 nt, Human herpesvirus 4 (Epstein-Barr virus)
uuaaucuggau

SEQ ID NO: 3965581 - RNA, 17 nt, Human herpesvirus 4 (Epstein-Barr virus)
uuaauguccaguggggu

SEQ ID NO: 3965582 - RNA, 18 nt, Human herpesvirus 4 (Epstein-Barr virus)
uuagcagccuccgggccg

SEQ ID NO: 3965583 - RNA, 14 nt, Human herpesvirus 4 (Epstein-Barr virus)
uuagguaucuggau

SEQ ID NO: 3965584 - RNA, 13 nt, Human herpesvirus 4 (Epstein-Barr virus)
gaugauauugaau

SEQ ID NO: 3965585 - RNA, 21 nt, Human herpesvirus 4 (Epstein-Barr virus)
gauuucaaauaccgagaugua

SEQ ID NO: 3965586 - RNA, 20 nt, Human herpesvirus 4 (Epstein-Barr virus)
gauuuugggcacacuuaacu

SEQ ID NO: 3965587 - RNA, 15 nt, Human herpesvirus 4 (Epstein-Barr virus)
gcaaagauccccagu

SEQ ID NO: 3965588 - RNA, 21 nt, Human herpesvirus 4 (Epstein-Barr virus)
gcaaccaauguaucccaaaua

SEQ ID NO: 3965589 - RNA, 19 nt, Human herpesvirus 4 (Epstein-Barr virus)
gcaacccccggcucucagg

SEQ ID NO: 3965590 - RNA, 18 nt, Human herpesvirus 4 (Epstein-Barr virus)
gcaagauccuucuggcac

SEQ ID NO: 3965591 - RNA, 19 nt, Human herpesvirus 4 (Epstein-Barr virus)
gcacaacggcugugacuac

SEQ ID NO: 3965592 - RNA, 13 nt, Human herpesvirus 4 (Epstein-Barr virus)
gcaccagcuccag

SEQ ID NO: 3965593 - RNA, 16 nt, Human herpesvirus 4 (Epstein-Barr virus)
gcacggucgccccucc

SEQ ID NO: 3965594 - RNA, 23 nt, Human herpesvirus 4 (Epstein-Barr virus)
gcacuuugaaagaugucaaacau

SEQ ID NO: 3965595 - RNA, 14 nt, Human herpesvirus 4 (Epstein-Barr virus)
gcagaaaggcuggc

SEQ ID NO: 3965596 - RNA, 18 nt, Human herpesvirus 4 (Epstein-Barr virus)
gcagcuacacucuggggu

SEQ ID NO: 3965597 - RNA, 13 nt, Human herpesvirus 4 (Epstein-Barr virus)
gcagcucuggcac

SEQ ID NO: 3965598 - RNA, 14 nt, Human herpesvirus 4 (Epstein-Barr virus)
gcaggaggaggggc

SEQ ID NO: 3965599 - RNA, 18 nt, Human herpesvirus 4 (Epstein-Barr virus)
gcaggaggaggggcagga

SEQ ID NO: 3965600 - RNA, 21 nt, Human herpesvirus 4 (Epstein-Barr virus)
gcaggaggaggggcaggagca

SEQ ID NO: 3965601 - RNA, 15 nt, Human herpesvirus 4 (Epstein-Barr virus)
gcaggaggggcagga

SEQ ID NO: 3965602 - RNA, 20 nt, Human herpesvirus 4 (Epstein-Barr virus)
gcaggaggggcaggaggggc

SEQ ID NO: 3965603 - RNA, 15 nt, Human herpesvirus 4 (Epstein-Barr virus)
gcaggguccaagguu

SEQ ID NO: 3965604 - RNA, 16 nt, Human herpesvirus 4 (Epstein-Barr virus)
gcaguccggagacuga

SEQ ID NO: 3965605 - RNA, 15 nt, Human herpesvirus 4 (Epstein-Barr virus)
gcaugaucaggaccc

SEQ ID NO: 3965606 - RNA, 18 nt, Human herpesvirus 4 (Epstein-Barr virus)
gcaugccaccgugaaguu

SEQ ID NO: 3965607 - RNA, 13 nt, Human herpesvirus 4 (Epstein-Barr virus)
gcauggcagccgg

SEQ ID NO: 3965608 - RNA, 13 nt, Human herpesvirus 4 (Epstein-Barr virus)
gcauggccaggcc

SEQ ID NO: 3965609 - RNA, 20 nt, Human herpesvirus 4 (Epstein-Barr virus)
gcauugcuggccgcagcugg

SEQ ID NO: 3965610 - RNA, 13 nt, Human herpesvirus 4 (Epstein-Barr virus)
gccaacuccccca

SEQ ID NO: 3965611 - RNA, 20 nt, Human herpesvirus 4 (Epstein-Barr virus)
aaaaaugugcagcuucucca

SEQ ID NO: 3965612 - RNA, 20 nt, Human herpesvirus 4 (Epstein-Barr virus)
aaaacucugcauggagaagc

SEQ ID NO: 3965613 - RNA, 19 nt, Human herpesvirus 4 (Epstein-Barr virus)
aaaauggggguuggagaaa

SEQ ID NO: 3965614 - RNA, 15 nt, Human herpesvirus 4 (Epstein-Barr virus)
aaacauacaggagga

SEQ ID NO: 3965615 - RNA, 17 nt, Human herpesvirus 4 (Epstein-Barr virus)
aaaccugcgaaacuugg

SEQ ID NO: 3965616 - RNA, 13 nt, Human herpesvirus 4 (Epstein-Barr virus)
aaacgcugcuugg

SEQ ID NO: 3965617 - RNA, 16 nt, Human herpesvirus 4 (Epstein-Barr virus)
aaaggcgcaguccgcc

SEQ ID NO: 3965618 - RNA, 21 nt, Human herpesvirus 4 (Epstein-Barr virus)
aaauacuucucuagagccagg

SEQ ID NO: 3965619 - RNA, 20 nt, Human herpesvirus 4 (Epstein-Barr virus)
aaauuugcugacauauguac

SEQ ID NO: 3965620 - RNA, 21 nt, Human herpesvirus 4 (Epstein-Barr virus)
aacacgcuuuugucugccugg

SEQ ID NO: 3965621 - RNA, 18 nt, Human herpesvirus 4 (Epstein-Barr virus)
aacagggguauguggugc

SEQ ID NO: 3965622 - RNA, 17 nt, Human herpesvirus 4 (Epstein-Barr virus)
aacaugagaaaauacuu

SEQ ID NO: 3965623 - RNA, 23 nt, Human herpesvirus 4 (Epstein-Barr virus)
aaccccagcaacauccggggcag

SEQ ID NO: 3965624 - RNA, 14 nt, Human herpesvirus 4 (Epstein-Barr virus)
aaccuugggggcaa

SEQ ID NO: 3965625 - RNA, 17 nt, Human herpesvirus 4 (Epstein-Barr virus)
aacggcccguggccugc

SEQ ID NO: 3965626 - RNA, 16 nt, Human herpesvirus 4 (Epstein-Barr virus)
aacguccaaguugcau

SEQ ID NO: 3965627 - RNA, 17 nt, Human herpesvirus 4 (Epstein-Barr virus)
aagaauaacaugccaau

SEQ ID NO: 3965628 - RNA, 18 nt, Human herpesvirus 4 (Epstein-Barr virus)
aagaccaauacccaggau

SEQ ID NO: 3965629 - RNA, 24 nt, Human herpesvirus 4 (Epstein-Barr virus)
aagagaggcuucccgccuagagca

SEQ ID NO: 3965630 - RNA, 15 nt, Human herpesvirus 4 (Epstein-Barr virus)
aagcaccacccagcc

SEQ ID NO: 3965631 - RNA, 12 nt, Human herpesvirus 4 (Epstein-Barr virus)
aagcgggccuga

SEQ ID NO: 3965632 - RNA, 19 nt, Human herpesvirus 4 (Epstein-Barr virus)
aaggcgacgcggagagguc

SEQ ID NO: 3965633 - RNA, 17 nt, Human herpesvirus 4 (Epstein-Barr virus)
aagggcaccgugggaaa

SEQ ID NO: 3965634 - RNA, 18 nt, Human herpesvirus 4 (Epstein-Barr virus)
aaguacgagaucuucccc

SEQ ID NO: 3965635 - RNA, 13 nt, Human herpesvirus 4 (Epstein-Barr virus)
aagucaggauucu

SEQ ID NO: 3965636 - RNA, 14 nt, Human herpesvirus 4 (Epstein-Barr virus)
aaucaccuuaacug

SEQ ID NO: 3965637 - RNA, 16 nt, Human herpesvirus 4 (Epstein-Barr virus)
aaucccucugggagaa

SEQ ID NO: 3965638 - RNA, 13 nt, Human herpesvirus 4 (Epstein-Barr virus)
aaucgcagcucua

SEQ ID NO: 3965639 - RNA, 14 nt, Human herpesvirus 4 (Epstein-Barr virus)
aaugacuaugagga

SEQ ID NO: 3965640 - RNA, 17 nt, Human herpesvirus 4 (Epstein-Barr virus)
acaacacauagaauugu

SEQ ID NO: 3965641 - RNA, 16 nt, Human herpesvirus 4 (Epstein-Barr virus)
acaagaacugggauga

SEQ ID NO: 3965642 - RNA, 12 nt, Human herpesvirus 4 (Epstein-Barr virus)
acaauaaaguug

SEQ ID NO: 3965643 - RNA, 16 nt, Human herpesvirus 4 (Epstein-Barr virus)
acaauugccaaguacu

SEQ ID NO: 3965644 - RNA, 13 nt, Human herpesvirus 4 (Epstein-Barr virus)
acacaaaaugagg

SEQ ID NO: 3965645 - RNA, 17 nt, Human herpesvirus 4 (Epstein-Barr virus)
acaccgagcagaaggcc

SEQ ID NO: 3965646 - RNA, 18 nt, Human herpesvirus 4 (Epstein-Barr virus)
acacgcuuuugucugccu

SEQ ID NO: 3965647 - RNA, 20 nt, Human herpesvirus 4 (Epstein-Barr virus)
acacuacuuguuucuggaau

SEQ ID NO: 3965648 - RNA, 17 nt, Human herpesvirus 4 (Epstein-Barr virus)
acacuugugguucuccu

SEQ ID NO: 3965649 - RNA, 20 nt, Human herpesvirus 4 (Epstein-Barr virus)
acagccagguguacgcccug

SEQ ID NO: 3965650 - RNA, 22 nt, Human herpesvirus 4 (Epstein-Barr virus)
acagccagguguacgcccuggc

SEQ ID NO: 3965651 - RNA, 15 nt, Human herpesvirus 4 (Epstein-Barr virus)
acaggaccuggaaau

SEQ ID NO: 3965652 - RNA, 14 nt, Human herpesvirus 4 (Epstein-Barr virus)
accaagcuaccaga

SEQ ID NO: 3965653 - RNA, 13 nt, Human herpesvirus 4 (Epstein-Barr virus)
accaaggcccuag

SEQ ID NO: 3965654 - RNA, 15 nt, Human herpesvirus 4 (Epstein-Barr virus)
accaaugccaaagcu

SEQ ID NO: 3965655 - RNA, 21 nt, Human herpesvirus 4 (Epstein-Barr virus)
accacucaggaagcuggccag

SEQ ID NO: 3965656 - RNA, 19 nt, Human herpesvirus 4 (Epstein-Barr virus)
accagagcccagaggaggc

SEQ ID NO: 3965657 - RNA, 20 nt, Human herpesvirus 4 (Epstein-Barr virus)
accagcccuuuuuccagugg

SEQ ID NO: 3965658 - RNA, 18 nt, Human herpesvirus 4 (Epstein-Barr virus)
accaggggcgagcagcgc

SEQ ID NO: 3965659 - RNA, 14 nt, Human herpesvirus 4 (Epstein-Barr virus)
acccaccacacagc

SEQ ID NO: 3965660 - RNA, 22 nt, Human herpesvirus 4 (Epstein-Barr virus)
acccaccccuccuacacacauc

SEQ ID NO: 3965661 - RNA, 14 nt, Human herpesvirus 4 (Epstein-Barr virus)
acccacuccagugc

SEQ ID NO: 3965662 - RNA, 20 nt, Human herpesvirus 4 (Epstein-Barr virus)
accccuguuagcuauuugau

SEQ ID NO: 3965663 - RNA, 18 nt, Human herpesvirus 4 (Epstein-Barr virus)
accgcagccacguccaga

SEQ ID NO: 3965664 - RNA, 22 nt, Human herpesvirus 4 (Epstein-Barr virus)
accggccaagguccugggccuc

SEQ ID NO: 3965665 - RNA, 15 nt, Human herpesvirus 4 (Epstein-Barr virus)
accggggccuuggca

SEQ ID NO: 3965666 - RNA, 17 nt, Human herpesvirus 4 (Epstein-Barr virus)
accugucuacuucgcca

SEQ ID NO: 3965667 - RNA, 18 nt, Human herpesvirus 4 (Epstein-Barr virus)
accuguuucggcgccgcc

SEQ ID NO: 3965668 - RNA, 15 nt, Human herpesvirus 4 (Epstein-Barr virus)
acgaugaaggagggc

SEQ ID NO: 3965669 - RNA, 16 nt, Human herpesvirus 4 (Epstein-Barr virus)
acgccggccugcuggc

SEQ ID NO: 3965670 - RNA, 18 nt, Human herpesvirus 4 (Epstein-Barr virus)
acgcuguuuugcagcuga

SEQ ID NO: 3965671 - RNA, 15 nt, Human herpesvirus 4 (Epstein-Barr virus)
acggaccccccucug

SEQ ID NO: 3965672 - RNA, 17 nt, Human herpesvirus 4 (Epstein-Barr virus)
acgggcucccucccccu

SEQ ID NO: 3965673 - RNA, 19 nt, Human herpesvirus 4 (Epstein-Barr virus)
acguacccauaacugggca

SEQ ID NO: 3965674 - RNA, 24 nt, Human herpesvirus 4 (Epstein-Barr virus)
acguggguggauguagggagcacu

SEQ ID NO: 3965675 - RNA, 13 nt, Human herpesvirus 4 (Epstein-Barr virus)
acuaauguggugg

SEQ ID NO: 3965676 - RNA, 23 nt, Human herpesvirus 4 (Epstein-Barr virus)
acuacuuguuucuggaaugcuuc

SEQ ID NO: 3965677 - RNA, 22 nt, Human herpesvirus 4 (Epstein-Barr virus)
acuaucacccauggccaggcuc

SEQ ID NO: 3965678 - RNA, 19 nt, Human herpesvirus 4 (Epstein-Barr virus)
acucacccccagccugugc

SEQ ID NO: 3965679 - RNA, 13 nt, Human herpesvirus 4 (Epstein-Barr virus)
acucggccacaca

SEQ ID NO: 3965680 - RNA, 19 nt, Human herpesvirus 4 (Epstein-Barr virus)
acucucccuccauuuacug

SEQ ID NO: 3965681 - RNA, 13 nt, Human herpesvirus 4 (Epstein-Barr virus)
acugcgaaaauuc

SEQ ID NO: 3965682 - RNA, 22 nt, Human herpesvirus 4 (Epstein-Barr virus)
acuggcacacacucccuuagcc

SEQ ID NO: 3965683 - RNA, 18 nt, Human herpesvirus 4 (Epstein-Barr virus)
acugggcaucgggcuuug

SEQ ID NO: 3965684 - RNA, 21 nt, Human herpesvirus 4 (Epstein-Barr virus)
acuuauguuucaagcagcuca

SEQ ID NO: 3965685 - RNA, 21 nt, Human herpesvirus 4 (Epstein-Barr virus)
acuugcucagguuucugggca

SEQ ID NO: 3965686 - RNA, 19 nt, Human herpesvirus 4 (Epstein-Barr virus)
agaacccccugcaggacac

SEQ ID NO: 3965687 - RNA, 21 nt, Human herpesvirus 4 (Epstein-Barr virus)
agaagcagauagccggccagg

SEQ ID NO: 3965688 - RNA, 13 nt, Human herpesvirus 4 (Epstein-Barr virus)
agaagugcuggga

SEQ ID NO: 3965689 - RNA, 16 nt, Human herpesvirus 4 (Epstein-Barr virus)
agaaucugggcuggga

SEQ ID NO: 3965690 - RNA, 17 nt, Human herpesvirus 4 (Epstein-Barr virus)
agaaugaugguggggga

SEQ ID NO: 3965691 - RNA, 14 nt, Human herpesvirus 4 (Epstein-Barr virus)
agacucuugaagau

SEQ ID NO: 3965692 - RNA, 12 nt, Human herpesvirus 4 (Epstein-Barr virus)
agagcggcgaga

SEQ ID NO: 3965693 - RNA, 16 nt, Human herpesvirus 4 (Epstein-Barr virus)
agagcggguggaggag

SEQ ID NO: 3965694 - RNA, 23 nt, Human herpesvirus 4 (Epstein-Barr virus)
agagcuccgccaccuccgggggc

SEQ ID NO: 3965695 - RNA, 14 nt, Human herpesvirus 4 (Epstein-Barr virus)
agagcucuggagga

SEQ ID NO: 3965696 - RNA, 18 nt, Human herpesvirus 4 (Epstein-Barr virus)
agaggaugaggcugauga

SEQ ID NO: 3965697 - RNA, 21 nt, Human herpesvirus 4 (Epstein-Barr virus)
agaggcaaacauacaggagga

SEQ ID NO: 3965698 - RNA, 16 nt, Human herpesvirus 4 (Epstein-Barr virus)
agaggcccgggggccu

SEQ ID NO: 3965699 - RNA, 15 nt, Human herpesvirus 4 (Epstein-Barr virus)
agagugcccuggagg

SEQ ID NO: 3965700 - RNA, 15 nt, Human herpesvirus 4 (Epstein-Barr virus)
agaucgccugccacu

SEQ ID NO: 3965701 - RNA, 21 nt, Human herpesvirus 4 (Epstein-Barr virus)
agaugauaaugaugaggagca

SEQ ID NO: 3965702 - RNA, 19 nt, Human herpesvirus 4 (Epstein-Barr virus)
agauuagggguaacccugu

SEQ ID NO: 3965703 - RNA, 18 nt, Human herpesvirus 4 (Epstein-Barr virus)
agauucagacgagucuga

SEQ ID NO: 3965704 - RNA, 14 nt, Human herpesvirus 4 (Epstein-Barr virus)
agauugucacagcu

SEQ ID NO: 3965705 - RNA, 13 nt, Human herpesvirus 4 (Epstein-Barr virus)
agcaccacccagc

SEQ ID NO: 3965706 - RNA, 16 nt, Human herpesvirus 4 (Epstein-Barr virus)
agcagcuggauguaca

SEQ ID NO: 3965707 - RNA, 17 nt, Human herpesvirus 4 (Epstein-Barr virus)
agcaggagcaggagcgg

SEQ ID NO: 3965708 - RNA, 16 nt, Human herpesvirus 4 (Epstein-Barr virus)
agcauggcggccuggc

SEQ ID NO: 3965709 - RNA, 21 nt, Human herpesvirus 4 (Epstein-Barr virus)
agcaugggcgaggggcgcccc

SEQ ID NO: 3965710 - RNA, 17 nt, Human herpesvirus 4 (Epstein-Barr virus)
agccacauucuggaacu

SEQ ID NO: 3965711 - RNA, 23 nt, Human herpesvirus 4 (Epstein-Barr virus)
agccacccgucccggguacaagu

SEQ ID NO: 3965712 - RNA, 14 nt, Human herpesvirus 4 (Epstein-Barr virus)
agccaguguggcug

SEQ ID NO: 3965713 - RNA, 16 nt, Human herpesvirus 4 (Epstein-Barr virus)
agcccaagaagaagcc

SEQ ID NO: 3965714 - RNA, 14 nt, Human herpesvirus 4 (Epstein-Barr virus)
agcccuuggaacug

SEQ ID NO: 3965715 - RNA, 21 nt, Human herpesvirus 4 (Epstein-Barr virus)
agccgcuucagacagccgcgg

SEQ ID NO: 3965716 - RNA, 13 nt, Human herpesvirus 4 (Epstein-Barr virus)
agccggccaggca

SEQ ID NO: 3965717 - RNA, 23 nt, Human herpesvirus 4 (Epstein-Barr virus)
agcgcucuggucgcccccucugc

SEQ ID NO: 3965718 - RNA, 17 nt, Human herpesvirus 4 (Epstein-Barr virus)
agcggacgguggggcuc

SEQ ID NO: 3965719 - RNA, 17 nt, Human herpesvirus 4 (Epstein-Barr virus)
agcggaugguggggcuu

SEQ ID NO: 3965720 - RNA, 22 nt, Human herpesvirus 4 (Epstein-Barr virus)
agcggcacagauuagaagauga

SEQ ID NO: 3965721 - RNA, 19 nt, Human herpesvirus 4 (Epstein-Barr virus)
agcgggaggggcaggagca

SEQ ID NO: 3965722 - RNA, 16 nt, Human herpesvirus 4 (Epstein-Barr virus)
agcggggguucuccag

SEQ ID NO: 3965723 - RNA, 12 nt, Human herpesvirus 4 (Epstein-Barr virus)
agcucaccuaug

SEQ ID NO: 3965724 - RNA, 16 nt, Human herpesvirus 4 (Epstein-Barr virus)
agcugaggggcaaccu

SEQ ID NO: 3965725 - RNA, 23 nt, Human herpesvirus 4 (Epstein-Barr virus)
ucucuggcugugcugacccuucu

SEQ ID NO: 3965726 - RNA, 21 nt, Human herpesvirus 4 (Epstein-Barr virus)
ucucuggugaaacuggcuucu

SEQ ID NO: 3965727 - RNA, 14 nt, Human herpesvirus 4 (Epstein-Barr virus)
ucugauggccugga

SEQ ID NO: 3965728 - RNA, 17 nt, Human herpesvirus 4 (Epstein-Barr virus)
ucuggcugugcugaccc

SEQ ID NO: 3965729 - RNA, 20 nt, Human herpesvirus 4 (Epstein-Barr virus)
ucuggucgcccccucugccu

SEQ ID NO: 3965730 - RNA, 16 nt, Human herpesvirus 4 (Epstein-Barr virus)
ucuuggguuccuagug

SEQ ID NO: 3965731 - RNA, 16 nt, Human herpesvirus 4 (Epstein-Barr virus)
ugaauuccgucaaggc

SEQ ID NO: 3965732 - RNA, 16 nt, Human herpesvirus 4 (Epstein-Barr virus)
ugacacccccagcgcu

SEQ ID NO: 3965733 - RNA, 20 nt, Human herpesvirus 4 (Epstein-Barr virus)
ugacagcugucacccaugcc

SEQ ID NO: 3965734 - RNA, 16 nt, Human herpesvirus 4 (Epstein-Barr virus)
ugacccuucugcugcu

SEQ ID NO: 3965735 - RNA, 17 nt, Human herpesvirus 4 (Epstein-Barr virus)
ugacccuucugcugcug

SEQ ID NO: 3965736 - RNA, 21 nt, Human herpesvirus 4 (Epstein-Barr virus)
ugacggugggcaugacacagg

SEQ ID NO: 3965737 - RNA, 22 nt, Human herpesvirus 4 (Epstein-Barr virus)
ugagaccgugucacucccgagg

SEQ ID NO: 3965738 - RNA, 14 nt, Human herpesvirus 4 (Epstein-Barr virus)
ugagcuggacgagg

SEQ ID NO: 3965739 - RNA, 21 nt, Human herpesvirus 4 (Epstein-Barr virus)
ugauggccuggagagcaugca

SEQ ID NO: 3965740 - RNA, 16 nt, Human herpesvirus 4 (Epstein-Barr virus)
ugauugagaucagaaa

SEQ ID NO: 3965741 - RNA, 17 nt, Human herpesvirus 4 (Epstein-Barr virus)
ugcaacagaggauuggc

SEQ ID NO: 3965742 - RNA, 12 nt, Human herpesvirus 4 (Epstein-Barr virus)
ugcaaggacggg

SEQ ID NO: 3965743 - RNA, 16 nt, Human herpesvirus 4 (Epstein-Barr virus)
ugcaccagcuccaggg

SEQ ID NO: 3965744 - RNA, 15 nt, Human herpesvirus 4 (Epstein-Barr virus)
ugcacccggacaugu

SEQ ID NO: 3965745 - RNA, 12 nt, Human herpesvirus 4 (Epstein-Barr virus)
ugcagacuccag

SEQ ID NO: 3965746 - RNA, 14 nt, Human herpesvirus 4 (Epstein-Barr virus)
ugcagacuccaggu

SEQ ID NO: 3965747 - RNA, 17 nt, Human herpesvirus 4 (Epstein-Barr virus)
ugcagggugcacagacu

SEQ ID NO: 3965748 - RNA, 16 nt, Human herpesvirus 4 (Epstein-Barr virus)
ugcauggagaagcugg

SEQ ID NO: 3965749 - RNA, 16 nt, Human herpesvirus 4 (Epstein-Barr virus)
ugccccucagccugcu

SEQ ID NO: 3965750 - RNA, 15 nt, Human herpesvirus 4 (Epstein-Barr virus)
ugcccucuccagcaa

SEQ ID NO: 3965751 - RNA, 14 nt, Human herpesvirus 4 (Epstein-Barr virus)
ugccgucccagggc

SEQ ID NO: 3965752 - RNA, 17 nt, Human herpesvirus 4 (Epstein-Barr virus)
ugccuccccagcaacag

SEQ ID NO: 3965753 - RNA, 19 nt, Human herpesvirus 4 (Epstein-Barr virus)
ugccucgggucucgccgcu

SEQ ID NO: 3965754 - RNA, 15 nt, Human herpesvirus 4 (Epstein-Barr virus)
ugccuggcgcuuugc

SEQ ID NO: 3965755 - RNA, 23 nt, Human herpesvirus 4 (Epstein-Barr virus)
ugccuguggccccggcuggccau

SEQ ID NO: 3965756 - RNA, 20 nt, Human herpesvirus 4 (Epstein-Barr virus)
ugcgacggcuuuagccuggc

SEQ ID NO: 3965757 - RNA, 21 nt, Human herpesvirus 4 (Epstein-Barr virus)
ugcgcaacgccggccugcugg

SEQ ID NO: 3965758 - RNA, 17 nt, Human herpesvirus 4 (Epstein-Barr virus)
ugcgcgccgccagcaug

SEQ ID NO: 3965759 - RNA, 18 nt, Human herpesvirus 4 (Epstein-Barr virus)
ugcggagggucagauuuu

SEQ ID NO: 3965760 - RNA, 23 nt, Human herpesvirus 4 (Epstein-Barr virus)
ugcuaugaccaugcccagacuca

SEQ ID NO: 3965761 - RNA, 15 nt, Human herpesvirus 4 (Epstein-Barr virus)
ugcugacccuucugc

SEQ ID NO: 3965762 - RNA, 19 nt, Human herpesvirus 4 (Epstein-Barr virus)
ugcugccagagccucugcc

SEQ ID NO: 3965763 - RNA, 13 nt, Human herpesvirus 4 (Epstein-Barr virus)
ugcugccuggggg

SEQ ID NO: 3965764 - RNA, 19 nt, Human herpesvirus 4 (Epstein-Barr virus)
ugcuucuggcucuucuggg

SEQ ID NO: 3965765 - RNA, 22 nt, Human herpesvirus 4 (Epstein-Barr virus)
uggaccaagggcagggcaaugg

SEQ ID NO: 3965766 - RNA, 18 nt, Human herpesvirus 4 (Epstein-Barr virus)
uggacccuauggagggca

SEQ ID NO: 3965767 - RNA, 21 nt, Human herpesvirus 4 (Epstein-Barr virus)
uggacuggggugugaagggca

SEQ ID NO: 3965768 - RNA, 15 nt, Human herpesvirus 4 (Epstein-Barr virus)
uggaggcccccggcu

SEQ ID NO: 3965769 - RNA, 19 nt, Human herpesvirus 4 (Epstein-Barr virus)
uggaguuuuacggggggca

SEQ ID NO: 3965770 - RNA, 20 nt, Human herpesvirus 4 (Epstein-Barr virus)
uggaucuacuuauuggagau

SEQ ID NO: 3965771 - RNA, 18 nt, Human herpesvirus 4 (Epstein-Barr virus)
uggcaucuuccuccuugu

SEQ ID NO: 3965772 - RNA, 18 nt, Human herpesvirus 4 (Epstein-Barr virus)
uggccgagcuggaggcca

SEQ ID NO: 3965773 - RNA, 18 nt, Human herpesvirus 4 (Epstein-Barr virus)
uggccugccuggaucuga

SEQ ID NO: 3965774 - RNA, 21 nt, Human herpesvirus 4 (Epstein-Barr virus)
uggcgccguuugacuguuugu

SEQ ID NO: 3965775 - RNA, 18 nt, Human herpesvirus 4 (Epstein-Barr virus)
uggcggcuauugccgccu

SEQ ID NO: 3965776 - RNA, 16 nt, Human herpesvirus 4 (Epstein-Barr virus)
uggcucuccuguguga

SEQ ID NO: 3965777 - RNA, 19 nt, Human herpesvirus 4 (Epstein-Barr virus)
ugggggcuacaggaggcca

SEQ ID NO: 3965778 - RNA, 20 nt, Human herpesvirus 4 (Epstein-Barr virus)
ugggggcuacaggaggccac

SEQ ID NO: 3965779 - RNA, 21 nt, Human herpesvirus 4 (Epstein-Barr virus)
uggggguggacaugaggaggu

SEQ ID NO: 3965780 - RNA, 20 nt, Human herpesvirus 4 (Epstein-Barr virus)
ugggguccucaaggauggca

SEQ ID NO: 3965781 - RNA, 15 nt, Human herpesvirus 4 (Epstein-Barr virus)
uggguccccucugcc

SEQ ID NO: 3965782 - RNA, 14 nt, Human herpesvirus 4 (Epstein-Barr virus)
uggucacucaggca

SEQ ID NO: 3965783 - RNA, 17 nt, Human herpesvirus 4 (Epstein-Barr virus)
uggucgcccccucugcc

SEQ ID NO: 3965784 - RNA, 13 nt, Human herpesvirus 4 (Epstein-Barr virus)
ugguggaggagga

SEQ ID NO: 3965785 - RNA, 21 nt, Human herpesvirus 4 (Epstein-Barr virus)
uggugggcuccuuagacugag

SEQ ID NO: 3965786 - RNA, 18 nt, Human herpesvirus 4 (Epstein-Barr virus)
uguacagaaacagagagu

SEQ ID NO: 3965787 - RNA, 19 nt, Human herpesvirus 4 (Epstein-Barr virus)
uguacugaccacucaggaa

SEQ ID NO: 3965788 - RNA, 19 nt, Human herpesvirus 4 (Epstein-Barr virus)
ugucuaacacgcuuuuguc

SEQ ID NO: 3965789 - RNA, 16 nt, Human herpesvirus 4 (Epstein-Barr virus)
ugucucggccuccugg

SEQ ID NO: 3965790 - RNA, 12 nt, Human herpesvirus 4 (Epstein-Barr virus)
ugucugacuugg

SEQ ID NO: 3965791 - RNA, 17 nt, Human herpesvirus 4 (Epstein-Barr virus)
uguguaaccucacugua

SEQ ID NO: 3965792 - RNA, 22 nt, Human herpesvirus 4 (Epstein-Barr virus)
ugugucccacuccaccugccgg

SEQ ID NO: 3965793 - RNA, 18 nt, Human herpesvirus 4 (Epstein-Barr virus)
uuaauggguaaaggggga

SEQ ID NO: 3965794 - RNA, 22 nt, Human herpesvirus 4 (Epstein-Barr virus)
uuaccaugucauaggcuugccu

SEQ ID NO: 3965795 - RNA, 16 nt, Human herpesvirus 4 (Epstein-Barr virus)
uuagcuauuccaccaa

SEQ ID NO: 3965796 - RNA, 16 nt, Human herpesvirus 4 (Epstein-Barr virus)
uuccugcccucccacu

SEQ ID NO: 3965797 - RNA, 19 nt, Human herpesvirus 4 (Epstein-Barr virus)
uuccugcccucccacuuuu

SEQ ID NO: 3965798 - RNA, 15 nt, Human herpesvirus 4 (Epstein-Barr virus)
uucugcccccugucu

SEQ ID NO: 3965799 - RNA, 16 nt, Human herpesvirus 4 (Epstein-Barr virus)
uucugccccucagccu

SEQ ID NO: 3965800 - RNA, 20 nt, Human herpesvirus 4 (Epstein-Barr virus)
uucuggccaaccugccucuc

SEQ ID NO: 3965801 - RNA, 19 nt, Human herpesvirus 4 (Epstein-Barr virus)
uugaaaccacgccugcuuc

SEQ ID NO: 3965802 - RNA, 19 nt, Human herpesvirus 4 (Epstein-Barr virus)
uugaucuuugacugacaca

SEQ ID NO: 3965803 - RNA, 16 nt, Human herpesvirus 4 (Epstein-Barr virus)
uugcgccgccuccccc

SEQ ID NO: 3965804 - RNA, 21 nt, Human herpesvirus 4 (Epstein-Barr virus)
uugcucuguguuuuuugccug

SEQ ID NO: 3965805 - RNA, 17 nt, Human herpesvirus 4 (Epstein-Barr virus)
uugucggacgaggagga

SEQ ID NO: 3965806 - RNA, 19 nt, Human herpesvirus 4 (Epstein-Barr virus)
uuuaacucuuaaaacuugc

SEQ ID NO: 3965807 - RNA, 17 nt, Human herpesvirus 4 (Epstein-Barr virus)
uuuaaggaaugaacacu

SEQ ID NO: 3965808 - RNA, 18 nt, Human herpesvirus 4 (Epstein-Barr virus)
uuuguacagacuuuuggc

SEQ ID NO: 3965809 - RNA, 20 nt, Human herpesvirus 4 (Epstein-Barr virus)
guuaucaccguaccaugagu

SEQ ID NO: 3965810 - RNA, 23 nt, Human herpesvirus 4 (Epstein-Barr virus)
guucaggaacagccuccgccgcc

SEQ ID NO: 3965811 - RNA, 22 nt, Human herpesvirus 4 (Epstein-Barr virus)
guugucacgucacucagcuccg

SEQ ID NO: 3965812 - RNA, 12 nt, Human herpesvirus 4 (Epstein-Barr virus)
guugucuuccca

SEQ ID NO: 3965813 - RNA, 12 nt, Human herpesvirus 4 (Epstein-Barr virus)
uaagaccaaggc

SEQ ID NO: 3965814 - RNA, 16 nt, Human herpesvirus 4 (Epstein-Barr virus)
uaaggcucugaagcaa

SEQ ID NO: 3965815 - RNA, 20 nt, Human herpesvirus 4 (Epstein-Barr virus)
uacaaacacgggccuggggc

SEQ ID NO: 3965816 - RNA, 22 nt, Human herpesvirus 4 (Epstein-Barr virus)
uacacucuggggucucaggccu

SEQ ID NO: 3965817 - RNA, 14 nt, Human herpesvirus 4 (Epstein-Barr virus)
uacagcaggauucc

SEQ ID NO: 3965818 - RNA, 14 nt, Human herpesvirus 4 (Epstein-Barr virus)
uaccugaugaguca

SEQ ID NO: 3965819 - RNA, 17 nt, Human herpesvirus 4 (Epstein-Barr virus)
uacgauggcggaaacaa

SEQ ID NO: 3965820 - RNA, 13 nt, Human herpesvirus 4 (Epstein-Barr virus)
uacgcgggccaca

SEQ ID NO: 3965821 - RNA, 15 nt, Human herpesvirus 4 (Epstein-Barr virus)
uacgcgggccacagg

SEQ ID NO: 3965822 - RNA, 17 nt, Human herpesvirus 4 (Epstein-Barr virus)
uacggcuuuccaguucc

SEQ ID NO: 3965823 - RNA, 23 nt, Human herpesvirus 4 (Epstein-Barr virus)
uacuggcuuucguccucuggcuc

SEQ ID NO: 3965824 - RNA, 14 nt, Human herpesvirus 4 (Epstein-Barr virus)
uagauauagaggcu

SEQ ID NO: 3965825 - RNA, 19 nt, Human herpesvirus 4 (Epstein-Barr virus)
uagccacccgucccgggua

SEQ ID NO: 3965826 - RNA, 15 nt, Human herpesvirus 4 (Epstein-Barr virus)
uagccggccaggcag

SEQ ID NO: 3965827 - RNA, 18 nt, Human herpesvirus 4 (Epstein-Barr virus)
uaggcaaaccuccaauca

SEQ ID NO: 3965828 - RNA, 17 nt, Human herpesvirus 4 (Epstein-Barr virus)
uaggcacaucuggaccu

SEQ ID NO: 3965829 - RNA, 23 nt, Human herpesvirus 4 (Epstein-Barr virus)
uauaaauuacuggcgugaauugu

SEQ ID NO: 3965830 - RNA, 17 nt, Human herpesvirus 4 (Epstein-Barr virus)
uaucacccauggccagg

SEQ ID NO: 3965831 - RNA, 15 nt, Human herpesvirus 4 (Epstein-Barr virus)
uauccaggaggagga

SEQ ID NO: 3965832 - RNA, 20 nt, Human herpesvirus 4 (Epstein-Barr virus)
uaugccuguggccccggcug

SEQ ID NO: 3965833 - RNA, 19 nt, Human herpesvirus 4 (Epstein-Barr virus)
uauggcagagcuuugcccc

SEQ ID NO: 3965834 - RNA, 21 nt, Human herpesvirus 4 (Epstein-Barr virus)
uauggugccggggcccacgug

SEQ ID NO: 3965835 - RNA, 15 nt, Human herpesvirus 4 (Epstein-Barr virus)
uauucucagaugcag

SEQ ID NO: 3965836 - RNA, 19 nt, Human herpesvirus 4 (Epstein-Barr virus)
ucaaagaacaaggccaaga

SEQ ID NO: 3965837 - RNA, 17 nt, Human herpesvirus 4 (Epstein-Barr virus)
ucaacuucagcuccagg

SEQ ID NO: 3965838 - RNA, 21 nt, Human herpesvirus 4 (Epstein-Barr virus)
ucaagagucucgccaucuacc

SEQ ID NO: 3965839 - RNA, 12 nt, Human herpesvirus 4 (Epstein-Barr virus)
ucaauuaaacaa

SEQ ID NO: 3965840 - RNA, 13 nt, Human herpesvirus 4 (Epstein-Barr virus)
ucacaggacaugu

SEQ ID NO: 3965841 - RNA, 16 nt, Human herpesvirus 4 (Epstein-Barr virus)
ucaccggcaccgccag

SEQ ID NO: 3965842 - RNA, 18 nt, Human herpesvirus 4 (Epstein-Barr virus)
ucacuuuguacagacuuu

SEQ ID NO: 3965843 - RNA, 18 nt, Human herpesvirus 4 (Epstein-Barr virus)
ucagcacuuugccagcaa

SEQ ID NO: 3965844 - RNA, 18 nt, Human herpesvirus 4 (Epstein-Barr virus)
ucagcucaaccgccaggg

SEQ ID NO: 3965845 - RNA, 12 nt, Human herpesvirus 4 (Epstein-Barr virus)
ucagcuccuugu

SEQ ID NO: 3965846 - RNA, 17 nt, Human herpesvirus 4 (Epstein-Barr virus)
ucaggaagcuggccagg

SEQ ID NO: 3965847 - RNA, 13 nt, Human herpesvirus 4 (Epstein-Barr virus)
uccaccagcuucu

SEQ ID NO: 3965848 - RNA, 20 nt, Human herpesvirus 4 (Epstein-Barr virus)
uccagagcugagugcccagg

SEQ ID NO: 3965849 - RNA, 14 nt, Human herpesvirus 4 (Epstein-Barr virus)
uccagccagugguc

SEQ ID NO: 3965850 - RNA, 17 nt, Human herpesvirus 4 (Epstein-Barr virus)
uccaggcccccgggugg

SEQ ID NO: 3965851 - RNA, 21 nt, Human herpesvirus 4 (Epstein-Barr virus)
uccccgagggugaggcccagc

SEQ ID NO: 3965852 - RNA, 18 nt, Human herpesvirus 4 (Epstein-Barr virus)
uccccgaggucagaaaga

SEQ ID NO: 3965853 - RNA, 11 nt, Human herpesvirus 4 (Epstein-Barr virus)
uccccucugcc

SEQ ID NO: 3965854 - RNA, 12 nt, Human herpesvirus 4 (Epstein-Barr virus)
ucccucugggag

SEQ ID NO: 3965855 - RNA, 18 nt, Human herpesvirus 4 (Epstein-Barr virus)
uccgcaccacagaaacua

SEQ ID NO: 3965856 - RNA, 21 nt, Human herpesvirus 4 (Epstein-Barr virus)
uccgcagccgcugaagccagg

SEQ ID NO: 3965857 - RNA, 20 nt, Human herpesvirus 4 (Epstein-Barr virus)
uccgcuuuaagaccaaggcc

SEQ ID NO: 3965858 - RNA, 17 nt, Human herpesvirus 4 (Epstein-Barr virus)
uccuagcacaaaccagu

SEQ ID NO: 3965859 - RNA, 19 nt, Human herpesvirus 4 (Epstein-Barr virus)
uccuagcacaaaccagucu

SEQ ID NO: 3965860 - RNA, 12 nt, Human herpesvirus 4 (Epstein-Barr virus)
uccuggccccca

SEQ ID NO: 3965861 - RNA, 20 nt, Human herpesvirus 4 (Epstein-Barr virus)
uccuggccggccgcccccug

SEQ ID NO: 3965862 - RNA, 13 nt, Human herpesvirus 4 (Epstein-Barr virus)
uccuucuuggccu

SEQ ID NO: 3965863 - RNA, 21 nt, Human herpesvirus 4 (Epstein-Barr virus)
uccuugggugaccuggccagg

SEQ ID NO: 3965864 - RNA, 13 nt, Human herpesvirus 4 (Epstein-Barr virus)
ucgcccccucugc

SEQ ID NO: 3965865 - RNA, 19 nt, Human herpesvirus 4 (Epstein-Barr virus)
ucgcgccccaucuuggccc

SEQ ID NO: 3965866 - RNA, 20 nt, Human herpesvirus 4 (Epstein-Barr virus)
ucgcugaaucuaguaugaag

SEQ ID NO: 3965867 - RNA, 14 nt, Human herpesvirus 4 (Epstein-Barr virus)
ucggagucuucaag

SEQ ID NO: 3965868 - RNA, 13 nt, Human herpesvirus 4 (Epstein-Barr virus)
ucggccuccuggc

SEQ ID NO: 3965869 - RNA, 14 nt, Human herpesvirus 4 (Epstein-Barr virus)
ucgucagagagguu

SEQ ID NO: 3965870 - RNA, 16 nt, Human herpesvirus 4 (Epstein-Barr virus)
ucuauaaaaauucaga

SEQ ID NO: 3965871 - RNA, 20 nt, Human herpesvirus 4 (Epstein-Barr virus)
ucucaaacggggaaggagga

SEQ ID NO: 3965872 - RNA, 10 nt, Human herpesvirus 4 (Epstein-Barr virus)
ucucaggccu

SEQ ID NO: 3965873 - RNA, 13 nt, Human herpesvirus 4 (Epstein-Barr virus)
ucucaucuccaaa

SEQ ID NO: 3965874 - RNA, 19 nt, Human herpesvirus 4 (Epstein-Barr virus)
ucucuagcaggugcaccag

SEQ ID NO: 3965875 - RNA, 15 nt, Human herpesvirus 4 (Epstein-Barr virus)
ccccgggagccacgg

SEQ ID NO: 3965876 - RNA, 19 nt, Human herpesvirus 4 (Epstein-Barr virus)
cccgagccccgccuggcgg

SEQ ID NO: 3965877 - RNA, 21 nt, Human herpesvirus 4 (Epstein-Barr virus)
cccgcuguaugaggaaggggc

SEQ ID NO: 3965878 - RNA, 13 nt, Human herpesvirus 4 (Epstein-Barr virus)
cccggcucucagg

SEQ ID NO: 3965879 - RNA, 23 nt, Human herpesvirus 4 (Epstein-Barr virus)
cccggggaaaagagagcugaugg

SEQ ID NO: 3965880 - RNA, 14 nt, Human herpesvirus 4 (Epstein-Barr virus)
cccgggggcgggag

SEQ ID NO: 3965881 - RNA, 17 nt, Human herpesvirus 4 (Epstein-Barr virus)
cccuaagcagcugaggg

SEQ ID NO: 3965882 - RNA, 15 nt, Human herpesvirus 4 (Epstein-Barr virus)
cccuccgcagccgcu

SEQ ID NO: 3965883 - RNA, 22 nt, Human herpesvirus 4 (Epstein-Barr virus)
cccuccucugggccgcccggcc

SEQ ID NO: 3965884 - RNA, 20 nt, Human herpesvirus 4 (Epstein-Barr virus)
cccucggugggccagauacu

SEQ ID NO: 3965885 - RNA, 15 nt, Human herpesvirus 4 (Epstein-Barr virus)
cccucugccuccggc

SEQ ID NO: 3965886 - RNA, 14 nt, Human herpesvirus 4 (Epstein-Barr virus)
cccugcaagccaag

SEQ ID NO: 3965887 - RNA, 12 nt, Human herpesvirus 4 (Epstein-Barr virus)
cccugggcucuc

SEQ ID NO: 3965888 - RNA, 23 nt, Human herpesvirus 4 (Epstein-Barr virus)
cccuggggcggcgaugucggggc

SEQ ID NO: 3965889 - RNA, 15 nt, Human herpesvirus 4 (Epstein-Barr virus)
ccgaagaagggaggg

SEQ ID NO: 3965890 - RNA, 24 nt, Human herpesvirus 4 (Epstein-Barr virus)
ccgcaccccccgccaccacggugc

SEQ ID NO: 3965891 - RNA, 15 nt, Human herpesvirus 4 (Epstein-Barr virus)
ccgccuagagcauuu

SEQ ID NO: 3965892 - RNA, 14 nt, Human herpesvirus 4 (Epstein-Barr virus)
ccgcgcccuccucu

SEQ ID NO: 3965893 - RNA, 17 nt, Human herpesvirus 4 (Epstein-Barr virus)
ccggcaccgccaggugg

SEQ ID NO: 3965894 - RNA, 15 nt, Human herpesvirus 4 (Epstein-Barr virus)
ccggcauccagugcg

SEQ ID NO: 3965895 - RNA, 15 nt, Human herpesvirus 4 (Epstein-Barr virus)
ccggccaugggggcu

SEQ ID NO: 3965896 - RNA, 12 nt, Human herpesvirus 4 (Epstein-Barr virus)
ccggccucgccu

SEQ ID NO: 3965897 - RNA, 13 nt, Human herpesvirus 4 (Epstein-Barr virus)
ccggcggcagugg

SEQ ID NO: 3965898 - RNA, 14 nt, Human herpesvirus 4 (Epstein-Barr virus)
ccggggaggccagg

SEQ ID NO: 3965899 - RNA, 17 nt, Human herpesvirus 4 (Epstein-Barr virus)
ccgguccccccagaagc

SEQ ID NO: 3965900 - RNA, 20 nt, Human herpesvirus 4 (Epstein-Barr virus)
ccgguccccccagaagcccc

SEQ ID NO: 3965901 - RNA, 19 nt, Human herpesvirus 4 (Epstein-Barr virus)
ccgucccggguacaagucc

SEQ ID NO: 3965902 - RNA, 15 nt, Human herpesvirus 4 (Epstein-Barr virus)
ccuacgcagaggcca

SEQ ID NO: 3965903 - RNA, 22 nt, Human herpesvirus 4 (Epstein-Barr virus)
ccuagagguuuugcuagggagg

SEQ ID NO: 3965904 - RNA, 19 nt, Human herpesvirus 4 (Epstein-Barr virus)
ccuagccaccguggccagg

SEQ ID NO: 3965905 - RNA, 23 nt, Human herpesvirus 4 (Epstein-Barr virus)
ccucacgcgaagggaaacguggg

SEQ ID NO: 3965906 - RNA, 17 nt, Human herpesvirus 4 (Epstein-Barr virus)
ccuccaacaggugcccg

SEQ ID NO: 3965907 - RNA, 22 nt, Human herpesvirus 4 (Epstein-Barr virus)
ccuccaagcggcacagauuaga

SEQ ID NO: 3965908 - RNA, 21 nt, Human herpesvirus 4 (Epstein-Barr virus)
ccuccaccgccgguuaacuuu

SEQ ID NO: 3965909 - RNA, 13 nt, Human herpesvirus 4 (Epstein-Barr virus)
ccuccuggccagc

SEQ ID NO: 3965910 - RNA, 23 nt, Human herpesvirus 4 (Epstein-Barr virus)
ccucgaguaggugccuccagagc

SEQ ID NO: 3965911 - RNA, 23 nt, Human herpesvirus 4 (Epstein-Barr virus)
ccucgcaggccccccgcaccagg

SEQ ID NO: 3965912 - RNA, 13 nt, Human herpesvirus 4 (Epstein-Barr virus)
ccucgguggccug

SEQ ID NO: 3965913 - RNA, 21 nt, Human herpesvirus 4 (Epstein-Barr virus)
ccucgugcaaccaggcccacu

SEQ ID NO: 3965914 - RNA, 15 nt, Human herpesvirus 4 (Epstein-Barr virus)
ccucugggguccagg

SEQ ID NO: 3965915 - RNA, 19 nt, Human herpesvirus 4 (Epstein-Barr virus)
ccugaagcuugcuggggcg

SEQ ID NO: 3965916 - RNA, 18 nt, Human herpesvirus 4 (Epstein-Barr virus)
ccugcaccaguggcugcc

SEQ ID NO: 3965917 - RNA, 17 nt, Human herpesvirus 4 (Epstein-Barr virus)
cucuguuccuucugcuc

SEQ ID NO: 3965918 - RNA, 22 nt, Human herpesvirus 4 (Epstein-Barr virus)
cucuugaagaucgugaggccug

SEQ ID NO: 3965919 - RNA, 23 nt, Human herpesvirus 4 (Epstein-Barr virus)
cugaacaucucauccccagaggg

SEQ ID NO: 3965920 - RNA, 13 nt, Human herpesvirus 4 (Epstein-Barr virus)
cugacauuucuca

SEQ ID NO: 3965921 - RNA, 18 nt, Human herpesvirus 4 (Epstein-Barr virus)
cugacuggcagaaaggcu

SEQ ID NO: 3965922 - RNA, 21 nt, Human herpesvirus 4 (Epstein-Barr virus)
cugagcauggcggccuggcag

SEQ ID NO: 3965923 - RNA, 15 nt, Human herpesvirus 4 (Epstein-Barr virus)
cugcaucuuccaggu

SEQ ID NO: 3965924 - RNA, 14 nt, Human herpesvirus 4 (Epstein-Barr virus)
cugccccucagccu

SEQ ID NO: 3965925 - RNA, 15 nt, Human herpesvirus 4 (Epstein-Barr virus)
cugccgcuacugcug

SEQ ID NO: 3965926 - RNA, 21 nt, Human herpesvirus 4 (Epstein-Barr virus)
cugccggaguuuucuccccca

SEQ ID NO: 3965927 - RNA, 17 nt, Human herpesvirus 4 (Epstein-Barr virus)
cugccuggaucugagcu

SEQ ID NO: 3965928 - RNA, 19 nt, Human herpesvirus 4 (Epstein-Barr virus)
cugcucuucaaccuuggca

SEQ ID NO: 3965929 - RNA, 21 nt, Human herpesvirus 4 (Epstein-Barr virus)
cuggaacggugggaagcucag

SEQ ID NO: 3965930 - RNA, 14 nt, Human herpesvirus 4 (Epstein-Barr virus)
cuggagcuggugca

SEQ ID NO: 3965931 - RNA, 15 nt, Human herpesvirus 4 (Epstein-Barr virus)
cuggaucuggggcug

SEQ ID NO: 3965932 - RNA, 12 nt, Human herpesvirus 4 (Epstein-Barr virus)
cuggcacacacu

SEQ ID NO: 3965933 - RNA, 17 nt, Human herpesvirus 4 (Epstein-Barr virus)
cuggcacacacucccuu

SEQ ID NO: 3965934 - RNA, 16 nt, Human herpesvirus 4 (Epstein-Barr virus)
cuggcauacucuucau

SEQ ID NO: 3965935 - RNA, 22 nt, Human herpesvirus 4 (Epstein-Barr virus)
cuggccaccacaucggacgggc

SEQ ID NO: 3965936 - RNA, 18 nt, Human herpesvirus 4 (Epstein-Barr virus)
cuggcggccgcugcgccc

SEQ ID NO: 3965937 - RNA, 12 nt, Human herpesvirus 4 (Epstein-Barr virus)
cuggcuccccau

SEQ ID NO: 3965938 - RNA, 14 nt, Human herpesvirus 4 (Epstein-Barr virus)
cugggcucucagga

SEQ ID NO: 3965939 - RNA, 16 nt, Human herpesvirus 4 (Epstein-Barr virus)
cuggucauggcggacu

SEQ ID NO: 3965940 - RNA, 21 nt, Human herpesvirus 4 (Epstein-Barr virus)
cuggugagaaguugguggugg

SEQ ID NO: 3965941 - RNA, 12 nt, Human herpesvirus 4 (Epstein-Barr virus)
cuguagccaccc

SEQ ID NO: 3965942 - RNA, 19 nt, Human herpesvirus 4 (Epstein-Barr virus)
cugucauugagguaaaaag

SEQ ID NO: 3965943 - RNA, 13 nt, Human herpesvirus 4 (Epstein-Barr virus)
cuguccugcugaa

SEQ ID NO: 3965944 - RNA, 13 nt, Human herpesvirus 4 (Epstein-Barr virus)
cugucucucuuug

SEQ ID NO: 3965945 - RNA, 21 nt, Human herpesvirus 4 (Epstein-Barr virus)
cugucucuuucuggccaaccu

SEQ ID NO: 3965946 - RNA, 16 nt, Human herpesvirus 4 (Epstein-Barr virus)
cuuaacuugacuacaa

SEQ ID NO: 3965947 - RNA, 15 nt, Human herpesvirus 4 (Epstein-Barr virus)
cuucauguccacuga

SEQ ID NO: 3965948 - RNA, 22 nt, Human herpesvirus 4 (Epstein-Barr virus)
cuuccacccccuggagccagcg

SEQ ID NO: 3965949 - RNA, 19 nt, Human herpesvirus 4 (Epstein-Barr virus)
cuucccagcuaguagcccu

SEQ ID NO: 3965950 - RNA, 14 nt, Human herpesvirus 4 (Epstein-Barr virus)
cuucguauaugugu

SEQ ID NO: 3965951 - RNA, 14 nt, Human herpesvirus 4 (Epstein-Barr virus)
cuucuggaacauuu

SEQ ID NO: 3965952 - RNA, 16 nt, Human herpesvirus 4 (Epstein-Barr virus)
cuugaccaguguguac

SEQ ID NO: 3965953 - RNA, 16 nt, Human herpesvirus 4 (Epstein-Barr virus)
cuugaccuugauguac

SEQ ID NO: 3965954 - RNA, 20 nt, Human herpesvirus 4 (Epstein-Barr virus)
cuugagcgccguggccaccu

SEQ ID NO: 3965955 - RNA, 16 nt, Human herpesvirus 4 (Epstein-Barr virus)
cuuggacccugcugcg

SEQ ID NO: 3965956 - RNA, 20 nt, Human herpesvirus 4 (Epstein-Barr virus)
cuuggggguggugggcuccu

SEQ ID NO: 3965957 - RNA, 15 nt, Human herpesvirus 4 (Epstein-Barr virus)
cuugguuucagccuc

SEQ ID NO: 3965958 - RNA, 17 nt, Human herpesvirus 4 (Epstein-Barr virus)
cuuucaguggucaccgg

SEQ ID NO: 3965959 - RNA, 19 nt, Human herpesvirus 4 (Epstein-Barr virus)
cuuucuggccaaccugccu

SEQ ID NO: 3965960 - RNA, 17 nt, Human herpesvirus 4 (Epstein-Barr virus)
cuuuuggccuucuuccu

SEQ ID NO: 3965961 - RNA, 15 nt, Human herpesvirus 4 (Epstein-Barr virus)
gaaaaacuggccaug

SEQ ID NO: 3965962 - RNA, 17 nt, Human herpesvirus 4 (Epstein-Barr virus)
gaaaccccacggagcag

SEQ ID NO: 3965963 - RNA, 14 nt, Human herpesvirus 4 (Epstein-Barr virus)
gaaacgucaggucu

SEQ ID NO: 3965964 - RNA, 15 nt, Human herpesvirus 4 (Epstein-Barr virus)
gaaacuugggggcag

SEQ ID NO: 3965965 - RNA, 15 nt, Human herpesvirus 4 (Epstein-Barr virus)
gaacauggaugugaa

SEQ ID NO: 3965966 - RNA, 15 nt, Human herpesvirus 4 (Epstein-Barr virus)
gaacugacgcuccag

SEQ ID NO: 3965967 - RNA, 16 nt, Human herpesvirus 4 (Epstein-Barr virus)
gaagacuccugccuga

SEQ ID NO: 3965968 - RNA, 15 nt, Human herpesvirus 4 (Epstein-Barr virus)
gaagcuggccaggcu

SEQ ID NO: 3965969 - RNA, 19 nt, Human herpesvirus 4 (Epstein-Barr virus)
gaaggaacggcggagagua

SEQ ID NO: 3965970 - RNA, 13 nt, Human herpesvirus 4 (Epstein-Barr virus)
gacaaggcaggcg

SEQ ID NO: 3965971 - RNA, 20 nt, Human herpesvirus 4 (Epstein-Barr virus)
gacacuuuagagcucuggag

SEQ ID NO: 3965972 - RNA, 14 nt, Human herpesvirus 4 (Epstein-Barr virus)
gacaugcagacucc

SEQ ID NO: 3965973 - RNA, 17 nt, Human herpesvirus 4 (Epstein-Barr virus)
gacauucuucugaagga

SEQ ID NO: 3965974 - RNA, 22 nt, Human herpesvirus 4 (Epstein-Barr virus)
gacauugguguuccacagccug

SEQ ID NO: 3965975 - RNA, 14 nt, Human herpesvirus 4 (Epstein-Barr virus)
gaccaccuggccag

SEQ ID NO: 3965976 - RNA, 19 nt, Human herpesvirus 4 (Epstein-Barr virus)
gacccgaucagagccccau

SEQ ID NO: 3965977 - RNA, 18 nt, Human herpesvirus 4 (Epstein-Barr virus)
gaccggcuacgcgggcca

SEQ ID NO: 3965978 - RNA, 17 nt, Human herpesvirus 4 (Epstein-Barr virus)
gaccucaaagaagaggg

SEQ ID NO: 3965979 - RNA, 16 nt, Human herpesvirus 4 (Epstein-Barr virus)
gaccucccgcccugag

SEQ ID NO: 3965980 - RNA, 16 nt, Human herpesvirus 4 (Epstein-Barr virus)
gacgcggagaggucca

SEQ ID NO: 3965981 - RNA, 16 nt, Human herpesvirus 4 (Epstein-Barr virus)
gacggugaccugacug

SEQ ID NO: 3965982 - RNA, 15 nt, Human herpesvirus 4 (Epstein-Barr virus)
gacugauccgcagaa

SEQ ID NO: 3965983 - RNA, 14 nt, Human herpesvirus 4 (Epstein-Barr virus)
gacugcaaacccug

SEQ ID NO: 3965984 - RNA, 23 nt, Human herpesvirus 4 (Epstein-Barr virus)
gacuggggugugaagggcagggc

SEQ ID NO: 3965985 - RNA, 23 nt, Human herpesvirus 4 (Epstein-Barr virus)
gacugggucgugguuuucugccc

SEQ ID NO: 3965986 - RNA, 15 nt, Human herpesvirus 4 (Epstein-Barr virus)
gagacacggcucugu

SEQ ID NO: 3965987 - RNA, 19 nt, Human herpesvirus 4 (Epstein-Barr virus)
gagaggccucuggggucca

SEQ ID NO: 3965988 - RNA, 13 nt, Human herpesvirus 4 (Epstein-Barr virus)
gagaucaggccaa

SEQ ID NO: 3965989 - RNA, 20 nt, Human herpesvirus 4 (Epstein-Barr virus)
gagaugugaauugggauggu

SEQ ID NO: 3965990 - RNA, 17 nt, Human herpesvirus 4 (Epstein-Barr virus)
gagcacauuccccccgc

SEQ ID NO: 3965991 - RNA, 21 nt, Human herpesvirus 4 (Epstein-Barr virus)
gagcagauuuccgucagccag

SEQ ID NO: 3965992 - RNA, 13 nt, Human herpesvirus 4 (Epstein-Barr virus)
gagcagggcccag

SEQ ID NO: 3965993 - RNA, 14 nt, Human herpesvirus 4 (Epstein-Barr virus)
gagcauggcggccu

SEQ ID NO: 3965994 - RNA, 18 nt, Human herpesvirus 4 (Epstein-Barr virus)
gagcauggcggccuggca

SEQ ID NO: 3965995 - RNA, 19 nt, Human herpesvirus 4 (Epstein-Barr virus)
gagcgcccaccgaccccau

SEQ ID NO: 3965996 - RNA, 14 nt, Human herpesvirus 4 (Epstein-Barr virus)
gagcggcaagggcu

SEQ ID NO: 3965997 - RNA, 20 nt, Human herpesvirus 4 (Epstein-Barr virus)
gagcgggaggggcaggagca

SEQ ID NO: 3965998 - RNA, 19 nt, Human herpesvirus 4 (Epstein-Barr virus)
gagcugagugcccagggca

SEQ ID NO: 3965999 - RNA, 15 nt, Human herpesvirus 4 (Epstein-Barr virus)
gagcuggacgagguc

SEQ ID NO: 3966000 - RNA, 19 nt, Human herpesvirus 4 (Epstein-Barr virus)
gaggcgggaauggccgcca

SEQ ID NO: 3966001 - RNA, 23 nt, Human herpesvirus 4 (Epstein-Barr virus)
gaggcguguggaaguacgagauc

SEQ ID NO: 3966002 - RNA, 21 nt, Human herpesvirus 4 (Epstein-Barr virus)
gagucacaccccacggccaug

SEQ ID NO: 3966003 - RNA, 22 nt, Human herpesvirus 4 (Epstein-Barr virus)
gauagcauggccgccagaguuc

SEQ ID NO: 3966004 - RNA, 20 nt, Human herpesvirus 4 (Epstein-Barr virus)
gauauagcucugcacaggcu

SEQ ID NO: 3966005 - RNA, 14 nt, Human herpesvirus 4 (Epstein-Barr virus)
ccugcauggccagg

SEQ ID NO: 3966006 - RNA, 18 nt, Human herpesvirus 4 (Epstein-Barr virus)
ccugccucucuuaugccu

SEQ ID NO: 3966007 - RNA, 16 nt, Human herpesvirus 4 (Epstein-Barr virus)
ccuggcggcccagccc

SEQ ID NO: 3966008 - RNA, 22 nt, Human herpesvirus 4 (Epstein-Barr virus)
ccugggcugccccgggcccacc

SEQ ID NO: 3966009 - RNA, 16 nt, Human herpesvirus 4 (Epstein-Barr virus)
ccugggggccuguguc

SEQ ID NO: 3966010 - RNA, 21 nt, Human herpesvirus 4 (Epstein-Barr virus)
ccugucucucuuugagggggc

SEQ ID NO: 3966011 - RNA, 21 nt, Human herpesvirus 4 (Epstein-Barr virus)
ccuuccagagcucuacaaccc

SEQ ID NO: 3966012 - RNA, 16 nt, Human herpesvirus 4 (Epstein-Barr virus)
ccuuccucugcccgcu

SEQ ID NO: 3966013 - RNA, 15 nt, Human herpesvirus 4 (Epstein-Barr virus)
ccuucucaugcuccu

SEQ ID NO: 3966014 - RNA, 14 nt, Human herpesvirus 4 (Epstein-Barr virus)
ccuucuccucagcc

SEQ ID NO: 3966015 - RNA, 19 nt, Human herpesvirus 4 (Epstein-Barr virus)
ccuugaggugccacagagc

SEQ ID NO: 3966016 - RNA, 20 nt, Human herpesvirus 4 (Epstein-Barr virus)
ccuuggauccccuuaaucua

SEQ ID NO: 3966017 - RNA, 21 nt, Human herpesvirus 4 (Epstein-Barr virus)
ccuugggugaccuggccaggc

SEQ ID NO: 3966018 - RNA, 18 nt, Human herpesvirus 4 (Epstein-Barr virus)
ccuugguuucagccucac

SEQ ID NO: 3966019 - RNA, 16 nt, Human herpesvirus 4 (Epstein-Barr virus)
ccuuuuaauucucuuc

SEQ ID NO: 3966020 - RNA, 15 nt, Human herpesvirus 4 (Epstein-Barr virus)
cgagaaaaugagcca

SEQ ID NO: 3966021 - RNA, 17 nt, Human herpesvirus 4 (Epstein-Barr virus)
cgagaagacguuguagg

SEQ ID NO: 3966022 - RNA, 18 nt, Human herpesvirus 4 (Epstein-Barr virus)
cgagagaagagagcggcg

SEQ ID NO: 3966023 - RNA, 19 nt, Human herpesvirus 4 (Epstein-Barr virus)
cgagcucuccagccacggc

SEQ ID NO: 3966024 - RNA, 23 nt, Human herpesvirus 4 (Epstein-Barr virus)
cgaggaggcggaagaccaggagc

SEQ ID NO: 3966025 - RNA, 19 nt, Human herpesvirus 4 (Epstein-Barr virus)
cgaucccaggccucagcgu

SEQ ID NO: 3966026 - RNA, 13 nt, Human herpesvirus 4 (Epstein-Barr virus)
cgcaccacagaaa

SEQ ID NO: 3966027 - RNA, 16 nt, Human herpesvirus 4 (Epstein-Barr virus)
cgcaccaccgcagcca

SEQ ID NO: 3966028 - RNA, 19 nt, Human herpesvirus 4 (Epstein-Barr virus)
cgcaccuguguccugggca

SEQ ID NO: 3966029 - RNA, 14 nt, Human herpesvirus 4 (Epstein-Barr virus)
cgccaugcucaggg

SEQ ID NO: 3966030 - RNA, 21 nt, Human herpesvirus 4 (Epstein-Barr virus)
cgcccacacagcgccagcagg

SEQ ID NO: 3966031 - RNA, 13 nt, Human herpesvirus 4 (Epstein-Barr virus)
cgccugcuucacg

SEQ ID NO: 3966032 - RNA, 16 nt, Human herpesvirus 4 (Epstein-Barr virus)
cgcgacucgugggaaa

SEQ ID NO: 3966033 - RNA, 16 nt, Human herpesvirus 4 (Epstein-Barr virus)
cgcgcagccuguucau

SEQ ID NO: 3966034 - RNA, 11 nt, Human herpesvirus 4 (Epstein-Barr virus)
cgcugcugcua

SEQ ID NO: 3966035 - RNA, 19 nt, Human herpesvirus 4 (Epstein-Barr virus)
cgcuggcucgccucauccu

SEQ ID NO: 3966036 - RNA, 16 nt, Human herpesvirus 4 (Epstein-Barr virus)
cgcuguuuugcagcug

SEQ ID NO: 3966037 - RNA, 14 nt, Human herpesvirus 4 (Epstein-Barr virus)
cggaagcccucugg

SEQ ID NO: 3966038 - RNA, 17 nt, Human herpesvirus 4 (Epstein-Barr virus)
cggaagggcaccguggg

SEQ ID NO: 3966039 - RNA, 16 nt, Human herpesvirus 4 (Epstein-Barr virus)
cggagagggaugggcu

SEQ ID NO: 3966040 - RNA, 18 nt, Human herpesvirus 4 (Epstein-Barr virus)
cggagguggagaggcccg

SEQ ID NO: 3966041 - RNA, 20 nt, Human herpesvirus 4 (Epstein-Barr virus)
cggcggggaacgugacaggc

SEQ ID NO: 3966042 - RNA, 16 nt, Human herpesvirus 4 (Epstein-Barr virus)
cggcgugccagaggcc

SEQ ID NO: 3966043 - RNA, 22 nt, Human herpesvirus 4 (Epstein-Barr virus)
cggcuagccugacuaaggguga

SEQ ID NO: 3966044 - RNA, 18 nt, Human herpesvirus 4 (Epstein-Barr virus)
cggcuggccgccguggcc

SEQ ID NO: 3966045 - RNA, 14 nt, Human herpesvirus 4 (Epstein-Barr virus)
cggcugugagcgca

SEQ ID NO: 3966046 - RNA, 14 nt, Human herpesvirus 4 (Epstein-Barr virus)
cgggccuggggcca

SEQ ID NO: 3966047 - RNA, 12 nt, Human herpesvirus 4 (Epstein-Barr virus)
cggggcugggga

SEQ ID NO: 3966048 - RNA, 22 nt, Human herpesvirus 4 (Epstein-Barr virus)
cgggggucaagcaaacggccug

SEQ ID NO: 3966049 - RNA, 16 nt, Human herpesvirus 4 (Epstein-Barr virus)
cggggguucuccaggc

SEQ ID NO: 3966050 - RNA, 14 nt, Human herpesvirus 4 (Epstein-Barr virus)
cgggucccgccucu

SEQ ID NO: 3966051 - RNA, 17 nt, Human herpesvirus 4 (Epstein-Barr virus)
cgguggugggcugcuga

SEQ ID NO: 3966052 - RNA, 21 nt, Human herpesvirus 4 (Epstein-Barr virus)
cggugucugugguugucuucc

SEQ ID NO: 3966053 - RNA, 13 nt, Human herpesvirus 4 (Epstein-Barr virus)
cguagaugagccu

SEQ ID NO: 3966054 - RNA, 18 nt, Human herpesvirus 4 (Epstein-Barr virus)
cgucacucggacuaucaa

SEQ ID NO: 3966055 - RNA, 15 nt, Human herpesvirus 4 (Epstein-Barr virus)
cgucagccaggguga

SEQ ID NO: 3966056 - RNA, 21 nt, Human herpesvirus 4 (Epstein-Barr virus)
cguccucgugagucugcugga

SEQ ID NO: 3966057 - RNA, 17 nt, Human herpesvirus 4 (Epstein-Barr virus)
cguccuuguccaggaga

SEQ ID NO: 3966058 - RNA, 19 nt, Human herpesvirus 4 (Epstein-Barr virus)
cgucugcaccccaguggac

SEQ ID NO: 3966059 - RNA, 16 nt, Human herpesvirus 4 (Epstein-Barr virus)
cgucuuacugcccagc

SEQ ID NO: 3966060 - RNA, 14 nt, Human herpesvirus 4 (Epstein-Barr virus)
cguggguccccucu

SEQ ID NO: 3966061 - RNA, 20 nt, Human herpesvirus 4 (Epstein-Barr virus)
cgugguggcauuaaugucca

SEQ ID NO: 3966062 - RNA, 17 nt, Human herpesvirus 4 (Epstein-Barr virus)
cgugguugggcagaacc

SEQ ID NO: 3966063 - RNA, 16 nt, Human herpesvirus 4 (Epstein-Barr virus)
cguguuccacaaugcc

SEQ ID NO: 3966064 - RNA, 20 nt, Human herpesvirus 4 (Epstein-Barr virus)
cuaaggcaguccaggggcca

SEQ ID NO: 3966065 - RNA, 17 nt, Human herpesvirus 4 (Epstein-Barr virus)
cuaaugccaugcagcgg

SEQ ID NO: 3966066 - RNA, 16 nt, Human herpesvirus 4 (Epstein-Barr virus)
cuacaccaccccacca

SEQ ID NO: 3966067 - RNA, 20 nt, Human herpesvirus 4 (Epstein-Barr virus)
cuacgagggccucuggcacg

SEQ ID NO: 3966068 - RNA, 14 nt, Human herpesvirus 4 (Epstein-Barr virus)
cuacgcagaggcca

SEQ ID NO: 3966069 - RNA, 21 nt, Human herpesvirus 4 (Epstein-Barr virus)
cuagcguacagaaggagaugg

SEQ ID NO: 3966070 - RNA, 15 nt, Human herpesvirus 4 (Epstein-Barr virus)
cuaguugguccaggg

SEQ ID NO: 3966071 - RNA, 16 nt, Human herpesvirus 4 (Epstein-Barr virus)
cuauagauccugggcc

SEQ ID NO: 3966072 - RNA, 14 nt, Human herpesvirus 4 (Epstein-Barr virus)
cuauggaggccccc

SEQ ID NO: 3966073 - RNA, 21 nt, Human herpesvirus 4 (Epstein-Barr virus)
cucacuucuacucuuggcagc

SEQ ID NO: 3966074 - RNA, 14 nt, Human herpesvirus 4 (Epstein-Barr virus)
cucagagagcauuu

SEQ ID NO: 3966075 - RNA, 18 nt, Human herpesvirus 4 (Epstein-Barr virus)
cucaggccucccagucua

SEQ ID NO: 3966076 - RNA, 19 nt, Human herpesvirus 4 (Epstein-Barr virus)
cuccaaucaccagccaccu

SEQ ID NO: 3966077 - RNA, 17 nt, Human herpesvirus 4 (Epstein-Barr virus)
cuccagccacggcgacc

SEQ ID NO: 3966078 - RNA, 16 nt, Human herpesvirus 4 (Epstein-Barr virus)
cuccaggcuccuggau

SEQ ID NO: 3966079 - RNA, 14 nt, Human herpesvirus 4 (Epstein-Barr virus)
cuccagugcgagga

SEQ ID NO: 3966080 - RNA, 22 nt, Human herpesvirus 4 (Epstein-Barr virus)
cuccauuuacugggaaugccuu

SEQ ID NO: 3966081 - RNA, 13 nt, Human herpesvirus 4 (Epstein-Barr virus)
cucccgcccugag

SEQ ID NO: 3966082 - RNA, 16 nt, Human herpesvirus 4 (Epstein-Barr virus)
cuccucagucuuugca

SEQ ID NO: 3966083 - RNA, 13 nt, Human herpesvirus 4 (Epstein-Barr virus)
cuccuccacccag

SEQ ID NO: 3966084 - RNA, 14 nt, Human herpesvirus 4 (Epstein-Barr virus)
cucgaguucucuag

SEQ ID NO: 3966085 - RNA, 16 nt, Human herpesvirus 4 (Epstein-Barr virus)
cucgcuggcucgccuc

SEQ ID NO: 3966086 - RNA, 15 nt, Human herpesvirus 4 (Epstein-Barr virus)
cucggccacacagug

SEQ ID NO: 3966087 - RNA, 23 nt, Human herpesvirus 4 (Epstein-Barr virus)
cucuacaauugccaaguacugaa

SEQ ID NO: 3966088 - RNA, 16 nt, Human herpesvirus 4 (Epstein-Barr virus)
cucucgcccaagcugc

SEQ ID NO: 3966089 - RNA, 20 nt, Human herpesvirus 4 (Epstein-Barr virus)
cucucuggcugugcugaccc

SEQ ID NO: 3966090 - RNA, 15 nt, Human herpesvirus 4 (Epstein-Barr virus)
cucugaccgacgggc

SEQ ID NO: 3966091 - RNA, 16 nt, Human herpesvirus 4 (Epstein-Barr virus)
cucuggcugugcugac

SEQ ID NO: 3966092 - RNA, 22 nt, Human herpesvirus 4 (Epstein-Barr virus)
cucugguaguaggcacaucugg

SEQ ID NO: 3966093 - RNA, 21 nt, Human herpesvirus 4 (Epstein-Barr virus)
uagaauuguuaguuuaaacag

SEQ ID NO: 3966094 - RNA, 16 nt, Human herpesvirus 4 (Epstein-Barr virus)
uagggagguggccaca

SEQ ID NO: 3966095 - RNA, 15 nt, Human herpesvirus 4 (Epstein-Barr virus)
uagggguaacccugu

SEQ ID NO: 3966096 - RNA, 17 nt, Human herpesvirus 4 (Epstein-Barr virus)
uauacuaacacgaaugc

SEQ ID NO: 3966097 - RNA, 16 nt, Human herpesvirus 4 (Epstein-Barr virus)
uaugcaaugcccaccc

SEQ ID NO: 3966098 - RNA, 20 nt, Human herpesvirus 4 (Epstein-Barr virus)
uauggacacuugguaaguuu

SEQ ID NO: 3966099 - RNA, 18 nt, Human herpesvirus 4 (Epstein-Barr virus)
uauggauagauagccacc

SEQ ID NO: 3966100 - RNA, 16 nt, Human herpesvirus 4 (Epstein-Barr virus)
uauugaugugacuugu

SEQ ID NO: 3966101 - RNA, 23 nt, Human herpesvirus 4 (Epstein-Barr virus)
ucaaaggccuugguuucagccuc

SEQ ID NO: 3966102 - RNA, 18 nt, Human herpesvirus 4 (Epstein-Barr virus)
ucaacuucagcuccaggg

SEQ ID NO: 3966103 - RNA, 15 nt, Human herpesvirus 4 (Epstein-Barr virus)
ucaaggcagucucca

SEQ ID NO: 3966104 - RNA, 22 nt, Human herpesvirus 4 (Epstein-Barr virus)
ucaaggggcacgagauggccca

SEQ ID NO: 3966105 - RNA, 21 nt, Human herpesvirus 4 (Epstein-Barr virus)
ucacaccccacggccaugcua

SEQ ID NO: 3966106 - RNA, 17 nt, Human herpesvirus 4 (Epstein-Barr virus)
ucaccugcacagaucug

SEQ ID NO: 3966107 - RNA, 13 nt, Human herpesvirus 4 (Epstein-Barr virus)
ucagaaaagugag

SEQ ID NO: 3966108 - RNA, 18 nt, Human herpesvirus 4 (Epstein-Barr virus)
ucagaagaauguccaaaa

SEQ ID NO: 3966109 - RNA, 17 nt, Human herpesvirus 4 (Epstein-Barr virus)
ucagauagccggaccuc

SEQ ID NO: 3966110 - RNA, 14 nt, Human herpesvirus 4 (Epstein-Barr virus)
ucagcaucacaggu

SEQ ID NO: 3966111 - RNA, 17 nt, Human herpesvirus 4 (Epstein-Barr virus)
ucagcgucaggagaggg

SEQ ID NO: 3966112 - RNA, 16 nt, Human herpesvirus 4 (Epstein-Barr virus)
ucaggccgccgcaucc

SEQ ID NO: 3966113 - RNA, 20 nt, Human herpesvirus 4 (Epstein-Barr virus)
ucauauguaugccuuggcau

SEQ ID NO: 3966114 - RNA, 16 nt, Human herpesvirus 4 (Epstein-Barr virus)
ucaucucaagggagga

SEQ ID NO: 3966115 - RNA, 13 nt, Human herpesvirus 4 (Epstein-Barr virus)
ucaucucgcuggc

SEQ ID NO: 3966116 - RNA, 15 nt, Human herpesvirus 4 (Epstein-Barr virus)
ucauggccgacgagg

SEQ ID NO: 3966117 - RNA, 22 nt, Human herpesvirus 4 (Epstein-Barr virus)
uccaacgagggcagacaccacc

SEQ ID NO: 3966118 - RNA, 19 nt, Human herpesvirus 4 (Epstein-Barr virus)
uccacagccccacucuugc

SEQ ID NO: 3966119 - RNA, 21 nt, Human herpesvirus 4 (Epstein-Barr virus)
uccaccuagaaagagccaugg

SEQ ID NO: 3966120 - RNA, 13 nt, Human herpesvirus 4 (Epstein-Barr virus)
uccagccaucaug

SEQ ID NO: 3966121 - RNA, 12 nt, Human herpesvirus 4 (Epstein-Barr virus)
uccagggcccug

SEQ ID NO: 3966122 - RNA, 21 nt, Human herpesvirus 4 (Epstein-Barr virus)
ucccacuuuuaccccaguccc

SEQ ID NO: 3966123 - RNA, 19 nt, Human herpesvirus 4 (Epstein-Barr virus)
uccccucugcagagagcca

SEQ ID NO: 3966124 - RNA, 17 nt, Human herpesvirus 4 (Epstein-Barr virus)
uccccugacgcuguggc

SEQ ID NO: 3966125 - RNA, 16 nt, Human herpesvirus 4 (Epstein-Barr virus)
ucccgcauugcgccgc

SEQ ID NO: 3966126 - RNA, 18 nt, Human herpesvirus 4 (Epstein-Barr virus)
uccggagacugaggccuu

SEQ ID NO: 3966127 - RNA, 15 nt, Human herpesvirus 4 (Epstein-Barr virus)
uccuagagggacagc

SEQ ID NO: 3966128 - RNA, 12 nt, Human herpesvirus 4 (Epstein-Barr virus)
uccuccaccgcc

SEQ ID NO: 3966129 - RNA, 16 nt, Human herpesvirus 4 (Epstein-Barr virus)
uccucugccuggccgg

SEQ ID NO: 3966130 - RNA, 22 nt, Human herpesvirus 4 (Epstein-Barr virus)
uccuggcauacuuuuugccacc

SEQ ID NO: 3966131 - RNA, 23 nt, Human herpesvirus 4 (Epstein-Barr virus)
uccuggccggccgcccccugacc

SEQ ID NO: 3966132 - RNA, 17 nt, Human herpesvirus 4 (Epstein-Barr virus)
ucuacgccccagaugaa

SEQ ID NO: 3966133 - RNA, 17 nt, Human herpesvirus 4 (Epstein-Barr virus)
ucuacucgaccagcacg

SEQ ID NO: 3966134 - RNA, 14 nt, Human herpesvirus 4 (Epstein-Barr virus)
ucugcugcugcugg

SEQ ID NO: 3966135 - RNA, 17 nt, Human herpesvirus 4 (Epstein-Barr virus)
ucuggaccuggacuggg

SEQ ID NO: 3966136 - RNA, 22 nt, Human herpesvirus 4 (Epstein-Barr virus)
ucugggccgcccggccucgccu

SEQ ID NO: 3966137 - RNA, 15 nt, Human herpesvirus 4 (Epstein-Barr virus)
ucuggucgcccccuc

SEQ ID NO: 3966138 - RNA, 22 nt, Human herpesvirus 4 (Epstein-Barr virus)
ucuuccgugccucgggccucaa

SEQ ID NO: 3966139 - RNA, 15 nt, Human herpesvirus 4 (Epstein-Barr virus)
ugaaaggggccgagg

SEQ ID NO: 3966140 - RNA, 13 nt, Human herpesvirus 4 (Epstein-Barr virus)
ugaagauggccuc

SEQ ID NO: 3966141 - RNA, 18 nt, Human herpesvirus 4 (Epstein-Barr virus)
ugaccaugauggugcaga

SEQ ID NO: 3966142 - RNA, 20 nt, Human herpesvirus 4 (Epstein-Barr virus)
ugaccucccgcccugagcug

SEQ ID NO: 3966143 - RNA, 19 nt, Human herpesvirus 4 (Epstein-Barr virus)
ugaccucuacacgcuugga

SEQ ID NO: 3966144 - RNA, 12 nt, Human herpesvirus 4 (Epstein-Barr virus)
ugacugagcgca

SEQ ID NO: 3966145 - RNA, 15 nt, Human herpesvirus 4 (Epstein-Barr virus)
ugaggccugagagcc

SEQ ID NO: 3966146 - RNA, 16 nt, Human herpesvirus 4 (Epstein-Barr virus)
ugaguccccuccuugg

SEQ ID NO: 3966147 - RNA, 13 nt, Human herpesvirus 4 (Epstein-Barr virus)
ugagucucucgag

SEQ ID NO: 3966148 - RNA, 14 nt, Human herpesvirus 4 (Epstein-Barr virus)
ugaucagggagaac

SEQ ID NO: 3966149 - RNA, 16 nt, Human herpesvirus 4 (Epstein-Barr virus)
ugcaaguuuggccgcu

SEQ ID NO: 3966150 - RNA, 18 nt, Human herpesvirus 4 (Epstein-Barr virus)
ugcacagacuagcgagga

SEQ ID NO: 3966151 - RNA, 15 nt, Human herpesvirus 4 (Epstein-Barr virus)
ugcaccagcuccagg

SEQ ID NO: 3966152 - RNA, 22 nt, Human herpesvirus 4 (Epstein-Barr virus)
ugcaccgauagcauggccgcca

SEQ ID NO: 3966153 - RNA, 22 nt, Human herpesvirus 4 (Epstein-Barr virus)
ugcagcgcccugucccuggagc

SEQ ID NO: 3966154 - RNA, 15 nt, Human herpesvirus 4 (Epstein-Barr virus)
ugcauccgcaccaca

SEQ ID NO: 3966155 - RNA, 17 nt, Human herpesvirus 4 (Epstein-Barr virus)
ugcauggagaagcugga

SEQ ID NO: 3966156 - RNA, 14 nt, Human herpesvirus 4 (Epstein-Barr virus)
ugcauggccaggcc

SEQ ID NO: 3966157 - RNA, 13 nt, Human herpesvirus 4 (Epstein-Barr virus)
ugccaaagcugaa

SEQ ID NO: 3966158 - RNA, 15 nt, Human herpesvirus 4 (Epstein-Barr virus)
ugccaucgggacaga

SEQ ID NO: 3966159 - RNA, 16 nt, Human herpesvirus 4 (Epstein-Barr virus)
ugccaugcacggcccu

SEQ ID NO: 3966160 - RNA, 22 nt, Human herpesvirus 4 (Epstein-Barr virus)
ugcccaccagagggugagccca

SEQ ID NO: 3966161 - RNA, 16 nt, Human herpesvirus 4 (Epstein-Barr virus)
ugcccccgccagcgcc

SEQ ID NO: 3966162 - RNA, 21 nt, Human herpesvirus 4 (Epstein-Barr virus)
ugcccucuccagcaaccaaug

SEQ ID NO: 3966163 - RNA, 18 nt, Human herpesvirus 4 (Epstein-Barr virus)
ugccgggcccgggacagc

SEQ ID NO: 3966164 - RNA, 16 nt, Human herpesvirus 4 (Epstein-Barr virus)
ugccuccagagccccu

SEQ ID NO: 3966165 - RNA, 19 nt, Human herpesvirus 4 (Epstein-Barr virus)
ugccuccggccgccccggg

SEQ ID NO: 3966166 - RNA, 22 nt, Human herpesvirus 4 (Epstein-Barr virus)
ugccuggaagaaucauggccua

SEQ ID NO: 3966167 - RNA, 17 nt, Human herpesvirus 4 (Epstein-Barr virus)
ugcucaaggcagucucc

SEQ ID NO: 3966168 - RNA, 12 nt, Human herpesvirus 4 (Epstein-Barr virus)
ugcugccugggg

SEQ ID NO: 3966169 - RNA, 20 nt, Human herpesvirus 4 (Epstein-Barr virus)
ugcuggagauuuucccacug

SEQ ID NO: 3966170 - RNA, 15 nt, Human herpesvirus 4 (Epstein-Barr virus)
ugcuguaguggccuu

SEQ ID NO: 3966171 - RNA, 12 nt, Human herpesvirus 4 (Epstein-Barr virus)
ugcuugugcucc

SEQ ID NO: 3966172 - RNA, 20 nt, Human herpesvirus 4 (Epstein-Barr virus)
uggaaacccucagucacggg

SEQ ID NO: 3966173 - RNA, 16 nt, Human herpesvirus 4 (Epstein-Barr virus)
uggacacccacccugc

SEQ ID NO: 3966174 - RNA, 21 nt, Human herpesvirus 4 (Epstein-Barr virus)
uggaccgugccauccucucgg

SEQ ID NO: 3966175 - RNA, 18 nt, Human herpesvirus 4 (Epstein-Barr virus)
uggacucggccacacagu

SEQ ID NO: 3966176 - RNA, 19 nt, Human herpesvirus 4 (Epstein-Barr virus)
uggagacggugaccugacu

SEQ ID NO: 3966177 - RNA, 15 nt, Human herpesvirus 4 (Epstein-Barr virus)
uggagcuggacggca

SEQ ID NO: 3966178 - RNA, 18 nt, Human herpesvirus 4 (Epstein-Barr virus)
uggagcuguaacuguggu

SEQ ID NO: 3966179 - RNA, 21 nt, Human herpesvirus 4 (Epstein-Barr virus)
uggaggcaauggucgccaggg

SEQ ID NO: 3966180 - RNA, 22 nt, Human herpesvirus 4 (Epstein-Barr virus)
uggagucugagaauaaggcucu

SEQ ID NO: 3966181 - RNA, 21 nt, Human herpesvirus 4 (Epstein-Barr virus)
cuacucaccuacaugucaacc

SEQ ID NO: 3966182 - RNA, 21 nt, Human herpesvirus 4 (Epstein-Barr virus)
cuacucguuuaagguccgcuc

SEQ ID NO: 3966183 - RNA, 16 nt, Human herpesvirus 4 (Epstein-Barr virus)
cuacucuuggcagcag

SEQ ID NO: 3966184 - RNA, 14 nt, Human herpesvirus 4 (Epstein-Barr virus)
cuagguacucuugg

SEQ ID NO: 3966185 - RNA, 22 nt, Human herpesvirus 4 (Epstein-Barr virus)
cuaguaugaaggcuggcaaaga

SEQ ID NO: 3966186 - RNA, 17 nt, Human herpesvirus 4 (Epstein-Barr virus)
cuaucacccauggccag

SEQ ID NO: 3966187 - RNA, 19 nt, Human herpesvirus 4 (Epstein-Barr virus)
cuaugcauuuccugcccuc

SEQ ID NO: 3966188 - RNA, 22 nt, Human herpesvirus 4 (Epstein-Barr virus)
cuauuagcagccuccgggccgc

SEQ ID NO: 3966189 - RNA, 13 nt, Human herpesvirus 4 (Epstein-Barr virus)
cucagagcuggga

SEQ ID NO: 3966190 - RNA, 17 nt, Human herpesvirus 4 (Epstein-Barr virus)
cucagguuucugggcau

SEQ ID NO: 3966191 - RNA, 13 nt, Human herpesvirus 4 (Epstein-Barr virus)
cucauccugcuca

SEQ ID NO: 3966192 - RNA, 16 nt, Human herpesvirus 4 (Epstein-Barr virus)
cucaugcgccagagcg

SEQ ID NO: 3966193 - RNA, 21 nt, Human herpesvirus 4 (Epstein-Barr virus)
cuccaggaucucccgcgccgc

SEQ ID NO: 3966194 - RNA, 19 nt, Human herpesvirus 4 (Epstein-Barr virus)
cucccauguaagccugccu

SEQ ID NO: 3966195 - RNA, 14 nt, Human herpesvirus 4 (Epstein-Barr virus)
cuccccucugcaga

SEQ ID NO: 3966196 - RNA, 18 nt, Human herpesvirus 4 (Epstein-Barr virus)
cuccgagagcuccgccac

SEQ ID NO: 3966197 - RNA, 22 nt, Human herpesvirus 4 (Epstein-Barr virus)
cuccgaugcccaccagccagcg

SEQ ID NO: 3966198 - RNA, 13 nt, Human herpesvirus 4 (Epstein-Barr virus)
cuccggcugcccg

SEQ ID NO: 3966199 - RNA, 22 nt, Human herpesvirus 4 (Epstein-Barr virus)
cucgcccacacagcgccagcag

SEQ ID NO: 3966200 - RNA, 22 nt, Human herpesvirus 4 (Epstein-Barr virus)
cucgguggugggcugcugaggg

SEQ ID NO: 3966201 - RNA, 18 nt, Human herpesvirus 4 (Epstein-Barr virus)
cucgugagucugcuggac

SEQ ID NO: 3966202 - RNA, 14 nt, Human herpesvirus 4 (Epstein-Barr virus)
cucucaggaacucc

SEQ ID NO: 3966203 - RNA, 22 nt, Human herpesvirus 4 (Epstein-Barr virus)
cucucgaggucugcgaugaggc

SEQ ID NO: 3966204 - RNA, 18 nt, Human herpesvirus 4 (Epstein-Barr virus)
cucucuggagaucuucuc

SEQ ID NO: 3966205 - RNA, 20 nt, Human herpesvirus 4 (Epstein-Barr virus)
cucuggcacgccguggcccu

SEQ ID NO: 3966206 - RNA, 22 nt, Human herpesvirus 4 (Epstein-Barr virus)
cucuggucgcccccucugccuc

SEQ ID NO: 3966207 - RNA, 17 nt, Human herpesvirus 4 (Epstein-Barr virus)
cugaagcaacagguccu

SEQ ID NO: 3966208 - RNA, 17 nt, Human herpesvirus 4 (Epstein-Barr virus)
cugacccuucugcugcu

SEQ ID NO: 3966209 - RNA, 19 nt, Human herpesvirus 4 (Epstein-Barr virus)
cugaccucccgcccugagc

SEQ ID NO: 3966210 - RNA, 23 nt, Human herpesvirus 4 (Epstein-Barr virus)
cugaccucccgcccugagcugga

SEQ ID NO: 3966211 - RNA, 14 nt, Human herpesvirus 4 (Epstein-Barr virus)
cugacgaggggcca

SEQ ID NO: 3966212 - RNA, 13 nt, Human herpesvirus 4 (Epstein-Barr virus)
cugacgcuccagg

SEQ ID NO: 3966213 - RNA, 21 nt, Human herpesvirus 4 (Epstein-Barr virus)
cugagaacugacgcuccagga

SEQ ID NO: 3966214 - RNA, 20 nt, Human herpesvirus 4 (Epstein-Barr virus)
cugagcaagauccuucuggc

SEQ ID NO: 3966215 - RNA, 21 nt, Human herpesvirus 4 (Epstein-Barr virus)
cugagcgugugcacccggcug

SEQ ID NO: 3966216 - RNA, 21 nt, Human herpesvirus 4 (Epstein-Barr virus)
cugauuuuccucauuggcuuu

SEQ ID NO: 3966217 - RNA, 16 nt, Human herpesvirus 4 (Epstein-Barr virus)
cugcaccggagccugc

SEQ ID NO: 3966218 - RNA, 12 nt, Human herpesvirus 4 (Epstein-Barr virus)
cugcauggccag

SEQ ID NO: 3966219 - RNA, 13 nt, Human herpesvirus 4 (Epstein-Barr virus)
cugccagccucag

SEQ ID NO: 3966220 - RNA, 23 nt, Human herpesvirus 4 (Epstein-Barr virus)
cugcccauccaucaacuucagcu

SEQ ID NO: 3966221 - RNA, 13 nt, Human herpesvirus 4 (Epstein-Barr virus)
cugccuggaucug

SEQ ID NO: 3966222 - RNA, 16 nt, Human herpesvirus 4 (Epstein-Barr virus)
cugccuggggaaaaug

SEQ ID NO: 3966223 - RNA, 20 nt, Human herpesvirus 4 (Epstein-Barr virus)
cugcgaugagggccuuccag

SEQ ID NO: 3966224 - RNA, 22 nt, Human herpesvirus 4 (Epstein-Barr virus)
cugcgccugagcugccugguga

SEQ ID NO: 3966225 - RNA, 16 nt, Human herpesvirus 4 (Epstein-Barr virus)
cugcggaguugagccc

SEQ ID NO: 3966226 - RNA, 22 nt, Human herpesvirus 4 (Epstein-Barr virus)
cugcgugagaugaacaccccca

SEQ ID NO: 3966227 - RNA, 19 nt, Human herpesvirus 4 (Epstein-Barr virus)
cugcguggcuggacggagg

SEQ ID NO: 3966228 - RNA, 14 nt, Human herpesvirus 4 (Epstein-Barr virus)
cugcuaagccagga

SEQ ID NO: 3966229 - RNA, 16 nt, Human herpesvirus 4 (Epstein-Barr virus)
cugcuagcgucacuga

SEQ ID NO: 3966230 - RNA, 23 nt, Human herpesvirus 4 (Epstein-Barr virus)
cugcuccaccgccuuaaggccga

SEQ ID NO: 3966231 - RNA, 17 nt, Human herpesvirus 4 (Epstein-Barr virus)
cugcugcugcuggucau

SEQ ID NO: 3966232 - RNA, 14 nt, Human herpesvirus 4 (Epstein-Barr virus)
cugcuucuccccga

SEQ ID NO: 3966233 - RNA, 18 nt, Human herpesvirus 4 (Epstein-Barr virus)
cuggaccagaaggcuccg

SEQ ID NO: 3966234 - RNA, 14 nt, Human herpesvirus 4 (Epstein-Barr virus)
cuggccgagcugga

SEQ ID NO: 3966235 - RNA, 21 nt, Human herpesvirus 4 (Epstein-Barr virus)
cuggcggccgcugcgcccugu

SEQ ID NO: 3966236 - RNA, 17 nt, Human herpesvirus 4 (Epstein-Barr virus)
cuggcuucugugacuuu

SEQ ID NO: 3966237 - RNA, 20 nt, Human herpesvirus 4 (Epstein-Barr virus)
cuggcuuucguccucuggcu

SEQ ID NO: 3966238 - RNA, 18 nt, Human herpesvirus 4 (Epstein-Barr virus)
cugggaggugcugaggcc

SEQ ID NO: 3966239 - RNA, 23 nt, Human herpesvirus 4 (Epstein-Barr virus)
cugguacguuggcuucugcugcu

SEQ ID NO: 3966240 - RNA, 15 nt, Human herpesvirus 4 (Epstein-Barr virus)
cuggucgcccccucu

SEQ ID NO: 3966241 - RNA, 23 nt, Human herpesvirus 4 (Epstein-Barr virus)
cuggugaugcuugugcuccugau

SEQ ID NO: 3966242 - RNA, 19 nt, Human herpesvirus 4 (Epstein-Barr virus)
cuggugccagacucucuuc

SEQ ID NO: 3966243 - RNA, 21 nt, Human herpesvirus 4 (Epstein-Barr virus)
cuguaccugaugagucacacc

SEQ ID NO: 3966244 - RNA, 17 nt, Human herpesvirus 4 (Epstein-Barr virus)
cuguacuuguccgggcu

SEQ ID NO: 3966245 - RNA, 18 nt, Human herpesvirus 4 (Epstein-Barr virus)
cuguagccacccgucccg

SEQ ID NO: 3966246 - RNA, 16 nt, Human herpesvirus 4 (Epstein-Barr virus)
cugucaccaggccugc

SEQ ID NO: 3966247 - RNA, 17 nt, Human herpesvirus 4 (Epstein-Barr virus)
cugucucggccuccugg

SEQ ID NO: 3966248 - RNA, 19 nt, Human herpesvirus 4 (Epstein-Barr virus)
cugugguugucuucccaga

SEQ ID NO: 3966249 - RNA, 16 nt, Human herpesvirus 4 (Epstein-Barr virus)
cuguguacgugccuca

SEQ ID NO: 3966250 - RNA, 20 nt, Human herpesvirus 4 (Epstein-Barr virus)
cuguguacgugccucagaua

SEQ ID NO: 3966251 - RNA, 17 nt, Human herpesvirus 4 (Epstein-Barr virus)
cuuacauucuuauugaa

SEQ ID NO: 3966252 - RNA, 14 nt, Human herpesvirus 4 (Epstein-Barr virus)
cuucagcuccaggg

SEQ ID NO: 3966253 - RNA, 23 nt, Human herpesvirus 4 (Epstein-Barr virus)
cuuccagacuaugcauacacuga

SEQ ID NO: 3966254 - RNA, 22 nt, Human herpesvirus 4 (Epstein-Barr virus)
cuucgcccccucuuuguggccu

SEQ ID NO: 3966255 - RNA, 18 nt, Human herpesvirus 4 (Epstein-Barr virus)
cuucugggaacaccccca

SEQ ID NO: 3966256 - RNA, 16 nt, Human herpesvirus 4 (Epstein-Barr virus)
cuucugucucggccuc

SEQ ID NO: 3966257 - RNA, 15 nt, Human herpesvirus 4 (Epstein-Barr virus)
cuugggggugguggg

SEQ ID NO: 3966258 - RNA, 18 nt, Human herpesvirus 4 (Epstein-Barr virus)
cuugugguucuccugauu

SEQ ID NO: 3966259 - RNA, 15 nt, Human herpesvirus 4 (Epstein-Barr virus)
cuuguuucucagaga

SEQ ID NO: 3966260 - RNA, 15 nt, Human herpesvirus 4 (Epstein-Barr virus)
cuuucaguggucacc

SEQ ID NO: 3966261 - RNA, 13 nt, Human herpesvirus 4 (Epstein-Barr virus)
cuuugccaaccug

SEQ ID NO: 3966262 - RNA, 21 nt, Human herpesvirus 4 (Epstein-Barr virus)
gaaaauaguuccaggugacag

SEQ ID NO: 3966263 - RNA, 12 nt, Human herpesvirus 4 (Epstein-Barr virus)
gaaaaugaugaa

SEQ ID NO: 3966264 - RNA, 16 nt, Human herpesvirus 4 (Epstein-Barr virus)
gaaacacagcucuggc

SEQ ID NO: 3966265 - RNA, 21 nt, Human herpesvirus 4 (Epstein-Barr virus)
gaaaccuugccuacgggcgca

SEQ ID NO: 3966266 - RNA, 13 nt, Human herpesvirus 4 (Epstein-Barr virus)
gaaccaucagcuc

SEQ ID NO: 3966267 - RNA, 17 nt, Human herpesvirus 4 (Epstein-Barr virus)
gaacucgagagaggccu

SEQ ID NO: 3966268 - RNA, 18 nt, Human herpesvirus 4 (Epstein-Barr virus)
gccccucagccugcuccu

SEQ ID NO: 3966269 - RNA, 20 nt, Human herpesvirus 4 (Epstein-Barr virus)
gcccgacccccgggcgcccc

SEQ ID NO: 3966270 - RNA, 22 nt, Human herpesvirus 4 (Epstein-Barr virus)
gcccgcuuuugcgaccccucug

SEQ ID NO: 3966271 - RNA, 16 nt, Human herpesvirus 4 (Epstein-Barr virus)
gcccuccgcagccgcu

SEQ ID NO: 3966272 - RNA, 16 nt, Human herpesvirus 4 (Epstein-Barr virus)
gcccucgagaacccca

SEQ ID NO: 3966273 - RNA, 19 nt, Human herpesvirus 4 (Epstein-Barr virus)
gcccucuuccgugccucgg

SEQ ID NO: 3966274 - RNA, 14 nt, Human herpesvirus 4 (Epstein-Barr virus)
gccgccgccagcag

SEQ ID NO: 3966275 - RNA, 14 nt, Human herpesvirus 4 (Epstein-Barr virus)
gccgcugccaggcc

SEQ ID NO: 3966276 - RNA, 16 nt, Human herpesvirus 4 (Epstein-Barr virus)
gccguagcccaguccg

SEQ ID NO: 3966277 - RNA, 16 nt, Human herpesvirus 4 (Epstein-Barr virus)
gccguccucgaaggcu

SEQ ID NO: 3966278 - RNA, 17 nt, Human herpesvirus 4 (Epstein-Barr virus)
gccuccaacaggugccc

SEQ ID NO: 3966279 - RNA, 20 nt, Human herpesvirus 4 (Epstein-Barr virus)
gccuccaacaggugcccgag

SEQ ID NO: 3966280 - RNA, 20 nt, Human herpesvirus 4 (Epstein-Barr virus)
gccuccagcucggccagcag

SEQ ID NO: 3966281 - RNA, 14 nt, Human herpesvirus 4 (Epstein-Barr virus)
gccuccgccugagc

SEQ ID NO: 3966282 - RNA, 13 nt, Human herpesvirus 4 (Epstein-Barr virus)
gccuccggccgcc

SEQ ID NO: 3966283 - RNA, 20 nt, Human herpesvirus 4 (Epstein-Barr virus)
gccucgcgacucgugggaaa

SEQ ID NO: 3966284 - RNA, 14 nt, Human herpesvirus 4 (Epstein-Barr virus)
gccucugcucuggu

SEQ ID NO: 3966285 - RNA, 20 nt, Human herpesvirus 4 (Epstein-Barr virus)
gccugaagcuugcuggggcg

SEQ ID NO: 3966286 - RNA, 19 nt, Human herpesvirus 4 (Epstein-Barr virus)
gccugagcugccuggugag

SEQ ID NO: 3966287 - RNA, 11 nt, Human herpesvirus 4 (Epstein-Barr virus)
gccugccaaag

SEQ ID NO: 3966288 - RNA, 14 nt, Human herpesvirus 4 (Epstein-Barr virus)
gccugccaaagagc

SEQ ID NO: 3966289 - RNA, 18 nt, Human herpesvirus 4 (Epstein-Barr virus)
gccuggugccagacucuc

SEQ ID NO: 3966290 - RNA, 15 nt, Human herpesvirus 4 (Epstein-Barr virus)
gccuguaauuguugc

SEQ ID NO: 3966291 - RNA, 22 nt, Human herpesvirus 4 (Epstein-Barr virus)
gccuguuuguccagcagggccu

SEQ ID NO: 3966292 - RNA, 14 nt, Human herpesvirus 4 (Epstein-Barr virus)
gccuuccagagcuc

SEQ ID NO: 3966293 - RNA, 21 nt, Human herpesvirus 4 (Epstein-Barr virus)
gccuucuccucagccuccaac

SEQ ID NO: 3966294 - RNA, 16 nt, Human herpesvirus 4 (Epstein-Barr virus)
gcgacauuuaccuggu

SEQ ID NO: 3966295 - RNA, 20 nt, Human herpesvirus 4 (Epstein-Barr virus)
gcgaggggcgccccagggca

SEQ ID NO: 3966296 - RNA, 20 nt, Human herpesvirus 4 (Epstein-Barr virus)
gcgagggggccuggugccag

SEQ ID NO: 3966297 - RNA, 15 nt, Human herpesvirus 4 (Epstein-Barr virus)
gcgcccuccucuggg

SEQ ID NO: 3966298 - RNA, 17 nt, Human herpesvirus 4 (Epstein-Barr virus)
gcgccgccucccccagc

SEQ ID NO: 3966299 - RNA, 21 nt, Human herpesvirus 4 (Epstein-Barr virus)
gcggcagcggacgguggggcu

SEQ ID NO: 3966300 - RNA, 16 nt, Human herpesvirus 4 (Epstein-Barr virus)
gcuaacaggacauguu

SEQ ID NO: 3966301 - RNA, 18 nt, Human herpesvirus 4 (Epstein-Barr virus)
gcucaggccaugcgcgcc

SEQ ID NO: 3966302 - RNA, 23 nt, Human herpesvirus 4 (Epstein-Barr virus)
gcucgcccacacagcgccagcag

SEQ ID NO: 3966303 - RNA, 16 nt, Human herpesvirus 4 (Epstein-Barr virus)
gcucucguugccaaaa

SEQ ID NO: 3966304 - RNA, 14 nt, Human herpesvirus 4 (Epstein-Barr virus)
gcugaacuggggcu

SEQ ID NO: 3966305 - RNA, 15 nt, Human herpesvirus 4 (Epstein-Barr virus)
gcugaacuggggcug

SEQ ID NO: 3966306 - RNA, 20 nt, Human herpesvirus 4 (Epstein-Barr virus)
gcugaagaugauggacccaa

SEQ ID NO: 3966307 - RNA, 14 nt, Human herpesvirus 4 (Epstein-Barr virus)
gcugagcgugugca

SEQ ID NO: 3966308 - RNA, 19 nt, Human herpesvirus 4 (Epstein-Barr virus)
gcugccagagccucugcca

SEQ ID NO: 3966309 - RNA, 13 nt, Human herpesvirus 4 (Epstein-Barr virus)
gcugccugggggc

SEQ ID NO: 3966310 - RNA, 13 nt, Human herpesvirus 4 (Epstein-Barr virus)
gcuggacgagguc

SEQ ID NO: 3966311 - RNA, 14 nt, Human herpesvirus 4 (Epstein-Barr virus)
gcuggccugccugg

SEQ ID NO: 3966312 - RNA, 23 nt, Human herpesvirus 4 (Epstein-Barr virus)
gcugucacccaugccuccccagc

SEQ ID NO: 3966313 - RNA, 17 nt, Human herpesvirus 4 (Epstein-Barr virus)
gcuucuuuuuggugaaa

SEQ ID NO: 3966314 - RNA, 20 nt, Human herpesvirus 4 (Epstein-Barr virus)
gcuuugagcuaaugccauag

SEQ ID NO: 3966315 - RNA, 20 nt, Human herpesvirus 4 (Epstein-Barr virus)
ggaaaaucucgcucagagcu

SEQ ID NO: 3966316 - RNA, 23 nt, Human herpesvirus 4 (Epstein-Barr virus)
ggaaaaucucgcucagagcuggg

SEQ ID NO: 3966317 - RNA, 15 nt, Human herpesvirus 4 (Epstein-Barr virus)
ggaacacccccaccc

SEQ ID NO: 3966318 - RNA, 15 nt, Human herpesvirus 4 (Epstein-Barr virus)
ggaacaccgggcagg

SEQ ID NO: 3966319 - RNA, 16 nt, Human herpesvirus 4 (Epstein-Barr virus)
ggaaugacgggcuccc

SEQ ID NO: 3966320 - RNA, 13 nt, Human herpesvirus 4 (Epstein-Barr virus)
ggacccugcugcg

SEQ ID NO: 3966321 - RNA, 14 nt, Human herpesvirus 4 (Epstein-Barr virus)
ggacgaggacgaga

SEQ ID NO: 3966322 - RNA, 18 nt, Human herpesvirus 4 (Epstein-Barr virus)
ggacgaggacggggaaga

SEQ ID NO: 3966323 - RNA, 13 nt, Human herpesvirus 4 (Epstein-Barr virus)
ggacgggcaggca

SEQ ID NO: 3966324 - RNA, 18 nt, Human herpesvirus 4 (Epstein-Barr virus)
ggagcaggaggaggggca

SEQ ID NO: 3966325 - RNA, 20 nt, Human herpesvirus 4 (Epstein-Barr virus)
ggagcaggaggggcaggagc

SEQ ID NO: 3966326 - RNA, 18 nt, Human herpesvirus 4 (Epstein-Barr virus)
ggagccagcgcugggggu

SEQ ID NO: 3966327 - RNA, 22 nt, Human herpesvirus 4 (Epstein-Barr virus)
ggagcggggguucuccaggcuc

SEQ ID NO: 3966328 - RNA, 15 nt, Human herpesvirus 4 (Epstein-Barr virus)
ggaggacgugaguga

SEQ ID NO: 3966329 - RNA, 14 nt, Human herpesvirus 4 (Epstein-Barr virus)
ggaggccagguagc

SEQ ID NO: 3966330 - RNA, 18 nt, Human herpesvirus 4 (Epstein-Barr virus)
ggaggggaccacuagguc

SEQ ID NO: 3966331 - RNA, 13 nt, Human herpesvirus 4 (Epstein-Barr virus)
ggaggggcggcag

SEQ ID NO: 3966332 - RNA, 16 nt, Human herpesvirus 4 (Epstein-Barr virus)
ggagucggugggcggu

SEQ ID NO: 3966333 - RNA, 21 nt, Human herpesvirus 4 (Epstein-Barr virus)
ggagucugagaauaaggcucu

SEQ ID NO: 3966334 - RNA, 12 nt, Human herpesvirus 4 (Epstein-Barr virus)
ggaugccuggcg

SEQ ID NO: 3966335 - RNA, 13 nt, Human herpesvirus 4 (Epstein-Barr virus)
ggcaaaccuccaa

SEQ ID NO: 3966336 - RNA, 17 nt, Human herpesvirus 4 (Epstein-Barr virus)
ggcaagggcucaccagg

SEQ ID NO: 3966337 - RNA, 18 nt, Human herpesvirus 4 (Epstein-Barr virus)
ggcacacacucccuuagc

SEQ ID NO: 3966338 - RNA, 20 nt, Human herpesvirus 4 (Epstein-Barr virus)
ggcacacacucccuuagcca

SEQ ID NO: 3966339 - RNA, 17 nt, Human herpesvirus 4 (Epstein-Barr virus)
ggcaccauagcauguca

SEQ ID NO: 3966340 - RNA, 18 nt, Human herpesvirus 4 (Epstein-Barr virus)
ggcaucauguuuuuggca

SEQ ID NO: 3966341 - RNA, 18 nt, Human herpesvirus 4 (Epstein-Barr virus)
ggccacggcgugccagag

SEQ ID NO: 3966342 - RNA, 16 nt, Human herpesvirus 4 (Epstein-Barr virus)
ggccagcaaaaccagc

SEQ ID NO: 3966343 - RNA, 16 nt, Human herpesvirus 4 (Epstein-Barr virus)
ggccagguagcccagc

SEQ ID NO: 3966344 - RNA, 17 nt, Human herpesvirus 4 (Epstein-Barr virus)
ggccaucauggccgacg

SEQ ID NO: 3966345 - RNA, 21 nt, Human herpesvirus 4 (Epstein-Barr virus)
ggcccgagguucucuucacua

SEQ ID NO: 3966346 - RNA, 14 nt, Human herpesvirus 4 (Epstein-Barr virus)
ggcccguuccaggc

SEQ ID NO: 3966347 - RNA, 19 nt, Human herpesvirus 4 (Epstein-Barr virus)
ggcccucagaauuucugcu

SEQ ID NO: 3966348 - RNA, 21 nt, Human herpesvirus 4 (Epstein-Barr virus)
ggccgagcagggacuggcggc

SEQ ID NO: 3966349 - RNA, 16 nt, Human herpesvirus 4 (Epstein-Barr virus)
ggccgcgcugcgaggc

SEQ ID NO: 3966350 - RNA, 19 nt, Human herpesvirus 4 (Epstein-Barr virus)
ggccucuacgccaggcucg

SEQ ID NO: 3966351 - RNA, 19 nt, Human herpesvirus 4 (Epstein-Barr virus)
ggcgacaguaacacagggu

SEQ ID NO: 3966352 - RNA, 16 nt, Human herpesvirus 4 (Epstein-Barr virus)
ggcgcgggucccccua

SEQ ID NO: 3966353 - RNA, 23 nt, Human herpesvirus 4 (Epstein-Barr virus)
ggcgguccuccacggggacacgc

SEQ ID NO: 3966354 - RNA, 19 nt, Human herpesvirus 4 (Epstein-Barr virus)
ggcggugggaucaugaagc

SEQ ID NO: 3966355 - RNA, 18 nt, Human herpesvirus 4 (Epstein-Barr virus)
ggcgucgggaaacacagc

SEQ ID NO: 3966356 - RNA, 21 nt, Human herpesvirus 4 (Epstein-Barr virus)
uggcacacauuacggugcugg

SEQ ID NO: 3966357 - RNA, 22 nt, Human herpesvirus 4 (Epstein-Barr virus)
uggccaccacaucggacgggca

SEQ ID NO: 3966358 - RNA, 10 nt, Human herpesvirus 4 (Epstein-Barr virus)
uggccgccgu

SEQ ID NO: 3966359 - RNA, 22 nt, Human herpesvirus 4 (Epstein-Barr virus)
uggccugggaggugcugaggcc

SEQ ID NO: 3966360 - RNA, 22 nt, Human herpesvirus 4 (Epstein-Barr virus)
uggccuucucugauggccugga

SEQ ID NO: 3966361 - RNA, 13 nt, Human herpesvirus 4 (Epstein-Barr virus)
uggcuauggucau

SEQ ID NO: 3966362 - RNA, 22 nt, Human herpesvirus 4 (Epstein-Barr virus)
uggcucagcuuggggccaccgg

SEQ ID NO: 3966363 - RNA, 17 nt, Human herpesvirus 4 (Epstein-Barr virus)
uggcuguacgccgccgc

SEQ ID NO: 3966364 - RNA, 17 nt, Human herpesvirus 4 (Epstein-Barr virus)
ugggaacugaguaggcu

SEQ ID NO: 3966365 - RNA, 13 nt, Human herpesvirus 4 (Epstein-Barr virus)
ugggaccggggcc

SEQ ID NO: 3966366 - RNA, 13 nt, Human herpesvirus 4 (Epstein-Barr virus)
ugggaucaugaag

SEQ ID NO: 3966367 - RNA, 14 nt, Human herpesvirus 4 (Epstein-Barr virus)
ugggcucccucugg

SEQ ID NO: 3966368 - RNA, 20 nt, Human herpesvirus 4 (Epstein-Barr virus)
uggggaguuagcauuggcgu

SEQ ID NO: 3966369 - RNA, 19 nt, Human herpesvirus 4 (Epstein-Barr virus)
ugggguauucucagaugca

SEQ ID NO: 3966370 - RNA, 22 nt, Human herpesvirus 4 (Epstein-Barr virus)
uggggugcgggugcgggugaug

SEQ ID NO: 3966371 - RNA, 20 nt, Human herpesvirus 4 (Epstein-Barr virus)
ugguagccggcgcugugugg

SEQ ID NO: 3966372 - RNA, 13 nt, Human herpesvirus 4 (Epstein-Barr virus)
uggucaagagcuu

SEQ ID NO: 3966373 - RNA, 15 nt, Human herpesvirus 4 (Epstein-Barr virus)
uggugaugcuugugc

SEQ ID NO: 3966374 - RNA, 13 nt, Human herpesvirus 4 (Epstein-Barr virus)
uggugggacugag

SEQ ID NO: 3966375 - RNA, 15 nt, Human herpesvirus 4 (Epstein-Barr virus)
uggugggaggcccag

SEQ ID NO: 3966376 - RNA, 14 nt, Human herpesvirus 4 (Epstein-Barr virus)
uguacugcgaugag

SEQ ID NO: 3966377 - RNA, 19 nt, Human herpesvirus 4 (Epstein-Barr virus)
uguacuugggauugcaaca

SEQ ID NO: 3966378 - RNA, 20 nt, Human herpesvirus 4 (Epstein-Barr virus)
uguagccacccgucccgggu

SEQ ID NO: 3966379 - RNA, 15 nt, Human herpesvirus 4 (Epstein-Barr virus)
uguccagcagggccu

SEQ ID NO: 3966380 - RNA, 19 nt, Human herpesvirus 4 (Epstein-Barr virus)
ugucggcuaaugccaugca

SEQ ID NO: 3966381 - RNA, 17 nt, Human herpesvirus 4 (Epstein-Barr virus)
ugucuaucucuauugcc

SEQ ID NO: 3966382 - RNA, 14 nt, Human herpesvirus 4 (Epstein-Barr virus)
ugucuccccucugc

SEQ ID NO: 3966383 - RNA, 17 nt, Human herpesvirus 4 (Epstein-Barr virus)
ugucucggccuccuggc

SEQ ID NO: 3966384 - RNA, 23 nt, Human herpesvirus 4 (Epstein-Barr virus)
ugucuucccagacucugcuuucu

SEQ ID NO: 3966385 - RNA, 13 nt, Human herpesvirus 4 (Epstein-Barr virus)
ugugagacaagcc

SEQ ID NO: 3966386 - RNA, 14 nt, Human herpesvirus 4 (Epstein-Barr virus)
ugugcugaagccca

SEQ ID NO: 3966387 - RNA, 16 nt, Human herpesvirus 4 (Epstein-Barr virus)
uguggcuguagccacc

SEQ ID NO: 3966388 - RNA, 22 nt, Human herpesvirus 4 (Epstein-Barr virus)
ugugucccccuccauuccaccc

SEQ ID NO: 3966389 - RNA, 13 nt, Human herpesvirus 4 (Epstein-Barr virus)
uguuauucccacc

SEQ ID NO: 3966390 - RNA, 14 nt, Human herpesvirus 4 (Epstein-Barr virus)
uguuuccagacacc

SEQ ID NO: 3966391 - RNA, 16 nt, Human herpesvirus 4 (Epstein-Barr virus)
uuaaggaaugaacacu

SEQ ID NO: 3966392 - RNA, 15 nt, Human herpesvirus 4 (Epstein-Barr virus)
uuacugggaaugccu

SEQ ID NO: 3966393 - RNA, 17 nt, Human herpesvirus 4 (Epstein-Barr virus)
uucccgacggcaugccu

SEQ ID NO: 3966394 - RNA, 20 nt, Human herpesvirus 4 (Epstein-Barr virus)
uucgggcaagauggagaggc

SEQ ID NO: 3966395 - RNA, 17 nt, Human herpesvirus 4 (Epstein-Barr virus)
uucucuaaucccucugg

SEQ ID NO: 3966396 - RNA, 16 nt, Human herpesvirus 4 (Epstein-Barr virus)
uugaggcaauggccac

SEQ ID NO: 3966397 - RNA, 14 nt, Human herpesvirus 4 (Epstein-Barr virus)
uugaugauauugaa

SEQ ID NO: 3966398 - RNA, 23 nt, Human herpesvirus 4 (Epstein-Barr virus)
uugcaaacaaacuucaagaguuu

SEQ ID NO: 3966399 - RNA, 23 nt, Human herpesvirus 4 (Epstein-Barr virus)
uugcuagucacacccguggaggu

SEQ ID NO: 3966400 - RNA, 12 nt, Human herpesvirus 4 (Epstein-Barr virus)
uuggcagacacc

SEQ ID NO: 3966401 - RNA, 13 nt, Human herpesvirus 4 (Epstein-Barr virus)
uuguaaaacuugg

SEQ ID NO: 3966402 - RNA, 17 nt, Human herpesvirus 4 (Epstein-Barr virus)
uuuauuaggcacaaacu

SEQ ID NO: 3966403 - RNA, 15 nt, Human herpesvirus 4 (Epstein-Barr virus)
uuucagcaucacagg

SEQ ID NO: 3966404 - RNA, 14 nt, Human herpesvirus 4 (Epstein-Barr virus)
uuugcaaacaaacu

SEQ ID NO: 3966405 - RNA, 12 nt, Human herpesvirus 4 (Epstein-Barr virus)
uuugccuggggc

SEQ ID NO: 3966406 - RNA, 17 nt, Human herpesvirus 4 (Epstein-Barr virus)
uuuucugccccucagcc

SEQ ID NO: 3966407 - RNA, 14 nt, Human herpesvirus 4 (Epstein-Barr virus)
gcuggugcaccugc

SEQ ID NO: 3966408 - RNA, 15 nt, Human herpesvirus 4 (Epstein-Barr virus)
gcuguugacaugagc

SEQ ID NO: 3966409 - RNA, 21 nt, Human herpesvirus 4 (Epstein-Barr virus)
gcuuacaagaauaacaugcca

SEQ ID NO: 3966410 - RNA, 18 nt, Human herpesvirus 4 (Epstein-Barr virus)
ggaaaauaguuccaggug

SEQ ID NO: 3966411 - RNA, 16 nt, Human herpesvirus 4 (Epstein-Barr virus)
ggaagacaacgaggua

SEQ ID NO: 3966412 - RNA, 14 nt, Human herpesvirus 4 (Epstein-Barr virus)
ggaccacauacauc

SEQ ID NO: 3966413 - RNA, 17 nt, Human herpesvirus 4 (Epstein-Barr virus)
ggaccuacaggacaaga

SEQ ID NO: 3966414 - RNA, 17 nt, Human herpesvirus 4 (Epstein-Barr virus)
ggacgauagcccaggca

SEQ ID NO: 3966415 - RNA, 18 nt, Human herpesvirus 4 (Epstein-Barr virus)
ggacgcuguccgccagga

SEQ ID NO: 3966416 - RNA, 24 nt, Human herpesvirus 4 (Epstein-Barr virus)
ggacguuggcgggacuggcacggu

SEQ ID NO: 3966417 - RNA, 13 nt, Human herpesvirus 4 (Epstein-Barr virus)
ggagacgcccuca

SEQ ID NO: 3966418 - RNA, 20 nt, Human herpesvirus 4 (Epstein-Barr virus)
ggagagauuucauccucaga

SEQ ID NO: 3966419 - RNA, 17 nt, Human herpesvirus 4 (Epstein-Barr virus)
ggagcaggagcaggagc

SEQ ID NO: 3966420 - RNA, 12 nt, Human herpesvirus 4 (Epstein-Barr virus)
ggagcaggaggg

SEQ ID NO: 3966421 - RNA, 14 nt, Human herpesvirus 4 (Epstein-Barr virus)
ggagccggcggccu

SEQ ID NO: 3966422 - RNA, 18 nt, Human herpesvirus 4 (Epstein-Barr virus)
ggaggaaaugaacccagg

SEQ ID NO: 3966423 - RNA, 22 nt, Human herpesvirus 4 (Epstein-Barr virus)
ggaggagcuccgugagcaggag

SEQ ID NO: 3966424 - RNA, 22 nt, Human herpesvirus 4 (Epstein-Barr virus)
ggaggaugaagauccaacuccg

SEQ ID NO: 3966425 - RNA, 17 nt, Human herpesvirus 4 (Epstein-Barr virus)
ggaggccucaggcaaca

SEQ ID NO: 3966426 - RNA, 16 nt, Human herpesvirus 4 (Epstein-Barr virus)
ggaggugcugaggccc

SEQ ID NO: 3966427 - RNA, 16 nt, Human herpesvirus 4 (Epstein-Barr virus)
ggagucgaagcucuug

SEQ ID NO: 3966428 - RNA, 14 nt, Human herpesvirus 4 (Epstein-Barr virus)
gagagaggccucug

SEQ ID NO: 3966429 - RNA, 19 nt, Human herpesvirus 4 (Epstein-Barr virus)
gagcaugaucaggacccug

SEQ ID NO: 3966430 - RNA, 13 nt, Human herpesvirus 4 (Epstein-Barr virus)
gagccgggggcau

SEQ ID NO: 3966431 - RNA, 12 nt, Human herpesvirus 4 (Epstein-Barr virus)
gagcgccguggc

SEQ ID NO: 3966432 - RNA, 13 nt, Human herpesvirus 4 (Epstein-Barr virus)
gagcuggaggcca

SEQ ID NO: 3966433 - RNA, 18 nt, Human herpesvirus 4 (Epstein-Barr virus)
gagcuguaacugugguuu

SEQ ID NO: 3966434 - RNA, 21 nt, Human herpesvirus 4 (Epstein-Barr virus)
gaggaacggugauuaggcacu

SEQ ID NO: 3966435 - RNA, 14 nt, Human herpesvirus 4 (Epstein-Barr virus)
gaggaggcggaaga

SEQ ID NO: 3966436 - RNA, 13 nt, Human herpesvirus 4 (Epstein-Barr virus)
gaggccucaggca

SEQ ID NO: 3966437 - RNA, 20 nt, Human herpesvirus 4 (Epstein-Barr virus)
gaggcggaagaccaggagcc

SEQ ID NO: 3966438 - RNA, 15 nt, Human herpesvirus 4 (Epstein-Barr virus)
gaggggcaggagcag

SEQ ID NO: 3966439 - RNA, 21 nt, Human herpesvirus 4 (Epstein-Barr virus)
gagugcccuggaggccucagg

SEQ ID NO: 3966440 - RNA, 16 nt, Human herpesvirus 4 (Epstein-Barr virus)
gauaaaguuguccugg

SEQ ID NO: 3966441 - RNA, 19 nt, Human herpesvirus 4 (Epstein-Barr virus)
gauaggggauuccugucca

SEQ ID NO: 3966442 - RNA, 22 nt, Human herpesvirus 4 (Epstein-Barr virus)
gaucagggccaagacauagaga

SEQ ID NO: 3966443 - RNA, 22 nt, Human herpesvirus 4 (Epstein-Barr virus)
gaucgauuggaaaagggcccag

SEQ ID NO: 3966444 - RNA, 14 nt, Human herpesvirus 4 (Epstein-Barr virus)
gaucuuugacugac

SEQ ID NO: 3966445 - RNA, 11 nt, Human herpesvirus 4 (Epstein-Barr virus)
gaugcccucau

SEQ ID NO: 3966446 - RNA, 18 nt, Human herpesvirus 4 (Epstein-Barr virus)
gcaacagacugcggggag

SEQ ID NO: 3966447 - RNA, 13 nt, Human herpesvirus 4 (Epstein-Barr virus)
gcaacugcguccu

SEQ ID NO: 3966448 - RNA, 16 nt, Human herpesvirus 4 (Epstein-Barr virus)
gcaagaauuggggcug

SEQ ID NO: 3966449 - RNA, 13 nt, Human herpesvirus 4 (Epstein-Barr virus)
gcacaaccuugga

SEQ ID NO: 3966450 - RNA, 14 nt, Human herpesvirus 4 (Epstein-Barr virus)
gcaccuagcccacu

SEQ ID NO: 3966451 - RNA, 22 nt, Human herpesvirus 4 (Epstein-Barr virus)
gcagauagccggccaggcagag

SEQ ID NO: 3966452 - RNA, 20 nt, Human herpesvirus 4 (Epstein-Barr virus)
cgaaggugcagcuggcccac

SEQ ID NO: 3966453 - RNA, 12 nt, Human herpesvirus 4 (Epstein-Barr virus)
cgacuucuggaa

SEQ ID NO: 3966454 - RNA, 22 nt, Human herpesvirus 4 (Epstein-Barr virus)
cgagacuuggaccaagggcagg

SEQ ID NO: 3966455 - RNA, 16 nt, Human herpesvirus 4 (Epstein-Barr virus)
cgagcggccuccgccg

SEQ ID NO: 3966456 - RNA, 17 nt, Human herpesvirus 4 (Epstein-Barr virus)
cgagcuccgugggccca

SEQ ID NO: 3966457 - RNA, 15 nt, Human herpesvirus 4 (Epstein-Barr virus)
cgaggauggaaaggg

SEQ ID NO: 3966458 - RNA, 17 nt, Human herpesvirus 4 (Epstein-Barr virus)
cgaggcccugcaagcca

SEQ ID NO: 3966459 - RNA, 19 nt, Human herpesvirus 4 (Epstein-Barr virus)
cgagggugaggcccagccc

SEQ ID NO: 3966460 - RNA, 20 nt, Human herpesvirus 4 (Epstein-Barr virus)
cgaugccucuacgccccaga

SEQ ID NO: 3966461 - RNA, 19 nt, Human herpesvirus 4 (Epstein-Barr virus)
cgauuggaaaagggcccag

SEQ ID NO: 3966462 - RNA, 20 nt, Human herpesvirus 4 (Epstein-Barr virus)
cgcccagggacauccccaga

SEQ ID NO: 3966463 - RNA, 15 nt, Human herpesvirus 4 (Epstein-Barr virus)
cgcccaguaugcagu

SEQ ID NO: 3966464 - RNA, 13 nt, Human herpesvirus 4 (Epstein-Barr virus)
cgcccccucugcc

SEQ ID NO: 3966465 - RNA, 14 nt, Human herpesvirus 4 (Epstein-Barr virus)
cgcccccugaccuc

SEQ ID NO: 3966466 - RNA, 21 nt, Human herpesvirus 4 (Epstein-Barr virus)
cgccccgaugcggaggacugc

SEQ ID NO: 3966467 - RNA, 23 nt, Human herpesvirus 4 (Epstein-Barr virus)
cgccgccccaggggucucuagac

SEQ ID NO: 3966468 - RNA, 17 nt, Human herpesvirus 4 (Epstein-Barr virus)
cgccuucuccucagccu

SEQ ID NO: 3966469 - RNA, 18 nt, Human herpesvirus 4 (Epstein-Barr virus)
cgcggcccaggucgagca

SEQ ID NO: 3966470 - RNA, 13 nt, Human herpesvirus 4 (Epstein-Barr virus)
cgcuacugcugcu

SEQ ID NO: 3966471 - RNA, 17 nt, Human herpesvirus 4 (Epstein-Barr virus)
cgcuccgcgcucggccu

SEQ ID NO: 3966472 - RNA, 22 nt, Human herpesvirus 4 (Epstein-Barr virus)
cgcucgcgggguuccccucccc

SEQ ID NO: 3966473 - RNA, 16 nt, Human herpesvirus 4 (Epstein-Barr virus)
cgcugcucgccccugg

SEQ ID NO: 3966474 - RNA, 16 nt, Human herpesvirus 4 (Epstein-Barr virus)
cgcugggaccggggcc

SEQ ID NO: 3966475 - RNA, 15 nt, Human herpesvirus 4 (Epstein-Barr virus)
cggcaccgucagcca

SEQ ID NO: 3966476 - RNA, 21 nt, Human herpesvirus 4 (Epstein-Barr virus)
cggcaucaugcgugaccaccu

SEQ ID NO: 3966477 - RNA, 16 nt, Human herpesvirus 4 (Epstein-Barr virus)
cggccacguccccggc

SEQ ID NO: 3966478 - RNA, 12 nt, Human herpesvirus 4 (Epstein-Barr virus)
cggcccucuucc

SEQ ID NO: 3966479 - RNA, 13 nt, Human herpesvirus 4 (Epstein-Barr virus)
cggccgaggccug

SEQ ID NO: 3966480 - RNA, 16 nt, Human herpesvirus 4 (Epstein-Barr virus)
cggccgaggccugcga

SEQ ID NO: 3966481 - RNA, 15 nt, Human herpesvirus 4 (Epstein-Barr virus)
cggcggaggccgagc

SEQ ID NO: 3966482 - RNA, 14 nt, Human herpesvirus 4 (Epstein-Barr virus)
cggcggcugcugcc

SEQ ID NO: 3966483 - RNA, 18 nt, Human herpesvirus 4 (Epstein-Barr virus)
cggcuagccugacuaagg

SEQ ID NO: 3966484 - RNA, 12 nt, Human herpesvirus 4 (Epstein-Barr virus)
cggcucucaggc

SEQ ID NO: 3966485 - RNA, 16 nt, Human herpesvirus 4 (Epstein-Barr virus)
cggcuuggcccucuca

SEQ ID NO: 3966486 - RNA, 16 nt, Human herpesvirus 4 (Epstein-Barr virus)
cgggagaggcagcccc

SEQ ID NO: 3966487 - RNA, 18 nt, Human herpesvirus 4 (Epstein-Barr virus)
cgggaggaaacaggagga

SEQ ID NO: 3966488 - RNA, 16 nt, Human herpesvirus 4 (Epstein-Barr virus)
cgggaugagcuggaga

SEQ ID NO: 3966489 - RNA, 17 nt, Human herpesvirus 4 (Epstein-Barr virus)
cgggcaaacagggcaga

SEQ ID NO: 3966490 - RNA, 19 nt, Human herpesvirus 4 (Epstein-Barr virus)
cgggccauucgugagucca

SEQ ID NO: 3966491 - RNA, 15 nt, Human herpesvirus 4 (Epstein-Barr virus)
cgggcccgggugccu

SEQ ID NO: 3966492 - RNA, 18 nt, Human herpesvirus 4 (Epstein-Barr virus)
cgggggcgacugccgccg

SEQ ID NO: 3966493 - RNA, 16 nt, Human herpesvirus 4 (Epstein-Barr virus)
cggggguggcagcccc

SEQ ID NO: 3966494 - RNA, 12 nt, Human herpesvirus 4 (Epstein-Barr virus)
cggguacaaguc

SEQ ID NO: 3966495 - RNA, 17 nt, Human herpesvirus 4 (Epstein-Barr virus)
cgguuagggaggacacu

SEQ ID NO: 3966496 - RNA, 19 nt, Human herpesvirus 4 (Epstein-Barr virus)
cgugcaugcagcgcccugu

SEQ ID NO: 3966497 - RNA, 15 nt, Human herpesvirus 4 (Epstein-Barr virus)
cgugcauggcagcag

SEQ ID NO: 3966498 - RNA, 17 nt, Human herpesvirus 4 (Epstein-Barr virus)
cguggccaggcccgagg

SEQ ID NO: 3966499 - RNA, 19 nt, Human herpesvirus 4 (Epstein-Barr virus)
cguggcuuccagagaggcg

SEQ ID NO: 3966500 - RNA, 21 nt, Human herpesvirus 4 (Epstein-Barr virus)
cguuccuggccauggccgaga

SEQ ID NO: 3966501 - RNA, 13 nt, Human herpesvirus 4 (Epstein-Barr virus)
cguuggcccauaa

SEQ ID NO: 3966502 - RNA, 15 nt, Human herpesvirus 4 (Epstein-Barr virus)
cuaauucagccaccu

SEQ ID NO: 3966503 - RNA, 14 nt, Human herpesvirus 4 (Epstein-Barr virus)
cuacaacucagccc

SEQ ID NO: 3966504 - RNA, 21 nt, Human herpesvirus 4 (Epstein-Barr virus)
cuacacucuggggucucaggc

SEQ ID NO: 3966505 - RNA, 16 nt, Human herpesvirus 4 (Epstein-Barr virus)
cuacgcgggccacagg

SEQ ID NO: 3966506 - RNA, 14 nt, Human herpesvirus 4 (Epstein-Barr virus)
cuacguguccaugu

SEQ ID NO: 3966507 - RNA, 14 nt, Human herpesvirus 4 (Epstein-Barr virus)
cuagagguuuugcu

SEQ ID NO: 3966508 - RNA, 14 nt, Human herpesvirus 4 (Epstein-Barr virus)
cuaggagagaaggg

SEQ ID NO: 3966509 - RNA, 17 nt, Human herpesvirus 4 (Epstein-Barr virus)
cuaggccugccacgugg

SEQ ID NO: 3966510 - RNA, 15 nt, Human herpesvirus 4 (Epstein-Barr virus)
cuaggcgggcgggcu

SEQ ID NO: 3966511 - RNA, 13 nt, Human herpesvirus 4 (Epstein-Barr virus)
cuaguuaccacag

SEQ ID NO: 3966512 - RNA, 18 nt, Human herpesvirus 4 (Epstein-Barr virus)
cuaugcaugagccacagg

SEQ ID NO: 3966513 - RNA, 14 nt, Human herpesvirus 4 (Epstein-Barr virus)
cucaaggcagucuc

SEQ ID NO: 3966514 - RNA, 15 nt, Human herpesvirus 4 (Epstein-Barr virus)
cucaaggcagucucc

SEQ ID NO: 3966515 - RNA, 15 nt, Human herpesvirus 4 (Epstein-Barr virus)
cucacaggacauguu

SEQ ID NO: 3966516 - RNA, 23 nt, Human herpesvirus 4 (Epstein-Barr virus)
cucagaugccggccaugcgcuuu

SEQ ID NO: 3966517 - RNA, 18 nt, Human herpesvirus 4 (Epstein-Barr virus)
cucaucuccaaaaaguug

SEQ ID NO: 3966518 - RNA, 17 nt, Human herpesvirus 4 (Epstein-Barr virus)
cucaugggggaaugagg

SEQ ID NO: 3966519 - RNA, 22 nt, Human herpesvirus 4 (Epstein-Barr virus)
cucauuucaguggcccucagaa

SEQ ID NO: 3966520 - RNA, 15 nt, Human herpesvirus 4 (Epstein-Barr virus)
cuccaggcuccugga

SEQ ID NO: 3966521 - RNA, 14 nt, Human herpesvirus 4 (Epstein-Barr virus)
cuccaucagggcca

SEQ ID NO: 3966522 - RNA, 17 nt, Human herpesvirus 4 (Epstein-Barr virus)
cucccauguaagccugc

SEQ ID NO: 3966523 - RNA, 13 nt, Human herpesvirus 4 (Epstein-Barr virus)
cuccguggccccg

SEQ ID NO: 3966524 - RNA, 23 nt, Human herpesvirus 4 (Epstein-Barr virus)
cuccucagaaaacucugcaugga

SEQ ID NO: 3966525 - RNA, 14 nt, Human herpesvirus 4 (Epstein-Barr virus)
cuccugacgccaau

SEQ ID NO: 3966526 - RNA, 19 nt, Human herpesvirus 4 (Epstein-Barr virus)
cucgaagcggucucagaca

SEQ ID NO: 3966527 - RNA, 18 nt, Human herpesvirus 4 (Epstein-Barr virus)
cucgcucagagcugggaa

SEQ ID NO: 3966528 - RNA, 12 nt, Human herpesvirus 4 (Epstein-Barr virus)
cucggcaccucc

SEQ ID NO: 3966529 - RNA, 21 nt, Human herpesvirus 4 (Epstein-Barr virus)
cucgugcaagcagcaccuguc

SEQ ID NO: 3966530 - RNA, 21 nt, Human herpesvirus 4 (Epstein-Barr virus)
cucucuggcugugcugacccu

SEQ ID NO: 3966531 - RNA, 22 nt, Human herpesvirus 4 (Epstein-Barr virus)
cucugccaacuuugagcugggc

SEQ ID NO: 3966532 - RNA, 17 nt, Human herpesvirus 4 (Epstein-Barr virus)
cucugcuuucugccguc

SEQ ID NO: 3966533 - RNA, 20 nt, Human herpesvirus 4 (Epstein-Barr virus)
cugaacaucucauccccaga

SEQ ID NO: 3966534 - RNA, 19 nt, Human herpesvirus 4 (Epstein-Barr virus)
cugagaccaugcucagugg

SEQ ID NO: 3966535 - RNA, 22 nt, Human herpesvirus 4 (Epstein-Barr virus)
cugagccacuccggacgcagag

SEQ ID NO: 3966536 - RNA, 14 nt, Human herpesvirus 4 (Epstein-Barr virus)
cugagccugagcca

SEQ ID NO: 3966537 - RNA, 20 nt, Human herpesvirus 4 (Epstein-Barr virus)
cugcacgagaccccugggcu

SEQ ID NO: 3966538 - RNA, 19 nt, Human herpesvirus 4 (Epstein-Barr virus)
cugcagugggccucucugg

SEQ ID NO: 3966539 - RNA, 21 nt, Human herpesvirus 4 (Epstein-Barr virus)
cugcagugggccucucuggcu

SEQ ID NO: 3966540 - RNA, 22 nt, Human herpesvirus 4 (Epstein-Barr virus)
caacugcuauucugagcaccaa

SEQ ID NO: 3966541 - RNA, 15 nt, Human herpesvirus 4 (Epstein-Barr virus)
caagaaucggguggc

SEQ ID NO: 3966542 - RNA, 16 nt, Human herpesvirus 4 (Epstein-Barr virus)
caagcagcucaccuau

SEQ ID NO: 3966543 - RNA, 13 nt, Human herpesvirus 4 (Epstein-Barr virus)
caagcucagcccc

SEQ ID NO: 3966544 - RNA, 20 nt, Human herpesvirus 4 (Epstein-Barr virus)
caaggacgggggugggcacc

SEQ ID NO: 3966545 - RNA, 16 nt, Human herpesvirus 4 (Epstein-Barr virus)
caaggaggggcggcag

SEQ ID NO: 3966546 - RNA, 22 nt, Human herpesvirus 4 (Epstein-Barr virus)
caagguucggaaaucuguugac

SEQ ID NO: 3966547 - RNA, 14 nt, Human herpesvirus 4 (Epstein-Barr virus)
caagugcuaugacc

SEQ ID NO: 3966548 - RNA, 18 nt, Human herpesvirus 4 (Epstein-Barr virus)
cacaagagccaucaccuc

SEQ ID NO: 3966549 - RNA, 20 nt, Human herpesvirus 4 (Epstein-Barr virus)
cacaccauccacagccccac

SEQ ID NO: 3966550 - RNA, 16 nt, Human herpesvirus 4 (Epstein-Barr virus)
cacacuuaacuugacu

SEQ ID NO: 3966551 - RNA, 18 nt, Human herpesvirus 4 (Epstein-Barr virus)
cacaucuggaccuggacu

SEQ ID NO: 3966552 - RNA, 21 nt, Human herpesvirus 4 (Epstein-Barr virus)
caccacccccaccacccccac

SEQ ID NO: 3966553 - RNA, 15 nt, Human herpesvirus 4 (Epstein-Barr virus)
caccaccccccccac

SEQ ID NO: 3966554 - RNA, 18 nt, Human herpesvirus 4 (Epstein-Barr virus)
caccacccccgcccccac

SEQ ID NO: 3966555 - RNA, 22 nt, Human herpesvirus 4 (Epstein-Barr virus)
caccauccacagccccacucuu

SEQ ID NO: 3966556 - RNA, 13 nt, Human herpesvirus 4 (Epstein-Barr virus)
caccaucuggcag

SEQ ID NO: 3966557 - RNA, 13 nt, Human herpesvirus 4 (Epstein-Barr virus)
cacccauggccag

SEQ ID NO: 3966558 - RNA, 22 nt, Human herpesvirus 4 (Epstein-Barr virus)
caccuguguccugggcaaggag

SEQ ID NO: 3966559 - RNA, 20 nt, Human herpesvirus 4 (Epstein-Barr virus)
cacgcuuuugucugccugga

SEQ ID NO: 3966560 - RNA, 18 nt, Human herpesvirus 4 (Epstein-Barr virus)
cacgguggaacaggagca

SEQ ID NO: 3966561 - RNA, 20 nt, Human herpesvirus 4 (Epstein-Barr virus)
cacucaggaagcuggccagg

SEQ ID NO: 3966562 - RNA, 19 nt, Human herpesvirus 4 (Epstein-Barr virus)
cacucguccgccuacuggu

SEQ ID NO: 3966563 - RNA, 11 nt, Human herpesvirus 4 (Epstein-Barr virus)
cacugacccau

SEQ ID NO: 3966564 - RNA, 17 nt, Human herpesvirus 4 (Epstein-Barr virus)
cacuguugcgcccggcc

SEQ ID NO: 3966565 - RNA, 15 nt, Human herpesvirus 4 (Epstein-Barr virus)
cacuuugccagcaac

SEQ ID NO: 3966566 - RNA, 17 nt, Human herpesvirus 4 (Epstein-Barr virus)
cagagccucugccacaa

SEQ ID NO: 3966567 - RNA, 20 nt, Human herpesvirus 4 (Epstein-Barr virus)
cagagccucugccacaaggc

SEQ ID NO: 3966568 - RNA, 16 nt, Human herpesvirus 4 (Epstein-Barr virus)
cagaggaggcuggugc

SEQ ID NO: 3966569 - RNA, 13 nt, Human herpesvirus 4 (Epstein-Barr virus)
cagaugaagacga

SEQ ID NO: 3966570 - RNA, 17 nt, Human herpesvirus 4 (Epstein-Barr virus)
cagcaccugucccuggg

SEQ ID NO: 3966571 - RNA, 17 nt, Human herpesvirus 4 (Epstein-Barr virus)
cagccagagccagccgg

SEQ ID NO: 3966572 - RNA, 18 nt, Human herpesvirus 4 (Epstein-Barr virus)
cagccagagccagccggg

SEQ ID NO: 3966573 - RNA, 21 nt, Human herpesvirus 4 (Epstein-Barr virus)
cagccagguguacgcccuggc

SEQ ID NO: 3966574 - RNA, 19 nt, Human herpesvirus 4 (Epstein-Barr virus)
cagcccggccgaggccugc

SEQ ID NO: 3966575 - RNA, 20 nt, Human herpesvirus 4 (Epstein-Barr virus)
cagcgaagaacacuccacag

SEQ ID NO: 3966576 - RNA, 20 nt, Human herpesvirus 4 (Epstein-Barr virus)
cagcgcggcagaggccucuc

SEQ ID NO: 3966577 - RNA, 14 nt, Human herpesvirus 4 (Epstein-Barr virus)
cagcuccagggcca

SEQ ID NO: 3966578 - RNA, 15 nt, Human herpesvirus 4 (Epstein-Barr virus)
cagcuccgcccucac

SEQ ID NO: 3966579 - RNA, 23 nt, Human herpesvirus 4 (Epstein-Barr virus)
caggaagcuggccaggcugguga

SEQ ID NO: 3966580 - RNA, 17 nt, Human herpesvirus 4 (Epstein-Barr virus)
caggagacguggguccc

SEQ ID NO: 3966581 - RNA, 15 nt, Human herpesvirus 4 (Epstein-Barr virus)
caggagcuugaggcc

SEQ ID NO: 3966582 - RNA, 21 nt, Human herpesvirus 4 (Epstein-Barr virus)
caggaggccaccgacgagcag

SEQ ID NO: 3966583 - RNA, 14 nt, Human herpesvirus 4 (Epstein-Barr virus)
caggaucagggcca

SEQ ID NO: 3966584 - RNA, 10 nt, Human herpesvirus 4 (Epstein-Barr virus)
caggccccca

SEQ ID NO: 3966585 - RNA, 12 nt, Human herpesvirus 4 (Epstein-Barr virus)
caggcuccugga

SEQ ID NO: 3966586 - RNA, 18 nt, Human herpesvirus 4 (Epstein-Barr virus)
cagggaaaaacuggccau

SEQ ID NO: 3966587 - RNA, 16 nt, Human herpesvirus 4 (Epstein-Barr virus)
cagggcaaagccacaa

SEQ ID NO: 3966588 - RNA, 16 nt, Human herpesvirus 4 (Epstein-Barr virus)
cagggcccguuccagg

SEQ ID NO: 3966589 - RNA, 14 nt, Human herpesvirus 4 (Epstein-Barr virus)
caggggagguggcu

SEQ ID NO: 3966590 - RNA, 11 nt, Human herpesvirus 4 (Epstein-Barr virus)
cagggguggca

SEQ ID NO: 3966591 - RNA, 17 nt, Human herpesvirus 4 (Epstein-Barr virus)
cagguagcaaggacccg

SEQ ID NO: 3966592 - RNA, 13 nt, Human herpesvirus 4 (Epstein-Barr virus)
caggugacagcag

SEQ ID NO: 3966593 - RNA, 14 nt, Human herpesvirus 4 (Epstein-Barr virus)
caguucuggugaug

SEQ ID NO: 3966594 - RNA, 23 nt, Human herpesvirus 4 (Epstein-Barr virus)
cauaaguccucauggcaggagag

SEQ ID NO: 3966595 - RNA, 16 nt, Human herpesvirus 4 (Epstein-Barr virus)
caucauaacugagcag

SEQ ID NO: 3966596 - RNA, 15 nt, Human herpesvirus 4 (Epstein-Barr virus)
cauccccagcccagc

SEQ ID NO: 3966597 - RNA, 17 nt, Human herpesvirus 4 (Epstein-Barr virus)
caucccggcccucuucc

SEQ ID NO: 3966598 - RNA, 16 nt, Human herpesvirus 4 (Epstein-Barr virus)
caucggacgggcaggc

SEQ ID NO: 3966599 - RNA, 13 nt, Human herpesvirus 4 (Epstein-Barr virus)
caucugcuucugg

SEQ ID NO: 3966600 - RNA, 14 nt, Human herpesvirus 4 (Epstein-Barr virus)
caugauggugcaga

SEQ ID NO: 3966601 - RNA, 15 nt, Human herpesvirus 4 (Epstein-Barr virus)
caugcaggccuggac

SEQ ID NO: 3966602 - RNA, 17 nt, Human herpesvirus 4 (Epstein-Barr virus)
caugcagggugcacaga

SEQ ID NO: 3966603 - RNA, 20 nt, Human herpesvirus 4 (Epstein-Barr virus)
caugccuccccagcaacaga

SEQ ID NO: 3966604 - RNA, 19 nt, Human herpesvirus 4 (Epstein-Barr virus)
caugcugcccggacggccu

SEQ ID NO: 3966605 - RNA, 16 nt, Human herpesvirus 4 (Epstein-Barr virus)
cauggacgaggacggg

SEQ ID NO: 3966606 - RNA, 21 nt, Human herpesvirus 4 (Epstein-Barr virus)
cauguguacuuguccucaucg

SEQ ID NO: 3966607 - RNA, 18 nt, Human herpesvirus 4 (Epstein-Barr virus)
cauuggcagcagcucugg

SEQ ID NO: 3966608 - RNA, 16 nt, Human herpesvirus 4 (Epstein-Barr virus)
cauuguccucaccaag

SEQ ID NO: 3966609 - RNA, 20 nt, Human herpesvirus 4 (Epstein-Barr virus)
ccaaaaugcacccggacaug

SEQ ID NO: 3966610 - RNA, 15 nt, Human herpesvirus 4 (Epstein-Barr virus)
ccaaagcuaacugua

SEQ ID NO: 3966611 - RNA, 17 nt, Human herpesvirus 4 (Epstein-Barr virus)
ccaacuuugagcugggc

SEQ ID NO: 3966612 - RNA, 17 nt, Human herpesvirus 4 (Epstein-Barr virus)
ccaaggcggcugcugag

SEQ ID NO: 3966613 - RNA, 14 nt, Human herpesvirus 4 (Epstein-Barr virus)
ccaaguugcauugg

SEQ ID NO: 3966614 - RNA, 17 nt, Human herpesvirus 4 (Epstein-Barr virus)
ccacacucccuccagaa

SEQ ID NO: 3966615 - RNA, 12 nt, Human herpesvirus 4 (Epstein-Barr virus)
ccaccuggccag

SEQ ID NO: 3966616 - RNA, 22 nt, Human herpesvirus 4 (Epstein-Barr virus)
ccacuaucacccauggccaggc

SEQ ID NO: 3966617 - RNA, 13 nt, Human herpesvirus 4 (Epstein-Barr virus)
ccacucagacucu

SEQ ID NO: 3966618 - RNA, 23 nt, Human herpesvirus 4 (Epstein-Barr virus)
ccacucuugccucggcgcuggga

SEQ ID NO: 3966619 - RNA, 17 nt, Human herpesvirus 4 (Epstein-Barr virus)
ccagaucgccugccacu

SEQ ID NO: 3966620 - RNA, 21 nt, Human herpesvirus 4 (Epstein-Barr virus)
ccagcaaccaauguaucccaa

SEQ ID NO: 3966621 - RNA, 13 nt, Human herpesvirus 4 (Epstein-Barr virus)
ccagcaggcucag

SEQ ID NO: 3966622 - RNA, 17 nt, Human herpesvirus 4 (Epstein-Barr virus)
ccagcuaacaggacaug

SEQ ID NO: 3966623 - RNA, 21 nt, Human herpesvirus 4 (Epstein-Barr virus)
ccaggaggaggacgugaguga

SEQ ID NO: 3966624 - RNA, 18 nt, Human herpesvirus 4 (Epstein-Barr virus)
ccaggcagccuugcgugg

SEQ ID NO: 3966625 - RNA, 20 nt, Human herpesvirus 4 (Epstein-Barr virus)
ccaggccugccaaagagcca

SEQ ID NO: 3966626 - RNA, 22 nt, Human herpesvirus 4 (Epstein-Barr virus)
ccaggccugccaaagagccaga

SEQ ID NO: 3966627 - RNA, 16 nt, Human herpesvirus 4 (Epstein-Barr virus)
ccaggccuuagcccag

SEQ ID NO: 3966628 - RNA, 16 nt, Human herpesvirus 4 (Epstein-Barr virus)
ccaggcgccgcagggg

SEQ ID NO: 3966629 - RNA, 13 nt, Human herpesvirus 4 (Epstein-Barr virus)
ccaggcuccugga

SEQ ID NO: 3966630 - RNA, 14 nt, Human herpesvirus 4 (Epstein-Barr virus)
ccagggccaggcga

SEQ ID NO: 3966631 - RNA, 15 nt, Human herpesvirus 4 (Epstein-Barr virus)
ccaggguccaggaga

SEQ ID NO: 3966632 - RNA, 12 nt, Human herpesvirus 4 (Epstein-Barr virus)
ccaggucacaga

SEQ ID NO: 3966633 - RNA, 13 nt, Human herpesvirus 4 (Epstein-Barr virus)
ccaggugguuaca

SEQ ID NO: 3966634 - RNA, 21 nt, Human herpesvirus 4 (Epstein-Barr virus)
ccaggugugcuucuuuuuggu

SEQ ID NO: 3966635 - RNA, 16 nt, Human herpesvirus 4 (Epstein-Barr virus)
ccauacaugucucaga

SEQ ID NO: 3966636 - RNA, 22 nt, Human herpesvirus 4 (Epstein-Barr virus)
ccauaccuacaccaccccacca

SEQ ID NO: 3966637 - RNA, 19 nt, Human herpesvirus 4 (Epstein-Barr virus)
ccaucaccuggguacccaa

SEQ ID NO: 3966638 - RNA, 18 nt, Human herpesvirus 4 (Epstein-Barr virus)
ccaucggauaaacagggg

SEQ ID NO: 3966639 - RNA, 21 nt, Human herpesvirus 4 (Epstein-Barr virus)
ccauggugccaagcucagccc

SEQ ID NO: 3966640 - RNA, 16 nt, Human herpesvirus 4 (Epstein-Barr virus)
cccaacagucuucagg

SEQ ID NO: 3966641 - RNA, 15 nt, Human herpesvirus 4 (Epstein-Barr virus)
cccaccaccaggcgg

SEQ ID NO: 3966642 - RNA, 21 nt, Human herpesvirus 4 (Epstein-Barr virus)
cccaccuuuuaauucucuucu

SEQ ID NO: 3966643 - RNA, 14 nt, Human herpesvirus 4 (Epstein-Barr virus)
cccacuccccucuc

SEQ ID NO: 3966644 - RNA, 22 nt, Human herpesvirus 4 (Epstein-Barr virus)
ccccaaaaguagaggcucaggc

SEQ ID NO: 3966645 - RNA, 23 nt, Human herpesvirus 4 (Epstein-Barr virus)
ccccaaaaguagaggcucaggcc

SEQ ID NO: 3966646 - RNA, 20 nt, Human herpesvirus 4 (Epstein-Barr virus)
ccccacggggugcucccccu

SEQ ID NO: 3966647 - RNA, 15 nt, Human herpesvirus 4 (Epstein-Barr virus)
ccccagagcagcccg

SEQ ID NO: 3966648 - RNA, 22 nt, Human herpesvirus 4 (Epstein-Barr virus)
ccccauacaugucucagaggcc

SEQ ID NO: 3966649 - RNA, 19 nt, Human herpesvirus 4 (Epstein-Barr virus)
ccccuggcggcccagcccg

SEQ ID NO: 3966650 - RNA, 22 nt, Human herpesvirus 4 (Epstein-Barr virus)
ccccugugcuucuaccaagacu

SEQ ID NO: 3966651 - RNA, 24 nt, Human herpesvirus 4 (Epstein-Barr virus)
cccggggaaaagagagcugaugga

SEQ ID NO: 3966652 - RNA, 15 nt, Human herpesvirus 4 (Epstein-Barr virus)
cccggguggugagga

SEQ ID NO: 3966653 - RNA, 16 nt, Human herpesvirus 4 (Epstein-Barr virus)
cccuagccaccguggc

SEQ ID NO: 3966654 - RNA, 15 nt, Human herpesvirus 4 (Epstein-Barr virus)
cccuccuccacccag

SEQ ID NO: 3966655 - RNA, 21 nt, Human herpesvirus 4 (Epstein-Barr virus)
cccucugcagagagccacauu

SEQ ID NO: 3966656 - RNA, 12 nt, Human herpesvirus 4 (Epstein-Barr virus)
cccucugggaga

SEQ ID NO: 3966657 - RNA, 22 nt, Human herpesvirus 4 (Epstein-Barr virus)
cccugaccggcgcgggagccgg

SEQ ID NO: 3966658 - RNA, 16 nt, Human herpesvirus 4 (Epstein-Barr virus)
cccugagcauggcggc

SEQ ID NO: 3966659 - RNA, 19 nt, Human herpesvirus 4 (Epstein-Barr virus)
cccugcucauaccuccacu

SEQ ID NO: 3966660 - RNA, 15 nt, Human herpesvirus 4 (Epstein-Barr virus)
cccuggaggccucag

SEQ ID NO: 3966661 - RNA, 14 nt, Human herpesvirus 4 (Epstein-Barr virus)
cccuggcggcccag

SEQ ID NO: 3966662 - RNA, 18 nt, Human herpesvirus 4 (Epstein-Barr virus)
ccgacaaugagcggggag

SEQ ID NO: 3966663 - RNA, 14 nt, Human herpesvirus 4 (Epstein-Barr virus)
ccgcagcuggcgga

SEQ ID NO: 3966664 - RNA, 19 nt, Human herpesvirus 4 (Epstein-Barr virus)
ccgcaggggugguggaugu

SEQ ID NO: 3966665 - RNA, 19 nt, Human herpesvirus 4 (Epstein-Barr virus)
ccgcagguggcugcugcca

SEQ ID NO: 3966666 - RNA, 18 nt, Human herpesvirus 4 (Epstein-Barr virus)
ccgccaacgcucagugcg

SEQ ID NO: 3966667 - RNA, 14 nt, Human herpesvirus 4 (Epstein-Barr virus)
ccgccgccgcagcc

SEQ ID NO: 3966668 - RNA, 17 nt, Human herpesvirus 4 (Epstein-Barr virus)
ccgccugguggugggug

SEQ ID NO: 3966669 - RNA, 20 nt, Human herpesvirus 4 (Epstein-Barr virus)
ccggaaccugagccugagcc

SEQ ID NO: 3966670 - RNA, 22 nt, Human herpesvirus 4 (Epstein-Barr virus)
ccggaccaaugccaaagcugaa

SEQ ID NO: 3966671 - RNA, 15 nt, Human herpesvirus 4 (Epstein-Barr virus)
ccggcgccaccugca

SEQ ID NO: 3966672 - RNA, 22 nt, Human herpesvirus 4 (Epstein-Barr virus)
ccgggaccgcgcccuccucugg

SEQ ID NO: 3966673 - RNA, 11 nt, Human herpesvirus 4 (Epstein-Barr virus)
ccggugguggg

SEQ ID NO: 3966674 - RNA, 16 nt, Human herpesvirus 4 (Epstein-Barr virus)
ccguaaucuguggugg

SEQ ID NO: 3966675 - RNA, 13 nt, Human herpesvirus 4 (Epstein-Barr virus)
ccgugcaccugcc

SEQ ID NO: 3966676 - RNA, 17 nt, Human herpesvirus 4 (Epstein-Barr virus)
ccgugguccugaggggc

SEQ ID NO: 3966677 - RNA, 17 nt, Human herpesvirus 4 (Epstein-Barr virus)
ccuagagguuuugcuag

SEQ ID NO: 3966678 - RNA, 19 nt, Human herpesvirus 4 (Epstein-Barr virus)
ccuaggccugccacguggg

SEQ ID NO: 3966679 - RNA, 16 nt, Human herpesvirus 4 (Epstein-Barr virus)
ccuagguacucuuggu

SEQ ID NO: 3966680 - RNA, 16 nt, Human herpesvirus 4 (Epstein-Barr virus)
ccuauagauccugggc

SEQ ID NO: 3966681 - RNA, 18 nt, Human herpesvirus 4 (Epstein-Barr virus)
ccucagaauuucugcuag

SEQ ID NO: 3966682 - RNA, 18 nt, Human herpesvirus 4 (Epstein-Barr virus)
ccucagcccccccugugc

SEQ ID NO: 3966683 - RNA, 16 nt, Human herpesvirus 4 (Epstein-Barr virus)
ccucgcgacucguggg

SEQ ID NO: 3966684 - RNA, 16 nt, Human herpesvirus 4 (Epstein-Barr virus)
agcuggcggacuacaa

SEQ ID NO: 3966685 - RNA, 22 nt, Human herpesvirus 4 (Epstein-Barr virus)
agcuguguuucccgacgccaau

SEQ ID NO: 3966686 - RNA, 12 nt, Human herpesvirus 4 (Epstein-Barr virus)
aggacaugugca

SEQ ID NO: 3966687 - RNA, 19 nt, Human herpesvirus 4 (Epstein-Barr virus)
aggaccauggaugugaaug

SEQ ID NO: 3966688 - RNA, 13 nt, Human herpesvirus 4 (Epstein-Barr virus)
aggacccugggcc

SEQ ID NO: 3966689 - RNA, 13 nt, Human herpesvirus 4 (Epstein-Barr virus)
aggaccuggaugc

SEQ ID NO: 3966690 - RNA, 24 nt, Human herpesvirus 4 (Epstein-Barr virus)
aggagaugauaaugaugaggagca

SEQ ID NO: 3966691 - RNA, 19 nt, Human herpesvirus 4 (Epstein-Barr virus)
aggagcaggaggaggggca

SEQ ID NO: 3966692 - RNA, 21 nt, Human herpesvirus 4 (Epstein-Barr virus)
aggagccucgccuugagggca

SEQ ID NO: 3966693 - RNA, 13 nt, Human herpesvirus 4 (Epstein-Barr virus)
aggagcuguuugg

SEQ ID NO: 3966694 - RNA, 22 nt, Human herpesvirus 4 (Epstein-Barr virus)
aggaggacaugugcauggccug

SEQ ID NO: 3966695 - RNA, 19 nt, Human herpesvirus 4 (Epstein-Barr virus)
aggcacacaaaaugaggaa

SEQ ID NO: 3966696 - RNA, 23 nt, Human herpesvirus 4 (Epstein-Barr virus)
aggcacggccucgugcaaccagg

SEQ ID NO: 3966697 - RNA, 20 nt, Human herpesvirus 4 (Epstein-Barr virus)
aggcagccccaaagcgggug

SEQ ID NO: 3966698 - RNA, 22 nt, Human herpesvirus 4 (Epstein-Barr virus)
aggccgagucaguuacacacac

SEQ ID NO: 3966699 - RNA, 17 nt, Human herpesvirus 4 (Epstein-Barr virus)
aggcgggaauggccgcc

SEQ ID NO: 3966700 - RNA, 18 nt, Human herpesvirus 4 (Epstein-Barr virus)
aggcguaacuugucuaca

SEQ ID NO: 3966701 - RNA, 18 nt, Human herpesvirus 4 (Epstein-Barr virus)
aggcucugcaugaggucc

SEQ ID NO: 3966702 - RNA, 17 nt, Human herpesvirus 4 (Epstein-Barr virus)
aggcugcuaagccagga

SEQ ID NO: 3966703 - RNA, 20 nt, Human herpesvirus 4 (Epstein-Barr virus)
agggagacguuugaguccaa

SEQ ID NO: 3966704 - RNA, 13 nt, Human herpesvirus 4 (Epstein-Barr virus)
aggggcaggagca

SEQ ID NO: 3966705 - RNA, 17 nt, Human herpesvirus 4 (Epstein-Barr virus)
aggggccucggccuggg

SEQ ID NO: 3966706 - RNA, 21 nt, Human herpesvirus 4 (Epstein-Barr virus)
aggggcggugggcgcgugcac

SEQ ID NO: 3966707 - RNA, 15 nt, Human herpesvirus 4 (Epstein-Barr virus)
aggucuccagagggc

SEQ ID NO: 3966708 - RNA, 22 nt, Human herpesvirus 4 (Epstein-Barr virus)
aggucuugccguggcgccuggg

SEQ ID NO: 3966709 - RNA, 14 nt, Human herpesvirus 4 (Epstein-Barr virus)
aggugcugaggccc

SEQ ID NO: 3966710 - RNA, 17 nt, Human herpesvirus 4 (Epstein-Barr virus)
agguggaggggggcggc

SEQ ID NO: 3966711 - RNA, 18 nt, Human herpesvirus 4 (Epstein-Barr virus)
agguguccagcgcucugg

SEQ ID NO: 3966712 - RNA, 18 nt, Human herpesvirus 4 (Epstein-Barr virus)
agguuaaaugugaagccc

SEQ ID NO: 3966713 - RNA, 19 nt, Human herpesvirus 4 (Epstein-Barr virus)
aguaaacccgauggccccg

SEQ ID NO: 3966714 - RNA, 21 nt, Human herpesvirus 4 (Epstein-Barr virus)
aguacgugcagaggacuuuug

SEQ ID NO: 3966715 - RNA, 20 nt, Human herpesvirus 4 (Epstein-Barr virus)
aguaggcacaucuggaccug

SEQ ID NO: 3966716 - RNA, 17 nt, Human herpesvirus 4 (Epstein-Barr virus)
aguccaggggccacaca

SEQ ID NO: 3966717 - RNA, 19 nt, Human herpesvirus 4 (Epstein-Barr virus)
agucgcguacucuguggag

SEQ ID NO: 3966718 - RNA, 21 nt, Human herpesvirus 4 (Epstein-Barr virus)
agugcauggauauagcucugc

SEQ ID NO: 3966719 - RNA, 18 nt, Human herpesvirus 4 (Epstein-Barr virus)
agugccuccgccugagcc

SEQ ID NO: 3966720 - RNA, 23 nt, Human herpesvirus 4 (Epstein-Barr virus)
aguggccgucuggcagggggccg

SEQ ID NO: 3966721 - RNA, 22 nt, Human herpesvirus 4 (Epstein-Barr virus)
aguuccucaacaaggagugccu

SEQ ID NO: 3966722 - RNA, 15 nt, Human herpesvirus 4 (Epstein-Barr virus)
aguuggcauuggcgu

SEQ ID NO: 3966723 - RNA, 18 nt, Human herpesvirus 4 (Epstein-Barr virus)
aguuguuauucccaccuc

SEQ ID NO: 3966724 - RNA, 21 nt, Human herpesvirus 4 (Epstein-Barr virus)
auaaaguugaugauauugaau

SEQ ID NO: 3966725 - RNA, 22 nt, Human herpesvirus 4 (Epstein-Barr virus)
auaacggggaaugugugacaug

SEQ ID NO: 3966726 - RNA, 16 nt, Human herpesvirus 4 (Epstein-Barr virus)
auaauacgcccgacaa

SEQ ID NO: 3966727 - RNA, 21 nt, Human herpesvirus 4 (Epstein-Barr virus)
auaucuggaggucuucucuga

SEQ ID NO: 3966728 - RNA, 15 nt, Human herpesvirus 4 (Epstein-Barr virus)
auauugaauuccaca

SEQ ID NO: 3966729 - RNA, 23 nt, Human herpesvirus 4 (Epstein-Barr virus)
aucaccgccguaaucuguggugg

SEQ ID NO: 3966730 - RNA, 12 nt, Human herpesvirus 4 (Epstein-Barr virus)
aucacuggcaaa

SEQ ID NO: 3966731 - RNA, 15 nt, Human herpesvirus 4 (Epstein-Barr virus)
aucagggccaagaca

SEQ ID NO: 3966732 - RNA, 14 nt, Human herpesvirus 4 (Epstein-Barr virus)
aucccaggccucag

SEQ ID NO: 3966733 - RNA, 21 nt, Human herpesvirus 4 (Epstein-Barr virus)
auccugcucauuauugcucuc

SEQ ID NO: 3966734 - RNA, 15 nt, Human herpesvirus 4 (Epstein-Barr virus)
aucucuauugccucu

SEQ ID NO: 3966735 - RNA, 18 nt, Human herpesvirus 4 (Epstein-Barr virus)
aucucugauuauagcucu

SEQ ID NO: 3966736 - RNA, 17 nt, Human herpesvirus 4 (Epstein-Barr virus)
aucugacacuuuagagc

SEQ ID NO: 3966737 - RNA, 15 nt, Human herpesvirus 4 (Epstein-Barr virus)
aucuggggcuggccu

SEQ ID NO: 3966738 - RNA, 13 nt, Human herpesvirus 4 (Epstein-Barr virus)
augaacccugggg

SEQ ID NO: 3966739 - RNA, 18 nt, Human herpesvirus 4 (Epstein-Barr virus)
augacgucaacuuuacuu

SEQ ID NO: 3966740 - RNA, 20 nt, Human herpesvirus 4 (Epstein-Barr virus)
augacucccucccgcacccu

SEQ ID NO: 3966741 - RNA, 13 nt, Human herpesvirus 4 (Epstein-Barr virus)
augagggaaaagg

SEQ ID NO: 3966742 - RNA, 20 nt, Human herpesvirus 4 (Epstein-Barr virus)
augcacggucauucugccgu

SEQ ID NO: 3966743 - RNA, 13 nt, Human herpesvirus 4 (Epstein-Barr virus)
augcaggccugga

SEQ ID NO: 3966744 - RNA, 16 nt, Human herpesvirus 4 (Epstein-Barr virus)
augcaggccuggacag

SEQ ID NO: 3966745 - RNA, 13 nt, Human herpesvirus 4 (Epstein-Barr virus)
augcaguggguga

SEQ ID NO: 3966746 - RNA, 22 nt, Human herpesvirus 4 (Epstein-Barr virus)
augcgugaccaccuggccaggg

SEQ ID NO: 3966747 - RNA, 22 nt, Human herpesvirus 4 (Epstein-Barr virus)
augcuguugaggcaaaagacua

SEQ ID NO: 3966748 - RNA, 14 nt, Human herpesvirus 4 (Epstein-Barr virus)
auggcauaauuucc

SEQ ID NO: 3966749 - RNA, 16 nt, Human herpesvirus 4 (Epstein-Barr virus)
augugcauggccuggg

SEQ ID NO: 3966750 - RNA, 17 nt, Human herpesvirus 4 (Epstein-Barr virus)
augugcccaagccugga

SEQ ID NO: 3966751 - RNA, 13 nt, Human herpesvirus 4 (Epstein-Barr virus)
auguuccuucuca

SEQ ID NO: 3966752 - RNA, 22 nt, Human herpesvirus 4 (Epstein-Barr virus)
auuaggcacuggacacacaugg

SEQ ID NO: 3966753 - RNA, 18 nt, Human herpesvirus 4 (Epstein-Barr virus)
auucucuaaucccucugg

SEQ ID NO: 3966754 - RNA, 20 nt, Human herpesvirus 4 (Epstein-Barr virus)
auugcugaacuggggcuggu

SEQ ID NO: 3966755 - RNA, 21 nt, Human herpesvirus 4 (Epstein-Barr virus)
auugcuugccuuuuugccaca

SEQ ID NO: 3966756 - RNA, 19 nt, Human herpesvirus 4 (Epstein-Barr virus)
auuggggugauccuguagc

SEQ ID NO: 3966757 - RNA, 14 nt, Human herpesvirus 4 (Epstein-Barr virus)
auuuagaaaccuug

SEQ ID NO: 3966758 - RNA, 17 nt, Human herpesvirus 4 (Epstein-Barr virus)
auuucaguggcccucag

SEQ ID NO: 3966759 - RNA, 14 nt, Human herpesvirus 4 (Epstein-Barr virus)
auuugcugacauau

SEQ ID NO: 3966760 - RNA, 17 nt, Human herpesvirus 4 (Epstein-Barr virus)
caaaacucacaggacau

SEQ ID NO: 3966761 - RNA, 21 nt, Human herpesvirus 4 (Epstein-Barr virus)
caaaacugguggacucuauug

SEQ ID NO: 3966762 - RNA, 19 nt, Human herpesvirus 4 (Epstein-Barr virus)
caacccccggcucucaggc

SEQ ID NO: 3966763 - RNA, 15 nt, Human herpesvirus 4 (Epstein-Barr virus)
caaccugauuccccc

SEQ ID NO: 3966764 - RNA, 19 nt, Human herpesvirus 4 (Epstein-Barr virus)
caacgccggccugcuggcc

SEQ ID NO: 3966765 - RNA, 22 nt, Human herpesvirus 4 (Epstein-Barr virus)
caacgcuuccacccccuggagc

SEQ ID NO: 3966766 - RNA, 11 nt, Human herpesvirus 4 (Epstein-Barr virus)
caacugcugca

SEQ ID NO: 3966767 - RNA, 20 nt, Human herpesvirus 4 (Epstein-Barr virus)
caagaggcagagagccagug

SEQ ID NO: 3966768 - RNA, 17 nt, Human herpesvirus 4 (Epstein-Barr virus)
caagcaaacggccuggc

SEQ ID NO: 3966769 - RNA, 13 nt, Human herpesvirus 4 (Epstein-Barr virus)
caagcggcacaga

SEQ ID NO: 3966770 - RNA, 23 nt, Human herpesvirus 4 (Epstein-Barr virus)
caagcugcuuugauuccugggau

SEQ ID NO: 3966771 - RNA, 22 nt, Human herpesvirus 4 (Epstein-Barr virus)
caagggaaaggaagggggcccu

SEQ ID NO: 3966772 - RNA, 12 nt, Human herpesvirus 4 (Epstein-Barr virus)
caagggaagagg

SEQ ID NO: 3966773 - RNA, 24 nt, Human herpesvirus 4 (Epstein-Barr virus)
caauaaaguugaugauauugaauu

SEQ ID NO: 3966774 - RNA, 13 nt, Human herpesvirus 4 (Epstein-Barr virus)
caaugccaaagcu

SEQ ID NO: 3966775 - RNA, 19 nt, Human herpesvirus 4 (Epstein-Barr virus)
cacaaccacggugacauuc

SEQ ID NO: 3966776 - RNA, 15 nt, Human herpesvirus 4 (Epstein-Barr virus)
cacaacuaccaggca

SEQ ID NO: 3966777 - RNA, 21 nt, Human herpesvirus 4 (Epstein-Barr virus)
cacacauuucagguaccccaa

SEQ ID NO: 3966778 - RNA, 17 nt, Human herpesvirus 4 (Epstein-Barr virus)
cacagaggugauguaga

SEQ ID NO: 3966779 - RNA, 19 nt, Human herpesvirus 4 (Epstein-Barr virus)
cacagguagcaaggacccg

SEQ ID NO: 3966780 - RNA, 18 nt, Human herpesvirus 4 (Epstein-Barr virus)
caccagggaggccuggga

SEQ ID NO: 3966781 - RNA, 16 nt, Human herpesvirus 4 (Epstein-Barr virus)
cacccaggcagccuug

SEQ ID NO: 3966782 - RNA, 11 nt, Human herpesvirus 4 (Epstein-Barr virus)
cacccccacca

SEQ ID NO: 3966783 - RNA, 15 nt, Human herpesvirus 4 (Epstein-Barr virus)
cacccucccccugcc

SEQ ID NO: 3966784 - RNA, 21 nt, Human herpesvirus 4 (Epstein-Barr virus)
caccggcuuggcccucucacu

SEQ ID NO: 3966785 - RNA, 15 nt, Human herpesvirus 4 (Epstein-Barr virus)
caccguggagccggg

SEQ ID NO: 3966786 - RNA, 16 nt, Human herpesvirus 4 (Epstein-Barr virus)
caccgugggaaaauag

SEQ ID NO: 3966787 - RNA, 15 nt, Human herpesvirus 4 (Epstein-Barr virus)
caccugcagggcuuc

SEQ ID NO: 3966788 - RNA, 20 nt, Human herpesvirus 4 (Epstein-Barr virus)
caccuggccagggcggagga

SEQ ID NO: 3966789 - RNA, 19 nt, Human herpesvirus 4 (Epstein-Barr virus)
caccugucccugggggccu

SEQ ID NO: 3966790 - RNA, 16 nt, Human herpesvirus 4 (Epstein-Barr virus)
caccuguguccugggc

SEQ ID NO: 3966791 - RNA, 17 nt, Human herpesvirus 4 (Epstein-Barr virus)
caccuguguccugggca

SEQ ID NO: 3966792 - RNA, 21 nt, Human herpesvirus 4 (Epstein-Barr virus)
caccuugaggugccacagagc

SEQ ID NO: 3966793 - RNA, 13 nt, Human herpesvirus 4 (Epstein-Barr virus)
cacgacuguuccu

SEQ ID NO: 3966794 - RNA, 20 nt, Human herpesvirus 4 (Epstein-Barr virus)
cacggcaccgucagccacac

SEQ ID NO: 3966795 - RNA, 23 nt, Human herpesvirus 4 (Epstein-Barr virus)
cacggcaccgucagccacacaau

SEQ ID NO: 3966796 - RNA, 19 nt, Human herpesvirus 4 (Epstein-Barr virus)
cacggcgucaaacagguga

SEQ ID NO: 3966797 - RNA, 17 nt, Human herpesvirus 4 (Epstein-Barr virus)
cacggggccgugcaccu

SEQ ID NO: 3966798 - RNA, 17 nt, Human herpesvirus 4 (Epstein-Barr virus)
cacggggugcucccccu

SEQ ID NO: 3966799 - RNA, 19 nt, Human herpesvirus 4 (Epstein-Barr virus)
cacuucuacucuuggcagc

SEQ ID NO: 3966800 - RNA, 14 nt, Human herpesvirus 4 (Epstein-Barr virus)
cagaagacuccugc

SEQ ID NO: 3966801 - RNA, 22 nt, Human herpesvirus 4 (Epstein-Barr virus)
cagacacauucgggugaaggcu

SEQ ID NO: 3966802 - RNA, 13 nt, Human herpesvirus 4 (Epstein-Barr virus)
cagacagccgcgg

SEQ ID NO: 3966803 - RNA, 13 nt, Human herpesvirus 4 (Epstein-Barr virus)
cagaccacccgga

SEQ ID NO: 3966804 - RNA, 20 nt, Human herpesvirus 4 (Epstein-Barr virus)
cagaguucccggcugcuccc

SEQ ID NO: 3966805 - RNA, 23 nt, Human herpesvirus 4 (Epstein-Barr virus)
cagauagccggccaggcagagga

SEQ ID NO: 3966806 - RNA, 15 nt, Human herpesvirus 4 (Epstein-Barr virus)
cagaugcagugggug

SEQ ID NO: 3966807 - RNA, 20 nt, Human herpesvirus 4 (Epstein-Barr virus)
cagcacgucgucagagaggu

SEQ ID NO: 3966808 - RNA, 20 nt, Human herpesvirus 4 (Epstein-Barr virus)
cagcagaagggucagcacag

SEQ ID NO: 3966809 - RNA, 17 nt, Human herpesvirus 4 (Epstein-Barr virus)
cagcagauccagggccc

SEQ ID NO: 3966810 - RNA, 19 nt, Human herpesvirus 4 (Epstein-Barr virus)
cagcagcucuggcacugcu

SEQ ID NO: 3966811 - RNA, 16 nt, Human herpesvirus 4 (Epstein-Barr virus)
cagcaguagcuuggga

SEQ ID NO: 3966812 - RNA, 15 nt, Human herpesvirus 4 (Epstein-Barr virus)
cagccagagccagcc

SEQ ID NO: 3966813 - RNA, 18 nt, Human herpesvirus 4 (Epstein-Barr virus)
cagccccgcccuccccau

SEQ ID NO: 3966814 - RNA, 18 nt, Human herpesvirus 4 (Epstein-Barr virus)
cagcgaccggcagauccc

SEQ ID NO: 3966815 - RNA, 22 nt, Human herpesvirus 4 (Epstein-Barr virus)
cagcgucaggaaguacagccgg

SEQ ID NO: 3966816 - RNA, 15 nt, Human herpesvirus 4 (Epstein-Barr virus)
cagcuaacaggacau

SEQ ID NO: 3966817 - RNA, 16 nt, Human herpesvirus 4 (Epstein-Barr virus)
cagcuccagggccagc

SEQ ID NO: 3966818 - RNA, 17 nt, Human herpesvirus 4 (Epstein-Barr virus)
cagcuccagggccagca

SEQ ID NO: 3966819 - RNA, 16 nt, Human herpesvirus 4 (Epstein-Barr virus)
cagcucuaacuuggca

SEQ ID NO: 3966820 - RNA, 15 nt, Human herpesvirus 4 (Epstein-Barr virus)
cauuaaagccuccuc

SEQ ID NO: 3966821 - RNA, 14 nt, Human herpesvirus 4 (Epstein-Barr virus)
cauuccacccacug

SEQ ID NO: 3966822 - RNA, 14 nt, Human herpesvirus 4 (Epstein-Barr virus)
cauugcaccuugcc

SEQ ID NO: 3966823 - RNA, 21 nt, Human herpesvirus 4 (Epstein-Barr virus)
cauugcaucgcucaccccugu

SEQ ID NO: 3966824 - RNA, 20 nt, Human herpesvirus 4 (Epstein-Barr virus)
cauuggcugcaaagggaccc

SEQ ID NO: 3966825 - RNA, 18 nt, Human herpesvirus 4 (Epstein-Barr virus)
cauugggcuaacgggagg

SEQ ID NO: 3966826 - RNA, 18 nt, Human herpesvirus 4 (Epstein-Barr virus)
cauuuuuagccccagccc

SEQ ID NO: 3966827 - RNA, 18 nt, Human herpesvirus 4 (Epstein-Barr virus)
ccaaacauaaaugcccca

SEQ ID NO: 3966828 - RNA, 16 nt, Human herpesvirus 4 (Epstein-Barr virus)
ccaaacuuuguccaga

SEQ ID NO: 3966829 - RNA, 16 nt, Human herpesvirus 4 (Epstein-Barr virus)
ccaagauagugaccaa

SEQ ID NO: 3966830 - RNA, 14 nt, Human herpesvirus 4 (Epstein-Barr virus)
ccaaucaccagcca

SEQ ID NO: 3966831 - RNA, 12 nt, Human herpesvirus 4 (Epstein-Barr virus)
ccaccacacagc

SEQ ID NO: 3966832 - RNA, 21 nt, Human herpesvirus 4 (Epstein-Barr virus)
ccaccgccuuaugaggaccca

SEQ ID NO: 3966833 - RNA, 18 nt, Human herpesvirus 4 (Epstein-Barr virus)
ccaccggggaggccaggu

SEQ ID NO: 3966834 - RNA, 14 nt, Human herpesvirus 4 (Epstein-Barr virus)
ccaccuccaccacc

SEQ ID NO: 3966835 - RNA, 14 nt, Human herpesvirus 4 (Epstein-Barr virus)
ccacuaggaaccca

SEQ ID NO: 3966836 - RNA, 13 nt, Human herpesvirus 4 (Epstein-Barr virus)
ccacucaggaagc

SEQ ID NO: 3966837 - RNA, 22 nt, Human herpesvirus 4 (Epstein-Barr virus)
ccacugagcaagauccuucugg

SEQ ID NO: 3966838 - RNA, 15 nt, Human herpesvirus 4 (Epstein-Barr virus)
ccagaagcagaugga

SEQ ID NO: 3966839 - RNA, 19 nt, Human herpesvirus 4 (Epstein-Barr virus)
ccagaguucccggcugcuc

SEQ ID NO: 3966840 - RNA, 16 nt, Human herpesvirus 4 (Epstein-Barr virus)
ccagcagauccagggc

SEQ ID NO: 3966841 - RNA, 17 nt, Human herpesvirus 4 (Epstein-Barr virus)
ccagcagggcacagagg

SEQ ID NO: 3966842 - RNA, 14 nt, Human herpesvirus 4 (Epstein-Barr virus)
ccagccaucaugcu

SEQ ID NO: 3966843 - RNA, 14 nt, Human herpesvirus 4 (Epstein-Barr virus)
ccagcgacugaucc

SEQ ID NO: 3966844 - RNA, 16 nt, Human herpesvirus 4 (Epstein-Barr virus)
ccagcucggccagcag

SEQ ID NO: 3966845 - RNA, 12 nt, Human herpesvirus 4 (Epstein-Barr virus)
ccagcugguggu

SEQ ID NO: 3966846 - RNA, 17 nt, Human herpesvirus 4 (Epstein-Barr virus)
ccaggcuuucuaugccu

SEQ ID NO: 3966847 - RNA, 18 nt, Human herpesvirus 4 (Epstein-Barr virus)
ccagggccggaaccugag

SEQ ID NO: 3966848 - RNA, 16 nt, Human herpesvirus 4 (Epstein-Barr virus)
ccaggucuugccgugg

SEQ ID NO: 3966849 - RNA, 14 nt, Human herpesvirus 4 (Epstein-Barr virus)
ccauaccaggugcc

SEQ ID NO: 3966850 - RNA, 18 nt, Human herpesvirus 4 (Epstein-Barr virus)
ccauaccuacaccacccc

SEQ ID NO: 3966851 - RNA, 21 nt, Human herpesvirus 4 (Epstein-Barr virus)
ccaucagcucgcccacacagc

SEQ ID NO: 3966852 - RNA, 20 nt, Human herpesvirus 4 (Epstein-Barr virus)
ccauccaucaacuucagcuc

SEQ ID NO: 3966853 - RNA, 15 nt, Human herpesvirus 4 (Epstein-Barr virus)
ccauguaagccugcc

SEQ ID NO: 3966854 - RNA, 20 nt, Human herpesvirus 4 (Epstein-Barr virus)
cccaauauccaucugcuucu

SEQ ID NO: 3966855 - RNA, 12 nt, Human herpesvirus 4 (Epstein-Barr virus)
cccacccccacc

SEQ ID NO: 3966856 - RNA, 18 nt, Human herpesvirus 4 (Epstein-Barr virus)
cccacggaagcccucugg

SEQ ID NO: 3966857 - RNA, 16 nt, Human herpesvirus 4 (Epstein-Barr virus)
cccacggaccccccuc

SEQ ID NO: 3966858 - RNA, 14 nt, Human herpesvirus 4 (Epstein-Barr virus)
cccagccacagcac

SEQ ID NO: 3966859 - RNA, 19 nt, Human herpesvirus 4 (Epstein-Barr virus)
cccagccuacucuccacuc

SEQ ID NO: 3966860 - RNA, 16 nt, Human herpesvirus 4 (Epstein-Barr virus)
cccagggacaucccca

SEQ ID NO: 3966861 - RNA, 18 nt, Human herpesvirus 4 (Epstein-Barr virus)
cccauccccagcccagcc

SEQ ID NO: 3966862 - RNA, 21 nt, Human herpesvirus 4 (Epstein-Barr virus)
cccauguugcgggugccggcc

SEQ ID NO: 3966863 - RNA, 17 nt, Human herpesvirus 4 (Epstein-Barr virus)
ccccagcuucugaggcg

SEQ ID NO: 3966864 - RNA, 17 nt, Human herpesvirus 4 (Epstein-Barr virus)
ccccaguggacaaggca

SEQ ID NO: 3966865 - RNA, 15 nt, Human herpesvirus 4 (Epstein-Barr virus)
ccccggccucccgcu

SEQ ID NO: 3966866 - RNA, 16 nt, Human herpesvirus 4 (Epstein-Barr virus)
gccacccgucccgggu

SEQ ID NO: 3966867 - RNA, 19 nt, Human herpesvirus 4 (Epstein-Barr virus)
gccagcaaaaccagcccgg

SEQ ID NO: 3966868 - RNA, 21 nt, Human herpesvirus 4 (Epstein-Barr virus)
gccaggaccuggaugcuguag

SEQ ID NO: 3966869 - RNA, 23 nt, Human herpesvirus 4 (Epstein-Barr virus)
gccagggugaccuggcucagguc

SEQ ID NO: 3966870 - RNA, 15 nt, Human herpesvirus 4 (Epstein-Barr virus)
gccaugcaggccugg

SEQ ID NO: 3966871 - RNA, 20 nt, Human herpesvirus 4 (Epstein-Barr virus)
gcccccaaaaguagaggcuc

SEQ ID NO: 3966872 - RNA, 19 nt, Human herpesvirus 4 (Epstein-Barr virus)
gcccccucugccuccggcc

SEQ ID NO: 3966873 - RNA, 23 nt, Human herpesvirus 4 (Epstein-Barr virus)
gccccgcccuccccauccccagc

SEQ ID NO: 3966874 - RNA, 21 nt, Human herpesvirus 4 (Epstein-Barr virus)
gccccggucaccccagaugcc

SEQ ID NO: 3966875 - RNA, 14 nt, Human herpesvirus 4 (Epstein-Barr virus)
gccccucagccugc

SEQ ID NO: 3966876 - RNA, 18 nt, Human herpesvirus 4 (Epstein-Barr virus)
gcccucaugcgccagagc

SEQ ID NO: 3966877 - RNA, 21 nt, Human herpesvirus 4 (Epstein-Barr virus)
gcccugaucugggagaugaga

SEQ ID NO: 3966878 - RNA, 14 nt, Human herpesvirus 4 (Epstein-Barr virus)
gccgccccgggccc

SEQ ID NO: 3966879 - RNA, 18 nt, Human herpesvirus 4 (Epstein-Barr virus)
gccgccgccuccgccgcc

SEQ ID NO: 3966880 - RNA, 16 nt, Human herpesvirus 4 (Epstein-Barr virus)
gccggaaccugagccu

SEQ ID NO: 3966881 - RNA, 20 nt, Human herpesvirus 4 (Epstein-Barr virus)
gccggcgcuguguggcugac

SEQ ID NO: 3966882 - RNA, 13 nt, Human herpesvirus 4 (Epstein-Barr virus)
gccguccucugga

SEQ ID NO: 3966883 - RNA, 14 nt, Human herpesvirus 4 (Epstein-Barr virus)
gccguggcgccugg

SEQ ID NO: 3966884 - RNA, 21 nt, Human herpesvirus 4 (Epstein-Barr virus)
gccuaaucaccguuccucauu

SEQ ID NO: 3966885 - RNA, 19 nt, Human herpesvirus 4 (Epstein-Barr virus)
gccuccauccaguggggcu

SEQ ID NO: 3966886 - RNA, 16 nt, Human herpesvirus 4 (Epstein-Barr virus)
gccuccucgcaggccc

SEQ ID NO: 3966887 - RNA, 20 nt, Human herpesvirus 4 (Epstein-Barr virus)
gccucgccuucuccucagcc

SEQ ID NO: 3966888 - RNA, 14 nt, Human herpesvirus 4 (Epstein-Barr virus)
gccugagacagagg

SEQ ID NO: 3966889 - RNA, 15 nt, Human herpesvirus 4 (Epstein-Barr virus)
gccugagcugccugg

SEQ ID NO: 3966890 - RNA, 16 nt, Human herpesvirus 4 (Epstein-Barr virus)
gccugccaaagagcca

SEQ ID NO: 3966891 - RNA, 16 nt, Human herpesvirus 4 (Epstein-Barr virus)
gccuggcucgccugga

SEQ ID NO: 3966892 - RNA, 19 nt, Human herpesvirus 4 (Epstein-Barr virus)
gccuguuuguccagcaggg

SEQ ID NO: 3966893 - RNA, 17 nt, Human herpesvirus 4 (Epstein-Barr virus)
gccuucuccucagccuc

SEQ ID NO: 3966894 - RNA, 17 nt, Human herpesvirus 4 (Epstein-Barr virus)
gccuucugcguccagac

SEQ ID NO: 3966895 - RNA, 17 nt, Human herpesvirus 4 (Epstein-Barr virus)
gccuugggggugguggg

SEQ ID NO: 3966896 - RNA, 22 nt, Human herpesvirus 4 (Epstein-Barr virus)
gcgccaucuagcgggagauguu

SEQ ID NO: 3966897 - RNA, 12 nt, Human herpesvirus 4 (Epstein-Barr virus)
gcgccggugggg

SEQ ID NO: 3966898 - RNA, 12 nt, Human herpesvirus 4 (Epstein-Barr virus)
gcgccugcucca

SEQ ID NO: 3966899 - RNA, 21 nt, Human herpesvirus 4 (Epstein-Barr virus)
gcggcagcggaugguggggcu

SEQ ID NO: 3966900 - RNA, 14 nt, Human herpesvirus 4 (Epstein-Barr virus)
gcggcguggagcug

SEQ ID NO: 3966901 - RNA, 12 nt, Human herpesvirus 4 (Epstein-Barr virus)
gcgugccaaacu

SEQ ID NO: 3966902 - RNA, 17 nt, Human herpesvirus 4 (Epstein-Barr virus)
gcguugccagacuccgc

SEQ ID NO: 3966903 - RNA, 21 nt, Human herpesvirus 4 (Epstein-Barr virus)
gcuacacucuggggucucagg

SEQ ID NO: 3966904 - RNA, 16 nt, Human herpesvirus 4 (Epstein-Barr virus)
gcucaccuauggucac

SEQ ID NO: 3966905 - RNA, 14 nt, Human herpesvirus 4 (Epstein-Barr virus)
gcucaguggccguc

SEQ ID NO: 3966906 - RNA, 16 nt, Human herpesvirus 4 (Epstein-Barr virus)
gcucccccuggacacu

SEQ ID NO: 3966907 - RNA, 23 nt, Human herpesvirus 4 (Epstein-Barr virus)
gcuccggauucaccggcaccgcc

SEQ ID NO: 3966908 - RNA, 21 nt, Human herpesvirus 4 (Epstein-Barr virus)
gcuccguccuuguccaggaga

SEQ ID NO: 3966909 - RNA, 18 nt, Human herpesvirus 4 (Epstein-Barr virus)
gcuccuggaucuggggcu

SEQ ID NO: 3966910 - RNA, 20 nt, Human herpesvirus 4 (Epstein-Barr virus)
gcucuucauguccacugagc

SEQ ID NO: 3966911 - RNA, 21 nt, Human herpesvirus 4 (Epstein-Barr virus)
gcugcaucuuaccccuggcuu

SEQ ID NO: 3966912 - RNA, 18 nt, Human herpesvirus 4 (Epstein-Barr virus)
gcugccgucccagggccg

SEQ ID NO: 3966913 - RNA, 18 nt, Human herpesvirus 4 (Epstein-Barr virus)
gcuggacgcgcagugcca

SEQ ID NO: 3966914 - RNA, 15 nt, Human herpesvirus 4 (Epstein-Barr virus)
gcugguuuggagaaa

SEQ ID NO: 3966915 - RNA, 22 nt, Human herpesvirus 4 (Epstein-Barr virus)
gcuucucguagagaucaggcca

SEQ ID NO: 3966916 - RNA, 13 nt, Human herpesvirus 4 (Epstein-Barr virus)
gcuucuggcucuu

SEQ ID NO: 3966917 - RNA, 16 nt, Human herpesvirus 4 (Epstein-Barr virus)
gcuugcgucugccccc

SEQ ID NO: 3966918 - RNA, 12 nt, Human herpesvirus 4 (Epstein-Barr virus)
gcuugcuggggc

SEQ ID NO: 3966919 - RNA, 16 nt, Human herpesvirus 4 (Epstein-Barr virus)
gcuuugcgaaaacgaa

SEQ ID NO: 3966920 - RNA, 12 nt, Human herpesvirus 4 (Epstein-Barr virus)
gcuuuucuccuc

SEQ ID NO: 3966921 - RNA, 16 nt, Human herpesvirus 4 (Epstein-Barr virus)
ggacagggggacucua

SEQ ID NO: 3966922 - RNA, 18 nt, Human herpesvirus 4 (Epstein-Barr virus)
ggacccacgguggaacag

SEQ ID NO: 3966923 - RNA, 16 nt, Human herpesvirus 4 (Epstein-Barr virus)
ggacgaggaggcggaa

SEQ ID NO: 3966924 - RNA, 14 nt, Human herpesvirus 4 (Epstein-Barr virus)
ggacucggggugau

SEQ ID NO: 3966925 - RNA, 16 nt, Human herpesvirus 4 (Epstein-Barr virus)
ggacuuccugggaggu

SEQ ID NO: 3966926 - RNA, 15 nt, Human herpesvirus 4 (Epstein-Barr virus)
ggagaggcagcccca

SEQ ID NO: 3966927 - RNA, 18 nt, Human herpesvirus 4 (Epstein-Barr virus)
ggccgccacccucccccu

SEQ ID NO: 3966928 - RNA, 16 nt, Human herpesvirus 4 (Epstein-Barr virus)
ggccgcugccaggccg

SEQ ID NO: 3966929 - RNA, 21 nt, Human herpesvirus 4 (Epstein-Barr virus)
ggccucuaaguacaggucgcg

SEQ ID NO: 3966930 - RNA, 16 nt, Human herpesvirus 4 (Epstein-Barr virus)
ggccucucuggcugug

SEQ ID NO: 3966931 - RNA, 17 nt, Human herpesvirus 4 (Epstein-Barr virus)
ggccugggaggugcuga

SEQ ID NO: 3966932 - RNA, 19 nt, Human herpesvirus 4 (Epstein-Barr virus)
ggccuuccucugccuggcc

SEQ ID NO: 3966933 - RNA, 16 nt, Human herpesvirus 4 (Epstein-Barr virus)
ggccuuuucccucauu

SEQ ID NO: 3966934 - RNA, 20 nt, Human herpesvirus 4 (Epstein-Barr virus)
ggcggaggagauccgccagg

SEQ ID NO: 3966935 - RNA, 13 nt, Human herpesvirus 4 (Epstein-Barr virus)
ggcggcaguggac

SEQ ID NO: 3966936 - RNA, 16 nt, Human herpesvirus 4 (Epstein-Barr virus)
ggcggcugcugagacc

SEQ ID NO: 3966937 - RNA, 14 nt, Human herpesvirus 4 (Epstein-Barr virus)
ggcgggcgggcuug

SEQ ID NO: 3966938 - RNA, 21 nt, Human herpesvirus 4 (Epstein-Barr virus)
ggcgucaggagacacggcucu

SEQ ID NO: 3966939 - RNA, 20 nt, Human herpesvirus 4 (Epstein-Barr virus)
ggcucgccucauccuggccc

SEQ ID NO: 3966940 - RNA, 13 nt, Human herpesvirus 4 (Epstein-Barr virus)
ggcucucaggccu

SEQ ID NO: 3966941 - RNA, 15 nt, Human herpesvirus 4 (Epstein-Barr virus)
ggcugcgguggugcg

SEQ ID NO: 3966942 - RNA, 18 nt, Human herpesvirus 4 (Epstein-Barr virus)
ggcugcucccgccucagg

SEQ ID NO: 3966943 - RNA, 19 nt, Human herpesvirus 4 (Epstein-Barr virus)
ggcugcugccgucccaggg

SEQ ID NO: 3966944 - RNA, 19 nt, Human herpesvirus 4 (Epstein-Barr virus)
gggaggcauaacgguggug

SEQ ID NO: 3966945 - RNA, 11 nt, Human herpesvirus 4 (Epstein-Barr virus)
gggcaccccac

SEQ ID NO: 3966946 - RNA, 11 nt, Human herpesvirus 4 (Epstein-Barr virus)
gggccaggcug

SEQ ID NO: 3966947 - RNA, 19 nt, Human herpesvirus 4 (Epstein-Barr virus)
gggccaggucacagaccag

SEQ ID NO: 3966948 - RNA, 21 nt, Human herpesvirus 4 (Epstein-Barr virus)
gggccauucgugaguccaggg

SEQ ID NO: 3966949 - RNA, 14 nt, Human herpesvirus 4 (Epstein-Barr virus)
gggcccgggugccu

SEQ ID NO: 3966950 - RNA, 14 nt, Human herpesvirus 4 (Epstein-Barr virus)
gggcgccccagggc

SEQ ID NO: 3966951 - RNA, 15 nt, Human herpesvirus 4 (Epstein-Barr virus)
gggcuggggagauga

SEQ ID NO: 3966952 - RNA, 16 nt, Human herpesvirus 4 (Epstein-Barr virus)
ggggcaggagcaggag

SEQ ID NO: 3966953 - RNA, 17 nt, Human herpesvirus 4 (Epstein-Barr virus)
ggggcggguauagagca

SEQ ID NO: 3966954 - RNA, 12 nt, Human herpesvirus 4 (Epstein-Barr virus)
ggggcuggccug

SEQ ID NO: 3966955 - RNA, 19 nt, Human herpesvirus 4 (Epstein-Barr virus)
gggggccaaaagggcucug

SEQ ID NO: 3966956 - RNA, 18 nt, Human herpesvirus 4 (Epstein-Barr virus)
ggguauguggugccaugu

SEQ ID NO: 3966957 - RNA, 19 nt, Human herpesvirus 4 (Epstein-Barr virus)
gguacucuuggugcagccc

SEQ ID NO: 3966958 - RNA, 18 nt, Human herpesvirus 4 (Epstein-Barr virus)
gguccaggguccaggaga

SEQ ID NO: 3966959 - RNA, 22 nt, Human herpesvirus 4 (Epstein-Barr virus)
ggucccccuccacgggagggcg

SEQ ID NO: 3966960 - RNA, 22 nt, Human herpesvirus 4 (Epstein-Barr virus)
gguccccgagggugaggcccag

SEQ ID NO: 3966961 - RNA, 12 nt, Human herpesvirus 4 (Epstein-Barr virus)
ggucgggggcac

SEQ ID NO: 3966962 - RNA, 16 nt, Human herpesvirus 4 (Epstein-Barr virus)
ggugccugagacagag

SEQ ID NO: 3966963 - RNA, 12 nt, Human herpesvirus 4 (Epstein-Barr virus)
ggugcucccccu

SEQ ID NO: 3966964 - RNA, 17 nt, Human herpesvirus 4 (Epstein-Barr virus)
ggugcucccccuggaca

SEQ ID NO: 3966965 - RNA, 20 nt, Human herpesvirus 4 (Epstein-Barr virus)
ggugcugccugggggcuuug

SEQ ID NO: 3966966 - RNA, 13 nt, Human herpesvirus 4 (Epstein-Barr virus)
gguggugggcugc

SEQ ID NO: 3966967 - RNA, 15 nt, Human herpesvirus 4 (Epstein-Barr virus)
gguggugggcugcug

SEQ ID NO: 3966968 - RNA, 20 nt, Human herpesvirus 4 (Epstein-Barr virus)
gguguucccagaagagccag

SEQ ID NO: 3966969 - RNA, 14 nt, Human herpesvirus 4 (Epstein-Barr virus)
gguuuggggcaggc

SEQ ID NO: 3966970 - RNA, 14 nt, Human herpesvirus 4 (Epstein-Barr virus)
gguuuucugccccu

SEQ ID NO: 3966971 - RNA, 22 nt, Human herpesvirus 4 (Epstein-Barr virus)
guacaacuaccugucugauugc

SEQ ID NO: 3966972 - RNA, 21 nt, Human herpesvirus 4 (Epstein-Barr virus)
guagaagugugucccccucca

SEQ ID NO: 3966973 - RNA, 23 nt, Human herpesvirus 4 (Epstein-Barr virus)
guagauggcgagacucuugaaga

SEQ ID NO: 3966974 - RNA, 20 nt, Human herpesvirus 4 (Epstein-Barr virus)
guagccgaauaucuggaggu

SEQ ID NO: 3966975 - RNA, 17 nt, Human herpesvirus 4 (Epstein-Barr virus)
guagccgggguggaggg

SEQ ID NO: 3966976 - RNA, 18 nt, Human herpesvirus 4 (Epstein-Barr virus)
guagccuugggggccugg

SEQ ID NO: 3966977 - RNA, 20 nt, Human herpesvirus 4 (Epstein-Barr virus)
guagucguuguucagggccg

SEQ ID NO: 3966978 - RNA, 13 nt, Human herpesvirus 4 (Epstein-Barr virus)
gucaccaggccug

SEQ ID NO: 3966979 - RNA, 23 nt, Human herpesvirus 4 (Epstein-Barr virus)
gucagcuguguacgugccucaga

SEQ ID NO: 3966980 - RNA, 13 nt, Human herpesvirus 4 (Epstein-Barr virus)
guccaaggcccaa

SEQ ID NO: 3966981 - RNA, 15 nt, Human herpesvirus 4 (Epstein-Barr virus)
guccauggcugcacc

SEQ ID NO: 3966982 - RNA, 18 nt, Human herpesvirus 4 (Epstein-Barr virus)
guccccguggaggaccgc

SEQ ID NO: 3966983 - RNA, 19 nt, Human herpesvirus 4 (Epstein-Barr virus)
guccgccggguucucaggg

SEQ ID NO: 3966984 - RNA, 19 nt, Human herpesvirus 4 (Epstein-Barr virus)
guccucuacugccuugucc

SEQ ID NO: 3966985 - RNA, 14 nt, Human herpesvirus 4 (Epstein-Barr virus)
guccugcugaaggg

SEQ ID NO: 3966986 - RNA, 20 nt, Human herpesvirus 4 (Epstein-Barr virus)
guccugggccucccaccacc

SEQ ID NO: 3966987 - RNA, 18 nt, Human herpesvirus 4 (Epstein-Barr virus)
guccuugugucucuauca

SEQ ID NO: 3966988 - RNA, 16 nt, Human herpesvirus 4 (Epstein-Barr virus)
gucgcuggcugguggg

SEQ ID NO: 3966989 - RNA, 10 nt, Human herpesvirus 4 (Epstein-Barr virus)
gucucagagg

SEQ ID NO: 3966990 - RNA, 19 nt, Human herpesvirus 4 (Epstein-Barr virus)
uccccagcaacagaucuug

SEQ ID NO: 3966991 - RNA, 14 nt, Human herpesvirus 4 (Epstein-Barr virus)
ucccccccagaccu

SEQ ID NO: 3966992 - RNA, 15 nt, Human herpesvirus 4 (Epstein-Barr virus)
ucccccccagaccug

SEQ ID NO: 3966993 - RNA, 15 nt, Human herpesvirus 4 (Epstein-Barr virus)
ucccccuccauucca

SEQ ID NO: 3966994 - RNA, 19 nt, Human herpesvirus 4 (Epstein-Barr virus)
uccccgagggugaggccca

SEQ ID NO: 3966995 - RNA, 13 nt, Human herpesvirus 4 (Epstein-Barr virus)
uccgaggcugaga

SEQ ID NO: 3966996 - RNA, 15 nt, Human herpesvirus 4 (Epstein-Barr virus)
uccgccaccuccggg

SEQ ID NO: 3966997 - RNA, 22 nt, Human herpesvirus 4 (Epstein-Barr virus)
uccgugagagccuacccaugac

SEQ ID NO: 3966998 - RNA, 20 nt, Human herpesvirus 4 (Epstein-Barr virus)
uccucuuacaccagaggcca

SEQ ID NO: 3966999 - RNA, 16 nt, Human herpesvirus 4 (Epstein-Barr virus)
ucgaagcggucucaga

SEQ ID NO: 3967000 - RNA, 23 nt, Human herpesvirus 4 (Epstein-Barr virus)
ucgaguaggugccuccagagccc

SEQ ID NO: 3967001 - RNA, 13 nt, Human herpesvirus 4 (Epstein-Barr virus)
ucgccgccccagg

SEQ ID NO: 3967002 - RNA, 14 nt, Human herpesvirus 4 (Epstein-Barr virus)
ucgccgccccaggg

SEQ ID NO: 3967003 - RNA, 13 nt, Human herpesvirus 4 (Epstein-Barr virus)
ucgcucagagcug

SEQ ID NO: 3967004 - RNA, 21 nt, Human herpesvirus 4 (Epstein-Barr virus)
ucuacaucccauaccuacacc

SEQ ID NO: 3967005 - RNA, 17 nt, Human herpesvirus 4 (Epstein-Barr virus)
ucuacgcggagcugcac

SEQ ID NO: 3967006 - RNA, 15 nt, Human herpesvirus 4 (Epstein-Barr virus)
ucuacucuuggcagc

SEQ ID NO: 3967007 - RNA, 23 nt, Human herpesvirus 4 (Epstein-Barr virus)
ucucagacaccaacacagacugc

SEQ ID NO: 3967008 - RNA, 18 nt, Human herpesvirus 4 (Epstein-Barr virus)
ucucauccccagagggcg

SEQ ID NO: 3967009 - RNA, 13 nt, Human herpesvirus 4 (Epstein-Barr virus)
ucuccagccacgg

SEQ ID NO: 3967010 - RNA, 12 nt, Human herpesvirus 4 (Epstein-Barr virus)
ucuccccucugc

SEQ ID NO: 3967011 - RNA, 20 nt, Human herpesvirus 4 (Epstein-Barr virus)
ucuccugugcuucagcagua

SEQ ID NO: 3967012 - RNA, 16 nt, Human herpesvirus 4 (Epstein-Barr virus)
ucuccuuguugaccuc

SEQ ID NO: 3967013 - RNA, 15 nt, Human herpesvirus 4 (Epstein-Barr virus)
ucucuuucuggccaa

SEQ ID NO: 3967014 - RNA, 15 nt, Human herpesvirus 4 (Epstein-Barr virus)
ucuggccaaccugcc

SEQ ID NO: 3967015 - RNA, 13 nt, Human herpesvirus 4 (Epstein-Barr virus)
ucuuaucagagag

SEQ ID NO: 3967016 - RNA, 14 nt, Human herpesvirus 4 (Epstein-Barr virus)
ucuucccagacucu

SEQ ID NO: 3967017 - RNA, 13 nt, Human herpesvirus 4 (Epstein-Barr virus)
ucuuuguggccuu

SEQ ID NO: 3967018 - RNA, 21 nt, Human herpesvirus 4 (Epstein-Barr virus)
ugaacuggggcugguggccug

SEQ ID NO: 3967019 - RNA, 16 nt, Human herpesvirus 4 (Epstein-Barr virus)
ugaagagcccccaccg

SEQ ID NO: 3967020 - RNA, 15 nt, Human herpesvirus 4 (Epstein-Barr virus)
ugacaucccaguucu

SEQ ID NO: 3967021 - RNA, 11 nt, Human herpesvirus 4 (Epstein-Barr virus)
ugaccaacaug

SEQ ID NO: 3967022 - RNA, 17 nt, Human herpesvirus 4 (Epstein-Barr virus)
ugaccacggcccacguc

SEQ ID NO: 3967023 - RNA, 14 nt, Human herpesvirus 4 (Epstein-Barr virus)
ugacccacuccagu

SEQ ID NO: 3967024 - RNA, 15 nt, Human herpesvirus 4 (Epstein-Barr virus)
ugacccacuccagug

SEQ ID NO: 3967025 - RNA, 13 nt, Human herpesvirus 4 (Epstein-Barr virus)
ugacgcuccagga

SEQ ID NO: 3967026 - RNA, 23 nt, Human herpesvirus 4 (Epstein-Barr virus)
ugacggugggcaugacacaggac

SEQ ID NO: 3967027 - RNA, 17 nt, Human herpesvirus 4 (Epstein-Barr virus)
ugagauuuaacccaccc

SEQ ID NO: 3967028 - RNA, 21 nt, Human herpesvirus 4 (Epstein-Barr virus)
ugagcccaccugucugacuug

SEQ ID NO: 3967029 - RNA, 19 nt, Human herpesvirus 4 (Epstein-Barr virus)
ugagccugagccacaccca

SEQ ID NO: 3967030 - RNA, 14 nt, Human herpesvirus 4 (Epstein-Barr virus)
ugaggaaggggccu

SEQ ID NO: 3967031 - RNA, 13 nt, Human herpesvirus 4 (Epstein-Barr virus)
ugaggagcgccca

SEQ ID NO: 3967032 - RNA, 16 nt, Human herpesvirus 4 (Epstein-Barr virus)
ugaucugggagaugag

SEQ ID NO: 3967033 - RNA, 13 nt, Human herpesvirus 4 (Epstein-Barr virus)
ugauggggacagg

SEQ ID NO: 3967034 - RNA, 21 nt, Human herpesvirus 4 (Epstein-Barr virus)
ugcaauaaauaaaaguacaga

SEQ ID NO: 3967035 - RNA, 20 nt, Human herpesvirus 4 (Epstein-Barr virus)
ugcagugggccucucuggcu

SEQ ID NO: 3967036 - RNA, 15 nt, Human herpesvirus 4 (Epstein-Barr virus)
ugcccaccagccagc

SEQ ID NO: 3967037 - RNA, 22 nt, Human herpesvirus 4 (Epstein-Barr virus)
ugccuaucauguuucaaccgcu

SEQ ID NO: 3967038 - RNA, 14 nt, Human herpesvirus 4 (Epstein-Barr virus)
ugccuccagagccc

SEQ ID NO: 3967039 - RNA, 20 nt, Human herpesvirus 4 (Epstein-Barr virus)
ugccuuucccccacccugga

SEQ ID NO: 3967040 - RNA, 11 nt, Human herpesvirus 4 (Epstein-Barr virus)
ugcgcgccgcc

SEQ ID NO: 3967041 - RNA, 18 nt, Human herpesvirus 4 (Epstein-Barr virus)
ugcuaugaccaugcccag

SEQ ID NO: 3967042 - RNA, 16 nt, Human herpesvirus 4 (Epstein-Barr virus)
ugcucaccaugguagc

SEQ ID NO: 3967043 - RNA, 17 nt, Human herpesvirus 4 (Epstein-Barr virus)
ugcucagaccccggguu

SEQ ID NO: 3967044 - RNA, 20 nt, Human herpesvirus 4 (Epstein-Barr virus)
ugcugcggcuaugcagccca

SEQ ID NO: 3967045 - RNA, 18 nt, Human herpesvirus 4 (Epstein-Barr virus)
ugcuucuaccaagacucc

SEQ ID NO: 3967046 - RNA, 21 nt, Human herpesvirus 4 (Epstein-Barr virus)
uggacacuuauguuucaagca

SEQ ID NO: 3967047 - RNA, 14 nt, Human herpesvirus 4 (Epstein-Barr virus)
uggagccgggggca

SEQ ID NO: 3967048 - RNA, 22 nt, Human herpesvirus 4 (Epstein-Barr virus)
uggaguccaugaccagggggca

SEQ ID NO: 3967049 - RNA, 14 nt, Human herpesvirus 4 (Epstein-Barr virus)
uggauuugaaagug

SEQ ID NO: 3967050 - RNA, 22 nt, Human herpesvirus 4 (Epstein-Barr virus)
uggcagaaucaccagagcccag

SEQ ID NO: 3967051 - RNA, 16 nt, Human herpesvirus 4 (Epstein-Barr virus)
uggcauucagauuucu

SEQ ID NO: 3967052 - RNA, 17 nt, Human herpesvirus 4 (Epstein-Barr virus)
uggccagguacgggcug

SEQ ID NO: 3967053 - RNA, 19 nt, Human herpesvirus 4 (Epstein-Barr virus)
uggccucgucaggagggca

SEQ ID NO: 3967054 - RNA, 14 nt, Human herpesvirus 4 (Epstein-Barr virus)
uggccuggagagca

SEQ ID NO: 3967055 - RNA, 14 nt, Human herpesvirus 4 (Epstein-Barr virus)
uggcggcccagccc

SEQ ID NO: 3967056 - RNA, 13 nt, Human herpesvirus 4 (Epstein-Barr virus)
uggcuagauuucc

SEQ ID NO: 3967057 - RNA, 16 nt, Human herpesvirus 4 (Epstein-Barr virus)
uggcuugggcuguggu

SEQ ID NO: 3967058 - RNA, 20 nt, Human herpesvirus 4 (Epstein-Barr virus)
ugggaauggagaggggagug

SEQ ID NO: 3967059 - RNA, 22 nt, Human herpesvirus 4 (Epstein-Barr virus)
ugggcugacacagacuuggccu

SEQ ID NO: 3967060 - RNA, 21 nt, Human herpesvirus 4 (Epstein-Barr virus)
uggggcuggcaguccuugugu

SEQ ID NO: 3967061 - RNA, 14 nt, Human herpesvirus 4 (Epstein-Barr virus)
uggguccccucugc

SEQ ID NO: 3967062 - RNA, 21 nt, Human herpesvirus 4 (Epstein-Barr virus)
ugggugaccacugagggagug

SEQ ID NO: 3967063 - RNA, 13 nt, Human herpesvirus 4 (Epstein-Barr virus)
uggugccggggcc

SEQ ID NO: 3967064 - RNA, 16 nt, Human herpesvirus 4 (Epstein-Barr virus)
uggugggcugcugagg

SEQ ID NO: 3967065 - RNA, 16 nt, Human herpesvirus 4 (Epstein-Barr virus)
ugguugugcggucugu

SEQ ID NO: 3967066 - RNA, 12 nt, Human herpesvirus 4 (Epstein-Barr virus)
uguccucccggg

SEQ ID NO: 3967067 - RNA, 20 nt, Human herpesvirus 4 (Epstein-Barr virus)
uguccucccuaaccgccugg

SEQ ID NO: 3967068 - RNA, 18 nt, Human herpesvirus 4 (Epstein-Barr virus)
ugucuccugacgccaaug

SEQ ID NO: 3967069 - RNA, 17 nt, Human herpesvirus 4 (Epstein-Barr virus)
gagggccucuggcacgc

SEQ ID NO: 3967070 - RNA, 17 nt, Human herpesvirus 4 (Epstein-Barr virus)
gagggccuuccagagcu

SEQ ID NO: 3967071 - RNA, 18 nt, Human herpesvirus 4 (Epstein-Barr virus)
gaggggcaggagcaggag

SEQ ID NO: 3967072 - RNA, 10 nt, Human herpesvirus 4 (Epstein-Barr virus)
gagggggcca

SEQ ID NO: 3967073 - RNA, 21 nt, Human herpesvirus 4 (Epstein-Barr virus)
gaguccaacauuaaagccucc

SEQ ID NO: 3967074 - RNA, 21 nt, Human herpesvirus 4 (Epstein-Barr virus)
gagugcugcagguaaaccuuc

SEQ ID NO: 3967075 - RNA, 16 nt, Human herpesvirus 4 (Epstein-Barr virus)
gauaaucugggcagcc

SEQ ID NO: 3967076 - RNA, 17 nt, Human herpesvirus 4 (Epstein-Barr virus)
gaucuggggcuggccug

SEQ ID NO: 3967077 - RNA, 20 nt, Human herpesvirus 4 (Epstein-Barr virus)
gaugcugccgcuacugcugc

SEQ ID NO: 3967078 - RNA, 13 nt, Human herpesvirus 4 (Epstein-Barr virus)
gauggcggggccu

SEQ ID NO: 3967079 - RNA, 19 nt, Human herpesvirus 4 (Epstein-Barr virus)
gauuggaaaagggcccagg

SEQ ID NO: 3967080 - RNA, 15 nt, Human herpesvirus 4 (Epstein-Barr virus)
gcaacauccggggca

SEQ ID NO: 3967081 - RNA, 20 nt, Human herpesvirus 4 (Epstein-Barr virus)
gcaaugggacgucuuguaaa

SEQ ID NO: 3967082 - RNA, 20 nt, Human herpesvirus 4 (Epstein-Barr virus)
gcacaaaggaaacugcugac

SEQ ID NO: 3967083 - RNA, 19 nt, Human herpesvirus 4 (Epstein-Barr virus)
gcacacuuaacuugacuac

SEQ ID NO: 3967084 - RNA, 20 nt, Human herpesvirus 4 (Epstein-Barr virus)
gcacaucuggcaccuguccu

SEQ ID NO: 3967085 - RNA, 15 nt, Human herpesvirus 4 (Epstein-Barr virus)
gcaccggagccacca

SEQ ID NO: 3967086 - RNA, 15 nt, Human herpesvirus 4 (Epstein-Barr virus)
gcaccuguguccugg

SEQ ID NO: 3967087 - RNA, 14 nt, Human herpesvirus 4 (Epstein-Barr virus)
gcacgggcagagga

SEQ ID NO: 3967088 - RNA, 17 nt, Human herpesvirus 4 (Epstein-Barr virus)
gcacugcguccaccugg

SEQ ID NO: 3967089 - RNA, 19 nt, Human herpesvirus 4 (Epstein-Barr virus)
gcagaggacuuuuggggug

SEQ ID NO: 3967090 - RNA, 16 nt, Human herpesvirus 4 (Epstein-Barr virus)
gcagaggccugcacca

SEQ ID NO: 3967091 - RNA, 14 nt, Human herpesvirus 4 (Epstein-Barr virus)
gcagccacguccag

SEQ ID NO: 3967092 - RNA, 17 nt, Human herpesvirus 4 (Epstein-Barr virus)
gcagccccaaagcgggu

SEQ ID NO: 3967093 - RNA, 15 nt, Human herpesvirus 4 (Epstein-Barr virus)
gcagcccccuccucc

SEQ ID NO: 3967094 - RNA, 19 nt, Human herpesvirus 4 (Epstein-Barr virus)
gcagccuugcguggugcug

SEQ ID NO: 3967095 - RNA, 22 nt, Human herpesvirus 4 (Epstein-Barr virus)
gcagcuaaguuuucuaagggca

SEQ ID NO: 3967096 - RNA, 14 nt, Human herpesvirus 4 (Epstein-Barr virus)
gcagcucuggcacu

SEQ ID NO: 3967097 - RNA, 22 nt, Human herpesvirus 4 (Epstein-Barr virus)
gcagcugaguccccuccuugga

SEQ ID NO: 3967098 - RNA, 17 nt, Human herpesvirus 4 (Epstein-Barr virus)
gcagcuggacgcgcagu

SEQ ID NO: 3967099 - RNA, 23 nt, Human herpesvirus 4 (Epstein-Barr virus)
gcaggacggggggcuggcgaaga

SEQ ID NO: 3967100 - RNA, 23 nt, Human herpesvirus 4 (Epstein-Barr virus)
gcaggccccccgcaccagggcca

SEQ ID NO: 3967101 - RNA, 14 nt, Human herpesvirus 4 (Epstein-Barr virus)
gcagggacgaggac

SEQ ID NO: 3967102 - RNA, 15 nt, Human herpesvirus 4 (Epstein-Barr virus)
gcaggucaggucccc

SEQ ID NO: 3967103 - RNA, 13 nt, Human herpesvirus 4 (Epstein-Barr virus)
gcaggugagggug

SEQ ID NO: 3967104 - RNA, 16 nt, Human herpesvirus 4 (Epstein-Barr virus)
gcauauuuucagaccc

SEQ ID NO: 3967105 - RNA, 14 nt, Human herpesvirus 4 (Epstein-Barr virus)
gcaugagccacagg

SEQ ID NO: 3967106 - RNA, 17 nt, Human herpesvirus 4 (Epstein-Barr virus)
gcaugagcuccucucca

SEQ ID NO: 3967107 - RNA, 20 nt, Human herpesvirus 4 (Epstein-Barr virus)
gcaugaucaggacccugggc

SEQ ID NO: 3967108 - RNA, 16 nt, Human herpesvirus 4 (Epstein-Barr virus)
gcauggauauagcucu

SEQ ID NO: 3967109 - RNA, 14 nt, Human herpesvirus 4 (Epstein-Barr virus)
gccacacagccuga

SEQ ID NO: 3967110 - RNA, 20 nt, Human herpesvirus 4 (Epstein-Barr virus)
gccaccgacgagcagaggac

SEQ ID NO: 3967111 - RNA, 21 nt, Human herpesvirus 4 (Epstein-Barr virus)
gccaccguggccaggcccgag

SEQ ID NO: 3967112 - RNA, 16 nt, Human herpesvirus 4 (Epstein-Barr virus)
gccacguccagacucc

SEQ ID NO: 3967113 - RNA, 16 nt, Human herpesvirus 4 (Epstein-Barr virus)
gccacugcaggcugga

SEQ ID NO: 3967114 - RNA, 22 nt, Human herpesvirus 4 (Epstein-Barr virus)
gccagaaucgguaaggaggggc

SEQ ID NO: 3967115 - RNA, 15 nt, Human herpesvirus 4 (Epstein-Barr virus)
gccagaucuaaggcc

SEQ ID NO: 3967116 - RNA, 21 nt, Human herpesvirus 4 (Epstein-Barr virus)
gccauaaguccucauggcagg

SEQ ID NO: 3967117 - RNA, 11 nt, Human herpesvirus 4 (Epstein-Barr virus)
gccauggccaa

SEQ ID NO: 3967118 - RNA, 15 nt, Human herpesvirus 4 (Epstein-Barr virus)
gccauggccgagaag

SEQ ID NO: 3967119 - RNA, 15 nt, Human herpesvirus 4 (Epstein-Barr virus)
gcccacgucaaggcc

SEQ ID NO: 3967120 - RNA, 19 nt, Human herpesvirus 4 (Epstein-Barr virus)
gcccagcagauccagggcc

SEQ ID NO: 3967121 - RNA, 10 nt, Human herpesvirus 4 (Epstein-Barr virus)
gcccccacca

SEQ ID NO: 3967122 - RNA, 18 nt, Human herpesvirus 4 (Epstein-Barr virus)
gcccccgccagcgccucc

SEQ ID NO: 3967123 - RNA, 19 nt, Human herpesvirus 4 (Epstein-Barr virus)
gcccgacccccgggcgccc

SEQ ID NO: 3967124 - RNA, 23 nt, Human herpesvirus 4 (Epstein-Barr virus)
gcccgcuuuugcgaccccucuga

SEQ ID NO: 3967125 - RNA, 16 nt, Human herpesvirus 4 (Epstein-Barr virus)
gcccugucccuggagc

SEQ ID NO: 3967126 - RNA, 13 nt, Human herpesvirus 4 (Epstein-Barr virus)
gccggcagccugg

SEQ ID NO: 3967127 - RNA, 21 nt, Human herpesvirus 4 (Epstein-Barr virus)
gccgucucaaacggggaagga

SEQ ID NO: 3967128 - RNA, 13 nt, Human herpesvirus 4 (Epstein-Barr virus)
gccuccuggccag

SEQ ID NO: 3967129 - RNA, 13 nt, Human herpesvirus 4 (Epstein-Barr virus)
gccucggccuggg

SEQ ID NO: 3967130 - RNA, 15 nt, Human herpesvirus 4 (Epstein-Barr virus)
gccucuaccuuccac

SEQ ID NO: 3967131 - RNA, 15 nt, Human herpesvirus 4 (Epstein-Barr virus)
ugugcacccggcugg

SEQ ID NO: 3967132 - RNA, 15 nt, Human herpesvirus 4 (Epstein-Barr virus)
uguggccccggcugg

SEQ ID NO: 3967133 - RNA, 13 nt, Human herpesvirus 4 (Epstein-Barr virus)
ugugugacaugcu

SEQ ID NO: 3967134 - RNA, 15 nt, Human herpesvirus 4 (Epstein-Barr virus)
uguuccacagccugc

SEQ ID NO: 3967135 - RNA, 22 nt, Human herpesvirus 4 (Epstein-Barr virus)
agcaggaggaggggcaggagca

SEQ ID NO: 3967136 - RNA, 21 nt, Human herpesvirus 4 (Epstein-Barr virus)
agcagugguguuugcuugccc

SEQ ID NO: 3967137 - RNA, 17 nt, Human herpesvirus 4 (Epstein-Barr virus)
agcccagaggaggcccc

SEQ ID NO: 3967138 - RNA, 19 nt, Human herpesvirus 4 (Epstein-Barr virus)
agccccacucuugccucgg

SEQ ID NO: 3967139 - RNA, 14 nt, Human herpesvirus 4 (Epstein-Barr virus)
agccccagccccuc

SEQ ID NO: 3967140 - RNA, 15 nt, Human herpesvirus 4 (Epstein-Barr virus)
agcccggccgaggcc

SEQ ID NO: 3967141 - RNA, 21 nt, Human herpesvirus 4 (Epstein-Barr virus)
agccucugccacaaggccagc

SEQ ID NO: 3967142 - RNA, 13 nt, Human herpesvirus 4 (Epstein-Barr virus)
agcgaagaacacu

SEQ ID NO: 3967143 - RNA, 17 nt, Human herpesvirus 4 (Epstein-Barr virus)
agcuacacucugggguc

SEQ ID NO: 3967144 - RNA, 17 nt, Human herpesvirus 4 (Epstein-Barr virus)
agcucggccagcaggcc

SEQ ID NO: 3967145 - RNA, 18 nt, Human herpesvirus 4 (Epstein-Barr virus)
agcugacggugggcauga

SEQ ID NO: 3967146 - RNA, 18 nt, Human herpesvirus 4 (Epstein-Barr virus)
agcugccucccugccccu

SEQ ID NO: 3967147 - RNA, 22 nt, Human herpesvirus 4 (Epstein-Barr virus)
aggaaggggccucggccugggg

SEQ ID NO: 3967148 - RNA, 13 nt, Human herpesvirus 4 (Epstein-Barr virus)
aggacgaggaggc

SEQ ID NO: 3967149 - RNA, 18 nt, Human herpesvirus 4 (Epstein-Barr virus)
aggagacguguguggcug

SEQ ID NO: 3967150 - RNA, 21 nt, Human herpesvirus 4 (Epstein-Barr virus)
aggagaugauaaugaugagga

SEQ ID NO: 3967151 - RNA, 22 nt, Human herpesvirus 4 (Epstein-Barr virus)
aggagcaggagcgggaggggca

SEQ ID NO: 3967152 - RNA, 14 nt, Human herpesvirus 4 (Epstein-Barr virus)
aggaggcuggugcc

SEQ ID NO: 3967153 - RNA, 14 nt, Human herpesvirus 4 (Epstein-Barr virus)
aggagucugcugcg

SEQ ID NO: 3967154 - RNA, 14 nt, Human herpesvirus 4 (Epstein-Barr virus)
aggaguuuaaccug

SEQ ID NO: 3967155 - RNA, 12 nt, Human herpesvirus 4 (Epstein-Barr virus)
aggaucagaauc

SEQ ID NO: 3967156 - RNA, 21 nt, Human herpesvirus 4 (Epstein-Barr virus)
aggcacuggacacacauggca

SEQ ID NO: 3967157 - RNA, 16 nt, Human herpesvirus 4 (Epstein-Barr virus)
aggcagccccaaagcg

SEQ ID NO: 3967158 - RNA, 17 nt, Human herpesvirus 4 (Epstein-Barr virus)
aggcccaggaccuuggc

SEQ ID NO: 3967159 - RNA, 12 nt, Human herpesvirus 4 (Epstein-Barr virus)
aggcccccggcu

SEQ ID NO: 3967160 - RNA, 18 nt, Human herpesvirus 4 (Epstein-Barr virus)
aggcccccgggugggcug

SEQ ID NO: 3967161 - RNA, 23 nt, Human herpesvirus 4 (Epstein-Barr virus)
aggcccucgagccauuugaggaa

SEQ ID NO: 3967162 - RNA, 16 nt, Human herpesvirus 4 (Epstein-Barr virus)
aggccgcugccaggcc

SEQ ID NO: 3967163 - RNA, 15 nt, Human herpesvirus 4 (Epstein-Barr virus)
aggccgggaggccuu

SEQ ID NO: 3967164 - RNA, 22 nt, Human herpesvirus 4 (Epstein-Barr virus)
aggccggggcgauaccuugggc

SEQ ID NO: 3967165 - RNA, 15 nt, Human herpesvirus 4 (Epstein-Barr virus)
aggcucggcccuccg

SEQ ID NO: 3967166 - RNA, 21 nt, Human herpesvirus 4 (Epstein-Barr virus)
agggcccguuccaggcucucc

SEQ ID NO: 3967167 - RNA, 23 nt, Human herpesvirus 4 (Epstein-Barr virus)
aggggccagguacaggaccugga

SEQ ID NO: 3967168 - RNA, 23 nt, Human herpesvirus 4 (Epstein-Barr virus)
agggguccccgagggugaggccc

SEQ ID NO: 3967169 - RNA, 20 nt, Human herpesvirus 4 (Epstein-Barr virus)
aggugcagcuggcccaccua

SEQ ID NO: 3967170 - RNA, 14 nt, Human herpesvirus 4 (Epstein-Barr virus)
agguggcugcugcc

SEQ ID NO: 3967171 - RNA, 23 nt, Human herpesvirus 4 (Epstein-Barr virus)
aguaagaugcauacgcugaguga

SEQ ID NO: 3967172 - RNA, 16 nt, Human herpesvirus 4 (Epstein-Barr virus)
aguaagcauggggcuc

SEQ ID NO: 3967173 - RNA, 19 nt, Human herpesvirus 4 (Epstein-Barr virus)
aguaaggccgcugccaggc

SEQ ID NO: 3967174 - RNA, 16 nt, Human herpesvirus 4 (Epstein-Barr virus)
aguaggugccuccaga

SEQ ID NO: 3967175 - RNA, 21 nt, Human herpesvirus 4 (Epstein-Barr virus)
aguccucauggcaggagaggc

SEQ ID NO: 3967176 - RNA, 12 nt, Human herpesvirus 4 (Epstein-Barr virus)
agucgaagcucu

SEQ ID NO: 3967177 - RNA, 17 nt, Human herpesvirus 4 (Epstein-Barr virus)
agucuauacggccacaa

SEQ ID NO: 3967178 - RNA, 21 nt, Human herpesvirus 4 (Epstein-Barr virus)
agugcaacaaucuggacucuc

SEQ ID NO: 3967179 - RNA, 22 nt, Human herpesvirus 4 (Epstein-Barr virus)
agugggccucucuggcugugcu

SEQ ID NO: 3967180 - RNA, 19 nt, Human herpesvirus 4 (Epstein-Barr virus)
aguguccagagaggaagac

SEQ ID NO: 3967181 - RNA, 19 nt, Human herpesvirus 4 (Epstein-Barr virus)
auacucaucugugagacaa

SEQ ID NO: 3967182 - RNA, 14 nt, Human herpesvirus 4 (Epstein-Barr virus)
auauguacaaugag

SEQ ID NO: 3967183 - RNA, 16 nt, Human herpesvirus 4 (Epstein-Barr virus)
aucaccagagcccaga

SEQ ID NO: 3967184 - RNA, 17 nt, Human herpesvirus 4 (Epstein-Barr virus)
aucagaauuagcaucag

SEQ ID NO: 3967185 - RNA, 14 nt, Human herpesvirus 4 (Epstein-Barr virus)
auccccagcccagc

SEQ ID NO: 3967186 - RNA, 18 nt, Human herpesvirus 4 (Epstein-Barr virus)
auccugcguggcuggacg

SEQ ID NO: 3967187 - RNA, 22 nt, Human herpesvirus 4 (Epstein-Barr virus)
aucucccgcuagauggcgcccu

SEQ ID NO: 3967188 - RNA, 14 nt, Human herpesvirus 4 (Epstein-Barr virus)
aucucgcucagagc

SEQ ID NO: 3967189 - RNA, 16 nt, Human herpesvirus 4 (Epstein-Barr virus)
aucuguacgggaacau

SEQ ID NO: 3967190 - RNA, 16 nt, Human herpesvirus 4 (Epstein-Barr virus)
aucuuugacugacaca

SEQ ID NO: 3967191 - RNA, 19 nt, Human herpesvirus 4 (Epstein-Barr virus)
augagcgauuuuaucacag

SEQ ID NO: 3967192 - RNA, 22 nt, Human herpesvirus 4 (Epstein-Barr virus)
augagggacguaucugggcacu

SEQ ID NO: 3967193 - RNA, 18 nt, Human herpesvirus 4 (Epstein-Barr virus)
augccaaagcugaagaac

SEQ ID NO: 3967194 - RNA, 17 nt, Human herpesvirus 4 (Epstein-Barr virus)
augcucagggccacggc

SEQ ID NO: 3967195 - RNA, 22 nt, Human herpesvirus 4 (Epstein-Barr virus)
auggagaugugcgcccugcucu

SEQ ID NO: 3967196 - RNA, 20 nt, Human herpesvirus 4 (Epstein-Barr virus)
auggauugaguaagcauggg

SEQ ID NO: 3967197 - RNA, 11 nt, Human herpesvirus 4 (Epstein-Barr virus)
auggccaggcu

SEQ ID NO: 3967198 - RNA, 19 nt, Human herpesvirus 4 (Epstein-Barr virus)
augugcagggauugggcuu

SEQ ID NO: 3967199 - RNA, 23 nt, Human herpesvirus 4 (Epstein-Barr virus)
auucacugggacaacugucacac

SEQ ID NO: 3967200 - RNA, 17 nt, Human herpesvirus 4 (Epstein-Barr virus)
auucagccaccuccccu

SEQ ID NO: 3967201 - RNA, 23 nt, Human herpesvirus 4 (Epstein-Barr virus)
auuccuaggagaaggagccucgc

SEQ ID NO: 3967202 - RNA, 19 nt, Human herpesvirus 4 (Epstein-Barr virus)
auuguaucucggucuuggc

SEQ ID NO: 3967203 - RNA, 15 nt, Human herpesvirus 4 (Epstein-Barr virus)
caaaagggcucugac

SEQ ID NO: 3967204 - RNA, 12 nt, Human herpesvirus 4 (Epstein-Barr virus)
caaacacuacaa

SEQ ID NO: 3967205 - RNA, 21 nt, Human herpesvirus 4 (Epstein-Barr virus)
caaaggccuugguuucagccu

SEQ ID NO: 3967206 - RNA, 18 nt, Human herpesvirus 4 (Epstein-Barr virus)
caaccaauguaucccaaa

SEQ ID NO: 3967207 - RNA, 20 nt, Human herpesvirus 4 (Epstein-Barr virus)
caaccgccgugucagcugug

SEQ ID NO: 3967208 - RNA, 21 nt, Human herpesvirus 4 (Epstein-Barr virus)
caaccuuuccaucacugaccc

SEQ ID NO: 3967209 - RNA, 14 nt, Human herpesvirus 4 (Epstein-Barr virus)
caacgcauccacca

SEQ ID NO: 3967210 - RNA, 15 nt, Human herpesvirus 4 (Epstein-Barr virus)
caagcuccggcugcc

SEQ ID NO: 3967211 - RNA, 17 nt, Human herpesvirus 4 (Epstein-Barr virus)
caaggauggaagagagg

SEQ ID NO: 3967212 - RNA, 14 nt, Human herpesvirus 4 (Epstein-Barr virus)
caaggcaguagagg

SEQ ID NO: 3967213 - RNA, 15 nt, Human herpesvirus 4 (Epstein-Barr virus)
caaggugucaauaau

SEQ ID NO: 3967214 - RNA, 17 nt, Human herpesvirus 4 (Epstein-Barr virus)
caaguaccagcuggugg

SEQ ID NO: 3967215 - RNA, 13 nt, Human herpesvirus 4 (Epstein-Barr virus)
caauacccaggau

SEQ ID NO: 3967216 - RNA, 13 nt, Human herpesvirus 4 (Epstein-Barr virus)
caauauccaucug

SEQ ID NO: 3967217 - RNA, 17 nt, Human herpesvirus 4 (Epstein-Barr virus)
caaugccaacuccccca

SEQ ID NO: 3967218 - RNA, 14 nt, Human herpesvirus 4 (Epstein-Barr virus)
cacacgcucagcuc

SEQ ID NO: 3967219 - RNA, 15 nt, Human herpesvirus 4 (Epstein-Barr virus)
cacacucccuccaga

SEQ ID NO: 3967220 - RNA, 16 nt, Human herpesvirus 4 (Epstein-Barr virus)
cacacucccuccagaa

SEQ ID NO: 3967221 - RNA, 19 nt, Human herpesvirus 4 (Epstein-Barr virus)
cacagugaugaacaccacc

SEQ ID NO: 3967222 - RNA, 23 nt, Human herpesvirus 4 (Epstein-Barr virus)
agauggacuugaggugggcugac

SEQ ID NO: 3967223 - RNA, 17 nt, Human herpesvirus 4 (Epstein-Barr virus)
agauuggugugaaagga

SEQ ID NO: 3967224 - RNA, 12 nt, Human herpesvirus 4 (Epstein-Barr virus)
agcaccaacaca

SEQ ID NO: 3967225 - RNA, 15 nt, Human herpesvirus 4 (Epstein-Barr virus)
agcaccacccagccc

SEQ ID NO: 3967226 - RNA, 22 nt, Human herpesvirus 4 (Epstein-Barr virus)
agcacgguagccuugggggccu

SEQ ID NO: 3967227 - RNA, 10 nt, Human herpesvirus 4 (Epstein-Barr virus)
agcaggaggg

SEQ ID NO: 3967228 - RNA, 14 nt, Human herpesvirus 4 (Epstein-Barr virus)
agcauggcagccgg

SEQ ID NO: 3967229 - RNA, 15 nt, Human herpesvirus 4 (Epstein-Barr virus)
agccacguccagacu

SEQ ID NO: 3967230 - RNA, 17 nt, Human herpesvirus 4 (Epstein-Barr virus)
agccacuacggccacgu

SEQ ID NO: 3967231 - RNA, 16 nt, Human herpesvirus 4 (Epstein-Barr virus)
agccagcgcacccggg

SEQ ID NO: 3967232 - RNA, 19 nt, Human herpesvirus 4 (Epstein-Barr virus)
agcccccucccgccccugu

SEQ ID NO: 3967233 - RNA, 16 nt, Human herpesvirus 4 (Epstein-Barr virus)
agccccuccauaggcc

SEQ ID NO: 3967234 - RNA, 12 nt, Human herpesvirus 4 (Epstein-Barr virus)
agccguggccuu

SEQ ID NO: 3967235 - RNA, 19 nt, Human herpesvirus 4 (Epstein-Barr virus)
agccugcuccugagaaugc

SEQ ID NO: 3967236 - RNA, 14 nt, Human herpesvirus 4 (Epstein-Barr virus)
agcgcggcagaggc

SEQ ID NO: 3967237 - RNA, 17 nt, Human herpesvirus 4 (Epstein-Barr virus)
agcggcauccucaaggg

SEQ ID NO: 3967238 - RNA, 17 nt, Human herpesvirus 4 (Epstein-Barr virus)
agcggggagagggugga

SEQ ID NO: 3967239 - RNA, 14 nt, Human herpesvirus 4 (Epstein-Barr virus)
agcuccgcccucac

SEQ ID NO: 3967240 - RNA, 17 nt, Human herpesvirus 4 (Epstein-Barr virus)
agcuccgugggcccaga

SEQ ID NO: 3967241 - RNA, 14 nt, Human herpesvirus 4 (Epstein-Barr virus)
agcuggacgagguc

SEQ ID NO: 3967242 - RNA, 13 nt, Human herpesvirus 4 (Epstein-Barr virus)
agcuggccaggcu

SEQ ID NO: 3967243 - RNA, 18 nt, Human herpesvirus 4 (Epstein-Barr virus)
agcugugugcgcgccgcc

SEQ ID NO: 3967244 - RNA, 20 nt, Human herpesvirus 4 (Epstein-Barr virus)
aggaagcuggccaggcuggu

SEQ ID NO: 3967245 - RNA, 21 nt, Human herpesvirus 4 (Epstein-Barr virus)
aggaauuauuuaccacacccc

SEQ ID NO: 3967246 - RNA, 15 nt, Human herpesvirus 4 (Epstein-Barr virus)
aggaauucuuccaga

SEQ ID NO: 3967247 - RNA, 22 nt, Human herpesvirus 4 (Epstein-Barr virus)
aggaccggaucgaaggagagcu

SEQ ID NO: 3967248 - RNA, 22 nt, Human herpesvirus 4 (Epstein-Barr virus)
aggagcguguccccguggagga

SEQ ID NO: 3967249 - RNA, 15 nt, Human herpesvirus 4 (Epstein-Barr virus)
aggagcuugaggcca

SEQ ID NO: 3967250 - RNA, 17 nt, Human herpesvirus 4 (Epstein-Barr virus)
aggccagguagcccagc

SEQ ID NO: 3967251 - RNA, 16 nt, Human herpesvirus 4 (Epstein-Barr virus)
aggcccccggcuggcc

SEQ ID NO: 3967252 - RNA, 19 nt, Human herpesvirus 4 (Epstein-Barr virus)
aggcccccggcuggccgcc

SEQ ID NO: 3967253 - RNA, 10 nt, Human herpesvirus 4 (Epstein-Barr virus)
aggccgccgc

SEQ ID NO: 3967254 - RNA, 19 nt, Human herpesvirus 4 (Epstein-Barr virus)
aggccgcugccaggccgcc

SEQ ID NO: 3967255 - RNA, 19 nt, Human herpesvirus 4 (Epstein-Barr virus)
aggccucagcgucaggaga

SEQ ID NO: 3967256 - RNA, 16 nt, Human herpesvirus 4 (Epstein-Barr virus)
aggccucuggggucca

SEQ ID NO: 3967257 - RNA, 19 nt, Human herpesvirus 4 (Epstein-Barr virus)
aggcggaagaccaggagcc

SEQ ID NO: 3967258 - RNA, 16 nt, Human herpesvirus 4 (Epstein-Barr virus)
aggggcaggaggggca

SEQ ID NO: 3967259 - RNA, 19 nt, Human herpesvirus 4 (Epstein-Barr virus)
agggggcgcggcuggaugc

SEQ ID NO: 3967260 - RNA, 15 nt, Human herpesvirus 4 (Epstein-Barr virus)
agggugaggcccagc

SEQ ID NO: 3967261 - RNA, 15 nt, Human herpesvirus 4 (Epstein-Barr virus)
aggucgccggagguc

SEQ ID NO: 3967262 - RNA, 12 nt, Human herpesvirus 4 (Epstein-Barr virus)
agguggccacac

SEQ ID NO: 3967263 - RNA, 17 nt, Human herpesvirus 4 (Epstein-Barr virus)
aggugggcugacacaga

SEQ ID NO: 3967264 - RNA, 20 nt, Human herpesvirus 4 (Epstein-Barr virus)
agguuuagcuauuccaccaa

SEQ ID NO: 3967265 - RNA, 21 nt, Human herpesvirus 4 (Epstein-Barr virus)
agguuucugggcauaaauucu

SEQ ID NO: 3967266 - RNA, 16 nt, Human herpesvirus 4 (Epstein-Barr virus)
aguaaaagcagaacag

SEQ ID NO: 3967267 - RNA, 13 nt, Human herpesvirus 4 (Epstein-Barr virus)
cagcagcccggcc

SEQ ID NO: 3967268 - RNA, 20 nt, Human herpesvirus 4 (Epstein-Barr virus)
cagcagcccggccgaggccu

SEQ ID NO: 3967269 - RNA, 17 nt, Human herpesvirus 4 (Epstein-Barr virus)
cagcaggcucaggccgc

SEQ ID NO: 3967270 - RNA, 16 nt, Human herpesvirus 4 (Epstein-Barr virus)
cagcauggcagccggg

SEQ ID NO: 3967271 - RNA, 21 nt, Human herpesvirus 4 (Epstein-Barr virus)
cagcccccucccgccccuguc

SEQ ID NO: 3967272 - RNA, 21 nt, Human herpesvirus 4 (Epstein-Barr virus)
cagccccucaucccugacccu

SEQ ID NO: 3967273 - RNA, 22 nt, Human herpesvirus 4 (Epstein-Barr virus)
cagcccuuuuaacauuggcagc

SEQ ID NO: 3967274 - RNA, 17 nt, Human herpesvirus 4 (Epstein-Barr virus)
cagcgccguccacggcc

SEQ ID NO: 3967275 - RNA, 18 nt, Human herpesvirus 4 (Epstein-Barr virus)
cagcucaaccgccagggc

SEQ ID NO: 3967276 - RNA, 21 nt, Human herpesvirus 4 (Epstein-Barr virus)
cagcucgcccacacagcgcca

SEQ ID NO: 3967277 - RNA, 16 nt, Human herpesvirus 4 (Epstein-Barr virus)
cagcucggccagcagg

SEQ ID NO: 3967278 - RNA, 21 nt, Human herpesvirus 4 (Epstein-Barr virus)
cagcucggccagcaggccggc

SEQ ID NO: 3967279 - RNA, 24 nt, Human herpesvirus 4 (Epstein-Barr virus)
cagcuucugaggcggcuguggccu

SEQ ID NO: 3967280 - RNA, 15 nt, Human herpesvirus 4 (Epstein-Barr virus)
cagcuuggggccacc

SEQ ID NO: 3967281 - RNA, 16 nt, Human herpesvirus 4 (Epstein-Barr virus)
caggcacggccgggcu

SEQ ID NO: 3967282 - RNA, 17 nt, Human herpesvirus 4 (Epstein-Barr virus)
caggcagaggaaggcca

SEQ ID NO: 3967283 - RNA, 15 nt, Human herpesvirus 4 (Epstein-Barr virus)
caggccuuagcccag

SEQ ID NO: 3967284 - RNA, 13 nt, Human herpesvirus 4 (Epstein-Barr virus)
caggcucuccagc

SEQ ID NO: 3967285 - RNA, 17 nt, Human herpesvirus 4 (Epstein-Barr virus)
cagggcccuggucaggg

SEQ ID NO: 3967286 - RNA, 15 nt, Human herpesvirus 4 (Epstein-Barr virus)
cagggcucuguucac

SEQ ID NO: 3967287 - RNA, 18 nt, Human herpesvirus 4 (Epstein-Barr virus)
caggggcgccgaaagcag

SEQ ID NO: 3967288 - RNA, 22 nt, Human herpesvirus 4 (Epstein-Barr virus)
cagggggcagucugagaaccug

SEQ ID NO: 3967289 - RNA, 17 nt, Human herpesvirus 4 (Epstein-Barr virus)
caggugcccgagccccg

SEQ ID NO: 3967290 - RNA, 19 nt, Human herpesvirus 4 (Epstein-Barr virus)
cagucaccuuccagacuau

SEQ ID NO: 3967291 - RNA, 23 nt, Human herpesvirus 4 (Epstein-Barr virus)
caguccgccaugaccagcagcag

SEQ ID NO: 3967292 - RNA, 20 nt, Human herpesvirus 4 (Epstein-Barr virus)
cagucuauccaggaggagga

SEQ ID NO: 3967293 - RNA, 18 nt, Human herpesvirus 4 (Epstein-Barr virus)
caguggccagcucauaug

SEQ ID NO: 3967294 - RNA, 19 nt, Human herpesvirus 4 (Epstein-Barr virus)
caguggccgucuggcaggg

SEQ ID NO: 3967295 - RNA, 16 nt, Human herpesvirus 4 (Epstein-Barr virus)
cagugggccucucugg

SEQ ID NO: 3967296 - RNA, 22 nt, Human herpesvirus 4 (Epstein-Barr virus)
cagugggccucucuggcugugc

SEQ ID NO: 3967297 - RNA, 16 nt, Human herpesvirus 4 (Epstein-Barr virus)
cauaccuacaccaccc

SEQ ID NO: 3967298 - RNA, 22 nt, Human herpesvirus 4 (Epstein-Barr virus)
cauacucaagagaucagcaacc

SEQ ID NO: 3967299 - RNA, 19 nt, Human herpesvirus 4 (Epstein-Barr virus)
caucaugcgugaccaccug

SEQ ID NO: 3967300 - RNA, 14 nt, Human herpesvirus 4 (Epstein-Barr virus)
caucauuagcccag

SEQ ID NO: 3967301 - RNA, 20 nt, Human herpesvirus 4 (Epstein-Barr virus)
caucucugauuauagcucug

SEQ ID NO: 3967302 - RNA, 14 nt, Human herpesvirus 4 (Epstein-Barr virus)
caucuggcucuccu

SEQ ID NO: 3967303 - RNA, 22 nt, Human herpesvirus 4 (Epstein-Barr virus)
caugacgcugcugcuacuggcu

SEQ ID NO: 3967304 - RNA, 23 nt, Human herpesvirus 4 (Epstein-Barr virus)
cauggugagacaccuggcccacu

SEQ ID NO: 3967305 - RNA, 18 nt, Human herpesvirus 4 (Epstein-Barr virus)
caugugcauggccugggc

SEQ ID NO: 3967306 - RNA, 15 nt, Human herpesvirus 4 (Epstein-Barr virus)
cauuccuaggagaag

SEQ ID NO: 3967307 - RNA, 19 nt, Human herpesvirus 4 (Epstein-Barr virus)
cauuuacguucuggugaug

SEQ ID NO: 3967308 - RNA, 15 nt, Human herpesvirus 4 (Epstein-Barr virus)
cauuucaguggcccu

SEQ ID NO: 3967309 - RNA, 21 nt, Human herpesvirus 4 (Epstein-Barr virus)
cauuuuuggugcugccugggg

SEQ ID NO: 3967310 - RNA, 20 nt, Human herpesvirus 4 (Epstein-Barr virus)
ccaaguugcauuggcugcaa

SEQ ID NO: 3967311 - RNA, 22 nt, Human herpesvirus 4 (Epstein-Barr virus)
ccaauguaucccaaauaaaugu

SEQ ID NO: 3967312 - RNA, 20 nt, Human herpesvirus 4 (Epstein-Barr virus)
ccacagagcaucagaugaga

SEQ ID NO: 3967313 - RNA, 21 nt, Human herpesvirus 4 (Epstein-Barr virus)
ccacagccccacucuugccuc

SEQ ID NO: 3967314 - RNA, 18 nt, Human herpesvirus 4 (Epstein-Barr virus)
ccaccacggugcagccua

SEQ ID NO: 3967315 - RNA, 14 nt, Human herpesvirus 4 (Epstein-Barr virus)
ccaccacucccacc

SEQ ID NO: 3967316 - RNA, 16 nt, Human herpesvirus 4 (Epstein-Barr virus)
ccaccuccccuguggc

SEQ ID NO: 3967317 - RNA, 12 nt, Human herpesvirus 4 (Epstein-Barr virus)
ccaccuggccac

SEQ ID NO: 3967318 - RNA, 19 nt, Human herpesvirus 4 (Epstein-Barr virus)
ccacggccguagcccaguc

SEQ ID NO: 3967319 - RNA, 22 nt, Human herpesvirus 4 (Epstein-Barr virus)
ccacggcgaccuguuccgcuuc

SEQ ID NO: 3967320 - RNA, 15 nt, Human herpesvirus 4 (Epstein-Barr virus)
ccacucuugccucgg

SEQ ID NO: 3967321 - RNA, 18 nt, Human herpesvirus 4 (Epstein-Barr virus)
ccacuuacaaccaagcca

SEQ ID NO: 3967322 - RNA, 13 nt, Human herpesvirus 4 (Epstein-Barr virus)
ccagcccuccuca

SEQ ID NO: 3967323 - RNA, 15 nt, Human herpesvirus 4 (Epstein-Barr virus)
ccaggagucugcugc

SEQ ID NO: 3967324 - RNA, 16 nt, Human herpesvirus 4 (Epstein-Barr virus)
ccaggcauacagcagc

SEQ ID NO: 3967325 - RNA, 13 nt, Human herpesvirus 4 (Epstein-Barr virus)
ccaggcuggugac

SEQ ID NO: 3967326 - RNA, 23 nt, Human herpesvirus 4 (Epstein-Barr virus)
ccaguguacugcgaugagggccu

SEQ ID NO: 3967327 - RNA, 14 nt, Human herpesvirus 4 (Epstein-Barr virus)
ccaucugcuucugg

SEQ ID NO: 3967328 - RNA, 17 nt, Human herpesvirus 4 (Epstein-Barr virus)
ccaucugcuucuggcuc

SEQ ID NO: 3967329 - RNA, 17 nt, Human herpesvirus 4 (Epstein-Barr virus)
ccaugacaucacagagg

SEQ ID NO: 3967330 - RNA, 19 nt, Human herpesvirus 4 (Epstein-Barr virus)
ccaugacgcugcugcuacu

SEQ ID NO: 3967331 - RNA, 14 nt, Human herpesvirus 4 (Epstein-Barr virus)
ccaugagugccaug

SEQ ID NO: 3967332 - RNA, 11 nt, Human herpesvirus 4 (Epstein-Barr virus)
ccauggccagg

SEQ ID NO: 3967333 - RNA, 18 nt, Human herpesvirus 4 (Epstein-Barr virus)
ccauggugccaagcucag

SEQ ID NO: 3967334 - RNA, 19 nt, Human herpesvirus 4 (Epstein-Barr virus)
cccaaaaguagaggcucag

SEQ ID NO: 3967335 - RNA, 21 nt, Human herpesvirus 4 (Epstein-Barr virus)
cccaccacccccaccaccucc

SEQ ID NO: 3967336 - RNA, 18 nt, Human herpesvirus 4 (Epstein-Barr virus)
cccaccaccccccccacc

SEQ ID NO: 3967337 - RNA, 18 nt, Human herpesvirus 4 (Epstein-Barr virus)
cccacuuuuaccccaguc

SEQ ID NO: 3967338 - RNA, 19 nt, Human herpesvirus 4 (Epstein-Barr virus)
cccagagggcgaaugggcu

SEQ ID NO: 3967339 - RNA, 23 nt, Human herpesvirus 4 (Epstein-Barr virus)
cccagagggcgaaugggcugcag

SEQ ID NO: 3967340 - RNA, 13 nt, Human herpesvirus 4 (Epstein-Barr virus)
cccagccacagca

SEQ ID NO: 3967341 - RNA, 22 nt, Human herpesvirus 4 (Epstein-Barr virus)
cccagcccccucucgcccaagc

SEQ ID NO: 3967342 - RNA, 18 nt, Human herpesvirus 4 (Epstein-Barr virus)
cccagcccuuaacacacc

SEQ ID NO: 3967343 - RNA, 18 nt, Human herpesvirus 4 (Epstein-Barr virus)
cccagccuacucuccacu

SEQ ID NO: 3967344 - RNA, 15 nt, Human herpesvirus 4 (Epstein-Barr virus)
cccaggggucucuag

SEQ ID NO: 3967345 - RNA, 18 nt, Human herpesvirus 4 (Epstein-Barr virus)
cccaucugagggcaguga

SEQ ID NO: 3967346 - RNA, 18 nt, Human herpesvirus 4 (Epstein-Barr virus)
ccccacacucccuccaga

SEQ ID NO: 3967347 - RNA, 13 nt, Human herpesvirus 4 (Epstein-Barr virus)
ccccagaagcccc

SEQ ID NO: 3967348 - RNA, 16 nt, Human herpesvirus 4 (Epstein-Barr virus)
ccccauagacucccau

SEQ ID NO: 3967349 - RNA, 17 nt, Human herpesvirus 4 (Epstein-Barr virus)
cccccuggcggcccagc

SEQ ID NO: 3967350 - RNA, 15 nt, Human herpesvirus 4 (Epstein-Barr virus)
ccccgcaccagggcc

SEQ ID NO: 3967351 - RNA, 15 nt, Human herpesvirus 4 (Epstein-Barr virus)
ccccggcucucaggc

SEQ ID NO: 3967352 - RNA, 14 nt, Human herpesvirus 4 (Epstein-Barr virus)
ccccuaccucggca

SEQ ID NO: 3967353 - RNA, 12 nt, Human herpesvirus 4 (Epstein-Barr virus)
ccccuggccacc

SEQ ID NO: 3967354 - RNA, 13 nt, Human herpesvirus 4 (Epstein-Barr virus)
ccccugugcuucu

SEQ ID NO: 3967355 - RNA, 15 nt, Human herpesvirus 4 (Epstein-Barr virus)
gccugacugacucuc

SEQ ID NO: 3967356 - RNA, 13 nt, Human herpesvirus 4 (Epstein-Barr virus)
gccugagagccgg

SEQ ID NO: 3967357 - RNA, 17 nt, Human herpesvirus 4 (Epstein-Barr virus)
gccugcggacucaggcc

SEQ ID NO: 3967358 - RNA, 18 nt, Human herpesvirus 4 (Epstein-Barr virus)
gccuggauguugacucca

SEQ ID NO: 3967359 - RNA, 22 nt, Human herpesvirus 4 (Epstein-Barr virus)
gccuggcucaaacgcugcuugg

SEQ ID NO: 3967360 - RNA, 11 nt, Human herpesvirus 4 (Epstein-Barr virus)
gccuggggcuc

SEQ ID NO: 3967361 - RNA, 20 nt, Human herpesvirus 4 (Epstein-Barr virus)
gcgaagggugggggugggug

SEQ ID NO: 3967362 - RNA, 21 nt, Human herpesvirus 4 (Epstein-Barr virus)
gcgacggcuuuagccuggccu

SEQ ID NO: 3967363 - RNA, 23 nt, Human herpesvirus 4 (Epstein-Barr virus)
gcgagcuccgugggcccagagug

SEQ ID NO: 3967364 - RNA, 13 nt, Human herpesvirus 4 (Epstein-Barr virus)
gcgccccagggca

SEQ ID NO: 3967365 - RNA, 13 nt, Human herpesvirus 4 (Epstein-Barr virus)
gcgcuguguggcu

SEQ ID NO: 3967366 - RNA, 22 nt, Human herpesvirus 4 (Epstein-Barr virus)
gcggcccagcagauccagggcc

SEQ ID NO: 3967367 - RNA, 22 nt, Human herpesvirus 4 (Epstein-Barr virus)
gcgggaguauggggccagaggc

SEQ ID NO: 3967368 - RNA, 23 nt, Human herpesvirus 4 (Epstein-Barr virus)
gcuacacucuggggucucaggcc

SEQ ID NO: 3967369 - RNA, 19 nt, Human herpesvirus 4 (Epstein-Barr virus)
gcuagaagugcugggaggu

SEQ ID NO: 3967370 - RNA, 21 nt, Human herpesvirus 4 (Epstein-Barr virus)
gcuagucacacccguggaggu

SEQ ID NO: 3967371 - RNA, 16 nt, Human herpesvirus 4 (Epstein-Barr virus)
gcuauagugagccagg

SEQ ID NO: 3967372 - RNA, 14 nt, Human herpesvirus 4 (Epstein-Barr virus)
gcucaaggaggggc

SEQ ID NO: 3967373 - RNA, 18 nt, Human herpesvirus 4 (Epstein-Barr virus)
gcucagcucaaccgccag

SEQ ID NO: 3967374 - RNA, 16 nt, Human herpesvirus 4 (Epstein-Barr virus)
gcucagugcggugcua

SEQ ID NO: 3967375 - RNA, 22 nt, Human herpesvirus 4 (Epstein-Barr virus)
gcuccagugccuccgccugagc

SEQ ID NO: 3967376 - RNA, 17 nt, Human herpesvirus 4 (Epstein-Barr virus)
gcuccgagagcuccgcc

SEQ ID NO: 3967377 - RNA, 17 nt, Human herpesvirus 4 (Epstein-Barr virus)
gcuccgugguccugagg

SEQ ID NO: 3967378 - RNA, 13 nt, Human herpesvirus 4 (Epstein-Barr virus)
gcuccuggaucug

SEQ ID NO: 3967379 - RNA, 17 nt, Human herpesvirus 4 (Epstein-Barr virus)
gcucggccagcaggccg

SEQ ID NO: 3967380 - RNA, 14 nt, Human herpesvirus 4 (Epstein-Barr virus)
gcugagugcccagg

SEQ ID NO: 3967381 - RNA, 20 nt, Human herpesvirus 4 (Epstein-Barr virus)
gcugcuggucauggcggacu

SEQ ID NO: 3967382 - RNA, 13 nt, Human herpesvirus 4 (Epstein-Barr virus)
gcuggccaggcug

SEQ ID NO: 3967383 - RNA, 17 nt, Human herpesvirus 4 (Epstein-Barr virus)
gcuggcucgccucaucc

SEQ ID NO: 3967384 - RNA, 14 nt, Human herpesvirus 4 (Epstein-Barr virus)
gcugguuggggcug

SEQ ID NO: 3967385 - RNA, 14 nt, Human herpesvirus 4 (Epstein-Barr virus)
gcuguaacuguggu

SEQ ID NO: 3967386 - RNA, 16 nt, Human herpesvirus 4 (Epstein-Barr virus)
gcuugugcuccugaua

SEQ ID NO: 3967387 - RNA, 17 nt, Human herpesvirus 4 (Epstein-Barr virus)
gcuuucguccucuggcu

SEQ ID NO: 3967388 - RNA, 16 nt, Human herpesvirus 4 (Epstein-Barr virus)
gcuuuugucugccugg

SEQ ID NO: 3967389 - RNA, 14 nt, Human herpesvirus 4 (Epstein-Barr virus)
ggaaacggcgagca

SEQ ID NO: 3967390 - RNA, 17 nt, Human herpesvirus 4 (Epstein-Barr virus)
ggaaaugagggaauuug

SEQ ID NO: 3967391 - RNA, 22 nt, Human herpesvirus 4 (Epstein-Barr virus)
ggaacaugagaaaauacuucuc

SEQ ID NO: 3967392 - RNA, 13 nt, Human herpesvirus 4 (Epstein-Barr virus)
ggaacauuugagg

SEQ ID NO: 3967393 - RNA, 22 nt, Human herpesvirus 4 (Epstein-Barr virus)
ggaagucuuuuauaaggcuccg

SEQ ID NO: 3967394 - RNA, 23 nt, Human herpesvirus 4 (Epstein-Barr virus)
ggaaugacgggcucccucccccu

SEQ ID NO: 3967395 - RNA, 14 nt, Human herpesvirus 4 (Epstein-Barr virus)
ggaaugccuuagcu

SEQ ID NO: 3967396 - RNA, 13 nt, Human herpesvirus 4 (Epstein-Barr virus)
ggacaagacaguc

SEQ ID NO: 3967397 - RNA, 18 nt, Human herpesvirus 4 (Epstein-Barr virus)
ggacacugccaagguuga

SEQ ID NO: 3967398 - RNA, 23 nt, Human herpesvirus 4 (Epstein-Barr virus)
ggaccagaaggcuccggcggcag

SEQ ID NO: 3967399 - RNA, 16 nt, Human herpesvirus 4 (Epstein-Barr virus)
ggacccuauggagggc

SEQ ID NO: 3967400 - RNA, 18 nt, Human herpesvirus 4 (Epstein-Barr virus)
ggagaugaccuccuacac

SEQ ID NO: 3967401 - RNA, 16 nt, Human herpesvirus 4 (Epstein-Barr virus)
ggagcaggagcaggag

SEQ ID NO: 3967402 - RNA, 12 nt, Human herpesvirus 4 (Epstein-Barr virus)
ggagcaggagga

SEQ ID NO: 3967403 - RNA, 21 nt, Human herpesvirus 4 (Epstein-Barr virus)
ggagcuccgagagcuccgcca

SEQ ID NO: 3967404 - RNA, 18 nt, Human herpesvirus 4 (Epstein-Barr virus)
ggaggaggacgugaguga

SEQ ID NO: 3967405 - RNA, 20 nt, Human herpesvirus 4 (Epstein-Barr virus)
ggaggcacacaaaaugagga

SEQ ID NO: 3967406 - RNA, 13 nt, Human herpesvirus 4 (Epstein-Barr virus)
ggaggccccggcc

SEQ ID NO: 3967407 - RNA, 18 nt, Human herpesvirus 4 (Epstein-Barr virus)
ggaugcaucuaaggucca

SEQ ID NO: 3967408 - RNA, 18 nt, Human herpesvirus 4 (Epstein-Barr virus)
ggauugcugaacuggggc

SEQ ID NO: 3967409 - RNA, 14 nt, Human herpesvirus 4 (Epstein-Barr virus)
ggcagacacccacg

SEQ ID NO: 3967410 - RNA, 14 nt, Human herpesvirus 4 (Epstein-Barr virus)
ggcagcagcucugg

SEQ ID NO: 3967411 - RNA, 22 nt, Human herpesvirus 4 (Epstein-Barr virus)
ggcaucguuugugauucccaga

SEQ ID NO: 3967412 - RNA, 20 nt, Human herpesvirus 4 (Epstein-Barr virus)
ggccaccggggaggccaggu

SEQ ID NO: 3967413 - RNA, 23 nt, Human herpesvirus 4 (Epstein-Barr virus)
ggccacgcugggaguccggcccu

SEQ ID NO: 3967414 - RNA, 17 nt, Human herpesvirus 4 (Epstein-Barr virus)
ggccaggcaccccaucu

SEQ ID NO: 3967415 - RNA, 18 nt, Human herpesvirus 4 (Epstein-Barr virus)
ggccauucgacaggccau

SEQ ID NO: 3967416 - RNA, 20 nt, Human herpesvirus 4 (Epstein-Barr virus)
ggcccacgccauaccugcac

SEQ ID NO: 3967417 - RNA, 19 nt, Human herpesvirus 4 (Epstein-Barr virus)
ggcccacgucuuuaccacc

SEQ ID NO: 3967418 - RNA, 17 nt, Human herpesvirus 4 (Epstein-Barr virus)
ggcccuuugccuggggc

SEQ ID NO: 3967419 - RNA, 14 nt, Human herpesvirus 4 (Epstein-Barr virus)
ggccgacgaggccc

SEQ ID NO: 3967420 - RNA, 15 nt, Human herpesvirus 4 (Epstein-Barr virus)
ggccucgguggcagu

SEQ ID NO: 3967421 - RNA, 23 nt, Human herpesvirus 4 (Epstein-Barr virus)
ggccugcuggccgagcuggaggc

SEQ ID NO: 3967422 - RNA, 22 nt, Human herpesvirus 4 (Epstein-Barr virus)
ggcgcccugcgaguccaagcug

SEQ ID NO: 3967423 - RNA, 13 nt, Human herpesvirus 4 (Epstein-Barr virus)
ggcgcgggagccg

SEQ ID NO: 3967424 - RNA, 21 nt, Human herpesvirus 4 (Epstein-Barr virus)
ggcggccucggaggugcccgg

SEQ ID NO: 3967425 - RNA, 21 nt, Human herpesvirus 4 (Epstein-Barr virus)
ggcgguuagggaggacacugc

SEQ ID NO: 3967426 - RNA, 15 nt, Human herpesvirus 4 (Epstein-Barr virus)
ggcguacaccuggcu

SEQ ID NO: 3967427 - RNA, 21 nt, Human herpesvirus 4 (Epstein-Barr virus)
ggcgucgggaaacacagcucu

SEQ ID NO: 3967428 - RNA, 13 nt, Human herpesvirus 4 (Epstein-Barr virus)
ggcguggguguca

SEQ ID NO: 3967429 - RNA, 16 nt, Human herpesvirus 4 (Epstein-Barr virus)
ggcucaggccaugcgc

SEQ ID NO: 3967430 - RNA, 16 nt, Human herpesvirus 4 (Epstein-Barr virus)
ggcuccccauagacuc

SEQ ID NO: 3967431 - RNA, 14 nt, Human herpesvirus 4 (Epstein-Barr virus)
ggcucccucccccu

SEQ ID NO: 3967432 - RNA, 19 nt, Human herpesvirus 4 (Epstein-Barr virus)
ggcuggaugcccucaugcg

SEQ ID NO: 3967433 - RNA, 22 nt, Human herpesvirus 4 (Epstein-Barr virus)
ggcugggugggagagcgcggcc

SEQ ID NO: 3967434 - RNA, 12 nt, Human herpesvirus 4 (Epstein-Barr virus)
ggcuuucguccu

SEQ ID NO: 3967435 - RNA, 14 nt, Human herpesvirus 4 (Epstein-Barr virus)
gggacauccccaga

SEQ ID NO: 3967436 - RNA, 17 nt, Human herpesvirus 4 (Epstein-Barr virus)
gggagccacggcgucaa

SEQ ID NO: 3967437 - RNA, 21 nt, Human herpesvirus 4 (Epstein-Barr virus)
gggcaggcccccagcuucuga

SEQ ID NO: 3967438 - RNA, 22 nt, Human herpesvirus 4 (Epstein-Barr virus)
gggcccuuagcaugggaggcgc

SEQ ID NO: 3967439 - RNA, 23 nt, Human herpesvirus 4 (Epstein-Barr virus)
gggccuagguacucuuggugcag

SEQ ID NO: 3967440 - RNA, 19 nt, Human herpesvirus 4 (Epstein-Barr virus)
gggccuggugccagacucu

SEQ ID NO: 3967441 - RNA, 18 nt, Human herpesvirus 4 (Epstein-Barr virus)
gggcgcccccaaacuuug

SEQ ID NO: 3967442 - RNA, 16 nt, Human herpesvirus 4 (Epstein-Barr virus)
gggcucccucccccuc

SEQ ID NO: 3967443 - RNA, 19 nt, Human herpesvirus 4 (Epstein-Barr virus)
aguacaggauuauugccaa

SEQ ID NO: 3967444 - RNA, 22 nt, Human herpesvirus 4 (Epstein-Barr virus)
aguagcacuggugguggaggag

SEQ ID NO: 3967445 - RNA, 15 nt, Human herpesvirus 4 (Epstein-Barr virus)
aguauuuugcaaaca

SEQ ID NO: 3967446 - RNA, 18 nt, Human herpesvirus 4 (Epstein-Barr virus)
aguccggagacugaggcc

SEQ ID NO: 3967447 - RNA, 20 nt, Human herpesvirus 4 (Epstein-Barr virus)
agugacacugaugagucuga

SEQ ID NO: 3967448 - RNA, 15 nt, Human herpesvirus 4 (Epstein-Barr virus)
aguggacaaggcagu

SEQ ID NO: 3967449 - RNA, 13 nt, Human herpesvirus 4 (Epstein-Barr virus)
aguggcugccccg

SEQ ID NO: 3967450 - RNA, 18 nt, Human herpesvirus 4 (Epstein-Barr virus)
agugggcuucgggggccu

SEQ ID NO: 3967451 - RNA, 15 nt, Human herpesvirus 4 (Epstein-Barr virus)
agugggugggcauug

SEQ ID NO: 3967452 - RNA, 21 nt, Human herpesvirus 4 (Epstein-Barr virus)
agugguuguauguucagagcu

SEQ ID NO: 3967453 - RNA, 13 nt, Human herpesvirus 4 (Epstein-Barr virus)
aguucccuucucc

SEQ ID NO: 3967454 - RNA, 18 nt, Human herpesvirus 4 (Epstein-Barr virus)
aguugggguccucaagga

SEQ ID NO: 3967455 - RNA, 20 nt, Human herpesvirus 4 (Epstein-Barr virus)
aguuguccugggcugccccg

SEQ ID NO: 3967456 - RNA, 14 nt, Human herpesvirus 4 (Epstein-Barr virus)
aguuuacuuucaag

SEQ ID NO: 3967457 - RNA, 15 nt, Human herpesvirus 4 (Epstein-Barr virus)
auaaaccuuaaaagu

SEQ ID NO: 3967458 - RNA, 16 nt, Human herpesvirus 4 (Epstein-Barr virus)
auaacugccagagcug

SEQ ID NO: 3967459 - RNA, 17 nt, Human herpesvirus 4 (Epstein-Barr virus)
auacaugucucagaggc

SEQ ID NO: 3967460 - RNA, 18 nt, Human herpesvirus 4 (Epstein-Barr virus)
auacccagagcaaaagca

SEQ ID NO: 3967461 - RNA, 15 nt, Human herpesvirus 4 (Epstein-Barr virus)
auaccgagauguaca

SEQ ID NO: 3967462 - RNA, 23 nt, Human herpesvirus 4 (Epstein-Barr virus)
auagauccugggccccccggagg

SEQ ID NO: 3967463 - RNA, 14 nt, Human herpesvirus 4 (Epstein-Barr virus)
auagccggccaggc

SEQ ID NO: 3967464 - RNA, 21 nt, Human herpesvirus 4 (Epstein-Barr virus)
auauggcuauacacaggagcc

SEQ ID NO: 3967465 - RNA, 14 nt, Human herpesvirus 4 (Epstein-Barr virus)
aucaccccgagucc

SEQ ID NO: 3967466 - RNA, 21 nt, Human herpesvirus 4 (Epstein-Barr virus)
aucaccuggguacccaaacca

SEQ ID NO: 3967467 - RNA, 16 nt, Human herpesvirus 4 (Epstein-Barr virus)
aucagacggggaggug

SEQ ID NO: 3967468 - RNA, 22 nt, Human herpesvirus 4 (Epstein-Barr virus)
auccaucaacuucagcuccagg

SEQ ID NO: 3967469 - RNA, 15 nt, Human herpesvirus 4 (Epstein-Barr virus)
aucccaaauaaaugu

SEQ ID NO: 3967470 - RNA, 17 nt, Human herpesvirus 4 (Epstein-Barr virus)
auccgccaggaccugga

SEQ ID NO: 3967471 - RNA, 15 nt, Human herpesvirus 4 (Epstein-Barr virus)
aucgaaggagagcug

SEQ ID NO: 3967472 - RNA, 15 nt, Human herpesvirus 4 (Epstein-Barr virus)
aucucccgcgccgca

SEQ ID NO: 3967473 - RNA, 22 nt, Human herpesvirus 4 (Epstein-Barr virus)
aucucugauuauagcucuggca

SEQ ID NO: 3967474 - RNA, 13 nt, Human herpesvirus 4 (Epstein-Barr virus)
aucuggcucuccu

SEQ ID NO: 3967475 - RNA, 19 nt, Human herpesvirus 4 (Epstein-Barr virus)
aucugggaguguagaggug

SEQ ID NO: 3967476 - RNA, 15 nt, Human herpesvirus 4 (Epstein-Barr virus)
augaacccuggggca

SEQ ID NO: 3967477 - RNA, 12 nt, Human herpesvirus 4 (Epstein-Barr virus)
augacucaucuc

SEQ ID NO: 3967478 - RNA, 22 nt, Human herpesvirus 4 (Epstein-Barr virus)
augcaacaauagaaguggaaac

SEQ ID NO: 3967479 - RNA, 20 nt, Human herpesvirus 4 (Epstein-Barr virus)
auggauagauagccacccgc

SEQ ID NO: 3967480 - RNA, 21 nt, Human herpesvirus 4 (Epstein-Barr virus)
augguguuaacuuucuccccu

SEQ ID NO: 3967481 - RNA, 14 nt, Human herpesvirus 4 (Epstein-Barr virus)
auguccuguggugu

SEQ ID NO: 3967482 - RNA, 13 nt, Human herpesvirus 4 (Epstein-Barr virus)
auguuacuucuuu

SEQ ID NO: 3967483 - RNA, 16 nt, Human herpesvirus 4 (Epstein-Barr virus)
auguuuucuggacaca

SEQ ID NO: 3967484 - RNA, 13 nt, Human herpesvirus 4 (Epstein-Barr virus)
auuauugauguga

SEQ ID NO: 3967485 - RNA, 18 nt, Human herpesvirus 4 (Epstein-Barr virus)
auugcuggccgcagcugg

SEQ ID NO: 3967486 - RNA, 20 nt, Human herpesvirus 4 (Epstein-Barr virus)
auuggucgucuucuuccccu

SEQ ID NO: 3967487 - RNA, 16 nt, Human herpesvirus 4 (Epstein-Barr virus)
auuuuauuuacagcca

SEQ ID NO: 3967488 - RNA, 23 nt, Human herpesvirus 4 (Epstein-Barr virus)
auuuucugcgugagaugaacacc

SEQ ID NO: 3967489 - RNA, 15 nt, Human herpesvirus 4 (Epstein-Barr virus)
caaacacgggccugg

SEQ ID NO: 3967490 - RNA, 16 nt, Human herpesvirus 4 (Epstein-Barr virus)
caaacagcagcagcag

SEQ ID NO: 3967491 - RNA, 20 nt, Human herpesvirus 4 (Epstein-Barr virus)
caaacucucucaucuccaaa

SEQ ID NO: 3967492 - RNA, 15 nt, Human herpesvirus 4 (Epstein-Barr virus)
caaagucaagggaaa

SEQ ID NO: 3967493 - RNA, 12 nt, Human herpesvirus 4 (Epstein-Barr virus)
caaauaaauguu

SEQ ID NO: 3967494 - RNA, 14 nt, Human herpesvirus 4 (Epstein-Barr virus)
caacacgaccaccu

SEQ ID NO: 3967495 - RNA, 19 nt, Human herpesvirus 4 (Epstein-Barr virus)
caacccuaacacucuuuuu

SEQ ID NO: 3967496 - RNA, 15 nt, Human herpesvirus 4 (Epstein-Barr virus)
caacugucacaccag

SEQ ID NO: 3967497 - RNA, 15 nt, Human herpesvirus 4 (Epstein-Barr virus)
caagauggagaggca

SEQ ID NO: 3967498 - RNA, 16 nt, Human herpesvirus 4 (Epstein-Barr virus)
caagauuguuccaggu

SEQ ID NO: 3967499 - RNA, 21 nt, Human herpesvirus 4 (Epstein-Barr virus)
caagcagcaccugucccuggg

SEQ ID NO: 3967500 - RNA, 21 nt, Human herpesvirus 4 (Epstein-Barr virus)
caaggacgggggugggcaccu

SEQ ID NO: 3967501 - RNA, 15 nt, Human herpesvirus 4 (Epstein-Barr virus)
caagguugaagagca

SEQ ID NO: 3967502 - RNA, 20 nt, Human herpesvirus 4 (Epstein-Barr virus)
caagugauuaggagcagggc

SEQ ID NO: 3967503 - RNA, 19 nt, Human herpesvirus 4 (Epstein-Barr virus)
caauaaaguugaugauauu

SEQ ID NO: 3967504 - RNA, 23 nt, Human herpesvirus 4 (Epstein-Barr virus)
caauguaucccaaauaaauguua

SEQ ID NO: 3967505 - RNA, 19 nt, Human herpesvirus 4 (Epstein-Barr virus)
cacaaccuuggacccugcu

SEQ ID NO: 3967506 - RNA, 15 nt, Human herpesvirus 4 (Epstein-Barr virus)
cacagccugcaccag

SEQ ID NO: 3967507 - RNA, 12 nt, Human herpesvirus 4 (Epstein-Barr virus)
cacagcugcugg

SEQ ID NO: 3967508 - RNA, 23 nt, Human herpesvirus 4 (Epstein-Barr virus)
cacaggcuuggaaacacccauuc

SEQ ID NO: 3967509 - RNA, 18 nt, Human herpesvirus 4 (Epstein-Barr virus)
cacaggguggggguggac

SEQ ID NO: 3967510 - RNA, 15 nt, Human herpesvirus 4 (Epstein-Barr virus)
cacaucuggaccugg

SEQ ID NO: 3967511 - RNA, 13 nt, Human herpesvirus 4 (Epstein-Barr virus)
caccacacaggua

SEQ ID NO: 3967512 - RNA, 20 nt, Human herpesvirus 4 (Epstein-Barr virus)
caccggagccaccacagcac

SEQ ID NO: 3967513 - RNA, 17 nt, Human herpesvirus 4 (Epstein-Barr virus)
caccggggaggccaggu

SEQ ID NO: 3967514 - RNA, 14 nt, Human herpesvirus 4 (Epstein-Barr virus)
caccguggagccgg

SEQ ID NO: 3967515 - RNA, 19 nt, Human herpesvirus 4 (Epstein-Barr virus)
caccguggagccgggcuuc

SEQ ID NO: 3967516 - RNA, 19 nt, Human herpesvirus 4 (Epstein-Barr virus)
caccuagaaagagccaugg

SEQ ID NO: 3967517 - RNA, 22 nt, Human herpesvirus 4 (Epstein-Barr virus)
caccuggcuguacgccgccgcc

SEQ ID NO: 3967518 - RNA, 20 nt, Human herpesvirus 4 (Epstein-Barr virus)
caccuuaacuggcacacacu

SEQ ID NO: 3967519 - RNA, 14 nt, Human herpesvirus 4 (Epstein-Barr virus)
cacggcccuccagc

SEQ ID NO: 3967520 - RNA, 19 nt, Human herpesvirus 4 (Epstein-Barr virus)
cacgggccuggggccauag

SEQ ID NO: 3967521 - RNA, 20 nt, Human herpesvirus 4 (Epstein-Barr virus)
cacggggugcucccccugga

SEQ ID NO: 3967522 - RNA, 21 nt, Human herpesvirus 4 (Epstein-Barr virus)
cacucaggaagcuggccaggc

SEQ ID NO: 3967523 - RNA, 20 nt, Human herpesvirus 4 (Epstein-Barr virus)
cacugauuuugggcacacuu

SEQ ID NO: 3967524 - RNA, 14 nt, Human herpesvirus 4 (Epstein-Barr virus)
cacugcaggcugga

SEQ ID NO: 3967525 - RNA, 19 nt, Human herpesvirus 4 (Epstein-Barr virus)
cagagcccagaggaggccc

SEQ ID NO: 3967526 - RNA, 14 nt, Human herpesvirus 4 (Epstein-Barr virus)
cagaggaggccccg

SEQ ID NO: 3967527 - RNA, 12 nt, Human herpesvirus 4 (Epstein-Barr virus)
cagaugcagugg

SEQ ID NO: 3967528 - RNA, 18 nt, Human herpesvirus 4 (Epstein-Barr virus)
cagcaaaaccagcccggg

SEQ ID NO: 3967529 - RNA, 21 nt, Human herpesvirus 4 (Epstein-Barr virus)
cagcaaccaauguaucccaaa

SEQ ID NO: 3967530 - RNA, 19 nt, Human herpesvirus 4 (Epstein-Barr virus)
cagcacagccagagaggcc

SEQ ID NO: 3967531 - RNA, 14 nt, Human herpesvirus 4 (Epstein-Barr virus)
cccgaguuggcauc

SEQ ID NO: 3967532 - RNA, 19 nt, Human herpesvirus 4 (Epstein-Barr virus)
cccgcaccagggccaggcg

SEQ ID NO: 3967533 - RNA, 16 nt, Human herpesvirus 4 (Epstein-Barr virus)
cccggcggcugcugcc

SEQ ID NO: 3967534 - RNA, 15 nt, Human herpesvirus 4 (Epstein-Barr virus)
cccggggguggcagc

SEQ ID NO: 3967535 - RNA, 20 nt, Human herpesvirus 4 (Epstein-Barr virus)
cccugaacaucucaucccca

SEQ ID NO: 3967536 - RNA, 13 nt, Human herpesvirus 4 (Epstein-Barr virus)
cccugucaccagg

SEQ ID NO: 3967537 - RNA, 14 nt, Human herpesvirus 4 (Epstein-Barr virus)
cccugucaccaggc

SEQ ID NO: 3967538 - RNA, 18 nt, Human herpesvirus 4 (Epstein-Barr virus)
cccugugcagggacgagg

SEQ ID NO: 3967539 - RNA, 19 nt, Human herpesvirus 4 (Epstein-Barr virus)
cccuucugcugcugcuggu

SEQ ID NO: 3967540 - RNA, 21 nt, Human herpesvirus 4 (Epstein-Barr virus)
cccuugagaagcagcucuucu

SEQ ID NO: 3967541 - RNA, 18 nt, Human herpesvirus 4 (Epstein-Barr virus)
ccgaagauuuggcgucua

SEQ ID NO: 3967542 - RNA, 15 nt, Human herpesvirus 4 (Epstein-Barr virus)
ccgaggccugcgacg

SEQ ID NO: 3967543 - RNA, 16 nt, Human herpesvirus 4 (Epstein-Barr virus)
ccgaggcugagggggc

SEQ ID NO: 3967544 - RNA, 22 nt, Human herpesvirus 4 (Epstein-Barr virus)
ccgagucaguuacacacacagu

SEQ ID NO: 3967545 - RNA, 17 nt, Human herpesvirus 4 (Epstein-Barr virus)
ccgaugauucuggccau

SEQ ID NO: 3967546 - RNA, 24 nt, Human herpesvirus 4 (Epstein-Barr virus)
ccgccauaacgccaucugcguggc

SEQ ID NO: 3967547 - RNA, 14 nt, Human herpesvirus 4 (Epstein-Barr virus)
ccgcccccaccacc

SEQ ID NO: 3967548 - RNA, 17 nt, Human herpesvirus 4 (Epstein-Barr virus)
ccgcgacuucgggggcg

SEQ ID NO: 3967549 - RNA, 14 nt, Human herpesvirus 4 (Epstein-Barr virus)
ccgcuacugcugcu

SEQ ID NO: 3967550 - RNA, 19 nt, Human herpesvirus 4 (Epstein-Barr virus)
ccgcuucagacagccgcgg

SEQ ID NO: 3967551 - RNA, 13 nt, Human herpesvirus 4 (Epstein-Barr virus)
ccggacggccuag

SEQ ID NO: 3967552 - RNA, 15 nt, Human herpesvirus 4 (Epstein-Barr virus)
ccggaggcagacacc

SEQ ID NO: 3967553 - RNA, 14 nt, Human herpesvirus 4 (Epstein-Barr virus)
ccggcaccgccagg

SEQ ID NO: 3967554 - RNA, 15 nt, Human herpesvirus 4 (Epstein-Barr virus)
ccggccgccccgggc

SEQ ID NO: 3967555 - RNA, 13 nt, Human herpesvirus 4 (Epstein-Barr virus)
ccggccugcuggc

SEQ ID NO: 3967556 - RNA, 18 nt, Human herpesvirus 4 (Epstein-Barr virus)
ccggcgccaccugcaggg

SEQ ID NO: 3967557 - RNA, 16 nt, Human herpesvirus 4 (Epstein-Barr virus)
ccggcucucaggccuc

SEQ ID NO: 3967558 - RNA, 12 nt, Human herpesvirus 4 (Epstein-Barr virus)
ccggcuggccau

SEQ ID NO: 3967559 - RNA, 13 nt, Human herpesvirus 4 (Epstein-Barr virus)
ccguccucuggac

SEQ ID NO: 3967560 - RNA, 17 nt, Human herpesvirus 4 (Epstein-Barr virus)
ccgugccauccucucgg

SEQ ID NO: 3967561 - RNA, 22 nt, Human herpesvirus 4 (Epstein-Barr virus)
ccguggccccgggagccacggc

SEQ ID NO: 3967562 - RNA, 19 nt, Human herpesvirus 4 (Epstein-Barr virus)
ccguuauugaaaccacgcc

SEQ ID NO: 3967563 - RNA, 22 nt, Human herpesvirus 4 (Epstein-Barr virus)
ggggaaugagggaaaaggcccu

SEQ ID NO: 3967564 - RNA, 17 nt, Human herpesvirus 4 (Epstein-Barr virus)
ggggaggagaagagagg

SEQ ID NO: 3967565 - RNA, 12 nt, Human herpesvirus 4 (Epstein-Barr virus)
ggggaggagaga

SEQ ID NO: 3967566 - RNA, 23 nt, Human herpesvirus 4 (Epstein-Barr virus)
ggggccuuguccgcugggccagg

SEQ ID NO: 3967567 - RNA, 13 nt, Human herpesvirus 4 (Epstein-Barr virus)
ggggcggcagcgg

SEQ ID NO: 3967568 - RNA, 19 nt, Human herpesvirus 4 (Epstein-Barr virus)
gggucaacagguggucgug

SEQ ID NO: 3967569 - RNA, 15 nt, Human herpesvirus 4 (Epstein-Barr virus)
gggucgccugacccu

SEQ ID NO: 3967570 - RNA, 14 nt, Human herpesvirus 4 (Epstein-Barr virus)
gguaccagaagagu

SEQ ID NO: 3967571 - RNA, 15 nt, Human herpesvirus 4 (Epstein-Barr virus)
gguccauggcugcac

SEQ ID NO: 3967572 - RNA, 18 nt, Human herpesvirus 4 (Epstein-Barr virus)
ggugaaacuggcuucugu

SEQ ID NO: 3967573 - RNA, 18 nt, Human herpesvirus 4 (Epstein-Barr virus)
ggugccaaugggcgcggg

SEQ ID NO: 3967574 - RNA, 19 nt, Human herpesvirus 4 (Epstein-Barr virus)
ggugccuccagagccccuu

SEQ ID NO: 3967575 - RNA, 16 nt, Human herpesvirus 4 (Epstein-Barr virus)
ggugggggugggugca

SEQ ID NO: 3967576 - RNA, 17 nt, Human herpesvirus 4 (Epstein-Barr virus)
ggugugaagggcagggc

SEQ ID NO: 3967577 - RNA, 15 nt, Human herpesvirus 4 (Epstein-Barr virus)
gguucuccaggcucc

SEQ ID NO: 3967578 - RNA, 19 nt, Human herpesvirus 4 (Epstein-Barr virus)
guaaaacuuggaggcugcu

SEQ ID NO: 3967579 - RNA, 22 nt, Human herpesvirus 4 (Epstein-Barr virus)
guaaagaucuaccccagcugca

SEQ ID NO: 3967580 - RNA, 14 nt, Human herpesvirus 4 (Epstein-Barr virus)
guaacaggugggac

SEQ ID NO: 3967581 - RNA, 18 nt, Human herpesvirus 4 (Epstein-Barr virus)
guacaggaccaugucggc

SEQ ID NO: 3967582 - RNA, 18 nt, Human herpesvirus 4 (Epstein-Barr virus)
guagccacccgucccggg

SEQ ID NO: 3967583 - RNA, 12 nt, Human herpesvirus 4 (Epstein-Barr virus)
guaugggggccc

SEQ ID NO: 3967584 - RNA, 13 nt, Human herpesvirus 4 (Epstein-Barr virus)
gucaagagcuucc

SEQ ID NO: 3967585 - RNA, 20 nt, Human herpesvirus 4 (Epstein-Barr virus)
gucaccagcuucgagagcca

SEQ ID NO: 3967586 - RNA, 14 nt, Human herpesvirus 4 (Epstein-Barr virus)
gucagaccugaaga

SEQ ID NO: 3967587 - RNA, 13 nt, Human herpesvirus 4 (Epstein-Barr virus)
gucaucuggcucu

SEQ ID NO: 3967588 - RNA, 21 nt, Human herpesvirus 4 (Epstein-Barr virus)
guccagcaggcucaggccgcc

SEQ ID NO: 3967589 - RNA, 14 nt, Human herpesvirus 4 (Epstein-Barr virus)
guccaggagaaggc

SEQ ID NO: 3967590 - RNA, 16 nt, Human herpesvirus 4 (Epstein-Barr virus)
guccaggggccacaca

SEQ ID NO: 3967591 - RNA, 13 nt, Human herpesvirus 4 (Epstein-Barr virus)
gucccccuagccc

SEQ ID NO: 3967592 - RNA, 15 nt, Human herpesvirus 4 (Epstein-Barr virus)
gucccuuuggaggac

SEQ ID NO: 3967593 - RNA, 14 nt, Human herpesvirus 4 (Epstein-Barr virus)
guccggucagguuu

SEQ ID NO: 3967594 - RNA, 15 nt, Human herpesvirus 4 (Epstein-Barr virus)
guccucauggcagga

SEQ ID NO: 3967595 - RNA, 16 nt, Human herpesvirus 4 (Epstein-Barr virus)
gucgcguacucugugg

SEQ ID NO: 3967596 - RNA, 15 nt, Human herpesvirus 4 (Epstein-Barr virus)
gucugcugccaugca

SEQ ID NO: 3967597 - RNA, 19 nt, Human herpesvirus 4 (Epstein-Barr virus)
gugaggccugagagccggg

SEQ ID NO: 3967598 - RNA, 17 nt, Human herpesvirus 4 (Epstein-Barr virus)
gugaguccagggcccug

SEQ ID NO: 3967599 - RNA, 18 nt, Human herpesvirus 4 (Epstein-Barr virus)
gugauggguggagaggcc

SEQ ID NO: 3967600 - RNA, 17 nt, Human herpesvirus 4 (Epstein-Barr virus)
gugcagggauugggcuu

SEQ ID NO: 3967601 - RNA, 13 nt, Human herpesvirus 4 (Epstein-Barr virus)
gugccuccagagc

SEQ ID NO: 3967602 - RNA, 13 nt, Human herpesvirus 4 (Epstein-Barr virus)
gugcguggucggg

SEQ ID NO: 3967603 - RNA, 19 nt, Human herpesvirus 4 (Epstein-Barr virus)
gugcugccugggggcuuug

SEQ ID NO: 3967604 - RNA, 21 nt, Human herpesvirus 4 (Epstein-Barr virus)
gugcugccugggggcuuuguu

SEQ ID NO: 3967605 - RNA, 21 nt, Human herpesvirus 4 (Epstein-Barr virus)
guggaaaaucucgcucagagc

SEQ ID NO: 3967606 - RNA, 17 nt, Human herpesvirus 4 (Epstein-Barr virus)
guggccgucuggcaggg

SEQ ID NO: 3967607 - RNA, 17 nt, Human herpesvirus 4 (Epstein-Barr virus)
guggccucuacgccagg

SEQ ID NO: 3967608 - RNA, 16 nt, Human herpesvirus 4 (Epstein-Barr virus)
gugggauggcggggcc

SEQ ID NO: 3967609 - RNA, 19 nt, Human herpesvirus 4 (Epstein-Barr virus)
gugggccucucuggcugug

SEQ ID NO: 3967610 - RNA, 21 nt, Human herpesvirus 4 (Epstein-Barr virus)
gugggcgcgugcacauauacc

SEQ ID NO: 3967611 - RNA, 22 nt, Human herpesvirus 4 (Epstein-Barr virus)
guggguuucugcccccugucuc

SEQ ID NO: 3967612 - RNA, 21 nt, Human herpesvirus 4 (Epstein-Barr virus)
gugguggcccucggugguggg

SEQ ID NO: 3967613 - RNA, 20 nt, Human herpesvirus 4 (Epstein-Barr virus)
gugguuuggggcaggccccc

SEQ ID NO: 3967614 - RNA, 14 nt, Human herpesvirus 4 (Epstein-Barr virus)
gugucaauaauuuc

SEQ ID NO: 3967615 - RNA, 13 nt, Human herpesvirus 4 (Epstein-Barr virus)
gugucuuggccag

SEQ ID NO: 3967616 - RNA, 21 nt, Human herpesvirus 4 (Epstein-Barr virus)
guugcauuggcugcaaaggga

SEQ ID NO: 3967617 - RNA, 14 nt, Human herpesvirus 4 (Epstein-Barr virus)
guuggauuggcugu

SEQ ID NO: 3967618 - RNA, 19 nt, Human herpesvirus 4 (Epstein-Barr virus)
guuuauggcauaaugggag

SEQ ID NO: 3967619 - RNA, 14 nt, Human herpesvirus 4 (Epstein-Barr virus)
guuucggacacacc

SEQ ID NO: 3967620 - RNA, 19 nt, Human herpesvirus 4 (Epstein-Barr virus)
guuucuguggcugccgaag

SEQ ID NO: 3967621 - RNA, 16 nt, Human herpesvirus 4 (Epstein-Barr virus)
guuuuaguguggcauu

SEQ ID NO: 3967622 - RNA, 16 nt, Human herpesvirus 4 (Epstein-Barr virus)
uaaauguuacuucuuu

SEQ ID NO: 3967623 - RNA, 23 nt, Human herpesvirus 4 (Epstein-Barr virus)
uaaauguuacuucuuuugcucuu

SEQ ID NO: 3967624 - RNA, 22 nt, Human herpesvirus 4 (Epstein-Barr virus)
uaacaagggaagagggaaaaga

SEQ ID NO: 3967625 - RNA, 13 nt, Human herpesvirus 4 (Epstein-Barr virus)
uaacaggacaugu

SEQ ID NO: 3967626 - RNA, 15 nt, Human herpesvirus 4 (Epstein-Barr virus)
uaacauuggcagcag

SEQ ID NO: 3967627 - RNA, 15 nt, Human herpesvirus 4 (Epstein-Barr virus)
uaaccuaugccugga

SEQ ID NO: 3967628 - RNA, 22 nt, Human herpesvirus 4 (Epstein-Barr virus)
uaacugugucccacuccaccug

SEQ ID NO: 3967629 - RNA, 17 nt, Human herpesvirus 4 (Epstein-Barr virus)
uaaggaacacggucugg

SEQ ID NO: 3967630 - RNA, 19 nt, Human herpesvirus 4 (Epstein-Barr virus)
uacaagaguucucugguga

SEQ ID NO: 3967631 - RNA, 19 nt, Human herpesvirus 4 (Epstein-Barr virus)
uacacugaauuuagccuga

SEQ ID NO: 3967632 - RNA, 23 nt, Human herpesvirus 4 (Epstein-Barr virus)
uacagcacaaccuuggacccugc

SEQ ID NO: 3967633 - RNA, 19 nt, Human herpesvirus 4 (Epstein-Barr virus)
uacccagaggaggacaugu

SEQ ID NO: 3967634 - RNA, 15 nt, Human herpesvirus 4 (Epstein-Barr virus)
uacccccuggccacc

SEQ ID NO: 3967635 - RNA, 17 nt, Human herpesvirus 4 (Epstein-Barr virus)
uacccucuuagggaggu

SEQ ID NO: 3967636 - RNA, 22 nt, Human herpesvirus 4 (Epstein-Barr virus)
uacuggcuuucguccucuggcu

SEQ ID NO: 3967637 - RNA, 18 nt, Human herpesvirus 4 (Epstein-Barr virus)
uagaaauuuugcauauuu

SEQ ID NO: 3967638 - RNA, 13 nt, Human herpesvirus 4 (Epstein-Barr virus)
uagcccccacgcu

SEQ ID NO: 3967639 - RNA, 19 nt, Human herpesvirus 4 (Epstein-Barr virus)
uagccguccuguccaagug

SEQ ID NO: 3967640 - RNA, 18 nt, Human herpesvirus 4 (Epstein-Barr virus)
uaggugccuccagagccc

SEQ ID NO: 3967641 - RNA, 10 nt, Human herpesvirus 4 (Epstein-Barr virus)
uaguuggagc

SEQ ID NO: 3967642 - RNA, 17 nt, Human herpesvirus 4 (Epstein-Barr virus)
uauaacugccagagcug

SEQ ID NO: 3967643 - RNA, 19 nt, Human herpesvirus 4 (Epstein-Barr virus)
uaugaaggcuggcaaagau

SEQ ID NO: 3967644 - RNA, 19 nt, Human herpesvirus 4 (Epstein-Barr virus)
uaugaugacgccgagaccu

SEQ ID NO: 3967645 - RNA, 15 nt, Human herpesvirus 4 (Epstein-Barr virus)
ucaaguaccagcugg

SEQ ID NO: 3967646 - RNA, 22 nt, Human herpesvirus 4 (Epstein-Barr virus)
ucaccugcacagaucugaccac

SEQ ID NO: 3967647 - RNA, 20 nt, Human herpesvirus 4 (Epstein-Barr virus)
ucacuuccucugcuuuucuc

SEQ ID NO: 3967648 - RNA, 12 nt, Human herpesvirus 4 (Epstein-Barr virus)
ucagcacuuugc

SEQ ID NO: 3967649 - RNA, 20 nt, Human herpesvirus 4 (Epstein-Barr virus)
ucagcaucaaugucaaggcu

SEQ ID NO: 3967650 - RNA, 19 nt, Human herpesvirus 4 (Epstein-Barr virus)
ucagccuugcccccgccag

SEQ ID NO: 3967651 - RNA, 19 nt, Human herpesvirus 4 (Epstein-Barr virus)
ucaucuauuagcagccucc

SEQ ID NO: 3967652 - RNA, 18 nt, Human herpesvirus 4 (Epstein-Barr virus)
ucaucuggcucuccugug

SEQ ID NO: 3967653 - RNA, 18 nt, Human herpesvirus 4 (Epstein-Barr virus)
ucaugcgugaccaccugg

SEQ ID NO: 3967654 - RNA, 21 nt, Human herpesvirus 4 (Epstein-Barr virus)
uccacagauggagagauuuca

SEQ ID NO: 3967655 - RNA, 15 nt, Human herpesvirus 4 (Epstein-Barr virus)
uccaccaccuucacc

SEQ ID NO: 3967656 - RNA, 19 nt, Human herpesvirus 4 (Epstein-Barr virus)
uccagacgcgauggcacac

SEQ ID NO: 3967657 - RNA, 21 nt, Human herpesvirus 4 (Epstein-Barr virus)
uccaggaucucccgcgccgca

SEQ ID NO: 3967658 - RNA, 20 nt, Human herpesvirus 4 (Epstein-Barr virus)
uccaugccaaugggggagga

SEQ ID NO: 3967659 - RNA, 13 nt, Human herpesvirus 4 (Epstein-Barr virus)
ucccaaguacaga

SEQ ID NO: 3967660 - RNA, 20 nt, Human herpesvirus 4 (Epstein-Barr virus)
ccguugugaccgccaccggc

SEQ ID NO: 3967661 - RNA, 17 nt, Human herpesvirus 4 (Epstein-Barr virus)
ccuaaugcauccgcacc

SEQ ID NO: 3967662 - RNA, 16 nt, Human herpesvirus 4 (Epstein-Barr virus)
ccuacucuccacggga

SEQ ID NO: 3967663 - RNA, 13 nt, Human herpesvirus 4 (Epstein-Barr virus)
ccuagccccgggc

SEQ ID NO: 3967664 - RNA, 17 nt, Human herpesvirus 4 (Epstein-Barr virus)
ccuaggagaaggagccu

SEQ ID NO: 3967665 - RNA, 13 nt, Human herpesvirus 4 (Epstein-Barr virus)
ccucaccaaggac

SEQ ID NO: 3967666 - RNA, 21 nt, Human herpesvirus 4 (Epstein-Barr virus)
ccucagagggggugccugugc

SEQ ID NO: 3967667 - RNA, 20 nt, Human herpesvirus 4 (Epstein-Barr virus)
ccucaucguucgguggggug

SEQ ID NO: 3967668 - RNA, 21 nt, Human herpesvirus 4 (Epstein-Barr virus)
ccuccacccagcagcagcccg

SEQ ID NO: 3967669 - RNA, 18 nt, Human herpesvirus 4 (Epstein-Barr virus)
ccuccgccgccgcagccg

SEQ ID NO: 3967670 - RNA, 16 nt, Human herpesvirus 4 (Epstein-Barr virus)
ccuccucugggccgcc

SEQ ID NO: 3967671 - RNA, 12 nt, Human herpesvirus 4 (Epstein-Barr virus)
ccuccuggccag

SEQ ID NO: 3967672 - RNA, 16 nt, Human herpesvirus 4 (Epstein-Barr virus)
ccucgcucagcccacu

SEQ ID NO: 3967673 - RNA, 19 nt, Human herpesvirus 4 (Epstein-Barr virus)
ccucggagaucaucccacu

SEQ ID NO: 3967674 - RNA, 13 nt, Human herpesvirus 4 (Epstein-Barr virus)
ccucggugguggg

SEQ ID NO: 3967675 - RNA, 12 nt, Human herpesvirus 4 (Epstein-Barr virus)
ccucugccuggc

SEQ ID NO: 3967676 - RNA, 17 nt, Human herpesvirus 4 (Epstein-Barr virus)
ccucuuccgugccucgg

SEQ ID NO: 3967677 - RNA, 20 nt, Human herpesvirus 4 (Epstein-Barr virus)
ccugaauccgcgcagccugu

SEQ ID NO: 3967678 - RNA, 21 nt, Human herpesvirus 4 (Epstein-Barr virus)
ccugacggugccgcuccuuug

SEQ ID NO: 3967679 - RNA, 15 nt, Human herpesvirus 4 (Epstein-Barr virus)
ccugcauggccaggc

SEQ ID NO: 3967680 - RNA, 15 nt, Human herpesvirus 4 (Epstein-Barr virus)
ccuggacgagggggc

SEQ ID NO: 3967681 - RNA, 21 nt, Human herpesvirus 4 (Epstein-Barr virus)
ccuggagagcaugcaggucag

SEQ ID NO: 3967682 - RNA, 15 nt, Human herpesvirus 4 (Epstein-Barr virus)
ccuggaucuggggcu

SEQ ID NO: 3967683 - RNA, 13 nt, Human herpesvirus 4 (Epstein-Barr virus)
ccuggccagggcg

SEQ ID NO: 3967684 - RNA, 13 nt, Human herpesvirus 4 (Epstein-Barr virus)
ccuggcgcuuugc

SEQ ID NO: 3967685 - RNA, 16 nt, Human herpesvirus 4 (Epstein-Barr virus)
ccuggcuccccauaga

SEQ ID NO: 3967686 - RNA, 19 nt, Human herpesvirus 4 (Epstein-Barr virus)
ccugggagggggcgagcag

SEQ ID NO: 3967687 - RNA, 21 nt, Human herpesvirus 4 (Epstein-Barr virus)
ccuggucaagagcuuccuggc

SEQ ID NO: 3967688 - RNA, 14 nt, Human herpesvirus 4 (Epstein-Barr virus)
ccugucggcccugc

SEQ ID NO: 3967689 - RNA, 21 nt, Human herpesvirus 4 (Epstein-Barr virus)
ccugucucuuucuggccaacc

SEQ ID NO: 3967690 - RNA, 19 nt, Human herpesvirus 4 (Epstein-Barr virus)
ccugucugacuuggccccu

SEQ ID NO: 3967691 - RNA, 22 nt, Human herpesvirus 4 (Epstein-Barr virus)
ccugugccucgucuaccucugu

SEQ ID NO: 3967692 - RNA, 14 nt, Human herpesvirus 4 (Epstein-Barr virus)
ccuguguccugggc

SEQ ID NO: 3967693 - RNA, 15 nt, Human herpesvirus 4 (Epstein-Barr virus)
ccuugagggcaaaga

SEQ ID NO: 3967694 - RNA, 20 nt, Human herpesvirus 4 (Epstein-Barr virus)
ccuuuaggcguaacuugucu

SEQ ID NO: 3967695 - RNA, 13 nt, Human herpesvirus 4 (Epstein-Barr virus)
ccuuugccugggg

SEQ ID NO: 3967696 - RNA, 15 nt, Human herpesvirus 4 (Epstein-Barr virus)
ccuuuggcuccuccu

SEQ ID NO: 3967697 - RNA, 19 nt, Human herpesvirus 4 (Epstein-Barr virus)
cgaagcagcuccgcccuca

SEQ ID NO: 3967698 - RNA, 19 nt, Human herpesvirus 4 (Epstein-Barr virus)
cgaagcucuuggucaaggu

SEQ ID NO: 3967699 - RNA, 15 nt, Human herpesvirus 4 (Epstein-Barr virus)
cgaaggugcagcugg

SEQ ID NO: 3967700 - RNA, 20 nt, Human herpesvirus 4 (Epstein-Barr virus)
cgacccccgggcgcccccaa

SEQ ID NO: 3967701 - RNA, 17 nt, Human herpesvirus 4 (Epstein-Barr virus)
cgaggacggggaagagg

SEQ ID NO: 3967702 - RNA, 14 nt, Human herpesvirus 4 (Epstein-Barr virus)
cgagggggccuggu

SEQ ID NO: 3967703 - RNA, 12 nt, Human herpesvirus 4 (Epstein-Barr virus)
cgaugcggagga

SEQ ID NO: 3967704 - RNA, 20 nt, Human herpesvirus 4 (Epstein-Barr virus)
cgcaccuguguccugggcaa

SEQ ID NO: 3967705 - RNA, 17 nt, Human herpesvirus 4 (Epstein-Barr virus)
cgcagccacguccagac

SEQ ID NO: 3967706 - RNA, 15 nt, Human herpesvirus 4 (Epstein-Barr virus)
cgcagguggcugcug

SEQ ID NO: 3967707 - RNA, 12 nt, Human herpesvirus 4 (Epstein-Barr virus)
cgccagccaccc

SEQ ID NO: 3967708 - RNA, 17 nt, Human herpesvirus 4 (Epstein-Barr virus)
cgccaugcucagggcca

SEQ ID NO: 3967709 - RNA, 11 nt, Human herpesvirus 4 (Epstein-Barr virus)
cgccccagggc

SEQ ID NO: 3967710 - RNA, 19 nt, Human herpesvirus 4 (Epstein-Barr virus)
cgcccugucaccaggccug

SEQ ID NO: 3967711 - RNA, 17 nt, Human herpesvirus 4 (Epstein-Barr virus)
cgcccugucccuggagc

SEQ ID NO: 3967712 - RNA, 19 nt, Human herpesvirus 4 (Epstein-Barr virus)
cgccugcggacucaggcca

SEQ ID NO: 3967713 - RNA, 17 nt, Human herpesvirus 4 (Epstein-Barr virus)
cgccugcuucacgccuc

SEQ ID NO: 3967714 - RNA, 11 nt, Human herpesvirus 4 (Epstein-Barr virus)
cgcgacugagg

SEQ ID NO: 3967715 - RNA, 14 nt, Human herpesvirus 4 (Epstein-Barr virus)
cgcggugguggccc

SEQ ID NO: 3967716 - RNA, 22 nt, Human herpesvirus 4 (Epstein-Barr virus)
cgcugauaaaguuguccugggc

SEQ ID NO: 3967717 - RNA, 11 nt, Human herpesvirus 4 (Epstein-Barr virus)
cgcugcaugca

SEQ ID NO: 3967718 - RNA, 18 nt, Human herpesvirus 4 (Epstein-Barr virus)
cggacuacguguccaugu

SEQ ID NO: 3967719 - RNA, 21 nt, Human herpesvirus 4 (Epstein-Barr virus)
cggaggacugcauccaacgcu

SEQ ID NO: 3967720 - RNA, 19 nt, Human herpesvirus 4 (Epstein-Barr virus)
cggcccuuugccuggggcu

SEQ ID NO: 3967721 - RNA, 22 nt, Human herpesvirus 4 (Epstein-Barr virus)
cggcgaugucggggcugcuggc

SEQ ID NO: 3967722 - RNA, 17 nt, Human herpesvirus 4 (Epstein-Barr virus)
cggcgcuugcgucugcc

SEQ ID NO: 3967723 - RNA, 13 nt, Human herpesvirus 4 (Epstein-Barr virus)
cggcggcugcugc

SEQ ID NO: 3967724 - RNA, 16 nt, Human herpesvirus 4 (Epstein-Barr virus)
cggcguggagcugggc

SEQ ID NO: 3967725 - RNA, 16 nt, Human herpesvirus 4 (Epstein-Barr virus)
cggcugcucccgccuc

SEQ ID NO: 3967726 - RNA, 16 nt, Human herpesvirus 4 (Epstein-Barr virus)
cgggaccgcgcccucc

SEQ ID NO: 3967727 - RNA, 22 nt, Human herpesvirus 4 (Epstein-Barr virus)
cgggcguugccagacuccgcca

SEQ ID NO: 3967728 - RNA, 16 nt, Human herpesvirus 4 (Epstein-Barr virus)
cggggagcggcaaggg

SEQ ID NO: 3967729 - RNA, 20 nt, Human herpesvirus 4 (Epstein-Barr virus)
cggggcuccccagccacagc

SEQ ID NO: 3967730 - RNA, 20 nt, Human herpesvirus 4 (Epstein-Barr virus)
cgggggcgacugccgccgcc

SEQ ID NO: 3967731 - RNA, 21 nt, Human herpesvirus 4 (Epstein-Barr virus)
cgggugcacacgcucagcuca

SEQ ID NO: 3967732 - RNA, 20 nt, Human herpesvirus 4 (Epstein-Barr virus)
cggugggaucaugaagcccc

SEQ ID NO: 3967733 - RNA, 12 nt, Human herpesvirus 4 (Epstein-Barr virus)
cgguguccaggu

SEQ ID NO: 3967734 - RNA, 12 nt, Human herpesvirus 4 (Epstein-Barr virus)
cgucaggagggc

SEQ ID NO: 3967735 - RNA, 19 nt, Human herpesvirus 4 (Epstein-Barr virus)
cgugaccaccuggccaggg

SEQ ID NO: 3967736 - RNA, 16 nt, Human herpesvirus 4 (Epstein-Barr virus)
cgugccauccucucgg

SEQ ID NO: 3967737 - RNA, 12 nt, Human herpesvirus 4 (Epstein-Barr virus)
cguggagcugga

SEQ ID NO: 3967738 - RNA, 14 nt, Human herpesvirus 4 (Epstein-Barr virus)
cguggcgccugggg

SEQ ID NO: 3967739 - RNA, 16 nt, Human herpesvirus 4 (Epstein-Barr virus)
cguggguccccucugc

SEQ ID NO: 3967740 - RNA, 18 nt, Human herpesvirus 4 (Epstein-Barr virus)
cgugguuuucugccccuc

SEQ ID NO: 3967741 - RNA, 14 nt, Human herpesvirus 4 (Epstein-Barr virus)
cguguggaagagga

SEQ ID NO: 3967742 - RNA, 16 nt, Human herpesvirus 4 (Epstein-Barr virus)
cguuaacauggacaug

SEQ ID NO: 3967743 - RNA, 15 nt, Human herpesvirus 4 (Epstein-Barr virus)
cuaacacgcaauaaa

SEQ ID NO: 3967744 - RNA, 16 nt, Human herpesvirus 4 (Epstein-Barr virus)
cuaaugccauagucac

SEQ ID NO: 3967745 - RNA, 17 nt, Human herpesvirus 4 (Epstein-Barr virus)
cuacaaccccuuccacg

SEQ ID NO: 3967746 - RNA, 21 nt, Human herpesvirus 4 (Epstein-Barr virus)
cuaccaggggcgagcagcgcg

SEQ ID NO: 3967747 - RNA, 15 nt, Human herpesvirus 4 (Epstein-Barr virus)
cuacgcgggccacag

SEQ ID NO: 3967748 - RNA, 21 nt, Human herpesvirus 4 (Epstein-Barr virus)
gaacugggaugaacccugggg

SEQ ID NO: 3967749 - RNA, 20 nt, Human herpesvirus 4 (Epstein-Barr virus)
gaagcagauagccggccagg

SEQ ID NO: 3967750 - RNA, 20 nt, Human herpesvirus 4 (Epstein-Barr virus)
gaagcuggccaggcugguga

SEQ ID NO: 3967751 - RNA, 20 nt, Human herpesvirus 4 (Epstein-Barr virus)
gaaggaggauggccuccagc

SEQ ID NO: 3967752 - RNA, 20 nt, Human herpesvirus 4 (Epstein-Barr virus)
gaaggcuccggcggcagugg

SEQ ID NO: 3967753 - RNA, 15 nt, Human herpesvirus 4 (Epstein-Barr virus)
gaaggcuugccaaaa

SEQ ID NO: 3967754 - RNA, 13 nt, Human herpesvirus 4 (Epstein-Barr virus)
gaagggcagggcu

SEQ ID NO: 3967755 - RNA, 12 nt, Human herpesvirus 4 (Epstein-Barr virus)
gaaucucugcca

SEQ ID NO: 3967756 - RNA, 21 nt, Human herpesvirus 4 (Epstein-Barr virus)
gacaaggcaguagaggacacc

SEQ ID NO: 3967757 - RNA, 20 nt, Human herpesvirus 4 (Epstein-Barr virus)
gacacccacccugcacacau

SEQ ID NO: 3967758 - RNA, 14 nt, Human herpesvirus 4 (Epstein-Barr virus)
gaccaaugccaaag

SEQ ID NO: 3967759 - RNA, 20 nt, Human herpesvirus 4 (Epstein-Barr virus)
gaccaccuacggcagccgcu

SEQ ID NO: 3967760 - RNA, 15 nt, Human herpesvirus 4 (Epstein-Barr virus)
gaccacggcccacgu

SEQ ID NO: 3967761 - RNA, 12 nt, Human herpesvirus 4 (Epstein-Barr virus)
gaccacugaggg

SEQ ID NO: 3967762 - RNA, 18 nt, Human herpesvirus 4 (Epstein-Barr virus)
gaccuguugucccugaga

SEQ ID NO: 3967763 - RNA, 21 nt, Human herpesvirus 4 (Epstein-Barr virus)
gacgcagaaugugcagggauu

SEQ ID NO: 3967764 - RNA, 19 nt, Human herpesvirus 4 (Epstein-Barr virus)
gacucccauguaagccugc

SEQ ID NO: 3967765 - RNA, 22 nt, Human herpesvirus 4 (Epstein-Barr virus)
gacugugguauccaccuagaaa

SEQ ID NO: 3967766 - RNA, 22 nt, Human herpesvirus 4 (Epstein-Barr virus)
gacuuuauacauaggucucggc

SEQ ID NO: 3967767 - RNA, 18 nt, Human herpesvirus 4 (Epstein-Barr virus)
gagacacaucuggaccag

SEQ ID NO: 3967768 - RNA, 21 nt, Human herpesvirus 4 (Epstein-Barr virus)
gagcaccggagccaccacagc

SEQ ID NO: 3967769 - RNA, 22 nt, Human herpesvirus 4 (Epstein-Barr virus)
gagcagauuuccgucagccagg

SEQ ID NO: 3967770 - RNA, 15 nt, Human herpesvirus 4 (Epstein-Barr virus)
gagcaugcaggucag

SEQ ID NO: 3967771 - RNA, 14 nt, Human herpesvirus 4 (Epstein-Barr virus)
gaggacgugaguga

SEQ ID NO: 3967772 - RNA, 14 nt, Human herpesvirus 4 (Epstein-Barr virus)
gaggccgagcaggg

SEQ ID NO: 3967773 - RNA, 16 nt, Human herpesvirus 4 (Epstein-Barr virus)
gagggcacggcaaggc

SEQ ID NO: 3967774 - RNA, 12 nt, Human herpesvirus 4 (Epstein-Barr virus)
gaggggcaggag

SEQ ID NO: 3967775 - RNA, 11 nt, Human herpesvirus 4 (Epstein-Barr virus)
gaggggggcag

SEQ ID NO: 3967776 - RNA, 21 nt, Human herpesvirus 4 (Epstein-Barr virus)
gagguccuggacgagggggcg

SEQ ID NO: 3967777 - RNA, 15 nt, Human herpesvirus 4 (Epstein-Barr virus)
gaguaauugcagugg

SEQ ID NO: 3967778 - RNA, 20 nt, Human herpesvirus 4 (Epstein-Barr virus)
gaguccccuccuuggagcug

SEQ ID NO: 3967779 - RNA, 17 nt, Human herpesvirus 4 (Epstein-Barr virus)
gagucugcuggacuccg

SEQ ID NO: 3967780 - RNA, 16 nt, Human herpesvirus 4 (Epstein-Barr virus)
gaguucucuagcaggu

SEQ ID NO: 3967781 - RNA, 14 nt, Human herpesvirus 4 (Epstein-Barr virus)
gauagauagccacc

SEQ ID NO: 3967782 - RNA, 16 nt, Human herpesvirus 4 (Epstein-Barr virus)
gauagcauggccgcca

SEQ ID NO: 3967783 - RNA, 18 nt, Human herpesvirus 4 (Epstein-Barr virus)
gauagugaacguggaggu

SEQ ID NO: 3967784 - RNA, 21 nt, Human herpesvirus 4 (Epstein-Barr virus)
gaucacuacuacaccgagcag

SEQ ID NO: 3967785 - RNA, 23 nt, Human herpesvirus 4 (Epstein-Barr virus)
gauccagggcccguuccaggcuc

SEQ ID NO: 3967786 - RNA, 17 nt, Human herpesvirus 4 (Epstein-Barr virus)
gaugacgccgagaccua

SEQ ID NO: 3967787 - RNA, 16 nt, Human herpesvirus 4 (Epstein-Barr virus)
gaugcaacagaggauu

SEQ ID NO: 3967788 - RNA, 15 nt, Human herpesvirus 4 (Epstein-Barr virus)
gaugcagcgcaucag

SEQ ID NO: 3967789 - RNA, 16 nt, Human herpesvirus 4 (Epstein-Barr virus)
gaugcaggaccuagaa

SEQ ID NO: 3967790 - RNA, 18 nt, Human herpesvirus 4 (Epstein-Barr virus)
gaugcauacgcugaguga

SEQ ID NO: 3967791 - RNA, 18 nt, Human herpesvirus 4 (Epstein-Barr virus)
gaugccucuacgccccag

SEQ ID NO: 3967792 - RNA, 16 nt, Human herpesvirus 4 (Epstein-Barr virus)
gauggaaagggcaugu

SEQ ID NO: 3967793 - RNA, 16 nt, Human herpesvirus 4 (Epstein-Barr virus)
gauggcaaagguccca

SEQ ID NO: 3967794 - RNA, 15 nt, Human herpesvirus 4 (Epstein-Barr virus)
gauggcccugaucug

SEQ ID NO: 3967795 - RNA, 13 nt, Human herpesvirus 4 (Epstein-Barr virus)
gcaaaagauggac

SEQ ID NO: 3967796 - RNA, 21 nt, Human herpesvirus 4 (Epstein-Barr virus)
gcaacccccggcucucaggcc

SEQ ID NO: 3967797 - RNA, 13 nt, Human herpesvirus 4 (Epstein-Barr virus)
gcaagcagcaccu

SEQ ID NO: 3967798 - RNA, 14 nt, Human herpesvirus 4 (Epstein-Barr virus)
gcacaggaugacag

SEQ ID NO: 3967799 - RNA, 22 nt, Human herpesvirus 4 (Epstein-Barr virus)
gcaccaacaacgaucccaggcc

SEQ ID NO: 3967800 - RNA, 20 nt, Human herpesvirus 4 (Epstein-Barr virus)
gcaccgauagcauggccgcc

SEQ ID NO: 3967801 - RNA, 15 nt, Human herpesvirus 4 (Epstein-Barr virus)
gcaccugucccuggg

SEQ ID NO: 3967802 - RNA, 17 nt, Human herpesvirus 4 (Epstein-Barr virus)
gcacgagaccccugggc

SEQ ID NO: 3967803 - RNA, 18 nt, Human herpesvirus 4 (Epstein-Barr virus)
gcacgagaccccugggcu

SEQ ID NO: 3967804 - RNA, 15 nt, Human herpesvirus 4 (Epstein-Barr virus)
gcacggcccuccagc

SEQ ID NO: 3967805 - RNA, 19 nt, Human herpesvirus 4 (Epstein-Barr virus)
gcacuuuauuaauaaacaa

SEQ ID NO: 3967806 - RNA, 18 nt, Human herpesvirus 4 (Epstein-Barr virus)
gcagaaaggcuggccgug

SEQ ID NO: 3967807 - RNA, 20 nt, Human herpesvirus 4 (Epstein-Barr virus)
gcagaaucaccagagcccag

SEQ ID NO: 3967808 - RNA, 15 nt, Human herpesvirus 4 (Epstein-Barr virus)
gcagaugaggccccu

SEQ ID NO: 3967809 - RNA, 23 nt, Human herpesvirus 4 (Epstein-Barr virus)
gcagcagacaaggacaggugcca

SEQ ID NO: 3967810 - RNA, 13 nt, Human herpesvirus 4 (Epstein-Barr virus)
gcagccagagcca

SEQ ID NO: 3967811 - RNA, 22 nt, Human herpesvirus 4 (Epstein-Barr virus)
gcagccgcggccaucaccuggg

SEQ ID NO: 3967812 - RNA, 17 nt, Human herpesvirus 4 (Epstein-Barr virus)
gcagcugaguccccucc

SEQ ID NO: 3967813 - RNA, 15 nt, Human herpesvirus 4 (Epstein-Barr virus)
gcagcuucuccagcg

SEQ ID NO: 3967814 - RNA, 20 nt, Human herpesvirus 4 (Epstein-Barr virus)
gcaggccccccgcaccaggg

SEQ ID NO: 3967815 - RNA, 15 nt, Human herpesvirus 4 (Epstein-Barr virus)
gcaguccaggggcca

SEQ ID NO: 3967816 - RNA, 12 nt, Human herpesvirus 4 (Epstein-Barr virus)
gcauccuaggca

SEQ ID NO: 3967817 - RNA, 20 nt, Human herpesvirus 4 (Epstein-Barr virus)
gcaugcuuagugccccccuu

SEQ ID NO: 3967818 - RNA, 12 nt, Human herpesvirus 4 (Epstein-Barr virus)
gcauggccuggg

SEQ ID NO: 3967819 - RNA, 14 nt, Human herpesvirus 4 (Epstein-Barr virus)
gcauggcggccugg

SEQ ID NO: 3967820 - RNA, 18 nt, Human herpesvirus 4 (Epstein-Barr virus)
gcauuacaccaucccaug

SEQ ID NO: 3967821 - RNA, 20 nt, Human herpesvirus 4 (Epstein-Barr virus)
gcauuuuuggugcugccugg

SEQ ID NO: 3967822 - RNA, 18 nt, Human herpesvirus 4 (Epstein-Barr virus)
gccaaccugcucucucug

SEQ ID NO: 3967823 - RNA, 20 nt, Human herpesvirus 4 (Epstein-Barr virus)
gccaaccugcucucucugga

SEQ ID NO: 3967824 - RNA, 21 nt, Human herpesvirus 4 (Epstein-Barr virus)
gccaaccugcucucucuggag

SEQ ID NO: 3967825 - RNA, 22 nt, Human herpesvirus 4 (Epstein-Barr virus)
gccaauccaugccaauggggga

SEQ ID NO: 3967826 - RNA, 20 nt, Human herpesvirus 4 (Epstein-Barr virus)
gccaauuggggugauccugu

SEQ ID NO: 3967827 - RNA, 16 nt, Human herpesvirus 4 (Epstein-Barr virus)
gccacagagcaucaga

SEQ ID NO: 3967828 - RNA, 13 nt, Human herpesvirus 4 (Epstein-Barr virus)
gccacauagcagg

SEQ ID NO: 3967829 - RNA, 17 nt, Human herpesvirus 4 (Epstein-Barr virus)
gccacgcaggauguuca

SEQ ID NO: 3967830 - RNA, 19 nt, Human herpesvirus 4 (Epstein-Barr virus)
gccacguccccggccuccc

SEQ ID NO: 3967831 - RNA, 16 nt, Human herpesvirus 4 (Epstein-Barr virus)
gccaggcuggugacaa

SEQ ID NO: 3967832 - RNA, 12 nt, Human herpesvirus 4 (Epstein-Barr virus)
gccauggccaau

SEQ ID NO: 3967833 - RNA, 22 nt, Human herpesvirus 4 (Epstein-Barr virus)
gccauggugccaagcucagccc

SEQ ID NO: 3967834 - RNA, 19 nt, Human herpesvirus 4 (Epstein-Barr virus)
gcccagccguucacucggc

SEQ ID NO: 3967835 - RNA, 17 nt, Human herpesvirus 4 (Epstein-Barr virus)
gccccgggcccagcccu

SEQ ID NO: 3967836 - RNA, 17 nt, Human herpesvirus 4 (Epstein-Barr virus)
ggcuacaacaggcugcu

SEQ ID NO: 3967837 - RNA, 18 nt, Human herpesvirus 4 (Epstein-Barr virus)
ggcucggggcuggggaga

SEQ ID NO: 3967838 - RNA, 13 nt, Human herpesvirus 4 (Epstein-Barr virus)
ggcugcuggcggc

SEQ ID NO: 3967839 - RNA, 11 nt, Human herpesvirus 4 (Epstein-Barr virus)
ggcuggccgug

SEQ ID NO: 3967840 - RNA, 19 nt, Human herpesvirus 4 (Epstein-Barr virus)
gggaacacccccaccccac

SEQ ID NO: 3967841 - RNA, 16 nt, Human herpesvirus 4 (Epstein-Barr virus)
gggaauaaucaaccug

SEQ ID NO: 3967842 - RNA, 20 nt, Human herpesvirus 4 (Epstein-Barr virus)
gggaucaugaagcccccagg

SEQ ID NO: 3967843 - RNA, 17 nt, Human herpesvirus 4 (Epstein-Barr virus)
gggcagagaggcgggaa

SEQ ID NO: 3967844 - RNA, 21 nt, Human herpesvirus 4 (Epstein-Barr virus)
gggcccagagugcuccggcug

SEQ ID NO: 3967845 - RNA, 18 nt, Human herpesvirus 4 (Epstein-Barr virus)
gggccugagacuggaccc

SEQ ID NO: 3967846 - RNA, 19 nt, Human herpesvirus 4 (Epstein-Barr virus)
gggcuccauguccuguggu

SEQ ID NO: 3967847 - RNA, 23 nt, Human herpesvirus 4 (Epstein-Barr virus)
ggggguggaggcugcgccugagc

SEQ ID NO: 3967848 - RNA, 20 nt, Human herpesvirus 4 (Epstein-Barr virus)
gggguccggucuugcaggga

SEQ ID NO: 3967849 - RNA, 13 nt, Human herpesvirus 4 (Epstein-Barr virus)
gggucucaggccu

SEQ ID NO: 3967850 - RNA, 18 nt, Human herpesvirus 4 (Epstein-Barr virus)
gggugaggcccagccccc

SEQ ID NO: 3967851 - RNA, 12 nt, Human herpesvirus 4 (Epstein-Barr virus)
gggugggugcaa

SEQ ID NO: 3967852 - RNA, 16 nt, Human herpesvirus 4 (Epstein-Barr virus)
gguagauggcgagacu

SEQ ID NO: 3967853 - RNA, 19 nt, Human herpesvirus 4 (Epstein-Barr virus)
ggucacagaccagccccuc

SEQ ID NO: 3967854 - RNA, 16 nt, Human herpesvirus 4 (Epstein-Barr virus)
ggucagacggccgcgc

SEQ ID NO: 3967855 - RNA, 19 nt, Human herpesvirus 4 (Epstein-Barr virus)
ggucagugauggaaagguu

SEQ ID NO: 3967856 - RNA, 21 nt, Human herpesvirus 4 (Epstein-Barr virus)
gguccuggacgagggggcgcg

SEQ ID NO: 3967857 - RNA, 17 nt, Human herpesvirus 4 (Epstein-Barr virus)
gguccuguuccggggcg

SEQ ID NO: 3967858 - RNA, 18 nt, Human herpesvirus 4 (Epstein-Barr virus)
ggucgucaucuggcucuc

SEQ ID NO: 3967859 - RNA, 16 nt, Human herpesvirus 4 (Epstein-Barr virus)
gguggcaguauuuugc

SEQ ID NO: 3967860 - RNA, 20 nt, Human herpesvirus 4 (Epstein-Barr virus)
gguggcauugcggguggaua

SEQ ID NO: 3967861 - RNA, 23 nt, Human herpesvirus 4 (Epstein-Barr virus)
ggugggaucaugaagcccccagg

SEQ ID NO: 3967862 - RNA, 20 nt, Human herpesvirus 4 (Epstein-Barr virus)
guaaggccgcugccaggccg

SEQ ID NO: 3967863 - RNA, 16 nt, Human herpesvirus 4 (Epstein-Barr virus)
guacaggaccuggaaa

SEQ ID NO: 3967864 - RNA, 13 nt, Human herpesvirus 4 (Epstein-Barr virus)
guaccagaagagu

SEQ ID NO: 3967865 - RNA, 15 nt, Human herpesvirus 4 (Epstein-Barr virus)
guaccagcugguggu

SEQ ID NO: 3967866 - RNA, 23 nt, Human herpesvirus 4 (Epstein-Barr virus)
guacugcagugggccucucuggc

SEQ ID NO: 3967867 - RNA, 16 nt, Human herpesvirus 4 (Epstein-Barr virus)
guagccccuaggccug

SEQ ID NO: 3967868 - RNA, 13 nt, Human herpesvirus 4 (Epstein-Barr virus)
guauugcagcugg

SEQ ID NO: 3967869 - RNA, 22 nt, Human herpesvirus 4 (Epstein-Barr virus)
gucaaacaggugagucagccuu

SEQ ID NO: 3967870 - RNA, 16 nt, Human herpesvirus 4 (Epstein-Barr virus)
gucaucagccgcugcg

SEQ ID NO: 3967871 - RNA, 17 nt, Human herpesvirus 4 (Epstein-Barr virus)
gucauccgaggcugaga

SEQ ID NO: 3967872 - RNA, 22 nt, Human herpesvirus 4 (Epstein-Barr virus)
gucaugacaauuuuagaugagg

SEQ ID NO: 3967873 - RNA, 17 nt, Human herpesvirus 4 (Epstein-Barr virus)
gucccaggccuuagccc

SEQ ID NO: 3967874 - RNA, 11 nt, Human herpesvirus 4 (Epstein-Barr virus)
guccccucugc

SEQ ID NO: 3967875 - RNA, 19 nt, Human herpesvirus 4 (Epstein-Barr virus)
guccgugagagccuaccca

SEQ ID NO: 3967876 - RNA, 11 nt, Human herpesvirus 4 (Epstein-Barr virus)
guccucuggac

SEQ ID NO: 3967877 - RNA, 14 nt, Human herpesvirus 4 (Epstein-Barr virus)
guccucuggcucuc

SEQ ID NO: 3967878 - RNA, 15 nt, Human herpesvirus 4 (Epstein-Barr virus)
gucgcguagcucugg

SEQ ID NO: 3967879 - RNA, 19 nt, Human herpesvirus 4 (Epstein-Barr virus)
gucuccccucugcagagag

SEQ ID NO: 3967880 - RNA, 23 nt, Human herpesvirus 4 (Epstein-Barr virus)
gucucgccgcuaguugguccagg

SEQ ID NO: 3967881 - RNA, 19 nt, Human herpesvirus 4 (Epstein-Barr virus)
gucucucuuugagggggcc

SEQ ID NO: 3967882 - RNA, 14 nt, Human herpesvirus 4 (Epstein-Barr virus)
gucuuugccaaccu

SEQ ID NO: 3967883 - RNA, 17 nt, Human herpesvirus 4 (Epstein-Barr virus)
gugaagggcagggcucg

SEQ ID NO: 3967884 - RNA, 14 nt, Human herpesvirus 4 (Epstein-Barr virus)
gugacauguccggg

SEQ ID NO: 3967885 - RNA, 18 nt, Human herpesvirus 4 (Epstein-Barr virus)
gugaccggacgggucuca

SEQ ID NO: 3967886 - RNA, 16 nt, Human herpesvirus 4 (Epstein-Barr virus)
gugagcccaccugucu

SEQ ID NO: 3967887 - RNA, 22 nt, Human herpesvirus 4 (Epstein-Barr virus)
gugaggacggugucugugguug

SEQ ID NO: 3967888 - RNA, 20 nt, Human herpesvirus 4 (Epstein-Barr virus)
gugaggcuauaacgcagguc

SEQ ID NO: 3967889 - RNA, 15 nt, Human herpesvirus 4 (Epstein-Barr virus)
gugaucauggaaacc

SEQ ID NO: 3967890 - RNA, 14 nt, Human herpesvirus 4 (Epstein-Barr virus)
gugcagggggcucg

SEQ ID NO: 3967891 - RNA, 13 nt, Human herpesvirus 4 (Epstein-Barr virus)
gugccagaggccc

SEQ ID NO: 3967892 - RNA, 17 nt, Human herpesvirus 4 (Epstein-Barr virus)
gugccagaugugccugg

SEQ ID NO: 3967893 - RNA, 12 nt, Human herpesvirus 4 (Epstein-Barr virus)
gugcccccacca

SEQ ID NO: 3967894 - RNA, 22 nt, Human herpesvirus 4 (Epstein-Barr virus)
gugccuaaacgugauggugcug

SEQ ID NO: 3967895 - RNA, 22 nt, Human herpesvirus 4 (Epstein-Barr virus)
guggacaaggcaguagaggaca

SEQ ID NO: 3967896 - RNA, 11 nt, Human herpesvirus 4 (Epstein-Barr virus)
guggccaggcc

SEQ ID NO: 3967897 - RNA, 20 nt, Human herpesvirus 4 (Epstein-Barr virus)
guggcuacuugcucagguuu

SEQ ID NO: 3967898 - RNA, 21 nt, Human herpesvirus 4 (Epstein-Barr virus)
gugggccucucuggcugugcu

SEQ ID NO: 3967899 - RNA, 18 nt, Human herpesvirus 4 (Epstein-Barr virus)
gugggcuucgggggccug

SEQ ID NO: 3967900 - RNA, 13 nt, Human herpesvirus 4 (Epstein-Barr virus)
guggugggcucug

SEQ ID NO: 3967901 - RNA, 14 nt, Human herpesvirus 4 (Epstein-Barr virus)
gugucuucugucuc

SEQ ID NO: 3967902 - RNA, 14 nt, Human herpesvirus 4 (Epstein-Barr virus)
gugugcgcgccgcc

SEQ ID NO: 3967903 - RNA, 12 nt, Human herpesvirus 4 (Epstein-Barr virus)
guucuccugauu

SEQ ID NO: 3967904 - RNA, 22 nt, Human herpesvirus 4 (Epstein-Barr virus)
guuguagguguccagcgcucug

SEQ ID NO: 3967905 - RNA, 16 nt, Human herpesvirus 4 (Epstein-Barr virus)
uaaagaaugcccacca

SEQ ID NO: 3967906 - RNA, 14 nt, Human herpesvirus 4 (Epstein-Barr virus)
uaaauaaacucauc

SEQ ID NO: 3967907 - RNA, 15 nt, Human herpesvirus 4 (Epstein-Barr virus)
uaaccauggacgagg

SEQ ID NO: 3967908 - RNA, 13 nt, Human herpesvirus 4 (Epstein-Barr virus)
uaaccugucuacu

SEQ ID NO: 3967909 - RNA, 15 nt, Human herpesvirus 4 (Epstein-Barr virus)
uaacucuuaaaacuu

SEQ ID NO: 3967910 - RNA, 15 nt, Human herpesvirus 4 (Epstein-Barr virus)
uaacugccagagcug

SEQ ID NO: 3967911 - RNA, 14 nt, Human herpesvirus 4 (Epstein-Barr virus)
uaacuugucuacau

SEQ ID NO: 3967912 - RNA, 13 nt, Human herpesvirus 4 (Epstein-Barr virus)
uaaggcuguugac

SEQ ID NO: 3967913 - RNA, 12 nt, Human herpesvirus 4 (Epstein-Barr virus)
uaaucuggaugu

SEQ ID NO: 3967914 - RNA, 20 nt, Human herpesvirus 4 (Epstein-Barr virus)
uacaccgucaacagauuucc

SEQ ID NO: 3967915 - RNA, 17 nt, Human herpesvirus 4 (Epstein-Barr virus)
uacaucccauaccuaca

SEQ ID NO: 3967916 - RNA, 19 nt, Human herpesvirus 4 (Epstein-Barr virus)
uacaucccauaccuacacc

SEQ ID NO: 3967917 - RNA, 19 nt, Human herpesvirus 4 (Epstein-Barr virus)
uaccgccacgcgucagcaa

SEQ ID NO: 3967918 - RNA, 20 nt, Human herpesvirus 4 (Epstein-Barr virus)
uacgaggcccuggcccaccg

SEQ ID NO: 3967919 - RNA, 23 nt, Human herpesvirus 4 (Epstein-Barr virus)
uacucuccgccguuccuucagaa

SEQ ID NO: 3967920 - RNA, 22 nt, Human herpesvirus 4 (Epstein-Barr virus)
uacucuuggcagcaguggccag

SEQ ID NO: 3967921 - RNA, 16 nt, Human herpesvirus 4 (Epstein-Barr virus)
uacuuucaagccacgc

SEQ ID NO: 3967922 - RNA, 22 nt, Human herpesvirus 4 (Epstein-Barr virus)
uagaaacuaugcaugagccaca

SEQ ID NO: 3967923 - RNA, 17 nt, Human herpesvirus 4 (Epstein-Barr virus)
uagaaugacagccuggu

SEQ ID NO: 3967924 - RNA, 17 nt, Human herpesvirus 4 (Epstein-Barr virus)
aacaucucauccccaga

SEQ ID NO: 3967925 - RNA, 22 nt, Human herpesvirus 4 (Epstein-Barr virus)
aacauguccuguuagcuggugc

SEQ ID NO: 3967926 - RNA, 16 nt, Human herpesvirus 4 (Epstein-Barr virus)
aaccaugccaucucug

SEQ ID NO: 3967927 - RNA, 12 nt, Human herpesvirus 4 (Epstein-Barr virus)
aacccccucccc

SEQ ID NO: 3967928 - RNA, 13 nt, Human herpesvirus 4 (Epstein-Barr virus)
aaccugcucucuc

SEQ ID NO: 3967929 - RNA, 19 nt, Human herpesvirus 4 (Epstein-Barr virus)
aacgaucccaggccucagc

SEQ ID NO: 3967930 - RNA, 22 nt, Human herpesvirus 4 (Epstein-Barr virus)
aacgcccagggacauccccaga

SEQ ID NO: 3967931 - RNA, 20 nt, Human herpesvirus 4 (Epstein-Barr virus)
aacuggccaugcaggccugg

SEQ ID NO: 3967932 - RNA, 21 nt, Human herpesvirus 4 (Epstein-Barr virus)
aacuggccaugcaggccugga

SEQ ID NO: 3967933 - RNA, 14 nt, Human herpesvirus 4 (Epstein-Barr virus)
aacuucagcuccag

SEQ ID NO: 3967934 - RNA, 15 nt, Human herpesvirus 4 (Epstein-Barr virus)
aacuuuguccagaug

SEQ ID NO: 3967935 - RNA, 19 nt, Human herpesvirus 4 (Epstein-Barr virus)
aagacuccugccugaauca

SEQ ID NO: 3967936 - RNA, 16 nt, Human herpesvirus 4 (Epstein-Barr virus)
aagagcuuccuggccg

SEQ ID NO: 3967937 - RNA, 18 nt, Human herpesvirus 4 (Epstein-Barr virus)
aagaucgugaggccugag

SEQ ID NO: 3967938 - RNA, 16 nt, Human herpesvirus 4 (Epstein-Barr virus)
aagcaaacggccuggc

SEQ ID NO: 3967939 - RNA, 15 nt, Human herpesvirus 4 (Epstein-Barr virus)
aagcuggccaggcug

SEQ ID NO: 3967940 - RNA, 15 nt, Human herpesvirus 4 (Epstein-Barr virus)
aaggcaguccagggg

SEQ ID NO: 3967941 - RNA, 21 nt, Human herpesvirus 4 (Epstein-Barr virus)
aaggcaguccaggggccacac

SEQ ID NO: 3967942 - RNA, 17 nt, Human herpesvirus 4 (Epstein-Barr virus)
aaggcuccggccccacg

SEQ ID NO: 3967943 - RNA, 22 nt, Human herpesvirus 4 (Epstein-Barr virus)
aaggcucuucgggcaagaugga

SEQ ID NO: 3967944 - RNA, 23 nt, Human herpesvirus 4 (Epstein-Barr virus)
aagucccgggggaggagaagaga

SEQ ID NO: 3967945 - RNA, 18 nt, Human herpesvirus 4 (Epstein-Barr virus)
aagucuauacggccacaa

SEQ ID NO: 3967946 - RNA, 12 nt, Human herpesvirus 4 (Epstein-Barr virus)
aauaaaguugau

SEQ ID NO: 3967947 - RNA, 15 nt, Human herpesvirus 4 (Epstein-Barr virus)
aaucucgcucagagc

SEQ ID NO: 3967948 - RNA, 22 nt, Human herpesvirus 4 (Epstein-Barr virus)
aaugggacgucuuguaaaacuu

SEQ ID NO: 3967949 - RNA, 13 nt, Human herpesvirus 4 (Epstein-Barr virus)
aauucagaccuga

SEQ ID NO: 3967950 - RNA, 23 nt, Human herpesvirus 4 (Epstein-Barr virus)
acaccagauguuuuacacgagga

SEQ ID NO: 3967951 - RNA, 20 nt, Human herpesvirus 4 (Epstein-Barr virus)
acacgggccuggggccauag

SEQ ID NO: 3967952 - RNA, 18 nt, Human herpesvirus 4 (Epstein-Barr virus)
acacgggggugcccccac

SEQ ID NO: 3967953 - RNA, 16 nt, Human herpesvirus 4 (Epstein-Barr virus)
acagcgccagcagggc

SEQ ID NO: 3967954 - RNA, 22 nt, Human herpesvirus 4 (Epstein-Barr virus)
acagcuagcagacauugguguu

SEQ ID NO: 3967955 - RNA, 16 nt, Human herpesvirus 4 (Epstein-Barr virus)
acaucugggaguguag

SEQ ID NO: 3967956 - RNA, 16 nt, Human herpesvirus 4 (Epstein-Barr virus)
acccccacccuucgcc

SEQ ID NO: 3967957 - RNA, 20 nt, Human herpesvirus 4 (Epstein-Barr virus)
acccuguacaccccgaccca

SEQ ID NO: 3967958 - RNA, 21 nt, Human herpesvirus 4 (Epstein-Barr virus)
acccuguagucaccugcacag

SEQ ID NO: 3967959 - RNA, 20 nt, Human herpesvirus 4 (Epstein-Barr virus)
accgccucuacccuccccau

SEQ ID NO: 3967960 - RNA, 16 nt, Human herpesvirus 4 (Epstein-Barr virus)
accggcgcgggagccg

SEQ ID NO: 3967961 - RNA, 16 nt, Human herpesvirus 4 (Epstein-Barr virus)
accggggaggccaggu

SEQ ID NO: 3967962 - RNA, 15 nt, Human herpesvirus 4 (Epstein-Barr virus)
accugcacagaucug

SEQ ID NO: 3967963 - RNA, 22 nt, Human herpesvirus 4 (Epstein-Barr virus)
accugucucucuuugagggggc

SEQ ID NO: 3967964 - RNA, 13 nt, Human herpesvirus 4 (Epstein-Barr virus)
acgagaaggagga

SEQ ID NO: 3967965 - RNA, 12 nt, Human herpesvirus 4 (Epstein-Barr virus)
acgaugacuccc

SEQ ID NO: 3967966 - RNA, 16 nt, Human herpesvirus 4 (Epstein-Barr virus)
acgcuuccacccccug

SEQ ID NO: 3967967 - RNA, 21 nt, Human herpesvirus 4 (Epstein-Barr virus)
acggccucaaaggccucggcg

SEQ ID NO: 3967968 - RNA, 16 nt, Human herpesvirus 4 (Epstein-Barr virus)
acggggugcucccccu

SEQ ID NO: 3967969 - RNA, 15 nt, Human herpesvirus 4 (Epstein-Barr virus)
acguccaccccaccc

SEQ ID NO: 3967970 - RNA, 15 nt, Human herpesvirus 4 (Epstein-Barr virus)
acgugcaaggaugga

SEQ ID NO: 3967971 - RNA, 13 nt, Human herpesvirus 4 (Epstein-Barr virus)
acucaggcacggu

SEQ ID NO: 3967972 - RNA, 15 nt, Human herpesvirus 4 (Epstein-Barr virus)
acucggccacacagu

SEQ ID NO: 3967973 - RNA, 23 nt, Human herpesvirus 4 (Epstein-Barr virus)
acucugcauggagaagcuggacg

SEQ ID NO: 3967974 - RNA, 14 nt, Human herpesvirus 4 (Epstein-Barr virus)
acucuuaaaacuug

SEQ ID NO: 3967975 - RNA, 13 nt, Human herpesvirus 4 (Epstein-Barr virus)
acugacacacagg

SEQ ID NO: 3967976 - RNA, 15 nt, Human herpesvirus 4 (Epstein-Barr virus)
acugcagugggccuc

SEQ ID NO: 3967977 - RNA, 17 nt, Human herpesvirus 4 (Epstein-Barr virus)
acugccuuguccacugg

SEQ ID NO: 3967978 - RNA, 13 nt, Human herpesvirus 4 (Epstein-Barr virus)
acugcgagggggc

SEQ ID NO: 3967979 - RNA, 15 nt, Human herpesvirus 4 (Epstein-Barr virus)
acugcgagggggccu

SEQ ID NO: 3967980 - RNA, 15 nt, Human herpesvirus 4 (Epstein-Barr virus)
acugcgaucuggacc

SEQ ID NO: 3967981 - RNA, 14 nt, Human herpesvirus 4 (Epstein-Barr virus)
acugcgaugagggc

SEQ ID NO: 3967982 - RNA, 18 nt, Human herpesvirus 4 (Epstein-Barr virus)
acugcguccaccuggcca

SEQ ID NO: 3967983 - RNA, 23 nt, Human herpesvirus 4 (Epstein-Barr virus)
acuggaugcaggaccuagaaugu

SEQ ID NO: 3967984 - RNA, 23 nt, Human herpesvirus 4 (Epstein-Barr virus)
acuggggugugaagggcagggcu

SEQ ID NO: 3967985 - RNA, 17 nt, Human herpesvirus 4 (Epstein-Barr virus)
acugugcacucucuccc

SEQ ID NO: 3967986 - RNA, 23 nt, Human herpesvirus 4 (Epstein-Barr virus)
acuucgggggcgacugccgccgc

SEQ ID NO: 3967987 - RNA, 20 nt, Human herpesvirus 4 (Epstein-Barr virus)
agaaaagagagcggcuguga

SEQ ID NO: 3967988 - RNA, 21 nt, Human herpesvirus 4 (Epstein-Barr virus)
agaagcaccucaaccuggaga

SEQ ID NO: 3967989 - RNA, 22 nt, Human herpesvirus 4 (Epstein-Barr virus)
agaagcggggcugggugggaga

SEQ ID NO: 3967990 - RNA, 14 nt, Human herpesvirus 4 (Epstein-Barr virus)
agacaccuggccca

SEQ ID NO: 3967991 - RNA, 22 nt, Human herpesvirus 4 (Epstein-Barr virus)
agacaccuggcccacuggaugc

SEQ ID NO: 3967992 - RNA, 16 nt, Human herpesvirus 4 (Epstein-Barr virus)
agaccaauacccagga

SEQ ID NO: 3967993 - RNA, 16 nt, Human herpesvirus 4 (Epstein-Barr virus)
agacccaucugagggc

SEQ ID NO: 3967994 - RNA, 21 nt, Human herpesvirus 4 (Epstein-Barr virus)
agacccaucugagggcaguga

SEQ ID NO: 3967995 - RNA, 12 nt, Human herpesvirus 4 (Epstein-Barr virus)
agacgcagcugu

SEQ ID NO: 3967996 - RNA, 14 nt, Human herpesvirus 4 (Epstein-Barr virus)
agacuaugcauaca

SEQ ID NO: 3967997 - RNA, 16 nt, Human herpesvirus 4 (Epstein-Barr virus)
agacugcaaacccugg

SEQ ID NO: 3967998 - RNA, 19 nt, Human herpesvirus 4 (Epstein-Barr virus)
agagagguugcgcugcuug

SEQ ID NO: 3967999 - RNA, 23 nt, Human herpesvirus 4 (Epstein-Barr virus)
agagccagccggguccgugcggc

SEQ ID NO: 3968000 - RNA, 17 nt, Human herpesvirus 4 (Epstein-Barr virus)
agagccccuuuugcccc

SEQ ID NO: 3968001 - RNA, 15 nt, Human herpesvirus 4 (Epstein-Barr virus)
agagccucugccaca

SEQ ID NO: 3968002 - RNA, 13 nt, Human herpesvirus 4 (Epstein-Barr virus)
agagcgacgagga

SEQ ID NO: 3968003 - RNA, 15 nt, Human herpesvirus 4 (Epstein-Barr virus)
agaggaggaggauga

SEQ ID NO: 3968004 - RNA, 14 nt, Human herpesvirus 4 (Epstein-Barr virus)
agaggaugauccug

SEQ ID NO: 3968005 - RNA, 22 nt, Human herpesvirus 4 (Epstein-Barr virus)
agaggucccauguacagcacaa

SEQ ID NO: 3968006 - RNA, 16 nt, Human herpesvirus 4 (Epstein-Barr virus)
agauagccggccaggc

SEQ ID NO: 3968007 - RNA, 19 nt, Human herpesvirus 4 (Epstein-Barr virus)
agauagccggccaggcaga

SEQ ID NO: 3968008 - RNA, 14 nt, Human herpesvirus 4 (Epstein-Barr virus)
agaucgugaggccu

SEQ ID NO: 3968009 - RNA, 14 nt, Human herpesvirus 4 (Epstein-Barr virus)
agauugccuucugu

SEQ ID NO: 3968010 - RNA, 15 nt, Human herpesvirus 4 (Epstein-Barr virus)
agcaggagcuugagg

SEQ ID NO: 3968011 - RNA, 10 nt, Human herpesvirus 4 (Epstein-Barr virus)
agcaggagga

SEQ ID NO: 3968012 - RNA, 18 nt, Human herpesvirus 4 (Epstein-Barr virus)
aaaacagaggcuggaugc

SEQ ID NO: 3968013 - RNA, 11 nt, Human herpesvirus 4 (Epstein-Barr virus)
aaaagagacug

SEQ ID NO: 3968014 - RNA, 12 nt, Human herpesvirus 4 (Epstein-Barr virus)
aaaaguccagcg

SEQ ID NO: 3968015 - RNA, 17 nt, Human herpesvirus 4 (Epstein-Barr virus)
aaacagaggcuggaugc

SEQ ID NO: 3968016 - RNA, 17 nt, Human herpesvirus 4 (Epstein-Barr virus)
aaacaggugagucagcc

SEQ ID NO: 3968017 - RNA, 14 nt, Human herpesvirus 4 (Epstein-Barr virus)
aaauuuacaccuga

SEQ ID NO: 3968018 - RNA, 15 nt, Human herpesvirus 4 (Epstein-Barr virus)
aacaaugugaaccuu

SEQ ID NO: 3968019 - RNA, 14 nt, Human herpesvirus 4 (Epstein-Barr virus)
aacaauuacagaua

SEQ ID NO: 3968020 - RNA, 19 nt, Human herpesvirus 4 (Epstein-Barr virus)
aacacggagaucucagaau

SEQ ID NO: 3968021 - RNA, 13 nt, Human herpesvirus 4 (Epstein-Barr virus)
aacacgggccugg

SEQ ID NO: 3968022 - RNA, 19 nt, Human herpesvirus 4 (Epstein-Barr virus)
aacccccggcucucaggcc

SEQ ID NO: 3968023 - RNA, 18 nt, Human herpesvirus 4 (Epstein-Barr virus)
aaccccuaccucggcauc

SEQ ID NO: 3968024 - RNA, 22 nt, Human herpesvirus 4 (Epstein-Barr virus)
aacgggggaaggaaaggccugc

SEQ ID NO: 3968025 - RNA, 21 nt, Human herpesvirus 4 (Epstein-Barr virus)
aacuaugcaugagccacaggc

SEQ ID NO: 3968026 - RNA, 19 nt, Human herpesvirus 4 (Epstein-Barr virus)
aacucccccaaacaugucc

SEQ ID NO: 3968027 - RNA, 18 nt, Human herpesvirus 4 (Epstein-Barr virus)
aacugacacacaggccug

SEQ ID NO: 3968028 - RNA, 18 nt, Human herpesvirus 4 (Epstein-Barr virus)
aacugcgagggggccugg

SEQ ID NO: 3968029 - RNA, 19 nt, Human herpesvirus 4 (Epstein-Barr virus)
aacugcgagggggccuggu

SEQ ID NO: 3968030 - RNA, 13 nt, Human herpesvirus 4 (Epstein-Barr virus)
aacuugacuacaa

SEQ ID NO: 3968031 - RNA, 23 nt, Human herpesvirus 4 (Epstein-Barr virus)
aacuuguuaggagacgcccucaa

SEQ ID NO: 3968032 - RNA, 13 nt, Human herpesvirus 4 (Epstein-Barr virus)
aagaccaaggccc

SEQ ID NO: 3968033 - RNA, 20 nt, Human herpesvirus 4 (Epstein-Barr virus)
aagagccgcuccguggcccc

SEQ ID NO: 3968034 - RNA, 18 nt, Human herpesvirus 4 (Epstein-Barr virus)
aagcggcccagcagaucc

SEQ ID NO: 3968035 - RNA, 21 nt, Human herpesvirus 4 (Epstein-Barr virus)
aagcuacaaacacgggccugg

SEQ ID NO: 3968036 - RNA, 14 nt, Human herpesvirus 4 (Epstein-Barr virus)
aaggagugccucug

SEQ ID NO: 3968037 - RNA, 16 nt, Human herpesvirus 4 (Epstein-Barr virus)
aaggcccuaauucagc

SEQ ID NO: 3968038 - RNA, 13 nt, Human herpesvirus 4 (Epstein-Barr virus)
aagggaggagugc

SEQ ID NO: 3968039 - RNA, 22 nt, Human herpesvirus 4 (Epstein-Barr virus)
aaguacugaaacgucaggucuu

SEQ ID NO: 3968040 - RNA, 21 nt, Human herpesvirus 4 (Epstein-Barr virus)
aauccuugggugaccuggcca

SEQ ID NO: 3968041 - RNA, 19 nt, Human herpesvirus 4 (Epstein-Barr virus)
aaucuucuucauagccuga

SEQ ID NO: 3968042 - RNA, 16 nt, Human herpesvirus 4 (Epstein-Barr virus)
aaugaccgugcaugca

SEQ ID NO: 3968043 - RNA, 19 nt, Human herpesvirus 4 (Epstein-Barr virus)
acaaacucucucaucucca

SEQ ID NO: 3968044 - RNA, 20 nt, Human herpesvirus 4 (Epstein-Barr virus)
acaacggcugugacuacacc

SEQ ID NO: 3968045 - RNA, 23 nt, Human herpesvirus 4 (Epstein-Barr virus)
acaagaaucggguggcuuccaga

SEQ ID NO: 3968046 - RNA, 15 nt, Human herpesvirus 4 (Epstein-Barr virus)
acacacaggccuggc

SEQ ID NO: 3968047 - RNA, 23 nt, Human herpesvirus 4 (Epstein-Barr virus)
acaccaccccaccauaugaugac

SEQ ID NO: 3968048 - RNA, 15 nt, Human herpesvirus 4 (Epstein-Barr virus)
acacgccagagacaa

SEQ ID NO: 3968049 - RNA, 22 nt, Human herpesvirus 4 (Epstein-Barr virus)
acacgccagagacaaggcaggc

SEQ ID NO: 3968050 - RNA, 13 nt, Human herpesvirus 4 (Epstein-Barr virus)
acacgggccuggg

SEQ ID NO: 3968051 - RNA, 17 nt, Human herpesvirus 4 (Epstein-Barr virus)
acagauugucuuccaca

SEQ ID NO: 3968052 - RNA, 16 nt, Human herpesvirus 4 (Epstein-Barr virus)
acagcaauggcacgga

SEQ ID NO: 3968053 - RNA, 23 nt, Human herpesvirus 4 (Epstein-Barr virus)
acaggcccucgagccauuugagg

SEQ ID NO: 3968054 - RNA, 14 nt, Human herpesvirus 4 (Epstein-Barr virus)
acaugucucagagg

SEQ ID NO: 3968055 - RNA, 11 nt, Human herpesvirus 4 (Epstein-Barr virus)
acauuggcagc

SEQ ID NO: 3968056 - RNA, 21 nt, Human herpesvirus 4 (Epstein-Barr virus)
acauuggcagcagcucuggca

SEQ ID NO: 3968057 - RNA, 21 nt, Human herpesvirus 4 (Epstein-Barr virus)
accacacagguagcaaggacc

SEQ ID NO: 3968058 - RNA, 15 nt, Human herpesvirus 4 (Epstein-Barr virus)
accacgaugacuccc

SEQ ID NO: 3968059 - RNA, 14 nt, Human herpesvirus 4 (Epstein-Barr virus)
accacugaccuggu

SEQ ID NO: 3968060 - RNA, 21 nt, Human herpesvirus 4 (Epstein-Barr virus)
accauggaugugaaugccccc

SEQ ID NO: 3968061 - RNA, 19 nt, Human herpesvirus 4 (Epstein-Barr virus)
accccacacucccuccaga

SEQ ID NO: 3968062 - RNA, 17 nt, Human herpesvirus 4 (Epstein-Barr virus)
accccagagcagcccgc

SEQ ID NO: 3968063 - RNA, 16 nt, Human herpesvirus 4 (Epstein-Barr virus)
acccccuggagccagc

SEQ ID NO: 3968064 - RNA, 17 nt, Human herpesvirus 4 (Epstein-Barr virus)
accccgaguccaaggcc

SEQ ID NO: 3968065 - RNA, 18 nt, Human herpesvirus 4 (Epstein-Barr virus)
acccgaggucaagucccg

SEQ ID NO: 3968066 - RNA, 20 nt, Human herpesvirus 4 (Epstein-Barr virus)
acccuugcccucuccagcaa

SEQ ID NO: 3968067 - RNA, 18 nt, Human herpesvirus 4 (Epstein-Barr virus)
accgauagcauggccgcc

SEQ ID NO: 3968068 - RNA, 14 nt, Human herpesvirus 4 (Epstein-Barr virus)
accguggccaggcc

SEQ ID NO: 3968069 - RNA, 18 nt, Human herpesvirus 4 (Epstein-Barr virus)
accuauagauccugggcc

SEQ ID NO: 3968070 - RNA, 17 nt, Human herpesvirus 4 (Epstein-Barr virus)
accugcucucucuggag

SEQ ID NO: 3968071 - RNA, 20 nt, Human herpesvirus 4 (Epstein-Barr virus)
accuuuccaucacugaccca

SEQ ID NO: 3968072 - RNA, 16 nt, Human herpesvirus 4 (Epstein-Barr virus)
acgaccuugaccacga

SEQ ID NO: 3968073 - RNA, 17 nt, Human herpesvirus 4 (Epstein-Barr virus)
acgacuauccaggucuu

SEQ ID NO: 3968074 - RNA, 15 nt, Human herpesvirus 4 (Epstein-Barr virus)
acgaggacgaggagg

SEQ ID NO: 3968075 - RNA, 16 nt, Human herpesvirus 4 (Epstein-Barr virus)
acgaggacgaggaggc

SEQ ID NO: 3968076 - RNA, 17 nt, Human herpesvirus 4 (Epstein-Barr virus)
acgccccgaaagcggcc

SEQ ID NO: 3968077 - RNA, 21 nt, Human herpesvirus 4 (Epstein-Barr virus)
acggcccacgucuuuaccacc

SEQ ID NO: 3968078 - RNA, 17 nt, Human herpesvirus 4 (Epstein-Barr virus)
acgguggaacaggagca

SEQ ID NO: 3968079 - RNA, 16 nt, Human herpesvirus 4 (Epstein-Barr virus)
acguccgugagagccu

SEQ ID NO: 3968080 - RNA, 16 nt, Human herpesvirus 4 (Epstein-Barr virus)
acgugaaccucccccc

SEQ ID NO: 3968081 - RNA, 18 nt, Human herpesvirus 4 (Epstein-Barr virus)
acgugcccagcuccgugg

SEQ ID NO: 3968082 - RNA, 19 nt, Human herpesvirus 4 (Epstein-Barr virus)
acguggguccccucugccg

SEQ ID NO: 3968083 - RNA, 19 nt, Human herpesvirus 4 (Epstein-Barr virus)
acuacgagggccucuggca

SEQ ID NO: 3968084 - RNA, 14 nt, Human herpesvirus 4 (Epstein-Barr virus)
acuauaccaaagcu

SEQ ID NO: 3968085 - RNA, 14 nt, Human herpesvirus 4 (Epstein-Barr virus)
acucaagagaucag

SEQ ID NO: 3968086 - RNA, 22 nt, Human herpesvirus 4 (Epstein-Barr virus)
acucgaagcggucucagacacc

SEQ ID NO: 3968087 - RNA, 19 nt, Human herpesvirus 4 (Epstein-Barr virus)
acucgagagaggccucugc

SEQ ID NO: 3968088 - RNA, 20 nt, Human herpesvirus 4 (Epstein-Barr virus)
acucggccacacagugggcu

SEQ ID NO: 3968089 - RNA, 22 nt, Human herpesvirus 4 (Epstein-Barr virus)
acugccccgguccccccagaag

SEQ ID NO: 3968090 - RNA, 14 nt, Human herpesvirus 4 (Epstein-Barr virus)
acugccgccgccuc

SEQ ID NO: 3968091 - RNA, 15 nt, Human herpesvirus 4 (Epstein-Barr virus)
acugcgggugucuca

SEQ ID NO: 3968092 - RNA, 20 nt, Human herpesvirus 4 (Epstein-Barr virus)
acugcguccaccuggccacc

SEQ ID NO: 3968093 - RNA, 21 nt, Human herpesvirus 4 (Epstein-Barr virus)
acuggcacgguggcuugggcu

SEQ ID NO: 3968094 - RNA, 22 nt, Human herpesvirus 4 (Epstein-Barr virus)
acuggccaugcaggccuggaca

SEQ ID NO: 3968095 - RNA, 21 nt, Human herpesvirus 4 (Epstein-Barr virus)
acugggaugaacccuggggca

SEQ ID NO: 3968096 - RNA, 17 nt, Human herpesvirus 4 (Epstein-Barr virus)
acugggggcaaagccag

SEQ ID NO: 3968097 - RNA, 14 nt, Human herpesvirus 4 (Epstein-Barr virus)
acugucacaccagu

SEQ ID NO: 3968098 - RNA, 18 nt, Human herpesvirus 4 (Epstein-Barr virus)
acuguuccuauaugcucu

SEQ ID NO: 3968099 - RNA, 15 nt, Human herpesvirus 4 (Epstein-Barr virus)
acuugaggugggcug

SEQ ID NO: 3968100 - RNA, 17 nt, Human herpesvirus 4 (Epstein-Barr virus)
acuuuuauuuauugcau

SEQ ID NO: 3968101 - RNA, 21 nt, Human herpesvirus 4 (Epstein-Barr virus)
agaaaacucugcauggagaag

SEQ ID NO: 3968102 - RNA, 20 nt, Human herpesvirus 4 (Epstein-Barr virus)
agaagacguuguaggugucc

SEQ ID NO: 3968103 - RNA, 14 nt, Human herpesvirus 4 (Epstein-Barr virus)
agaagagaggcuuc

SEQ ID NO: 3968104 - RNA, 16 nt, Human herpesvirus 4 (Epstein-Barr virus)
agaaguuggugguggg

SEQ ID NO: 3968105 - RNA, 20 nt, Human herpesvirus 4 (Epstein-Barr virus)
agaaucggguggcuuccaga

SEQ ID NO: 3968106 - RNA, 14 nt, Human herpesvirus 4 (Epstein-Barr virus)
agaccccugggcuc

SEQ ID NO: 3968107 - RNA, 20 nt, Human herpesvirus 4 (Epstein-Barr virus)
agacucccauguaagccugc

SEQ ID NO: 3968108 - RNA, 16 nt, Human herpesvirus 4 (Epstein-Barr virus)
agacugcacaggauga

SEQ ID NO: 3968109 - RNA, 22 nt, Human herpesvirus 4 (Epstein-Barr virus)
agacuucagguggucauguuuc

SEQ ID NO: 3968110 - RNA, 15 nt, Human herpesvirus 4 (Epstein-Barr virus)
agagaaugacagcaa

SEQ ID NO: 3968111 - RNA, 23 nt, Human herpesvirus 4 (Epstein-Barr virus)
agagaucagcaaccuugggggca

SEQ ID NO: 3968112 - RNA, 23 nt, Human herpesvirus 4 (Epstein-Barr virus)
agagcagauuuccgucagccagg

SEQ ID NO: 3968113 - RNA, 16 nt, Human herpesvirus 4 (Epstein-Barr virus)
agagccgcuccguggc

SEQ ID NO: 3968114 - RNA, 15 nt, Human herpesvirus 4 (Epstein-Barr virus)
agagcucuggaggac

SEQ ID NO: 3968115 - RNA, 13 nt, Human herpesvirus 4 (Epstein-Barr virus)
agaggauuggcug

SEQ ID NO: 3968116 - RNA, 20 nt, Human herpesvirus 4 (Epstein-Barr virus)
agaggcaaacauacaggagg

SEQ ID NO: 3968117 - RNA, 13 nt, Human herpesvirus 4 (Epstein-Barr virus)
agagggaaaagag

SEQ ID NO: 3968118 - RNA, 18 nt, Human herpesvirus 4 (Epstein-Barr virus)
agagugcccuggaggccu

SEQ ID NO: 3968119 - RNA, 21 nt, Human herpesvirus 4 (Epstein-Barr virus)
agauagccacccgcuguauga

SEQ ID NO: 3968120 - RNA, 13 nt, Human herpesvirus 4 (Epstein-Barr virus)
agaucgccugcca

SEQ ID NO: 3968121 - RNA, 21 nt, Human herpesvirus 4 (Epstein-Barr virus)
agaugaggccccuuacuucca

SEQ ID NO: 3968122 - RNA, 19 nt, Human herpesvirus 4 (Epstein-Barr virus)
agaugcauacgcugaguga

SEQ ID NO: 3968123 - RNA, 14 nt, Human herpesvirus 4 (Epstein-Barr virus)
agauggacuugagg

SEQ ID NO: 3968124 - RNA, 18 nt, Human herpesvirus 4 (Epstein-Barr virus)
ccguuccaggcucuccag

SEQ ID NO: 3968125 - RNA, 16 nt, Human herpesvirus 4 (Epstein-Barr virus)
ccuacaccaccccacc

SEQ ID NO: 3968126 - RNA, 22 nt, Human herpesvirus 4 (Epstein-Barr virus)
ccuaucacgggggucaagcaaa

SEQ ID NO: 3968127 - RNA, 16 nt, Human herpesvirus 4 (Epstein-Barr virus)
ccucaaaggccucggc

SEQ ID NO: 3968128 - RNA, 20 nt, Human herpesvirus 4 (Epstein-Barr virus)
ccucaacaaggagugccucu

SEQ ID NO: 3968129 - RNA, 15 nt, Human herpesvirus 4 (Epstein-Barr virus)
ccucagaggaggagg

SEQ ID NO: 3968130 - RNA, 16 nt, Human herpesvirus 4 (Epstein-Barr virus)
ccucagcccccccugu

SEQ ID NO: 3968131 - RNA, 18 nt, Human herpesvirus 4 (Epstein-Barr virus)
ccucauucccccaugaga

SEQ ID NO: 3968132 - RNA, 15 nt, Human herpesvirus 4 (Epstein-Barr virus)
ccucauuggcuuugc

SEQ ID NO: 3968133 - RNA, 19 nt, Human herpesvirus 4 (Epstein-Barr virus)
ccuccauuccacccacuga

SEQ ID NO: 3968134 - RNA, 13 nt, Human herpesvirus 4 (Epstein-Barr virus)
ccuccccuguggc

SEQ ID NO: 3968135 - RNA, 13 nt, Human herpesvirus 4 (Epstein-Barr virus)
ccucggccugggg

SEQ ID NO: 3968136 - RNA, 19 nt, Human herpesvirus 4 (Epstein-Barr virus)
ccucgguggccugcucacc

SEQ ID NO: 3968137 - RNA, 17 nt, Human herpesvirus 4 (Epstein-Barr virus)
ccucuagcaucugcuau

SEQ ID NO: 3968138 - RNA, 16 nt, Human herpesvirus 4 (Epstein-Barr virus)
ccucugccuggccggc

SEQ ID NO: 3968139 - RNA, 22 nt, Human herpesvirus 4 (Epstein-Barr virus)
ccucuugauagggauccgcuag

SEQ ID NO: 3968140 - RNA, 15 nt, Human herpesvirus 4 (Epstein-Barr virus)
ccucuuuguggccuu

SEQ ID NO: 3968141 - RNA, 15 nt, Human herpesvirus 4 (Epstein-Barr virus)
ccucuuuuggcuggc

SEQ ID NO: 3968142 - RNA, 23 nt, Human herpesvirus 4 (Epstein-Barr virus)
ccugaauccgcgcagccuguuca

SEQ ID NO: 3968143 - RNA, 15 nt, Human herpesvirus 4 (Epstein-Barr virus)
ccugacggugguggg

SEQ ID NO: 3968144 - RNA, 23 nt, Human herpesvirus 4 (Epstein-Barr virus)
ccugagcuggacgagguccugga

SEQ ID NO: 3968145 - RNA, 19 nt, Human herpesvirus 4 (Epstein-Barr virus)
ccugaucugggagaugaga

SEQ ID NO: 3968146 - RNA, 17 nt, Human herpesvirus 4 (Epstein-Barr virus)
ccugcacggcccuccag

SEQ ID NO: 3968147 - RNA, 14 nt, Human herpesvirus 4 (Epstein-Barr virus)
ccugcccucccacu

SEQ ID NO: 3968148 - RNA, 13 nt, Human herpesvirus 4 (Epstein-Barr virus)
ccugcggggaacu

SEQ ID NO: 3968149 - RNA, 21 nt, Human herpesvirus 4 (Epstein-Barr virus)
ccugcuggccgagcuggaggc

SEQ ID NO: 3968150 - RNA, 14 nt, Human herpesvirus 4 (Epstein-Barr virus)
ccugcuucacgccu

SEQ ID NO: 3968151 - RNA, 19 nt, Human herpesvirus 4 (Epstein-Barr virus)
ccuggaagaaucauggccu

SEQ ID NO: 3968152 - RNA, 17 nt, Human herpesvirus 4 (Epstein-Barr virus)
ccuggccgggcgccugc

SEQ ID NO: 3968153 - RNA, 14 nt, Human herpesvirus 4 (Epstein-Barr virus)
ccuggcggcccagc

SEQ ID NO: 3968154 - RNA, 18 nt, Human herpesvirus 4 (Epstein-Barr virus)
ccuggcggcccagcccga

SEQ ID NO: 3968155 - RNA, 14 nt, Human herpesvirus 4 (Epstein-Barr virus)
ccugggcugccccg

SEQ ID NO: 3968156 - RNA, 20 nt, Human herpesvirus 4 (Epstein-Barr virus)
ccuggggccauaguggcggc

SEQ ID NO: 3968157 - RNA, 16 nt, Human herpesvirus 4 (Epstein-Barr virus)
ccugguacaggaccau

SEQ ID NO: 3968158 - RNA, 22 nt, Human herpesvirus 4 (Epstein-Barr virus)
ccugucgauaucccugcugucu

SEQ ID NO: 3968159 - RNA, 18 nt, Human herpesvirus 4 (Epstein-Barr virus)
ccugucuccccucgagcg

SEQ ID NO: 3968160 - RNA, 19 nt, Human herpesvirus 4 (Epstein-Barr virus)
ccuguggagauuaggggua

SEQ ID NO: 3968161 - RNA, 15 nt, Human herpesvirus 4 (Epstein-Barr virus)
ccuuagccacacugu

SEQ ID NO: 3968162 - RNA, 16 nt, Human herpesvirus 4 (Epstein-Barr virus)
ccuugcucgcagcugg

SEQ ID NO: 3968163 - RNA, 22 nt, Human herpesvirus 4 (Epstein-Barr virus)
ccuuggcgggucauccgccacc

SEQ ID NO: 3968164 - RNA, 18 nt, Human herpesvirus 4 (Epstein-Barr virus)
ccuuuaggcguaacuugu

SEQ ID NO: 3968165 - RNA, 16 nt, Human herpesvirus 4 (Epstein-Barr virus)
cgaagcggucucagac

SEQ ID NO: 3968166 - RNA, 22 nt, Human herpesvirus 4 (Epstein-Barr virus)
cgacacgguuauggcagagcuu

SEQ ID NO: 3968167 - RNA, 18 nt, Human herpesvirus 4 (Epstein-Barr virus)
cgaggacggggaagagga

SEQ ID NO: 3968168 - RNA, 13 nt, Human herpesvirus 4 (Epstein-Barr virus)
cgagggccucugg

SEQ ID NO: 3968169 - RNA, 13 nt, Human herpesvirus 4 (Epstein-Barr virus)
cgagggugaggcc

SEQ ID NO: 3968170 - RNA, 16 nt, Human herpesvirus 4 (Epstein-Barr virus)
cgauggucgucaucug

SEQ ID NO: 3968171 - RNA, 20 nt, Human herpesvirus 4 (Epstein-Barr virus)
cgaugucggggcugcuggcg

SEQ ID NO: 3968172 - RNA, 21 nt, Human herpesvirus 4 (Epstein-Barr virus)
cgccagcgccuccucgcaggc

SEQ ID NO: 3968173 - RNA, 18 nt, Human herpesvirus 4 (Epstein-Barr virus)
cgccgccccaggggucuc

SEQ ID NO: 3968174 - RNA, 15 nt, Human herpesvirus 4 (Epstein-Barr virus)
cgccuccucgcaggc

SEQ ID NO: 3968175 - RNA, 18 nt, Human herpesvirus 4 (Epstein-Barr virus)
cgcggacuccgugaccaa

SEQ ID NO: 3968176 - RNA, 14 nt, Human herpesvirus 4 (Epstein-Barr virus)
cgcggugagggccg

SEQ ID NO: 3968177 - RNA, 20 nt, Human herpesvirus 4 (Epstein-Barr virus)
cgcucugcgccagccccgcc

SEQ ID NO: 3968178 - RNA, 23 nt, Human herpesvirus 4 (Epstein-Barr virus)
cgcucuggucgcccccucugccu

SEQ ID NO: 3968179 - RNA, 23 nt, Human herpesvirus 4 (Epstein-Barr virus)
cggccucgccuucuccucagccu

SEQ ID NO: 3968180 - RNA, 15 nt, Human herpesvirus 4 (Epstein-Barr virus)
cgggcacugcgucca

SEQ ID NO: 3968181 - RNA, 18 nt, Human herpesvirus 4 (Epstein-Barr virus)
cgggcaucuuaucagaga

SEQ ID NO: 3968182 - RNA, 20 nt, Human herpesvirus 4 (Epstein-Barr virus)
cgggcggcucaggaucaggg

SEQ ID NO: 3968183 - RNA, 18 nt, Human herpesvirus 4 (Epstein-Barr virus)
cggggguggaggcugcgc

SEQ ID NO: 3968184 - RNA, 17 nt, Human herpesvirus 4 (Epstein-Barr virus)
cggugcaaggacggggg

SEQ ID NO: 3968185 - RNA, 13 nt, Human herpesvirus 4 (Epstein-Barr virus)
cggugccugugga

SEQ ID NO: 3968186 - RNA, 21 nt, Human herpesvirus 4 (Epstein-Barr virus)
cggugcugaccggcucggcca

SEQ ID NO: 3968187 - RNA, 21 nt, Human herpesvirus 4 (Epstein-Barr virus)
cggugcugccagagccucugc

SEQ ID NO: 3968188 - RNA, 18 nt, Human herpesvirus 4 (Epstein-Barr virus)
cgguggccugcucaccau

SEQ ID NO: 3968189 - RNA, 16 nt, Human herpesvirus 4 (Epstein-Barr virus)
cgguuagugugccucu

SEQ ID NO: 3968190 - RNA, 21 nt, Human herpesvirus 4 (Epstein-Barr virus)
cguauauguguugagaugagu

SEQ ID NO: 3968191 - RNA, 20 nt, Human herpesvirus 4 (Epstein-Barr virus)
cgucagcaacugcguccucu

SEQ ID NO: 3968192 - RNA, 22 nt, Human herpesvirus 4 (Epstein-Barr virus)
cgucccagggccggaaccugag

SEQ ID NO: 3968193 - RNA, 16 nt, Human herpesvirus 4 (Epstein-Barr virus)
cgugaucaugagggcu

SEQ ID NO: 3968194 - RNA, 18 nt, Human herpesvirus 4 (Epstein-Barr virus)
cguuaacauggacaugcu

SEQ ID NO: 3968195 - RNA, 16 nt, Human herpesvirus 4 (Epstein-Barr virus)
cuaaaagcagccaccu

SEQ ID NO: 3968196 - RNA, 22 nt, Human herpesvirus 4 (Epstein-Barr virus)
cuaauggaauauuaauaaauau

SEQ ID NO: 3968197 - RNA, 21 nt, Human herpesvirus 4 (Epstein-Barr virus)
cuacaucaauggaacccuagc

SEQ ID NO: 3968198 - RNA, 18 nt, Human herpesvirus 4 (Epstein-Barr virus)
cuaccugucggcccugcg

SEQ ID NO: 3968199 - RNA, 17 nt, Human herpesvirus 4 (Epstein-Barr virus)
cuacugccuuacacugg

SEQ ID NO: 3968200 - RNA, 14 nt, Human herpesvirus 4 (Epstein-Barr virus)
cuagaagugcuggg

SEQ ID NO: 3968201 - RNA, 18 nt, Human herpesvirus 4 (Epstein-Barr virus)
cuagcucacuuucagugg

SEQ ID NO: 3968202 - RNA, 19 nt, Human herpesvirus 4 (Epstein-Barr virus)
cuaggagaaggagccucgc

SEQ ID NO: 3968203 - RNA, 12 nt, Human herpesvirus 4 (Epstein-Barr virus)
cuauaaaaauuc

SEQ ID NO: 3968204 - RNA, 13 nt, Human herpesvirus 4 (Epstein-Barr virus)
cucaaccgccagg

SEQ ID NO: 3968205 - RNA, 20 nt, Human herpesvirus 4 (Epstein-Barr virus)
cucaaggcagucuccaccuu

SEQ ID NO: 3968206 - RNA, 23 nt, Human herpesvirus 4 (Epstein-Barr virus)
cucagagggggugccugugccuc

SEQ ID NO: 3968207 - RNA, 13 nt, Human herpesvirus 4 (Epstein-Barr virus)
cucagccuccaac

SEQ ID NO: 3968208 - RNA, 17 nt, Human herpesvirus 4 (Epstein-Barr virus)
cucagcucaaccgccag

SEQ ID NO: 3968209 - RNA, 19 nt, Human herpesvirus 4 (Epstein-Barr virus)
cucagcuuggggccaccgg

SEQ ID NO: 3968210 - RNA, 22 nt, Human herpesvirus 4 (Epstein-Barr virus)
cucaggaagcuggccaggcugg

SEQ ID NO: 3968211 - RNA, 21 nt, Human herpesvirus 4 (Epstein-Barr virus)
cucaggcacggucgccccucc

SEQ ID NO: 3968212 - RNA, 20 nt, Human herpesvirus 4 (Epstein-Barr virus)
cucaggccucccagucuauc

SEQ ID NO: 3968213 - RNA, 18 nt, Human herpesvirus 4 (Epstein-Barr virus)
cucauggaggggcggcag

SEQ ID NO: 3968214 - RNA, 22 nt, Human herpesvirus 4 (Epstein-Barr virus)
cuccacuuacaaccaagccacu

SEQ ID NO: 3968215 - RNA, 22 nt, Human herpesvirus 4 (Epstein-Barr virus)
cucccgccccuguccacugccc

SEQ ID NO: 3968216 - RNA, 12 nt, Human herpesvirus 4 (Epstein-Barr virus)
cucccucccccu

SEQ ID NO: 3968217 - RNA, 16 nt, Human herpesvirus 4 (Epstein-Barr virus)
cuccgcaguccggaga

SEQ ID NO: 3968218 - RNA, 16 nt, Human herpesvirus 4 (Epstein-Barr virus)
cuccggauucaccggc

SEQ ID NO: 3968219 - RNA, 18 nt, Human herpesvirus 4 (Epstein-Barr virus)
cuccguccuuguccagga

SEQ ID NO: 3968220 - RNA, 20 nt, Human herpesvirus 4 (Epstein-Barr virus)
cuccuacacacaucagaccu

SEQ ID NO: 3968221 - RNA, 22 nt, Human herpesvirus 4 (Epstein-Barr virus)
cuccuacgcgcuaccuccuauc

SEQ ID NO: 3968222 - RNA, 17 nt, Human herpesvirus 4 (Epstein-Barr virus)
cucgaaggugcagcugg

SEQ ID NO: 3968223 - RNA, 22 nt, Human herpesvirus 4 (Epstein-Barr virus)
cucgccucauccuggcccccaa

SEQ ID NO: 3968224 - RNA, 16 nt, Human herpesvirus 4 (Epstein-Barr virus)
cucggccacacagugg

SEQ ID NO: 3968225 - RNA, 14 nt, Human herpesvirus 4 (Epstein-Barr virus)
cucggccuccuggc

SEQ ID NO: 3968226 - RNA, 19 nt, Human herpesvirus 4 (Epstein-Barr virus)
cucguccaucuugagcgcc

SEQ ID NO: 3968227 - RNA, 21 nt, Human herpesvirus 4 (Epstein-Barr virus)
cucucgaggucugcgaugagg

SEQ ID NO: 3968228 - RNA, 19 nt, Human herpesvirus 4 (Epstein-Barr virus)
cucugauuauagcucuggc

SEQ ID NO: 3968229 - RNA, 19 nt, Human herpesvirus 4 (Epstein-Barr virus)
cucuggcugugcugacccu

SEQ ID NO: 3968230 - RNA, 16 nt, Human herpesvirus 4 (Epstein-Barr virus)
cugaccacggcccacg

SEQ ID NO: 3968231 - RNA, 17 nt, Human herpesvirus 4 (Epstein-Barr virus)
cugacggaaaucugcuc

SEQ ID NO: 3968232 - RNA, 13 nt, Human herpesvirus 4 (Epstein-Barr virus)
cugacggugaugu

SEQ ID NO: 3968233 - RNA, 15 nt, Human herpesvirus 4 (Epstein-Barr virus)
cugauggccuggaga

SEQ ID NO: 3968234 - RNA, 17 nt, Human herpesvirus 4 (Epstein-Barr virus)
cugcacggcccuccagc

SEQ ID NO: 3968235 - RNA, 21 nt, Human herpesvirus 4 (Epstein-Barr virus)
cugccaacuuugagcugggca

SEQ ID NO: 3968236 - RNA, 17 nt, Human herpesvirus 4 (Epstein-Barr virus)
cugccagagccucugcc

SEQ ID NO: 3968237 - RNA, 14 nt, Human herpesvirus 4 (Epstein-Barr virus)
cugcccagccuacu

SEQ ID NO: 3968238 - RNA, 14 nt, Human herpesvirus 4 (Epstein-Barr virus)
cugcccuucagugu

SEQ ID NO: 3968239 - RNA, 18 nt, Human herpesvirus 4 (Epstein-Barr virus)
cugccgggaggugcuggg

SEQ ID NO: 3968240 - RNA, 15 nt, Human herpesvirus 4 (Epstein-Barr virus)
cugccuccggccgcc

SEQ ID NO: 3968241 - RNA, 14 nt, Human herpesvirus 4 (Epstein-Barr virus)
cugcguagaugagc

SEQ ID NO: 3968242 - RNA, 14 nt, Human herpesvirus 4 (Epstein-Barr virus)
cugcuacuggcuuu

SEQ ID NO: 3968243 - RNA, 19 nt, Human herpesvirus 4 (Epstein-Barr virus)
cugcuucuggaccgugcca

SEQ ID NO: 3968244 - RNA, 17 nt, Human herpesvirus 4 (Epstein-Barr virus)
cuggagauuuucccacu

SEQ ID NO: 3968245 - RNA, 11 nt, Human herpesvirus 4 (Epstein-Barr virus)
cuggagcuggu

SEQ ID NO: 3968246 - RNA, 13 nt, Human herpesvirus 4 (Epstein-Barr virus)
cuggccagcaccc

SEQ ID NO: 3968247 - RNA, 15 nt, Human herpesvirus 4 (Epstein-Barr virus)
cuggccgagcuggag

SEQ ID NO: 3968248 - RNA, 14 nt, Human herpesvirus 4 (Epstein-Barr virus)
cuggcucuucuggg

SEQ ID NO: 3968249 - RNA, 18 nt, Human herpesvirus 4 (Epstein-Barr virus)
cuggggcucagacuuagg

SEQ ID NO: 3968250 - RNA, 13 nt, Human herpesvirus 4 (Epstein-Barr virus)
cugggguccagga

SEQ ID NO: 3968251 - RNA, 18 nt, Human herpesvirus 4 (Epstein-Barr virus)
cuguaauucuaugggaau

SEQ ID NO: 3968252 - RNA, 13 nt, Human herpesvirus 4 (Epstein-Barr virus)
cugucuguaaacu

SEQ ID NO: 3968253 - RNA, 14 nt, Human herpesvirus 4 (Epstein-Barr virus)
cugugcugacccuu

SEQ ID NO: 3968254 - RNA, 17 nt, Human herpesvirus 4 (Epstein-Barr virus)
cuguguccgacgccugc

SEQ ID NO: 3968255 - RNA, 15 nt, Human herpesvirus 4 (Epstein-Barr virus)
cugugugcgcgccgc

SEQ ID NO: 3968256 - RNA, 17 nt, Human herpesvirus 4 (Epstein-Barr virus)
cuucagcaucaauguca

SEQ ID NO: 3968257 - RNA, 16 nt, Human herpesvirus 4 (Epstein-Barr virus)
cuucagggaaaaacug

SEQ ID NO: 3968258 - RNA, 16 nt, Human herpesvirus 4 (Epstein-Barr virus)
cuucaggggaaucucu

SEQ ID NO: 3968259 - RNA, 18 nt, Human herpesvirus 4 (Epstein-Barr virus)
cuuccagcgcaagcuugc

SEQ ID NO: 3968260 - RNA, 20 nt, Human herpesvirus 4 (Epstein-Barr virus)
cuucgaggucuccccugacg

SEQ ID NO: 3968261 - RNA, 14 nt, Human herpesvirus 4 (Epstein-Barr virus)
cuuggcaguguccu

SEQ ID NO: 3968262 - RNA, 20 nt, Human herpesvirus 4 (Epstein-Barr virus)
cuuggccagcggggagaggg

SEQ ID NO: 3968263 - RNA, 16 nt, Human herpesvirus 4 (Epstein-Barr virus)
cuugguauugcgcugg

SEQ ID NO: 3968264 - RNA, 22 nt, Human herpesvirus 4 (Epstein-Barr virus)
cuuuaggcguaacuugucuaca

SEQ ID NO: 3968265 - RNA, 16 nt, Human herpesvirus 4 (Epstein-Barr virus)
cuuucuggccaaccug

SEQ ID NO: 3968266 - RNA, 20 nt, Human herpesvirus 4 (Epstein-Barr virus)
cuuucuggccaaccugccuc

SEQ ID NO: 3968267 - RNA, 14 nt, Human herpesvirus 4 (Epstein-Barr virus)
cuuugccagcaacu

SEQ ID NO: 3968268 - RNA, 15 nt, Human herpesvirus 4 (Epstein-Barr virus)
gaaaauauauugcaa

SEQ ID NO: 3968269 - RNA, 17 nt, Human herpesvirus 4 (Epstein-Barr virus)
gaaaaucucgcucagag

SEQ ID NO: 3968270 - RNA, 14 nt, Human herpesvirus 4 (Epstein-Barr virus)
gaacccuagccacc

SEQ ID NO: 3968271 - RNA, 13 nt, Human herpesvirus 4 (Epstein-Barr virus)
gaagaggacgagg

SEQ ID NO: 3968272 - RNA, 14 nt, Human herpesvirus 4 (Epstein-Barr virus)
gaauaugaugagga

SEQ ID NO: 3968273 - RNA, 19 nt, Human herpesvirus 4 (Epstein-Barr virus)
gaaugacgggcucccuccc

SEQ ID NO: 3968274 - RNA, 18 nt, Human herpesvirus 4 (Epstein-Barr virus)
gaauuguuaguuuaaaca

SEQ ID NO: 3968275 - RNA, 22 nt, Human herpesvirus 4 (Epstein-Barr virus)
gacagcagcguccuggccccau

SEQ ID NO: 3968276 - RNA, 21 nt, Human herpesvirus 4 (Epstein-Barr virus)
gacauggccgcccgccuggcu

SEQ ID NO: 3968277 - RNA, 13 nt, Human herpesvirus 4 (Epstein-Barr virus)
gaccaagcuacca

SEQ ID NO: 3968278 - RNA, 22 nt, Human herpesvirus 4 (Epstein-Barr virus)
gacccuauggagggcagcgaag

SEQ ID NO: 3968279 - RNA, 13 nt, Human herpesvirus 4 (Epstein-Barr virus)
gacccuucugcug

SEQ ID NO: 3968280 - RNA, 18 nt, Human herpesvirus 4 (Epstein-Barr virus)
gaccucccgcccugagcu

SEQ ID NO: 3968281 - RNA, 11 nt, Human herpesvirus 4 (Epstein-Barr virus)
gaccugugugc

SEQ ID NO: 3968282 - RNA, 13 nt, Human herpesvirus 4 (Epstein-Barr virus)
gacgcuguuuugc

SEQ ID NO: 3968283 - RNA, 20 nt, Human herpesvirus 4 (Epstein-Barr virus)
gacguggguccccucugccg

SEQ ID NO: 3968284 - RNA, 14 nt, Human herpesvirus 4 (Epstein-Barr virus)
gacuggcaacuccu

SEQ ID NO: 3968285 - RNA, 16 nt, Human herpesvirus 4 (Epstein-Barr virus)
gagaaaaugagccaug

SEQ ID NO: 3968286 - RNA, 15 nt, Human herpesvirus 4 (Epstein-Barr virus)
gagagaagagagcgg

SEQ ID NO: 3968287 - RNA, 14 nt, Human herpesvirus 4 (Epstein-Barr virus)
gagagcauuucagg

SEQ ID NO: 3968288 - RNA, 13 nt, Human herpesvirus 4 (Epstein-Barr virus)
gagcggcugugag

SEQ ID NO: 3968289 - RNA, 13 nt, Human herpesvirus 4 (Epstein-Barr virus)
gagcuccgugggc

SEQ ID NO: 3968290 - RNA, 19 nt, Human herpesvirus 4 (Epstein-Barr virus)
gaggcacacaaaaugagga

SEQ ID NO: 3968291 - RNA, 18 nt, Human herpesvirus 4 (Epstein-Barr virus)
gaggcuauaacgcagguc

SEQ ID NO: 3968292 - RNA, 17 nt, Human herpesvirus 4 (Epstein-Barr virus)
gaggcugcgccugagcu

SEQ ID NO: 3968293 - RNA, 16 nt, Human herpesvirus 4 (Epstein-Barr virus)
gagggaaaaggcccua

SEQ ID NO: 3968294 - RNA, 12 nt, Human herpesvirus 4 (Epstein-Barr virus)
uguuccuucugc

SEQ ID NO: 3968295 - RNA, 15 nt, Human herpesvirus 4 (Epstein-Barr virus)
uuaccugguacauug

SEQ ID NO: 3968296 - RNA, 24 nt, Human herpesvirus 4 (Epstein-Barr virus)
uuacugcccagccuacucuccacu

SEQ ID NO: 3968297 - RNA, 15 nt, Human herpesvirus 4 (Epstein-Barr virus)
uuagccccagccccu

SEQ ID NO: 3968298 - RNA, 17 nt, Human herpesvirus 4 (Epstein-Barr virus)
uuccacagcaauggcac

SEQ ID NO: 3968299 - RNA, 11 nt, Human herpesvirus 4 (Epstein-Barr virus)
uuccagagagg

SEQ ID NO: 3968300 - RNA, 18 nt, Human herpesvirus 4 (Epstein-Barr virus)
uucccagacucugcuuuc

SEQ ID NO: 3968301 - RNA, 17 nt, Human herpesvirus 4 (Epstein-Barr virus)
uucccggacaauacacc

SEQ ID NO: 3968302 - RNA, 18 nt, Human herpesvirus 4 (Epstein-Barr virus)
uucccucgaaucccuacc

SEQ ID NO: 3968303 - RNA, 19 nt, Human herpesvirus 4 (Epstein-Barr virus)
uuccucauuggcuuugccc

SEQ ID NO: 3968304 - RNA, 11 nt, Human herpesvirus 4 (Epstein-Barr virus)
uucuccaggcu

SEQ ID NO: 3968305 - RNA, 21 nt, Human herpesvirus 4 (Epstein-Barr virus)
uucugaggcggcuguggccuc

SEQ ID NO: 3968306 - RNA, 15 nt, Human herpesvirus 4 (Epstein-Barr virus)
uucugccccucagcc

SEQ ID NO: 3968307 - RNA, 14 nt, Human herpesvirus 4 (Epstein-Barr virus)
uucugucucggccu

SEQ ID NO: 3968308 - RNA, 14 nt, Human herpesvirus 4 (Epstein-Barr virus)
uugcuauucaauca

SEQ ID NO: 3968309 - RNA, 22 nt, Human herpesvirus 4 (Epstein-Barr virus)
uuugccaaccugcucucucugg

SEQ ID NO: 3968310 - RNA, 19 nt, Human herpesvirus 4 (Epstein-Barr virus)
cagcuggugguccgcaugu

SEQ ID NO: 3968311 - RNA, 19 nt, Human herpesvirus 4 (Epstein-Barr virus)
cagcugugugcgcgccgcc

SEQ ID NO: 3968312 - RNA, 14 nt, Human herpesvirus 4 (Epstein-Barr virus)
caggacggggggcu

SEQ ID NO: 3968313 - RNA, 20 nt, Human herpesvirus 4 (Epstein-Barr virus)
caggacuaaccaugccaucu

SEQ ID NO: 3968314 - RNA, 16 nt, Human herpesvirus 4 (Epstein-Barr virus)
caggagcaggagcagg

SEQ ID NO: 3968315 - RNA, 14 nt, Human herpesvirus 4 (Epstein-Barr virus)
caggaggaaaggcu

SEQ ID NO: 3968316 - RNA, 19 nt, Human herpesvirus 4 (Epstein-Barr virus)
caggaggggcaggagcagg

SEQ ID NO: 3968317 - RNA, 15 nt, Human herpesvirus 4 (Epstein-Barr virus)
caggagucugcugcg

SEQ ID NO: 3968318 - RNA, 21 nt, Human herpesvirus 4 (Epstein-Barr virus)
caggauguucacgugggcccc

SEQ ID NO: 3968319 - RNA, 14 nt, Human herpesvirus 4 (Epstein-Barr virus)
caggauuccugauu

SEQ ID NO: 3968320 - RNA, 17 nt, Human herpesvirus 4 (Epstein-Barr virus)
caggcaccccaucuucc

SEQ ID NO: 3968321 - RNA, 20 nt, Human herpesvirus 4 (Epstein-Barr virus)
caggccaugcgcgcccuguc

SEQ ID NO: 3968322 - RNA, 14 nt, Human herpesvirus 4 (Epstein-Barr virus)
caggcccucauucc

SEQ ID NO: 3968323 - RNA, 22 nt, Human herpesvirus 4 (Epstein-Barr virus)
caggccgccaugcucagggcca

SEQ ID NO: 3968324 - RNA, 20 nt, Human herpesvirus 4 (Epstein-Barr virus)
caggccggcguugcgcacca

SEQ ID NO: 3968325 - RNA, 15 nt, Human herpesvirus 4 (Epstein-Barr virus)
cagggccaggcuguc

SEQ ID NO: 3968326 - RNA, 15 nt, Human herpesvirus 4 (Epstein-Barr virus)
cagggccuugagccc

SEQ ID NO: 3968327 - RNA, 19 nt, Human herpesvirus 4 (Epstein-Barr virus)
caggguccaggagaaggcu

SEQ ID NO: 3968328 - RNA, 20 nt, Human herpesvirus 4 (Epstein-Barr virus)
cagguuaaaugugaagcccg

SEQ ID NO: 3968329 - RNA, 20 nt, Human herpesvirus 4 (Epstein-Barr virus)
caguacuagcauggagaggu

SEQ ID NO: 3968330 - RNA, 14 nt, Human herpesvirus 4 (Epstein-Barr virus)
caguagaggacacc

SEQ ID NO: 3968331 - RNA, 22 nt, Human herpesvirus 4 (Epstein-Barr virus)
caguagccgaauaucuggaggu

SEQ ID NO: 3968332 - RNA, 18 nt, Human herpesvirus 4 (Epstein-Barr virus)
caguagcuugggaacacc

SEQ ID NO: 3968333 - RNA, 13 nt, Human herpesvirus 4 (Epstein-Barr virus)
caguccuccgcau

SEQ ID NO: 3968334 - RNA, 22 nt, Human herpesvirus 4 (Epstein-Barr virus)
cagucucaaucucucccacgga

SEQ ID NO: 3968335 - RNA, 20 nt, Human herpesvirus 4 (Epstein-Barr virus)
caguggaccucaaagaagag

SEQ ID NO: 3968336 - RNA, 19 nt, Human herpesvirus 4 (Epstein-Barr virus)
cagugucccugcugcccau

SEQ ID NO: 3968337 - RNA, 22 nt, Human herpesvirus 4 (Epstein-Barr virus)
caguuucuuuccgcgguggugg

SEQ ID NO: 3968338 - RNA, 16 nt, Human herpesvirus 4 (Epstein-Barr virus)
caucaagcagaaaggc

SEQ ID NO: 3968339 - RNA, 22 nt, Human herpesvirus 4 (Epstein-Barr virus)
caucggggcggacgccuccucc

SEQ ID NO: 3968340 - RNA, 15 nt, Human herpesvirus 4 (Epstein-Barr virus)
caucucaacacauau

SEQ ID NO: 3968341 - RNA, 23 nt, Human herpesvirus 4 (Epstein-Barr virus)
caucucgcuggcucgccucaucc

SEQ ID NO: 3968342 - RNA, 14 nt, Human herpesvirus 4 (Epstein-Barr virus)
caucugcccggcua

SEQ ID NO: 3968343 - RNA, 20 nt, Human herpesvirus 4 (Epstein-Barr virus)
caugacaauuuuagaugagg

SEQ ID NO: 3968344 - RNA, 20 nt, Human herpesvirus 4 (Epstein-Barr virus)
caugacagucccguuggugg

SEQ ID NO: 3968345 - RNA, 13 nt, Human herpesvirus 4 (Epstein-Barr virus)
caugagggcaccg

SEQ ID NO: 3968346 - RNA, 22 nt, Human herpesvirus 4 (Epstein-Barr virus)
caugcaggucaggucccccucc

SEQ ID NO: 3968347 - RNA, 15 nt, Human herpesvirus 4 (Epstein-Barr virus)
cauggccgagaagcu

SEQ ID NO: 3968348 - RNA, 14 nt, Human herpesvirus 4 (Epstein-Barr virus)
gucucaugggggaa

SEQ ID NO: 3968349 - RNA, 18 nt, Human herpesvirus 4 (Epstein-Barr virus)
gucucggcacccaggcag

SEQ ID NO: 3968350 - RNA, 21 nt, Human herpesvirus 4 (Epstein-Barr virus)
gucucugaaggauccaugcaa

SEQ ID NO: 3968351 - RNA, 23 nt, Human herpesvirus 4 (Epstein-Barr virus)
gucugagaauaaggcucugaagc

SEQ ID NO: 3968352 - RNA, 17 nt, Human herpesvirus 4 (Epstein-Barr virus)
gucuucccagacucugc

SEQ ID NO: 3968353 - RNA, 22 nt, Human herpesvirus 4 (Epstein-Barr virus)
gugaaauaaaagcuucugguug

SEQ ID NO: 3968354 - RNA, 11 nt, Human herpesvirus 4 (Epstein-Barr virus)
gugaaucaugu

SEQ ID NO: 3968355 - RNA, 14 nt, Human herpesvirus 4 (Epstein-Barr virus)
gugacacagugccc

SEQ ID NO: 3968356 - RNA, 13 nt, Human herpesvirus 4 (Epstein-Barr virus)
gugacgaggaugg

SEQ ID NO: 3968357 - RNA, 13 nt, Human herpesvirus 4 (Epstein-Barr virus)
gugagggggccug

SEQ ID NO: 3968358 - RNA, 21 nt, Human herpesvirus 4 (Epstein-Barr virus)
gugauuaggagcagggcccag

SEQ ID NO: 3968359 - RNA, 21 nt, Human herpesvirus 4 (Epstein-Barr virus)
gugccaaacugcgagggggcc

SEQ ID NO: 3968360 - RNA, 21 nt, Human herpesvirus 4 (Epstein-Barr virus)
gugccuaaacgugauggugcu

SEQ ID NO: 3968361 - RNA, 22 nt, Human herpesvirus 4 (Epstein-Barr virus)
gugcgcgccgccagcauggcag

SEQ ID NO: 3968362 - RNA, 16 nt, Human herpesvirus 4 (Epstein-Barr virus)
gugcgcggaaucagga

SEQ ID NO: 3968363 - RNA, 13 nt, Human herpesvirus 4 (Epstein-Barr virus)
gugcugccagagc

SEQ ID NO: 3968364 - RNA, 15 nt, Human herpesvirus 4 (Epstein-Barr virus)
guggaccucaaagaa

SEQ ID NO: 3968365 - RNA, 19 nt, Human herpesvirus 4 (Epstein-Barr virus)
guggccuuccucugccugg

SEQ ID NO: 3968366 - RNA, 12 nt, Human herpesvirus 4 (Epstein-Barr virus)
guggcugcugcc

SEQ ID NO: 3968367 - RNA, 13 nt, Human herpesvirus 4 (Epstein-Barr virus)
gugggcucccucu

SEQ ID NO: 3968368 - RNA, 15 nt, Human herpesvirus 4 (Epstein-Barr virus)
gugggcugacacaga

SEQ ID NO: 3968369 - RNA, 15 nt, Human herpesvirus 4 (Epstein-Barr virus)
guguacgugccucag

SEQ ID NO: 3968370 - RNA, 22 nt, Human herpesvirus 4 (Epstein-Barr virus)
ggagcaggaggaggggcaggag

SEQ ID NO: 3968371 - RNA, 15 nt, Human herpesvirus 4 (Epstein-Barr virus)
ggagcgggaggggca

SEQ ID NO: 3968372 - RNA, 19 nt, Human herpesvirus 4 (Epstein-Barr virus)
ggagcggggguucuccagg

SEQ ID NO: 3968373 - RNA, 16 nt, Human herpesvirus 4 (Epstein-Barr virus)
ggaggaaacaggagga

SEQ ID NO: 3968374 - RNA, 13 nt, Human herpesvirus 4 (Epstein-Barr virus)
ggaggaagauggc

SEQ ID NO: 3968375 - RNA, 18 nt, Human herpesvirus 4 (Epstein-Barr virus)
ggagguaauuagcacggu

SEQ ID NO: 3968376 - RNA, 22 nt, Human herpesvirus 4 (Epstein-Barr virus)
ggaguaaggccgcugccaggcc

SEQ ID NO: 3968377 - RNA, 12 nt, Human herpesvirus 4 (Epstein-Barr virus)
ggaguuucgcuu

SEQ ID NO: 3968378 - RNA, 19 nt, Human herpesvirus 4 (Epstein-Barr virus)
ggaucagucgcuggcuggu

SEQ ID NO: 3968379 - RNA, 20 nt, Human herpesvirus 4 (Epstein-Barr virus)
ggaucccauggaggagauga

SEQ ID NO: 3968380 - RNA, 21 nt, Human herpesvirus 4 (Epstein-Barr virus)
ggauggaagagaggggcaggg

SEQ ID NO: 3968381 - RNA, 16 nt, Human herpesvirus 4 (Epstein-Barr virus)
ggcaaaggucccaggc

SEQ ID NO: 3968382 - RNA, 18 nt, Human herpesvirus 4 (Epstein-Barr virus)
ggcacacauuacggugcu

SEQ ID NO: 3968383 - RNA, 10 nt, Human herpesvirus 4 (Epstein-Barr virus)
ggcacccagg

SEQ ID NO: 3968384 - RNA, 23 nt, Human herpesvirus 4 (Epstein-Barr virus)
ggcaccuguccuugucugcugcc

SEQ ID NO: 3968385 - RNA, 22 nt, Human herpesvirus 4 (Epstein-Barr virus)
ggcagaaccaucagcucgccca

SEQ ID NO: 3968386 - RNA, 19 nt, Human herpesvirus 4 (Epstein-Barr virus)
ggcagaggccucucucgag

SEQ ID NO: 3968387 - RNA, 19 nt, Human herpesvirus 4 (Epstein-Barr virus)
ggcagccuugcguggugcu

SEQ ID NO: 3968388 - RNA, 23 nt, Human herpesvirus 4 (Epstein-Barr virus)
ggcagcgaagaacacuccacaga

SEQ ID NO: 3968389 - RNA, 18 nt, Human herpesvirus 4 (Epstein-Barr virus)
ggcauguguacuuguccu

SEQ ID NO: 3968390 - RNA, 23 nt, Human herpesvirus 4 (Epstein-Barr virus)
ggccaccacaucggacgggcagg

SEQ ID NO: 3968391 - RNA, 17 nt, Human herpesvirus 4 (Epstein-Barr virus)
ggccaucgcaagcuccu

SEQ ID NO: 3968392 - RNA, 17 nt, Human herpesvirus 4 (Epstein-Barr virus)
ggcccacgucuuuacca

SEQ ID NO: 3968393 - RNA, 18 nt, Human herpesvirus 4 (Epstein-Barr virus)
ggcccagcccuccucaga

SEQ ID NO: 3968394 - RNA, 19 nt, Human herpesvirus 4 (Epstein-Barr virus)
ggcccccagcuucugaggc

SEQ ID NO: 3968395 - RNA, 17 nt, Human herpesvirus 4 [Epstein-Barr virus]
cccagacucugcuuucu

SEQ ID NO: 3968396 - RNA, 13 nt, Human herpesvirus 4 [Epstein-Barr virus]
cccagcagcagcc

SEQ ID NO: 3968397 - RNA, 14 nt, Human herpesvirus 4 [Epstein-Barr virus]
cccagccccuccuc

SEQ ID NO: 3968398 - RNA, 19 nt, Human herpesvirus 4 [Epstein-Barr virus]
cccagcccgccagccaccc

SEQ ID NO: 3968399 - RNA, 23 nt, Human herpesvirus 4 [Epstein-Barr virus]
cccagccuacucuccacucccag

SEQ ID NO: 3968400 - RNA, 20 nt, Human herpesvirus 4 [Epstein-Barr virus]
cccagcuaguagcccuugga

SEQ ID NO: 3968401 - RNA, 15 nt, Human herpesvirus 4 [Epstein-Barr virus]
cccagcuucugaggc

SEQ ID NO: 3968402 - RNA, 19 nt, Human herpesvirus 4 [Epstein-Barr virus]
cccagggcagacugcacag

SEQ ID NO: 3968403 - RNA, 16 nt, Human herpesvirus 4 [Epstein-Barr virus]
cccagggguggcagug

SEQ ID NO: 3968404 - RNA, 23 nt, Human herpesvirus 4 [Epstein-Barr virus]
cccaguugacggacgugcccagc

SEQ ID NO: 3968405 - RNA, 18 nt, Human herpesvirus 4 [Epstein-Barr virus]
cccaucugagggcaguga

SEQ ID NO: 3968406 - RNA, 16 nt, Human herpesvirus 4 [Epstein-Barr virus]
cccaugccuccccagc

SEQ ID NO: 3968407 - RNA, 20 nt, Human herpesvirus 4 [Epstein-Barr virus]
ccccacaaacaccagugucc

SEQ ID NO: 3968408 - RNA, 13 nt, Human herpesvirus 4 [Epstein-Barr virus]
ccccaccaccccc

SEQ ID NO: 3968409 - RNA, 19 nt, Human herpesvirus 4 [Epstein-Barr virus]
ccccaccaccuccaccacc

SEQ ID NO: 3968410 - RNA, 16 nt, Human herpesvirus 4 [Epstein-Barr virus]
ccccagaagcccccaa

SEQ ID NO: 3968411 - RNA, 16 nt, Human herpesvirus 4 [Epstein-Barr virus]
ccccagacucaccccc

SEQ ID NO: 3968412 - RNA, 17 nt, Human herpesvirus 4 [Epstein-Barr virus]
cccccuccauuccaccc

SEQ ID NO: 3968413 - RNA, 24 nt, Human herpesvirus 4 [Epstein-Barr virus]
cccccugcaggacacgugacaugu

SEQ ID NO: 3968414 - RNA, 13 nt, Human herpesvirus 4 [Epstein-Barr virus]
ccccgccaccacg

SEQ ID NO: 3968415 - RNA, 20 nt, Human herpesvirus 4 [Epstein-Barr virus]
ccccggagcccugcccuccu

SEQ ID NO: 3968416 - RNA, 22 nt, Human herpesvirus 4 [Epstein-Barr virus]
ccccuccauuccacccacugau

SEQ ID NO: 3968417 - RNA, 16 nt, Human herpesvirus 4 [Epstein-Barr virus]
ccccucccgccccugu

SEQ ID NO: 3968418 - RNA, 16 nt, Human herpesvirus 4 [Epstein-Barr virus]
ccccugccugcaugcu

SEQ ID NO: 3968419 - RNA, 16 nt, Human herpesvirus 4 [Epstein-Barr virus]
ccccuggcggcccagc

SEQ ID NO: 3968420 - RNA, 20 nt, Human herpesvirus 4 [Epstein-Barr virus]
cccgaaagcggcccagcaga

SEQ ID NO: 3968421 - RNA, 23 nt, Human herpesvirus 4 [Epstein-Barr virus]
cccgacuuauggcuagauuuccu

SEQ ID NO: 3968422 - RNA, 17 nt, Human herpesvirus 4 [Epstein-Barr virus]
cccgagaccggcuccgg

SEQ ID NO: 3968423 - RNA, 18 nt, Human herpesvirus 4 [Epstein-Barr virus]
cccgccagcgccuccucg

SEQ ID NO: 3968424 - RNA, 23 nt, Human herpesvirus 4 [Epstein-Barr virus]
cccgccgugaacucugcccuuca

SEQ ID NO: 3968425 - RNA, 16 nt, Human herpesvirus 4 [Epstein-Barr virus]
cccggccgaggccugc

SEQ ID NO: 3968426 - RNA, 14 nt, Human herpesvirus 4 [Epstein-Barr virus]
cccggccucccgcu

SEQ ID NO: 3968427 - RNA, 13 nt, Human herpesvirus 4 [Epstein-Barr virus]
cccggcgccaccu

SEQ ID NO: 3968428 - RNA, 22 nt, Human herpesvirus 4 [Epstein-Barr virus]
cccgggaccgcgcccuccucug

SEQ ID NO: 3968429 - RNA, 19 nt, Human herpesvirus 4 [Epstein-Barr virus]
cccgggggaggagaagaga

SEQ ID NO: 3968430 - RNA, 18 nt, Human herpesvirus 4 [Epstein-Barr virus]
cccggggguggaggcugc

SEQ ID NO: 3968431 - RNA, 20 nt, Human herpesvirus 4 [Epstein-Barr virus]
cccggguacccuuucuacca

SEQ ID NO: 3968432 - RNA, 17 nt, Human herpesvirus 4 [Epstein-Barr virus]
cccuacucuccacggga

SEQ ID NO: 3968433 - RNA, 16 nt, Human herpesvirus 4 [Epstein-Barr virus]
cccucccgcacccuca

SEQ ID NO: 3968434 - RNA, 19 nt, Human herpesvirus 4 [Epstein-Barr virus]
cccucguggcauccuucag

SEQ ID NO: 3968435 - RNA, 21 nt, Human herpesvirus 4 [Epstein-Barr virus]
cccugaacaucucauccccag

SEQ ID NO: 3968436 - RNA, 14 nt, Human herpesvirus 4 [Epstein-Barr virus]
cccugacgcugugg

SEQ ID NO: 3968437 - RNA, 15 nt, Human herpesvirus 4 [Epstein-Barr virus]
cccugagcuggacga

SEQ ID NO: 3968438 - RNA, 17 nt, Human herpesvirus 4 [Epstein-Barr virus]
cccugcauggccaggcc

SEQ ID NO: 3968439 - RNA, 20 nt, Human herpesvirus 4 [Epstein-Barr virus]
cccugccccucggugggcca

SEQ ID NO: 3968440 - RNA, 14 nt, Human herpesvirus 4 [Epstein-Barr virus]
cccugcugucucug

SEQ ID NO: 3968441 - RNA, 13 nt, Human herpesvirus 4 [Epstein-Barr virus]
cccugucuccccu

SEQ ID NO: 3968442 - RNA, 14 nt, Human herpesvirus 4 [Epstein-Barr virus]
cccugugcuucuac

SEQ ID NO: 3968443 - RNA, 15 nt, Human herpesvirus 4 [Epstein-Barr virus]
cccuuuuaacauugg

SEQ ID NO: 3968444 - RNA, 17 nt, Human herpesvirus 4 [Epstein-Barr virus]
ccgacgagcagaggacu

SEQ ID NO: 3968445 - RNA, 20 nt, Human herpesvirus 4 [Epstein-Barr virus]
ccgagaccaaggcggcugcu

SEQ ID NO: 3968446 - RNA, 20 nt, Human herpesvirus 4 [Epstein-Barr virus]
ccgagggugaggcccagccc

SEQ ID NO: 3968447 - RNA, 18 nt, Human herpesvirus 4 [Epstein-Barr virus]
ccgaggucagaaagaggc

SEQ ID NO: 3968448 - RNA, 15 nt, Human herpesvirus 4 [Epstein-Barr virus]
ccgaucagagcccca

SEQ ID NO: 3968449 - RNA, 22 nt, Human herpesvirus 4 [Epstein-Barr virus]
ccgaugcccaccagccagcgac

SEQ ID NO: 3968450 - RNA, 20 nt, Human herpesvirus 4 [Epstein-Barr virus]
ccgcauccuaggcacggccu

SEQ ID NO: 3968451 - RNA, 14 nt, Human herpesvirus 4 [Epstein-Barr virus]
ccgccagcagcccc

SEQ ID NO: 3968452 - RNA, 14 nt, Human herpesvirus 4 [Epstein-Barr virus]
ccgccagcgccucc

SEQ ID NO: 3968453 - RNA, 16 nt, Human herpesvirus 4 [Epstein-Barr virus]
ccgccagcgccuccuc

SEQ ID NO: 3968454 - RNA, 15 nt, Human herpesvirus 4 [Epstein-Barr virus]
ccgcccgccuggcuc

SEQ ID NO: 3968455 - RNA, 23 nt, Human herpesvirus 4 [Epstein-Barr virus]
ccgccgcagaagagccgcuccgu

SEQ ID NO: 3968456 - RNA, 16 nt, Human herpesvirus 4 [Epstein-Barr virus]
ccgcggugguggcccu

SEQ ID NO: 3968457 - RNA, 22 nt, Human herpesvirus 4 [Epstein-Barr virus]
ccgcucggguaagugcuuuuuc

SEQ ID NO: 3968458 - RNA, 16 nt, Human herpesvirus 4 [Epstein-Barr virus]
ccgggaggugcugggu

SEQ ID NO: 3968459 - RNA, 13 nt, Human herpesvirus 4 [Epstein-Barr virus]
ccgggcccagccc

SEQ ID NO: 3968460 - RNA, 17 nt, Human herpesvirus 4 [Epstein-Barr virus]
ccgggcccagcccuccu

SEQ ID NO: 3968461 - RNA, 18 nt, Human herpesvirus 4 [Epstein-Barr virus]
cugacaccggugacagug

SEQ ID NO: 3968462 - RNA, 16 nt, Human herpesvirus 4 [Epstein-Barr virus]
cugacauauguacaau

SEQ ID NO: 3968463 - RNA, 13 nt, Human herpesvirus 4 [Epstein-Barr virus]
cugaccaggacau

SEQ ID NO: 3968464 - RNA, 15 nt, Human herpesvirus 4 [Epstein-Barr virus]
cugaccaucacaugg

SEQ ID NO: 3968465 - RNA, 19 nt, Human herpesvirus 4 [Epstein-Barr virus]
cugagaauaaggcucugaa

SEQ ID NO: 3968466 - RNA, 16 nt, Human herpesvirus 4 [Epstein-Barr virus]
cugagacagaggugcu

SEQ ID NO: 3968467 - RNA, 20 nt, Human herpesvirus 4 [Epstein-Barr virus]
cugagaccucuguguccaag

SEQ ID NO: 3968468 - RNA, 23 nt, Human herpesvirus 4 [Epstein-Barr virus]
cugagcuggacgagguccuggac

SEQ ID NO: 3968469 - RNA, 19 nt, Human herpesvirus 4 [Epstein-Barr virus]
cugaggcccguccccugac

SEQ ID NO: 3968470 - RNA, 18 nt, Human herpesvirus 4 [Epstein-Barr virus]
cugagugcccagggcaga

SEQ ID NO: 3968471 - RNA, 20 nt, Human herpesvirus 4 [Epstein-Barr virus]
cugauaaaguuguccugggc

SEQ ID NO: 3968472 - RNA, 18 nt, Human herpesvirus 4 [Epstein-Barr virus]
cugaucugggagaugaga

SEQ ID NO: 3968473 - RNA, 14 nt, Human herpesvirus 4 [Epstein-Barr virus]
cugaugugcugccc

SEQ ID NO: 3968474 - RNA, 18 nt, Human herpesvirus 4 [Epstein-Barr virus]
cugcagcuaugggguccc

SEQ ID NO: 3968475 - RNA, 19 nt, Human herpesvirus 4 [Epstein-Barr virus]
cugcagugggccucucugg

SEQ ID NO: 3968476 - RNA, 19 nt, Human herpesvirus 4 [Epstein-Barr virus]
cugccaacuuugagcuggg

SEQ ID NO: 3968477 - RNA, 12 nt, Human herpesvirus 4 [Epstein-Barr virus]
cugcccauccau

SEQ ID NO: 3968478 - RNA, 16 nt, Human herpesvirus 4 [Epstein-Barr virus]
cugccccguugcaccg

SEQ ID NO: 3968479 - RNA, 21 nt, Human herpesvirus 4 [Epstein-Barr virus]
cugcccggacggccuagccau

SEQ ID NO: 3968480 - RNA, 13 nt, Human herpesvirus 4 [Epstein-Barr virus]
cugcccuccucca

SEQ ID NO: 3968481 - RNA, 22 nt, Human herpesvirus 4 [Epstein-Barr virus]
cugcccuccuccacccagcagc

SEQ ID NO: 3968482 - RNA, 22 nt, Human herpesvirus 4 [Epstein-Barr virus]
cugccucccugccccucggugg

SEQ ID NO: 3968483 - RNA, 22 nt, Human herpesvirus 4 [Epstein-Barr virus]
cugccuccggccgccccgggcc

SEQ ID NO: 3968484 - RNA, 17 nt, Human herpesvirus 4 [Epstein-Barr virus]
cugccuuacacuggaaa

SEQ ID NO: 3968485 - RNA, 20 nt, Human herpesvirus 4 [Epstein-Barr virus]
cugcgagggggccuggugcc

SEQ ID NO: 3968486 - RNA, 21 nt, Human herpesvirus 4 [Epstein-Barr virus]
cugcgagggggccuggugcca

SEQ ID NO: 3968487 - RNA, 22 nt, Human herpesvirus 4 [Epstein-Barr virus]
cugcgaugagggccuuccagag

SEQ ID NO: 3968488 - RNA, 12 nt, Human herpesvirus 4 [Epstein-Barr virus]
cugcgccuccug

SEQ ID NO: 3968489 - RNA, 14 nt, Human herpesvirus 4 [Epstein-Barr virus]
cugcggggaaacca

SEQ ID NO: 3968490 - RNA, 16 nt, Human herpesvirus 4 [Epstein-Barr virus]
cugcguccucuaccug

SEQ ID NO: 3968491 - RNA, 16 nt, Human herpesvirus 4 [Epstein-Barr virus]
cugcuagcgucacuga

SEQ ID NO: 3968492 - RNA, 19 nt, Human herpesvirus 4 [Epstein-Barr virus]
cugcucuucaaccuuggca

SEQ ID NO: 3968493 - RNA, 17 nt, Human herpesvirus 4 [Epstein-Barr virus]
cugcugcugcuggucau

SEQ ID NO: 3968494 - RNA, 15 nt, Human herpesvirus 4 [Epstein-Barr virus]
cugcuucuggcucuu

SEQ ID NO: 3968495 - RNA, 13 nt, Human herpesvirus 4 [Epstein-Barr virus]
cugcuuucugccg

SEQ ID NO: 3968496 - RNA, 14 nt, Human herpesvirus 4 [Epstein-Barr virus]
cuggagcuggugca

SEQ ID NO: 3968497 - RNA, 18 nt, Human herpesvirus 4 [Epstein-Barr virus]
cuggagcuggugcaccug

SEQ ID NO: 3968498 - RNA, 23 nt, Human herpesvirus 4 [Epstein-Barr virus]
cuggaggacggucuggcacugga

SEQ ID NO: 3968499 - RNA, 23 nt, Human herpesvirus 4 [Epstein-Barr virus]
cuggaggcaauggucgccagggu

SEQ ID NO: 3968500 - RNA, 12 nt, Human herpesvirus 4 [Epstein-Barr virus]
cuggaggccuca

SEQ ID NO: 3968501 - RNA, 15 nt, Human herpesvirus 4 [Epstein-Barr virus]
cuggcagaaaggcug

SEQ ID NO: 3968502 - RNA, 18 nt, Human herpesvirus 4 [Epstein-Barr virus]
cuggcagaaaggcuggcc

SEQ ID NO: 3968503 - RNA, 17 nt, Human herpesvirus 4 [Epstein-Barr virus]
cuggccaaccugccucu

SEQ ID NO: 3968504 - RNA, 23 nt, Human herpesvirus 4 [Epstein-Barr virus]
cuggccaccacaucggacgggca

SEQ ID NO: 3968505 - RNA, 15 nt, Human herpesvirus 4 [Epstein-Barr virus]
gagcaggagcaggag

SEQ ID NO: 3968506 - RNA, 19 nt, Human herpesvirus 4 [Epstein-Barr virus]
gagcaggaggaggggcagg

SEQ ID NO: 3968507 - RNA, 22 nt, Human herpesvirus 4 [Epstein-Barr virus]
gagccagaucuaaggccgggag

SEQ ID NO: 3968508 - RNA, 19 nt, Human herpesvirus 4 [Epstein-Barr virus]
gagcugcaccggagccugc

SEQ ID NO: 3968509 - RNA, 15 nt, Human herpesvirus 4 [Epstein-Barr virus]
gagcuggacgagguc

SEQ ID NO: 3968510 - RNA, 14 nt, Human herpesvirus 4 [Epstein-Barr virus]
gagcuguuuggcuc

SEQ ID NO: 3968511 - RNA, 12 nt, Human herpesvirus 4 [Epstein-Barr virus]
gaggaaacagga

SEQ ID NO: 3968512 - RNA, 14 nt, Human herpesvirus 4 [Epstein-Barr virus]
gaggacgugaguga

SEQ ID NO: 3968513 - RNA, 14 nt, Human herpesvirus 4 [Epstein-Barr virus]
gaggagauccgcca

SEQ ID NO: 3968514 - RNA, 15 nt, Human herpesvirus 4 [Epstein-Barr virus]
gaggaggaccuggug

SEQ ID NO: 3968515 - RNA, 21 nt, Human herpesvirus 4 [Epstein-Barr virus]
gaggaggcuggugccuuggcu

SEQ ID NO: 3968516 - RNA, 12 nt, Human herpesvirus 4 [Epstein-Barr virus]
gaggcgcagccc

SEQ ID NO: 3968517 - RNA, 21 nt, Human herpesvirus 4 [Epstein-Barr virus]
gaggcggaagaccaggagccc

SEQ ID NO: 3968518 - RNA, 16 nt, Human herpesvirus 4 [Epstein-Barr virus]
gaggcguccgccccga

SEQ ID NO: 3968519 - RNA, 15 nt, Human herpesvirus 4 [Epstein-Barr virus]
gaggcuucccgccua

SEQ ID NO: 3968520 - RNA, 23 nt, Human herpesvirus 4 [Epstein-Barr virus]
gagggggccugagacuggacccu

SEQ ID NO: 3968521 - RNA, 13 nt, Human herpesvirus 4 [Epstein-Barr virus]
gagggggccuggu

SEQ ID NO: 3968522 - RNA, 23 nt, Human herpesvirus 4 [Epstein-Barr virus]
gagguaaugauuacgcaggccac

SEQ ID NO: 3968523 - RNA, 21 nt, Human herpesvirus 4 [Epstein-Barr virus]
gagguacaugggccacugcag

SEQ ID NO: 3968524 - RNA, 15 nt, Human herpesvirus 4 [Epstein-Barr virus]
gaggugauguagagg

SEQ ID NO: 3968525 - RNA, 15 nt, Human herpesvirus 4 [Epstein-Barr virus]
gagguugggccacgc

SEQ ID NO: 3968526 - RNA, 20 nt, Human herpesvirus 4 [Epstein-Barr virus]
gaguaaggccgcugccaggc

SEQ ID NO: 3968527 - RNA, 15 nt, Human herpesvirus 4 [Epstein-Barr virus]
gaguaauugcagugg

SEQ ID NO: 3968528 - RNA, 19 nt, Human herpesvirus 4 [Epstein-Barr virus]
gagucaguuacacacacag

SEQ ID NO: 3968529 - RNA, 23 nt, Human herpesvirus 4 [Epstein-Barr virus]
gaguccaaacagcuaauuucuac

SEQ ID NO: 3968530 - RNA, 15 nt, Human herpesvirus 4 [Epstein-Barr virus]
gagucugcuggacuc

SEQ ID NO: 3968531 - RNA, 14 nt, Human herpesvirus 4 [Epstein-Barr virus]
gaguguagaggugg

SEQ ID NO: 3968532 - RNA, 15 nt, Human herpesvirus 4 [Epstein-Barr virus]
gaguucccggcugcu

SEQ ID NO: 3968533 - RNA, 17 nt, Human herpesvirus 4 [Epstein-Barr virus]
gaguucuacaaugccag

SEQ ID NO: 3968534 - RNA, 20 nt, Human herpesvirus 4 [Epstein-Barr virus]
gaguuggcaucuuccuccuu

SEQ ID NO: 3968535 - RNA, 20 nt, Human herpesvirus 4 [Epstein-Barr virus]
gauauagcucugcacaggcu

SEQ ID NO: 3968536 - RNA, 23 nt, Human herpesvirus 4 [Epstein-Barr virus]
gauaucacacccucggagaucau

SEQ ID NO: 3968537 - RNA, 13 nt, Human herpesvirus 4 [Epstein-Barr virus]
gauccccagugga

SEQ ID NO: 3968538 - RNA, 14 nt, Human herpesvirus 4 [Epstein-Barr virus]
gaucgauuggaaaa

SEQ ID NO: 3968539 - RNA, 15 nt, Human herpesvirus 4 [Epstein-Barr virus]
gaucuggggcuggcc

SEQ ID NO: 3968540 - RNA, 18 nt, Human herpesvirus 4 [Epstein-Barr virus]
gaugacugagcgcacggc

SEQ ID NO: 3968541 - RNA, 14 nt, Human herpesvirus 4 [Epstein-Barr virus]
gaugagcuggagac

SEQ ID NO: 3968542 - RNA, 24 nt, Human herpesvirus 4 [Epstein-Barr virus]
gaugaggcugaugauggccacgac

SEQ ID NO: 3968543 - RNA, 18 nt, Human herpesvirus 4 [Epstein-Barr virus]
gaugcauacgcugaguga

SEQ ID NO: 3968544 - RNA, 20 nt, Human herpesvirus 4 [Epstein-Barr virus]
gaugcccaccagccagcgac

SEQ ID NO: 3968545 - RNA, 21 nt, Human herpesvirus 4 [Epstein-Barr virus]
gaugcugccgcuacugcugcu

SEQ ID NO: 3968546 - RNA, 21 nt, Human herpesvirus 4 [Epstein-Barr virus]
gauggggcgcgcuucagcucc

SEQ ID NO: 3968547 - RNA, 15 nt, Human herpesvirus 4 [Epstein-Barr virus]
gauggugcuggucuc

SEQ ID NO: 3968548 - RNA, 22 nt, Human herpesvirus 4 [Epstein-Barr virus]
gauguacuuuccuagaaacugu

SEQ ID NO: 3968549 - RNA, 15 nt, Human herpesvirus 4 [Epstein-Barr virus]
gauugaggcaauggc

SEQ ID NO: 3968550 - RNA, 19 nt, Human herpesvirus 4 [Epstein-Barr virus]
gauuggaaaagggcccagg

SEQ ID NO: 3968551 - RNA, 19 nt, Human herpesvirus 4 [Epstein-Barr virus]
gauuucuaguuaccacagg

SEQ ID NO: 3968552 - RNA, 17 nt, Human herpesvirus 4 [Epstein-Barr virus]
gcaaacugacacacagg

SEQ ID NO: 3968553 - RNA, 13 nt, Human herpesvirus 4 [Epstein-Barr virus]
gcaaccuuggggg

SEQ ID NO: 3968554 - RNA, 16 nt, Human herpesvirus 4 [Epstein-Barr virus]
gcaaccuugggggcaa

SEQ ID NO: 3968555 - RNA, 14 nt, Human herpesvirus 4 [Epstein-Barr virus]
gcaaggacgggggu

SEQ ID NO: 3968556 - RNA, 14 nt, Human herpesvirus 4 [Epstein-Barr virus]
gcaaggauggaaga

SEQ ID NO: 3968557 - RNA, 14 nt, Human herpesvirus 4 [Epstein-Barr virus]
gcacagccagagag

SEQ ID NO: 3968558 - RNA, 18 nt, Human herpesvirus 4 [Epstein-Barr virus]
gcacaggaugacagcugu

SEQ ID NO: 3968559 - RNA, 17 nt, Human herpesvirus 4 [Epstein-Barr virus]
gcacccggcuggacccc

SEQ ID NO: 3968560 - RNA, 18 nt, Human herpesvirus 4 [Epstein-Barr virus]
gcaccgaacauggguaau

SEQ ID NO: 3968561 - RNA, 13 nt, Human herpesvirus 4 [Epstein-Barr virus]
gcaccggagccac

SEQ ID NO: 3968562 - RNA, 16 nt, Human herpesvirus 4 [Epstein-Barr virus]
gcaccggagccaccac

SEQ ID NO: 3968563 - RNA, 15 nt, Human herpesvirus 4 [Epstein-Barr virus]
gcaccugucccuggg

SEQ ID NO: 3968564 - RNA, 15 nt, Human herpesvirus 4 [Epstein-Barr virus]
gcaccuguguccugg

SEQ ID NO: 3968565 - RNA, 17 nt, Human herpesvirus 4 [Epstein-Barr virus]
gcacggucgccccuccg

SEQ ID NO: 3968566 - RNA, 20 nt, Human herpesvirus 4 [Epstein-Barr virus]
gcacugcguccaccuggcca

SEQ ID NO: 3968567 - RNA, 22 nt, Human herpesvirus 4 [Epstein-Barr virus]
gcagacaccuuuacccagcccu

SEQ ID NO: 3968568 - RNA, 18 nt, Human herpesvirus 4 [Epstein-Barr virus]
gcagaccccagagcagcc

SEQ ID NO: 3968569 - RNA, 17 nt, Human herpesvirus 4 [Epstein-Barr virus]
gcagaggccaucauggc

SEQ ID NO: 3968570 - RNA, 12 nt, Human herpesvirus 4 [Epstein-Barr virus]
gcagaggccugc

SEQ ID NO: 3968571 - RNA, 19 nt, Human herpesvirus 4 [Epstein-Barr virus]
gcagaggccugcaccaguu

SEQ ID NO: 3968572 - RNA, 21 nt, Human herpesvirus 4 [Epstein-Barr virus]
gcagauagccggccaggcaga

SEQ ID NO: 3968573 - RNA, 22 nt, Human herpesvirus 4 [Epstein-Barr virus]
gcagauuuccgucagccagggu

SEQ ID NO: 3968574 - RNA, 14 nt, Human herpesvirus 4 [Epstein-Barr virus]
gcagcagcucuggc

SEQ ID NO: 3968575 - RNA, 19 nt, Human herpesvirus 4 [Epstein-Barr virus]
gcagcaguggccagcucau

SEQ ID NO: 3968576 - RNA, 19 nt, Human herpesvirus 4 [Epstein-Barr virus]
gcagcagugugugaagauu

SEQ ID NO: 3968577 - RNA, 13 nt, Human herpesvirus 4 [Epstein-Barr virus]
gcagcauuuacaa

SEQ ID NO: 3968578 - RNA, 18 nt, Human herpesvirus 4 [Epstein-Barr virus]
gcagccuguucauagaga

SEQ ID NO: 3968579 - RNA, 23 nt, Human herpesvirus 4 [Epstein-Barr virus]
ugcuucuggaccgugccauccuc

SEQ ID NO: 3968580 - RNA, 21 nt, Human herpesvirus 4 [Epstein-Barr virus]
ugcuuuuugccaggccuguca

SEQ ID NO: 3968581 - RNA, 14 nt, Human herpesvirus 4 [Epstein-Barr virus]
uggaaacccucagu

SEQ ID NO: 3968582 - RNA, 15 nt, Human herpesvirus 4 [Epstein-Barr virus]
uggaacaggagcagg

SEQ ID NO: 3968583 - RNA, 15 nt, Human herpesvirus 4 [Epstein-Barr virus]
uggaacccuagccac

SEQ ID NO: 3968584 - RNA, 14 nt, Human herpesvirus 4 [Epstein-Barr virus]
uggacacccacccu

SEQ ID NO: 3968585 - RNA, 12 nt, Human herpesvirus 4 [Epstein-Barr virus]
uggacaugcuga

SEQ ID NO: 3968586 - RNA, 13 nt, Human herpesvirus 4 [Epstein-Barr virus]
uggacugugguau

SEQ ID NO: 3968587 - RNA, 20 nt, Human herpesvirus 4 [Epstein-Barr virus]
uggagagauuucauccucag

SEQ ID NO: 3968588 - RNA, 21 nt, Human herpesvirus 4 [Epstein-Barr virus]
uggagaugauucaugggcugg

SEQ ID NO: 3968589 - RNA, 13 nt, Human herpesvirus 4 [Epstein-Barr virus]
uggagaugcucug

SEQ ID NO: 3968590 - RNA, 18 nt, Human herpesvirus 4 [Epstein-Barr virus]
uggaggcugcgccugagc

SEQ ID NO: 3968591 - RNA, 21 nt, Human herpesvirus 4 [Epstein-Barr virus]
uggaggggggcggcguggagc

SEQ ID NO: 3968592 - RNA, 14 nt, Human herpesvirus 4 [Epstein-Barr virus]
uggcaaagggcaug

SEQ ID NO: 3968593 - RNA, 16 nt, Human herpesvirus 4 [Epstein-Barr virus]
uggcacgggcagagga

SEQ ID NO: 3968594 - RNA, 15 nt, Human herpesvirus 4 [Epstein-Barr virus]
uggcacgguccagaa

SEQ ID NO: 3968595 - RNA, 13 nt, Human herpesvirus 4 [Epstein-Barr virus]
uggcagcaguggc

SEQ ID NO: 3968596 - RNA, 14 nt, Human herpesvirus 4 [Epstein-Barr virus]
uggcaggagaggcg

SEQ ID NO: 3968597 - RNA, 19 nt, Human herpesvirus 4 [Epstein-Barr virus]
uggcaguauuuugcaaaca

SEQ ID NO: 3968598 - RNA, 17 nt, Human herpesvirus 4 [Epstein-Barr virus]
uggccagguacgggcug

SEQ ID NO: 3968599 - RNA, 19 nt, Human herpesvirus 4 [Epstein-Barr virus]
uggcccugcaaacugacac

SEQ ID NO: 3968600 - RNA, 16 nt, Human herpesvirus 4 [Epstein-Barr virus]
uggccggugcugccag

SEQ ID NO: 3968601 - RNA, 15 nt, Human herpesvirus 4 [Epstein-Barr virus]
uggccguccucugga

SEQ ID NO: 3968602 - RNA, 18 nt, Human herpesvirus 4 [Epstein-Barr virus]
uggccuccagcucggcca

SEQ ID NO: 3968603 - RNA, 22 nt, Human herpesvirus 4 [Epstein-Barr virus]
uggccuccagcucggccagcag

SEQ ID NO: 3968604 - RNA, 16 nt, Human herpesvirus 4 [Epstein-Barr virus]
uggcgucucaggcuau

SEQ ID NO: 3968605 - RNA, 14 nt, Human herpesvirus 4 [Epstein-Barr virus]
uggcucgccucauc

SEQ ID NO: 3968606 - RNA, 19 nt, Human herpesvirus 4 [Epstein-Barr virus]
uggcucgccucauccuggc

SEQ ID NO: 3968607 - RNA, 15 nt, Human herpesvirus 4 [Epstein-Barr virus]
uggcucucuucgcca

SEQ ID NO: 3968608 - RNA, 13 nt, Human herpesvirus 4 [Epstein-Barr virus]
uggcugccccggc

SEQ ID NO: 3968609 - RNA, 14 nt, Human herpesvirus 4 [Epstein-Barr virus]
uggcugugcugacc

SEQ ID NO: 3968610 - RNA, 16 nt, Human herpesvirus 4 [Epstein-Barr virus]
uggcuugcuccaccag

SEQ ID NO: 3968611 - RNA, 18 nt, Human herpesvirus 4 [Epstein-Barr virus]
ugggaauaacaagggaag

SEQ ID NO: 3968612 - RNA, 16 nt, Human herpesvirus 4 [Epstein-Barr virus]
ugggaccuacaggaca

SEQ ID NO: 3968613 - RNA, 20 nt, Human herpesvirus 4 [Epstein-Barr virus]
ugggagcaaccagcugguca

SEQ ID NO: 3968614 - RNA, 18 nt, Human herpesvirus 4 [Epstein-Barr virus]
ugggcaugacacaggaca

SEQ ID NO: 3968615 - RNA, 16 nt, Human herpesvirus 4 [Epstein-Barr virus]
ugggcugcuauaguga

SEQ ID NO: 3968616 - RNA, 18 nt, Human herpesvirus 4 [Epstein-Barr virus]
uggggccagaggcgacgc

SEQ ID NO: 3968617 - RNA, 19 nt, Human herpesvirus 4 [Epstein-Barr virus]
uggggcugagaccaugcuc

SEQ ID NO: 3968618 - RNA, 18 nt, Human herpesvirus 4 [Epstein-Barr virus]
ugggucagugauggaaag

SEQ ID NO: 3968619 - RNA, 17 nt, Human herpesvirus 4 [Epstein-Barr virus]
ugggugcacagguggcc

SEQ ID NO: 3968620 - RNA, 13 nt, Human herpesvirus 4 [Epstein-Barr virus]
ugggugggcauug

SEQ ID NO: 3968621 - RNA, 17 nt, Human herpesvirus 4 [Epstein-Barr virus]
ugguccaggguccagga

SEQ ID NO: 3968622 - RNA, 18 nt, Human herpesvirus 4 [Epstein-Barr virus]
ugguccaggguccaggag

SEQ ID NO: 3968623 - RNA, 13 nt, Human herpesvirus 4 [Epstein-Barr virus]
ugguccugagggg

SEQ ID NO: 3968624 - RNA, 18 nt, Human herpesvirus 4 [Epstein-Barr virus]
uggucgcccccucugccu

SEQ ID NO: 3968625 - RNA, 22 nt, Human herpesvirus 4 [Epstein-Barr virus]
uggucgucaucuggcucuccug

SEQ ID NO: 3968626 - RNA, 22 nt, Human herpesvirus 4 [Epstein-Barr virus]
uggucuccuucuuuaucuccau

SEQ ID NO: 3968627 - RNA, 16 nt, Human herpesvirus 4 [Epstein-Barr virus]
uggucuuuuaugagcc

SEQ ID NO: 3968628 - RNA, 21 nt, Human herpesvirus 4 [Epstein-Barr virus]
uggugcgguuauaacugccag

SEQ ID NO: 3968629 - RNA, 21 nt, Human herpesvirus 4 [Epstein-Barr virus]
uggugcuguccugcugaaggg

SEQ ID NO: 3968630 - RNA, 12 nt, Human herpesvirus 4 [Epstein-Barr virus]
ugguggcagcag

SEQ ID NO: 3968631 - RNA, 21 nt, Human herpesvirus 4 [Epstein-Barr virus]
ugguggcauuaauguccagug

SEQ ID NO: 3968632 - RNA, 23 nt, Human herpesvirus 4 [Epstein-Barr virus]
ugguggcccagcaacuaagagcc

SEQ ID NO: 3968633 - RNA, 15 nt, Human herpesvirus 4 [Epstein-Barr virus]
ugguucaguggacac

SEQ ID NO: 3968634 - RNA, 15 nt, Human herpesvirus 4 [Epstein-Barr virus]
ugguugucuucccag

SEQ ID NO: 3968635 - RNA, 16 nt, Human herpesvirus 4 [Epstein-Barr virus]
uguaaucgcagcucua

SEQ ID NO: 3968636 - RNA, 16 nt, Human herpesvirus 4 [Epstein-Barr virus]
uguagccacccguccc

SEQ ID NO: 3968637 - RNA, 21 nt, Human herpesvirus 4 [Epstein-Barr virus]
uguagccccuaggccugccac

SEQ ID NO: 3968638 - RNA, 20 nt, Human herpesvirus 4 [Epstein-Barr virus]
uguagcgccgcgguuucagc

SEQ ID NO: 3968639 - RNA, 19 nt, Human herpesvirus 4 [Epstein-Barr virus]
uguauugggacuugaaggu

SEQ ID NO: 3968640 - RNA, 22 nt, Human herpesvirus 4 [Epstein-Barr virus]
ugucaccaggccugccaaagag

SEQ ID NO: 3968641 - RNA, 15 nt, Human herpesvirus 4 [Epstein-Barr virus]
ugucacguguccugc

SEQ ID NO: 3968642 - RNA, 21 nt, Human herpesvirus 4 [Epstein-Barr virus]
ugucauaaccuggagucugca

SEQ ID NO: 3968643 - RNA, 15 nt, Human herpesvirus 4 [Epstein-Barr virus]
uguccagauguccag

SEQ ID NO: 3968644 - RNA, 13 nt, Human herpesvirus 4 [Epstein-Barr virus]
uguccggucaggu

SEQ ID NO: 3968645 - RNA, 15 nt, Human herpesvirus 4 [Epstein-Barr virus]
ugucuucccagacuc

SEQ ID NO: 3968646 - RNA, 19 nt, Human herpesvirus 4 [Epstein-Barr virus]
ugugccucgucuaccucug

SEQ ID NO: 3968647 - RNA, 14 nt, Human herpesvirus 4 [Epstein-Barr virus]
ugugcgcccugcuc

SEQ ID NO: 3968648 - RNA, 21 nt, Human herpesvirus 4 [Epstein-Barr virus]
ugugcugaagcccaagaagaa

SEQ ID NO: 3968649 - RNA, 18 nt, Human herpesvirus 4 [Epstein-Barr virus]
uguggccgacuucuggaa

SEQ ID NO: 3968650 - RNA, 13 nt, Human herpesvirus 4 [Epstein-Barr virus]
ugugguucuccug

SEQ ID NO: 3968651 - RNA, 15 nt, Human herpesvirus 4 [Epstein-Barr virus]
uguguacauuccagu

SEQ ID NO: 3968652 - RNA, 13 nt, Human herpesvirus 4 [Epstein-Barr virus]
uguuacuucuuuu

SEQ ID NO: 3968653 - RNA, 18 nt, Human herpesvirus 4 [Epstein-Barr virus]
uguugaagcagaugugcc

SEQ ID NO: 3968654 - RNA, 11 nt, Human herpesvirus 4 [Epstein-Barr virus]
uguugggugaa

SEQ ID NO: 3968655 - RNA, 14 nt, Human herpesvirus 4 [Epstein-Barr virus]
uguuucaagcagcu

SEQ ID NO: 3968656 - RNA, 23 nt, Human herpesvirus 4 [Epstein-Barr virus]
uguuucucagagagcauuucagg

SEQ ID NO: 3968657 - RNA, 14 nt, Human herpesvirus 4 [Epstein-Barr virus]
uguuucuggaaugc

SEQ ID NO: 3968658 - RNA, 20 nt, Human herpesvirus 4 [Epstein-Barr virus]
uuaaaaggggcagcaaucuc

SEQ ID NO: 3968659 - RNA, 14 nt, Human herpesvirus 4 [Epstein-Barr virus]
uuaaagccuccucg

SEQ ID NO: 3968660 - RNA, 19 nt, Human herpesvirus 4 [Epstein-Barr virus]
uuaacccacccaaaaugca

SEQ ID NO: 3968661 - RNA, 15 nt, Human herpesvirus 4 [Epstein-Barr virus]
uuaccagugugccag

SEQ ID NO: 3968662 - RNA, 14 nt, Human herpesvirus 4 [Epstein-Barr virus]
uuaggcacuggaca

SEQ ID NO: 3968663 - RNA, 16 nt, Human herpesvirus 4 [Epstein-Barr virus]
uuauggcagagcuuug

SEQ ID NO: 3968664 - RNA, 13 nt, Human herpesvirus 4 [Epstein-Barr virus]
uucacuuccucug

SEQ ID NO: 3968665 - RNA, 19 nt, Human herpesvirus 4 [Epstein-Barr virus]
uucaggggaaucucugcca

SEQ ID NO: 3968666 - RNA, 19 nt, Human herpesvirus 4 [Epstein-Barr virus]
uucauccucagaggaggag

SEQ ID NO: 3968667 - RNA, 12 nt, Human herpesvirus 4 [Epstein-Barr virus]
ugcaguccuccg

SEQ ID NO: 3968668 - RNA, 15 nt, Human herpesvirus 4 [Epstein-Barr virus]
ugcagucgcugcugc

SEQ ID NO: 3968669 - RNA, 15 nt, Human herpesvirus 4 [Epstein-Barr virus]
ugcauacacugaauu

SEQ ID NO: 3968670 - RNA, 17 nt, Human herpesvirus 4 [Epstein-Barr virus]
ugcauacgcugagugag

SEQ ID NO: 3968671 - RNA, 15 nt, Human herpesvirus 4 [Epstein-Barr virus]
ugcaugagccacagg

SEQ ID NO: 3968672 - RNA, 11 nt, Human herpesvirus 4 [Epstein-Barr virus]
ugcauggccag

SEQ ID NO: 3968673 - RNA, 15 nt, Human herpesvirus 4 [Epstein-Barr virus]
ugccaauccaugcca

SEQ ID NO: 3968674 - RNA, 17 nt, Human herpesvirus 4 [Epstein-Barr virus]
ugccaugcacggcccug

SEQ ID NO: 3968675 - RNA, 20 nt, Human herpesvirus 4 [Epstein-Barr virus]
ugcccagcuccgugguccug

SEQ ID NO: 3968676 - RNA, 21 nt, Human herpesvirus 4 [Epstein-Barr virus]
ugccccccuggcggcccagcc

SEQ ID NO: 3968677 - RNA, 20 nt, Human herpesvirus 4 [Epstein-Barr virus]
ugccccgguccccccagaag

SEQ ID NO: 3968678 - RNA, 19 nt, Human herpesvirus 4 [Epstein-Barr virus]
ugcccucaugcgccagagc

SEQ ID NO: 3968679 - RNA, 23 nt, Human herpesvirus 4 [Epstein-Barr virus]
ugcccuccuccacccagcagcag

SEQ ID NO: 3968680 - RNA, 22 nt, Human herpesvirus 4 [Epstein-Barr virus]
ugcccuggaggccucaggcaac

SEQ ID NO: 3968681 - RNA, 13 nt, Human herpesvirus 4 [Epstein-Barr virus]
ugccgucccaggg

SEQ ID NO: 3968682 - RNA, 16 nt, Human herpesvirus 4 [Epstein-Barr virus]
ugccuccagagccccu

SEQ ID NO: 3968683 - RNA, 15 nt, Human herpesvirus 4 [Epstein-Barr virus]
ugccugccuguaauu

SEQ ID NO: 3968684 - RNA, 15 nt, Human herpesvirus 4 [Epstein-Barr virus]
ugccugugccucguc

SEQ ID NO: 3968685 - RNA, 21 nt, Human herpesvirus 4 [Epstein-Barr virus]
ugccuguggccccggcuggcc

SEQ ID NO: 3968686 - RNA, 14 nt, Human herpesvirus 4 [Epstein-Barr virus]
ugcgagggggccug

SEQ ID NO: 3968687 - RNA, 22 nt, Human herpesvirus 4 [Epstein-Barr virus]
ugcgcgcccugucaccaggccu

SEQ ID NO: 3968688 - RNA, 21 nt, Human herpesvirus 4 [Epstein-Barr virus]
ugcggaucagucgcuggcugg

SEQ ID NO: 3968689 - RNA, 22 nt, Human herpesvirus 4 [Epstein-Barr virus]
ugcggcagaaauugaaagugcu

SEQ ID NO: 3968690 - RNA, 20 nt, Human herpesvirus 4 [Epstein-Barr virus]
ugcugccgcuacugcugcua

SEQ ID NO: 3968691 - RNA, 12 nt, Human herpesvirus 4 [Epstein-Barr virus]
gucccccuccau

SEQ ID NO: 3968692 - RNA, 20 nt, Human herpesvirus 4 [Epstein-Barr virus]
gucccccuccauuccaccca

SEQ ID NO: 3968693 - RNA, 15 nt, Human herpesvirus 4 [Epstein-Barr virus]
gucccugcugcccau

SEQ ID NO: 3968694 - RNA, 16 nt, Human herpesvirus 4 [Epstein-Barr virus]
guccgacgccugcgga

SEQ ID NO: 3968695 - RNA, 18 nt, Human herpesvirus 4 [Epstein-Barr virus]
cuaccucuuuuggcuggc

SEQ ID NO: 3968696 - RNA, 15 nt, Human herpesvirus 4 [Epstein-Barr virus]
cuacgaaacugacca

SEQ ID NO: 3968697 - RNA, 12 nt, Human herpesvirus 4 [Epstein-Barr virus]
cuacugcugcua

SEQ ID NO: 3968698 - RNA, 16 nt, Human herpesvirus 4 [Epstein-Barr virus]
cuagagguuuugcuag

SEQ ID NO: 3968699 - RNA, 18 nt, Human herpesvirus 4 [Epstein-Barr virus]
cuagccguccuguccaag

SEQ ID NO: 3968700 - RNA, 19 nt, Human herpesvirus 4 [Epstein-Barr virus]
cuagcgucacugauuuugg

SEQ ID NO: 3968701 - RNA, 21 nt, Human herpesvirus 4 [Epstein-Barr virus]
cuagcuauaaaagaggccggg

SEQ ID NO: 3968702 - RNA, 18 nt, Human herpesvirus 4 [Epstein-Barr virus]
cuaguaugaaggcuggca

SEQ ID NO: 3968703 - RNA, 17 nt, Human herpesvirus 4 [Epstein-Barr virus]
cuauagugagccaggcu

SEQ ID NO: 3968704 - RNA, 17 nt, Human herpesvirus 4 [Epstein-Barr virus]
cuaucacagggacaucu

SEQ ID NO: 3968705 - RNA, 19 nt, Human herpesvirus 4 [Epstein-Barr virus]
cucaaacggggaaggagga

SEQ ID NO: 3968706 - RNA, 13 nt, Human herpesvirus 4 [Epstein-Barr virus]
cucaccaugguag

SEQ ID NO: 3968707 - RNA, 20 nt, Human herpesvirus 4 [Epstein-Barr virus]
cucacuucuacucuuggcag

SEQ ID NO: 3968708 - RNA, 21 nt, Human herpesvirus 4 [Epstein-Barr virus]
cucacuucuacucuuggcagc

SEQ ID NO: 3968709 - RNA, 19 nt, Human herpesvirus 4 [Epstein-Barr virus]
cucagaaaacucugcaugg

SEQ ID NO: 3968710 - RNA, 15 nt, Human herpesvirus 4 [Epstein-Barr virus]
cucagaggaggagga

SEQ ID NO: 3968711 - RNA, 18 nt, Human herpesvirus 4 [Epstein-Barr virus]
cucagaggaggaggauga

SEQ ID NO: 3968712 - RNA, 22 nt, Human herpesvirus 4 [Epstein-Barr virus]
cucagagucuacucgaccagca

SEQ ID NO: 3968713 - RNA, 23 nt, Human herpesvirus 4 [Epstein-Barr virus]
cucagaugccggccaugcgcuuu

SEQ ID NO: 3968714 - RNA, 17 nt, Human herpesvirus 4 [Epstein-Barr virus]
cucagcacuuugccagc

SEQ ID NO: 3968715 - RNA, 19 nt, Human herpesvirus 4 [Epstein-Barr virus]
cucagcgucaggagagggc

SEQ ID NO: 3968716 - RNA, 17 nt, Human herpesvirus 4 [Epstein-Barr virus]
cucagcuccgcgcucaa

SEQ ID NO: 3968717 - RNA, 16 nt, Human herpesvirus 4 [Epstein-Barr virus]
cucaggcggaggcacu

SEQ ID NO: 3968718 - RNA, 16 nt, Human herpesvirus 4 [Epstein-Barr virus]
cucagguuucugggca

SEQ ID NO: 3968719 - RNA, 17 nt, Human herpesvirus 4 [Epstein-Barr virus]
cucagguuucugggcau

SEQ ID NO: 3968720 - RNA, 14 nt, Human herpesvirus 4 [Epstein-Barr virus]
cucauaauggugcc

SEQ ID NO: 3968721 - RNA, 22 nt, Human herpesvirus 4 [Epstein-Barr virus]
cucauggaggggcggcagcgga

SEQ ID NO: 3968722 - RNA, 14 nt, Human herpesvirus 4 [Epstein-Barr virus]
cuccaaaaaguugg

SEQ ID NO: 3968723 - RNA, 23 nt, Human herpesvirus 4 [Epstein-Barr virus]
cuccacagaguacgcgacugagg

SEQ ID NO: 3968724 - RNA, 11 nt, Human herpesvirus 4 [Epstein-Barr virus]
cuccaccaccu

SEQ ID NO: 3968725 - RNA, 15 nt, Human herpesvirus 4 [Epstein-Barr virus]
cuccacccagcagca

SEQ ID NO: 3968726 - RNA, 21 nt, Human herpesvirus 4 [Epstein-Barr virus]
cuccaccgccgguuaacuuua

SEQ ID NO: 3968727 - RNA, 15 nt, Human herpesvirus 4 [Epstein-Barr virus]
cuccagagagggagu

SEQ ID NO: 3968728 - RNA, 17 nt, Human herpesvirus 4 [Epstein-Barr virus]
cuccagcggcuaccugu

SEQ ID NO: 3968729 - RNA, 11 nt, Human herpesvirus 4 [Epstein-Barr virus]
cuccaggcucc

SEQ ID NO: 3968730 - RNA, 15 nt, Human herpesvirus 4 [Epstein-Barr virus]
cuccaggcuccugga

SEQ ID NO: 3968731 - RNA, 14 nt, Human herpesvirus 4 [Epstein-Barr virus]
cuccaucagggcca

SEQ ID NO: 3968732 - RNA, 16 nt, Human herpesvirus 4 [Epstein-Barr virus]
cuccauuccacccacu

SEQ ID NO: 3968733 - RNA, 19 nt, Human herpesvirus 4 [Epstein-Barr virus]
cucccaauauccaucugcu

SEQ ID NO: 3968734 - RNA, 21 nt, Human herpesvirus 4 [Epstein-Barr virus]
cucccacuuuuaccccagucc

SEQ ID NO: 3968735 - RNA, 15 nt, Human herpesvirus 4 [Epstein-Barr virus]
cucccauguaagccu

SEQ ID NO: 3968736 - RNA, 20 nt, Human herpesvirus 4 [Epstein-Barr virus]
cucccauguaagccugccuc

SEQ ID NO: 3968737 - RNA, 13 nt, Human herpesvirus 4 [Epstein-Barr virus]
cuccccagccaca

SEQ ID NO: 3968738 - RNA, 19 nt, Human herpesvirus 4 [Epstein-Barr virus]
cuccccugacgcuguggcc

SEQ ID NO: 3968739 - RNA, 17 nt, Human herpesvirus 4 [Epstein-Barr virus]
cucccgcccugagcugg

SEQ ID NO: 3968740 - RNA, 15 nt, Human herpesvirus 4 [Epstein-Barr virus]
cucccgccucaggga

SEQ ID NO: 3968741 - RNA, 22 nt, Human herpesvirus 4 [Epstein-Barr virus]
cuccgaugcccaccagccagcg

SEQ ID NO: 3968742 - RNA, 23 nt, Human herpesvirus 4 [Epstein-Barr virus]
cuccgccgccugcggcccacuga

SEQ ID NO: 3968743 - RNA, 19 nt, Human herpesvirus 4 [Epstein-Barr virus]
cuccggcugcccgucucgg

SEQ ID NO: 3968744 - RNA, 19 nt, Human herpesvirus 4 [Epstein-Barr virus]
cuccguccuuguccaggag

SEQ ID NO: 3968745 - RNA, 15 nt, Human herpesvirus 4 [Epstein-Barr virus]
auggcggacugcgcc

SEQ ID NO: 3968746 - RNA, 22 nt, Human herpesvirus 4 [Epstein-Barr virus]
augggaauaacaagggaagagg

SEQ ID NO: 3968747 - RNA, 17 nt, Human herpesvirus 4 [Epstein-Barr virus]
augggaccucuuuccca

SEQ ID NO: 3968748 - RNA, 17 nt, Human herpesvirus 4 [Epstein-Barr virus]
auggucgaugaacaagu

SEQ ID NO: 3968749 - RNA, 14 nt, Human herpesvirus 4 [Epstein-Barr virus]
auggugcuggucuc

SEQ ID NO: 3968750 - RNA, 19 nt, Human herpesvirus 4 [Epstein-Barr virus]
auguaagccugccucgagu

SEQ ID NO: 3968751 - RNA, 14 nt, Human herpesvirus 4 [Epstein-Barr virus]
augucacguguccu

SEQ ID NO: 3968752 - RNA, 13 nt, Human herpesvirus 4 [Epstein-Barr virus]
auguccuguggug

SEQ ID NO: 3968753 - RNA, 19 nt, Human herpesvirus 4 [Epstein-Barr virus]
auguggugccauguggcau

SEQ ID NO: 3968754 - RNA, 16 nt, Human herpesvirus 4 [Epstein-Barr virus]
auguuacuucuuuugc

SEQ ID NO: 3968755 - RNA, 23 nt, Human herpesvirus 4 [Epstein-Barr virus]
auuaaaggccaauuggcacucac

SEQ ID NO: 3968756 - RNA, 21 nt, Human herpesvirus 4 [Epstein-Barr virus]
auuagauucacguuccucauc

SEQ ID NO: 3968757 - RNA, 16 nt, Human herpesvirus 4 [Epstein-Barr virus]
auuccaggugugcuuc

SEQ ID NO: 3968758 - RNA, 21 nt, Human herpesvirus 4 [Epstein-Barr virus]
auuccccggggacaccugcac

SEQ ID NO: 3968759 - RNA, 18 nt, Human herpesvirus 4 [Epstein-Barr virus]
auuccuaggagaaggagc

SEQ ID NO: 3968760 - RNA, 13 nt, Human herpesvirus 4 [Epstein-Barr virus]
auucuccugccug

SEQ ID NO: 3968761 - RNA, 14 nt, Human herpesvirus 4 [Epstein-Barr virus]
auucucuucuguuu

SEQ ID NO: 3968762 - RNA, 18 nt, Human herpesvirus 4 [Epstein-Barr virus]
auugaaaccacgccugcu

SEQ ID NO: 3968763 - RNA, 16 nt, Human herpesvirus 4 [Epstein-Barr virus]
auugccauguccaagu

SEQ ID NO: 3968764 - RNA, 21 nt, Human herpesvirus 4 [Epstein-Barr virus]
auugcugagaaccugcugcua

SEQ ID NO: 3968765 - RNA, 18 nt, Human herpesvirus 4 [Epstein-Barr virus]
auuggacacccacccugc

SEQ ID NO: 3968766 - RNA, 21 nt, Human herpesvirus 4 [Epstein-Barr virus]
auuugcacuuucuuugcuuca

SEQ ID NO: 3968767 - RNA, 18 nt, Human herpesvirus 4 [Epstein-Barr virus]
auuugccuaacauggagg

SEQ ID NO: 3968768 - RNA, 16 nt, Human herpesvirus 4 [Epstein-Barr virus]
auuuugggagcuccag

SEQ ID NO: 3968769 - RNA, 20 nt, Human herpesvirus 4 [Epstein-Barr virus]
caaacugacacacaggccug

SEQ ID NO: 3968770 - RNA, 20 nt, Human herpesvirus 4 [Epstein-Barr virus]
caaagacgccggaugccugc

SEQ ID NO: 3968771 - RNA, 19 nt, Human herpesvirus 4 [Epstein-Barr virus]
caacacaaccacggugaca

SEQ ID NO: 3968772 - RNA, 20 nt, Human herpesvirus 4 [Epstein-Barr virus]
caacacaacuaccaggcaga

SEQ ID NO: 3968773 - RNA, 14 nt, Human herpesvirus 4 [Epstein-Barr virus]
caaccaauguaucc

SEQ ID NO: 3968774 - RNA, 14 nt, Human herpesvirus 4 [Epstein-Barr virus]
caaccaggcccacu

SEQ ID NO: 3968775 - RNA, 13 nt, Human herpesvirus 4 [Epstein-Barr virus]
caacccaaaacca

SEQ ID NO: 3968776 - RNA, 16 nt, Human herpesvirus 4 [Epstein-Barr virus]
caacuucagcuccagg

SEQ ID NO: 3968777 - RNA, 18 nt, Human herpesvirus 4 [Epstein-Barr virus]
caagagccaucaccucuu

SEQ ID NO: 3968778 - RNA, 15 nt, Human herpesvirus 4 [Epstein-Barr virus]
caagaggcagagagc

SEQ ID NO: 3968779 - RNA, 21 nt, Human herpesvirus 4 [Epstein-Barr virus]
caagaguuuaagcagcacuga

SEQ ID NO: 3968780 - RNA, 21 nt, Human herpesvirus 4 [Epstein-Barr virus]
caagccgggggagaagcaccu

SEQ ID NO: 3968781 - RNA, 14 nt, Human herpesvirus 4 [Epstein-Barr virus]
caagcugacagaag

SEQ ID NO: 3968782 - RNA, 18 nt, Human herpesvirus 4 [Epstein-Barr virus]
caagcuuaugcagcaccu

SEQ ID NO: 3968783 - RNA, 17 nt, Human herpesvirus 4 [Epstein-Barr virus]
caaggcaguagaggaca

SEQ ID NO: 3968784 - RNA, 18 nt, Human herpesvirus 4 [Epstein-Barr virus]
caaggcaguagaggacac

SEQ ID NO: 3968785 - RNA, 13 nt, Human herpesvirus 4 [Epstein-Barr virus]
caaggcccuagcc

SEQ ID NO: 3968786 - RNA, 19 nt, Human herpesvirus 4 [Epstein-Barr virus]
caaggugucaauaauuuca

SEQ ID NO: 3968787 - RNA, 18 nt, Human herpesvirus 4 [Epstein-Barr virus]
caagucccggguggugag

SEQ ID NO: 3968788 - RNA, 13 nt, Human herpesvirus 4 [Epstein-Barr virus]
caauaauuucagu

SEQ ID NO: 3968789 - RNA, 16 nt, Human herpesvirus 4 [Epstein-Barr virus]
caaucaccagccaccu

SEQ ID NO: 3968790 - RNA, 12 nt, Human herpesvirus 4 [Epstein-Barr virus]
caaucucuccca

SEQ ID NO: 3968791 - RNA, 18 nt, Human herpesvirus 4 [Epstein-Barr virus]
caaugggagcacauuccc

SEQ ID NO: 3968792 - RNA, 17 nt, Human herpesvirus 4 [Epstein-Barr virus]
cacaacggcugugacua

SEQ ID NO: 3968793 - RNA, 17 nt, Human herpesvirus 4 [Epstein-Barr virus]
cacacacucccuuagcc

SEQ ID NO: 3968794 - RNA, 20 nt, Human herpesvirus 4 [Epstein-Barr virus]
cacacgccagagacaaggca

SEQ ID NO: 3968795 - RNA, 21 nt, Human herpesvirus 4 [Epstein-Barr virus]
cacacggaaaccacaacagcc

SEQ ID NO: 3968796 - RNA, 16 nt, Human herpesvirus 4 [Epstein-Barr virus]
cacagcgccagcaggg

SEQ ID NO: 3968797 - RNA, 12 nt, Human herpesvirus 4 [Epstein-Barr virus]
cacaggacaugu

SEQ ID NO: 3968798 - RNA, 17 nt, Human herpesvirus 4 [Epstein-Barr virus]
cacauacaucccugucu

SEQ ID NO: 3968799 - RNA, 16 nt, Human herpesvirus 4 [Epstein-Barr virus]
cacauauacuggagau

SEQ ID NO: 3968800 - RNA, 18 nt, Human herpesvirus 4 [Epstein-Barr virus]
caccacccccaccacccc

SEQ ID NO: 3968801 - RNA, 17 nt, Human herpesvirus 4 [Epstein-Barr virus]
caccacccccaccaccu

SEQ ID NO: 3968802 - RNA, 18 nt, Human herpesvirus 4 [Epstein-Barr virus]
caccacccccaccaccuc

SEQ ID NO: 3968803 - RNA, 14 nt, Human herpesvirus 4 [Epstein-Barr virus]
caccagcuccaggg

SEQ ID NO: 3968804 - RNA, 22 nt, Human herpesvirus 4 [Epstein-Barr virus]
caccaggccugccaaagagcca

SEQ ID NO: 3968805 - RNA, 17 nt, Human herpesvirus 4 [Epstein-Barr virus]
cacccauggccaggcuc

SEQ ID NO: 3968806 - RNA, 14 nt, Human herpesvirus 4 [Epstein-Barr virus]
cacccccaccaccc

SEQ ID NO: 3968807 - RNA, 14 nt, Human herpesvirus 4 [Epstein-Barr virus]
cacccccaccaccu

SEQ ID NO: 3968808 - RNA, 18 nt, Human herpesvirus 4 [Epstein-Barr virus]
caccccccccaccaccac

SEQ ID NO: 3968809 - RNA, 17 nt, Human herpesvirus 4 [Epstein-Barr virus]
cacccggacccggacca

SEQ ID NO: 3968810 - RNA, 12 nt, Human herpesvirus 4 [Epstein-Barr virus]
cacccgucccgg

SEQ ID NO: 3968811 - RNA, 23 nt, Human herpesvirus 4 [Epstein-Barr virus]
cacccgucccggguacaaguccc

SEQ ID NO: 3968812 - RNA, 20 nt, Human herpesvirus 4 [Epstein-Barr virus]
cacccucccccugccccguu

SEQ ID NO: 3968813 - RNA, 15 nt, Human herpesvirus 4 [Epstein-Barr virus]
caccgcagccacguc

SEQ ID NO: 3968814 - RNA, 19 nt, Human herpesvirus 4 [Epstein-Barr virus]
caccgucuacccagaggag

SEQ ID NO: 3968815 - RNA, 14 nt, Human herpesvirus 4 [Epstein-Barr virus]
caccguggccaggc

SEQ ID NO: 3968816 - RNA, 16 nt, Human herpesvirus 4 [Epstein-Barr virus]
caccuccaccaccuuc

SEQ ID NO: 3968817 - RNA, 14 nt, Human herpesvirus 4 [Epstein-Barr virus]
cgcguggagcugga

SEQ ID NO: 3968818 - RNA, 16 nt, Human herpesvirus 4 [Epstein-Barr virus]
cgcuaguugguccagg

SEQ ID NO: 3968819 - RNA, 14 nt, Human herpesvirus 4 [Epstein-Barr virus]
cgcucagagcuggg

SEQ ID NO: 3968820 - RNA, 15 nt, Human herpesvirus 4 [Epstein-Barr virus]
cgcuccgcgcucggc

SEQ ID NO: 3968821 - RNA, 22 nt, Human herpesvirus 4 [Epstein-Barr virus]
cgcucuguuugaaacacaguuu

SEQ ID NO: 3968822 - RNA, 17 nt, Human herpesvirus 4 [Epstein-Barr virus]
cgcuuccacccccugga

SEQ ID NO: 3968823 - RNA, 15 nt, Human herpesvirus 4 [Epstein-Barr virus]
cggaaaucugcucuu

SEQ ID NO: 3968824 - RNA, 15 nt, Human herpesvirus 4 [Epstein-Barr virus]
cggaagacaacgagg

SEQ ID NO: 3968825 - RNA, 11 nt, Human herpesvirus 4 [Epstein-Barr virus]
cggacacaccg

SEQ ID NO: 3968826 - RNA, 15 nt, Human herpesvirus 4 [Epstein-Barr virus]
cggacgugcccagcu

SEQ ID NO: 3968827 - RNA, 13 nt, Human herpesvirus 4 [Epstein-Barr virus]
cggacugcgccuu

SEQ ID NO: 3968828 - RNA, 23 nt, Human herpesvirus 4 [Epstein-Barr virus]
cggagagugcccuggaggccuca

SEQ ID NO: 3968829 - RNA, 14 nt, Human herpesvirus 4 [Epstein-Barr virus]
cggaguugagcccg

SEQ ID NO: 3968830 - RNA, 19 nt, Human herpesvirus 4 [Epstein-Barr virus]
cggaucgaaggagagcugg

SEQ ID NO: 3968831 - RNA, 20 nt, Human herpesvirus 4 [Epstein-Barr virus]
cggcaucaccguggagccgg

SEQ ID NO: 3968832 - RNA, 20 nt, Human herpesvirus 4 [Epstein-Barr virus]
cggcauuccuaggagaagga

SEQ ID NO: 3968833 - RNA, 19 nt, Human herpesvirus 4 [Epstein-Barr virus]
cggcccgucuuacugccca

SEQ ID NO: 3968834 - RNA, 19 nt, Human herpesvirus 4 [Epstein-Barr virus]
cggcccuuugccuggggcu

SEQ ID NO: 3968835 - RNA, 16 nt, Human herpesvirus 4 [Epstein-Barr virus]
cggccgcugcgcccug

SEQ ID NO: 3968836 - RNA, 12 nt, Human herpesvirus 4 [Epstein-Barr virus]
cggccucaaagg

SEQ ID NO: 3968837 - RNA, 12 nt, Human herpesvirus 4 [Epstein-Barr virus]
cggccugcuggc

SEQ ID NO: 3968838 - RNA, 20 nt, Human herpesvirus 4 [Epstein-Barr virus]
cggccugcuggccgagcugg

SEQ ID NO: 3968839 - RNA, 21 nt, Human herpesvirus 4 [Epstein-Barr virus]
cggccugcuggccgagcugga

SEQ ID NO: 3968840 - RNA, 20 nt, Human herpesvirus 4 [Epstein-Barr virus]
cggcgcuugcgucugccccc

SEQ ID NO: 3968841 - RNA, 21 nt, Human herpesvirus 4 [Epstein-Barr virus]
cggcggacccgaucagagccc

SEQ ID NO: 3968842 - RNA, 18 nt, Human herpesvirus 4 [Epstein-Barr virus]
cggcggccucggaggugc

SEQ ID NO: 3968843 - RNA, 14 nt, Human herpesvirus 4 [Epstein-Barr virus]
cggcggcugcugcc

SEQ ID NO: 3968844 - RNA, 17 nt, Human herpesvirus 4 [Epstein-Barr virus]
cggcguggagcugggcc

SEQ ID NO: 3968845 - RNA, 14 nt, Human herpesvirus 4 [Epstein-Barr virus]
cggcucggccacgc

SEQ ID NO: 3968846 - RNA, 17 nt, Human herpesvirus 4 [Epstein-Barr virus]
cggcugugagcgcacgu

SEQ ID NO: 3968847 - RNA, 15 nt, Human herpesvirus 4 [Epstein-Barr virus]
cgggagccggcggcc

SEQ ID NO: 3968848 - RNA, 13 nt, Human herpesvirus 4 [Epstein-Barr virus]
cgggaggcggugc

SEQ ID NO: 3968849 - RNA, 14 nt, Human herpesvirus 4 [Epstein-Barr virus]
cgggaggggcagga

SEQ ID NO: 3968850 - RNA, 22 nt, Human herpesvirus 4 [Epstein-Barr virus]
cgggcagaggacacgcuggucu

SEQ ID NO: 3968851 - RNA, 21 nt, Human herpesvirus 4 [Epstein-Barr virus]
cgggcaggcauuuuuggugcu

SEQ ID NO: 3968852 - RNA, 13 nt, Human herpesvirus 4 [Epstein-Barr virus]
cgggccaucuccg

SEQ ID NO: 3968853 - RNA, 14 nt, Human herpesvirus 4 [Epstein-Barr virus]
cgggcuccaugucc

SEQ ID NO: 3968854 - RNA, 17 nt, Human herpesvirus 4 [Epstein-Barr virus]
cggggagaacgguggcc

SEQ ID NO: 3968855 - RNA, 19 nt, Human herpesvirus 4 [Epstein-Barr virus]
cggggagcggcaagggcuc

SEQ ID NO: 3968856 - RNA, 21 nt, Human herpesvirus 4 [Epstein-Barr virus]
cggggccuuggcaucaucagc

SEQ ID NO: 3968857 - RNA, 16 nt, Human herpesvirus 4 [Epstein-Barr virus]
cggggguggaggcugc

SEQ ID NO: 3968858 - RNA, 16 nt, Human herpesvirus 4 [Epstein-Barr virus]
cgggggugggcaccuc

SEQ ID NO: 3968859 - RNA, 15 nt, Human herpesvirus 4 [Epstein-Barr virus]
cgggucccccuagcc

SEQ ID NO: 3968860 - RNA, 13 nt, Human herpesvirus 4 [Epstein-Barr virus]
cgggucucgccgc

SEQ ID NO: 3968861 - RNA, 20 nt, Human herpesvirus 4 [Epstein-Barr virus]
uuccagacuaugcauacacu

SEQ ID NO: 3968862 - RNA, 18 nt, Human herpesvirus 4 [Epstein-Barr virus]
uucccagcuaguagcccu

SEQ ID NO: 3968863 - RNA, 22 nt, Human herpesvirus 4 [Epstein-Barr virus]
uucccgccuagagcauuugcaa

SEQ ID NO: 3968864 - RNA, 15 nt, Human herpesvirus 4 [Epstein-Barr virus]
uucccgccuccccuc

SEQ ID NO: 3968865 - RNA, 22 nt, Human herpesvirus 4 [Epstein-Barr virus]
uucccggcugcucccgccucag

SEQ ID NO: 3968866 - RNA, 15 nt, Human herpesvirus 4 [Epstein-Barr virus]
uuccuauaugcucuc

SEQ ID NO: 3968867 - RNA, 13 nt, Human herpesvirus 4 [Epstein-Barr virus]
uuccuggccaugg

SEQ ID NO: 3968868 - RNA, 23 nt, Human herpesvirus 4 [Epstein-Barr virus]
uucggucaaguaccagcuggugg

SEQ ID NO: 3968869 - RNA, 15 nt, Human herpesvirus 4 [Epstein-Barr virus]
uucucaaacaguccc

SEQ ID NO: 3968870 - RNA, 19 nt, Human herpesvirus 4 [Epstein-Barr virus]
uucuguacaauggggccag

SEQ ID NO: 3968871 - RNA, 19 nt, Human herpesvirus 4 [Epstein-Barr virus]
uugaagguggaggggggcg

SEQ ID NO: 3968872 - RNA, 15 nt, Human herpesvirus 4 [Epstein-Barr virus]
uugauuuggaggaag

SEQ ID NO: 3968873 - RNA, 22 nt, Human herpesvirus 4 [Epstein-Barr virus]
uugccucuuguguucuugccgc

SEQ ID NO: 3968874 - RNA, 12 nt, Human herpesvirus 4 [Epstein-Barr virus]
uugccuggggcu

SEQ ID NO: 3968875 - RNA, 19 nt, Human herpesvirus 4 [Epstein-Barr virus]
uuggagaaaacgggggugg

SEQ ID NO: 3968876 - RNA, 15 nt, Human herpesvirus 4 [Epstein-Barr virus]
uugguaaaacaaggg

SEQ ID NO: 3968877 - RNA, 20 nt, Human herpesvirus 4 [Epstein-Barr virus]
uugguccaggguccaggaga

SEQ ID NO: 3968878 - RNA, 14 nt, Human herpesvirus 4 [Epstein-Barr virus]
uuguccgcugggcc

SEQ ID NO: 3968879 - RNA, 16 nt, Human herpesvirus 4 [Epstein-Barr virus]
uugucggagguggaga

SEQ ID NO: 3968880 - RNA, 17 nt, Human herpesvirus 4 [Epstein-Barr virus]
uugugcggucuguuuuc

SEQ ID NO: 3968881 - RNA, 13 nt, Human herpesvirus 4 [Epstein-Barr virus]
uuguucuuuggag

SEQ ID NO: 3968882 - RNA, 16 nt, Human herpesvirus 4 [Epstein-Barr virus]
uuuccaugacaguccc

SEQ ID NO: 3968883 - RNA, 21 nt, Human herpesvirus 4 [Epstein-Barr virus]
uuuccugcccucccacuuuua

SEQ ID NO: 3968884 - RNA, 20 nt, Human herpesvirus 4 [Epstein-Barr virus]
uuugacugacacauaaacau

SEQ ID NO: 3968885 - RNA, 15 nt, Human herpesvirus 4 [Epstein-Barr virus]
uuugauaaaccuuaa

SEQ ID NO: 3968886 - RNA, 14 nt, Human herpesvirus 4 [Epstein-Barr virus]
uuugcuagggagga

SEQ ID NO: 3968887 - RNA, 20 nt, Human herpesvirus 4 [Epstein-Barr virus]
uuuggcauguguacuugucc

SEQ ID NO: 3968888 - RNA, 13 nt, Human herpesvirus 4 [Epstein-Barr virus]
uuuggugcugccu

SEQ ID NO: 3968889 - RNA, 16 nt, Human herpesvirus 4 [Epstein-Barr virus]
uuuuugccacauguuu

SEQ ID NO: 3968890 - RNA, 15 nt, Human herpesvirus 4 [Epstein-Barr virus]
aaaaaaugcaacaau

SEQ ID NO: 3968891 - RNA, 21 nt, Human herpesvirus 4 [Epstein-Barr virus]
aaaaucaacuacaagcagcua

SEQ ID NO: 3968892 - RNA, 14 nt, Human herpesvirus 4 [Epstein-Barr virus]
aaaaucagaccacc

SEQ ID NO: 3968893 - RNA, 19 nt, Human herpesvirus 4 [Epstein-Barr virus]
aaagaucuaccccagcugc

SEQ ID NO: 3968894 - RNA, 16 nt, Human herpesvirus 4 [Epstein-Barr virus]
aaagcggcccagcaga

SEQ ID NO: 3968895 - RNA, 20 nt, Human herpesvirus 4 [Epstein-Barr virus]
aaagcuaacuguacauacug

SEQ ID NO: 3968896 - RNA, 13 nt, Human herpesvirus 4 [Epstein-Barr virus]
aaagcugaagaac

SEQ ID NO: 3968897 - RNA, 13 nt, Human herpesvirus 4 [Epstein-Barr virus]
aaaggaagggggc

SEQ ID NO: 3968898 - RNA, 16 nt, Human herpesvirus 4 [Epstein-Barr virus]
aaagucccgagcggcc

SEQ ID NO: 3968899 - RNA, 15 nt, Human herpesvirus 4 [Epstein-Barr virus]
aaaucugacacuuua

SEQ ID NO: 3968900 - RNA, 18 nt, Human herpesvirus 4 [Epstein-Barr virus]
aaauuuagcacgucccaa

SEQ ID NO: 3968901 - RNA, 17 nt, Human herpesvirus 4 [Epstein-Barr virus]
aacaaggagugccucug

SEQ ID NO: 3968902 - RNA, 21 nt, Human herpesvirus 4 [Epstein-Barr virus]
aacaguagaagaacugcaaga

SEQ ID NO: 3968903 - RNA, 18 nt, Human herpesvirus 4 [Epstein-Barr virus]
aacauaaaugccccaucu

SEQ ID NO: 3968904 - RNA, 23 nt, Human herpesvirus 4 [Epstein-Barr virus]
aacauuugaggaggcacacaaaa

SEQ ID NO: 3968905 - RNA, 17 nt, Human herpesvirus 4 [Epstein-Barr virus]
aacccaauucccgccuc

SEQ ID NO: 3968906 - RNA, 15 nt, Human herpesvirus 4 [Epstein-Barr virus]
aaccccuauauccua

SEQ ID NO: 3968907 - RNA, 15 nt, Human herpesvirus 4 [Epstein-Barr virus]
aacccuguagucacc

SEQ ID NO: 3968908 - RNA, 24 nt, Human herpesvirus 4 [Epstein-Barr virus]
aacccuugcccucuccagcaacca

SEQ ID NO: 3968909 - RNA, 15 nt, Human herpesvirus 4 [Epstein-Barr virus]
aacucagccccaucu

SEQ ID NO: 3968910 - RNA, 17 nt, Human herpesvirus 4 [Epstein-Barr virus]
aacugacacacaggccu

SEQ ID NO: 3968911 - RNA, 14 nt, Human herpesvirus 4 [Epstein-Barr virus]
aacugccagagcug

SEQ ID NO: 3968912 - RNA, 20 nt, Human herpesvirus 4 [Epstein-Barr virus]
aacuuccaacgcauccacca

SEQ ID NO: 3968913 - RNA, 16 nt, Human herpesvirus 4 [Epstein-Barr virus]
aacuugggggcaggcu

SEQ ID NO: 3968914 - RNA, 14 nt, Human herpesvirus 4 [Epstein-Barr virus]
aagcaacugcugca

SEQ ID NO: 3968915 - RNA, 13 nt, Human herpesvirus 4 [Epstein-Barr virus]
aagcauggggcuc

SEQ ID NO: 3968916 - RNA, 22 nt, Human herpesvirus 4 [Epstein-Barr virus]
aagccgggggagaagcaccuca

SEQ ID NO: 3968917 - RNA, 21 nt, Human herpesvirus 4 [Epstein-Barr virus]
aagccuucuccuggacccugg

SEQ ID NO: 3968918 - RNA, 10 nt, Human herpesvirus 4 [Epstein-Barr virus]
aagcucagca

SEQ ID NO: 3968919 - RNA, 22 nt, Human herpesvirus 4 [Epstein-Barr virus]
aagcuuaugcagcaccucagcu

SEQ ID NO: 3968920 - RNA, 14 nt, Human herpesvirus 4 [Epstein-Barr virus]
aaggaggggcggca

SEQ ID NO: 3968921 - RNA, 17 nt, Human herpesvirus 4 [Epstein-Barr virus]
aaggccgcugccaggcc

SEQ ID NO: 3968922 - RNA, 16 nt, Human herpesvirus 4 [Epstein-Barr virus]
aaggccugcugucauc

SEQ ID NO: 3968923 - RNA, 16 nt, Human herpesvirus 4 [Epstein-Barr virus]
aaggcucugcacagga

SEQ ID NO: 3968924 - RNA, 22 nt, Human herpesvirus 4 [Epstein-Barr virus]
aaggugucaauaauuucaguga

SEQ ID NO: 3968925 - RNA, 19 nt, Human herpesvirus 4 [Epstein-Barr virus]
aaguugaugauauugaauu

SEQ ID NO: 3968926 - RNA, 16 nt, Human herpesvirus 4 [Epstein-Barr virus]
aauaaauaucuuccug

SEQ ID NO: 3968927 - RNA, 16 nt, Human herpesvirus 4 [Epstein-Barr virus]
aauaccgagauguaca

SEQ ID NO: 3968928 - RNA, 16 nt, Human herpesvirus 4 [Epstein-Barr virus]
aauauuaauaaauauc

SEQ ID NO: 3968929 - RNA, 20 nt, Human herpesvirus 4 [Epstein-Barr virus]
aaucucgcucagagcuggga

SEQ ID NO: 3968930 - RNA, 22 nt, Human herpesvirus 4 [Epstein-Barr virus]
aaucucucccacggaccccccu

SEQ ID NO: 3968931 - RNA, 19 nt, Human herpesvirus 4 [Epstein-Barr virus]
aaugaacacucauggugug

SEQ ID NO: 3968932 - RNA, 17 nt, Human herpesvirus 4 [Epstein-Barr virus]
aauggggguuggagaaa

SEQ ID NO: 3968933 - RNA, 20 nt, Human herpesvirus 4 [Epstein-Barr virus]
aauguuccagaagucggcca

SEQ ID NO: 3968934 - RNA, 13 nt, Human herpesvirus 4 [Epstein-Barr virus]
aauucccgccucc

SEQ ID NO: 3968935 - RNA, 16 nt, Human herpesvirus 4 [Epstein-Barr virus]
acaaaaccacugaccu

SEQ ID NO: 3968936 - RNA, 20 nt, Human herpesvirus 4 [Epstein-Barr virus]
acaaaauggggguuggagaa

SEQ ID NO: 3968937 - RNA, 18 nt, Human herpesvirus 4 [Epstein-Barr virus]
acaaaggaaacugcugac

SEQ ID NO: 3968938 - RNA, 21 nt, Human herpesvirus 4 [Epstein-Barr virus]
acaaccuuggacccugcugcg

SEQ ID NO: 3968939 - RNA, 18 nt, Human herpesvirus 4 [Epstein-Barr virus]
acaagguucggaaaucug

SEQ ID NO: 3968940 - RNA, 16 nt, Human herpesvirus 4 [Epstein-Barr virus]
acaaguaccagcccuu

SEQ ID NO: 3968941 - RNA, 16 nt, Human herpesvirus 4 [Epstein-Barr virus]
acaauagaaguggaaa

SEQ ID NO: 3968942 - RNA, 22 nt, Human herpesvirus 4 [Epstein-Barr virus]
acaaucuugugaaccagaaaga

SEQ ID NO: 3968943 - RNA, 17 nt, Human herpesvirus 4 [Epstein-Barr virus]
acacacauggcacucau

SEQ ID NO: 3968944 - RNA, 13 nt, Human herpesvirus 4 [Epstein-Barr virus]
acacagugggcuu

SEQ ID NO: 3968945 - RNA, 14 nt, Human herpesvirus 4 [Epstein-Barr virus]
acaccauggccucg

SEQ ID NO: 3968946 - RNA, 15 nt, Human herpesvirus 4 [Epstein-Barr virus]
acaccgggcaggucc

SEQ ID NO: 3968947 - RNA, 22 nt, Human herpesvirus 4 [Epstein-Barr virus]
acacuuauguuucaagcagcuc

SEQ ID NO: 3968948 - RNA, 13 nt, Human herpesvirus 4 [Epstein-Barr virus]
acagacccugggc

SEQ ID NO: 3968949 - RNA, 18 nt, Human herpesvirus 4 [Epstein-Barr virus]
acagacuuggccuugggg

SEQ ID NO: 3968950 - RNA, 23 nt, Human herpesvirus 4 [Epstein-Barr virus]
acagcaauggcacggaugccugg

SEQ ID NO: 3968951 - RNA, 12 nt, Human herpesvirus 4 [Epstein-Barr virus]
acaggacauguu

SEQ ID NO: 3968952 - RNA, 15 nt, Human herpesvirus 4 [Epstein-Barr virus]
acaggacuaaccaug

SEQ ID NO: 3968953 - RNA, 12 nt, Human herpesvirus 4 [Epstein-Barr virus]
acaggagcagga

SEQ ID NO: 3968954 - RNA, 18 nt, Human herpesvirus 4 [Epstein-Barr virus]
acagggguauguggugcc

SEQ ID NO: 3968955 - RNA, 17 nt, Human herpesvirus 4 [Epstein-Barr virus]
acagguacuaacacgca

SEQ ID NO: 3968956 - RNA, 12 nt, Human herpesvirus 4 [Epstein-Barr virus]
acauaaaugccc

SEQ ID NO: 3968957 - RNA, 16 nt, Human herpesvirus 4 [Epstein-Barr virus]
acauauccagagcuga

SEQ ID NO: 3968958 - RNA, 12 nt, Human herpesvirus 4 [Epstein-Barr virus]
acauauguacaa

SEQ ID NO: 3968959 - RNA, 20 nt, Human herpesvirus 4 [Epstein-Barr virus]
acaugagaaaauacuucucu

SEQ ID NO: 3968960 - RNA, 21 nt, Human herpesvirus 4 [Epstein-Barr virus]
acaugucacguguccugcagg

SEQ ID NO: 3968961 - RNA, 23 nt, Human herpesvirus 4 [Epstein-Barr virus]
acauuaaccucaaccacaaaaug

SEQ ID NO: 3968962 - RNA, 13 nt, Human herpesvirus 4 [Epstein-Barr virus]
acauuggcagcag

SEQ ID NO: 3968963 - RNA, 19 nt, Human herpesvirus 4 [Epstein-Barr virus]
accaaggcggcugcugaga

SEQ ID NO: 3968964 - RNA, 15 nt, Human herpesvirus 4 [Epstein-Barr virus]
accaagggcagggca

SEQ ID NO: 3968965 - RNA, 15 nt, Human herpesvirus 4 [Epstein-Barr virus]
accacaacagccaga

SEQ ID NO: 3968966 - RNA, 17 nt, Human herpesvirus 4 [Epstein-Barr virus]
accacucccaccacccc

SEQ ID NO: 3968967 - RNA, 16 nt, Human herpesvirus 4 [Epstein-Barr virus]
accaggcccacugcaa

SEQ ID NO: 3968968 - RNA, 18 nt, Human herpesvirus 4 [Epstein-Barr virus]
accaggccugccaaagag

SEQ ID NO: 3968969 - RNA, 13 nt, Human herpesvirus 4 [Epstein-Barr virus]
accauccacagcc

SEQ ID NO: 3968970 - RNA, 16 nt, Human herpesvirus 4 [Epstein-Barr virus]
accauccacagcccca

SEQ ID NO: 3968971 - RNA, 12 nt, Human herpesvirus 4 [Epstein-Barr virus]
acccaacaaagc

SEQ ID NO: 3968972 - RNA, 15 nt, Human herpesvirus 4 [Epstein-Barr virus]
acccaaugugcaugg

SEQ ID NO: 3968973 - RNA, 17 nt, Human herpesvirus 4 [Epstein-Barr virus]
acccaccgcaaccgcug

SEQ ID NO: 3968974 - RNA, 15 nt, Human herpesvirus 4 [Epstein-Barr virus]
acccagcagcagccc

SEQ ID NO: 3968975 - RNA, 19 nt, Human herpesvirus 4 [Epstein-Barr virus]
acccauaccaggugccuuu

SEQ ID NO: 3968976 - RNA, 15 nt, Human herpesvirus 4 [Epstein-Barr virus]
accccuaccucggca

SEQ ID NO: 3968977 - RNA, 15 nt, Human herpesvirus 4 [Epstein-Barr virus]
accccugggcucuca

SEQ ID NO: 3968978 - RNA, 16 nt, Human herpesvirus 4 [Epstein-Barr virus]
acccgucccggguaca

SEQ ID NO: 3968979 - RNA, 12 nt, Human herpesvirus 4 [Epstein-Barr virus]
acccucccccug

SEQ ID NO: 3968980 - RNA, 16 nt, Human herpesvirus 4 [Epstein-Barr virus]
acccugguacaggacc

SEQ ID NO: 3968981 - RNA, 15 nt, Human herpesvirus 4 [Epstein-Barr virus]
acccuucugcugcug

SEQ ID NO: 3968982 - RNA, 19 nt, Human herpesvirus 4 [Epstein-Barr virus]
acccuugguauugcgcugg

SEQ ID NO: 3968983 - RNA, 15 nt, Human herpesvirus 4 [Epstein-Barr virus]
accgcgcccuccucu

SEQ ID NO: 3968984 - RNA, 22 nt, Human herpesvirus 4 [Epstein-Barr virus]
accggugacagugcuuacugcg

SEQ ID NO: 3968985 - RNA, 12 nt, Human herpesvirus 4 [Epstein-Barr virus]
accuacaccacc

SEQ ID NO: 3968986 - RNA, 20 nt, Human herpesvirus 4 [Epstein-Barr virus]
accuccaaucaccagccacc

SEQ ID NO: 3968987 - RNA, 10 nt, Human herpesvirus 4 [Epstein-Barr virus]
accuccacca

SEQ ID NO: 3968988 - RNA, 20 nt, Human herpesvirus 4 [Epstein-Barr virus]
accuguccuugucugcugcc

SEQ ID NO: 3968989 - RNA, 19 nt, Human herpesvirus 4 [Epstein-Barr virus]
acgaacuccuccagcagug

SEQ ID NO: 3968990 - RNA, 13 nt, Human herpesvirus 4 [Epstein-Barr virus]
acgacuguuccua

SEQ ID NO: 3968991 - RNA, 15 nt, Human herpesvirus 4 [Epstein-Barr virus]
acgaggaggaagaga

SEQ ID NO: 3968992 - RNA, 12 nt, Human herpesvirus 4 [Epstein-Barr virus]
acgccaaugcca

SEQ ID NO: 3968993 - RNA, 15 nt, Human herpesvirus 4 [Epstein-Barr virus]
acgccaaugccaacu

SEQ ID NO: 3968994 - RNA, 18 nt, Human herpesvirus 4 [Epstein-Barr virus]
acgccgccgccagcagcc

SEQ ID NO: 3968995 - RNA, 14 nt, Human herpesvirus 4 [Epstein-Barr virus]
acgccugcuucacg

SEQ ID NO: 3968996 - RNA, 19 nt, Human herpesvirus 4 [Epstein-Barr virus]
acgccugcuucacgccucg

SEQ ID NO: 3968997 - RNA, 22 nt, Human herpesvirus 4 [Epstein-Barr virus]
acgccugcuucacgccucguuu

SEQ ID NO: 3968998 - RNA, 18 nt, Human herpesvirus 4 [Epstein-Barr virus]
acgcucagugcggugcua

SEQ ID NO: 3968999 - RNA, 15 nt, Human herpesvirus 4 [Epstein-Barr virus]
acgcuccuucuuggc

SEQ ID NO: 3969000 - RNA, 22 nt, Human herpesvirus 4 [Epstein-Barr virus]
acgcuguccgccaggacggaga

SEQ ID NO: 3969001 - RNA, 15 nt, Human herpesvirus 4 [Epstein-Barr virus]
acggaaaucugcucu

SEQ ID NO: 3969002 - RNA, 15 nt, Human herpesvirus 4 [Epstein-Barr virus]
acggaugcugcagag

SEQ ID NO: 3969003 - RNA, 15 nt, Human herpesvirus 4 [Epstein-Barr virus]
acggcaugccuaaug

SEQ ID NO: 3969004 - RNA, 20 nt, Human herpesvirus 4 [Epstein-Barr virus]
acgggcaucuuaucagagag

SEQ ID NO: 3969005 - RNA, 20 nt, Human herpesvirus 4 [Epstein-Barr virus]
acggggccgugcaccugcca

SEQ ID NO: 3969006 - RNA, 20 nt, Human herpesvirus 4 [Epstein-Barr virus]
acgggucucacgagggucug

SEQ ID NO: 3969007 - RNA, 16 nt, Human herpesvirus 4 [Epstein-Barr virus]
acgguggaacaggagc

SEQ ID NO: 3969008 - RNA, 21 nt, Human herpesvirus 4 [Epstein-Barr virus]
acgguggcuugggcuguggua

SEQ ID NO: 3969009 - RNA, 19 nt, Human herpesvirus 4 [Epstein-Barr virus]
acguacccauaacugggca

SEQ ID NO: 3969010 - RNA, 17 nt, Human herpesvirus 4 [Epstein-Barr virus]
acgugagugacacugau

SEQ ID NO: 3969011 - RNA, 13 nt, Human herpesvirus 4 [Epstein-Barr virus]
acgugcccagcuc

SEQ ID NO: 3969012 - RNA, 21 nt, Human herpesvirus 4 [Epstein-Barr virus]
acuaauguucucuaacugugu

SEQ ID NO: 3969013 - RNA, 15 nt, Human herpesvirus 4 [Epstein-Barr virus]
acuacaauguuccuu

SEQ ID NO: 3969014 - RNA, 22 nt, Human herpesvirus 4 [Epstein-Barr virus]
acuagcggcgagacccgaggca

SEQ ID NO: 3969015 - RNA, 14 nt, Human herpesvirus 4 [Epstein-Barr virus]
acuauguucucuac

SEQ ID NO: 3969016 - RNA, 19 nt, Human herpesvirus 4 [Epstein-Barr virus]
acucaccaagauuguucca

SEQ ID NO: 3969017 - RNA, 19 nt, Human herpesvirus 4 [Epstein-Barr virus]
acucauuacuuguucuuuu

SEQ ID NO: 3969018 - RNA, 18 nt, Human herpesvirus 4 [Epstein-Barr virus]
acuccaggcccccgggug

SEQ ID NO: 3969019 - RNA, 15 nt, Human herpesvirus 4 [Epstein-Barr virus]
acucccgaggcacuu

SEQ ID NO: 3969020 - RNA, 12 nt, Human herpesvirus 4 [Epstein-Barr virus]
acuccgccacca

SEQ ID NO: 3969021 - RNA, 16 nt, Human herpesvirus 4 [Epstein-Barr virus]
acucgaaacuauggca

SEQ ID NO: 3969022 - RNA, 21 nt, Human herpesvirus 4 [Epstein-Barr virus]
acucuaaaaaucaaaacuuua

SEQ ID NO: 3969023 - RNA, 17 nt, Human herpesvirus 4 [Epstein-Barr virus]
acucucucccccgggcg

SEQ ID NO: 3969024 - RNA, 14 nt, Human herpesvirus 4 [Epstein-Barr virus]
acucugaccaggac

SEQ ID NO: 3969025 - RNA, 16 nt, Human herpesvirus 4 [Epstein-Barr virus]
acucuuggugcagccc

SEQ ID NO: 3969026 - RNA, 14 nt, Human herpesvirus 4 [Epstein-Barr virus]
acugcaaacccugg

SEQ ID NO: 3969027 - RNA, 19 nt, Human herpesvirus 4 [Epstein-Barr virus]
acugcgagggggccuggug

SEQ ID NO: 3969028 - RNA, 19 nt, Human herpesvirus 4 [Epstein-Barr virus]
acugcgggugucucaagcu

SEQ ID NO: 3969029 - RNA, 20 nt, Human herpesvirus 4 [Epstein-Barr virus]
acugcgguugucacuuucuu

SEQ ID NO: 3969030 - RNA, 18 nt, Human herpesvirus 4 [Epstein-Barr virus]
acugcguccaccuggcca

SEQ ID NO: 3969031 - RNA, 17 nt, Human herpesvirus 4 [Epstein-Barr virus]
acuggcaacuccucuua

SEQ ID NO: 3969032 - RNA, 17 nt, Human herpesvirus 4 [Epstein-Barr virus]
acuggcacacacucccu

SEQ ID NO: 3969033 - RNA, 12 nt, Human herpesvirus 4 [Epstein-Barr virus]
acuguccagaca

SEQ ID NO: 3969034 - RNA, 18 nt, Human herpesvirus 4 [Epstein-Barr virus]
acuguucaaacagcagca

SEQ ID NO: 3969035 - RNA, 17 nt, Human herpesvirus 4 [Epstein-Barr virus]
acuguuccuauaugcuc

SEQ ID NO: 3969036 - RNA, 14 nt, Human herpesvirus 4 [Epstein-Barr virus]
acuguucucugcuc

SEQ ID NO: 3969037 - RNA, 21 nt, Human herpesvirus 4 [Epstein-Barr virus]
acuugcucagguuucugggca

SEQ ID NO: 3969038 - RNA, 17 nt, Human herpesvirus 4 [Epstein-Barr virus]
acuuuuauuucaguucu

SEQ ID NO: 3969039 - RNA, 16 nt, Human herpesvirus 4 [Epstein-Barr virus]
agaacugacgcuccag

SEQ ID NO: 3969040 - RNA, 15 nt, Human herpesvirus 4 [Epstein-Barr virus]
agaagacuccugccu

SEQ ID NO: 3969041 - RNA, 22 nt, Human herpesvirus 4 [Epstein-Barr virus]
agaagcuacaaacacgggccug

SEQ ID NO: 3969042 - RNA, 17 nt, Human herpesvirus 4 [Epstein-Barr virus]
agaagugugucccccuc

SEQ ID NO: 3969043 - RNA, 19 nt, Human herpesvirus 4 [Epstein-Barr virus]
agaagugugucccccucca

SEQ ID NO: 3969044 - RNA, 23 nt, Human herpesvirus 4 [Epstein-Barr virus]
agaaucaccagagcccagaggag

SEQ ID NO: 3969045 - RNA, 16 nt, Human herpesvirus 4 [Epstein-Barr virus]
agacacaucuggacca

SEQ ID NO: 3969046 - RNA, 13 nt, Human herpesvirus 4 [Epstein-Barr virus]
ccagguagcccag

SEQ ID NO: 3969047 - RNA, 22 nt, Human herpesvirus 4 [Epstein-Barr virus]
ccagugacgaagacccaucuga

SEQ ID NO: 3969048 - RNA, 20 nt, Human herpesvirus 4 [Epstein-Barr virus]
ccagugccuccgccugagcc

SEQ ID NO: 3969049 - RNA, 21 nt, Human herpesvirus 4 [Epstein-Barr virus]
ccaguggccggggccguggag

SEQ ID NO: 3969050 - RNA, 23 nt, Human herpesvirus 4 [Epstein-Barr virus]
ccauccaucaacuucagcuccag

SEQ ID NO: 3969051 - RNA, 15 nt, Human herpesvirus 4 [Epstein-Barr virus]
ccauccccagcccag

SEQ ID NO: 3969052 - RNA, 15 nt, Human herpesvirus 4 [Epstein-Barr virus]
ccaugacgcugcugc

SEQ ID NO: 3969053 - RNA, 18 nt, Human herpesvirus 4 [Epstein-Barr virus]
ccauggugagacaccugg

SEQ ID NO: 3969054 - RNA, 14 nt, Human herpesvirus 4 [Epstein-Barr virus]
ccauucucguccau

SEQ ID NO: 3969055 - RNA, 15 nt, Human herpesvirus 4 [Epstein-Barr virus]
cccaagccuggaugu

SEQ ID NO: 3969056 - RNA, 13 nt, Human herpesvirus 4 [Epstein-Barr virus]
cccaaugugcaug

SEQ ID NO: 3969057 - RNA, 14 nt, Human herpesvirus 4 [Epstein-Barr virus]
cccaaugugcaugg

SEQ ID NO: 3969058 - RNA, 15 nt, Human herpesvirus 4 [Epstein-Barr virus]
cccaauucacaucuc

SEQ ID NO: 3969059 - RNA, 20 nt, Human herpesvirus 4 [Epstein-Barr virus]
cccaccacccccaccaccuc

SEQ ID NO: 3969060 - RNA, 22 nt, Human herpesvirus 4 [Epstein-Barr virus]
cccacgugaacauccugcgugg

SEQ ID NO: 3969061 - RNA, 21 nt, Human herpesvirus 4 [Epstein-Barr virus]
cccacugucacugugcacucu

SEQ ID NO: 3969062 - RNA, 18 nt, Human herpesvirus 4 [Epstein-Barr virus]
cuggccaggcuggugaca

SEQ ID NO: 3969063 - RNA, 14 nt, Human herpesvirus 4 [Epstein-Barr virus]
cuggcccccaaccc

SEQ ID NO: 3969064 - RNA, 14 nt, Human herpesvirus 4 [Epstein-Barr virus]
cuggccgcagcugg

SEQ ID NO: 3969065 - RNA, 15 nt, Human herpesvirus 4 [Epstein-Barr virus]
cuggccgcagcuggc

SEQ ID NO: 3969066 - RNA, 17 nt, Human herpesvirus 4 [Epstein-Barr virus]
cuggccgccggauggcc

SEQ ID NO: 3969067 - RNA, 21 nt, Human herpesvirus 4 [Epstein-Barr virus]
cuggccuccuuaaauucaccu

SEQ ID NO: 3969068 - RNA, 14 nt, Human herpesvirus 4 [Epstein-Barr virus]
cuggcggcccagcc

SEQ ID NO: 3969069 - RNA, 22 nt, Human herpesvirus 4 [Epstein-Barr virus]
cuggcuccccauagacucccau

SEQ ID NO: 3969070 - RNA, 21 nt, Human herpesvirus 4 [Epstein-Barr virus]
cuggcucuucugggaacaccc

SEQ ID NO: 3969071 - RNA, 12 nt, Human herpesvirus 4 [Epstein-Barr virus]
cuggcugugcug

SEQ ID NO: 3969072 - RNA, 22 nt, Human herpesvirus 4 [Epstein-Barr virus]
cuggcuuucguccucuggcucu

SEQ ID NO: 3969073 - RNA, 23 nt, Human herpesvirus 4 [Epstein-Barr virus]
cuggcuuucguccucuggcucuc

SEQ ID NO: 3969074 - RNA, 22 nt, Human herpesvirus 4 [Epstein-Barr virus]
cugggaggugauguagguugua

SEQ ID NO: 3969075 - RNA, 14 nt, Human herpesvirus 4 [Epstein-Barr virus]
cugguacaggacca

SEQ ID NO: 3969076 - RNA, 16 nt, Human herpesvirus 4 [Epstein-Barr virus]
cuggugagccacguag

SEQ ID NO: 3969077 - RNA, 19 nt, Human herpesvirus 4 [Epstein-Barr virus]
cuguacaaacccaacaaug

SEQ ID NO: 3969078 - RNA, 15 nt, Human herpesvirus 4 [Epstein-Barr virus]
cuguccacugccccg

SEQ ID NO: 3969079 - RNA, 19 nt, Human herpesvirus 4 [Epstein-Barr virus]
cugucuacuucgccaugcu

SEQ ID NO: 3969080 - RNA, 18 nt, Human herpesvirus 4 [Epstein-Barr virus]
cugucucugaaggaucca

SEQ ID NO: 3969081 - RNA, 17 nt, Human herpesvirus 4 [Epstein-Barr virus]
cugucucuuucuggcca

SEQ ID NO: 3969082 - RNA, 17 nt, Human herpesvirus 4 [Epstein-Barr virus]
cugugcuucagcaguag

SEQ ID NO: 3969083 - RNA, 19 nt, Human herpesvirus 4 [Epstein-Barr virus]
cuguggccccggcuggcca

SEQ ID NO: 3969084 - RNA, 15 nt, Human herpesvirus 4 [Epstein-Barr virus]
cuguguccugggcaa

SEQ ID NO: 3969085 - RNA, 23 nt, Human herpesvirus 4 [Epstein-Barr virus]
cugugugcgcgccgccagcaugg

SEQ ID NO: 3969086 - RNA, 19 nt, Human herpesvirus 4 [Epstein-Barr virus]
cuuaaaaaugugcagcuuc

SEQ ID NO: 3969087 - RNA, 22 nt, Human herpesvirus 4 [Epstein-Barr virus]
cuuaaaaaugugcagcuucucc

SEQ ID NO: 3969088 - RNA, 15 nt, Human herpesvirus 4 [Epstein-Barr virus]
cuuaugcuaacauuu

SEQ ID NO: 3969089 - RNA, 12 nt, Human herpesvirus 4 [Epstein-Barr virus]
cuucaccaccac

SEQ ID NO: 3969090 - RNA, 19 nt, Human herpesvirus 4 [Epstein-Barr virus]
cuucacuaaggcaguccag

SEQ ID NO: 3969091 - RNA, 13 nt, Human herpesvirus 4 [Epstein-Barr virus]
cuucagugucugg

SEQ ID NO: 3969092 - RNA, 14 nt, Human herpesvirus 4 [Epstein-Barr virus]
cuuccacagcaaug

SEQ ID NO: 3969093 - RNA, 22 nt, Human herpesvirus 4 [Epstein-Barr virus]
cuuccacccccuggagccagcg

SEQ ID NO: 3969094 - RNA, 22 nt, Human herpesvirus 4 [Epstein-Barr virus]
cuuccagagaggcgcagcccag

SEQ ID NO: 3969095 - RNA, 14 nt, Human herpesvirus 4 [Epstein-Barr virus]
cuuccagagcucua

SEQ ID NO: 3969096 - RNA, 13 nt, Human herpesvirus 4 [Epstein-Barr virus]
cuuccaugucuac

SEQ ID NO: 3969097 - RNA, 19 nt, Human herpesvirus 4 [Epstein-Barr virus]
cuucccagacucugcuuuc

SEQ ID NO: 3969098 - RNA, 17 nt, Human herpesvirus 4 [Epstein-Barr virus]
cuucucaaaggccuugg

SEQ ID NO: 3969099 - RNA, 19 nt, Human herpesvirus 4 [Epstein-Barr virus]
cuucucauuagucaggagg

SEQ ID NO: 3969100 - RNA, 17 nt, Human herpesvirus 4 [Epstein-Barr virus]
cuucuccucagccucca

SEQ ID NO: 3969101 - RNA, 16 nt, Human herpesvirus 4 [Epstein-Barr virus]
cuugcccucuccagca

SEQ ID NO: 3969102 - RNA, 22 nt, Human herpesvirus 4 [Epstein-Barr virus]
cuugcuccaccagcuucucaaa

SEQ ID NO: 3969103 - RNA, 12 nt, Human herpesvirus 4 [Epstein-Barr virus]
cuugcuggggcg

SEQ ID NO: 3969104 - RNA, 21 nt, Human herpesvirus 4 [Epstein-Barr virus]
cuuggaggcugcuaagccagg

SEQ ID NO: 3969105 - RNA, 15 nt, Human herpesvirus 4 [Epstein-Barr virus]
cuuggcagcaguggc

SEQ ID NO: 3969106 - RNA, 17 nt, Human herpesvirus 4 [Epstein-Barr virus]
cuuggcuauggucaugg

SEQ ID NO: 3969107 - RNA, 19 nt, Human herpesvirus 4 [Epstein-Barr virus]
cuugggauugcaacacgac

SEQ ID NO: 3969108 - RNA, 16 nt, Human herpesvirus 4 [Epstein-Barr virus]
cuuguccgcuauuuuu

SEQ ID NO: 3969109 - RNA, 18 nt, Human herpesvirus 4 [Epstein-Barr virus]
cuuguccuuggugugcac

SEQ ID NO: 3969110 - RNA, 13 nt, Human herpesvirus 4 [Epstein-Barr virus]
cuugugcuccuga

SEQ ID NO: 3969111 - RNA, 10 nt, Human herpesvirus 4 [Epstein-Barr virus]
cuuguuucaa

SEQ ID NO: 3969112 - RNA, 20 nt, Human herpesvirus 4 [Epstein-Barr virus]
cuuuacccagcccuuaacac

SEQ ID NO: 3969113 - RNA, 19 nt, Human herpesvirus 4 [Epstein-Barr virus]
cuuuaggcguaacuugucu

SEQ ID NO: 3969114 - RNA, 16 nt, Human herpesvirus 4 [Epstein-Barr virus]
cuuucgacugucauuu

SEQ ID NO: 3969115 - RNA, 15 nt, Human herpesvirus 4 [Epstein-Barr virus]
cuuucuaccaggggc

SEQ ID NO: 3969116 - RNA, 13 nt, Human herpesvirus 4 [Epstein-Barr virus]
cuuucuccuucaa

SEQ ID NO: 3969117 - RNA, 15 nt, Human herpesvirus 4 [Epstein-Barr virus]
cuuugaugaggcuga

SEQ ID NO: 3969118 - RNA, 23 nt, Human herpesvirus 4 [Epstein-Barr virus]
cuuuguggugggacugagauuua

SEQ ID NO: 3969119 - RNA, 12 nt, Human herpesvirus 4 [Epstein-Barr virus]
gaaaagccacau

SEQ ID NO: 3969120 - RNA, 20 nt, Human herpesvirus 4 [Epstein-Barr virus]
gaaaauaguuccaggugaca

SEQ ID NO: 3969121 - RNA, 22 nt, Human herpesvirus 4 [Epstein-Barr virus]
gaaaauaguuccaggugacagc

SEQ ID NO: 3969122 - RNA, 21 nt, Human herpesvirus 4 [Epstein-Barr virus]
gaaaccugcgaaacuuggggg

SEQ ID NO: 3969123 - RNA, 14 nt, Human herpesvirus 4 [Epstein-Barr virus]
gaaacuacacggcc

SEQ ID NO: 3969124 - RNA, 23 nt, Human herpesvirus 4 [Epstein-Barr virus]
gaacacggcaccgucagccacac

SEQ ID NO: 3969125 - RNA, 19 nt, Human herpesvirus 4 [Epstein-Barr virus]
gaacacucauggugugaga

SEQ ID NO: 3969126 - RNA, 17 nt, Human herpesvirus 4 [Epstein-Barr virus]
gaacaucuggcuggggc

SEQ ID NO: 3969127 - RNA, 12 nt, Human herpesvirus 4 [Epstein-Barr virus]
gaacgcccagua

SEQ ID NO: 3969128 - RNA, 22 nt, Human herpesvirus 4 [Epstein-Barr virus]
gaacuggggcugguggccuggg

SEQ ID NO: 3969129 - RNA, 23 nt, Human herpesvirus 4 [Epstein-Barr virus]
gaacuguacuaaauuugcugaca

SEQ ID NO: 3969130 - RNA, 13 nt, Human herpesvirus 4 [Epstein-Barr virus]
gaagaccaggagc

SEQ ID NO: 3969131 - RNA, 23 nt, Human herpesvirus 4 [Epstein-Barr virus]
gaagacccaucugagggcaguga

SEQ ID NO: 3969132 - RNA, 14 nt, Human herpesvirus 4 [Epstein-Barr virus]
gaagauugaagaca

SEQ ID NO: 3969133 - RNA, 22 nt, Human herpesvirus 4 [Epstein-Barr virus]
gaagcccaagaagaagcccacc

SEQ ID NO: 3969134 - RNA, 23 nt, Human herpesvirus 4 [Epstein-Barr virus]
gaagcccccaaaaguagaggcuc

SEQ ID NO: 3969135 - RNA, 14 nt, Human herpesvirus 4 [Epstein-Barr virus]
gaagcgaagcagcu

SEQ ID NO: 3969136 - RNA, 14 nt, Human herpesvirus 4 [Epstein-Barr virus]
gaaggaaaggccug

SEQ ID NO: 3969137 - RNA, 15 nt, Human herpesvirus 4 [Epstein-Barr virus]
gaaggacagggggac

SEQ ID NO: 3969138 - RNA, 21 nt, Human herpesvirus 4 [Epstein-Barr virus]
gaaggcgugggugucagaccu

SEQ ID NO: 3969139 - RNA, 20 nt, Human herpesvirus 4 [Epstein-Barr virus]
gaaggcuagacgcagcugug

SEQ ID NO: 3969140 - RNA, 15 nt, Human herpesvirus 4 [Epstein-Barr virus]
gaagucgguguccag

SEQ ID NO: 3969141 - RNA, 20 nt, Human herpesvirus 4 [Epstein-Barr virus]
gaaguuuuaacaccugacca

SEQ ID NO: 3969142 - RNA, 18 nt, Human herpesvirus 4 [Epstein-Barr virus]
gaaucaccagagcccaga

SEQ ID NO: 3969143 - RNA, 19 nt, Human herpesvirus 4 [Epstein-Barr virus]
gaaucuugauaaaacaggu

SEQ ID NO: 3969144 - RNA, 16 nt, Human herpesvirus 4 [Epstein-Barr virus]
gaaugacgggcucccu

SEQ ID NO: 3969145 - RNA, 20 nt, Human herpesvirus 4 [Epstein-Barr virus]
gaauuccccugccugcaugc

SEQ ID NO: 3969146 - RNA, 12 nt, Human herpesvirus 4 [Epstein-Barr virus]
gaauuggggcug

SEQ ID NO: 3969147 - RNA, 13 nt, Human herpesvirus 4 [Epstein-Barr virus]
gacaagaggcaga

SEQ ID NO: 3969148 - RNA, 22 nt, Human herpesvirus 4 [Epstein-Barr virus]
gacaauacacccaucuggaguu

SEQ ID NO: 3969149 - RNA, 14 nt, Human herpesvirus 4 [Epstein-Barr virus]
gacaccagauguuu

SEQ ID NO: 3969150 - RNA, 13 nt, Human herpesvirus 4 [Epstein-Barr virus]
ggacacaccgcca

SEQ ID NO: 3969151 - RNA, 18 nt, Human herpesvirus 4 [Epstein-Barr virus]
ggacagcacaacaagaaa

SEQ ID NO: 3969152 - RNA, 19 nt, Human herpesvirus 4 [Epstein-Barr virus]
ggacaugcugaugugcugc

SEQ ID NO: 3969153 - RNA, 20 nt, Human herpesvirus 4 [Epstein-Barr virus]
ggacaugucacguguccugc

SEQ ID NO: 3969154 - RNA, 17 nt, Human herpesvirus 4 [Epstein-Barr virus]
ggacccggaccaaugcc

SEQ ID NO: 3969155 - RNA, 19 nt, Human herpesvirus 4 [Epstein-Barr virus]
ggacccuauggagggcagc

SEQ ID NO: 3969156 - RNA, 14 nt, Human herpesvirus 4 [Epstein-Barr virus]
ggacccugcugcga

SEQ ID NO: 3969157 - RNA, 20 nt, Human herpesvirus 4 [Epstein-Barr virus]
ggacccuugucuuuggugga

SEQ ID NO: 3969158 - RNA, 20 nt, Human herpesvirus 4 [Epstein-Barr virus]
ggaccggaucgaaggagagc

SEQ ID NO: 3969159 - RNA, 15 nt, Human herpesvirus 4 [Epstein-Barr virus]
ggaccuguugcuuca

SEQ ID NO: 3969160 - RNA, 12 nt, Human herpesvirus 4 [Epstein-Barr virus]
ggacgcugcugu

SEQ ID NO: 3969161 - RNA, 19 nt, Human herpesvirus 4 [Epstein-Barr virus]
ggagacacaucuggaccag

SEQ ID NO: 3969162 - RNA, 12 nt, Human herpesvirus 4 [Epstein-Barr virus]
ggagaggggagu

SEQ ID NO: 3969163 - RNA, 21 nt, Human herpesvirus 4 [Epstein-Barr virus]
ggagauugauuuggaggaaga

SEQ ID NO: 3969164 - RNA, 23 nt, Human herpesvirus 4 [Epstein-Barr virus]
ggagauugauuuggaggaagagu

SEQ ID NO: 3969165 - RNA, 19 nt, Human herpesvirus 4 [Epstein-Barr virus]
ggagcacauuccccccgcc

SEQ ID NO: 3969166 - RNA, 18 nt, Human herpesvirus 4 [Epstein-Barr virus]
ggagccaccacagcacaa

SEQ ID NO: 3969167 - RNA, 18 nt, Human herpesvirus 4 [Epstein-Barr virus]
ggagcuccgagagcuccg

SEQ ID NO: 3969168 - RNA, 17 nt, Human herpesvirus 4 [Epstein-Barr virus]
ggagcuggugcaccugc

SEQ ID NO: 3969169 - RNA, 21 nt, Human herpesvirus 4 [Epstein-Barr virus]
ggaggaagagacuucacagag

SEQ ID NO: 3969170 - RNA, 18 nt, Human herpesvirus 4 [Epstein-Barr virus]
ggaggagacguguguggc

SEQ ID NO: 3969171 - RNA, 17 nt, Human herpesvirus 4 [Epstein-Barr virus]
ggaggagcuccgugagc

SEQ ID NO: 3969172 - RNA, 14 nt, Human herpesvirus 4 [Epstein-Barr virus]
ggaggaggggcagg

SEQ ID NO: 3969173 - RNA, 12 nt, Human herpesvirus 4 [Epstein-Barr virus]
ggaggcagacac

SEQ ID NO: 3969174 - RNA, 22 nt, Human herpesvirus 4 [Epstein-Barr virus]
ggaggccagguagcccagcguc

SEQ ID NO: 3969175 - RNA, 15 nt, Human herpesvirus 4 [Epstein-Barr virus]
ggaggggcggcagcg

SEQ ID NO: 3969176 - RNA, 14 nt, Human herpesvirus 4 [Epstein-Barr virus]
ggauauagcucugc

SEQ ID NO: 3969177 - RNA, 16 nt, Human herpesvirus 4 [Epstein-Barr virus]
ggauccuccaccgccg

SEQ ID NO: 3969178 - RNA, 19 nt, Human herpesvirus 4 [Epstein-Barr virus]
ggaugaggcugaugauggc

SEQ ID NO: 3969179 - RNA, 21 nt, Human herpesvirus 4 [Epstein-Barr virus]
ggaugagguuagcguggacag

SEQ ID NO: 3969180 - RNA, 22 nt, Human herpesvirus 4 [Epstein-Barr virus]
ggaugccucacgcgaagggaaa

SEQ ID NO: 3969181 - RNA, 18 nt, Human herpesvirus 4 [Epstein-Barr virus]
ggcacaucuggaccugga

SEQ ID NO: 3969182 - RNA, 21 nt, Human herpesvirus 4 [Epstein-Barr virus]
ggcacugcguccaccuggcca

SEQ ID NO: 3969183 - RNA, 20 nt, Human herpesvirus 4 [Epstein-Barr virus]
ggcagaaugaccgugcaugc

SEQ ID NO: 3969184 - RNA, 12 nt, Human herpesvirus 4 [Epstein-Barr virus]
ggcagaggccuc

SEQ ID NO: 3969185 - RNA, 19 nt, Human herpesvirus 4 [Epstein-Barr virus]
ggcagcagcucuggcacug

SEQ ID NO: 3969186 - RNA, 15 nt, Human herpesvirus 4 [Epstein-Barr virus]
ggcagccuugcgugg

SEQ ID NO: 3969187 - RNA, 14 nt, Human herpesvirus 4 [Epstein-Barr virus]
ggcagucuccaccu

SEQ ID NO: 3969188 - RNA, 21 nt, Human herpesvirus 4 [Epstein-Barr virus]
ggcauaaauucuccugccugc

SEQ ID NO: 3969189 - RNA, 17 nt, Human herpesvirus 4 [Epstein-Barr virus]
ggccacaaagagggggc

SEQ ID NO: 3969190 - RNA, 21 nt, Human herpesvirus 4 [Epstein-Barr virus]
ggccaccuucuccaucuccau

SEQ ID NO: 3969191 - RNA, 19 nt, Human herpesvirus 4 [Epstein-Barr virus]
ggccagcaaaaccagcccg

SEQ ID NO: 3969192 - RNA, 17 nt, Human herpesvirus 4 [Epstein-Barr virus]
ggccaggacgcugcugu

SEQ ID NO: 3969193 - RNA, 23 nt, Human herpesvirus 4 [Epstein-Barr virus]
ggccagggcggaggagauccgcc

SEQ ID NO: 3969194 - RNA, 20 nt, Human herpesvirus 4 [Epstein-Barr virus]
ggccagguacaggaccugga

SEQ ID NO: 3969195 - RNA, 17 nt, Human herpesvirus 4 [Epstein-Barr virus]
ggccauaguggcggcag

SEQ ID NO: 3969196 - RNA, 19 nt, Human herpesvirus 4 [Epstein-Barr virus]
ggcccguuccaggcucucc

SEQ ID NO: 3969197 - RNA, 14 nt, Human herpesvirus 4 [Epstein-Barr virus]
ggcccuggcccacc

SEQ ID NO: 3969198 - RNA, 21 nt, Human herpesvirus 4 [Epstein-Barr virus]
ggcccuguacacuacacucua

SEQ ID NO: 3969199 - RNA, 18 nt, Human herpesvirus 4 [Epstein-Barr virus]
ggcccuuugccuggggcu

SEQ ID NO: 3969200 - RNA, 18 nt, Human herpesvirus 4 [Epstein-Barr virus]
ggccgccuauggggccug

SEQ ID NO: 3969201 - RNA, 14 nt, Human herpesvirus 4 [Epstein-Barr virus]
ggccgcugccaggc

SEQ ID NO: 3969202 - RNA, 20 nt, Human herpesvirus 4 [Epstein-Barr virus]
ggccuccauccaguggggcu

SEQ ID NO: 3969203 - RNA, 18 nt, Human herpesvirus 4 [Epstein-Barr virus]
ggccuccuggccagcacc

SEQ ID NO: 3969204 - RNA, 22 nt, Human herpesvirus 4 [Epstein-Barr virus]
ggccucgucaggagggcagaga

SEQ ID NO: 3969205 - RNA, 14 nt, Human herpesvirus 4 [Epstein-Barr virus]
ggccugagagccgg

SEQ ID NO: 3969206 - RNA, 18 nt, Human herpesvirus 4 [Epstein-Barr virus]
ggccugugucuucugucu

SEQ ID NO: 3969207 - RNA, 13 nt, Human herpesvirus 4 [Epstein-Barr virus]
ggccuuagcccag

SEQ ID NO: 3969208 - RNA, 14 nt, Human herpesvirus 4 [Epstein-Barr virus]
ggcgaaggcggaga

SEQ ID NO: 3969209 - RNA, 13 nt, Human herpesvirus 4 [Epstein-Barr virus]
ggcgaaggguggg

SEQ ID NO: 3969210 - RNA, 19 nt, Human herpesvirus 4 [Epstein-Barr virus]
ggcgacaguaacacagggu

SEQ ID NO: 3969211 - RNA, 15 nt, Human herpesvirus 4 [Epstein-Barr virus]
ggcgacugggggcaa

SEQ ID NO: 3969212 - RNA, 18 nt, Human herpesvirus 4 [Epstein-Barr virus]
ggcgagacuuggaccaag

SEQ ID NO: 3969213 - RNA, 16 nt, Human herpesvirus 4 [Epstein-Barr virus]
ggcgcuguuauggcca

SEQ ID NO: 3969214 - RNA, 22 nt, Human herpesvirus 4 [Epstein-Barr virus]
acugccuggggaaaauguaccc

SEQ ID NO: 3969215 - RNA, 16 nt, Human herpesvirus 4 [Epstein-Barr virus]
acugcgagggggccug

SEQ ID NO: 3969216 - RNA, 18 nt, Human herpesvirus 4 [Epstein-Barr virus]
acugcuagcgucacugau

SEQ ID NO: 3969217 - RNA, 20 nt, Human herpesvirus 4 [Epstein-Barr virus]
acugcuagcgucacugauuu

SEQ ID NO: 3969218 - RNA, 16 nt, Human herpesvirus 4 [Epstein-Barr virus]
acuggaugcaggaccu

SEQ ID NO: 3969219 - RNA, 22 nt, Human herpesvirus 4 [Epstein-Barr virus]
acuggucaccagcuucgagagc

SEQ ID NO: 3969220 - RNA, 15 nt, Human herpesvirus 4 [Epstein-Barr virus]
acugucacugugcac

SEQ ID NO: 3969221 - RNA, 21 nt, Human herpesvirus 4 [Epstein-Barr virus]
acuucaagaguuuaagcagca

SEQ ID NO: 3969222 - RNA, 14 nt, Human herpesvirus 4 [Epstein-Barr virus]
acuucagcuccagg

SEQ ID NO: 3969223 - RNA, 18 nt, Human herpesvirus 4 [Epstein-Barr virus]
acuuccacagcaauggca

SEQ ID NO: 3969224 - RNA, 16 nt, Human herpesvirus 4 [Epstein-Barr virus]
acuucuacucuuggca

SEQ ID NO: 3969225 - RNA, 13 nt, Human herpesvirus 4 [Epstein-Barr virus]
acuuggaggcugc

SEQ ID NO: 3969226 - RNA, 21 nt, Human herpesvirus 4 [Epstein-Barr virus]
acuugucuacaucccauaccu

SEQ ID NO: 3969227 - RNA, 15 nt, Human herpesvirus 4 [Epstein-Barr virus]
acuuuuugccaccca

SEQ ID NO: 3969228 - RNA, 13 nt, Human herpesvirus 4 [Epstein-Barr virus]
agaaccccagcaa

SEQ ID NO: 3969229 - RNA, 19 nt, Human herpesvirus 4 [Epstein-Barr virus]
agaacugcaagauaucaca

SEQ ID NO: 3969230 - RNA, 16 nt, Human herpesvirus 4 [Epstein-Barr virus]
agaagauugaagacaa

SEQ ID NO: 3969231 - RNA, 13 nt, Human herpesvirus 4 [Epstein-Barr virus]
agaagcuggacgu

SEQ ID NO: 3969232 - RNA, 15 nt, Human herpesvirus 4 [Epstein-Barr virus]
agaaugcccaccaga

SEQ ID NO: 3969233 - RNA, 17 nt, Human herpesvirus 4 [Epstein-Barr virus]
agacacggcucugucag

SEQ ID NO: 3969234 - RNA, 13 nt, Human herpesvirus 4 [Epstein-Barr virus]
agacccaucugag

SEQ ID NO: 3969235 - RNA, 14 nt, Human herpesvirus 4 [Epstein-Barr virus]
agaccuauguauaa

SEQ ID NO: 3969236 - RNA, 19 nt, Human herpesvirus 4 [Epstein-Barr virus]
agaccucgaguccggggag

SEQ ID NO: 3969237 - RNA, 14 nt, Human herpesvirus 4 [Epstein-Barr virus]
agacggggagguga

SEQ ID NO: 3969238 - RNA, 16 nt, Human herpesvirus 4 [Epstein-Barr virus]
agacguggguccccuc

SEQ ID NO: 3969239 - RNA, 14 nt, Human herpesvirus 4 [Epstein-Barr virus]
agacucaggcccuc

SEQ ID NO: 3969240 - RNA, 14 nt, Human herpesvirus 4 [Epstein-Barr virus]
agacucuccgcuuu

SEQ ID NO: 3969241 - RNA, 14 nt, Human herpesvirus 4 [Epstein-Barr virus]
agagaggccucugg

SEQ ID NO: 3969242 - RNA, 22 nt, Human herpesvirus 4 [Epstein-Barr virus]
agagcugagugcccagggcaga

SEQ ID NO: 3969243 - RNA, 14 nt, Human herpesvirus 4 [Epstein-Barr virus]
agaggaugaggcug

SEQ ID NO: 3969244 - RNA, 15 nt, Human herpesvirus 4 [Epstein-Barr virus]
agagguucagggacu

SEQ ID NO: 3969245 - RNA, 18 nt, Human herpesvirus 4 [Epstein-Barr virus]
agagguuuugcuagggag

SEQ ID NO: 3969246 - RNA, 23 nt, Human herpesvirus 4 [Epstein-Barr virus]
agagguuuugcuagggaggagac

SEQ ID NO: 3969247 - RNA, 20 nt, Human herpesvirus 4 [Epstein-Barr virus]
agaucacggcugucuagacg

SEQ ID NO: 3969248 - RNA, 23 nt, Human herpesvirus 4 [Epstein-Barr virus]
agaucagaaaauaaaaagaaugu

SEQ ID NO: 3969249 - RNA, 14 nt, Human herpesvirus 4 [Epstein-Barr virus]
agauccugggcccc

SEQ ID NO: 3969250 - RNA, 18 nt, Human herpesvirus 4 [Epstein-Barr virus]
agaugaagacgaggagau

SEQ ID NO: 3969251 - RNA, 19 nt, Human herpesvirus 4 [Epstein-Barr virus]
agaugagccucucaaaggc

SEQ ID NO: 3969252 - RNA, 22 nt, Human herpesvirus 4 [Epstein-Barr virus]
agauuguuccaggucagaccua

SEQ ID NO: 3969253 - RNA, 21 nt, Human herpesvirus 4 [Epstein-Barr virus]
agcaacccccggcucucaggc

SEQ ID NO: 3969254 - RNA, 16 nt, Human herpesvirus 4 [Epstein-Barr virus]
agcaccucaaccugga

SEQ ID NO: 3969255 - RNA, 17 nt, Human herpesvirus 4 [Epstein-Barr virus]
agcaccucaaccuggag

SEQ ID NO: 3969256 - RNA, 23 nt, Human herpesvirus 4 [Epstein-Barr virus]
agcacgguagccuugggggccug

SEQ ID NO: 3969257 - RNA, 17 nt, Human herpesvirus 4 [Epstein-Barr virus]
agcacuuugaaagaugu

SEQ ID NO: 3969258 - RNA, 19 nt, Human herpesvirus 4 [Epstein-Barr virus]
agcagacaaggacaggugc

SEQ ID NO: 3969259 - RNA, 19 nt, Human herpesvirus 4 [Epstein-Barr virus]
agcagauagccggccaggc

SEQ ID NO: 3969260 - RNA, 22 nt, Human herpesvirus 4 [Epstein-Barr virus]
agcagauuuccgucagccaggg

SEQ ID NO: 3969261 - RNA, 14 nt, Human herpesvirus 4 [Epstein-Barr virus]
agcagcaguggugu

SEQ ID NO: 3969262 - RNA, 14 nt, Human herpesvirus 4 [Epstein-Barr virus]
agcagcuacacucu

SEQ ID NO: 3969263 - RNA, 22 nt, Human herpesvirus 4 [Epstein-Barr virus]
agcaggaggaggggcaggagca

SEQ ID NO: 3969264 - RNA, 21 nt, Human herpesvirus 4 [Epstein-Barr virus]
agcaggaggaggggcaggagg

SEQ ID NO: 3969265 - RNA, 15 nt, Human herpesvirus 4 [Epstein-Barr virus]
agcaggugagggugc

SEQ ID NO: 3969266 - RNA, 14 nt, Human herpesvirus 4 [Epstein-Barr virus]
agcagguggcacac

SEQ ID NO: 3969267 - RNA, 17 nt, Human herpesvirus 4 [Epstein-Barr virus]
agcauggcggccuggca

SEQ ID NO: 3969268 - RNA, 21 nt, Human herpesvirus 4 [Epstein-Barr virus]
agccacacaaucagccgggag

SEQ ID NO: 3969269 - RNA, 22 nt, Human herpesvirus 4 [Epstein-Barr virus]
agccacacaaucagccgggagg

SEQ ID NO: 3969270 - RNA, 15 nt, Human herpesvirus 4 [Epstein-Barr virus]
agccaccacagcaca

SEQ ID NO: 3969271 - RNA, 19 nt, Human herpesvirus 4 [Epstein-Barr virus]
agccaccccagacaggaga

SEQ ID NO: 3969272 - RNA, 18 nt, Human herpesvirus 4 [Epstein-Barr virus]
agccacggcgucaaacag

SEQ ID NO: 3969273 - RNA, 22 nt, Human herpesvirus 4 [Epstein-Barr virus]
agccaggcuuucuaugccugaa

SEQ ID NO: 3969274 - RNA, 14 nt, Human herpesvirus 4 [Epstein-Barr virus]
agcccacuccccuc

SEQ ID NO: 3969275 - RNA, 23 nt, Human herpesvirus 4 [Epstein-Barr virus]
agccccaauucuugcacccaccc

SEQ ID NO: 3969276 - RNA, 17 nt, Human herpesvirus 4 [Epstein-Barr virus]
agccgucgauaccgggu

SEQ ID NO: 3969277 - RNA, 20 nt, Human herpesvirus 4 [Epstein-Barr virus]
agccuacucuccacucccag

SEQ ID NO: 3969278 - RNA, 14 nt, Human herpesvirus 4 [Epstein-Barr virus]
agccucugccacaa

SEQ ID NO: 3969279 - RNA, 21 nt, Human herpesvirus 4 [Epstein-Barr virus]
agccugcaccaguggcugccc

SEQ ID NO: 3969280 - RNA, 21 nt, Human herpesvirus 4 [Epstein-Barr virus]
agcgaagcuagugcagggggc

SEQ ID NO: 3969281 - RNA, 15 nt, Human herpesvirus 4 [Epstein-Barr virus]
agcgacgaggaugaa

SEQ ID NO: 3969282 - RNA, 20 nt, Human herpesvirus 4 [Epstein-Barr virus]
agcgccgcgguuucagcauc

SEQ ID NO: 3969283 - RNA, 14 nt, Human herpesvirus 4 [Epstein-Barr virus]
agcgccguggccac

SEQ ID NO: 3969284 - RNA, 12 nt, Human herpesvirus 4 [Epstein-Barr virus]
agcgccuccucg

SEQ ID NO: 3969285 - RNA, 18 nt, Human herpesvirus 4 [Epstein-Barr virus]
agcgccuccucgcaggcc

SEQ ID NO: 3969286 - RNA, 19 nt, Human herpesvirus 4 [Epstein-Barr virus]
agcggcauccucaaggggc

SEQ ID NO: 3969287 - RNA, 19 nt, Human herpesvirus 4 [Epstein-Barr virus]
agcgggaggggcaggagca

SEQ ID NO: 3969288 - RNA, 21 nt, Human herpesvirus 4 [Epstein-Barr virus]
agcguggucgugcugcuagcc

SEQ ID NO: 3969289 - RNA, 17 nt, Human herpesvirus 4 [Epstein-Barr virus]
agcgugugcacccggcu

SEQ ID NO: 3969290 - RNA, 17 nt, Human herpesvirus 4 [Epstein-Barr virus]
agcucacuuucagugga

SEQ ID NO: 3969291 - RNA, 14 nt, Human herpesvirus 4 [Epstein-Barr virus]
agcuccagggccag

SEQ ID NO: 3969292 - RNA, 19 nt, Human herpesvirus 4 [Epstein-Barr virus]
agcuccgagagcuccgcca

SEQ ID NO: 3969293 - RNA, 23 nt, Human herpesvirus 4 [Epstein-Barr virus]
agcuccgugagcaggagcuugag

SEQ ID NO: 3969294 - RNA, 19 nt, Human herpesvirus 4 [Epstein-Barr virus]
agcucugguaguaggcaca

SEQ ID NO: 3969295 - RNA, 18 nt, Human herpesvirus 4 [Epstein-Barr virus]
agcugccgcgauguaccc

SEQ ID NO: 3969296 - RNA, 15 nt, Human herpesvirus 4 [Epstein-Barr virus]
agcuggccaggcugg

SEQ ID NO: 3969297 - RNA, 22 nt, Human herpesvirus 4 [Epstein-Barr virus]
agcugggccucuaaguacaggu

SEQ ID NO: 3969298 - RNA, 23 nt, Human herpesvirus 4 [Epstein-Barr virus]
agcuucagggaaaaacuggccau

SEQ ID NO: 3969299 - RNA, 14 nt, Human herpesvirus 4 [Epstein-Barr virus]
agcuuuugaccaag

SEQ ID NO: 3969300 - RNA, 21 nt, Human herpesvirus 4 [Epstein-Barr virus]
aggaacacggucuggucacua

SEQ ID NO: 3969301 - RNA, 14 nt, Human herpesvirus 4 [Epstein-Barr virus]
caccacggugcagc

SEQ ID NO: 3969302 - RNA, 22 nt, Human herpesvirus 4 [Epstein-Barr virus]
caccacuaagguuacugcacag

SEQ ID NO: 3969303 - RNA, 21 nt, Human herpesvirus 4 [Epstein-Barr virus]
caccagagggugagcccaccu

SEQ ID NO: 3969304 - RNA, 17 nt, Human herpesvirus 4 [Epstein-Barr virus]
caccagcuaacaggaca

SEQ ID NO: 3969305 - RNA, 20 nt, Human herpesvirus 4 [Epstein-Barr virus]
caccagcuaacaggacaugu

SEQ ID NO: 3969306 - RNA, 15 nt, Human herpesvirus 4 [Epstein-Barr virus]
caccagcuccaggga

SEQ ID NO: 3969307 - RNA, 16 nt, Human herpesvirus 4 [Epstein-Barr virus]
caccagggaggccugg

SEQ ID NO: 3969308 - RNA, 22 nt, Human herpesvirus 4 [Epstein-Barr virus]
caccaguguccagagaggaaga

SEQ ID NO: 3969309 - RNA, 19 nt, Human herpesvirus 4 [Epstein-Barr virus]
caccauagcaugucacaca

SEQ ID NO: 3969310 - RNA, 16 nt, Human herpesvirus 4 [Epstein-Barr virus]
caccaugguagccggc

SEQ ID NO: 3969311 - RNA, 15 nt, Human herpesvirus 4 [Epstein-Barr virus]
caccccacacucccu

SEQ ID NO: 3969312 - RNA, 15 nt, Human herpesvirus 4 [Epstein-Barr virus]
caccccaccauauga

SEQ ID NO: 3969313 - RNA, 23 nt, Human herpesvirus 4 [Epstein-Barr virus]
caccccaguggacaaggcaguag

SEQ ID NO: 3969314 - RNA, 16 nt, Human herpesvirus 4 [Epstein-Barr virus]
caccccggcgccaccu

SEQ ID NO: 3969315 - RNA, 23 nt, Human herpesvirus 4 [Epstein-Barr virus]
cacccggacccggaccaaugcca

SEQ ID NO: 3969316 - RNA, 21 nt, Human herpesvirus 4 [Epstein-Barr virus]
cacccggggaaccggccccgu

SEQ ID NO: 3969317 - RNA, 15 nt, Human herpesvirus 4 [Epstein-Barr virus]
caccgagcagaaggc

SEQ ID NO: 3969318 - RNA, 18 nt, Human herpesvirus 4 [Epstein-Barr virus]
caccgagcagaaggccau

SEQ ID NO: 3969319 - RNA, 17 nt, Human herpesvirus 4 [Epstein-Barr virus]
caccggcuuggcccucu

SEQ ID NO: 3969320 - RNA, 16 nt, Human herpesvirus 4 [Epstein-Barr virus]
caccggugacagugcu

SEQ ID NO: 3969321 - RNA, 11 nt, Human herpesvirus 4 [Epstein-Barr virus]
caccuccacca

SEQ ID NO: 3969322 - RNA, 11 nt, Human herpesvirus 4 [Epstein-Barr virus]
caccugccauc

SEQ ID NO: 3969323 - RNA, 14 nt, Human herpesvirus 4 [Epstein-Barr virus]
caccugcuagagaa

SEQ ID NO: 3969324 - RNA, 13 nt, Human herpesvirus 4 [Epstein-Barr virus]
caccuggccaggg

SEQ ID NO: 3969325 - RNA, 20 nt, Human herpesvirus 4 [Epstein-Barr virus]
caccuguccuugucugcugc

SEQ ID NO: 3969326 - RNA, 21 nt, Human herpesvirus 4 [Epstein-Barr virus]
caccuuaacuggcacacacuc

SEQ ID NO: 3969327 - RNA, 21 nt, Human herpesvirus 4 [Epstein-Barr virus]
caccuugacuguaaucacugg

SEQ ID NO: 3969328 - RNA, 21 nt, Human herpesvirus 4 [Epstein-Barr virus]
caccuugaggugccacagagc

SEQ ID NO: 3969329 - RNA, 14 nt, Human herpesvirus 4 [Epstein-Barr virus]
cacgaaugcccagg

SEQ ID NO: 3969330 - RNA, 16 nt, Human herpesvirus 4 [Epstein-Barr virus]
cacgagauggcccagu

SEQ ID NO: 3969331 - RNA, 15 nt, Human herpesvirus 4 [Epstein-Barr virus]
cacgccguggcccug

SEQ ID NO: 3969332 - RNA, 17 nt, Human herpesvirus 4 [Epstein-Barr virus]
cacgcuuuugucugccu

SEQ ID NO: 3969333 - RNA, 16 nt, Human herpesvirus 4 [Epstein-Barr virus]
cacgggccuggggcca

SEQ ID NO: 3969334 - RNA, 17 nt, Human herpesvirus 4 [Epstein-Barr virus]
cacguagccuauuugca

SEQ ID NO: 3969335 - RNA, 21 nt, Human herpesvirus 4 [Epstein-Barr virus]
cacgugaacauccugcguggc

SEQ ID NO: 3969336 - RNA, 12 nt, Human herpesvirus 4 [Epstein-Barr virus]
cacucagcuccg

SEQ ID NO: 3969337 - RNA, 20 nt, Human herpesvirus 4 [Epstein-Barr virus]
cacucaggaagcuggccagg

SEQ ID NO: 3969338 - RNA, 19 nt, Human herpesvirus 4 [Epstein-Barr virus]
cacucaugguacggugaua

SEQ ID NO: 3969339 - RNA, 22 nt, Human herpesvirus 4 [Epstein-Barr virus]
cacuccuaugcauuuccugccc

SEQ ID NO: 3969340 - RNA, 16 nt, Human herpesvirus 4 [Epstein-Barr virus]
cacucugaccaggaca

SEQ ID NO: 3969341 - RNA, 22 nt, Human herpesvirus 4 [Epstein-Barr virus]
cacugccaagguugaagagcag

SEQ ID NO: 3969342 - RNA, 24 nt, Human herpesvirus 4 [Epstein-Barr virus]
cacugccaagguugaagagcagau

SEQ ID NO: 3969343 - RNA, 16 nt, Human herpesvirus 4 [Epstein-Barr virus]
cacugucacugugcac

SEQ ID NO: 3969344 - RNA, 18 nt, Human herpesvirus 4 [Epstein-Barr virus]
cacuuccacagcaauggc

SEQ ID NO: 3969345 - RNA, 20 nt, Human herpesvirus 4 [Epstein-Barr virus]
cacuuccacagcaauggcac

SEQ ID NO: 3969346 - RNA, 16 nt, Human herpesvirus 4 [Epstein-Barr virus]
cacuuuguacagacuu

SEQ ID NO: 3969347 - RNA, 14 nt, Human herpesvirus 4 [Epstein-Barr virus]
cagaaaagugagcc

SEQ ID NO: 3969348 - RNA, 21 nt, Human herpesvirus 4 [Epstein-Barr virus]
cagaaaaucgcagcagggucc

SEQ ID NO: 3969349 - RNA, 12 nt, Human herpesvirus 4 [Epstein-Barr virus]
cagaacaucacu

SEQ ID NO: 3969350 - RNA, 20 nt, Human herpesvirus 4 [Epstein-Barr virus]
cagaagcuacaaacacgggc

SEQ ID NO: 3969351 - RNA, 17 nt, Human herpesvirus 4 [Epstein-Barr virus]
cagaaugaccgugcaug

SEQ ID NO: 3969352 - RNA, 15 nt, Human herpesvirus 4 [Epstein-Barr virus]
cagaauugucacuga

SEQ ID NO: 3969353 - RNA, 23 nt, Human herpesvirus 4 [Epstein-Barr virus]
cagacaugguguagacagauccc

SEQ ID NO: 3969354 - RNA, 16 nt, Human herpesvirus 4 [Epstein-Barr virus]
cagaccccagagcagc

SEQ ID NO: 3969355 - RNA, 21 nt, Human herpesvirus 4 [Epstein-Barr virus]
cagaccucugcacaacacaac

SEQ ID NO: 3969356 - RNA, 15 nt, Human herpesvirus 4 [Epstein-Barr virus]
cagaccugugugcug

SEQ ID NO: 3969357 - RNA, 22 nt, Human herpesvirus 4 [Epstein-Barr virus]
cagacggcgcuugcgucugccc

SEQ ID NO: 3969358 - RNA, 20 nt, Human herpesvirus 4 [Epstein-Barr virus]
cagacuccgaauauccccaa

SEQ ID NO: 3969359 - RNA, 15 nt, Human herpesvirus 4 [Epstein-Barr virus]
cagacucugcuuucu

SEQ ID NO: 3969360 - RNA, 22 nt, Human herpesvirus 4 [Epstein-Barr virus]
cagacuuagggccggggccgag

SEQ ID NO: 3969361 - RNA, 12 nt, Human herpesvirus 4 [Epstein-Barr virus]
cagagcaaaagc

SEQ ID NO: 3969362 - RNA, 13 nt, Human herpesvirus 4 [Epstein-Barr virus]
cagagccucugcc

SEQ ID NO: 3969363 - RNA, 15 nt, Human herpesvirus 4 [Epstein-Barr virus]
cagagcggcauccuc

SEQ ID NO: 3969364 - RNA, 12 nt, Human herpesvirus 4 [Epstein-Barr virus]
cagagcugagug

SEQ ID NO: 3969365 - RNA, 17 nt, Human herpesvirus 4 [Epstein-Barr virus]
cagagcugagugcccag

SEQ ID NO: 3969366 - RNA, 13 nt, Human herpesvirus 4 [Epstein-Barr virus]
cagaggaaggcca

SEQ ID NO: 3969367 - RNA, 22 nt, Human herpesvirus 4 [Epstein-Barr virus]
cagaggacuaauguucucuaac

SEQ ID NO: 3969368 - RNA, 18 nt, Human herpesvirus 4 [Epstein-Barr virus]
cagaggacuguucucugc

SEQ ID NO: 3969369 - RNA, 19 nt, Human herpesvirus 4 [Epstein-Barr virus]
cagaggccaucauggccga

SEQ ID NO: 3969370 - RNA, 14 nt, Human herpesvirus 4 [Epstein-Barr virus]
cagagggugagccc

SEQ ID NO: 3969371 - RNA, 17 nt, Human herpesvirus 4 [Epstein-Barr virus]
cagagucuacucgacca

SEQ ID NO: 3969372 - RNA, 18 nt, Human herpesvirus 4 [Epstein-Barr virus]
cagaguucccggcugcuc

SEQ ID NO: 3969373 - RNA, 15 nt, Human herpesvirus 4 [Epstein-Barr virus]
cagauguccaggggu

SEQ ID NO: 3969374 - RNA, 23 nt, Human herpesvirus 4 [Epstein-Barr virus]
cagauuuccgucagccaggguga

SEQ ID NO: 3969375 - RNA, 12 nt, Human herpesvirus 4 [Epstein-Barr virus]
cagccaccuccc

SEQ ID NO: 3969376 - RNA, 15 nt, Human herpesvirus 4 [Epstein-Barr virus]
cagccacggcgaccu

SEQ ID NO: 3969377 - RNA, 16 nt, Human herpesvirus 4 [Epstein-Barr virus]
cagcccccuccuccag

SEQ ID NO: 3969378 - RNA, 14 nt, Human herpesvirus 4 [Epstein-Barr virus]
cagcccgcaccccc

SEQ ID NO: 3969379 - RNA, 14 nt, Human herpesvirus 4 [Epstein-Barr virus]
cagcccuuaacaca

SEQ ID NO: 3969380 - RNA, 16 nt, Human herpesvirus 4 [Epstein-Barr virus]
cagccgggucgugaaa

SEQ ID NO: 3969381 - RNA, 21 nt, Human herpesvirus 4 [Epstein-Barr virus]
cagccuacucuccacucccag

SEQ ID NO: 3969382 - RNA, 22 nt, Human herpesvirus 4 [Epstein-Barr virus]
cagccugcaccaguggcugccc

SEQ ID NO: 3969383 - RNA, 21 nt, Human herpesvirus 4 [Epstein-Barr virus]
cagccuugcguggugcugucc

SEQ ID NO: 3969384 - RNA, 23 nt, Human herpesvirus 4 [Epstein-Barr virus]
cagcgaccggcagaucccgcauu

SEQ ID NO: 3969385 - RNA, 21 nt, Human herpesvirus 4 [Epstein-Barr virus]
cagcgcucuggucgcccccuc

SEQ ID NO: 3969386 - RNA, 15 nt, Human herpesvirus 4 [Epstein-Barr virus]
cagcgcuggcuccag

SEQ ID NO: 3969387 - RNA, 16 nt, Human herpesvirus 4 [Epstein-Barr virus]
cagcgucaggagaggg

SEQ ID NO: 3969388 - RNA, 22 nt, Human herpesvirus 4 [Epstein-Barr virus]
ccuuuggcuccuccuguuucug

SEQ ID NO: 3969389 - RNA, 21 nt, Human herpesvirus 4 [Epstein-Barr virus]
cgaaagcacuuugaaagaugu

SEQ ID NO: 3969390 - RNA, 19 nt, Human herpesvirus 4 [Epstein-Barr virus]
cgaacgaugaggaacguga

SEQ ID NO: 3969391 - RNA, 17 nt, Human herpesvirus 4 [Epstein-Barr virus]
cgaacuccuccagcagu

SEQ ID NO: 3969392 - RNA, 15 nt, Human herpesvirus 4 [Epstein-Barr virus]
cgaagcgagacagua

SEQ ID NO: 3969393 - RNA, 17 nt, Human herpesvirus 4 [Epstein-Barr virus]
cgaaggcguggguguca

SEQ ID NO: 3969394 - RNA, 17 nt, Human herpesvirus 4 [Epstein-Barr virus]
cgacaauaaaguugaug

SEQ ID NO: 3969395 - RNA, 20 nt, Human herpesvirus 4 [Epstein-Barr virus]
cgacgaggcccugcaagcca

SEQ ID NO: 3969396 - RNA, 20 nt, Human herpesvirus 4 [Epstein-Barr virus]
cgacgcuguuuugcagcuga

SEQ ID NO: 3969397 - RNA, 14 nt, Human herpesvirus 4 [Epstein-Barr virus]
cgagaauuggcaga

SEQ ID NO: 3969398 - RNA, 16 nt, Human herpesvirus 4 [Epstein-Barr virus]
cgagaccggcuccgga

SEQ ID NO: 3969399 - RNA, 13 nt, Human herpesvirus 4 [Epstein-Barr virus]
cgagcaugagcuc

SEQ ID NO: 3969400 - RNA, 21 nt, Human herpesvirus 4 [Epstein-Barr virus]
cgagccugucgauaucccugc

SEQ ID NO: 3969401 - RNA, 21 nt, Human herpesvirus 4 [Epstein-Barr virus]
cgaggaggaagagacuucaca

SEQ ID NO: 3969402 - RNA, 21 nt, Human herpesvirus 4 [Epstein-Barr virus]
cgaggcagacaaggccccgcc

SEQ ID NO: 3969403 - RNA, 15 nt, Human herpesvirus 4 [Epstein-Barr virus]
cgagggcagacacca

SEQ ID NO: 3969404 - RNA, 22 nt, Human herpesvirus 4 [Epstein-Barr virus]
cgaguaggugccuccagagccc

SEQ ID NO: 3969405 - RNA, 19 nt, Human herpesvirus 4 [Epstein-Barr virus]
cgauuggaaaagggcccag

SEQ ID NO: 3969406 - RNA, 22 nt, Human herpesvirus 4 [Epstein-Barr virus]
cgcagcugugugcgcgccgcca

SEQ ID NO: 3969407 - RNA, 17 nt, Human herpesvirus 4 [Epstein-Barr virus]
cgcaguccgccaugacc

SEQ ID NO: 3969408 - RNA, 15 nt, Human herpesvirus 4 [Epstein-Barr virus]
cgccaaugccaacuc

SEQ ID NO: 3969409 - RNA, 13 nt, Human herpesvirus 4 [Epstein-Barr virus]
cgccaccuccggg

SEQ ID NO: 3969410 - RNA, 14 nt, Human herpesvirus 4 [Epstein-Barr virus]
cgccagcagggcac

SEQ ID NO: 3969411 - RNA, 14 nt, Human herpesvirus 4 [Epstein-Barr virus]
cgcccccaccaccc

SEQ ID NO: 3969412 - RNA, 13 nt, Human herpesvirus 4 [Epstein-Barr virus]
cgccccgggcccg

SEQ ID NO: 3969413 - RNA, 21 nt, Human herpesvirus 4 [Epstein-Barr virus]
cgcccgccuggcucgccugga

SEQ ID NO: 3969414 - RNA, 17 nt, Human herpesvirus 4 [Epstein-Barr virus]
cgcccugagcuggacga

SEQ ID NO: 3969415 - RNA, 19 nt, Human herpesvirus 4 [Epstein-Barr virus]
cgcccugucaccaggccug

SEQ ID NO: 3969416 - RNA, 19 nt, Human herpesvirus 4 [Epstein-Barr virus]
cgcccugucccuggagcug

SEQ ID NO: 3969417 - RNA, 17 nt, Human herpesvirus 4 [Epstein-Barr virus]
cgccgcagaagagccgc

SEQ ID NO: 3969418 - RNA, 16 nt, Human herpesvirus 4 [Epstein-Barr virus]
cgccugacccucuugc

SEQ ID NO: 3969419 - RNA, 19 nt, Human herpesvirus 4 [Epstein-Barr virus]
cgccugcggacucaggcca

SEQ ID NO: 3969420 - RNA, 21 nt, Human herpesvirus 4 [Epstein-Barr virus]
cgcgacauguuucuggugagc

SEQ ID NO: 3969421 - RNA, 16 nt, Human herpesvirus 4 [Epstein-Barr virus]
cgcggaaucaggacca

SEQ ID NO: 3969422 - RNA, 13 nt, Human herpesvirus 4 [Epstein-Barr virus]
cgcggcuggaugc

SEQ ID NO: 3969423 - RNA, 13 nt, Human herpesvirus 4 [Epstein-Barr virus]
cgcuacugcugcu

SEQ ID NO: 3969424 - RNA, 22 nt, Human herpesvirus 4 [Epstein-Barr virus]
cgcucagcucaaccgccagggc

SEQ ID NO: 3969425 - RNA, 16 nt, Human herpesvirus 4 [Epstein-Barr virus]
cgcugcugcuacuggc

SEQ ID NO: 3969426 - RNA, 15 nt, Human herpesvirus 4 [Epstein-Barr virus]
cgcuguaacgugucg

SEQ ID NO: 3969427 - RNA, 16 nt, Human herpesvirus 4 [Epstein-Barr virus]
cggaaaccacaacagc

SEQ ID NO: 3969428 - RNA, 20 nt, Human herpesvirus 4 [Epstein-Barr virus]
cggacccugguacaggacca

SEQ ID NO: 3969429 - RNA, 16 nt, Human herpesvirus 4 [Epstein-Barr virus]
cggagaggcgggaccc

SEQ ID NO: 3969430 - RNA, 14 nt, Human herpesvirus 4 [Epstein-Barr virus]
cggcaccgccaggu

SEQ ID NO: 3969431 - RNA, 15 nt, Human herpesvirus 4 [Epstein-Barr virus]
cggcaccuagcccac

SEQ ID NO: 3969432 - RNA, 21 nt, Human herpesvirus 4 [Epstein-Barr virus]
cggcaucaccguggagccggg

SEQ ID NO: 3969433 - RNA, 11 nt, Human herpesvirus 4 [Epstein-Barr virus]
cggcccagccc

SEQ ID NO: 3969434 - RNA, 20 nt, Human herpesvirus 4 [Epstein-Barr virus]
cggccucgccuucuccucag

SEQ ID NO: 3969435 - RNA, 22 nt, Human herpesvirus 4 [Epstein-Barr virus]
cggcgccgcccgggggccaguc

SEQ ID NO: 3969436 - RNA, 12 nt, Human herpesvirus 4 [Epstein-Barr virus]
cggcguggagcu

SEQ ID NO: 3969437 - RNA, 15 nt, Human herpesvirus 4 [Epstein-Barr virus]
cggcguggagcuggg

SEQ ID NO: 3969438 - RNA, 19 nt, Human herpesvirus 4 [Epstein-Barr virus]
cggcucaggaucagggcca

SEQ ID NO: 3969439 - RNA, 20 nt, Human herpesvirus 4 [Epstein-Barr virus]
cggcucaggaucagggccaa

SEQ ID NO: 3969440 - RNA, 16 nt, Human herpesvirus 4 [Epstein-Barr virus]
cggcucucaggccuca

SEQ ID NO: 3969441 - RNA, 12 nt, Human herpesvirus 4 [Epstein-Barr virus]
cggcugcucccg

SEQ ID NO: 3969442 - RNA, 23 nt, Human herpesvirus 4 [Epstein-Barr virus]
cggcuguggccucuacgccaggc

SEQ ID NO: 3969443 - RNA, 18 nt, Human herpesvirus 4 [Epstein-Barr virus]
cgggagggacgggccucu

SEQ ID NO: 3969444 - RNA, 22 nt, Human herpesvirus 4 [Epstein-Barr virus]
cgggagggcgcucugcgccagc

SEQ ID NO: 3969445 - RNA, 21 nt, Human herpesvirus 4 [Epstein-Barr virus]
cgggaguauggggccagaggc

SEQ ID NO: 3969446 - RNA, 19 nt, Human herpesvirus 4 [Epstein-Barr virus]
cgggcaaacagggcagaga

SEQ ID NO: 3969447 - RNA, 15 nt, Human herpesvirus 4 [Epstein-Barr virus]
cgggcaagauggaga

SEQ ID NO: 3969448 - RNA, 18 nt, Human herpesvirus 4 [Epstein-Barr virus]
cgggcgccugcuccaccg

SEQ ID NO: 3969449 - RNA, 14 nt, Human herpesvirus 4 [Epstein-Barr virus]
cgggcuugugcuug

SEQ ID NO: 3969450 - RNA, 13 nt, Human herpesvirus 4 [Epstein-Barr virus]
cggggaagaggac

SEQ ID NO: 3969451 - RNA, 14 nt, Human herpesvirus 4 [Epstein-Barr virus]
cggggaggccaggu

SEQ ID NO: 3969452 - RNA, 14 nt, Human herpesvirus 4 [Epstein-Barr virus]
cggggcaugcugcc

SEQ ID NO: 3969453 - RNA, 13 nt, Human herpesvirus 4 [Epstein-Barr virus]
cggggggcuggcg

SEQ ID NO: 3969454 - RNA, 16 nt, Human herpesvirus 4 [Epstein-Barr virus]
cgggggugggcgguga

SEQ ID NO: 3969455 - RNA, 21 nt, Human herpesvirus 4 [Epstein-Barr virus]
cggggugccuuagagucccug

SEQ ID NO: 3969456 - RNA, 22 nt, Human herpesvirus 4 [Epstein-Barr virus]
cgggucaggucgcggaccaggg

SEQ ID NO: 3969457 - RNA, 23 nt, Human herpesvirus 4 [Epstein-Barr virus]
cgguagccuugggggccuggacu

SEQ ID NO: 3969458 - RNA, 14 nt, Human herpesvirus 4 [Epstein-Barr virus]
cggucaaguaccag

SEQ ID NO: 3969459 - RNA, 19 nt, Human herpesvirus 4 [Epstein-Barr virus]
cggugccgcuccuuugcgg

SEQ ID NO: 3969460 - RNA, 19 nt, Human herpesvirus 4 [Epstein-Barr virus]
cgguggguggaacgcucca

SEQ ID NO: 3969461 - RNA, 19 nt, Human herpesvirus 4 [Epstein-Barr virus]
cguacccauaacugggcau

SEQ ID NO: 3969462 - RNA, 23 nt, Human herpesvirus 4 [Epstein-Barr virus]
cgucacucggacuaucaaccacu

SEQ ID NO: 3969463 - RNA, 15 nt, Human herpesvirus 4 [Epstein-Barr virus]
cgucaucuggcucuc

SEQ ID NO: 3969464 - RNA, 17 nt, Human herpesvirus 4 [Epstein-Barr virus]
cgucaucuggcucuccu

SEQ ID NO: 3969465 - RNA, 20 nt, Human herpesvirus 4 [Epstein-Barr virus]
cgucauggcauccgccgcga

SEQ ID NO: 3969466 - RNA, 11 nt, Human herpesvirus 4 [Epstein-Barr virus]
cguccuggccc

SEQ ID NO: 3969467 - RNA, 19 nt, Human herpesvirus 4 [Epstein-Barr virus]
cgucuuguaaaacuuggag

SEQ ID NO: 3969468 - RNA, 14 nt, Human herpesvirus 4 [Epstein-Barr virus]
cgugaacucugccc

SEQ ID NO: 3969469 - RNA, 16 nt, Human herpesvirus 4 [Epstein-Barr virus]
cgugccagaggcccuc

SEQ ID NO: 3969470 - RNA, 23 nt, Human herpesvirus 4 [Epstein-Barr virus]
cgugccucagauagccggaccuc

SEQ ID NO: 3969471 - RNA, 22 nt, Human herpesvirus 4 [Epstein-Barr virus]
cguggacaguuugauacucacc

SEQ ID NO: 3969472 - RNA, 23 nt, Human herpesvirus 4 [Epstein-Barr virus]
cguggaguccaugaccagggggc

SEQ ID NO: 3969473 - RNA, 15 nt, Human herpesvirus 4 [Epstein-Barr virus]
cguggucgugcugcu

SEQ ID NO: 3969474 - RNA, 19 nt, Human herpesvirus 4 [Epstein-Barr virus]
cguggugcuguccugcuga

SEQ ID NO: 3969475 - RNA, 15 nt, Human herpesvirus 4 [Epstein-Barr virus]
ugcauggccugggcc

SEQ ID NO: 3969476 - RNA, 16 nt, Human herpesvirus 4 [Epstein-Barr virus]
ugcauggccugggccc

SEQ ID NO: 3969477 - RNA, 19 nt, Human herpesvirus 4 [Epstein-Barr virus]
ugcauuuccugcccuccca

SEQ ID NO: 3969478 - RNA, 15 nt, Human herpesvirus 4 [Epstein-Barr virus]
ugccaagagcugccu

SEQ ID NO: 3969479 - RNA, 21 nt, Human herpesvirus 4 [Epstein-Barr virus]
ugccauggccauucgacaggc

SEQ ID NO: 3969480 - RNA, 18 nt, Human herpesvirus 4 [Epstein-Barr virus]
ugccauguguguccagug

SEQ ID NO: 3969481 - RNA, 13 nt, Human herpesvirus 4 [Epstein-Barr virus]
ugcccgagccccg

SEQ ID NO: 3969482 - RNA, 15 nt, Human herpesvirus 4 [Epstein-Barr virus]
ugcccgccgugaacu

SEQ ID NO: 3969483 - RNA, 21 nt, Human herpesvirus 4 [Epstein-Barr virus]
ugcccgcuuccuccgcagucc

SEQ ID NO: 3969484 - RNA, 20 nt, Human herpesvirus 4 [Epstein-Barr virus]
ugcccuagagguuuugcuag

SEQ ID NO: 3969485 - RNA, 15 nt, Human herpesvirus 4 [Epstein-Barr virus]
ugcccucuccagcaa

SEQ ID NO: 3969486 - RNA, 19 nt, Human herpesvirus 4 [Epstein-Barr virus]
ugccgcguguuugcugcuc

SEQ ID NO: 3969487 - RNA, 19 nt, Human herpesvirus 4 [Epstein-Barr virus]
ugccgucuucggucaagua

SEQ ID NO: 3969488 - RNA, 18 nt, Human herpesvirus 4 [Epstein-Barr virus]
ugccuaauggccguccuc

SEQ ID NO: 3969489 - RNA, 21 nt, Human herpesvirus 4 [Epstein-Barr virus]
ugccuacgggcgcaccugugu

SEQ ID NO: 3969490 - RNA, 19 nt, Human herpesvirus 4 [Epstein-Barr virus]
ugccuccggccgccccggg

SEQ ID NO: 3969491 - RNA, 22 nt, Human herpesvirus 4 [Epstein-Barr virus]
ugccucuacgccccagaugaaa

SEQ ID NO: 3969492 - RNA, 15 nt, Human herpesvirus 4 [Epstein-Barr virus]
ugccucugggugcug

SEQ ID NO: 3969493 - RNA, 19 nt, Human herpesvirus 4 [Epstein-Barr virus]
ugccugaagcuugcugggg

SEQ ID NO: 3969494 - RNA, 16 nt, Human herpesvirus 4 [Epstein-Barr virus]
ugccuguggccccggc

SEQ ID NO: 3969495 - RNA, 15 nt, Human herpesvirus 4 [Epstein-Barr virus]
ugccuuuuugccaca

SEQ ID NO: 3969496 - RNA, 20 nt, Human herpesvirus 4 [Epstein-Barr virus]
ugcgccagagcggcauccuc

SEQ ID NO: 3969497 - RNA, 18 nt, Human herpesvirus 4 [Epstein-Barr virus]
ugcgcggaaucaggacca

SEQ ID NO: 3969498 - RNA, 14 nt, Human herpesvirus 4 [Epstein-Barr virus]
ugcggagggucaga

SEQ ID NO: 3969499 - RNA, 13 nt, Human herpesvirus 4 [Epstein-Barr virus]
ugcguggcuggac

SEQ ID NO: 3969500 - RNA, 16 nt, Human herpesvirus 4 [Epstein-Barr virus]
ugcguugaacccaccc

SEQ ID NO: 3969501 - RNA, 21 nt, Human herpesvirus 4 [Epstein-Barr virus]
ugcucaaggcagucuccaccu

SEQ ID NO: 3969502 - RNA, 16 nt, Human herpesvirus 4 [Epstein-Barr virus]
ugcucucguugccaaa

SEQ ID NO: 3969503 - RNA, 14 nt, Human herpesvirus 4 [Epstein-Barr virus]
ugcucucucuggag

SEQ ID NO: 3969504 - RNA, 14 nt, Human herpesvirus 4 [Epstein-Barr virus]
ugcugaugugcugc

SEQ ID NO: 3969505 - RNA, 17 nt, Human herpesvirus 4 [Epstein-Barr virus]
ugcugccagagccucug

SEQ ID NO: 3969506 - RNA, 20 nt, Human herpesvirus 4 [Epstein-Barr virus]
ugcugccagagccucugcca

SEQ ID NO: 3969507 - RNA, 13 nt, Human herpesvirus 4 [Epstein-Barr virus]
ugcugccuggggg

SEQ ID NO: 3969508 - RNA, 16 nt, Human herpesvirus 4 [Epstein-Barr virus]
ugcugcugcuggucau

SEQ ID NO: 3969509 - RNA, 20 nt, Human herpesvirus 4 [Epstein-Barr virus]
ugcuggacuccgaggaccag

SEQ ID NO: 3969510 - RNA, 22 nt, Human herpesvirus 4 [Epstein-Barr virus]
ugcuggagauuuucccacugug

SEQ ID NO: 3969511 - RNA, 18 nt, Human herpesvirus 4 [Epstein-Barr virus]
ugcugggucgccugaccc

SEQ ID NO: 3969512 - RNA, 13 nt, Human herpesvirus 4 [Epstein-Barr virus]
ugcuugccccggg

SEQ ID NO: 3969513 - RNA, 22 nt, Human herpesvirus 4 [Epstein-Barr virus]
uggacacuugugguucuccuga

SEQ ID NO: 3969514 - RNA, 20 nt, Human herpesvirus 4 [Epstein-Barr virus]
uggacauucuucugaaggaa

SEQ ID NO: 3969515 - RNA, 21 nt, Human herpesvirus 4 [Epstein-Barr virus]
uggacccuauggagggcagcg

SEQ ID NO: 3969516 - RNA, 19 nt, Human herpesvirus 4 [Epstein-Barr virus]
uggacuggggugugaaggg

SEQ ID NO: 3969517 - RNA, 18 nt, Human herpesvirus 4 [Epstein-Barr virus]
uggagagaggcaaauguc

SEQ ID NO: 3969518 - RNA, 19 nt, Human herpesvirus 4 [Epstein-Barr virus]
uggagagauuucauccuca

SEQ ID NO: 3969519 - RNA, 23 nt, Human herpesvirus 4 [Epstein-Barr virus]
uggagagauuucauccucagagg

SEQ ID NO: 3969520 - RNA, 12 nt, Human herpesvirus 4 [Epstein-Barr virus]
uggagaggccac

SEQ ID NO: 3969521 - RNA, 23 nt, Human herpesvirus 4 [Epstein-Barr virus]
uggagauuuucccacugugccua

SEQ ID NO: 3969522 - RNA, 23 nt, Human herpesvirus 4 [Epstein-Barr virus]
uggaggagaugaccuccuacacg

SEQ ID NO: 3969523 - RNA, 19 nt, Human herpesvirus 4 [Epstein-Barr virus]
uggaggcccccggcuggcc

SEQ ID NO: 3969524 - RNA, 21 nt, Human herpesvirus 4 [Epstein-Barr virus]
uggaggcugcgccugagcugc

SEQ ID NO: 3969525 - RNA, 23 nt, Human herpesvirus 4 [Epstein-Barr virus]
uggauugcugaacuggggcuggu

SEQ ID NO: 3969526 - RNA, 14 nt, Human herpesvirus 4 [Epstein-Barr virus]
uggcacgacuguuc

SEQ ID NO: 3969527 - RNA, 13 nt, Human herpesvirus 4 [Epstein-Barr virus]
uggcagcagcucu

SEQ ID NO: 3969528 - RNA, 14 nt, Human herpesvirus 4 [Epstein-Barr virus]
uggcagcagcucug

SEQ ID NO: 3969529 - RNA, 12 nt, Human herpesvirus 4 [Epstein-Barr virus]
uggcagcagugg

SEQ ID NO: 3969530 - RNA, 19 nt, Human herpesvirus 4 [Epstein-Barr virus]
uggcagcccccuccuccag

SEQ ID NO: 3969531 - RNA, 20 nt, Human herpesvirus 4 [Epstein-Barr virus]
uggcagggggccgggcgcgc

SEQ ID NO: 3969532 - RNA, 15 nt, Human herpesvirus 4 [Epstein-Barr virus]
uggccaggcugguga

SEQ ID NO: 3969533 - RNA, 14 nt, Human herpesvirus 4 [Epstein-Barr virus]
uggccggggccgug

SEQ ID NO: 3969534 - RNA, 19 nt, Human herpesvirus 4 [Epstein-Barr virus]
uggccgguggauccuccac

SEQ ID NO: 3969535 - RNA, 20 nt, Human herpesvirus 4 [Epstein-Barr virus]
uggccuuccucugccuggcc

SEQ ID NO: 3969536 - RNA, 13 nt, Human herpesvirus 4 [Epstein-Barr virus]
uggcggccuggca

SEQ ID NO: 3969537 - RNA, 17 nt, Human herpesvirus 4 [Epstein-Barr virus]
uggcggggccuugucug

SEQ ID NO: 3969538 - RNA, 15 nt, Human herpesvirus 4 [Epstein-Barr virus]
uggcuacuugcucag

SEQ ID NO: 3969539 - RNA, 19 nt, Human herpesvirus 4 [Epstein-Barr virus]
uggcuucuuagaugaggag

SEQ ID NO: 3969540 - RNA, 18 nt, Human herpesvirus 4 [Epstein-Barr virus]
ugggaggcccaggaccuu

SEQ ID NO: 3969541 - RNA, 21 nt, Human herpesvirus 4 [Epstein-Barr virus]
ugggcaauauaaauuacuggc

SEQ ID NO: 3969542 - RNA, 21 nt, Human herpesvirus 4 [Epstein-Barr virus]
ugggcgcgggucccccuagcc

SEQ ID NO: 3969543 - RNA, 16 nt, Human herpesvirus 4 [Epstein-Barr virus]
ugggcgcgugcacaua

SEQ ID NO: 3969544 - RNA, 10 nt, Human herpesvirus 4 [Epstein-Barr virus]
uggggagcua

SEQ ID NO: 3969545 - RNA, 20 nt, Human herpesvirus 4 [Epstein-Barr virus]
uggggauuacccgacccagc

SEQ ID NO: 3969546 - RNA, 20 nt, Human herpesvirus 4 [Epstein-Barr virus]
uggggccugugacuggugcu

SEQ ID NO: 3969547 - RNA, 14 nt, Human herpesvirus 4 [Epstein-Barr virus]
uggggcugagacca

SEQ ID NO: 3969548 - RNA, 12 nt, Human herpesvirus 4 [Epstein-Barr virus]
uggggggggugg

SEQ ID NO: 3969549 - RNA, 21 nt, Human herpesvirus 4 [Epstein-Barr virus]
ugggguccaggagucugcugc

SEQ ID NO: 3969550 - RNA, 16 nt, Human herpesvirus 4 [Epstein-Barr virus]
uggguccccucugccg

SEQ ID NO: 3969551 - RNA, 22 nt, Human herpesvirus 4 [Epstein-Barr virus]
ugguaguaggcacaucuggacc

SEQ ID NO: 3969552 - RNA, 20 nt, Human herpesvirus 4 [Epstein-Barr virus]
uggucauggccagcuuugag

SEQ ID NO: 3969553 - RNA, 24 nt, Human herpesvirus 4 [Epstein-Barr virus]
uggucgggagaacgaaggcguggg

SEQ ID NO: 3969554 - RNA, 17 nt, Human herpesvirus 4 [Epstein-Barr virus]
uggugcuguccugcuga

SEQ ID NO: 3969555 - RNA, 14 nt, Human herpesvirus 4 [Epstein-Barr virus]
ugguggucagcagc

SEQ ID NO: 3969556 - RNA, 13 nt, Human herpesvirus 4 [Epstein-Barr virus]
ugguuucagccuc

SEQ ID NO: 3969557 - RNA, 19 nt, Human herpesvirus 4 [Epstein-Barr virus]
uguaacugugguuuccaug

SEQ ID NO: 3969558 - RNA, 22 nt, Human herpesvirus 4 [Epstein-Barr virus]
uguagccacccgucccggguac

SEQ ID NO: 3969559 - RNA, 19 nt, Human herpesvirus 4 [Epstein-Barr virus]
ugucaaggcucugcacagg

SEQ ID NO: 3969560 - RNA, 18 nt, Human herpesvirus 4 [Epstein-Barr virus]
ugucaauaauuucaguga

SEQ ID NO: 3969561 - RNA, 13 nt, Human herpesvirus 4 [Epstein-Barr virus]
ugucagaccugaa

SEQ ID NO: 3969562 - RNA, 13 nt, Human herpesvirus 4 [Epstein-Barr virus]
aaggaggggcggc

SEQ ID NO: 3969563 - RNA, 22 nt, Human herpesvirus 4 [Epstein-Barr virus]
aaggagugccucugggugcuga

SEQ ID NO: 3969564 - RNA, 18 nt, Human herpesvirus 4 [Epstein-Barr virus]
aaggauggcacgggcaga

SEQ ID NO: 3969565 - RNA, 20 nt, Human herpesvirus 4 [Epstein-Barr virus]
aaggcuccggcggcagugga

SEQ ID NO: 3969566 - RNA, 13 nt, Human herpesvirus 4 [Epstein-Barr virus]
aagguccaucccg

SEQ ID NO: 3969567 - RNA, 18 nt, Human herpesvirus 4 [Epstein-Barr virus]
aagguggaggggggcggc

SEQ ID NO: 3969568 - RNA, 18 nt, Human herpesvirus 4 [Epstein-Barr virus]
aaguaccagcuggugguc

SEQ ID NO: 3969569 - RNA, 12 nt, Human herpesvirus 4 [Epstein-Barr virus]
aauaaaaacagc

SEQ ID NO: 3969570 - RNA, 16 nt, Human herpesvirus 4 [Epstein-Barr virus]
aauacaagaguucucu

SEQ ID NO: 3969571 - RNA, 16 nt, Human herpesvirus 4 [Epstein-Barr virus]
aaucccucugggagaa

SEQ ID NO: 3969572 - RNA, 15 nt, Human herpesvirus 4 [Epstein-Barr virus]
aaugcgauucugaac

SEQ ID NO: 3969573 - RNA, 18 nt, Human herpesvirus 4 [Epstein-Barr virus]
aauggccguccucuggac

SEQ ID NO: 3969574 - RNA, 13 nt, Human herpesvirus 4 [Epstein-Barr virus]
aauguaucccaaa

SEQ ID NO: 3969575 - RNA, 13 nt, Human herpesvirus 4 [Epstein-Barr virus]
aaugucaccacua

SEQ ID NO: 3969576 - RNA, 21 nt, Human herpesvirus 4 [Epstein-Barr virus]
aauguuccuucucaugcuccu

SEQ ID NO: 3969577 - RNA, 11 nt, Human herpesvirus 4 [Epstein-Barr virus]
acaccauccca

SEQ ID NO: 3969578 - RNA, 17 nt, Human herpesvirus 4 [Epstein-Barr virus]
acacccccacuuuucca

SEQ ID NO: 3969579 - RNA, 18 nt, Human herpesvirus 4 [Epstein-Barr virus]
acacgcuggucuugaauu

SEQ ID NO: 3969580 - RNA, 19 nt, Human herpesvirus 4 [Epstein-Barr virus]
acacgcuuuugucugccug

SEQ ID NO: 3969581 - RNA, 20 nt, Human herpesvirus 4 [Epstein-Barr virus]
acacgggggugcccccacca

SEQ ID NO: 3969582 - RNA, 18 nt, Human herpesvirus 4 [Epstein-Barr virus]
acacgguuauggcagagc

SEQ ID NO: 3969583 - RNA, 17 nt, Human herpesvirus 4 [Epstein-Barr virus]
acacuccauuaauucca

SEQ ID NO: 3969584 - RNA, 20 nt, Human herpesvirus 4 [Epstein-Barr virus]
acagagccgugucuccugac

SEQ ID NO: 3969585 - RNA, 16 nt, Human herpesvirus 4 [Epstein-Barr virus]
acagcaaggacggucc

SEQ ID NO: 3969586 - RNA, 14 nt, Human herpesvirus 4 [Epstein-Barr virus]
acagcgccagcagg

SEQ ID NO: 3969587 - RNA, 18 nt, Human herpesvirus 4 [Epstein-Barr virus]
acagcgccagcagggcac

SEQ ID NO: 3969588 - RNA, 22 nt, Human herpesvirus 4 [Epstein-Barr virus]
acaggagacguggguccccucu

SEQ ID NO: 3969589 - RNA, 15 nt, Human herpesvirus 4 [Epstein-Barr virus]
acagguagcaaggac

SEQ ID NO: 3969590 - RNA, 13 nt, Human herpesvirus 4 [Epstein-Barr virus]
acauacaucccug

SEQ ID NO: 3969591 - RNA, 13 nt, Human herpesvirus 4 [Epstein-Barr virus]
acaucucagggac

SEQ ID NO: 3969592 - RNA, 18 nt, Human herpesvirus 4 [Epstein-Barr virus]
acaucuggaccuggacug

SEQ ID NO: 3969593 - RNA, 19 nt, Human herpesvirus 4 [Epstein-Barr virus]
acaucuggcuggggcauua

SEQ ID NO: 3969594 - RNA, 15 nt, Human herpesvirus 4 [Epstein-Barr virus]
acauugguguuccac

SEQ ID NO: 3969595 - RNA, 22 nt, Human herpesvirus 4 [Epstein-Barr virus]
accaagaccaauacccaggauc

SEQ ID NO: 3969596 - RNA, 12 nt, Human herpesvirus 4 [Epstein-Barr virus]
accacugaggga

SEQ ID NO: 3969597 - RNA, 13 nt, Human herpesvirus 4 [Epstein-Barr virus]
accagcugguggu

SEQ ID NO: 3969598 - RNA, 20 nt, Human herpesvirus 4 [Epstein-Barr virus]
accagcuucgagagccacga

SEQ ID NO: 3969599 - RNA, 20 nt, Human herpesvirus 4 [Epstein-Barr virus]
accagggggcagucugagaa

SEQ ID NO: 3969600 - RNA, 15 nt, Human herpesvirus 4 [Epstein-Barr virus]
accaugccaucucug

SEQ ID NO: 3969601 - RNA, 14 nt, Human herpesvirus 4 [Epstein-Barr virus]
acccagcagcagcc

SEQ ID NO: 3969602 - RNA, 13 nt, Human herpesvirus 4 [Epstein-Barr virus]
accccacggagca

SEQ ID NO: 3969603 - RNA, 17 nt, Human herpesvirus 4 [Epstein-Barr virus]
accccuccuaugcgccc

SEQ ID NO: 3969604 - RNA, 19 nt, Human herpesvirus 4 [Epstein-Barr virus]
acccgaggucaagucccgg

SEQ ID NO: 3969605 - RNA, 18 nt, Human herpesvirus 4 [Epstein-Barr virus]
acccggaccaaugccaaa

SEQ ID NO: 3969606 - RNA, 19 nt, Human herpesvirus 4 [Epstein-Barr virus]
acccuccccaugggauggc

SEQ ID NO: 3969607 - RNA, 11 nt, Human herpesvirus 4 [Epstein-Barr virus]
acccuggggca

SEQ ID NO: 3969608 - RNA, 18 nt, Human herpesvirus 4 [Epstein-Barr virus]
accgaauggggcagugga

SEQ ID NO: 3969609 - RNA, 14 nt, Human herpesvirus 4 [Epstein-Barr virus]
accgcgcccuccuc

SEQ ID NO: 3969610 - RNA, 15 nt, Human herpesvirus 4 [Epstein-Barr virus]
accguggccaggccc

SEQ ID NO: 3969611 - RNA, 14 nt, Human herpesvirus 4 [Epstein-Barr virus]
accuacaccacccc

SEQ ID NO: 3969612 - RNA, 15 nt, Human herpesvirus 4 [Epstein-Barr virus]
accucuguuccuucu

SEQ ID NO: 3969613 - RNA, 22 nt, Human herpesvirus 4 [Epstein-Barr virus]
accugcacgagaccccugggcu

SEQ ID NO: 3969614 - RNA, 19 nt, Human herpesvirus 4 [Epstein-Barr virus]
accugcuaaccagauguga

SEQ ID NO: 3969615 - RNA, 23 nt, Human herpesvirus 4 [Epstein-Barr virus]
accuggaaauggccuaggagaga

SEQ ID NO: 3969616 - RNA, 17 nt, Human herpesvirus 4 [Epstein-Barr virus]
accuguguccugggcaa

SEQ ID NO: 3969617 - RNA, 22 nt, Human herpesvirus 4 [Epstein-Barr virus]
accuuaacuggcacacacuccc

SEQ ID NO: 3969618 - RNA, 17 nt, Human herpesvirus 4 [Epstein-Barr virus]
accuuccagacuaugca

SEQ ID NO: 3969619 - RNA, 14 nt, Human herpesvirus 4 [Epstein-Barr virus]
accuuuugucuccc

SEQ ID NO: 3969620 - RNA, 17 nt, Human herpesvirus 4 [Epstein-Barr virus]
acgaggacgagaaggag

SEQ ID NO: 3969621 - RNA, 16 nt, Human herpesvirus 4 [Epstein-Barr virus]
acgaggacgaggaggc

SEQ ID NO: 3969622 - RNA, 23 nt, Human herpesvirus 4 [Epstein-Barr virus]
acgaggaggcggaagaccaggag

SEQ ID NO: 3969623 - RNA, 23 nt, Human herpesvirus 4 [Epstein-Barr virus]
acgaggggccagguacaggaccu

SEQ ID NO: 3969624 - RNA, 15 nt, Human herpesvirus 4 [Epstein-Barr virus]
acgcagaaugugcag

SEQ ID NO: 3969625 - RNA, 22 nt, Human herpesvirus 4 [Epstein-Barr virus]
acgcaggauguucacgugggcc

SEQ ID NO: 3969626 - RNA, 23 nt, Human herpesvirus 4 [Epstein-Barr virus]
acgcucccgggcaaacagggcag

SEQ ID NO: 3969627 - RNA, 13 nt, Human herpesvirus 4 [Epstein-Barr virus]
acgcuccuggguu

SEQ ID NO: 3969628 - RNA, 21 nt, Human herpesvirus 4 [Epstein-Barr virus]
acggccucaaaggccucggcg

SEQ ID NO: 3969629 - RNA, 22 nt, Human herpesvirus 4 [Epstein-Barr virus]
acggccucgugcaaccaggccc

SEQ ID NO: 3969630 - RNA, 11 nt, Human herpesvirus 4 [Epstein-Barr virus]
acggccuggca

SEQ ID NO: 3969631 - RNA, 18 nt, Human herpesvirus 4 [Epstein-Barr virus]
acggcgucaaacagguga

SEQ ID NO: 3969632 - RNA, 15 nt, Human herpesvirus 4 [Epstein-Barr virus]
acgggcuggugggcu

SEQ ID NO: 3969633 - RNA, 17 nt, Human herpesvirus 4 [Epstein-Barr virus]
acgggguggugccuggu

SEQ ID NO: 3969634 - RNA, 17 nt, Human herpesvirus 4 [Epstein-Barr virus]
acgguggaacaggagca

SEQ ID NO: 3969635 - RNA, 22 nt, Human herpesvirus 4 [Epstein-Barr virus]
acgugccucagauagccggacc

SEQ ID NO: 3969636 - RNA, 22 nt, Human herpesvirus 4 [Epstein-Barr virus]
acuaggaaacggcgagcagggu

SEQ ID NO: 3969637 - RNA, 12 nt, Human herpesvirus 4 [Epstein-Barr virus]
acucacaggaca

SEQ ID NO: 3969638 - RNA, 21 nt, Human herpesvirus 4 [Epstein-Barr virus]
acucaccaagauuguuccagg

SEQ ID NO: 3969639 - RNA, 18 nt, Human herpesvirus 4 [Epstein-Barr virus]
acucaggaagcuggccag

SEQ ID NO: 3969640 - RNA, 14 nt, Human herpesvirus 4 [Epstein-Barr virus]
acuccaccugccgg

SEQ ID NO: 3969641 - RNA, 18 nt, Human herpesvirus 4 [Epstein-Barr virus]
acucccauguaagccugc

SEQ ID NO: 3969642 - RNA, 14 nt, Human herpesvirus 4 [Epstein-Barr virus]
acuccccucuccau

SEQ ID NO: 3969643 - RNA, 17 nt, Human herpesvirus 4 [Epstein-Barr virus]
acuccuggcauacuuuu

SEQ ID NO: 3969644 - RNA, 22 nt, Human herpesvirus 4 [Epstein-Barr virus]
acucgaccagcacguggguuuc

SEQ ID NO: 3969645 - RNA, 18 nt, Human herpesvirus 4 [Epstein-Barr virus]
acucuuguugcuagccuc

SEQ ID NO: 3969646 - RNA, 19 nt, Human herpesvirus 4 [Epstein-Barr virus]
acugaauuuauacccagug

SEQ ID NO: 3969647 - RNA, 13 nt, Human herpesvirus 4 [Epstein-Barr virus]
acugaccacucag

SEQ ID NO: 3969648 - RNA, 14 nt, Human herpesvirus 4 [Epstein-Barr virus]
acugccagagcugu

SEQ ID NO: 3969649 - RNA, 15 nt, Human herpesvirus 4 [Epstein-Barr virus]
acugccgccgccucc

SEQ ID NO: 3969650 - RNA, 17 nt, Human herpesvirus 4 [Epstein-Barr virus]
cuugugaaccagaaaga

SEQ ID NO: 3969651 - RNA, 19 nt, Human herpesvirus 4 [Epstein-Barr virus]
cuugugaacuuuaacauug

SEQ ID NO: 3969652 - RNA, 16 nt, Human herpesvirus 4 [Epstein-Barr virus]
cuuguuggaauggggc

SEQ ID NO: 3969653 - RNA, 13 nt, Human herpesvirus 4 [Epstein-Barr virus]
cuuucuaccaggg

SEQ ID NO: 3969654 - RNA, 19 nt, Human herpesvirus 4 [Epstein-Barr virus]
cuuucuggccaaccugccu

SEQ ID NO: 3969655 - RNA, 18 nt, Human herpesvirus 4 [Epstein-Barr virus]
cuuugaugaggcugaaau

SEQ ID NO: 3969656 - RNA, 18 nt, Human herpesvirus 4 [Epstein-Barr virus]
cuuugccaaccugcucuc

SEQ ID NO: 3969657 - RNA, 22 nt, Human herpesvirus 4 [Epstein-Barr virus]
cuuugcugaagaugauggaccc

SEQ ID NO: 3969658 - RNA, 19 nt, Human herpesvirus 4 [Epstein-Barr virus]
cuuuuauuuauugcaucac

SEQ ID NO: 3969659 - RNA, 19 nt, Human herpesvirus 4 [Epstein-Barr virus]
cuuuugcaacgccuuuuuc

SEQ ID NO: 3969660 - RNA, 19 nt, Human herpesvirus 4 [Epstein-Barr virus]
gaaaaccggcgagacuugg

SEQ ID NO: 3969661 - RNA, 19 nt, Human herpesvirus 4 [Epstein-Barr virus]
gaaaauguacccaucccgg

SEQ ID NO: 3969662 - RNA, 21 nt, Human herpesvirus 4 [Epstein-Barr virus]
gaaacaggagauuggugugaa

SEQ ID NO: 3969663 - RNA, 15 nt, Human herpesvirus 4 [Epstein-Barr virus]
gaaacuggcuucugu

SEQ ID NO: 3969664 - RNA, 15 nt, Human herpesvirus 4 [Epstein-Barr virus]
gaaagcggcccagca

SEQ ID NO: 3969665 - RNA, 20 nt, Human herpesvirus 4 [Epstein-Barr virus]
gaaagucuauacggccacaa

SEQ ID NO: 3969666 - RNA, 20 nt, Human herpesvirus 4 [Epstein-Barr virus]
gaacacccccaccccaccga

SEQ ID NO: 3969667 - RNA, 16 nt, Human herpesvirus 4 [Epstein-Barr virus]
gaacaucuggcugggg

SEQ ID NO: 3969668 - RNA, 14 nt, Human herpesvirus 4 [Epstein-Barr virus]
gaacccuagccacc

SEQ ID NO: 3969669 - RNA, 13 nt, Human herpesvirus 4 [Epstein-Barr virus]
gaacugauggcaa

SEQ ID NO: 3969670 - RNA, 14 nt, Human herpesvirus 4 [Epstein-Barr virus]
gaagaagcccaccu

SEQ ID NO: 3969671 - RNA, 23 nt, Human herpesvirus 4 [Epstein-Barr virus]
gaagaagcccaccuaugugaccg

SEQ ID NO: 3969672 - RNA, 14 nt, Human herpesvirus 4 [Epstein-Barr virus]
gaagaucgugaggc

SEQ ID NO: 3969673 - RNA, 20 nt, Human herpesvirus 4 [Epstein-Barr virus]
gaagauugucacagcugcug

SEQ ID NO: 3969674 - RNA, 16 nt, Human herpesvirus 4 [Epstein-Barr virus]
gaagcagaugugccca

SEQ ID NO: 3969675 - RNA, 16 nt, Human herpesvirus 4 [Epstein-Barr virus]
gaagcaugggggaaac

SEQ ID NO: 3969676 - RNA, 19 nt, Human herpesvirus 4 [Epstein-Barr virus]
gaaggggccucggccuggg

SEQ ID NO: 3969677 - RNA, 12 nt, Human herpesvirus 4 [Epstein-Barr virus]
gaagugggaccu

SEQ ID NO: 3969678 - RNA, 22 nt, Human herpesvirus 4 [Epstein-Barr virus]
gaauacccugcauggccaggcc

SEQ ID NO: 3969679 - RNA, 16 nt, Human herpesvirus 4 [Epstein-Barr virus]
gaauauuaauaaauau

SEQ ID NO: 3969680 - RNA, 21 nt, Human herpesvirus 4 [Epstein-Barr virus]
gaaucaaaaucagaccacccg

SEQ ID NO: 3969681 - RNA, 21 nt, Human herpesvirus 4 [Epstein-Barr virus]
gaaucuaguaugaaggcuggc

SEQ ID NO: 3969682 - RNA, 22 nt, Human herpesvirus 4 [Epstein-Barr virus]
gaaucuccugugcuucagcagu

SEQ ID NO: 3969683 - RNA, 17 nt, Human herpesvirus 4 [Epstein-Barr virus]
gaaugcccaggcggcua

SEQ ID NO: 3969684 - RNA, 16 nt, Human herpesvirus 4 [Epstein-Barr virus]
gacaagacagucacau

SEQ ID NO: 3969685 - RNA, 16 nt, Human herpesvirus 4 [Epstein-Barr virus]
gacacaucuggaccag

SEQ ID NO: 3969686 - RNA, 18 nt, Human herpesvirus 4 [Epstein-Barr virus]
gacaccggugacagugcu

SEQ ID NO: 3969687 - RNA, 15 nt, Human herpesvirus 4 [Epstein-Barr virus]
gacaccugcacgaga

SEQ ID NO: 3969688 - RNA, 19 nt, Human herpesvirus 4 [Epstein-Barr virus]
gacaugagcauggaagaca

SEQ ID NO: 3969689 - RNA, 17 nt, Human herpesvirus 4 [Epstein-Barr virus]
gacauguuucuggugag

SEQ ID NO: 3969690 - RNA, 16 nt, Human herpesvirus 4 [Epstein-Barr virus]
gaccaaggcccuagcc

SEQ ID NO: 3969691 - RNA, 11 nt, Human herpesvirus 4 [Epstein-Barr virus]
gaccacccgga

SEQ ID NO: 3969692 - RNA, 16 nt, Human herpesvirus 4 [Epstein-Barr virus]
gaccaucacauggggc

SEQ ID NO: 3969693 - RNA, 20 nt, Human herpesvirus 4 [Epstein-Barr virus]
gacccccgggcgcccccaaa

SEQ ID NO: 3969694 - RNA, 14 nt, Human herpesvirus 4 [Epstein-Barr virus]
gacccugguacagg

SEQ ID NO: 3969695 - RNA, 18 nt, Human herpesvirus 4 [Epstein-Barr virus]
gaccgggagccucagugu

SEQ ID NO: 3969696 - RNA, 17 nt, Human herpesvirus 4 [Epstein-Barr virus]
gaccucauccugcucau

SEQ ID NO: 3969697 - RNA, 14 nt, Human herpesvirus 4 [Epstein-Barr virus]
gaccuggcucaggu

SEQ ID NO: 3969698 - RNA, 17 nt, Human herpesvirus 4 [Epstein-Barr virus]
gaccugugugcuguauu

SEQ ID NO: 3969699 - RNA, 23 nt, Human herpesvirus 4 [Epstein-Barr virus]
gacgaagacccaucugagggcag

SEQ ID NO: 3969700 - RNA, 16 nt, Human herpesvirus 4 [Epstein-Barr virus]
gacgagaaggaggaga

SEQ ID NO: 3969701 - RNA, 17 nt, Human herpesvirus 4 [Epstein-Barr virus]
gacgccgagaccuaugu

SEQ ID NO: 3969702 - RNA, 20 nt, Human herpesvirus 4 [Epstein-Barr virus]
gacggcgcuugcgucugccc

SEQ ID NO: 3969703 - RNA, 19 nt, Human herpesvirus 4 [Epstein-Barr virus]
gacgggcucccucccccuc

SEQ ID NO: 3969704 - RNA, 16 nt, Human herpesvirus 4 [Epstein-Barr virus]
gacgggguggugccug

SEQ ID NO: 3969705 - RNA, 16 nt, Human herpesvirus 4 [Epstein-Barr virus]
gacggugucugugguu

SEQ ID NO: 3969706 - RNA, 13 nt, Human herpesvirus 4 [Epstein-Barr virus]
gacguggcugcgg

SEQ ID NO: 3969707 - RNA, 21 nt, Human herpesvirus 4 [Epstein-Barr virus]
gacguuugaguccaaacagcu

SEQ ID NO: 3969708 - RNA, 14 nt, Human herpesvirus 4 [Epstein-Barr virus]
gacucaauuuccaa

SEQ ID NO: 3969709 - RNA, 19 nt, Human herpesvirus 4 [Epstein-Barr virus]
gacuccgaauauccccaaa

SEQ ID NO: 3969710 - RNA, 13 nt, Human herpesvirus 4 [Epstein-Barr virus]
gacucugcuuucu

SEQ ID NO: 3969711 - RNA, 20 nt, Human herpesvirus 4 [Epstein-Barr virus]
gacuuuguuuagggacagac

SEQ ID NO: 3969712 - RNA, 17 nt, Human herpesvirus 4 [Epstein-Barr virus]
gacuuuuggcaauggga

SEQ ID NO: 3969713 - RNA, 20 nt, Human herpesvirus 4 [Epstein-Barr virus]
gacuuuuggcaaugggagca

SEQ ID NO: 3969714 - RNA, 17 nt, Human herpesvirus 4 [Epstein-Barr virus]
gagaagggagacacauc

SEQ ID NO: 3969715 - RNA, 12 nt, Human herpesvirus 4 [Epstein-Barr virus]
gagaaugacagc

SEQ ID NO: 3969716 - RNA, 16 nt, Human herpesvirus 4 [Epstein-Barr virus]
gagaccaaggcggcug

SEQ ID NO: 3969717 - RNA, 20 nt, Human herpesvirus 4 [Epstein-Barr virus]
gagaggccucugccgcgcug

SEQ ID NO: 3969718 - RNA, 22 nt, Human herpesvirus 4 [Epstein-Barr virus]
gagaggcgggaauggccgccac

SEQ ID NO: 3969719 - RNA, 13 nt, Human herpesvirus 4 [Epstein-Barr virus]
gagaucaggccaa

SEQ ID NO: 3969720 - RNA, 12 nt, Human herpesvirus 4 [Epstein-Barr virus]
gagcaaccagcu

SEQ ID NO: 3969721 - RNA, 20 nt, Human herpesvirus 4 [Epstein-Barr virus]
gagcaggaggggcaggagca

SEQ ID NO: 3969722 - RNA, 21 nt, Human herpesvirus 4 [Epstein-Barr virus]
gagcaggaggggcaggagcag

SEQ ID NO: 3969723 - RNA, 19 nt, Human herpesvirus 4 [Epstein-Barr virus]
gagcagucgcauggcggga

SEQ ID NO: 3969724 - RNA, 13 nt, Human herpesvirus 4 [Epstein-Barr virus]
gagcccccaccgc

SEQ ID NO: 3969725 - RNA, 22 nt, Human herpesvirus 4 [Epstein-Barr virus]
gagccgugucuccugacgccaa

SEQ ID NO: 3969726 - RNA, 13 nt, Human herpesvirus 4 [Epstein-Barr virus]
gagcggcugugag

SEQ ID NO: 3969727 - RNA, 18 nt, Human herpesvirus 4 [Epstein-Barr virus]
gagcgggaggggcaggag

SEQ ID NO: 3969728 - RNA, 17 nt, Human herpesvirus 4 [Epstein-Barr virus]
gagcuugaggccagaga

SEQ ID NO: 3969729 - RNA, 13 nt, Human herpesvirus 4 [Epstein-Barr virus]
gaggaaggggccu

SEQ ID NO: 3969730 - RNA, 15 nt, Human herpesvirus 4 [Epstein-Barr virus]
gaggacggugucugu

SEQ ID NO: 3969731 - RNA, 17 nt, Human herpesvirus 4 [Epstein-Barr virus]
gaggagaagagaggcuu

SEQ ID NO: 3969732 - RNA, 15 nt, Human herpesvirus 4 [Epstein-Barr virus]
gaggaggggcaggag

SEQ ID NO: 3969733 - RNA, 16 nt, Human herpesvirus 4 [Epstein-Barr virus]
gaggcagagagccagu

SEQ ID NO: 3969734 - RNA, 14 nt, Human herpesvirus 4 [Epstein-Barr virus]
gaggcccacugcag

SEQ ID NO: 3969735 - RNA, 20 nt, Human herpesvirus 4 [Epstein-Barr virus]
gaggccugggagggggcgag

SEQ ID NO: 3969736 - RNA, 19 nt, Human herpesvirus 4 [Epstein-Barr virus]
gaggcggaagaccaggagc

SEQ ID NO: 3969737 - RNA, 23 nt, Human herpesvirus 4 [Epstein-Barr virus]
gaggcugagaacugacgcuccag

SEQ ID NO: 3969738 - RNA, 16 nt, Human herpesvirus 4 [Epstein-Barr virus]
gccaccguggccaggc

SEQ ID NO: 3969739 - RNA, 23 nt, Human herpesvirus 4 [Epstein-Barr virus]
gccacgcgucagcaaaccagcuu

SEQ ID NO: 3969740 - RNA, 18 nt, Human herpesvirus 4 [Epstein-Barr virus]
gccacggcgugccagagg

SEQ ID NO: 3969741 - RNA, 13 nt, Human herpesvirus 4 [Epstein-Barr virus]
gccacguccccgg

SEQ ID NO: 3969742 - RNA, 16 nt, Human herpesvirus 4 [Epstein-Barr virus]
gccagagccucugcca

SEQ ID NO: 3969743 - RNA, 18 nt, Human herpesvirus 4 [Epstein-Barr virus]
gccagcaaaaccagcccg

SEQ ID NO: 3969744 - RNA, 14 nt, Human herpesvirus 4 [Epstein-Barr virus]
gccagccaccccag

SEQ ID NO: 3969745 - RNA, 22 nt, Human herpesvirus 4 [Epstein-Barr virus]
gccagcgccuccucgcaggccc

SEQ ID NO: 3969746 - RNA, 16 nt, Human herpesvirus 4 [Epstein-Barr virus]
gccaggacgcugcugu

SEQ ID NO: 3969747 - RNA, 16 nt, Human herpesvirus 4 [Epstein-Barr virus]
gccaggauaaucaggc

SEQ ID NO: 3969748 - RNA, 20 nt, Human herpesvirus 4 [Epstein-Barr virus]
gccaggccgccaugcucagg

SEQ ID NO: 3969749 - RNA, 14 nt, Human herpesvirus 4 [Epstein-Barr virus]
gccagguagcccag

SEQ ID NO: 3969750 - RNA, 15 nt, Human herpesvirus 4 [Epstein-Barr virus]
gccagguagcccagc

SEQ ID NO: 3969751 - RNA, 13 nt, Human herpesvirus 4 [Epstein-Barr virus]
gccauccuccuuc

SEQ ID NO: 3969752 - RNA, 17 nt, Human herpesvirus 4 [Epstein-Barr virus]
gccauucgacaggccau

SEQ ID NO: 3969753 - RNA, 16 nt, Human herpesvirus 4 [Epstein-Barr virus]
gcccacacagcgccag

SEQ ID NO: 3969754 - RNA, 18 nt, Human herpesvirus 4 [Epstein-Barr virus]
gcccacacagcgccagca

SEQ ID NO: 3969755 - RNA, 14 nt, Human herpesvirus 4 [Epstein-Barr virus]
gcccaccagccagc

SEQ ID NO: 3969756 - RNA, 19 nt, Human herpesvirus 4 [Epstein-Barr virus]
gcccagaggaggccccggc

SEQ ID NO: 3969757 - RNA, 22 nt, Human herpesvirus 4 [Epstein-Barr virus]
gcccagcagauccagggcccgu

SEQ ID NO: 3969758 - RNA, 12 nt, Human herpesvirus 4 [Epstein-Barr virus]
gcccagcccccu

SEQ ID NO: 3969759 - RNA, 16 nt, Human herpesvirus 4 [Epstein-Barr virus]
gcccagcccccucccg

SEQ ID NO: 3969760 - RNA, 18 nt, Human herpesvirus 4 [Epstein-Barr virus]
gcccagcccgacccccgg

SEQ ID NO: 3969761 - RNA, 23 nt, Human herpesvirus 4 [Epstein-Barr virus]
gcccagcccuccucagaaaacuc

SEQ ID NO: 3969762 - RNA, 16 nt, Human herpesvirus 4 [Epstein-Barr virus]
gccccaauaugccaac

SEQ ID NO: 3969763 - RNA, 13 nt, Human herpesvirus 4 [Epstein-Barr virus]
gccccagccccuc

SEQ ID NO: 3969764 - RNA, 12 nt, Human herpesvirus 4 [Epstein-Barr virus]
gcccccaccacc

SEQ ID NO: 3969765 - RNA, 18 nt, Human herpesvirus 4 [Epstein-Barr virus]
gcccccaccacucccacc

SEQ ID NO: 3969766 - RNA, 14 nt, Human herpesvirus 4 [Epstein-Barr virus]
gcccccgccagcgc

SEQ ID NO: 3969767 - RNA, 22 nt, Human herpesvirus 4 [Epstein-Barr virus]
gcccccugucucuuucuggcca

SEQ ID NO: 3969768 - RNA, 20 nt, Human herpesvirus 4 [Epstein-Barr virus]
gccccgaugcggaggacugc

SEQ ID NO: 3969769 - RNA, 17 nt, Human herpesvirus 4 [Epstein-Barr virus]
gccccggucaccccaga

SEQ ID NO: 3969770 - RNA, 16 nt, Human herpesvirus 4 [Epstein-Barr virus]
gccccuguccacugcc

SEQ ID NO: 3969771 - RNA, 18 nt, Human herpesvirus 4 [Epstein-Barr virus]
gcccgacaauaaaguuga

SEQ ID NO: 3969772 - RNA, 23 nt, Human herpesvirus 4 [Epstein-Barr virus]
gcccgacccccgggcgcccccaa

SEQ ID NO: 3969773 - RNA, 20 nt, Human herpesvirus 4 [Epstein-Barr virus]
gcccgcaccccccgccacca

SEQ ID NO: 3969774 - RNA, 16 nt, Human herpesvirus 4 [Epstein-Barr virus]
gcccgucuuacugccc

SEQ ID NO: 3969775 - RNA, 22 nt, Human herpesvirus 4 [Epstein-Barr virus]
gcccguuccaggcucuccagcc

SEQ ID NO: 3969776 - RNA, 16 nt, Human herpesvirus 4 [Epstein-Barr virus]
gcccuccucugggccg

SEQ ID NO: 3969777 - RNA, 21 nt, Human herpesvirus 4 [Epstein-Barr virus]
gcccugagcuggacgaggucc

SEQ ID NO: 3969778 - RNA, 12 nt, Human herpesvirus 4 [Epstein-Barr virus]
gcccuggucagg

SEQ ID NO: 3969779 - RNA, 13 nt, Human herpesvirus 4 [Epstein-Barr virus]
gcccuuugccugg

SEQ ID NO: 3969780 - RNA, 17 nt, Human herpesvirus 4 [Epstein-Barr virus]
gccgcaccacgggaggc

SEQ ID NO: 3969781 - RNA, 13 nt, Human herpesvirus 4 [Epstein-Barr virus]
gccgccgccagca

SEQ ID NO: 3969782 - RNA, 13 nt, Human herpesvirus 4 [Epstein-Barr virus]
gccgcggcccagg

SEQ ID NO: 3969783 - RNA, 14 nt, Human herpesvirus 4 [Epstein-Barr virus]
gccgcuccguggcc

SEQ ID NO: 3969784 - RNA, 18 nt, Human herpesvirus 4 [Epstein-Barr virus]
gccgcuuacagccagaga

SEQ ID NO: 3969785 - RNA, 13 nt, Human herpesvirus 4 [Epstein-Barr virus]
gccggggcccacg

SEQ ID NO: 3969786 - RNA, 23 nt, Human herpesvirus 4 [Epstein-Barr virus]
gccgguuuugcagucgcugcugc

SEQ ID NO: 3969787 - RNA, 20 nt, Human herpesvirus 4 [Epstein-Barr virus]
gccuacugauggccaucuuu

SEQ ID NO: 3969788 - RNA, 22 nt, Human herpesvirus 4 [Epstein-Barr virus]
gccuagccaucggggcacguuu

SEQ ID NO: 3969789 - RNA, 19 nt, Human herpesvirus 4 [Epstein-Barr virus]
gccucaaaguccugcacua

SEQ ID NO: 3969790 - RNA, 13 nt, Human herpesvirus 4 [Epstein-Barr virus]
gccucagcccccc

SEQ ID NO: 3969791 - RNA, 15 nt, Human herpesvirus 4 [Epstein-Barr virus]
gccuccaacaggugc

SEQ ID NO: 3969792 - RNA, 22 nt, Human herpesvirus 4 [Epstein-Barr virus]
gccuccaacaggugcccgagcc

SEQ ID NO: 3969793 - RNA, 15 nt, Human herpesvirus 4 [Epstein-Barr virus]
gccuccagcucggcc

SEQ ID NO: 3969794 - RNA, 14 nt, Human herpesvirus 4 [Epstein-Barr virus]
gccucuacccuccc

SEQ ID NO: 3969795 - RNA, 17 nt, Human herpesvirus 4 [Epstein-Barr virus]
gccucucuggcugugcu

SEQ ID NO: 3969796 - RNA, 21 nt, Human herpesvirus 4 [Epstein-Barr virus]
gccucucuggcugugcugacc

SEQ ID NO: 3969797 - RNA, 19 nt, Human herpesvirus 4 [Epstein-Barr virus]
gccucugccgcgcugcucg

SEQ ID NO: 3969798 - RNA, 16 nt, Human herpesvirus 4 [Epstein-Barr virus]
gccugaagcuugcugg

SEQ ID NO: 3969799 - RNA, 22 nt, Human herpesvirus 4 [Epstein-Barr virus]
gccugagacagaggugcucaag

SEQ ID NO: 3969800 - RNA, 16 nt, Human herpesvirus 4 [Epstein-Barr virus]
gccugccaaagagcca

SEQ ID NO: 3969801 - RNA, 12 nt, Human herpesvirus 4 [Epstein-Barr virus]
gccugccucugc

SEQ ID NO: 3969802 - RNA, 16 nt, Human herpesvirus 4 [Epstein-Barr virus]
gccugccucugcucug

SEQ ID NO: 3969803 - RNA, 23 nt, Human herpesvirus 4 [Epstein-Barr virus]
gccuggccggcuaucugcuucug

SEQ ID NO: 3969804 - RNA, 14 nt, Human herpesvirus 4 [Epstein-Barr virus]
gccuucgcccccuc

SEQ ID NO: 3969805 - RNA, 15 nt, Human herpesvirus 4 [Epstein-Barr virus]
gccuucuccucagcc

SEQ ID NO: 3969806 - RNA, 15 nt, Human herpesvirus 4 [Epstein-Barr virus]
gccuugcguggugcu

SEQ ID NO: 3969807 - RNA, 13 nt, Human herpesvirus 4 [Epstein-Barr virus]
gcgacacuugggu

SEQ ID NO: 3969808 - RNA, 18 nt, Human herpesvirus 4 [Epstein-Barr virus]
gcgagcuccgugggccca

SEQ ID NO: 3969809 - RNA, 17 nt, Human herpesvirus 4 [Epstein-Barr virus]
gcgcaacgccggccugc

SEQ ID NO: 3969810 - RNA, 13 nt, Human herpesvirus 4 [Epstein-Barr virus]
gcgcccugcgagu

SEQ ID NO: 3969811 - RNA, 17 nt, Human herpesvirus 4 [Epstein-Barr virus]
gcgccgguggggaaggc

SEQ ID NO: 3969812 - RNA, 15 nt, Human herpesvirus 4 [Epstein-Barr virus]
gcggagagggauggg

SEQ ID NO: 3969813 - RNA, 21 nt, Human herpesvirus 4 [Epstein-Barr virus]
gcggcaagggcucaccaggga

SEQ ID NO: 3969814 - RNA, 20 nt, Human herpesvirus 4 [Epstein-Barr virus]
gcggcucaggaucagggcca

SEQ ID NO: 3969815 - RNA, 13 nt, Human herpesvirus 4 [Epstein-Barr virus]
gcgggaggggcag

SEQ ID NO: 3969816 - RNA, 19 nt, Human herpesvirus 4 [Epstein-Barr virus]
gcggggcuccccagccaca

SEQ ID NO: 3969817 - RNA, 19 nt, Human herpesvirus 4 [Epstein-Barr virus]
gcgucaggagagggccaga

SEQ ID NO: 3969818 - RNA, 15 nt, Human herpesvirus 4 [Epstein-Barr virus]
gcgucauuucuucca

SEQ ID NO: 3969819 - RNA, 22 nt, Human herpesvirus 4 [Epstein-Barr virus]
gcguccucuaccuggucaagag

SEQ ID NO: 3969820 - RNA, 20 nt, Human herpesvirus 4 [Epstein-Barr virus]
gcguugcgcaccaccgcagc

SEQ ID NO: 3969821 - RNA, 14 nt, Human herpesvirus 4 [Epstein-Barr virus]
gcuacucuccgccg

SEQ ID NO: 3969822 - RNA, 18 nt, Human herpesvirus 4 [Epstein-Barr virus]
gcuaucuuugcugaagau

SEQ ID NO: 3969823 - RNA, 19 nt, Human herpesvirus 4 [Epstein-Barr virus]
gcuaucuuugcugaagaug

SEQ ID NO: 3969824 - RNA, 23 nt, Human herpesvirus 4 [Epstein-Barr virus]
gcuaugaagaagauugaagacaa

SEQ ID NO: 3969825 - RNA, 21 nt, Human herpesvirus 4 [Epstein-Barr virus]
gcuaugaccaugcccagacuc

SEQ ID NO: 3969826 - RNA, 17 nt, Human herpesvirus 4 [Epstein-Barr virus]
guccgccaugaccagca

SEQ ID NO: 3969827 - RNA, 13 nt, Human herpesvirus 4 [Epstein-Barr virus]
guccgcugggcca

SEQ ID NO: 3969828 - RNA, 21 nt, Human herpesvirus 4 [Epstein-Barr virus]
gucgcuggcauacucuucauu

SEQ ID NO: 3969829 - RNA, 20 nt, Human herpesvirus 4 [Epstein-Barr virus]
gucggacgaggaggaagaga

SEQ ID NO: 3969830 - RNA, 15 nt, Human herpesvirus 4 [Epstein-Barr virus]
gucuacuucgccaug

SEQ ID NO: 3969831 - RNA, 17 nt, Human herpesvirus 4 [Epstein-Barr virus]
gucuccagcggcuaccu

SEQ ID NO: 3969832 - RNA, 21 nt, Human herpesvirus 4 [Epstein-Barr virus]
gucucuuucuggccaaccugc

SEQ ID NO: 3969833 - RNA, 22 nt, Human herpesvirus 4 [Epstein-Barr virus]
gucugacgaggggccagguaca

SEQ ID NO: 3969834 - RNA, 14 nt, Human herpesvirus 4 [Epstein-Barr virus]
gucugacuuggccc

SEQ ID NO: 3969835 - RNA, 16 nt, Human herpesvirus 4 [Epstein-Barr virus]
gucugcaccccagugg

SEQ ID NO: 3969836 - RNA, 21 nt, Human herpesvirus 4 [Epstein-Barr virus]
gucuucggucaaguaccagcu

SEQ ID NO: 3969837 - RNA, 23 nt, Human herpesvirus 4 [Epstein-Barr virus]
gucuucugucucggccuccuggc

SEQ ID NO: 3969838 - RNA, 13 nt, Human herpesvirus 4 [Epstein-Barr virus]
gugaaugcacgcc

SEQ ID NO: 3969839 - RNA, 16 nt, Human herpesvirus 4 [Epstein-Barr virus]
gugaccacugagggag

SEQ ID NO: 3969840 - RNA, 12 nt, Human herpesvirus 4 [Epstein-Barr virus]
gugagcccaccu

SEQ ID NO: 3969841 - RNA, 16 nt, Human herpesvirus 4 [Epstein-Barr virus]
gugaggagcgcccacc

SEQ ID NO: 3969842 - RNA, 13 nt, Human herpesvirus 4 [Epstein-Barr virus]
gugaggccugaga

SEQ ID NO: 3969843 - RNA, 15 nt, Human herpesvirus 4 [Epstein-Barr virus]
gugaggcggugccug

SEQ ID NO: 3969844 - RNA, 14 nt, Human herpesvirus 4 [Epstein-Barr virus]
gugcaccugcuaga

SEQ ID NO: 3969845 - RNA, 15 nt, Human herpesvirus 4 [Epstein-Barr virus]
gugcagacgagcaug

SEQ ID NO: 3969846 - RNA, 17 nt, Human herpesvirus 4 [Epstein-Barr virus]
gugcagccuaccgccac

SEQ ID NO: 3969847 - RNA, 17 nt, Human herpesvirus 4 [Epstein-Barr virus]
gugcccuggaggccuca

SEQ ID NO: 3969848 - RNA, 13 nt, Human herpesvirus 4 [Epstein-Barr virus]
gugccuccagagc

SEQ ID NO: 3969849 - RNA, 18 nt, Human herpesvirus 4 [Epstein-Barr virus]
gugcuggagauuuuccca

SEQ ID NO: 3969850 - RNA, 15 nt, Human herpesvirus 4 [Epstein-Barr virus]
gugcuguugggccuu

SEQ ID NO: 3969851 - RNA, 17 nt, Human herpesvirus 4 [Epstein-Barr virus]
gugcuuuccaccggugg

SEQ ID NO: 3969852 - RNA, 19 nt, Human herpesvirus 4 [Epstein-Barr virus]
guggacucggccacacagu

SEQ ID NO: 3969853 - RNA, 13 nt, Human herpesvirus 4 [Epstein-Barr virus]
guggagaggcccg

SEQ ID NO: 3969854 - RNA, 11 nt, Human herpesvirus 4 [Epstein-Barr virus]
guggaggcucg

SEQ ID NO: 3969855 - RNA, 12 nt, Human herpesvirus 4 [Epstein-Barr virus]
guggagggccga

SEQ ID NO: 3969856 - RNA, 18 nt, Human herpesvirus 4 [Epstein-Barr virus]
guggaggggggcggcgug

SEQ ID NO: 3969857 - RNA, 21 nt, Human herpesvirus 4 [Epstein-Barr virus]
guggccucuacgccaggcucg

SEQ ID NO: 3969858 - RNA, 12 nt, Human herpesvirus 4 [Epstein-Barr virus]
guggcugcugcc

SEQ ID NO: 3969859 - RNA, 19 nt, Human herpesvirus 4 [Epstein-Barr virus]
gugggauggcggggccuug

SEQ ID NO: 3969860 - RNA, 22 nt, Human herpesvirus 4 [Epstein-Barr virus]
gugggccucucuggcugugcug

SEQ ID NO: 3969861 - RNA, 20 nt, Human herpesvirus 4 [Epstein-Barr virus]
gugguaacaggugggacaaa

SEQ ID NO: 3969862 - RNA, 14 nt, Human herpesvirus 4 [Epstein-Barr virus]
guggucuccuucuu

SEQ ID NO: 3969863 - RNA, 14 nt, Human herpesvirus 4 [Epstein-Barr virus]
gugguucuccugau

SEQ ID NO: 3969864 - RNA, 22 nt, Human herpesvirus 4 [Epstein-Barr virus]
guguauugcucucguugccaaa

SEQ ID NO: 3969865 - RNA, 15 nt, Human herpesvirus 4 [Epstein-Barr virus]
guguauuucuggcca

SEQ ID NO: 3969866 - RNA, 20 nt, Human herpesvirus 4 [Epstein-Barr virus]
guguauuucuggccaucugu

SEQ ID NO: 3969867 - RNA, 18 nt, Human herpesvirus 4 [Epstein-Barr virus]
guguccagguguggaaaa

SEQ ID NO: 3969868 - RNA, 16 nt, Human herpesvirus 4 [Epstein-Barr virus]
gugucgcguagcucug

SEQ ID NO: 3969869 - RNA, 13 nt, Human herpesvirus 4 [Epstein-Barr virus]
guguuccacagcc

SEQ ID NO: 3969870 - RNA, 16 nt, Human herpesvirus 4 [Epstein-Barr virus]
guguuccacagccugc

SEQ ID NO: 3969871 - RNA, 13 nt, Human herpesvirus 4 [Epstein-Barr virus]
guguuugcuugcc

SEQ ID NO: 3969872 - RNA, 13 nt, Human herpesvirus 4 [Epstein-Barr virus]
guuagugugccuc

SEQ ID NO: 3969873 - RNA, 16 nt, Human herpesvirus 4 [Epstein-Barr virus]
guuauaacugccagag

SEQ ID NO: 3969874 - RNA, 22 nt, Human herpesvirus 4 [Epstein-Barr virus]
guuauuacugauugucgcuggc

SEQ ID NO: 3969875 - RNA, 15 nt, Human herpesvirus 4 [Epstein-Barr virus]
guucccggcacacca

SEQ ID NO: 3969876 - RNA, 22 nt, Human herpesvirus 4 [Epstein-Barr virus]
guugccgugguugggcagaacc

SEQ ID NO: 3969877 - RNA, 13 nt, Human herpesvirus 4 [Epstein-Barr virus]
guugguggcacug

SEQ ID NO: 3969878 - RNA, 18 nt, Human herpesvirus 4 [Epstein-Barr virus]
guuucuggaaugcuucua

SEQ ID NO: 3969879 - RNA, 15 nt, Human herpesvirus 4 [Epstein-Barr virus]
uaaaaaugugcagcu

SEQ ID NO: 3969880 - RNA, 21 nt, Human herpesvirus 4 [Epstein-Barr virus]
uaaacauugcaccuugccggc

SEQ ID NO: 3969881 - RNA, 18 nt, Human herpesvirus 4 [Epstein-Barr virus]
uaaaguuggucaggcuga

SEQ ID NO: 3969882 - RNA, 18 nt, Human herpesvirus 4 [Epstein-Barr virus]
uaacacgaaugcccaggc

SEQ ID NO: 3969883 - RNA, 21 nt, Human herpesvirus 4 [Epstein-Barr virus]
uaacacuacuuguuucuggaa

SEQ ID NO: 3969884 - RNA, 13 nt, Human herpesvirus 4 [Epstein-Barr virus]
uaacauccgagac

SEQ ID NO: 3969885 - RNA, 14 nt, Human herpesvirus 4 [Epstein-Barr virus]
uaacauugaugaac

SEQ ID NO: 3969886 - RNA, 13 nt, Human herpesvirus 4 [Epstein-Barr virus]
uaaccuaugccug

SEQ ID NO: 3969887 - RNA, 15 nt, Human herpesvirus 4 [Epstein-Barr virus]
uaacgggaagugugu

SEQ ID NO: 3969888 - RNA, 23 nt, Human herpesvirus 4 [Epstein-Barr virus]
uaacgggggaaggaaaggccugc

SEQ ID NO: 3969889 - RNA, 16 nt, Human herpesvirus 4 [Epstein-Barr virus]
uaacugugucccacuc

SEQ ID NO: 3969890 - RNA, 15 nt, Human herpesvirus 4 [Epstein-Barr virus]
uaacuugacuacaau

SEQ ID NO: 3969891 - RNA, 12 nt, Human herpesvirus 4 [Epstein-Barr virus]
uaagccugccuc

SEQ ID NO: 3969892 - RNA, 19 nt, Human herpesvirus 4 [Epstein-Barr virus]
uaaguaauuuguugccguu

SEQ ID NO: 3969893 - RNA, 18 nt, Human herpesvirus 4 [Epstein-Barr virus]
uacaacucagccccaucu

SEQ ID NO: 3969894 - RNA, 20 nt, Human herpesvirus 4 [Epstein-Barr virus]
uacagcagcuggauguacag

SEQ ID NO: 3969895 - RNA, 20 nt, Human herpesvirus 4 [Epstein-Barr virus]
uacagccgggcuaugcucua

SEQ ID NO: 3969896 - RNA, 12 nt, Human herpesvirus 4 [Epstein-Barr virus]
uacaggaggaaa

SEQ ID NO: 3969897 - RNA, 23 nt, Human herpesvirus 4 [Epstein-Barr virus]
uacauguuuuucguuaacaugga

SEQ ID NO: 3969898 - RNA, 17 nt, Human herpesvirus 4 [Epstein-Barr virus]
uacccggucgcauggug

SEQ ID NO: 3969899 - RNA, 23 nt, Human herpesvirus 4 [Epstein-Barr virus]
uaccgccacgcgucagcaaacca

SEQ ID NO: 3969900 - RNA, 20 nt, Human herpesvirus 4 [Epstein-Barr virus]
uacgcccgacaauaaaguug

SEQ ID NO: 3969901 - RNA, 14 nt, Human herpesvirus 4 [Epstein-Barr virus]
uacggcuuuccagu

SEQ ID NO: 3969902 - RNA, 18 nt, Human herpesvirus 4 [Epstein-Barr virus]
uacguuggcuucugcugc

SEQ ID NO: 3969903 - RNA, 13 nt, Human herpesvirus 4 [Epstein-Barr virus]
uacucggggucuc

SEQ ID NO: 3969904 - RNA, 19 nt, Human herpesvirus 4 [Epstein-Barr virus]
uacucuucauucuugcuau

SEQ ID NO: 3969905 - RNA, 17 nt, Human herpesvirus 4 [Epstein-Barr virus]
uacugauugucgcuggc

SEQ ID NO: 3969906 - RNA, 19 nt, Human herpesvirus 4 [Epstein-Barr virus]
uagaauccagccagugguc

SEQ ID NO: 3969907 - RNA, 15 nt, Human herpesvirus 4 [Epstein-Barr virus]
uagaggcucaggcca

SEQ ID NO: 3969908 - RNA, 17 nt, Human herpesvirus 4 [Epstein-Barr virus]
uagcauggccgccagag

SEQ ID NO: 3969909 - RNA, 17 nt, Human herpesvirus 4 [Epstein-Barr virus]
uagccuauuugcacguu

SEQ ID NO: 3969910 - RNA, 12 nt, Human herpesvirus 4 [Epstein-Barr virus]
uaggaauuauuu

SEQ ID NO: 3969911 - RNA, 17 nt, Human herpesvirus 4 [Epstein-Barr virus]
uaggagcagggcccagu

SEQ ID NO: 3969912 - RNA, 16 nt, Human herpesvirus 4 [Epstein-Barr virus]
uaggcacaucuggacc

SEQ ID NO: 3969913 - RNA, 18 nt, Human herpesvirus 4 [Epstein-Barr virus]
uaggugccuccagagccc

SEQ ID NO: 3969914 - RNA, 13 nt, Human herpesvirus 4 [Epstein-Barr virus]
gccuggacugugg

SEQ ID NO: 3969915 - RNA, 22 nt, Human herpesvirus 4 [Epstein-Barr virus]
gccuggggauaagaaacacgcu

SEQ ID NO: 3969916 - RNA, 14 nt, Human herpesvirus 4 [Epstein-Barr virus]
gccuggggcucaga

SEQ ID NO: 3969917 - RNA, 19 nt, Human herpesvirus 4 [Epstein-Barr virus]
gccuguuuguccagcaggg

SEQ ID NO: 3969918 - RNA, 22 nt, Human herpesvirus 4 [Epstein-Barr virus]
gccuguuuguccagcagggccu

SEQ ID NO: 3969919 - RNA, 13 nt, Human herpesvirus 4 [Epstein-Barr virus]
gccuuacacugga

SEQ ID NO: 3969920 - RNA, 12 nt, Human herpesvirus 4 [Epstein-Barr virus]
gccuuccucugc

SEQ ID NO: 3969921 - RNA, 16 nt, Human herpesvirus 4 [Epstein-Barr virus]
gccuugcguggugcug

SEQ ID NO: 3969922 - RNA, 18 nt, Human herpesvirus 4 [Epstein-Barr virus]
gccuugguuucagccuca

SEQ ID NO: 3969923 - RNA, 21 nt, Human herpesvirus 4 [Epstein-Barr virus]
gccuugguuucagccucacug

SEQ ID NO: 3969924 - RNA, 19 nt, Human herpesvirus 4 [Epstein-Barr virus]
gccuuguucuuugaccuuu

SEQ ID NO: 3969925 - RNA, 21 nt, Human herpesvirus 4 [Epstein-Barr virus]
gcgacauguuucuggugagcc

SEQ ID NO: 3969926 - RNA, 14 nt, Human herpesvirus 4 [Epstein-Barr virus]
gcgacgcucccggg

SEQ ID NO: 3969927 - RNA, 17 nt, Human herpesvirus 4 [Epstein-Barr virus]
gcgagcucuccagccac

SEQ ID NO: 3969928 - RNA, 21 nt, Human herpesvirus 4 [Epstein-Barr virus]
gcgaugucggggcugcuggcg

SEQ ID NO: 3969929 - RNA, 23 nt, Human herpesvirus 4 [Epstein-Barr virus]
gcgcaacgccggccugcuggccg

SEQ ID NO: 3969930 - RNA, 20 nt, Human herpesvirus 4 [Epstein-Barr virus]
gcgcaggggagggggcagga

SEQ ID NO: 3969931 - RNA, 18 nt, Human herpesvirus 4 [Epstein-Barr virus]
gcgccagcagggcacaga

SEQ ID NO: 3969932 - RNA, 18 nt, Human herpesvirus 4 [Epstein-Barr virus]
gcgcccugucaccaggcc

SEQ ID NO: 3969933 - RNA, 13 nt, Human herpesvirus 4 [Epstein-Barr virus]
gcgccgccagcau

SEQ ID NO: 3969934 - RNA, 14 nt, Human herpesvirus 4 [Epstein-Barr virus]
gcgccguggccacc

SEQ ID NO: 3969935 - RNA, 15 nt, Human herpesvirus 4 [Epstein-Barr virus]
gcgcucgucguucag

SEQ ID NO: 3969936 - RNA, 19 nt, Human herpesvirus 4 [Epstein-Barr virus]
gcgcuguggagagaggcaa

SEQ ID NO: 3969937 - RNA, 20 nt, Human herpesvirus 4 [Epstein-Barr virus]
gcggacccgaucagagcccc

SEQ ID NO: 3969938 - RNA, 15 nt, Human herpesvirus 4 [Epstein-Barr virus]
gcggcccacugaaaa

SEQ ID NO: 3969939 - RNA, 22 nt, Human herpesvirus 4 [Epstein-Barr virus]
gcggcccagcagauccagggcc

SEQ ID NO: 3969940 - RNA, 23 nt, Human herpesvirus 4 [Epstein-Barr virus]
gcggcccagcagauccagggccc

SEQ ID NO: 3969941 - RNA, 19 nt, Human herpesvirus 4 [Epstein-Barr virus]
gcgggggaccacauacauc

SEQ ID NO: 3969942 - RNA, 22 nt, Human herpesvirus 4 [Epstein-Barr virus]
gcgucccaaacauaaaugcccc

SEQ ID NO: 3969943 - RNA, 18 nt, Human herpesvirus 4 [Epstein-Barr virus]
gcgucgggaaacacagcu

SEQ ID NO: 3969944 - RNA, 20 nt, Human herpesvirus 4 [Epstein-Barr virus]
gcgucuguuuguguagugag

SEQ ID NO: 3969945 - RNA, 15 nt, Human herpesvirus 4 [Epstein-Barr virus]
gcgugaauugugccc

SEQ ID NO: 3969946 - RNA, 14 nt, Human herpesvirus 4 [Epstein-Barr virus]
gcguggugcugucc

SEQ ID NO: 3969947 - RNA, 15 nt, Human herpesvirus 4 [Epstein-Barr virus]
gcguguuugcugcuc

SEQ ID NO: 3969948 - RNA, 13 nt, Human herpesvirus 4 [Epstein-Barr virus]
gcguugccagacu

SEQ ID NO: 3969949 - RNA, 13 nt, Human herpesvirus 4 [Epstein-Barr virus]
gcuaaccagaugu

SEQ ID NO: 3969950 - RNA, 13 nt, Human herpesvirus 4 [Epstein-Barr virus]
gcuagggaggaga

SEQ ID NO: 3969951 - RNA, 15 nt, Human herpesvirus 4 [Epstein-Barr virus]
gcuagggaggagacg

SEQ ID NO: 3969952 - RNA, 22 nt, Human herpesvirus 4 [Epstein-Barr virus]
gcuaguggcgcugcguggcacc

SEQ ID NO: 3969953 - RNA, 22 nt, Human herpesvirus 4 [Epstein-Barr virus]
gcucccgggcaaacagggcaga

SEQ ID NO: 3969954 - RNA, 17 nt, Human herpesvirus 4 [Epstein-Barr virus]
gcuccgagagcuccgcc

SEQ ID NO: 3969955 - RNA, 16 nt, Human herpesvirus 4 [Epstein-Barr virus]
gcuccggcugccgcac

SEQ ID NO: 3969956 - RNA, 20 nt, Human herpesvirus 4 [Epstein-Barr virus]
gcucgcccacacagcgccag

SEQ ID NO: 3969957 - RNA, 22 nt, Human herpesvirus 4 [Epstein-Barr virus]
gcucgccuggagucugagaaua

SEQ ID NO: 3969958 - RNA, 19 nt, Human herpesvirus 4 [Epstein-Barr virus]
gcucgucguucaggaacag

SEQ ID NO: 3969959 - RNA, 20 nt, Human herpesvirus 4 [Epstein-Barr virus]
gcucuucgugcucuucaugu

SEQ ID NO: 3969960 - RNA, 15 nt, Human herpesvirus 4 [Epstein-Barr virus]
gcucuucugggaaca

SEQ ID NO: 3969961 - RNA, 16 nt, Human herpesvirus 4 [Epstein-Barr virus]
gcugaccggcucggcc

SEQ ID NO: 3969962 - RNA, 21 nt, Human herpesvirus 4 [Epstein-Barr virus]
gcugagaacugacgcuccagg

SEQ ID NO: 3969963 - RNA, 16 nt, Human herpesvirus 4 [Epstein-Barr virus]
gcugaugugcugcccc

SEQ ID NO: 3969964 - RNA, 13 nt, Human herpesvirus 4 [Epstein-Barr virus]
gcugccaggccgc

SEQ ID NO: 3969965 - RNA, 18 nt, Human herpesvirus 4 [Epstein-Barr virus]
gcugccgaagcagauggc

SEQ ID NO: 3969966 - RNA, 13 nt, Human herpesvirus 4 [Epstein-Barr virus]
gcugcgccuccug

SEQ ID NO: 3969967 - RNA, 15 nt, Human herpesvirus 4 [Epstein-Barr virus]
gcugcgguggugcgc

SEQ ID NO: 3969968 - RNA, 16 nt, Human herpesvirus 4 [Epstein-Barr virus]
gcugcucgccccuggu

SEQ ID NO: 3969969 - RNA, 22 nt, Human herpesvirus 4 [Epstein-Barr virus]
gcuggacgugaaccuccccccc

SEQ ID NO: 3969970 - RNA, 19 nt, Human herpesvirus 4 [Epstein-Barr virus]
gcuggacuccgaggaccag

SEQ ID NO: 3969971 - RNA, 13 nt, Human herpesvirus 4 [Epstein-Barr virus]
gcuggccgagcug

SEQ ID NO: 3969972 - RNA, 20 nt, Human herpesvirus 4 [Epstein-Barr virus]
gcuggcucgccucauccugg

SEQ ID NO: 3969973 - RNA, 18 nt, Human herpesvirus 4 [Epstein-Barr virus]
gcuguccuucugucacaa

SEQ ID NO: 3969974 - RNA, 20 nt, Human herpesvirus 4 [Epstein-Barr virus]
gcuguggccggugcugccag

SEQ ID NO: 3969975 - RNA, 20 nt, Human herpesvirus 4 [Epstein-Barr virus]
gcuucuuagaugaggagcag

SEQ ID NO: 3969976 - RNA, 23 nt, Human herpesvirus 4 [Epstein-Barr virus]
gcuucuucguauauguguugaga

SEQ ID NO: 3969977 - RNA, 20 nt, Human herpesvirus 4 [Epstein-Barr virus]
gcuuuguugggucugauguu

SEQ ID NO: 3969978 - RNA, 16 nt, Human herpesvirus 4 [Epstein-Barr virus]
ggaaaagagagcugau

SEQ ID NO: 3969979 - RNA, 17 nt, Human herpesvirus 4 [Epstein-Barr virus]
ggaaaagagagcugaug

SEQ ID NO: 3969980 - RNA, 21 nt, Human herpesvirus 4 [Epstein-Barr virus]
ggaaagaggucccauguacag

SEQ ID NO: 3969981 - RNA, 18 nt, Human herpesvirus 4 [Epstein-Barr virus]
ggaacaaacaugggcugc

SEQ ID NO: 3969982 - RNA, 15 nt, Human herpesvirus 4 [Epstein-Barr virus]
ggaacacccccaccc

SEQ ID NO: 3969983 - RNA, 21 nt, Human herpesvirus 4 [Epstein-Barr virus]
ggaacacccccaccccaccga

SEQ ID NO: 3969984 - RNA, 23 nt, Human herpesvirus 4 [Epstein-Barr virus]
ggaacacggcaccgucagccaca

SEQ ID NO: 3969985 - RNA, 23 nt, Human herpesvirus 4 [Epstein-Barr virus]
ggaacccuagccaccguggccag

SEQ ID NO: 3969986 - RNA, 22 nt, Human herpesvirus 4 [Epstein-Barr virus]
ggaagagacuucacagagcagc

SEQ ID NO: 3969987 - RNA, 16 nt, Human herpesvirus 4 [Epstein-Barr virus]
ggaagcucagcaguug

SEQ ID NO: 3969988 - RNA, 16 nt, Human herpesvirus 4 [Epstein-Barr virus]
ggaaggaaaggccugc

SEQ ID NO: 3969989 - RNA, 13 nt, Human herpesvirus 4 [Epstein-Barr virus]
ggaaugaacacuc

SEQ ID NO: 3969990 - RNA, 14 nt, Human herpesvirus 4 [Epstein-Barr virus]
ggaaugugugacau

SEQ ID NO: 3969991 - RNA, 22 nt, Human herpesvirus 4 [Epstein-Barr virus]
ggaauuugugguuuggggcagg

SEQ ID NO: 3969992 - RNA, 17 nt, Human herpesvirus 4 [Epstein-Barr virus]
ggacacacauggcacuc

SEQ ID NO: 3969993 - RNA, 18 nt, Human herpesvirus 4 [Epstein-Barr virus]
ggacagacccugggccuu

SEQ ID NO: 3969994 - RNA, 18 nt, Human herpesvirus 4 [Epstein-Barr virus]
ggacagcagcguccuggc

SEQ ID NO: 3969995 - RNA, 17 nt, Human herpesvirus 4 [Epstein-Barr virus]
ggacaggugccagaugu

SEQ ID NO: 3969996 - RNA, 21 nt, Human herpesvirus 4 [Epstein-Barr virus]
ggacaugcugaugugcugccc

SEQ ID NO: 3969997 - RNA, 11 nt, Human herpesvirus 4 [Epstein-Barr virus]
ggacaugucac

SEQ ID NO: 3969998 - RNA, 20 nt, Human herpesvirus 4 [Epstein-Barr virus]
gauguccuggccgggcgccu

SEQ ID NO: 3969999 - RNA, 19 nt, Human herpesvirus 4 [Epstein-Barr virus]
gauuaggcacuggacacac

SEQ ID NO: 3970000 - RNA, 17 nt, Human herpesvirus 4 [Epstein-Barr virus]
gauucaccggcaccgcc

SEQ ID NO: 3970001 - RNA, 20 nt, Human herpesvirus 4 [Epstein-Barr virus]
gauucucuaaucccucuggg

SEQ ID NO: 3970002 - RNA, 18 nt, Human herpesvirus 4 [Epstein-Barr virus]
gauugucacagcugcugg

SEQ ID NO: 3970003 - RNA, 20 nt, Human herpesvirus 4 [Epstein-Barr virus]
gauuugcucuucgugcucuu

SEQ ID NO: 3970004 - RNA, 14 nt, Human herpesvirus 4 [Epstein-Barr virus]
gcaaaacucacagg

SEQ ID NO: 3970005 - RNA, 16 nt, Human herpesvirus 4 [Epstein-Barr virus]
gcaacauugcagggcu

SEQ ID NO: 3970006 - RNA, 13 nt, Human herpesvirus 4 [Epstein-Barr virus]
gcaaccagcacgu

SEQ ID NO: 3970007 - RNA, 24 nt, Human herpesvirus 4 [Epstein-Barr virus]
gcaaccagcacgucgucagagagg

SEQ ID NO: 3970008 - RNA, 12 nt, Human herpesvirus 4 [Epstein-Barr virus]
gcaacugcugca

SEQ ID NO: 3970009 - RNA, 20 nt, Human herpesvirus 4 [Epstein-Barr virus]
gcaauaaauaaaaguacaga

SEQ ID NO: 3970010 - RNA, 16 nt, Human herpesvirus 4 [Epstein-Barr virus]
gcaaugcccacccacu

SEQ ID NO: 3970011 - RNA, 16 nt, Human herpesvirus 4 [Epstein-Barr virus]
gcaauugggcauaccc

SEQ ID NO: 3970012 - RNA, 17 nt, Human herpesvirus 4 [Epstein-Barr virus]
gcaauugggcauaccca

SEQ ID NO: 3970013 - RNA, 23 nt, Human herpesvirus 4 [Epstein-Barr virus]
gcacaacaagaaaucccaguugu

SEQ ID NO: 3970014 - RNA, 22 nt, Human herpesvirus 4 [Epstein-Barr virus]
gcacacacucccuuagccacac

SEQ ID NO: 3970015 - RNA, 18 nt, Human herpesvirus 4 [Epstein-Barr virus]
gcacagaucugaccacgg

SEQ ID NO: 3970016 - RNA, 18 nt, Human herpesvirus 4 [Epstein-Barr virus]
gcacauauaccgcucggc

SEQ ID NO: 3970017 - RNA, 19 nt, Human herpesvirus 4 [Epstein-Barr virus]
gcaccgggaugagcuggag

SEQ ID NO: 3970018 - RNA, 15 nt, Human herpesvirus 4 [Epstein-Barr virus]
gcacgagauggccca

SEQ ID NO: 3970019 - RNA, 15 nt, Human herpesvirus 4 [Epstein-Barr virus]
gcacggcacccuccc

SEQ ID NO: 3970020 - RNA, 19 nt, Human herpesvirus 4 [Epstein-Barr virus]
gcacgguggcuugggcugu

SEQ ID NO: 3970021 - RNA, 16 nt, Human herpesvirus 4 [Epstein-Barr virus]
gcacucugaccaggac

SEQ ID NO: 3970022 - RNA, 14 nt, Human herpesvirus 4 [Epstein-Barr virus]
gcacuguugcgccc

SEQ ID NO: 3970023 - RNA, 18 nt, Human herpesvirus 4 [Epstein-Barr virus]
gcacuuucuuugcuucac

SEQ ID NO: 3970024 - RNA, 14 nt, Human herpesvirus 4 [Epstein-Barr virus]
gcagagagccacau

SEQ ID NO: 3970025 - RNA, 18 nt, Human herpesvirus 4 [Epstein-Barr virus]
gcagcaacgcccagggac

SEQ ID NO: 3970026 - RNA, 21 nt, Human herpesvirus 4 [Epstein-Barr virus]
gcagcccgcaccccccgccac

SEQ ID NO: 3970027 - RNA, 19 nt, Human herpesvirus 4 [Epstein-Barr virus]
gcagcccggccgaggccug

SEQ ID NO: 3970028 - RNA, 21 nt, Human herpesvirus 4 [Epstein-Barr virus]
gcagcugaggggcaaccugaa

SEQ ID NO: 3970029 - RNA, 13 nt, Human herpesvirus 4 [Epstein-Barr virus]
gcaggagcaggag

SEQ ID NO: 3970030 - RNA, 17 nt, Human herpesvirus 4 [Epstein-Barr virus]
gcaggagcaggagcggg

SEQ ID NO: 3970031 - RNA, 22 nt, Human herpesvirus 4 [Epstein-Barr virus]
gcaggagcaggaggaggggcag

SEQ ID NO: 3970032 - RNA, 18 nt, Human herpesvirus 4 [Epstein-Barr virus]
gcaggaggaggggcagga

SEQ ID NO: 3970033 - RNA, 13 nt, Human herpesvirus 4 [Epstein-Barr virus]
gcaggaggggcag

SEQ ID NO: 3970034 - RNA, 23 nt, Human herpesvirus 4 [Epstein-Barr virus]
gcaggccccccgcaccagggcca

SEQ ID NO: 3970035 - RNA, 16 nt, Human herpesvirus 4 [Epstein-Barr virus]
gcaggugcaccagcuc

SEQ ID NO: 3970036 - RNA, 15 nt, Human herpesvirus 4 [Epstein-Barr virus]
gcaguccaggggcca

SEQ ID NO: 3970037 - RNA, 15 nt, Human herpesvirus 4 [Epstein-Barr virus]
gcauacggcuuucca

SEQ ID NO: 3970038 - RNA, 14 nt, Human herpesvirus 4 [Epstein-Barr virus]
gcaucagaugagac

SEQ ID NO: 3970039 - RNA, 13 nt, Human herpesvirus 4 [Epstein-Barr virus]
gcaucucuuuuac

SEQ ID NO: 3970040 - RNA, 22 nt, Human herpesvirus 4 [Epstein-Barr virus]
gcauggcagcagacaaggacag

SEQ ID NO: 3970041 - RNA, 23 nt, Human herpesvirus 4 [Epstein-Barr virus]
gcauggcgggaguauggggccag

SEQ ID NO: 3970042 - RNA, 21 nt, Human herpesvirus 4 [Epstein-Barr virus]
gcauuggcugcaaagggaccc

SEQ ID NO: 3970043 - RNA, 19 nt, Human herpesvirus 4 [Epstein-Barr virus]
gcauuuuuggugcugccug

SEQ ID NO: 3970044 - RNA, 14 nt, Human herpesvirus 4 [Epstein-Barr virus]
gccaacucccccaa

SEQ ID NO: 3970045 - RNA, 22 nt, Human herpesvirus 4 [Epstein-Barr virus]
gccaaugacccacuccagugcg

SEQ ID NO: 3970046 - RNA, 17 nt, Human herpesvirus 4 [Epstein-Barr virus]
gccaaugggggaggaga

SEQ ID NO: 3970047 - RNA, 20 nt, Human herpesvirus 4 [Epstein-Barr virus]
gccaaugggggaggagagac

SEQ ID NO: 3970048 - RNA, 23 nt, Human herpesvirus 4 [Epstein-Barr virus]
gccacaaccgccgugucagcugu

SEQ ID NO: 3970049 - RNA, 12 nt, Human herpesvirus 4 [Epstein-Barr virus]
gccacacugggg

SEQ ID NO: 3970050 - RNA, 15 nt, Human herpesvirus 4 [Epstein-Barr virus]
gccacccgucccggg

SEQ ID NO: 3970051 - RNA, 17 nt, Human herpesvirus 4 [Epstein-Barr virus]
gccacggcgucaaacag

SEQ ID NO: 3970052 - RNA, 15 nt, Human herpesvirus 4 [Epstein-Barr virus]
ucaagagaucagcaa

SEQ ID NO: 3970053 - RNA, 22 nt, Human herpesvirus 4 [Epstein-Barr virus]
ucaagcuuaugcagcaccucag

SEQ ID NO: 3970054 - RNA, 17 nt, Human herpesvirus 4 [Epstein-Barr virus]
ucaaucuucuucauagc

SEQ ID NO: 3970055 - RNA, 17 nt, Human herpesvirus 4 [Epstein-Barr virus]
ucacauugcaucgcuca

SEQ ID NO: 3970056 - RNA, 11 nt, Human herpesvirus 4 [Epstein-Barr virus]
ucaccagagcc

SEQ ID NO: 3970057 - RNA, 16 nt, Human herpesvirus 4 [Epstein-Barr virus]
ucacccauggccaggc

SEQ ID NO: 3970058 - RNA, 15 nt, Human herpesvirus 4 [Epstein-Barr virus]
ucaccuacaugucaa

SEQ ID NO: 3970059 - RNA, 18 nt, Human herpesvirus 4 [Epstein-Barr virus]
ucacucucaguaauuccc

SEQ ID NO: 3970060 - RNA, 18 nt, Human herpesvirus 4 [Epstein-Barr virus]
ucacugagaaucuccugu

SEQ ID NO: 3970061 - RNA, 21 nt, Human herpesvirus 4 [Epstein-Barr virus]
ucagaagcuacaaacacgggc

SEQ ID NO: 3970062 - RNA, 18 nt, Human herpesvirus 4 [Epstein-Barr virus]
ucagaccugaucagggaa

SEQ ID NO: 3970063 - RNA, 15 nt, Human herpesvirus 4 [Epstein-Barr virus]
ucagcacagccagag

SEQ ID NO: 3970064 - RNA, 17 nt, Human herpesvirus 4 [Epstein-Barr virus]
ucagccacacaaucagc

SEQ ID NO: 3970065 - RNA, 11 nt, Human herpesvirus 4 [Epstein-Barr virus]
ucagccaccuc

SEQ ID NO: 3970066 - RNA, 15 nt, Human herpesvirus 4 [Epstein-Barr virus]
ucagccuccaacagg

SEQ ID NO: 3970067 - RNA, 19 nt, Human herpesvirus 4 [Epstein-Barr virus]
ucagcucaaccgccagggc

SEQ ID NO: 3970068 - RNA, 10 nt, Human herpesvirus 4 [Epstein-Barr virus]
ucagcuccag

SEQ ID NO: 3970069 - RNA, 18 nt, Human herpesvirus 4 [Epstein-Barr virus]
ucagcuccagggccagca

SEQ ID NO: 3970070 - RNA, 20 nt, Human herpesvirus 4 [Epstein-Barr virus]
ucaggagguacaugggccac

SEQ ID NO: 3970071 - RNA, 18 nt, Human herpesvirus 4 [Epstein-Barr virus]
ucaggaucagggccaaga

SEQ ID NO: 3970072 - RNA, 15 nt, Human herpesvirus 4 [Epstein-Barr virus]
ucaggcggaggcacu

SEQ ID NO: 3970073 - RNA, 16 nt, Human herpesvirus 4 [Epstein-Barr virus]
ucauaaccccuaccuc

SEQ ID NO: 3970074 - RNA, 17 nt, Human herpesvirus 4 [Epstein-Barr virus]
ucauccgaggcugagaa

SEQ ID NO: 3970075 - RNA, 18 nt, Human herpesvirus 4 [Epstein-Barr virus]
ucauuuuuagccccagcc

SEQ ID NO: 3970076 - RNA, 23 nt, Human herpesvirus 4 [Epstein-Barr virus]
uccacaccauccacagccccacu

SEQ ID NO: 3970077 - RNA, 22 nt, Human herpesvirus 4 [Epstein-Barr virus]
uccacagccccacucuugccuc

SEQ ID NO: 3970078 - RNA, 22 nt, Human herpesvirus 4 [Epstein-Barr virus]
uccacccccuggagccagcgcu

SEQ ID NO: 3970079 - RNA, 14 nt, Human herpesvirus 4 [Epstein-Barr virus]
uccagaaaaugccg

SEQ ID NO: 3970080 - RNA, 13 nt, Human herpesvirus 4 [Epstein-Barr virus]
uccagagccccuu

SEQ ID NO: 3970081 - RNA, 22 nt, Human herpesvirus 4 [Epstein-Barr virus]
uccagcaaccaauguaucccaa

SEQ ID NO: 3970082 - RNA, 20 nt, Human herpesvirus 4 [Epstein-Barr virus]
uccagcccuugcgccgccuc

SEQ ID NO: 3970083 - RNA, 16 nt, Human herpesvirus 4 [Epstein-Barr virus]
uccagccgggugcaca

SEQ ID NO: 3970084 - RNA, 22 nt, Human herpesvirus 4 [Epstein-Barr virus]
uccagcucggccagcaggccgg

SEQ ID NO: 3970085 - RNA, 19 nt, Human herpesvirus 4 [Epstein-Barr virus]
uccaguuuuuaugugccuc

SEQ ID NO: 3970086 - RNA, 16 nt, Human herpesvirus 4 [Epstein-Barr virus]
uccauuccacccacug

SEQ ID NO: 3970087 - RNA, 13 nt, Human herpesvirus 4 [Epstein-Barr virus]
uccauuucauugc

SEQ ID NO: 3970088 - RNA, 13 nt, Human herpesvirus 4 [Epstein-Barr virus]
ucccaaguacaga

SEQ ID NO: 3970089 - RNA, 19 nt, Human herpesvirus 4 [Epstein-Barr virus]
ucccauguaagccugccuc

SEQ ID NO: 3970090 - RNA, 16 nt, Human herpesvirus 4 [Epstein-Barr virus]
ucccauguuuguaacu

SEQ ID NO: 3970091 - RNA, 11 nt, Human herpesvirus 4 [Epstein-Barr virus]
uccccauggga

SEQ ID NO: 3970092 - RNA, 18 nt, Human herpesvirus 4 [Epstein-Barr virus]
uccccccagaagccccca

SEQ ID NO: 3970093 - RNA, 22 nt, Human herpesvirus 4 [Epstein-Barr virus]
uccccgagggugaggcccagcc

SEQ ID NO: 3970094 - RNA, 13 nt, Human herpesvirus 4 [Epstein-Barr virus]
uccccggccuccc

SEQ ID NO: 3970095 - RNA, 22 nt, Human herpesvirus 4 [Epstein-Barr virus]
uccccugccugcaugcuuagug

SEQ ID NO: 3970096 - RNA, 17 nt, Human herpesvirus 4 [Epstein-Barr virus]
ucccgccccuguccacu

SEQ ID NO: 3970097 - RNA, 20 nt, Human herpesvirus 4 [Epstein-Barr virus]
ucccgugcuuuuugccaggc

SEQ ID NO: 3970098 - RNA, 12 nt, Human herpesvirus 4 [Epstein-Barr virus]
ucccucugggag

SEQ ID NO: 3970099 - RNA, 21 nt, Human herpesvirus 4 [Epstein-Barr virus]
ucccugggggccugugucuuc

SEQ ID NO: 3970100 - RNA, 11 nt, Human herpesvirus 4 [Epstein-Barr virus]
ucccuuccuuu

SEQ ID NO: 3970101 - RNA, 19 nt, Human herpesvirus 4 [Epstein-Barr virus]
uccguccuuguccaggaga

SEQ ID NO: 3970102 - RNA, 18 nt, Human herpesvirus 4 [Epstein-Barr virus]
gagcuccgugagcaggag

SEQ ID NO: 3970103 - RNA, 14 nt, Human herpesvirus 4 [Epstein-Barr virus]
gagcuggagacccg

SEQ ID NO: 3970104 - RNA, 20 nt, Human herpesvirus 4 [Epstein-Barr virus]
gagcugggcaaagauuuucu

SEQ ID NO: 3970105 - RNA, 17 nt, Human herpesvirus 4 [Epstein-Barr virus]
gagcuuccuggccggcc

SEQ ID NO: 3970106 - RNA, 17 nt, Human herpesvirus 4 [Epstein-Barr virus]
gaggacacgcuggucuu

SEQ ID NO: 3970107 - RNA, 19 nt, Human herpesvirus 4 [Epstein-Barr virus]
gaggacggugucugugguu

SEQ ID NO: 3970108 - RNA, 18 nt, Human herpesvirus 4 [Epstein-Barr virus]
gaggagcaccggagccac

SEQ ID NO: 3970109 - RNA, 12 nt, Human herpesvirus 4 [Epstein-Barr virus]
gaggaggcacac

SEQ ID NO: 3970110 - RNA, 18 nt, Human herpesvirus 4 [Epstein-Barr virus]
gaggauaaucugggcagc

SEQ ID NO: 3970111 - RNA, 24 nt, Human herpesvirus 4 [Epstein-Barr virus]
gaggauggcacgguccagaagcag

SEQ ID NO: 3970112 - RNA, 14 nt, Human herpesvirus 4 [Epstein-Barr virus]
gaggccguguuucu

SEQ ID NO: 3970113 - RNA, 12 nt, Human herpesvirus 4 [Epstein-Barr virus]
gaggccugagag

SEQ ID NO: 3970114 - RNA, 17 nt, Human herpesvirus 4 [Epstein-Barr virus]
gaggcggaagaccagga

SEQ ID NO: 3970115 - RNA, 18 nt, Human herpesvirus 4 [Epstein-Barr virus]
gagggcagcgaagaacac

SEQ ID NO: 3970116 - RNA, 18 nt, Human herpesvirus 4 [Epstein-Barr virus]
gaggggcaggagcaggag

SEQ ID NO: 3970117 - RNA, 11 nt, Human herpesvirus 4 [Epstein-Barr virus]
gagggggacaa

SEQ ID NO: 3970118 - RNA, 21 nt, Human herpesvirus 4 [Epstein-Barr virus]
gaggggggcggcguggagcug

SEQ ID NO: 3970119 - RNA, 21 nt, Human herpesvirus 4 [Epstein-Barr virus]
gagucagccuugcccccgcca

SEQ ID NO: 3970120 - RNA, 14 nt, Human herpesvirus 4 [Epstein-Barr virus]
gagucccuccucac

SEQ ID NO: 3970121 - RNA, 21 nt, Human herpesvirus 4 [Epstein-Barr virus]
gagugcccuggaggccucagg

SEQ ID NO: 3970122 - RNA, 21 nt, Human herpesvirus 4 [Epstein-Barr virus]
gaguuggcaucuuccuccuug

SEQ ID NO: 3970123 - RNA, 18 nt, Human herpesvirus 4 [Epstein-Barr virus]
gauacucaucugugagac

SEQ ID NO: 3970124 - RNA, 12 nt, Human herpesvirus 4 [Epstein-Barr virus]
gauccgccagga

SEQ ID NO: 3970125 - RNA, 15 nt, Human herpesvirus 4 [Epstein-Barr virus]
gaucuccuuuggcuc

SEQ ID NO: 3970126 - RNA, 18 nt, Human herpesvirus 4 [Epstein-Barr virus]
gaugcccaguuaugggua

SEQ ID NO: 3970127 - RNA, 13 nt, Human herpesvirus 4 [Epstein-Barr virus]
gauggcacgggca

SEQ ID NO: 3970128 - RNA, 19 nt, Human herpesvirus 4 [Epstein-Barr virus]
gauggccuccagcucggcc

SEQ ID NO: 3970129 - RNA, 22 nt, Human herpesvirus 4 [Epstein-Barr virus]
gauggcgacuuuguuuagggac

SEQ ID NO: 3970130 - RNA, 12 nt, Human herpesvirus 4 [Epstein-Barr virus]
gauggguggaga

SEQ ID NO: 3970131 - RNA, 13 nt, Human herpesvirus 4 [Epstein-Barr virus]
gauguagacaagu

SEQ ID NO: 3970132 - RNA, 21 nt, Human herpesvirus 4 [Epstein-Barr virus]
cugccccucagccugcuccug

SEQ ID NO: 3970133 - RNA, 17 nt, Human herpesvirus 4 [Epstein-Barr virus]
cugcccuccuccaccca

SEQ ID NO: 3970134 - RNA, 21 nt, Human herpesvirus 4 [Epstein-Barr virus]
cugccuggaucugagcuaugu

SEQ ID NO: 3970135 - RNA, 14 nt, Human herpesvirus 4 [Epstein-Barr virus]
cugccuggauucuu

SEQ ID NO: 3970136 - RNA, 23 nt, Human herpesvirus 4 [Epstein-Barr virus]
cugccuggauucuuacagcagga

SEQ ID NO: 3970137 - RNA, 22 nt, Human herpesvirus 4 [Epstein-Barr virus]
cugcgccugagcugccugguga

SEQ ID NO: 3970138 - RNA, 13 nt, Human herpesvirus 4 [Epstein-Barr virus]
cugcgccuuuagg

SEQ ID NO: 3970139 - RNA, 17 nt, Human herpesvirus 4 [Epstein-Barr virus]
cugcguccaccuggcca

SEQ ID NO: 3970140 - RNA, 14 nt, Human herpesvirus 4 [Epstein-Barr virus]
cugcguggcaccaa

SEQ ID NO: 3970141 - RNA, 15 nt, Human herpesvirus 4 [Epstein-Barr virus]
cugcuacuacugccu

SEQ ID NO: 3970142 - RNA, 17 nt, Human herpesvirus 4 [Epstein-Barr virus]
cugcucccgccucaggg

SEQ ID NO: 3970143 - RNA, 18 nt, Human herpesvirus 4 [Epstein-Barr virus]
cugcucccgccucaggga

SEQ ID NO: 3970144 - RNA, 19 nt, Human herpesvirus 4 [Epstein-Barr virus]
cugcuccgcguggagcugg

SEQ ID NO: 3970145 - RNA, 14 nt, Human herpesvirus 4 [Epstein-Barr virus]
cugcucgccccugg

SEQ ID NO: 3970146 - RNA, 16 nt, Human herpesvirus 4 [Epstein-Barr virus]
cugcugccgucccagg

SEQ ID NO: 3970147 - RNA, 22 nt, Human herpesvirus 4 [Epstein-Barr virus]
cugcuucuggcucuucugggaa

SEQ ID NO: 3970148 - RNA, 22 nt, Human herpesvirus 4 [Epstein-Barr virus]
cugcuugugaucauggaaacca

SEQ ID NO: 3970149 - RNA, 22 nt, Human herpesvirus 4 [Epstein-Barr virus]
cuggacgcgcagugccaagagc

SEQ ID NO: 3970150 - RNA, 16 nt, Human herpesvirus 4 [Epstein-Barr virus]
cuggauucuuacagca

SEQ ID NO: 3970151 - RNA, 15 nt, Human herpesvirus 4 [Epstein-Barr virus]
cuggcaacuccucuu

SEQ ID NO: 3970152 - RNA, 14 nt, Human herpesvirus 4 [Epstein-Barr virus]
cuggcacacacucc

SEQ ID NO: 3970153 - RNA, 15 nt, Human herpesvirus 4 [Epstein-Barr virus]
cuggcaccuguccuu

SEQ ID NO: 3970154 - RNA, 13 nt, Human herpesvirus 4 [Epstein-Barr virus]
auggaggggcggc

SEQ ID NO: 3970155 - RNA, 16 nt, Human herpesvirus 4 [Epstein-Barr virus]
auggcacgggcagagg

SEQ ID NO: 3970156 - RNA, 18 nt, Human herpesvirus 4 [Epstein-Barr virus]
auggccacgacuauccag

SEQ ID NO: 3970157 - RNA, 17 nt, Human herpesvirus 4 [Epstein-Barr virus]
auggccgccacccuccc

SEQ ID NO: 3970158 - RNA, 19 nt, Human herpesvirus 4 [Epstein-Barr virus]
augggggaaugagggaaaa

SEQ ID NO: 3970159 - RNA, 19 nt, Human herpesvirus 4 [Epstein-Barr virus]
auggucgucaucuggcucu

SEQ ID NO: 3970160 - RNA, 18 nt, Human herpesvirus 4 [Epstein-Barr virus]
auguagcuauacuuucuu

SEQ ID NO: 3970161 - RNA, 14 nt, Human herpesvirus 4 [Epstein-Barr virus]
auguauugggacuu

SEQ ID NO: 3970162 - RNA, 14 nt, Human herpesvirus 4 [Epstein-Barr virus]
auguccacugagca

SEQ ID NO: 3970163 - RNA, 14 nt, Human herpesvirus 4 [Epstein-Barr virus]
augucggggcugcu

SEQ ID NO: 3970164 - RNA, 15 nt, Human herpesvirus 4 [Epstein-Barr virus]
auguggugggggcua

SEQ ID NO: 3970165 - RNA, 22 nt, Human herpesvirus 4 [Epstein-Barr virus]
auguucccggcacaccagacau

SEQ ID NO: 3970166 - RNA, 17 nt, Human herpesvirus 4 [Epstein-Barr virus]
auguuuuccccauguug

SEQ ID NO: 3970167 - RNA, 21 nt, Human herpesvirus 4 [Epstein-Barr virus]
auguuuuuggcauguguacuu

SEQ ID NO: 3970168 - RNA, 13 nt, Human herpesvirus 4 [Epstein-Barr virus]
auuagcagccucc

SEQ ID NO: 3970169 - RNA, 13 nt, Human herpesvirus 4 [Epstein-Barr virus]
auucacaucucag

SEQ ID NO: 3970170 - RNA, 14 nt, Human herpesvirus 4 [Epstein-Barr virus]
auucaucagaagcu

SEQ ID NO: 3970171 - RNA, 12 nt, Human herpesvirus 4 [Epstein-Barr virus]
auuccacccacu

SEQ ID NO: 3970172 - RNA, 21 nt, Human herpesvirus 4 [Epstein-Barr virus]
auucuaugggaauaacaaggg

SEQ ID NO: 3970173 - RNA, 16 nt, Human herpesvirus 4 [Epstein-Barr virus]
auugaggacccaccuu

SEQ ID NO: 3970174 - RNA, 19 nt, Human herpesvirus 4 [Epstein-Barr virus]
auugcugagaaccugcugc

SEQ ID NO: 3970175 - RNA, 13 nt, Human herpesvirus 4 [Epstein-Barr virus]
auuguacagagcu

SEQ ID NO: 3970176 - RNA, 13 nt, Human herpesvirus 4 [Epstein-Barr virus]
auuguugcgcccu

SEQ ID NO: 3970177 - RNA, 22 nt, Human herpesvirus 4 [Epstein-Barr virus]
auuuacgguuagugugccucug

SEQ ID NO: 3970178 - RNA, 14 nt, Human herpesvirus 4 [Epstein-Barr virus]
auuuugccugaagc

SEQ ID NO: 3970179 - RNA, 20 nt, Human herpesvirus 4 [Epstein-Barr virus]
auuuugggcacacuuaacuu

SEQ ID NO: 3970180 - RNA, 16 nt, Human herpesvirus 4 [Epstein-Barr virus]
caaaaguagaggcuca

SEQ ID NO: 3970181 - RNA, 21 nt, Human herpesvirus 4 [Epstein-Barr virus]
caaaaucaaaguaguuggagc

SEQ ID NO: 3970182 - RNA, 14 nt, Human herpesvirus 4 [Epstein-Barr virus]
caaacauguccugu

SEQ ID NO: 3970183 - RNA, 22 nt, Human herpesvirus 4 [Epstein-Barr virus]
caaacugacacacaggccuggc

SEQ ID NO: 3970184 - RNA, 23 nt, Human herpesvirus 4 [Epstein-Barr virus]
caaagcugaagaacggacugcgg

SEQ ID NO: 3970185 - RNA, 23 nt, Human herpesvirus 4 [Epstein-Barr virus]
caaagguguagaagugugucccc

SEQ ID NO: 3970186 - RNA, 22 nt, Human herpesvirus 4 [Epstein-Barr virus]
caaagucaagggaaaggaaggg

SEQ ID NO: 3970187 - RNA, 13 nt, Human herpesvirus 4 [Epstein-Barr virus]
caaauaaauguua

SEQ ID NO: 3970188 - RNA, 19 nt, Human herpesvirus 4 [Epstein-Barr virus]
caacaaggagugccucugg

SEQ ID NO: 3970189 - RNA, 19 nt, Human herpesvirus 4 [Epstein-Barr virus]
caacagacugcggggagga

SEQ ID NO: 3970190 - RNA, 13 nt, Human herpesvirus 4 [Epstein-Barr virus]
caacagccagaau

SEQ ID NO: 3970191 - RNA, 20 nt, Human herpesvirus 4 [Epstein-Barr virus]
caacaggugcccgagccccg

SEQ ID NO: 3970192 - RNA, 18 nt, Human herpesvirus 4 [Epstein-Barr virus]
caacauuaaagccuccuc

SEQ ID NO: 3970193 - RNA, 15 nt, Human herpesvirus 4 [Epstein-Barr virus]
caaccaagccacuac

SEQ ID NO: 3970194 - RNA, 14 nt, Human herpesvirus 4 [Epstein-Barr virus]
caaccuggagacaa

SEQ ID NO: 3970195 - RNA, 16 nt, Human herpesvirus 4 [Epstein-Barr virus]
caacgaucccaggccu

SEQ ID NO: 3970196 - RNA, 18 nt, Human herpesvirus 4 [Epstein-Barr virus]
caacgccggccugcuggc

SEQ ID NO: 3970197 - RNA, 22 nt, Human herpesvirus 4 [Epstein-Barr virus]
caacgccuuuuuccuagcuuau

SEQ ID NO: 3970198 - RNA, 16 nt, Human herpesvirus 4 [Epstein-Barr virus]
caacuacaagcagcua

SEQ ID NO: 3970199 - RNA, 21 nt, Human herpesvirus 4 [Epstein-Barr virus]
caagaacccccugcaggacac

SEQ ID NO: 3970200 - RNA, 12 nt, Human herpesvirus 4 [Epstein-Barr virus]
caagcagcaccu

SEQ ID NO: 3970201 - RNA, 13 nt, Human herpesvirus 4 [Epstein-Barr virus]
caagcagcuagag

SEQ ID NO: 3970202 - RNA, 20 nt, Human herpesvirus 4 [Epstein-Barr virus]
caagcagguauugcagcugg

SEQ ID NO: 3970203 - RNA, 20 nt, Human herpesvirus 4 [Epstein-Barr virus]
caagcuuaugcagcaccuca

SEQ ID NO: 3970204 - RNA, 21 nt, Human herpesvirus 4 [Epstein-Barr virus]
caaggaaacaaaaccacugac

SEQ ID NO: 3970205 - RNA, 15 nt, Human herpesvirus 4 [Epstein-Barr virus]
caaggacaacagcua

SEQ ID NO: 3970206 - RNA, 17 nt, Human herpesvirus 4 [Epstein-Barr virus]
caaggcagucuccaccu

SEQ ID NO: 3970207 - RNA, 22 nt, Human herpesvirus 4 [Epstein-Barr virus]
caagggaggagugcugcaggua

SEQ ID NO: 3970208 - RNA, 23 nt, Human herpesvirus 4 [Epstein-Barr virus]
caauuggcacucacccccgagga

SEQ ID NO: 3970209 - RNA, 12 nt, Human herpesvirus 4 [Epstein-Barr virus]
cacaacagccag

SEQ ID NO: 3970210 - RNA, 16 nt, Human herpesvirus 4 [Epstein-Barr virus]
cacaacagccagaauc

SEQ ID NO: 3970211 - RNA, 18 nt, Human herpesvirus 4 [Epstein-Barr virus]
cacaccaucccaauucac

SEQ ID NO: 3970212 - RNA, 19 nt, Human herpesvirus 4 [Epstein-Barr virus]
cacagaaacuacacggccu

SEQ ID NO: 3970213 - RNA, 16 nt, Human herpesvirus 4 [Epstein-Barr virus]
cacagaggaggcuggu

SEQ ID NO: 3970214 - RNA, 22 nt, Human herpesvirus 4 [Epstein-Barr virus]
cacagaggugauguagaggcgc

SEQ ID NO: 3970215 - RNA, 18 nt, Human herpesvirus 4 [Epstein-Barr virus]
cacagccugcaccagugg

SEQ ID NO: 3970216 - RNA, 13 nt, Human herpesvirus 4 [Epstein-Barr virus]
cacagcugcuggu

SEQ ID NO: 3970217 - RNA, 13 nt, Human herpesvirus 4 [Epstein-Barr virus]
cacaucucaggga

SEQ ID NO: 3970218 - RNA, 15 nt, Human herpesvirus 4 [Epstein-Barr virus]
cacaucuggcaccug

SEQ ID NO: 3970219 - RNA, 13 nt, Human herpesvirus 4 [Epstein-Barr virus]
cacauucggguga

SEQ ID NO: 3970220 - RNA, 14 nt, Human herpesvirus 4 [Epstein-Barr virus]
caccaacacaacca

SEQ ID NO: 3970221 - RNA, 19 nt, Human herpesvirus 4 [Epstein-Barr virus]
caccacccccaccaccucc

SEQ ID NO: 3970222 - RNA, 18 nt, Human herpesvirus 4 [Epstein-Barr virus]
caccacucccaccacccc

SEQ ID NO: 3970223 - RNA, 18 nt, Human herpesvirus 4 [Epstein-Barr virus]
caccagcuucgagagcca

SEQ ID NO: 3970224 - RNA, 18 nt, Human herpesvirus 4 [Epstein-Barr virus]
caccagggaggccuggga

SEQ ID NO: 3970225 - RNA, 14 nt, Human herpesvirus 4 [Epstein-Barr virus]
caccagggccaggc

SEQ ID NO: 3970226 - RNA, 18 nt, Human herpesvirus 4 [Epstein-Barr virus]
caccaucuggcagcuuuu

SEQ ID NO: 3970227 - RNA, 15 nt, Human herpesvirus 4 [Epstein-Barr virus]
cacccaccuaugcca

SEQ ID NO: 3970228 - RNA, 20 nt, Human herpesvirus 4 [Epstein-Barr virus]
cacccacugauaauacgccc

SEQ ID NO: 3970229 - RNA, 17 nt, Human herpesvirus 4 [Epstein-Barr virus]
caccccacggccaugcu

SEQ ID NO: 3970230 - RNA, 18 nt, Human herpesvirus 4 [Epstein-Barr virus]
cacccccuggagccagcg

SEQ ID NO: 3970231 - RNA, 17 nt, Human herpesvirus 4 [Epstein-Barr virus]
caccccuccuacacaca

SEQ ID NO: 3970232 - RNA, 15 nt, Human herpesvirus 4 [Epstein-Barr virus]
cacccgucccgggua

SEQ ID NO: 3970233 - RNA, 21 nt, Human herpesvirus 4 [Epstein-Barr virus]
cacccuggccgugcuggauga

SEQ ID NO: 3970234 - RNA, 17 nt, Human herpesvirus 4 [Epstein-Barr virus]
caccggagccaccacag

SEQ ID NO: 3970235 - RNA, 15 nt, Human herpesvirus 4 [Epstein-Barr virus]
caccggggaggccag

SEQ ID NO: 3970236 - RNA, 20 nt, Human herpesvirus 4 [Epstein-Barr virus]
caccgucagccacacaauca

SEQ ID NO: 3970237 - RNA, 15 nt, Human herpesvirus 4 [Epstein-Barr virus]
caccgugggaaaaua

SEQ ID NO: 3970238 - RNA, 17 nt, Human herpesvirus 4 [Epstein-Barr virus]
caccuagaaagagccau

SEQ ID NO: 3970239 - RNA, 17 nt, Human herpesvirus 4 [Epstein-Barr virus]
caccucaaccuggagac

SEQ ID NO: 3970240 - RNA, 22 nt, Human herpesvirus 4 [Epstein-Barr virus]
caccugucugacuuggccccug

SEQ ID NO: 3970241 - RNA, 17 nt, Human herpesvirus 4 [Epstein-Barr virus]
caccuugccggccaccu

SEQ ID NO: 3970242 - RNA, 22 nt, Human herpesvirus 4 [Epstein-Barr virus]
cuaucaggaccugggagggcca

SEQ ID NO: 3970243 - RNA, 12 nt, Human herpesvirus 4 [Epstein-Barr virus]
cuaugacaccua

SEQ ID NO: 3970244 - RNA, 17 nt, Human herpesvirus 4 [Epstein-Barr virus]
cuaugcaugagccacag

SEQ ID NO: 3970245 - RNA, 13 nt, Human herpesvirus 4 [Epstein-Barr virus]
cucacaggacaug

SEQ ID NO: 3970246 - RNA, 16 nt, Human herpesvirus 4 [Epstein-Barr virus]
cucaccguggcagaca

SEQ ID NO: 3970247 - RNA, 18 nt, Human herpesvirus 4 [Epstein-Barr virus]
cucacuucuacucuuggc

SEQ ID NO: 3970248 - RNA, 19 nt, Human herpesvirus 4 [Epstein-Barr virus]
cucagaauuucugcuagcu

SEQ ID NO: 3970249 - RNA, 17 nt, Human herpesvirus 4 [Epstein-Barr virus]
cucagagggggugccug

SEQ ID NO: 3970250 - RNA, 20 nt, Human herpesvirus 4 [Epstein-Barr virus]
cucagcuguucccagucucc

SEQ ID NO: 3970251 - RNA, 16 nt, Human herpesvirus 4 [Epstein-Barr virus]
cucaggaagcuggcca

SEQ ID NO: 3970252 - RNA, 23 nt, Human herpesvirus 4 [Epstein-Barr virus]
cucaggcacggucgccccuccga

SEQ ID NO: 3970253 - RNA, 14 nt, Human herpesvirus 4 [Epstein-Barr virus]
cucaggccgccgca

SEQ ID NO: 3970254 - RNA, 23 nt, Human herpesvirus 4 [Epstein-Barr virus]
cucagggccacggcgugccagag

SEQ ID NO: 3970255 - RNA, 16 nt, Human herpesvirus 4 [Epstein-Barr virus]
cucauaccuccacuua

SEQ ID NO: 3970256 - RNA, 16 nt, Human herpesvirus 4 [Epstein-Barr virus]
cucaucgcacgggggu

SEQ ID NO: 3970257 - RNA, 21 nt, Human herpesvirus 4 [Epstein-Barr virus]
cuccaacgaggaucccgcagg

SEQ ID NO: 3970258 - RNA, 20 nt, Human herpesvirus 4 [Epstein-Barr virus]
cuccaccagcuucucaaagg

SEQ ID NO: 3970259 - RNA, 17 nt, Human herpesvirus 4 [Epstein-Barr virus]
cuccagcucggccagca

SEQ ID NO: 3970260 - RNA, 14 nt, Human herpesvirus 4 [Epstein-Barr virus]
auggcggccuggca

SEQ ID NO: 3970261 - RNA, 21 nt, Human herpesvirus 4 [Epstein-Barr virus]
augggggaaugagggaaaagg

SEQ ID NO: 3970262 - RNA, 13 nt, Human herpesvirus 4 [Epstein-Barr virus]
auggguccucaua

SEQ ID NO: 3970263 - RNA, 12 nt, Human herpesvirus 4 [Epstein-Barr virus]
augggugcauuu

SEQ ID NO: 3970264 - RNA, 12 nt, Human herpesvirus 4 [Epstein-Barr virus]
auguacccaucc

SEQ ID NO: 3970265 - RNA, 20 nt, Human herpesvirus 4 [Epstein-Barr virus]
auguacccaucccggcccuc

SEQ ID NO: 3970266 - RNA, 21 nt, Human herpesvirus 4 [Epstein-Barr virus]
augucaaggcucugcacagga

SEQ ID NO: 3970267 - RNA, 13 nt, Human herpesvirus 4 [Epstein-Barr virus]
augucagcuccac

SEQ ID NO: 3970268 - RNA, 23 nt, Human herpesvirus 4 [Epstein-Barr virus]
auguccaaaaggucaaagaacaa

SEQ ID NO: 3970269 - RNA, 17 nt, Human herpesvirus 4 [Epstein-Barr virus]
augucggcuaaugccau

SEQ ID NO: 3970270 - RNA, 18 nt, Human herpesvirus 4 [Epstein-Barr virus]
augucugacgaggggcca

SEQ ID NO: 3970271 - RNA, 20 nt, Human herpesvirus 4 [Epstein-Barr virus]
auguuuggguuauugacauc

SEQ ID NO: 3970272 - RNA, 19 nt, Human herpesvirus 4 [Epstein-Barr virus]
auuaagagucccuccucac

SEQ ID NO: 3970273 - RNA, 17 nt, Human herpesvirus 4 [Epstein-Barr virus]
auuacggugcuggagau

SEQ ID NO: 3970274 - RNA, 16 nt, Human herpesvirus 4 [Epstein-Barr virus]
auuacuggcgugaauu

SEQ ID NO: 3970275 - RNA, 19 nt, Human herpesvirus 4 [Epstein-Barr virus]
auuagcacgguagccuugg

SEQ ID NO: 3970276 - RNA, 16 nt, Human herpesvirus 4 [Epstein-Barr virus]
auuauauuguaagaca

SEQ ID NO: 3970277 - RNA, 13 nt, Human herpesvirus 4 [Epstein-Barr virus]
auuccacccacug

SEQ ID NO: 3970278 - RNA, 13 nt, Human herpesvirus 4 [Epstein-Barr virus]
auuccccugccug

SEQ ID NO: 3970279 - RNA, 20 nt, Human herpesvirus 4 [Epstein-Barr virus]
auucccucgaaucccuacca

SEQ ID NO: 3970280 - RNA, 23 nt, Human herpesvirus 4 [Epstein-Barr virus]
auucuccugccugccucugcucu

SEQ ID NO: 3970281 - RNA, 21 nt, Human herpesvirus 4 [Epstein-Barr virus]
auugaaaccacgccugcuuca

SEQ ID NO: 3970282 - RNA, 21 nt, Human herpesvirus 4 [Epstein-Barr virus]
auuggacgucccuuuggagga

SEQ ID NO: 3970283 - RNA, 17 nt, Human herpesvirus 4 [Epstein-Barr virus]
auugggugaccacugag

SEQ ID NO: 3970284 - RNA, 14 nt, Human herpesvirus 4 [Epstein-Barr virus]
auuuacaaacacua

SEQ ID NO: 3970285 - RNA, 13 nt, Human herpesvirus 4 [Epstein-Barr virus]
auuucauccucag

SEQ ID NO: 3970286 - RNA, 17 nt, Human herpesvirus 4 [Epstein-Barr virus]
auuucugcuagcuucag

SEQ ID NO: 3970287 - RNA, 22 nt, Human herpesvirus 4 [Epstein-Barr virus]
auuugaggaggcacacaaaaug

SEQ ID NO: 3970288 - RNA, 14 nt, Human herpesvirus 4 [Epstein-Barr virus]
auuuugggccagga

SEQ ID NO: 3970289 - RNA, 17 nt, Human herpesvirus 4 [Epstein-Barr virus]
caaacagcagcagcagu

SEQ ID NO: 3970290 - RNA, 15 nt, Human herpesvirus 4 [Epstein-Barr virus]
caaacauaaaugccc

SEQ ID NO: 3970291 - RNA, 12 nt, Human herpesvirus 4 [Epstein-Barr virus]
caaacaugggcu

SEQ ID NO: 3970292 - RNA, 17 nt, Human herpesvirus 4 [Epstein-Barr virus]
caaacugacacacaggc

SEQ ID NO: 3970293 - RNA, 21 nt, Human herpesvirus 4 [Epstein-Barr virus]
caacagcgaccggcagauccc

SEQ ID NO: 3970294 - RNA, 22 nt, Human herpesvirus 4 [Epstein-Barr virus]
caaccaauguaucccaaauaaa

SEQ ID NO: 3970295 - RNA, 17 nt, Human herpesvirus 4 [Epstein-Barr virus]
caacccuaacacucuuu

SEQ ID NO: 3970296 - RNA, 12 nt, Human herpesvirus 4 [Epstein-Barr virus]
caacgccccugc

SEQ ID NO: 3970297 - RNA, 18 nt, Human herpesvirus 4 [Epstein-Barr virus]
caacguccgugagagccu

SEQ ID NO: 3970298 - RNA, 14 nt, Human herpesvirus 4 [Epstein-Barr virus]
caacugucacacca

SEQ ID NO: 3970299 - RNA, 14 nt, Human herpesvirus 4 [Epstein-Barr virus]
caagaguucucugg

SEQ ID NO: 3970300 - RNA, 17 nt, Human herpesvirus 4 [Epstein-Barr virus]
caagcaaacggccuggc

SEQ ID NO: 3970301 - RNA, 12 nt, Human herpesvirus 4 [Epstein-Barr virus]
caagcagcucac

SEQ ID NO: 3970302 - RNA, 15 nt, Human herpesvirus 4 [Epstein-Barr virus]
caagcuaccagaguc

SEQ ID NO: 3970303 - RNA, 19 nt, Human herpesvirus 4 [Epstein-Barr virus]
caaggauggaagagagggg

SEQ ID NO: 3970304 - RNA, 22 nt, Human herpesvirus 4 [Epstein-Barr virus]
caaggauggcacgggcagagga

SEQ ID NO: 3970305 - RNA, 18 nt, Human herpesvirus 4 [Epstein-Barr virus]
caaggcggcugcugagac

SEQ ID NO: 3970306 - RNA, 23 nt, Human herpesvirus 4 [Epstein-Barr virus]
caaggucuggaggacggucuggc

SEQ ID NO: 3970307 - RNA, 22 nt, Human herpesvirus 4 [Epstein-Barr virus]
caaggugucaauaauuucagug

SEQ ID NO: 3970308 - RNA, 16 nt, Human herpesvirus 4 [Epstein-Barr virus]
caagguugaagagcag

SEQ ID NO: 3970309 - RNA, 17 nt, Human herpesvirus 4 [Epstein-Barr virus]
caaguguuuccagacac

SEQ ID NO: 3970310 - RNA, 21 nt, Human herpesvirus 4 [Epstein-Barr virus]
caaguuuaagcaacugcugca

SEQ ID NO: 3970311 - RNA, 22 nt, Human herpesvirus 4 [Epstein-Barr virus]
caauaaaguugaugauauugaa

SEQ ID NO: 3970312 - RNA, 19 nt, Human herpesvirus 4 [Epstein-Barr virus]
caauaaauaaaaguacaga

SEQ ID NO: 3970313 - RNA, 19 nt, Human herpesvirus 4 [Epstein-Barr virus]
caauauccaucugcuucug

SEQ ID NO: 3970314 - RNA, 15 nt, Human herpesvirus 4 [Epstein-Barr virus]
caaucaccagccacc

SEQ ID NO: 3970315 - RNA, 15 nt, Human herpesvirus 4 [Epstein-Barr virus]
caaugagagggacuu

SEQ ID NO: 3970316 - RNA, 17 nt, Human herpesvirus 4 [Epstein-Barr virus]
caaugccaacuccccca

SEQ ID NO: 3970317 - RNA, 15 nt, Human herpesvirus 4 [Epstein-Barr virus]
caauggucgccaggg

SEQ ID NO: 3970318 - RNA, 16 nt, Human herpesvirus 4 [Epstein-Barr virus]
caauggucgccagggu

SEQ ID NO: 3970319 - RNA, 19 nt, Human herpesvirus 4 [Epstein-Barr virus]
caauuaggcuaaaagcagc

SEQ ID NO: 3970320 - RNA, 23 nt, Human herpesvirus 4 [Epstein-Barr virus]
cacaaaaugaggaacggugauua

SEQ ID NO: 3970321 - RNA, 22 nt, Human herpesvirus 4 [Epstein-Barr virus]
cacaaccacggugacauucacu

SEQ ID NO: 3970322 - RNA, 12 nt, Human herpesvirus 4 [Epstein-Barr virus]
cacaccauccca

SEQ ID NO: 3970323 - RNA, 15 nt, Human herpesvirus 4 [Epstein-Barr virus]
cacaccuuggcgggu

SEQ ID NO: 3970324 - RNA, 15 nt, Human herpesvirus 4 [Epstein-Barr virus]
cacacucccuccaga

SEQ ID NO: 3970325 - RNA, 16 nt, Human herpesvirus 4 [Epstein-Barr virus]
cacagaccagccccuc

SEQ ID NO: 3970326 - RNA, 15 nt, Human herpesvirus 4 [Epstein-Barr virus]
cacagcgccagcagg

SEQ ID NO: 3970327 - RNA, 23 nt, Human herpesvirus 4 [Epstein-Barr virus]
cacaggacaacggcauucccgug

SEQ ID NO: 3970328 - RNA, 15 nt, Human herpesvirus 4 [Epstein-Barr virus]
cacaggcauugcuaa

SEQ ID NO: 3970329 - RNA, 20 nt, Human herpesvirus 4 [Epstein-Barr virus]
cacauuggacacccacccug

SEQ ID NO: 3970330 - RNA, 12 nt, Human herpesvirus 4 [Epstein-Barr virus]
caccaccacccc

SEQ ID NO: 3970331 - RNA, 13 nt, Human herpesvirus 4 [Epstein-Barr virus]
caccagaucgccu

SEQ ID NO: 3970332 - RNA, 13 nt, Human herpesvirus 4 [Epstein-Barr virus]
caccagcuccagg

SEQ ID NO: 3970333 - RNA, 20 nt, Human herpesvirus 4 [Epstein-Barr virus]
caccagcuccagggacaggg

SEQ ID NO: 3970334 - RNA, 12 nt, Human herpesvirus 4 [Epstein-Barr virus]
caccauccacag

SEQ ID NO: 3970335 - RNA, 14 nt, Human herpesvirus 4 [Epstein-Barr virus]
cacccacuacaccc

SEQ ID NO: 3970336 - RNA, 18 nt, Human herpesvirus 4 [Epstein-Barr virus]
cacccacugauaauacgc

SEQ ID NO: 3970337 - RNA, 22 nt, Human herpesvirus 4 [Epstein-Barr virus]
cacccucggagaucaucccacu

SEQ ID NO: 3970338 - RNA, 15 nt, Human herpesvirus 4 [Epstein-Barr virus]
cacccuguacacccc

SEQ ID NO: 3970339 - RNA, 15 nt, Human herpesvirus 4 [Epstein-Barr virus]
caccgggaugagcug

SEQ ID NO: 3970340 - RNA, 20 nt, Human herpesvirus 4 [Epstein-Barr virus]
caccggggaggccagguagc

SEQ ID NO: 3970341 - RNA, 15 nt, Human herpesvirus 4 [Epstein-Barr virus]
caccgucagccacac

SEQ ID NO: 3970342 - RNA, 16 nt, Human herpesvirus 4 [Epstein-Barr virus]
caccgucagccacaca

SEQ ID NO: 3970343 - RNA, 15 nt, Human herpesvirus 4 [Epstein-Barr virus]
caccuagcccacucc

SEQ ID NO: 3970344 - RNA, 15 nt, Human herpesvirus 4 [Epstein-Barr virus]
caccugcacagaucu

SEQ ID NO: 3970345 - RNA, 21 nt, Human herpesvirus 4 [Epstein-Barr virus]
caccuguccuugucugcugcc

SEQ ID NO: 3970346 - RNA, 20 nt, Human herpesvirus 4 [Epstein-Barr virus]
cacgacuacgagggccucug

SEQ ID NO: 3970347 - RNA, 22 nt, Human herpesvirus 4 [Epstein-Barr virus]
cacgacuguuccuauaugcucu

SEQ ID NO: 3970348 - RNA, 21 nt, Human herpesvirus 4 [Epstein-Barr virus]
agacacgucguucaugagagg

SEQ ID NO: 3970349 - RNA, 11 nt, Human herpesvirus 4 [Epstein-Barr virus]
agaccaaggcc

SEQ ID NO: 3970350 - RNA, 14 nt, Human herpesvirus 4 [Epstein-Barr virus]
agaccaaggcccua

SEQ ID NO: 3970351 - RNA, 22 nt, Human herpesvirus 4 [Epstein-Barr virus]
agaccccggguugguggcacug

SEQ ID NO: 3970352 - RNA, 21 nt, Human herpesvirus 4 [Epstein-Barr virus]
agaccccugggcucucaggaa

SEQ ID NO: 3970353 - RNA, 16 nt, Human herpesvirus 4 [Epstein-Barr virus]
agaccucgaguccggg

SEQ ID NO: 3970354 - RNA, 21 nt, Human herpesvirus 4 [Epstein-Barr virus]
agacguguguggcuguagcca

SEQ ID NO: 3970355 - RNA, 14 nt, Human herpesvirus 4 [Epstein-Barr virus]
agacuccugccuga

SEQ ID NO: 3970356 - RNA, 23 nt, Human herpesvirus 4 [Epstein-Barr virus]
agacuucagguggucauguuucc

SEQ ID NO: 3970357 - RNA, 21 nt, Human herpesvirus 4 [Epstein-Barr virus]
agagaggcgggaauggccgcc

SEQ ID NO: 3970358 - RNA, 13 nt, Human herpesvirus 4 [Epstein-Barr virus]
agagcuccgccac

SEQ ID NO: 3970359 - RNA, 20 nt, Human herpesvirus 4 [Epstein-Barr virus]
agaggccguguuucucccac

SEQ ID NO: 3970360 - RNA, 22 nt, Human herpesvirus 4 [Epstein-Barr virus]
agaggcgggggguaugugcugc

SEQ ID NO: 3970361 - RNA, 13 nt, Human herpesvirus 4 [Epstein-Barr virus]
agagguuuugcua

SEQ ID NO: 3970362 - RNA, 17 nt, Human herpesvirus 4 [Epstein-Barr virus]
agaguacgugcagagga

SEQ ID NO: 3970363 - RNA, 20 nt, Human herpesvirus 4 [Epstein-Barr virus]
agauagggaccagaggacua

SEQ ID NO: 3970364 - RNA, 11 nt, Human herpesvirus 4 [Epstein-Barr virus]
agaucuucuca

SEQ ID NO: 3970365 - RNA, 20 nt, Human herpesvirus 4 [Epstein-Barr virus]
agaugagauagaggaccgga

SEQ ID NO: 3970366 - RNA, 16 nt, Human herpesvirus 4 [Epstein-Barr virus]
agcaacgcccagggac

SEQ ID NO: 3970367 - RNA, 20 nt, Human herpesvirus 4 [Epstein-Barr virus]
agcaagauccuucuggcacg

SEQ ID NO: 3970368 - RNA, 22 nt, Human herpesvirus 4 [Epstein-Barr virus]
agcacaagugauuaggagcagg

SEQ ID NO: 3970369 - RNA, 21 nt, Human herpesvirus 4 [Epstein-Barr virus]
agcaccggagccaccacagca

SEQ ID NO: 3970370 - RNA, 15 nt, Human herpesvirus 4 [Epstein-Barr virus]
agcacgguagccuug

SEQ ID NO: 3970371 - RNA, 16 nt, Human herpesvirus 4 [Epstein-Barr virus]
agcacuuugccagcaa

SEQ ID NO: 3970372 - RNA, 22 nt, Human herpesvirus 4 [Epstein-Barr virus]
agcagaugugcccaagccugga

SEQ ID NO: 3970373 - RNA, 20 nt, Human herpesvirus 4 [Epstein-Barr virus]
agcagcguccuggccccauu

SEQ ID NO: 3970374 - RNA, 14 nt, Human herpesvirus 4 [Epstein-Barr virus]
agcagcucaccuau

SEQ ID NO: 3970375 - RNA, 16 nt, Human herpesvirus 4 [Epstein-Barr virus]
agcagcucuggcacug

SEQ ID NO: 3970376 - RNA, 17 nt, Human herpesvirus 4 [Epstein-Barr virus]
agcagcuggauguacag

SEQ ID NO: 3970377 - RNA, 14 nt, Human herpesvirus 4 [Epstein-Barr virus]
agcaguagcuuggg

SEQ ID NO: 3970378 - RNA, 20 nt, Human herpesvirus 4 [Epstein-Barr virus]
agcauggccgccagaguucc

SEQ ID NO: 3970379 - RNA, 22 nt, Human herpesvirus 4 [Epstein-Barr virus]
agccacacccaccuaugccaau

SEQ ID NO: 3970380 - RNA, 12 nt, Human herpesvirus 4 [Epstein-Barr virus]
agccacauucau

SEQ ID NO: 3970381 - RNA, 17 nt, Human herpesvirus 4 [Epstein-Barr virus]
agccacuacggccacgu

SEQ ID NO: 3970382 - RNA, 22 nt, Human herpesvirus 4 [Epstein-Barr virus]
agccagggugaccuggcucagg

SEQ ID NO: 3970383 - RNA, 21 nt, Human herpesvirus 4 [Epstein-Barr virus]
agccagguguacgcccuggcg

SEQ ID NO: 3970384 - RNA, 23 nt, Human herpesvirus 4 [Epstein-Barr virus]
agcccauucucguccaucucgau

SEQ ID NO: 3970385 - RNA, 14 nt, Human herpesvirus 4 [Epstein-Barr virus]
agccccacucuugc

SEQ ID NO: 3970386 - RNA, 17 nt, Human herpesvirus 4 [Epstein-Barr virus]
agccccauggugugaga

SEQ ID NO: 3970387 - RNA, 18 nt, Human herpesvirus 4 [Epstein-Barr virus]
agcccccucccgccccug

SEQ ID NO: 3970388 - RNA, 18 nt, Human herpesvirus 4 [Epstein-Barr virus]
agccccuuuugccccccu

SEQ ID NO: 3970389 - RNA, 17 nt, Human herpesvirus 4 [Epstein-Barr virus]
agcccggccgaggccug

SEQ ID NO: 3970390 - RNA, 21 nt, Human herpesvirus 4 [Epstein-Barr virus]
agcccuccucagaaaacucug

SEQ ID NO: 3970391 - RNA, 17 nt, Human herpesvirus 4 [Epstein-Barr virus]
agccggcggccucggag

SEQ ID NO: 3970392 - RNA, 16 nt, Human herpesvirus 4 [Epstein-Barr virus]
agccuccaacaggugc

SEQ ID NO: 3970393 - RNA, 13 nt, Human herpesvirus 4 [Epstein-Barr virus]
agccugaggaaca

SEQ ID NO: 3970394 - RNA, 15 nt, Human herpesvirus 4 [Epstein-Barr virus]
agcgagacaguacuc

SEQ ID NO: 3970395 - RNA, 18 nt, Human herpesvirus 4 [Epstein-Barr virus]
agcgcacgugacagauuu

SEQ ID NO: 3970396 - RNA, 19 nt, Human herpesvirus 4 [Epstein-Barr virus]
agcgcucuggucgcccccu

SEQ ID NO: 3970397 - RNA, 21 nt, Human herpesvirus 4 [Epstein-Barr virus]
agcgcucuggucgcccccucu

SEQ ID NO: 3970398 - RNA, 23 nt, Human herpesvirus 4 [Epstein-Barr virus]
agcggcccagcagauccagggcc

SEQ ID NO: 3970399 - RNA, 13 nt, Human herpesvirus 4 [Epstein-Barr virus]
agcggcugugagc

SEQ ID NO: 3970400 - RNA, 13 nt, Human herpesvirus 4 [Epstein-Barr virus]
agcgggugcagua

SEQ ID NO: 3970401 - RNA, 22 nt, Human herpesvirus 4 [Epstein-Barr virus]
agcuacacucuggggucucagg

SEQ ID NO: 3970402 - RNA, 16 nt, Human herpesvirus 4 [Epstein-Barr virus]
agcuagugcagggggc

SEQ ID NO: 3970403 - RNA, 12 nt, Human herpesvirus 4 [Epstein-Barr virus]
agcuccagggac

SEQ ID NO: 3970404 - RNA, 15 nt, Human herpesvirus 4 [Epstein-Barr virus]
agcuccagggccagc

SEQ ID NO: 3970405 - RNA, 23 nt, Human herpesvirus 4 [Epstein-Barr virus]
agcuccgcgcucaacaccuucuc

SEQ ID NO: 3970406 - RNA, 14 nt, Human herpesvirus 4 [Epstein-Barr virus]
agcuccggcugccc

SEQ ID NO: 3970407 - RNA, 14 nt, Human herpesvirus 4 [Epstein-Barr virus]
agcuccucuccaaa

SEQ ID NO: 3970408 - RNA, 20 nt, Human herpesvirus 4 [Epstein-Barr virus]
agcucgcccacacagcgcca

SEQ ID NO: 3970409 - RNA, 16 nt, Human herpesvirus 4 [Epstein-Barr virus]
agcucggccagcaggc

SEQ ID NO: 3970410 - RNA, 17 nt, Human herpesvirus 4 [Epstein-Barr virus]
agcucggccagcaggcc

SEQ ID NO: 3970411 - RNA, 13 nt, Human herpesvirus 4 [Epstein-Barr virus]
agcucuggcacug

SEQ ID NO: 3970412 - RNA, 11 nt, Human herpesvirus 4 [Epstein-Barr virus]
agcugcugguu

SEQ ID NO: 3970413 - RNA, 15 nt, Human herpesvirus 4 [Epstein-Barr virus]
aggaaacugcugaca

SEQ ID NO: 3970414 - RNA, 23 nt, Human herpesvirus 4 [Epstein-Barr virus]
aggaacuccgcccaggucuugcc

SEQ ID NO: 3970415 - RNA, 20 nt, Human herpesvirus 4 [Epstein-Barr virus]
aggacacgcuggucuugaau

SEQ ID NO: 3970416 - RNA, 12 nt, Human herpesvirus 4 [Epstein-Barr virus]
aggacauguuug

SEQ ID NO: 3970417 - RNA, 16 nt, Human herpesvirus 4 [Epstein-Barr virus]
aggacgcugcugucca

SEQ ID NO: 3970418 - RNA, 22 nt, Human herpesvirus 4 [Epstein-Barr virus]
aggagaaaaucugcuucucccc

SEQ ID NO: 3970419 - RNA, 18 nt, Human herpesvirus 4 [Epstein-Barr virus]
aggagacuggcaacuccu

SEQ ID NO: 3970420 - RNA, 16 nt, Human herpesvirus 4 [Epstein-Barr virus]
aggagagcuggauggu

SEQ ID NO: 3970421 - RNA, 18 nt, Human herpesvirus 4 [Epstein-Barr virus]
aggagcaggaggaggggc

SEQ ID NO: 3970422 - RNA, 13 nt, Human herpesvirus 4 [Epstein-Barr virus]
aggagcaggaggg

SEQ ID NO: 3970423 - RNA, 15 nt, Human herpesvirus 4 [Epstein-Barr virus]
aggagcuccgugagc

SEQ ID NO: 3970424 - RNA, 17 nt, Human herpesvirus 4 [Epstein-Barr virus]
aggaggcggaagaccag

SEQ ID NO: 3970425 - RNA, 19 nt, Human herpesvirus 4 [Epstein-Barr virus]
aggaggggcaggagcagga

SEQ ID NO: 3970426 - RNA, 15 nt, Human herpesvirus 4 [Epstein-Barr virus]
aggagugcugcaggu

SEQ ID NO: 3970427 - RNA, 15 nt, Human herpesvirus 4 [Epstein-Barr virus]
aggauaaucaggcga

SEQ ID NO: 3970428 - RNA, 13 nt, Human herpesvirus 4 [Epstein-Barr virus]
aggaugagaccag

SEQ ID NO: 3970429 - RNA, 20 nt, Human herpesvirus 4 [Epstein-Barr virus]
aggcaauggccaccgcagag

SEQ ID NO: 3970430 - RNA, 17 nt, Human herpesvirus 4 [Epstein-Barr virus]
aggcacggucgccccuc

SEQ ID NO: 3970431 - RNA, 21 nt, Human herpesvirus 4 [Epstein-Barr virus]
aggcacggucgccccuccgag

SEQ ID NO: 3970432 - RNA, 17 nt, Human herpesvirus 4 [Epstein-Barr virus]
aggcagaggaaggccac

SEQ ID NO: 3970433 - RNA, 16 nt, Human herpesvirus 4 [Epstein-Barr virus]
aggcaguagaggacac

SEQ ID NO: 3970434 - RNA, 18 nt, Human herpesvirus 4 [Epstein-Barr virus]
aggccaaauggagacugc

SEQ ID NO: 3970435 - RNA, 16 nt, Human herpesvirus 4 [Epstein-Barr virus]
aggccaccgucuaccc

SEQ ID NO: 3970436 - RNA, 17 nt, Human herpesvirus 4 [Epstein-Barr virus]
aggccaccguggcccgc

SEQ ID NO: 3970437 - RNA, 22 nt, Human herpesvirus 4 [Epstein-Barr virus]
aggccaugcgcgcccugucacc

SEQ ID NO: 3970438 - RNA, 18 nt, Human herpesvirus 4 [Epstein-Barr virus]
aggcccuaauucagccac

SEQ ID NO: 3970439 - RNA, 22 nt, Human herpesvirus 4 [Epstein-Barr virus]
aggccgccaugcucagggccac

SEQ ID NO: 3970440 - RNA, 16 nt, Human herpesvirus 4 [Epstein-Barr virus]
aggcgacgcuccuggg

SEQ ID NO: 3970441 - RNA, 22 nt, Human herpesvirus 4 [Epstein-Barr virus]
aggcucggcccuccgcauccua

SEQ ID NO: 3970442 - RNA, 13 nt, Human herpesvirus 4 [Epstein-Barr virus]
aggcugagaacug

SEQ ID NO: 3970443 - RNA, 21 nt, Human herpesvirus 4 [Epstein-Barr virus]
agggcagacugcacaggauga

SEQ ID NO: 3970444 - RNA, 15 nt, Human herpesvirus 4 [Epstein-Barr virus]
agggcagcgaagaac

SEQ ID NO: 3970445 - RNA, 12 nt, Human herpesvirus 4 [Epstein-Barr virus]
agggccaagaca

SEQ ID NO: 3970446 - RNA, 14 nt, Human herpesvirus 4 [Epstein-Barr virus]
agggcccuggucag

SEQ ID NO: 3970447 - RNA, 14 nt, Human herpesvirus 4 [Epstein-Barr virus]
agggcgccaucuag

SEQ ID NO: 3970448 - RNA, 15 nt, Human herpesvirus 4 [Epstein-Barr virus]
aggggcaggagcagg

SEQ ID NO: 3970449 - RNA, 21 nt, Human herpesvirus 4 [Epstein-Barr virus]
aggggcaggagcaggaggagg

SEQ ID NO: 3970450 - RNA, 14 nt, Human herpesvirus 4 [Epstein-Barr virus]
aggggcgagcagcg

SEQ ID NO: 3970451 - RNA, 23 nt, Human herpesvirus 4 [Epstein-Barr virus]
aggggcgagcagcgcggcagagg

SEQ ID NO: 3970452 - RNA, 20 nt, Human herpesvirus 4 [Epstein-Barr virus]
aggggcuuguucuuggcgga

SEQ ID NO: 3970453 - RNA, 18 nt, Human herpesvirus 4 [Epstein-Barr virus]
agggggccuggugccaga

SEQ ID NO: 3970454 - RNA, 15 nt, Human herpesvirus 4 [Epstein-Barr virus]
aggggggaccuuaac

SEQ ID NO: 3970455 - RNA, 15 nt, Human herpesvirus 4 [Epstein-Barr virus]
agggugaggcccagc

SEQ ID NO: 3970456 - RNA, 17 nt, Human herpesvirus 4 [Epstein-Barr virus]
agggugaggcccagccc

SEQ ID NO: 3970457 - RNA, 21 nt, Human herpesvirus 4 [Epstein-Barr virus]
aggguggacagcagcguccug

SEQ ID NO: 3970458 - RNA, 17 nt, Human herpesvirus 4 [Epstein-Barr virus]
aggucgaccaccucaac

SEQ ID NO: 3970459 - RNA, 19 nt, Human herpesvirus 4 [Epstein-Barr virus]
aggucgacccuccugucac

SEQ ID NO: 3970460 - RNA, 17 nt, Human herpesvirus 4 [Epstein-Barr virus]
aggugauguagaggcgc

SEQ ID NO: 3970461 - RNA, 16 nt, Human herpesvirus 4 [Epstein-Barr virus]
agguggcugcugccaa

SEQ ID NO: 3970462 - RNA, 20 nt, Human herpesvirus 4 [Epstein-Barr virus]
aggugucaauaauuucagug

SEQ ID NO: 3970463 - RNA, 18 nt, Human herpesvirus 4 [Epstein-Barr virus]
agguguuguguccuguau

SEQ ID NO: 3970464 - RNA, 17 nt, Human herpesvirus 4 [Epstein-Barr virus]
aguaccguugugaccgc

SEQ ID NO: 3970465 - RNA, 18 nt, Human herpesvirus 4 [Epstein-Barr virus]
aguacuagcauggagagg

SEQ ID NO: 3970466 - RNA, 21 nt, Human herpesvirus 4 [Epstein-Barr virus]
aguacugcagugggccucucu

SEQ ID NO: 3970467 - RNA, 18 nt, Human herpesvirus 4 [Epstein-Barr virus]
aguagcacugguggugga

SEQ ID NO: 3970468 - RNA, 14 nt, Human herpesvirus 4 [Epstein-Barr virus]
agucaccugcacag

SEQ ID NO: 3970469 - RNA, 23 nt, Human herpesvirus 4 [Epstein-Barr virus]
aguccugucucuuuguguucuug

SEQ ID NO: 3970470 - RNA, 19 nt, Human herpesvirus 4 [Epstein-Barr virus]
agucuacucgaccagcacg

SEQ ID NO: 3970471 - RNA, 17 nt, Human herpesvirus 4 [Epstein-Barr virus]
agugccaagagcugccu

SEQ ID NO: 3970472 - RNA, 19 nt, Human herpesvirus 4 [Epstein-Barr virus]
agugccaagagcugccucc

SEQ ID NO: 3970473 - RNA, 23 nt, Human herpesvirus 4 [Epstein-Barr virus]
aguggaccucaaagaagaggggg

SEQ ID NO: 3970474 - RNA, 22 nt, Human herpesvirus 4 [Epstein-Barr virus]
aguggaugcaucuaagguccau

SEQ ID NO: 3970475 - RNA, 12 nt, Human herpesvirus 4 [Epstein-Barr virus]
aguggcggugga

SEQ ID NO: 3970476 - RNA, 15 nt, Human herpesvirus 4 [Epstein-Barr virus]
agugguucuccugau

SEQ ID NO: 3970477 - RNA, 22 nt, Human herpesvirus 4 [Epstein-Barr virus]
aguugguccaggguccaggaga

SEQ ID NO: 3970478 - RNA, 15 nt, Human herpesvirus 4 [Epstein-Barr virus]
auaaaagaggccggg

SEQ ID NO: 3970479 - RNA, 22 nt, Human herpesvirus 4 [Epstein-Barr virus]
auaaagcuguccuucugucaca

SEQ ID NO: 3970480 - RNA, 15 nt, Human herpesvirus 4 [Epstein-Barr virus]
auaagaaacacgcug

SEQ ID NO: 3970481 - RNA, 20 nt, Human herpesvirus 4 [Epstein-Barr virus]
auaauggugccugagggagg

SEQ ID NO: 3970482 - RNA, 14 nt, Human herpesvirus 4 [Epstein-Barr virus]
auaccugcacggcc

SEQ ID NO: 3970483 - RNA, 17 nt, Human herpesvirus 4 [Epstein-Barr virus]
auaccuugggcaucaug

SEQ ID NO: 3970484 - RNA, 16 nt, Human herpesvirus 4 [Epstein-Barr virus]
auacucaucugugaga

SEQ ID NO: 3970485 - RNA, 18 nt, Human herpesvirus 4 [Epstein-Barr virus]
auagaggggagcagaggu

SEQ ID NO: 3970486 - RNA, 18 nt, Human herpesvirus 4 [Epstein-Barr virus]
auagcagaagacuccugc

SEQ ID NO: 3970487 - RNA, 14 nt, Human herpesvirus 4 [Epstein-Barr virus]
auagcauggccgcc

SEQ ID NO: 3970488 - RNA, 23 nt, Human herpesvirus 4 [Epstein-Barr virus]
auagcucugcacaggcuuggaaa

SEQ ID NO: 3970489 - RNA, 20 nt, Human herpesvirus 4 [Epstein-Barr virus]
auaugcucucgcacucuugu

SEQ ID NO: 3970490 - RNA, 21 nt, Human herpesvirus 4 [Epstein-Barr virus]
auauggcuauacacaggagcc

SEQ ID NO: 3970491 - RNA, 21 nt, Human herpesvirus 4 [Epstein-Barr virus]
aucaaccugauucccccugcu

SEQ ID NO: 3970492 - RNA, 18 nt, Human herpesvirus 4 [Epstein-Barr virus]
aucaaccuguauaaugac

SEQ ID NO: 3970493 - RNA, 18 nt, Human herpesvirus 4 [Epstein-Barr virus]
aucacaucaagcagaaag

SEQ ID NO: 3970494 - RNA, 22 nt, Human herpesvirus 4 [Epstein-Barr virus]
aucccaguuguuauucccaccu

SEQ ID NO: 3970495 - RNA, 12 nt, Human herpesvirus 4 [Epstein-Barr virus]
auccccagccca

SEQ ID NO: 3970496 - RNA, 18 nt, Human herpesvirus 4 [Epstein-Barr virus]
aucccugucucccaccca

SEQ ID NO: 3970497 - RNA, 17 nt, Human herpesvirus 4 [Epstein-Barr virus]
auccgccaggaccugga

SEQ ID NO: 3970498 - RNA, 21 nt, Human herpesvirus 4 [Epstein-Barr virus]
auccuagagggacagcugacg

SEQ ID NO: 3970499 - RNA, 12 nt, Human herpesvirus 4 [Epstein-Barr virus]
auccuggccccc

SEQ ID NO: 3970500 - RNA, 20 nt, Human herpesvirus 4 [Epstein-Barr virus]
aucgggcuuuguugggucug

SEQ ID NO: 3970501 - RNA, 22 nt, Human herpesvirus 4 [Epstein-Barr virus]
aucggguggcuuccagaaaaug

SEQ ID NO: 3970502 - RNA, 17 nt, Human herpesvirus 4 [Epstein-Barr virus]
aucuaguaugaaggcug

SEQ ID NO: 3970503 - RNA, 12 nt, Human herpesvirus 4 [Epstein-Barr virus]
aucuccuaggcu

SEQ ID NO: 3970504 - RNA, 19 nt, Human herpesvirus 4 [Epstein-Barr virus]
aucuguugacgguguaacu

SEQ ID NO: 3970505 - RNA, 18 nt, Human herpesvirus 4 [Epstein-Barr virus]
aucuuaccccuggcuucc

SEQ ID NO: 3970506 - RNA, 21 nt, Human herpesvirus 4 [Epstein-Barr virus]
aucuuccugucggcucucuuu

SEQ ID NO: 3970507 - RNA, 15 nt, Human herpesvirus 4 [Epstein-Barr virus]
augaacccuggggca

SEQ ID NO: 3970508 - RNA, 14 nt, Human herpesvirus 4 [Epstein-Barr virus]
augacgcugcugcu

SEQ ID NO: 3970509 - RNA, 18 nt, Human herpesvirus 4 [Epstein-Barr virus]
augacgcugcugcuacug

SEQ ID NO: 3970510 - RNA, 13 nt, Human herpesvirus 4 [Epstein-Barr virus]
augaggaaggggc

SEQ ID NO: 3970511 - RNA, 14 nt, Human herpesvirus 4 [Epstein-Barr virus]
augauauugaauuc

SEQ ID NO: 3970512 - RNA, 13 nt, Human herpesvirus 4 [Epstein-Barr virus]
augcaaugcccac

SEQ ID NO: 3970513 - RNA, 14 nt, Human herpesvirus 4 [Epstein-Barr virus]
augcacgccaacag

SEQ ID NO: 3970514 - RNA, 16 nt, Human herpesvirus 4 [Epstein-Barr virus]
augcaggccuggacag

SEQ ID NO: 3970515 - RNA, 21 nt, Human herpesvirus 4 [Epstein-Barr virus]
augcauuuccugcccucccac

SEQ ID NO: 3970516 - RNA, 19 nt, Human herpesvirus 4 [Epstein-Barr virus]
augccaagagccccuccau

SEQ ID NO: 3970517 - RNA, 17 nt, Human herpesvirus 4 [Epstein-Barr virus]
augcuugugcuccugau

SEQ ID NO: 3970518 - RNA, 20 nt, Human herpesvirus 4 [Epstein-Barr virus]
auggaagagaggggcaggga

SEQ ID NO: 3970519 - RNA, 15 nt, Human herpesvirus 4 [Epstein-Barr virus]
auggcaaagguccca

SEQ ID NO: 3970520 - RNA, 21 nt, Human herpesvirus 4 [Epstein-Barr virus]
auggcauaaugggagggagcc

SEQ ID NO: 3970521 - RNA, 19 nt, Human herpesvirus 4 [Epstein-Barr virus]
auggcccugaucugggaga

SEQ ID NO: 3970522 - RNA, 13 nt, Human herpesvirus 4 [Epstein-Barr virus]
auggccugggccc

SEQ ID NO: 3970523 - RNA, 14 nt, Human herpesvirus 4 [Epstein-Barr virus]
auggcgaccgucac

SEQ ID NO: 3970524 - RNA, 21 nt, Human herpesvirus 4 [Epstein-Barr virus]
aggaacggugauuaggcacug

SEQ ID NO: 3970525 - RNA, 17 nt, Human herpesvirus 4 [Epstein-Barr virus]
aggacaacagcuagcag

SEQ ID NO: 3970526 - RNA, 19 nt, Human herpesvirus 4 [Epstein-Barr virus]
aggacacccaccaccaggc

SEQ ID NO: 3970527 - RNA, 16 nt, Human herpesvirus 4 [Epstein-Barr virus]
aggacgauagcccagg

SEQ ID NO: 3970528 - RNA, 20 nt, Human herpesvirus 4 [Epstein-Barr virus]
aggagaagagaggcuucccg

SEQ ID NO: 3970529 - RNA, 14 nt, Human herpesvirus 4 [Epstein-Barr virus]
aggagaaggagccu

SEQ ID NO: 3970530 - RNA, 19 nt, Human herpesvirus 4 [Epstein-Barr virus]
aggagauccgccaggaccu

SEQ ID NO: 3970531 - RNA, 16 nt, Human herpesvirus 4 [Epstein-Barr virus]
aggauaaucugggcag

SEQ ID NO: 3970532 - RNA, 20 nt, Human herpesvirus 4 [Epstein-Barr virus]
aggauauuaggcaaggguga

SEQ ID NO: 3970533 - RNA, 18 nt, Human herpesvirus 4 [Epstein-Barr virus]
aggauggaagagaggggc

SEQ ID NO: 3970534 - RNA, 15 nt, Human herpesvirus 4 [Epstein-Barr virus]
aggcagccuugcgug

SEQ ID NO: 3970535 - RNA, 20 nt, Human herpesvirus 4 [Epstein-Barr virus]
aggccauacgucuagccaca

SEQ ID NO: 3970536 - RNA, 18 nt, Human herpesvirus 4 [Epstein-Barr virus]
aggccaugcgcgcccugu

SEQ ID NO: 3970537 - RNA, 16 nt, Human herpesvirus 4 [Epstein-Barr virus]
aggcccagcccccucu

SEQ ID NO: 3970538 - RNA, 20 nt, Human herpesvirus 4 [Epstein-Barr virus]
aggccccccgcaccagggcc

SEQ ID NO: 3970539 - RNA, 21 nt, Human herpesvirus 4 [Epstein-Barr virus]
aggcccuaauucagccaccuc

SEQ ID NO: 3970540 - RNA, 16 nt, Human herpesvirus 4 [Epstein-Barr virus]
aggccgcugccaggcc

SEQ ID NO: 3970541 - RNA, 18 nt, Human herpesvirus 4 [Epstein-Barr virus]
aggccgggagaggcagcc

SEQ ID NO: 3970542 - RNA, 16 nt, Human herpesvirus 4 [Epstein-Barr virus]
aggccgguuuugcagu

SEQ ID NO: 3970543 - RNA, 16 nt, Human herpesvirus 4 [Epstein-Barr virus]
aggcuccuggaucugg

SEQ ID NO: 3970544 - RNA, 20 nt, Human herpesvirus 4 [Epstein-Barr virus]
aggcuccuggaucuggggcu

SEQ ID NO: 3970545 - RNA, 23 nt, Human herpesvirus 4 [Epstein-Barr virus]
aggcuguugacaugagcauggaa

SEQ ID NO: 3970546 - RNA, 23 nt, Human herpesvirus 4 [Epstein-Barr virus]
aggcuugccugacugacucuccc

SEQ ID NO: 3970547 - RNA, 17 nt, Human herpesvirus 4 [Epstein-Barr virus]
aggcuuucuaugccuga

SEQ ID NO: 3970548 - RNA, 16 nt, Human herpesvirus 4 [Epstein-Barr virus]
agggaaaggaaggggg

SEQ ID NO: 3970549 - RNA, 17 nt, Human herpesvirus 4 [Epstein-Barr virus]
agggaaaggaagggggc

SEQ ID NO: 3970550 - RNA, 23 nt, Human herpesvirus 4 [Epstein-Barr virus]
agggaagagggaaaagagacugc

SEQ ID NO: 3970551 - RNA, 18 nt, Human herpesvirus 4 [Epstein-Barr virus]
agggaagcguucuucacu

SEQ ID NO: 3970552 - RNA, 21 nt, Human herpesvirus 4 [Epstein-Barr virus]
agggagacacaucuggaccag

SEQ ID NO: 3970553 - RNA, 22 nt, Human herpesvirus 4 [Epstein-Barr virus]
agggagacacaucuggaccaga

SEQ ID NO: 3970554 - RNA, 11 nt, Human herpesvirus 4 [Epstein-Barr virus]
agggaggagac

SEQ ID NO: 3970555 - RNA, 21 nt, Human herpesvirus 4 [Epstein-Barr virus]
agggaguguuccacaguaaug

SEQ ID NO: 3970556 - RNA, 21 nt, Human herpesvirus 4 [Epstein-Barr virus]
agggcagacaccaccugcucg

SEQ ID NO: 3970557 - RNA, 16 nt, Human herpesvirus 4 [Epstein-Barr virus]
agggcagacugcacag

SEQ ID NO: 3970558 - RNA, 18 nt, Human herpesvirus 4 [Epstein-Barr virus]
agggccacggcgugccag

SEQ ID NO: 3970559 - RNA, 17 nt, Human herpesvirus 4 [Epstein-Barr virus]
agggccuuccagagcuc

SEQ ID NO: 3970560 - RNA, 15 nt, Human herpesvirus 4 [Epstein-Barr virus]
agguaaucucuggua

SEQ ID NO: 3970561 - RNA, 19 nt, Human herpesvirus 4 [Epstein-Barr virus]
agguacuaacacgcaauaa

SEQ ID NO: 3970562 - RNA, 15 nt, Human herpesvirus 4 [Epstein-Barr virus]
agguagacgaggcac

SEQ ID NO: 3970563 - RNA, 13 nt, Human herpesvirus 4 [Epstein-Barr virus]
aggucuaugggga

SEQ ID NO: 3970564 - RNA, 22 nt, Human herpesvirus 4 [Epstein-Barr virus]
aggucugcgaugaggcgguggg

SEQ ID NO: 3970565 - RNA, 17 nt, Human herpesvirus 4 [Epstein-Barr virus]
aggucuucucugacaaa

SEQ ID NO: 3970566 - RNA, 17 nt, Human herpesvirus 4 [Epstein-Barr virus]
aggugcaccagcuccag

SEQ ID NO: 3970567 - RNA, 15 nt, Human herpesvirus 4 [Epstein-Barr virus]
agguggcugcugcca

SEQ ID NO: 3970568 - RNA, 17 nt, Human herpesvirus 4 [Epstein-Barr virus]
agguggcugcugccaaa

SEQ ID NO: 3970569 - RNA, 22 nt, Human herpesvirus 4 [Epstein-Barr virus]
aggugggacaaaauggggucug

SEQ ID NO: 3970570 - RNA, 13 nt, Human herpesvirus 4 [Epstein-Barr virus]
agguugggccacg

SEQ ID NO: 3970571 - RNA, 14 nt, Human herpesvirus 4 [Epstein-Barr virus]
aguacagacuuuga

SEQ ID NO: 3970572 - RNA, 19 nt, Human herpesvirus 4 [Epstein-Barr virus]
aguaccagcccuuuuucca

SEQ ID NO: 3970573 - RNA, 13 nt, Human herpesvirus 4 [Epstein-Barr virus]
aguaccagcuggu

SEQ ID NO: 3970574 - RNA, 16 nt, Human herpesvirus 4 [Epstein-Barr virus]
aguagcccuuggaacu

SEQ ID NO: 3970575 - RNA, 13 nt, Human herpesvirus 4 [Epstein-Barr virus]
agucaccugcaca

SEQ ID NO: 3970576 - RNA, 19 nt, Human herpesvirus 4 [Epstein-Barr virus]
aguccagggcccuggucag

SEQ ID NO: 3970577 - RNA, 14 nt, Human herpesvirus 4 [Epstein-Barr virus]
agucuccgggucag

SEQ ID NO: 3970578 - RNA, 13 nt, Human herpesvirus 4 [Epstein-Barr virus]
agugaccagucac

SEQ ID NO: 3970579 - RNA, 18 nt, Human herpesvirus 4 [Epstein-Barr virus]
agugcaacaaucuggacu

SEQ ID NO: 3970580 - RNA, 12 nt, Human herpesvirus 4 [Epstein-Barr virus]
agugcagggggc

SEQ ID NO: 3970581 - RNA, 14 nt, Human herpesvirus 4 [Epstein-Barr virus]
agugccucugggug

SEQ ID NO: 3970582 - RNA, 17 nt, Human herpesvirus 4 [Epstein-Barr virus]
agugcuaugaccaugcc

SEQ ID NO: 3970583 - RNA, 21 nt, Human herpesvirus 4 [Epstein-Barr virus]
aguggcagaaucaccagagcc

SEQ ID NO: 3970584 - RNA, 12 nt, Human herpesvirus 4 [Epstein-Barr virus]
aguuaccuucuu

SEQ ID NO: 3970585 - RNA, 17 nt, Human herpesvirus 4 [Epstein-Barr virus]
aguuccaauagaggagc

SEQ ID NO: 3970586 - RNA, 19 nt, Human herpesvirus 4 [Epstein-Barr virus]
aguuggcaucuuccuccuu

SEQ ID NO: 3970587 - RNA, 16 nt, Human herpesvirus 4 [Epstein-Barr virus]
aguugguccagggucc

SEQ ID NO: 3970588 - RNA, 21 nt, Human herpesvirus 4 [Epstein-Barr virus]
aguugguccaggguccaggag

SEQ ID NO: 3970589 - RNA, 15 nt, Human herpesvirus 4 [Epstein-Barr virus]
aguuuuaacaccuga

SEQ ID NO: 3970590 - RNA, 22 nt, Human herpesvirus 4 [Epstein-Barr virus]
auaaauuaagagucccuccuca

SEQ ID NO: 3970591 - RNA, 19 nt, Human herpesvirus 4 [Epstein-Barr virus]
auaauacgcccgacaauaa

SEQ ID NO: 3970592 - RNA, 17 nt, Human herpesvirus 4 [Epstein-Barr virus]
auaaugucuucaauaga

SEQ ID NO: 3970593 - RNA, 20 nt, Human herpesvirus 4 [Epstein-Barr virus]
auacucaucugugagacaag

SEQ ID NO: 3970594 - RNA, 18 nt, Human herpesvirus 4 [Epstein-Barr virus]
auaugguuccccccaucu

SEQ ID NO: 3970595 - RNA, 17 nt, Human herpesvirus 4 [Epstein-Barr virus]
aucaacuucagcuccag

SEQ ID NO: 3970596 - RNA, 23 nt, Human herpesvirus 4 [Epstein-Barr virus]
aucaaggaaacaaaaccacugac

SEQ ID NO: 3970597 - RNA, 17 nt, Human herpesvirus 4 [Epstein-Barr virus]
aucacagaggaggcugg

SEQ ID NO: 3970598 - RNA, 15 nt, Human herpesvirus 4 [Epstein-Barr virus]
aucaccagagcccag

SEQ ID NO: 3970599 - RNA, 16 nt, Human herpesvirus 4 [Epstein-Barr virus]
aucagacggggaggug

SEQ ID NO: 3970600 - RNA, 12 nt, Human herpesvirus 4 [Epstein-Barr virus]
aucaucugaaaa

SEQ ID NO: 3970601 - RNA, 11 nt, Human herpesvirus 4 [Epstein-Barr virus]
auccagggccc

SEQ ID NO: 3970602 - RNA, 21 nt, Human herpesvirus 4 [Epstein-Barr virus]
auccaucugcuucuggcucuu

SEQ ID NO: 3970603 - RNA, 23 nt, Human herpesvirus 4 [Epstein-Barr virus]
aucccaguuguuauucccaccuc

SEQ ID NO: 3970604 - RNA, 14 nt, Human herpesvirus 4 [Epstein-Barr virus]
aucccauaccuaca

SEQ ID NO: 3970605 - RNA, 13 nt, Human herpesvirus 4 [Epstein-Barr virus]
auccuggccccca

SEQ ID NO: 3970606 - RNA, 13 nt, Human herpesvirus 4 [Epstein-Barr virus]
aucgccugccacu

SEQ ID NO: 3970607 - RNA, 15 nt, Human herpesvirus 4 [Epstein-Barr virus]
aucggacgggcaggc

SEQ ID NO: 3970608 - RNA, 19 nt, Human herpesvirus 4 [Epstein-Barr virus]
aucuacaacaaaacuggug

SEQ ID NO: 3970609 - RNA, 20 nt, Human herpesvirus 4 [Epstein-Barr virus]
aucucagaauugucacugag

SEQ ID NO: 3970610 - RNA, 16 nt, Human herpesvirus 4 [Epstein-Barr virus]
aucuccaucagggcca

SEQ ID NO: 3970611 - RNA, 16 nt, Human herpesvirus 4 [Epstein-Barr virus]
aucugagggcagugau

SEQ ID NO: 3970612 - RNA, 11 nt, Human herpesvirus 4 [Epstein-Barr virus]
cagcucaccua

SEQ ID NO: 3970613 - RNA, 15 nt, Human herpesvirus 4 [Epstein-Barr virus]
cagcuccagggacag

SEQ ID NO: 3970614 - RNA, 13 nt, Human herpesvirus 4 [Epstein-Barr virus]
cagcucggccagc

SEQ ID NO: 3970615 - RNA, 20 nt, Human herpesvirus 4 [Epstein-Barr virus]
cagcuggacgcgcagugcca

SEQ ID NO: 3970616 - RNA, 22 nt, Human herpesvirus 4 [Epstein-Barr virus]
cagcuggcccaccuaaagagag

SEQ ID NO: 3970617 - RNA, 17 nt, Human herpesvirus 4 [Epstein-Barr virus]
cagcuggugguccgcau

SEQ ID NO: 3970618 - RNA, 20 nt, Human herpesvirus 4 [Epstein-Barr virus]
cagcuuaacgggaagagaag

SEQ ID NO: 3970619 - RNA, 16 nt, Human herpesvirus 4 [Epstein-Barr virus]
caggacauguuugggg

SEQ ID NO: 3970620 - RNA, 14 nt, Human herpesvirus 4 [Epstein-Barr virus]
caggacggagaagc

SEQ ID NO: 3970621 - RNA, 16 nt, Human herpesvirus 4 [Epstein-Barr virus]
caggacggagaagcgg

SEQ ID NO: 3970622 - RNA, 14 nt, Human herpesvirus 4 [Epstein-Barr virus]
caggagagggccag

SEQ ID NO: 3970623 - RNA, 17 nt, Human herpesvirus 4 [Epstein-Barr virus]
caggaggaggggcagga

SEQ ID NO: 3970624 - RNA, 15 nt, Human herpesvirus 4 [Epstein-Barr virus]
caggagucugcugcg

SEQ ID NO: 3970625 - RNA, 15 nt, Human herpesvirus 4 [Epstein-Barr virus]
caggaucagaaucaa

SEQ ID NO: 3970626 - RNA, 19 nt, Human herpesvirus 4 [Epstein-Barr virus]
caggcacaucuggcaccug

SEQ ID NO: 3970627 - RNA, 19 nt, Human herpesvirus 4 [Epstein-Barr virus]
caggcacggucgccccucc

SEQ ID NO: 3970628 - RNA, 16 nt, Human herpesvirus 4 [Epstein-Barr virus]
caggcagccuugcgug

SEQ ID NO: 3970629 - RNA, 21 nt, Human herpesvirus 4 [Epstein-Barr virus]
caggcagccuugcguggugcu

SEQ ID NO: 3970630 - RNA, 21 nt, Human herpesvirus 4 [Epstein-Barr virus]
caggcauuuuuggugcugccu

SEQ ID NO: 3970631 - RNA, 16 nt, Human herpesvirus 4 [Epstein-Barr virus]
caggcccgaccugcca

SEQ ID NO: 3970632 - RNA, 19 nt, Human herpesvirus 4 [Epstein-Barr virus]
caggccgccaugcucaggg

SEQ ID NO: 3970633 - RNA, 15 nt, Human herpesvirus 4 [Epstein-Barr virus]
caggccucccagucu

SEQ ID NO: 3970634 - RNA, 13 nt, Human herpesvirus 4 [Epstein-Barr virus]
caggcuaugaaga

SEQ ID NO: 3970635 - RNA, 14 nt, Human herpesvirus 4 [Epstein-Barr virus]
caggcuccuggauc

SEQ ID NO: 3970636 - RNA, 17 nt, Human herpesvirus 4 [Epstein-Barr virus]
caggcuuggaaacaccc

SEQ ID NO: 3970637 - RNA, 12 nt, Human herpesvirus 4 [Epstein-Barr virus]
cagggcaacacc

SEQ ID NO: 3970638 - RNA, 12 nt, Human herpesvirus 4 [Epstein-Barr virus]
cagggcaauggg

SEQ ID NO: 3970639 - RNA, 19 nt, Human herpesvirus 4 [Epstein-Barr virus]
cagggccaagacauagaga

SEQ ID NO: 3970640 - RNA, 19 nt, Human herpesvirus 4 [Epstein-Barr virus]
cagggcccguuccaggcuc

SEQ ID NO: 3970641 - RNA, 21 nt, Human herpesvirus 4 [Epstein-Barr virus]
cagggcccguuccaggcucuc

SEQ ID NO: 3970642 - RNA, 23 nt, Human herpesvirus 4 [Epstein-Barr virus]
cagggcucuguucacgcgauggu

SEQ ID NO: 3970643 - RNA, 15 nt, Human herpesvirus 4 [Epstein-Barr virus]
cagggcuucacuaga

SEQ ID NO: 3970644 - RNA, 20 nt, Human herpesvirus 4 [Epstein-Barr virus]
caggggaaucucugccaacu

SEQ ID NO: 3970645 - RNA, 14 nt, Human herpesvirus 4 [Epstein-Barr virus]
caggggcgagcagc

SEQ ID NO: 3970646 - RNA, 14 nt, Human herpesvirus 4 [Epstein-Barr virus]
caggucaggucccc

SEQ ID NO: 3970647 - RNA, 21 nt, Human herpesvirus 4 [Epstein-Barr virus]
caggugcccgagccccgccug

SEQ ID NO: 3970648 - RNA, 23 nt, Human herpesvirus 4 [Epstein-Barr virus]
caggugccuuuuguacaagcuuu

SEQ ID NO: 3970649 - RNA, 12 nt, Human herpesvirus 4 [Epstein-Barr virus]
cagguggcugcu

SEQ ID NO: 3970650 - RNA, 17 nt, Human herpesvirus 4 [Epstein-Barr virus]
caguaaacacugccaua

SEQ ID NO: 3970651 - RNA, 14 nt, Human herpesvirus 4 [Epstein-Barr virus]
cagucgcugcugca

SEQ ID NO: 3970652 - RNA, 15 nt, Human herpesvirus 4 [Epstein-Barr virus]
cagucgcuggcuggu

SEQ ID NO: 3970653 - RNA, 13 nt, Human herpesvirus 4 [Epstein-Barr virus]
cagucuccggguc

SEQ ID NO: 3970654 - RNA, 18 nt, Human herpesvirus 4 [Epstein-Barr virus]
cagugccuccgccugagc

SEQ ID NO: 3970655 - RNA, 20 nt, Human herpesvirus 4 [Epstein-Barr virus]
caguggaccucaaagaagag

SEQ ID NO: 3970656 - RNA, 15 nt, Human herpesvirus 4 [Epstein-Barr virus]
caguggcccucagaa

SEQ ID NO: 3970657 - RNA, 20 nt, Human herpesvirus 4 [Epstein-Barr virus]
cagugggccucucuggcugu

SEQ ID NO: 3970658 - RNA, 15 nt, Human herpesvirus 4 [Epstein-Barr virus]
cauacucuucauucu

SEQ ID NO: 3970659 - RNA, 22 nt, Human herpesvirus 4 [Epstein-Barr virus]
cauccaucaacuucagcuccag

SEQ ID NO: 3970660 - RNA, 14 nt, Human herpesvirus 4 [Epstein-Barr virus]
caucccaauucaca

SEQ ID NO: 3970661 - RNA, 17 nt, Human herpesvirus 4 [Epstein-Barr virus]
cauccgccacccccguc

SEQ ID NO: 3970662 - RNA, 21 nt, Human herpesvirus 4 [Epstein-Barr virus]
caucgacacacgagccauaga

SEQ ID NO: 3970663 - RNA, 18 nt, Human herpesvirus 4 [Epstein-Barr virus]
caucgccgccccaggggu

SEQ ID NO: 3970664 - RNA, 16 nt, Human herpesvirus 4 [Epstein-Barr virus]
caucggagucgguggg

SEQ ID NO: 3970665 - RNA, 17 nt, Human herpesvirus 4 [Epstein-Barr virus]
caucuacgcggagcugc

SEQ ID NO: 3970666 - RNA, 18 nt, Human herpesvirus 4 [Epstein-Barr virus]
caucuauuagcagccucc

SEQ ID NO: 3970667 - RNA, 12 nt, Human herpesvirus 4 [Epstein-Barr virus]
caucuggaccug

SEQ ID NO: 3970668 - RNA, 14 nt, Human herpesvirus 4 [Epstein-Barr virus]
caugacacaggaca

SEQ ID NO: 3970669 - RNA, 21 nt, Human herpesvirus 4 [Epstein-Barr virus]
caugacagucccguugguggu

SEQ ID NO: 3970670 - RNA, 14 nt, Human herpesvirus 4 [Epstein-Barr virus]
caugacgcugcugc

SEQ ID NO: 3970671 - RNA, 16 nt, Human herpesvirus 4 [Epstein-Barr virus]
caugacgcugcugcua

SEQ ID NO: 3970672 - RNA, 21 nt, Human herpesvirus 4 [Epstein-Barr virus]
caugacgcugcugcuacuggc

SEQ ID NO: 3970673 - RNA, 17 nt, Human herpesvirus 4 [Epstein-Barr virus]
caugcaggucagguccc

SEQ ID NO: 3970674 - RNA, 15 nt, Human herpesvirus 4 [Epstein-Barr virus]
caugccuccccagca

SEQ ID NO: 3970675 - RNA, 23 nt, Human herpesvirus 4 [Epstein-Barr virus]
caugcuccuauggacacuuggua

SEQ ID NO: 3970676 - RNA, 18 nt, Human herpesvirus 4 [Epstein-Barr virus]
caugcucuuugaugggga

SEQ ID NO: 3970677 - RNA, 13 nt, Human herpesvirus 4 [Epstein-Barr virus]
cauggcagcagac

SEQ ID NO: 3970678 - RNA, 14 nt, Human herpesvirus 4 [Epstein-Barr virus]
cauggccgagaagc

SEQ ID NO: 3970679 - RNA, 16 nt, Human herpesvirus 4 [Epstein-Barr virus]
cauggcggacugcgcc

SEQ ID NO: 3970680 - RNA, 16 nt, Human herpesvirus 4 [Epstein-Barr virus]
cauguaacaagaacug

SEQ ID NO: 3970681 - RNA, 13 nt, Human herpesvirus 4 [Epstein-Barr virus]
caugucagcucca

SEQ ID NO: 3970682 - RNA, 13 nt, Human herpesvirus 4 [Epstein-Barr virus]
cauguccacugag

SEQ ID NO: 3970683 - RNA, 13 nt, Human herpesvirus 4 [Epstein-Barr virus]
caugucucagagg

SEQ ID NO: 3970684 - RNA, 19 nt, Human herpesvirus 4 [Epstein-Barr virus]
caugucugacgaggggcca

SEQ ID NO: 3970685 - RNA, 20 nt, Human herpesvirus 4 [Epstein-Barr virus]
cauuagcccagccgcaaaua

SEQ ID NO: 3970686 - RNA, 16 nt, Human herpesvirus 4 [Epstein-Barr virus]
cauucccuugcucgca

SEQ ID NO: 3970687 - RNA, 15 nt, Human herpesvirus 4 [Epstein-Barr virus]
cauucuaucagcuua

SEQ ID NO: 3970688 - RNA, 23 nt, Human herpesvirus 4 [Epstein-Barr virus]
cauucucaucuacaauggcuggu

SEQ ID NO: 3970689 - RNA, 18 nt, Human herpesvirus 4 [Epstein-Barr virus]
cauucugccgucucaaac

SEQ ID NO: 3970690 - RNA, 16 nt, Human herpesvirus 4 [Epstein-Barr virus]
cauuggcgucaggaga

SEQ ID NO: 3970691 - RNA, 18 nt, Human herpesvirus 4 [Epstein-Barr virus]
cauuuuauuuacagccau

SEQ ID NO: 3970692 - RNA, 20 nt, Human herpesvirus 4 [Epstein-Barr virus]
ccaacaggugcccgagcccc

SEQ ID NO: 3970693 - RNA, 14 nt, Human herpesvirus 4 [Epstein-Barr virus]
ccaacgcucagugc

SEQ ID NO: 3970694 - RNA, 14 nt, Human herpesvirus 4 [Epstein-Barr virus]
ccaagacucccuga

SEQ ID NO: 3970695 - RNA, 16 nt, Human herpesvirus 4 [Epstein-Barr virus]
ccaagauagugaccaa

SEQ ID NO: 3970696 - RNA, 16 nt, Human herpesvirus 4 [Epstein-Barr virus]
ccaagcaccacccagc

SEQ ID NO: 3970697 - RNA, 21 nt, Human herpesvirus 4 [Epstein-Barr virus]
ccaagccacuacggccacguc

SEQ ID NO: 3970698 - RNA, 19 nt, Human herpesvirus 4 [Epstein-Barr virus]
ccaaugacccacuccagug

SEQ ID NO: 3970699 - RNA, 13 nt, Human herpesvirus 4 [Epstein-Barr virus]
ccacacagcgcca

SEQ ID NO: 3970700 - RNA, 21 nt, Human herpesvirus 4 [Epstein-Barr virus]
gugugacaugcuauggugccg

SEQ ID NO: 3970701 - RNA, 12 nt, Human herpesvirus 4 [Epstein-Barr virus]
gugugcuguauu

SEQ ID NO: 3970702 - RNA, 22 nt, Human herpesvirus 4 [Epstein-Barr virus]
gugugucccccuccauuccacc

SEQ ID NO: 3970703 - RNA, 20 nt, Human herpesvirus 4 [Epstein-Barr virus]
guuaaacugaaucuccaccu

SEQ ID NO: 3970704 - RNA, 14 nt, Human herpesvirus 4 [Epstein-Barr virus]
guuaacauggacau

SEQ ID NO: 3970705 - RNA, 16 nt, Human herpesvirus 4 [Epstein-Barr virus]
guuaacuuucuccccu

SEQ ID NO: 3970706 - RNA, 20 nt, Human herpesvirus 4 [Epstein-Barr virus]
guuaagcugcaccuggacau

SEQ ID NO: 3970707 - RNA, 17 nt, Human herpesvirus 4 [Epstein-Barr virus]
guuauguuuuccccaug

SEQ ID NO: 3970708 - RNA, 13 nt, Human herpesvirus 4 [Epstein-Barr virus]
guuccacagccug

SEQ ID NO: 3970709 - RNA, 15 nt, Human herpesvirus 4 [Epstein-Barr virus]
guuccccccagccug

SEQ ID NO: 3970710 - RNA, 19 nt, Human herpesvirus 4 [Epstein-Barr virus]
guuccucaacaaggagugc

SEQ ID NO: 3970711 - RNA, 18 nt, Human herpesvirus 4 [Epstein-Barr virus]
guucuccaggcuccugga

SEQ ID NO: 3970712 - RNA, 14 nt, Human herpesvirus 4 [Epstein-Barr virus]
guuggcgggacugg

SEQ ID NO: 3970713 - RNA, 15 nt, Human herpesvirus 4 [Epstein-Barr virus]
guuuacaucugcccg

SEQ ID NO: 3970714 - RNA, 15 nt, Human herpesvirus 4 [Epstein-Barr virus]
guuugcuugccccgg

SEQ ID NO: 3970715 - RNA, 14 nt, Human herpesvirus 4 [Epstein-Barr virus]
uaaaacuccacaga

SEQ ID NO: 3970716 - RNA, 17 nt, Human herpesvirus 4 [Epstein-Barr virus]
uaaaauuuacaccugac

SEQ ID NO: 3970717 - RNA, 18 nt, Human herpesvirus 4 [Epstein-Barr virus]
uaaacauugcaccuugcc

SEQ ID NO: 3970718 - RNA, 21 nt, Human herpesvirus 4 [Epstein-Barr virus]
uaaagagacucaggcccucau

SEQ ID NO: 3970719 - RNA, 19 nt, Human herpesvirus 4 [Epstein-Barr virus]
uaaagaucuaccccagcug

SEQ ID NO: 3970720 - RNA, 16 nt, Human herpesvirus 4 [Epstein-Barr virus]
uaaaugcaccuugacu

SEQ ID NO: 3970721 - RNA, 15 nt, Human herpesvirus 4 [Epstein-Barr virus]
uaacacaccacacag

SEQ ID NO: 3970722 - RNA, 16 nt, Human herpesvirus 4 [Epstein-Barr virus]
uaaccuaugccuggaa

SEQ ID NO: 3970723 - RNA, 19 nt, Human herpesvirus 4 [Epstein-Barr virus]
uaacggggaaugugugaca

SEQ ID NO: 3970724 - RNA, 14 nt, Human herpesvirus 4 [Epstein-Barr virus]
uaacuggcacacac

SEQ ID NO: 3970725 - RNA, 18 nt, Human herpesvirus 4 [Epstein-Barr virus]
uaagaaugggagcaacca

SEQ ID NO: 3970726 - RNA, 16 nt, Human herpesvirus 4 [Epstein-Barr virus]
uaagagucccuccuca

SEQ ID NO: 3970727 - RNA, 14 nt, Human herpesvirus 4 [Epstein-Barr virus]
uaagcuuaugagcg

SEQ ID NO: 3970728 - RNA, 22 nt, Human herpesvirus 4 [Epstein-Barr virus]
uaaggccgggagaggcagcccc

SEQ ID NO: 3970729 - RNA, 15 nt, Human herpesvirus 4 [Epstein-Barr virus]
uaauguacagacuac

SEQ ID NO: 3970730 - RNA, 15 nt, Human herpesvirus 4 [Epstein-Barr virus]
uacaaccccuuccac

SEQ ID NO: 3970731 - RNA, 19 nt, Human herpesvirus 4 [Epstein-Barr virus]
uacacacaucagaccucug

SEQ ID NO: 3970732 - RNA, 24 nt, Human herpesvirus 4 [Epstein-Barr virus]
uaccagcccuuuuuccaguggcau

SEQ ID NO: 3970733 - RNA, 23 nt, Human herpesvirus 4 [Epstein-Barr virus]
uaccaggggcgagcagcgcggca

SEQ ID NO: 3970734 - RNA, 12 nt, Human herpesvirus 4 [Epstein-Barr virus]
uacccaucacac

SEQ ID NO: 3970735 - RNA, 13 nt, Human herpesvirus 4 [Epstein-Barr virus]
uacccaucccggc

SEQ ID NO: 3970736 - RNA, 22 nt, Human herpesvirus 4 [Epstein-Barr virus]
uaccggcgagcaugaucaggac

SEQ ID NO: 3970737 - RNA, 15 nt, Human herpesvirus 4 [Epstein-Barr virus]
uaccuccacuuacaa

SEQ ID NO: 3970738 - RNA, 15 nt, Human herpesvirus 4 [Epstein-Barr virus]
uaccuuccucugccc

SEQ ID NO: 3970739 - RNA, 22 nt, Human herpesvirus 4 [Epstein-Barr virus]
uaccuugggcaucaugcagggu

SEQ ID NO: 3970740 - RNA, 13 nt, Human herpesvirus 4 [Epstein-Barr virus]
uagaaugugguaa

SEQ ID NO: 3970741 - RNA, 19 nt, Human herpesvirus 4 [Epstein-Barr virus]
uagacagaaauugggugac

SEQ ID NO: 3970742 - RNA, 12 nt, Human herpesvirus 4 [Epstein-Barr virus]
uagagcauuugc

SEQ ID NO: 3970743 - RNA, 17 nt, Human herpesvirus 4 [Epstein-Barr virus]
uagauggcgcgggugag

SEQ ID NO: 3970744 - RNA, 18 nt, Human herpesvirus 4 [Epstein-Barr virus]
uagcauggccgccagagu

SEQ ID NO: 3970745 - RNA, 13 nt, Human herpesvirus 4 [Epstein-Barr virus]
uagccccagcccc

SEQ ID NO: 3970746 - RNA, 13 nt, Human herpesvirus 4 [Epstein-Barr virus]
uagccggccaggc

SEQ ID NO: 3970747 - RNA, 18 nt, Human herpesvirus 4 [Epstein-Barr virus]
uagcgccccuauaaccac

SEQ ID NO: 3970748 - RNA, 20 nt, Human herpesvirus 4 [Epstein-Barr virus]
uagcgucccaaacauaaaug

SEQ ID NO: 3970749 - RNA, 17 nt, Human herpesvirus 4 [Epstein-Barr virus]
uaggagcccgggccagc

SEQ ID NO: 3970750 - RNA, 16 nt, Human herpesvirus 4 [Epstein-Barr virus]
uaggcguaacuugucu

SEQ ID NO: 3970751 - RNA, 23 nt, Human herpesvirus 4 [Epstein-Barr virus]
uagguaucuggaucuacuuauug

SEQ ID NO: 3970752 - RNA, 22 nt, Human herpesvirus 4 [Epstein-Barr virus]
uaggugccgacaccggggugcc

SEQ ID NO: 3970753 - RNA, 18 nt, Human herpesvirus 4 [Epstein-Barr virus]
uagguguccagcgcucug

SEQ ID NO: 3970754 - RNA, 22 nt, Human herpesvirus 4 [Epstein-Barr virus]
uagugcgcgugaguucuuuagg

SEQ ID NO: 3970755 - RNA, 20 nt, Human herpesvirus 4 [Epstein-Barr virus]
uauggcugcggaguugagcc

SEQ ID NO: 3970756 - RNA, 16 nt, Human herpesvirus 4 [Epstein-Barr virus]
uauucaaucaaccuga

SEQ ID NO: 3970757 - RNA, 12 nt, Human herpesvirus 4 [Epstein-Barr virus]
ucaaacagcagc

SEQ ID NO: 3970758 - RNA, 14 nt, Human herpesvirus 4 [Epstein-Barr virus]
ucacauauccagag

SEQ ID NO: 3970759 - RNA, 17 nt, Human herpesvirus 4 [Epstein-Barr virus]
ucaccagggaggccugg

SEQ ID NO: 3970760 - RNA, 19 nt, Human herpesvirus 4 [Epstein-Barr virus]
ucacuaaaguuggucaggc

SEQ ID NO: 3970761 - RNA, 16 nt, Human herpesvirus 4 [Epstein-Barr virus]
ucacuuucuuugcaau

SEQ ID NO: 3970762 - RNA, 14 nt, Human herpesvirus 4 [Epstein-Barr virus]
ucagagaggccucu

SEQ ID NO: 3970763 - RNA, 19 nt, Human herpesvirus 4 [Epstein-Barr virus]
ucagagcugggaagaaugg

SEQ ID NO: 3970764 - RNA, 16 nt, Human herpesvirus 4 [Epstein-Barr virus]
ucagcaucacagguua

SEQ ID NO: 3970765 - RNA, 15 nt, Human herpesvirus 4 [Epstein-Barr virus]
ucagccugcuccuga

SEQ ID NO: 3970766 - RNA, 20 nt, Human herpesvirus 4 [Epstein-Barr virus]
ucagcucgcccacacagcgc

SEQ ID NO: 3970767 - RNA, 18 nt, Human herpesvirus 4 [Epstein-Barr virus]
ucagggaaaaacuggcca

SEQ ID NO: 3970768 - RNA, 16 nt, Human herpesvirus 4 [Epstein-Barr virus]
ucagguuucugggcau

SEQ ID NO: 3970769 - RNA, 15 nt, Human herpesvirus 4 [Epstein-Barr virus]
ucagugcggugcuac

SEQ ID NO: 3970770 - RNA, 18 nt, Human herpesvirus 4 [Epstein-Barr virus]
ucaucauaacugagcagg

SEQ ID NO: 3970771 - RNA, 17 nt, Human herpesvirus 4 [Epstein-Barr virus]
ucaucaucgggaaaggc

SEQ ID NO: 3970772 - RNA, 13 nt, Human herpesvirus 4 [Epstein-Barr virus]
ucaucccugaccc

SEQ ID NO: 3970773 - RNA, 19 nt, Human herpesvirus 4 [Epstein-Barr virus]
ucaucucgcuggcucgccu

SEQ ID NO: 3970774 - RNA, 17 nt, Human herpesvirus 4 [Epstein-Barr virus]
ucaucuggcucuccugu

SEQ ID NO: 3970775 - RNA, 19 nt, Human herpesvirus 4 [Epstein-Barr virus]
uccaagaaaccccacggag

SEQ ID NO: 3970776 - RNA, 14 nt, Human herpesvirus 4 [Epstein-Barr virus]
uccaaggcccaaca

SEQ ID NO: 3970777 - RNA, 15 nt, Human herpesvirus 4 [Epstein-Barr virus]
uccaagugcaacaau

SEQ ID NO: 3970778 - RNA, 23 nt, Human herpesvirus 4 [Epstein-Barr virus]
uccaaguugcauuggcugcaaag

SEQ ID NO: 3970779 - RNA, 17 nt, Human herpesvirus 4 [Epstein-Barr virus]
uccacaccauccacagc

SEQ ID NO: 3970780 - RNA, 19 nt, Human herpesvirus 4 [Epstein-Barr virus]
uccaggcucuccagcccca

SEQ ID NO: 3970781 - RNA, 19 nt, Human herpesvirus 4 [Epstein-Barr virus]
uccagggcccguuccaggc

SEQ ID NO: 3970782 - RNA, 16 nt, Human herpesvirus 4 [Epstein-Barr virus]
uccaggggccacacag

SEQ ID NO: 3970783 - RNA, 16 nt, Human herpesvirus 4 [Epstein-Barr virus]
uccaguaugccugccu

SEQ ID NO: 3970784 - RNA, 20 nt, Human herpesvirus 4 [Epstein-Barr virus]
uccaugacgcugcugcuacu

SEQ ID NO: 3970785 - RNA, 15 nt, Human herpesvirus 4 [Epstein-Barr virus]
ucccaaauaaauguu

SEQ ID NO: 3970786 - RNA, 19 nt, Human herpesvirus 4 [Epstein-Barr virus]
ucccacugggacggggugg

SEQ ID NO: 3970787 - RNA, 21 nt, Human herpesvirus 4 [Epstein-Barr virus]
ucccagaaagaagugggaccu

SEQ ID NO: 3970788 - RNA, 21 nt, Human herpesvirus 4 [Epstein-Barr virus]
uguccacuggggugcagacga

SEQ ID NO: 3970789 - RNA, 13 nt, Human herpesvirus 4 [Epstein-Barr virus]
ugucccacuccac

SEQ ID NO: 3970790 - RNA, 22 nt, Human herpesvirus 4 [Epstein-Barr virus]
uguccucccgggguccagaguu

SEQ ID NO: 3970791 - RNA, 20 nt, Human herpesvirus 4 [Epstein-Barr virus]
ugucggcuaaugccaugcag

SEQ ID NO: 3970792 - RNA, 22 nt, Human herpesvirus 4 [Epstein-Barr virus]
ugucuaacacgcuuuugucugc

SEQ ID NO: 3970793 - RNA, 15 nt, Human herpesvirus 4 [Epstein-Barr virus]
ugucucggccuccug

SEQ ID NO: 3970794 - RNA, 20 nt, Human herpesvirus 4 [Epstein-Barr virus]
ugucugugguugucuuccca

SEQ ID NO: 3970795 - RNA, 14 nt, Human herpesvirus 4 [Epstein-Barr virus]
ugucuuccacacca

SEQ ID NO: 3970796 - RNA, 16 nt, Human herpesvirus 4 [Epstein-Barr virus]
ugugaaccagaaagau

SEQ ID NO: 3970797 - RNA, 15 nt, Human herpesvirus 4 [Epstein-Barr virus]
ugugaccgucuacau

SEQ ID NO: 3970798 - RNA, 15 nt, Human herpesvirus 4 [Epstein-Barr virus]
ugugaucauggaaac

SEQ ID NO: 3970799 - RNA, 17 nt, Human herpesvirus 4 [Epstein-Barr virus]
uguggaagaggaaacag

SEQ ID NO: 3970800 - RNA, 17 nt, Human herpesvirus 4 [Epstein-Barr virus]
uguggccggugcugcca

SEQ ID NO: 3970801 - RNA, 22 nt, Human herpesvirus 4 [Epstein-Barr virus]
ugugucccccuccauuccaccc

SEQ ID NO: 3970802 - RNA, 14 nt, Human herpesvirus 4 [Epstein-Barr virus]
ugugucuucugucu

SEQ ID NO: 3970803 - RNA, 17 nt, Human herpesvirus 4 [Epstein-Barr virus]
uguguuccuaaaaaaug

SEQ ID NO: 3970804 - RNA, 22 nt, Human herpesvirus 4 [Epstein-Barr virus]
uguucccuaagcagcugagggg

SEQ ID NO: 3970805 - RNA, 22 nt, Human herpesvirus 4 [Epstein-Barr virus]
uguucucgugcaagcagcaccu

SEQ ID NO: 3970806 - RNA, 19 nt, Human herpesvirus 4 [Epstein-Barr virus]
uguucuuggcggacaucau

SEQ ID NO: 3970807 - RNA, 18 nt, Human herpesvirus 4 [Epstein-Barr virus]
uguuggauuggcugucau

SEQ ID NO: 3970808 - RNA, 18 nt, Human herpesvirus 4 [Epstein-Barr virus]
uguuuacaucugcccggc

SEQ ID NO: 3970809 - RNA, 16 nt, Human herpesvirus 4 [Epstein-Barr virus]
uguuucccgacgccaa

SEQ ID NO: 3970810 - RNA, 17 nt, Human herpesvirus 4 [Epstein-Barr virus]
uguuugcugcucggggc

SEQ ID NO: 3970811 - RNA, 14 nt, Human herpesvirus 4 [Epstein-Barr virus]
uguuuguacuucuu

SEQ ID NO: 3970812 - RNA, 22 nt, Human herpesvirus 4 [Epstein-Barr virus]
uguuuguggcggcaucauguuu

SEQ ID NO: 3970813 - RNA, 14 nt, Human herpesvirus 4 [Epstein-Barr virus]
uuaacaccugcagc

SEQ ID NO: 3970814 - RNA, 17 nt, Human herpesvirus 4 [Epstein-Barr virus]
uuaagagucccuccuca

SEQ ID NO: 3970815 - RNA, 17 nt, Human herpesvirus 4 [Epstein-Barr virus]
uuacaaccaagccacua

SEQ ID NO: 3970816 - RNA, 16 nt, Human herpesvirus 4 [Epstein-Barr virus]
uuagccccagccccuc

SEQ ID NO: 3970817 - RNA, 21 nt, Human herpesvirus 4 [Epstein-Barr virus]
uuaucagagaggccucugggg

SEQ ID NO: 3970818 - RNA, 16 nt, Human herpesvirus 4 [Epstein-Barr virus]
uuauugaaaccacgcc

SEQ ID NO: 3970819 - RNA, 17 nt, Human herpesvirus 4 [Epstein-Barr virus]
uucaacacgaccaccua

SEQ ID NO: 3970820 - RNA, 12 nt, Human herpesvirus 4 [Epstein-Barr virus]
uucaaccuaauu

SEQ ID NO: 3970821 - RNA, 22 nt, Human herpesvirus 4 [Epstein-Barr virus]
uucacggggccgugcaccugcc

SEQ ID NO: 3970822 - RNA, 20 nt, Human herpesvirus 4 [Epstein-Barr virus]
uuccaugacgcugcugcuac

SEQ ID NO: 3970823 - RNA, 14 nt, Human herpesvirus 4 [Epstein-Barr virus]
uucccagacucugc

SEQ ID NO: 3970824 - RNA, 22 nt, Human herpesvirus 4 [Epstein-Barr virus]
uucccagccccaauucuugcac

SEQ ID NO: 3970825 - RNA, 17 nt, Human herpesvirus 4 [Epstein-Barr virus]
uuccuacaacucagccc

SEQ ID NO: 3970826 - RNA, 21 nt, Human herpesvirus 4 [Epstein-Barr virus]
uuccuacaacucagccccauc

SEQ ID NO: 3970827 - RNA, 23 nt, Human herpesvirus 4 [Epstein-Barr virus]
uuccucaucguucgguggggugg

SEQ ID NO: 3970828 - RNA, 19 nt, Human herpesvirus 4 [Epstein-Barr virus]
uuccucauuggcuuugccc

SEQ ID NO: 3970829 - RNA, 21 nt, Human herpesvirus 4 [Epstein-Barr virus]
uuccugucggcucucuuugaa

SEQ ID NO: 3970830 - RNA, 13 nt, Human herpesvirus 4 [Epstein-Barr virus]
uuccuugccaucu

SEQ ID NO: 3970831 - RNA, 22 nt, Human herpesvirus 4 [Epstein-Barr virus]
uucuaugggaauaacaagggaa

SEQ ID NO: 3970832 - RNA, 18 nt, Human herpesvirus 4 [Epstein-Barr virus]
uucugaggcggcuguggc

SEQ ID NO: 3970833 - RNA, 16 nt, Human herpesvirus 4 [Epstein-Barr virus]
uucugcugcugcuggu

SEQ ID NO: 3970834 - RNA, 17 nt, Human herpesvirus 4 [Epstein-Barr virus]
uucuggccaaccugccu

SEQ ID NO: 3970835 - RNA, 18 nt, Human herpesvirus 4 [Epstein-Barr virus]
uucuuagaugaggagcag

SEQ ID NO: 3970836 - RNA, 20 nt, Human herpesvirus 4 [Epstein-Barr virus]
uugagcgccguggccaccuu

SEQ ID NO: 3970837 - RNA, 11 nt, Human herpesvirus 4 [Epstein-Barr virus]
uugaggaccca

SEQ ID NO: 3970838 - RNA, 11 nt, Human herpesvirus 4 [Epstein-Barr virus]
uugcagcugga

SEQ ID NO: 3970839 - RNA, 14 nt, Human herpesvirus 4 [Epstein-Barr virus]
uugcccguggggau

SEQ ID NO: 3970840 - RNA, 15 nt, Human herpesvirus 4 [Epstein-Barr virus]
uugcucucguugcca

SEQ ID NO: 3970841 - RNA, 19 nt, Human herpesvirus 4 [Epstein-Barr virus]
uuggcaacgagagcaauac

SEQ ID NO: 3970842 - RNA, 14 nt, Human herpesvirus 4 [Epstein-Barr virus]
uuggcgucucaggc

SEQ ID NO: 3970843 - RNA, 23 nt, Human herpesvirus 4 [Epstein-Barr virus]
uugguggauugcugaacuggggc

SEQ ID NO: 3970844 - RNA, 19 nt, Human herpesvirus 4 [Epstein-Barr virus]
uugugaagguaaacaagcu

SEQ ID NO: 3970845 - RNA, 17 nt, Human herpesvirus 4 [Epstein-Barr virus]
uuuaaacgagagaagag

SEQ ID NO: 3970846 - RNA, 15 nt, Human herpesvirus 4 [Epstein-Barr virus]
uuuaaggaaugaaca

SEQ ID NO: 3970847 - RNA, 14 nt, Human herpesvirus 4 [Epstein-Barr virus]
uuuacaucugcccg

SEQ ID NO: 3970848 - RNA, 17 nt, Human herpesvirus 4 [Epstein-Barr virus]
uuucccccacccuggaa

SEQ ID NO: 3970849 - RNA, 15 nt, Human herpesvirus 4 [Epstein-Barr virus]
uuuccgucagccagg

SEQ ID NO: 3970850 - RNA, 16 nt, Human herpesvirus 4 [Epstein-Barr virus]
uuuccgucagccaggg

SEQ ID NO: 3970851 - RNA, 16 nt, Human herpesvirus 4 [Epstein-Barr virus]
uuuccuucuugaccuu

SEQ ID NO: 3970852 - RNA, 14 nt, Human herpesvirus 4 [Epstein-Barr virus]
uuucuaugccugaa

SEQ ID NO: 3970853 - RNA, 10 nt, Human herpesvirus 4 [Epstein-Barr virus]
uuucugcccc

SEQ ID NO: 3970854 - RNA, 17 nt, Human herpesvirus 4 [Epstein-Barr virus]
uuugccagcaacuuaua

SEQ ID NO: 3970855 - RNA, 13 nt, Human herpesvirus 4 [Epstein-Barr virus]
uuugcgaccccuc

SEQ ID NO: 3970856 - RNA, 14 nt, Human herpesvirus 4 [Epstein-Barr virus]
uuuggcuugcucca

SEQ ID NO: 3970857 - RNA, 16 nt, Human herpesvirus 4 [Epstein-Barr virus]
uuugggagcuccagag

SEQ ID NO: 3970858 - RNA, 18 nt, Human herpesvirus 4 [Epstein-Barr virus]
cacgccugcuucacgccu

SEQ ID NO: 3970859 - RNA, 19 nt, Human herpesvirus 4 [Epstein-Barr virus]
cacgcuccgcgcucggccu

SEQ ID NO: 3970860 - RNA, 14 nt, Human herpesvirus 4 [Epstein-Barr virus]
cacggaugccuggc

SEQ ID NO: 3970861 - RNA, 15 nt, Human herpesvirus 4 [Epstein-Barr virus]
cacggcccuccagcg

SEQ ID NO: 3970862 - RNA, 16 nt, Human herpesvirus 4 [Epstein-Barr virus]
cacggcgucaaacagg

SEQ ID NO: 3970863 - RNA, 23 nt, Human herpesvirus 4 [Epstein-Barr virus]
cacggggccgugcaccugccauc

SEQ ID NO: 3970864 - RNA, 19 nt, Human herpesvirus 4 [Epstein-Barr virus]
cacuacuacaccgagcaga

SEQ ID NO: 3970865 - RNA, 15 nt, Human herpesvirus 4 [Epstein-Barr virus]
cacuacuuguuucug

SEQ ID NO: 3970866 - RNA, 21 nt, Human herpesvirus 4 [Epstein-Barr virus]
cacuaucacccauggccaggc

SEQ ID NO: 3970867 - RNA, 19 nt, Human herpesvirus 4 [Epstein-Barr virus]
cacucaggaagcuggccag

SEQ ID NO: 3970868 - RNA, 22 nt, Human herpesvirus 4 [Epstein-Barr virus]
cacucauggugugagacuggaa

SEQ ID NO: 3970869 - RNA, 16 nt, Human herpesvirus 4 [Epstein-Barr virus]
cacucccgaggcacuu

SEQ ID NO: 3970870 - RNA, 23 nt, Human herpesvirus 4 [Epstein-Barr virus]
cacuccuaugcauuuccugcccu

SEQ ID NO: 3970871 - RNA, 14 nt, Human herpesvirus 4 [Epstein-Barr virus]
cacucugaccagga

SEQ ID NO: 3970872 - RNA, 14 nt, Human herpesvirus 4 [Epstein-Barr virus]
cacucuuaccuucc

SEQ ID NO: 3970873 - RNA, 23 nt, Human herpesvirus 4 [Epstein-Barr virus]
cacucuuuuuucaacgcagucuu

SEQ ID NO: 3970874 - RNA, 19 nt, Human herpesvirus 4 [Epstein-Barr virus]
cacuggugguggaggagga

SEQ ID NO: 3970875 - RNA, 19 nt, Human herpesvirus 4 [Epstein-Barr virus]
cacuugggcacggagagug

SEQ ID NO: 3970876 - RNA, 21 nt, Human herpesvirus 4 [Epstein-Barr virus]
cacuugguaaguuuucccuuc

SEQ ID NO: 3970877 - RNA, 18 nt, Human herpesvirus 4 [Epstein-Barr virus]
cacuugugguucuccuga

SEQ ID NO: 3970878 - RNA, 16 nt, Human herpesvirus 4 [Epstein-Barr virus]
cacuuuagagcucugg

SEQ ID NO: 3970879 - RNA, 15 nt, Human herpesvirus 4 [Epstein-Barr virus]
cacuuucuuugcaau

SEQ ID NO: 3970880 - RNA, 21 nt, Human herpesvirus 4 [Epstein-Barr virus]
cacuuucuuugcaauuugccu

SEQ ID NO: 3970881 - RNA, 20 nt, Human herpesvirus 4 [Epstein-Barr virus]
cagaaaacucugcauggaga

SEQ ID NO: 3970882 - RNA, 18 nt, Human herpesvirus 4 [Epstein-Barr virus]
cagacuuuuggcaauggg

SEQ ID NO: 3970883 - RNA, 18 nt, Human herpesvirus 4 [Epstein-Barr virus]
cagagccucugccacaag

SEQ ID NO: 3970884 - RNA, 15 nt, Human herpesvirus 4 [Epstein-Barr virus]
cagaggaaggccaca

SEQ ID NO: 3970885 - RNA, 17 nt, Human herpesvirus 4 [Epstein-Barr virus]
cagaggacuaauguucu

SEQ ID NO: 3970886 - RNA, 20 nt, Human herpesvirus 4 [Epstein-Barr virus]
cagaggcgacgcuccugggu

SEQ ID NO: 3970887 - RNA, 23 nt, Human herpesvirus 4 [Epstein-Barr virus]
cagagggcgaaugggcugcagca

SEQ ID NO: 3970888 - RNA, 17 nt, Human herpesvirus 4 [Epstein-Barr virus]
cagauagccggccaggc

SEQ ID NO: 3970889 - RNA, 19 nt, Human herpesvirus 4 [Epstein-Barr virus]
cagauagccggccaggcag

SEQ ID NO: 3970890 - RNA, 18 nt, Human herpesvirus 4 [Epstein-Barr virus]
cagaucccauuuuucacu

SEQ ID NO: 3970891 - RNA, 16 nt, Human herpesvirus 4 [Epstein-Barr virus]
cagaugcaguggguga

SEQ ID NO: 3970892 - RNA, 19 nt, Human herpesvirus 4 [Epstein-Barr virus]
cagcagauagugaacgugg

SEQ ID NO: 3970893 - RNA, 18 nt, Human herpesvirus 4 [Epstein-Barr virus]
cagcagauccagggcccg

SEQ ID NO: 3970894 - RNA, 20 nt, Human herpesvirus 4 [Epstein-Barr virus]
cagcagggcacagaggugau

SEQ ID NO: 3970895 - RNA, 21 nt, Human herpesvirus 4 [Epstein-Barr virus]
cagcagugguguuugcuugcc

SEQ ID NO: 3970896 - RNA, 13 nt, Human herpesvirus 4 [Epstein-Barr virus]
cagccacgcagga

SEQ ID NO: 3970897 - RNA, 20 nt, Human herpesvirus 4 [Epstein-Barr virus]
cagcccuuaacacaccacac

SEQ ID NO: 3970898 - RNA, 14 nt, Human herpesvirus 4 [Epstein-Barr virus]
cagcgccagcaggg

SEQ ID NO: 3970899 - RNA, 14 nt, Human herpesvirus 4 [Epstein-Barr virus]
cagcgcuggcucca

SEQ ID NO: 3970900 - RNA, 18 nt, Human herpesvirus 4 [Epstein-Barr virus]
cagcucaaccgccagggc

SEQ ID NO: 3970901 - RNA, 16 nt, Human herpesvirus 4 [Epstein-Barr virus]
cagcuccagggccagc

SEQ ID NO: 3970902 - RNA, 17 nt, Human herpesvirus 4 [Epstein-Barr virus]
cagcuccagggccagca

SEQ ID NO: 3970903 - RNA, 16 nt, Human herpesvirus 4 [Epstein-Barr virus]
cagcucuaacuuggca

SEQ ID NO: 3970904 - RNA, 22 nt, Human herpesvirus 4 [Epstein-Barr virus]
cagcucuaacuuggcaucucuu

SEQ ID NO: 3970905 - RNA, 13 nt, Human herpesvirus 4 [Epstein-Barr virus]
caggaacagccuc

SEQ ID NO: 3970906 - RNA, 14 nt, Human herpesvirus 4 [Epstein-Barr virus]
caggaccuagaaug

SEQ ID NO: 3970907 - RNA, 15 nt, Human herpesvirus 4 [Epstein-Barr virus]
caggacgcugcuguc

SEQ ID NO: 3970908 - RNA, 17 nt, Human herpesvirus 4 [Epstein-Barr virus]
caggagcuugaggccag

SEQ ID NO: 3970909 - RNA, 15 nt, Human herpesvirus 4 [Epstein-Barr virus]
caggaggaggggcag

SEQ ID NO: 3970910 - RNA, 18 nt, Human herpesvirus 4 [Epstein-Barr virus]
caggagggcagagagggg

SEQ ID NO: 3970911 - RNA, 18 nt, Human herpesvirus 4 [Epstein-Barr virus]
caggcacaucuggcaccu

SEQ ID NO: 3970912 - RNA, 18 nt, Human herpesvirus 4 [Epstein-Barr virus]
caggcagaggaaggccac

SEQ ID NO: 3970913 - RNA, 20 nt, Human herpesvirus 4 [Epstein-Barr virus]
caggcagaugaggccccuua

SEQ ID NO: 3970914 - RNA, 17 nt, Human herpesvirus 4 [Epstein-Barr virus]
caggcauuuuuggugcu

SEQ ID NO: 3970915 - RNA, 20 nt, Human herpesvirus 4 [Epstein-Barr virus]
caggccaccgucuacccaga

SEQ ID NO: 3970916 - RNA, 16 nt, Human herpesvirus 4 [Epstein-Barr virus]
caggcccccagcuucu

SEQ ID NO: 3970917 - RNA, 20 nt, Human herpesvirus 4 [Epstein-Barr virus]
caggccgccuauggggccug

SEQ ID NO: 3970918 - RNA, 15 nt, Human herpesvirus 4 [Epstein-Barr virus]
caggcucuccagccc

SEQ ID NO: 3970919 - RNA, 14 nt, Human herpesvirus 4 [Epstein-Barr virus]
caggcugcgccucc

SEQ ID NO: 3970920 - RNA, 22 nt, Human herpesvirus 4 [Epstein-Barr virus]
cagggaaaaacuggccaugcag

SEQ ID NO: 3970921 - RNA, 16 nt, Human herpesvirus 4 [Epstein-Barr virus]
cagggcaaagccacaa

SEQ ID NO: 3970922 - RNA, 14 nt, Human herpesvirus 4 [Epstein-Barr virus]
cagggccgugcaug

SEQ ID NO: 3970923 - RNA, 15 nt, Human herpesvirus 4 [Epstein-Barr virus]
cagggccgugcaugg

SEQ ID NO: 3970924 - RNA, 14 nt, Human herpesvirus 4 [Epstein-Barr virus]
caggggucucuaga

SEQ ID NO: 3970925 - RNA, 15 nt, Human herpesvirus 4 [Epstein-Barr virus]
caggguccaggagaa

SEQ ID NO: 3970926 - RNA, 23 nt, Human herpesvirus 4 [Epstein-Barr virus]
cagggugaacacuugggcacgga

SEQ ID NO: 3970927 - RNA, 23 nt, Human herpesvirus 4 [Epstein-Barr virus]
caggguggcuacuugcucagguu

SEQ ID NO: 3970928 - RNA, 14 nt, Human herpesvirus 4 [Epstein-Barr virus]
cagguacaggaccu

SEQ ID NO: 3970929 - RNA, 18 nt, Human herpesvirus 4 [Epstein-Barr virus]
caggucccccuccacggg

SEQ ID NO: 3970930 - RNA, 21 nt, Human herpesvirus 4 [Epstein-Barr virus]
caggugcaccagcuccaggga

SEQ ID NO: 3970931 - RNA, 15 nt, Human herpesvirus 4 [Epstein-Barr virus]
caggugcacgcuccc

SEQ ID NO: 3970932 - RNA, 21 nt, Human herpesvirus 4 [Epstein-Barr virus]
caggugccugacggugccgcu

SEQ ID NO: 3970933 - RNA, 16 nt, Human herpesvirus 4 [Epstein-Barr virus]
caguaacacagggugg

SEQ ID NO: 3970934 - RNA, 20 nt, Human herpesvirus 4 [Epstein-Barr virus]
caguagccgaauaucuggag

SEQ ID NO: 3970935 - RNA, 22 nt, Human herpesvirus 4 [Epstein-Barr virus]
caguaugcucgaagcauugggc

SEQ ID NO: 3970936 - RNA, 12 nt, Human herpesvirus 4 [Epstein-Barr virus]
caguauguacag

SEQ ID NO: 3970937 - RNA, 17 nt, Human herpesvirus 4 [Epstein-Barr virus]
cagucccaccacaaagg

SEQ ID NO: 3970938 - RNA, 13 nt, Human herpesvirus 4 [Epstein-Barr virus]
caguccuccgcau

SEQ ID NO: 3970939 - RNA, 14 nt, Human herpesvirus 4 [Epstein-Barr virus]
cagucgcuggcugg

SEQ ID NO: 3970940 - RNA, 21 nt, Human herpesvirus 4 [Epstein-Barr virus]
cagugacgaagacccaucuga

SEQ ID NO: 3970941 - RNA, 16 nt, Human herpesvirus 4 [Epstein-Barr virus]
caguggacacccacca

SEQ ID NO: 3970942 - RNA, 13 nt, Human herpesvirus 4 [Epstein-Barr virus]
caguggcccucag

SEQ ID NO: 3970943 - RNA, 14 nt, Human herpesvirus 4 [Epstein-Barr virus]
caguggcugccccg

SEQ ID NO: 3970944 - RNA, 17 nt, Human herpesvirus 4 [Epstein-Barr virus]
cagugucccugcugccc

SEQ ID NO: 3970945 - RNA, 21 nt, Human herpesvirus 4 [Epstein-Barr virus]
caguugaaauaucuagcacgg

SEQ ID NO: 3970946 - RNA, 22 nt, Human herpesvirus 4 [Epstein-Barr virus]
cauaacaaucuugugaaccaga

SEQ ID NO: 3970947 - RNA, 12 nt, Human herpesvirus 4 [Epstein-Barr virus]
cauacagcagcu

SEQ ID NO: 3970948 - RNA, 22 nt, Human herpesvirus 4 [Epstein-Barr virus]
cauacgucuagccacauagcag

SEQ ID NO: 3970949 - RNA, 21 nt, Human herpesvirus 4 [Epstein-Barr virus]
cauaggcuugccugacugacu

SEQ ID NO: 3970950 - RNA, 14 nt, Human herpesvirus 4 [Epstein-Barr virus]
cauaucgcaacacu

SEQ ID NO: 3970951 - RNA, 15 nt, Human herpesvirus 4 [Epstein-Barr virus]
caucagcucgcccac

SEQ ID NO: 3970952 - RNA, 20 nt, Human herpesvirus 4 [Epstein-Barr virus]
caucaggcgaaggcggagaa

SEQ ID NO: 3970953 - RNA, 21 nt, Human herpesvirus 4 [Epstein-Barr virus]
cauccaucaacuucagcucca

SEQ ID NO: 3970954 - RNA, 21 nt, Human herpesvirus 4 [Epstein-Barr virus]
caucccauaccuacaccaccc

SEQ ID NO: 3970955 - RNA, 14 nt, Human herpesvirus 4 [Epstein-Barr virus]
cauccgaggcugag

SEQ ID NO: 3970956 - RNA, 17 nt, Human herpesvirus 4 [Epstein-Barr virus]
caucuacaauggcuggu

SEQ ID NO: 3970957 - RNA, 21 nt, Human herpesvirus 4 [Epstein-Barr virus]
caucugaaaaugacaggcugc

SEQ ID NO: 3970958 - RNA, 22 nt, Human herpesvirus 4 [Epstein-Barr virus]
caugcccagacucaucucaagg

SEQ ID NO: 3970959 - RNA, 15 nt, Human herpesvirus 4 [Epstein-Barr virus]
caugcucagggccac

SEQ ID NO: 3970960 - RNA, 16 nt, Human herpesvirus 4 [Epstein-Barr virus]
caugcuugggcaugcu

SEQ ID NO: 3970961 - RNA, 17 nt, Human herpesvirus 4 [Epstein-Barr virus]
cauggaaaccacucaga

SEQ ID NO: 3970962 - RNA, 21 nt, Human herpesvirus 4 [Epstein-Barr virus]
cauggagaacguccacgggga

SEQ ID NO: 3970963 - RNA, 13 nt, Human herpesvirus 4 [Epstein-Barr virus]
cauggccaggcuc

SEQ ID NO: 3970964 - RNA, 14 nt, Human herpesvirus 4 [Epstein-Barr virus]
cauggccugggccc

SEQ ID NO: 3970965 - RNA, 22 nt, Human herpesvirus 4 [Epstein-Barr virus]
cauggugagacaccuggcccac

SEQ ID NO: 3970966 - RNA, 14 nt, Human herpesvirus 4 [Epstein-Barr virus]
caugguguagacag

SEQ ID NO: 3970967 - RNA, 19 nt, Human herpesvirus 4 [Epstein-Barr virus]
cauuccccccgccuuuggg

SEQ ID NO: 3970968 - RNA, 16 nt, Human herpesvirus 4 [Epstein-Barr virus]
cauuccuaggagaagg

SEQ ID NO: 3970969 - RNA, 15 nt, Human herpesvirus 4 [Epstein-Barr virus]
cauugcagggcucug

SEQ ID NO: 3970970 - RNA, 18 nt, Human herpesvirus 4 [Epstein-Barr virus]
cauuggcagcagcucugg

SEQ ID NO: 3970971 - RNA, 19 nt, Human herpesvirus 4 [Epstein-Barr virus]
ccaaaacuauaccaaagcu

SEQ ID NO: 3970972 - RNA, 22 nt, Human herpesvirus 4 [Epstein-Barr virus]
ccaaaaguagaggcucaggcca

SEQ ID NO: 3970973 - RNA, 17 nt, Human herpesvirus 4 [Epstein-Barr virus]
ccaaagcgggugcagua

SEQ ID NO: 3970974 - RNA, 21 nt, Human herpesvirus 4 [Epstein-Barr virus]
ccaacaggugcccgagccccg

SEQ ID NO: 3970975 - RNA, 16 nt, Human herpesvirus 4 [Epstein-Barr virus]
ccaagcggcacagauu

SEQ ID NO: 3970976 - RNA, 11 nt, Human herpesvirus 4 [Epstein-Barr virus]
ccaaguacaga

SEQ ID NO: 3970977 - RNA, 20 nt, Human herpesvirus 4 [Epstein-Barr virus]
ccaaguguuuccagacacca

SEQ ID NO: 3970978 - RNA, 14 nt, Human herpesvirus 4 [Epstein-Barr virus]
ccacaaaaaaugca

SEQ ID NO: 3970979 - RNA, 22 nt, Human herpesvirus 4 [Epstein-Barr virus]
ccacaaacaccaguguccagag

SEQ ID NO: 3970980 - RNA, 23 nt, Human herpesvirus 4 [Epstein-Barr virus]
ccacaacugcuauucugagcacc

SEQ ID NO: 3970981 - RNA, 15 nt, Human herpesvirus 4 [Epstein-Barr virus]
ccaccaccuccacca

SEQ ID NO: 3970982 - RNA, 16 nt, Human herpesvirus 4 [Epstein-Barr virus]
ccaccacgaugacucc

SEQ ID NO: 3970983 - RNA, 15 nt, Human herpesvirus 4 [Epstein-Barr virus]
ccaccacucccacca

SEQ ID NO: 3970984 - RNA, 15 nt, Human herpesvirus 4 [Epstein-Barr virus]
ccaccagcuucucaa

SEQ ID NO: 3970985 - RNA, 22 nt, Human herpesvirus 4 [Epstein-Barr virus]
ccaccauaugaugacgccgaga

SEQ ID NO: 3970986 - RNA, 15 nt, Human herpesvirus 4 [Epstein-Barr virus]
ccacccccaccaccu

SEQ ID NO: 3970987 - RNA, 16 nt, Human herpesvirus 4 [Epstein-Barr virus]
ccaccgaccccauauc

SEQ ID NO: 3970988 - RNA, 19 nt, Human herpesvirus 4 [Epstein-Barr virus]
ccaccggcuuggcccucuc

SEQ ID NO: 3970989 - RNA, 18 nt, Human herpesvirus 4 [Epstein-Barr virus]
ccaccggggaggccaggu

SEQ ID NO: 3970990 - RNA, 21 nt, Human herpesvirus 4 [Epstein-Barr virus]
ccaccuagaaagagccauggu

SEQ ID NO: 3970991 - RNA, 13 nt, Human herpesvirus 4 [Epstein-Barr virus]
ccaccuccccugu

SEQ ID NO: 3970992 - RNA, 21 nt, Human herpesvirus 4 [Epstein-Barr virus]
ccaccuguguaaccucacugu

SEQ ID NO: 3970993 - RNA, 18 nt, Human herpesvirus 4 [Epstein-Barr virus]
ccacgguggaacaggagc

SEQ ID NO: 3970994 - RNA, 17 nt, Human herpesvirus 4 [Epstein-Barr virus]
ccacgucaaggcccgga

SEQ ID NO: 3970995 - RNA, 13 nt, Human herpesvirus 4 [Epstein-Barr virus]
ccacguccagacu

SEQ ID NO: 3970996 - RNA, 22 nt, Human herpesvirus 4 [Epstein-Barr virus]
ccacuaucacccauggccaggc

SEQ ID NO: 3970997 - RNA, 19 nt, Human herpesvirus 4 [Epstein-Barr virus]
ccacugugccuaaacguga

SEQ ID NO: 3970998 - RNA, 20 nt, Human herpesvirus 4 [Epstein-Barr virus]
ccacuuacaaccaagccacu

SEQ ID NO: 3970999 - RNA, 19 nt, Human herpesvirus 4 [Epstein-Barr virus]
ccagagcagcccgcacccc

SEQ ID NO: 3971000 - RNA, 17 nt, Human herpesvirus 4 [Epstein-Barr virus]
ccagaugacugagcgca

SEQ ID NO: 3971001 - RNA, 17 nt, Human herpesvirus 4 [Epstein-Barr virus]
ccagcaaccaauguauc

SEQ ID NO: 3971002 - RNA, 16 nt, Human herpesvirus 4 [Epstein-Barr virus]
ccagcagauccagggc

SEQ ID NO: 3971003 - RNA, 12 nt, Human herpesvirus 4 [Epstein-Barr virus]
ccagcagcagcc

SEQ ID NO: 3971004 - RNA, 12 nt, Human herpesvirus 4 [Epstein-Barr virus]
ccagcaggcuca

SEQ ID NO: 3971005 - RNA, 14 nt, Human herpesvirus 4 [Epstein-Barr virus]
ccagcagggcacag

SEQ ID NO: 3971006 - RNA, 20 nt, Human herpesvirus 4 [Epstein-Barr virus]
ccagcagggccuugagccca

SEQ ID NO: 3971007 - RNA, 16 nt, Human herpesvirus 4 [Epstein-Barr virus]
ccagcauggcagccgg

SEQ ID NO: 3971008 - RNA, 13 nt, Human herpesvirus 4 [Epstein-Barr virus]
ccagccacagcac

SEQ ID NO: 3971009 - RNA, 22 nt, Human herpesvirus 4 [Epstein-Barr virus]
ccagccccaauucuugcaccca

SEQ ID NO: 3971010 - RNA, 23 nt, Human herpesvirus 4 [Epstein-Barr virus]
ccagcuaguagcccuuggaacug

SEQ ID NO: 3971011 - RNA, 15 nt, Human herpesvirus 4 [Epstein-Barr virus]
ccagcucggccagca

SEQ ID NO: 3971012 - RNA, 15 nt, Human herpesvirus 4 [Epstein-Barr virus]
ccaggaccuggaugc

SEQ ID NO: 3971013 - RNA, 21 nt, Human herpesvirus 4 [Epstein-Barr virus]
ccaggaggaggacgugaguga

SEQ ID NO: 3971014 - RNA, 21 nt, Human herpesvirus 4 [Epstein-Barr virus]
ccagggacauccccagacuca

SEQ ID NO: 3971015 - RNA, 13 nt, Human herpesvirus 4 [Epstein-Barr virus]
ccagggaggccug

SEQ ID NO: 3971016 - RNA, 17 nt, Human herpesvirus 4 [Epstein-Barr virus]
ccagggcguacaccugg

SEQ ID NO: 3971017 - RNA, 20 nt, Human herpesvirus 4 [Epstein-Barr virus]
ccagguacaggaccuggaaa

SEQ ID NO: 3971018 - RNA, 22 nt, Human herpesvirus 4 [Epstein-Barr virus]
ccucggcgcugggacugccugg

SEQ ID NO: 3971019 - RNA, 18 nt, Human herpesvirus 4 [Epstein-Barr virus]
ccucgggucucgccgcua

SEQ ID NO: 3971020 - RNA, 15 nt, Human herpesvirus 4 [Epstein-Barr virus]
ccucguuuacuaaug

SEQ ID NO: 3971021 - RNA, 13 nt, Human herpesvirus 4 [Epstein-Barr virus]
ccucuacgcccca

SEQ ID NO: 3971022 - RNA, 19 nt, Human herpesvirus 4 [Epstein-Barr virus]
ccucucuggcugugcugac

SEQ ID NO: 3971023 - RNA, 13 nt, Human herpesvirus 4 [Epstein-Barr virus]
ccugagccacacc

SEQ ID NO: 3971024 - RNA, 18 nt, Human herpesvirus 4 [Epstein-Barr virus]
ccugagccugagccacac

SEQ ID NO: 3971025 - RNA, 14 nt, Human herpesvirus 4 [Epstein-Barr virus]
ccugagcugccugg

SEQ ID NO: 3971026 - RNA, 21 nt, Human herpesvirus 4 [Epstein-Barr virus]
ccugauauugucccccuagcc

SEQ ID NO: 3971027 - RNA, 22 nt, Human herpesvirus 4 [Epstein-Barr virus]
ccugauuuuuguccgcaggugg

SEQ ID NO: 3971028 - RNA, 22 nt, Human herpesvirus 4 [Epstein-Barr virus]
ccugcaaacugacacacaggcc

SEQ ID NO: 3971029 - RNA, 17 nt, Human herpesvirus 4 [Epstein-Barr virus]
ccugcacggcccuccag

SEQ ID NO: 3971030 - RNA, 15 nt, Human herpesvirus 4 [Epstein-Barr virus]
ccugcauggccaggc

SEQ ID NO: 3971031 - RNA, 23 nt, Human herpesvirus 4 [Epstein-Barr virus]
ccugccacuuccacagcaauggc

SEQ ID NO: 3971032 - RNA, 21 nt, Human herpesvirus 4 [Epstein-Barr virus]
ccugccucucuuaugccugug

SEQ ID NO: 3971033 - RNA, 22 nt, Human herpesvirus 4 [Epstein-Barr virus]
ccugcgacgcggugcugaccgg

SEQ ID NO: 3971034 - RNA, 17 nt, Human herpesvirus 4 [Epstein-Barr virus]
ccugcggacucaggcca

SEQ ID NO: 3971035 - RNA, 23 nt, Human herpesvirus 4 [Epstein-Barr virus]
ccugcguugaacccaccccuccu

SEQ ID NO: 3971036 - RNA, 14 nt, Human herpesvirus 4 [Epstein-Barr virus]
ccuggaagcaggag

SEQ ID NO: 3971037 - RNA, 22 nt, Human herpesvirus 4 [Epstein-Barr virus]
ccuggacacaagagccaucacc

SEQ ID NO: 3971038 - RNA, 13 nt, Human herpesvirus 4 [Epstein-Barr virus]
ccuggagccagcg

SEQ ID NO: 3971039 - RNA, 14 nt, Human herpesvirus 4 [Epstein-Barr virus]
ccuggaucugagcu

SEQ ID NO: 3971040 - RNA, 14 nt, Human herpesvirus 4 [Epstein-Barr virus]
ccuggcccacugga

SEQ ID NO: 3971041 - RNA, 21 nt, Human herpesvirus 4 [Epstein-Barr virus]
ccuggcuguacgccgccgcca

SEQ ID NO: 3971042 - RNA, 17 nt, Human herpesvirus 4 [Epstein-Barr virus]
ccugggcaaggagcugu

SEQ ID NO: 3971043 - RNA, 16 nt, Human herpesvirus 4 [Epstein-Barr virus]
ccugguacaggaccau

SEQ ID NO: 3971044 - RNA, 14 nt, Human herpesvirus 4 [Epstein-Barr virus]
ccugugccauacca

SEQ ID NO: 3971045 - RNA, 24 nt, Human herpesvirus 4 [Epstein-Barr virus]
ccuucgauuuuacgaugaaggagg

SEQ ID NO: 3971046 - RNA, 16 nt, Human herpesvirus 4 [Epstein-Barr virus]
ccuucuccaucuccau

SEQ ID NO: 3971047 - RNA, 20 nt, Human herpesvirus 4 [Epstein-Barr virus]
ccuucucugauggccuggag

SEQ ID NO: 3971048 - RNA, 23 nt, Human herpesvirus 4 [Epstein-Barr virus]
ccuucugcugcugcuggucaugg

SEQ ID NO: 3971049 - RNA, 17 nt, Human herpesvirus 4 [Epstein-Barr virus]
ccuuggggguggugggc

SEQ ID NO: 3971050 - RNA, 15 nt, Human herpesvirus 4 [Epstein-Barr virus]
cgaaacuauggcaga

SEQ ID NO: 3971051 - RNA, 14 nt, Human herpesvirus 4 [Epstein-Barr virus]
cgaaagcggcccag

SEQ ID NO: 3971052 - RNA, 18 nt, Human herpesvirus 4 [Epstein-Barr virus]
cgaagaacacuccacaga

SEQ ID NO: 3971053 - RNA, 15 nt, Human herpesvirus 4 [Epstein-Barr virus]
cgaaggagagcugga

SEQ ID NO: 3971054 - RNA, 14 nt, Human herpesvirus 4 [Epstein-Barr virus]
cgacaucgccgccc

SEQ ID NO: 3971055 - RNA, 21 nt, Human herpesvirus 4 [Epstein-Barr virus]
cgaccccauaucgcaacacug

SEQ ID NO: 3971056 - RNA, 13 nt, Human herpesvirus 4 [Epstein-Barr virus]
cgaccugccaaag

SEQ ID NO: 3971057 - RNA, 15 nt, Human herpesvirus 4 [Epstein-Barr virus]
cgacgagcagaggac

SEQ ID NO: 3971058 - RNA, 13 nt, Human herpesvirus 4 [Epstein-Barr virus]
cgacgcucccggg

SEQ ID NO: 3971059 - RNA, 20 nt, Human herpesvirus 4 [Epstein-Barr virus]
cgacuacgagggccucuggc

SEQ ID NO: 3971060 - RNA, 17 nt, Human herpesvirus 4 [Epstein-Barr virus]
cgagcagcgcggcagag

SEQ ID NO: 3971061 - RNA, 19 nt, Human herpesvirus 4 [Epstein-Barr virus]
cgagcagcgcggcagaggc

SEQ ID NO: 3971062 - RNA, 22 nt, Human herpesvirus 4 [Epstein-Barr virus]
cgagcagcgcggcagaggccuc

SEQ ID NO: 3971063 - RNA, 17 nt, Human herpesvirus 4 [Epstein-Barr virus]
cgagccccgccuggcgg

SEQ ID NO: 3971064 - RNA, 15 nt, Human herpesvirus 4 [Epstein-Barr virus]
cgagcucuccagcca

SEQ ID NO: 3971065 - RNA, 17 nt, Human herpesvirus 4 [Epstein-Barr virus]
cgaggaacuggcucagc

SEQ ID NO: 3971066 - RNA, 18 nt, Human herpesvirus 4 [Epstein-Barr virus]
cgaggaacuggcucagcu

SEQ ID NO: 3971067 - RNA, 18 nt, Human herpesvirus 4 [Epstein-Barr virus]
cgaggauaaucugggcag

SEQ ID NO: 3971068 - RNA, 23 nt, Human herpesvirus 4 [Epstein-Barr virus]
cgaggcugagaacugacgcucca

SEQ ID NO: 3971069 - RNA, 12 nt, Human herpesvirus 4 [Epstein-Barr virus]
cgaggggccagg

SEQ ID NO: 3971070 - RNA, 13 nt, Human herpesvirus 4 [Epstein-Barr virus]
cgaggggccaggu

SEQ ID NO: 3971071 - RNA, 24 nt, Human herpesvirus 4 [Epstein-Barr virus]
cgaugaacgccuacgcagaggcca

SEQ ID NO: 3971072 - RNA, 20 nt, Human herpesvirus 4 [Epstein-Barr virus]
cgaugccucuacgccccaga

SEQ ID NO: 3971073 - RNA, 19 nt, Human herpesvirus 4 [Epstein-Barr virus]
cgcaacgccggccugcugg

SEQ ID NO: 3971074 - RNA, 13 nt, Human herpesvirus 4 [Epstein-Barr virus]
cgcaccagggcca

SEQ ID NO: 3971075 - RNA, 19 nt, Human herpesvirus 4 [Epstein-Barr virus]
cgcaccuguguccugggca

SEQ ID NO: 3971076 - RNA, 17 nt, Human herpesvirus 4 [Epstein-Barr virus]
cgcagaggccugcacca

SEQ ID NO: 3971077 - RNA, 17 nt, Human herpesvirus 4 [Epstein-Barr virus]
cgcagccacguccagac

SEQ ID NO: 3971078 - RNA, 15 nt, Human herpesvirus 4 [Epstein-Barr virus]
cgccaccggcuuggc

SEQ ID NO: 3971079 - RNA, 22 nt, Human herpesvirus 4 [Epstein-Barr virus]
ugauucaucagaagcuacaaac

SEQ ID NO: 3971080 - RNA, 18 nt, Human herpesvirus 4 [Epstein-Barr virus]
ugcaacaaucuggacucu

SEQ ID NO: 3971081 - RNA, 23 nt, Human herpesvirus 4 [Epstein-Barr virus]
ugcaagauaucacacccucggag

SEQ ID NO: 3971082 - RNA, 16 nt, Human herpesvirus 4 [Epstein-Barr virus]
ugcacaggaugacagc

SEQ ID NO: 3971083 - RNA, 13 nt, Human herpesvirus 4 [Epstein-Barr virus]
ugcaccagcucca

SEQ ID NO: 3971084 - RNA, 14 nt, Human herpesvirus 4 [Epstein-Barr virus]
ugcaccagcuccag

SEQ ID NO: 3971085 - RNA, 17 nt, Human herpesvirus 4 [Epstein-Barr virus]
ugcacuauauucuccag

SEQ ID NO: 3971086 - RNA, 16 nt, Human herpesvirus 4 [Epstein-Barr virus]
ugcaggccuggacagc

SEQ ID NO: 3971087 - RNA, 20 nt, Human herpesvirus 4 [Epstein-Barr virus]
ugcagugggccucucuggcu

SEQ ID NO: 3971088 - RNA, 13 nt, Human herpesvirus 4 [Epstein-Barr virus]
ugcauggccaggc

SEQ ID NO: 3971089 - RNA, 14 nt, Human herpesvirus 4 [Epstein-Barr virus]
ugcauggccaggcc

SEQ ID NO: 3971090 - RNA, 19 nt, Human herpesvirus 4 [Epstein-Barr virus]
ugccagaugugccugggcu

SEQ ID NO: 3971091 - RNA, 15 nt, Human herpesvirus 4 [Epstein-Barr virus]
ugccaugugugucca

SEQ ID NO: 3971092 - RNA, 16 nt, Human herpesvirus 4 [Epstein-Barr virus]
ugccauguguguccag

SEQ ID NO: 3971093 - RNA, 19 nt, Human herpesvirus 4 [Epstein-Barr virus]
ugcccaccagccagcgacu

SEQ ID NO: 3971094 - RNA, 17 nt, Human herpesvirus 4 [Epstein-Barr virus]
ugcccagacucaucuca

SEQ ID NO: 3971095 - RNA, 21 nt, Human herpesvirus 4 [Epstein-Barr virus]
ugcccagacucaucucaaggg

SEQ ID NO: 3971096 - RNA, 14 nt, Human herpesvirus 4 [Epstein-Barr virus]
ugccccucagccug

SEQ ID NO: 3971097 - RNA, 17 nt, Human herpesvirus 4 [Epstein-Barr virus]
ugccccucagccugcuc

SEQ ID NO: 3971098 - RNA, 22 nt, Human herpesvirus 4 [Epstein-Barr virus]
ugccggcccuuacaacagguuu

SEQ ID NO: 3971099 - RNA, 15 nt, Human herpesvirus 4 [Epstein-Barr virus]
ugccgugaaugcacg

SEQ ID NO: 3971100 - RNA, 22 nt, Human herpesvirus 4 [Epstein-Barr virus]
ugccuaaacgugauggugcugg

SEQ ID NO: 3971101 - RNA, 16 nt, Human herpesvirus 4 [Epstein-Barr virus]
ugccucccugccccuc

SEQ ID NO: 3971102 - RNA, 19 nt, Human herpesvirus 4 [Epstein-Barr virus]
ugccuccucaaauguucca

SEQ ID NO: 3971103 - RNA, 21 nt, Human herpesvirus 4 [Epstein-Barr virus]
ugccucgaguaggugccucca

SEQ ID NO: 3971104 - RNA, 17 nt, Human herpesvirus 4 [Epstein-Barr virus]
ugccucugggugcugag

SEQ ID NO: 3971105 - RNA, 17 nt, Human herpesvirus 4 [Epstein-Barr virus]
ugccuggauucuuacag

SEQ ID NO: 3971106 - RNA, 19 nt, Human herpesvirus 4 [Epstein-Barr virus]
ugccuugcucucagcacuu

SEQ ID NO: 3971107 - RNA, 21 nt, Human herpesvirus 4 [Epstein-Barr virus]
ugccuuucccccacccuggaa

SEQ ID NO: 3971108 - RNA, 22 nt, Human herpesvirus 4 [Epstein-Barr virus]
ugcgaaaacgaaagugcuugaa

SEQ ID NO: 3971109 - RNA, 21 nt, Human herpesvirus 4 [Epstein-Barr virus]
ugcgagaauuggcagacaccu

SEQ ID NO: 3971110 - RNA, 19 nt, Human herpesvirus 4 [Epstein-Barr virus]
ugcgaugagggccuuccag

SEQ ID NO: 3971111 - RNA, 12 nt, Human herpesvirus 4 [Epstein-Barr virus]
ugcggggaacug

SEQ ID NO: 3971112 - RNA, 21 nt, Human herpesvirus 4 [Epstein-Barr virus]
ugcgucagcaacugcguccuc

SEQ ID NO: 3971113 - RNA, 16 nt, Human herpesvirus 4 [Epstein-Barr virus]
ugcguccucuaccugg

SEQ ID NO: 3971114 - RNA, 17 nt, Human herpesvirus 4 [Epstein-Barr virus]
ugcuagcgucacugauu

SEQ ID NO: 3971115 - RNA, 16 nt, Human herpesvirus 4 [Epstein-Barr virus]
ugcuagcuucagggaa

SEQ ID NO: 3971116 - RNA, 12 nt, Human herpesvirus 4 [Epstein-Barr virus]
ugcucaaggcag

SEQ ID NO: 3971117 - RNA, 17 nt, Human herpesvirus 4 [Epstein-Barr virus]
ugcuccagugccuccgc

SEQ ID NO: 3971118 - RNA, 16 nt, Human herpesvirus 4 [Epstein-Barr virus]
ugcugaugugcugccc

SEQ ID NO: 3971119 - RNA, 13 nt, Human herpesvirus 4 [Epstein-Barr virus]
ugcugcccaugga

SEQ ID NO: 3971120 - RNA, 20 nt, Human herpesvirus 4 [Epstein-Barr virus]
ugcugcucggggcaugcugc

SEQ ID NO: 3971121 - RNA, 15 nt, Human herpesvirus 4 [Epstein-Barr virus]
ugcuggccgagcugg

SEQ ID NO: 3971122 - RNA, 16 nt, Human herpesvirus 4 [Epstein-Barr virus]
uggaaaagggcccagg

SEQ ID NO: 3971123 - RNA, 15 nt, Human herpesvirus 4 [Epstein-Barr virus]
uggaccaagggcagg

SEQ ID NO: 3971124 - RNA, 14 nt, Human herpesvirus 4 [Epstein-Barr virus]
uggacccugcugcg

SEQ ID NO: 3971125 - RNA, 18 nt, Human herpesvirus 4 [Epstein-Barr virus]
uggaugcaucuaaggucc

SEQ ID NO: 3971126 - RNA, 15 nt, Human herpesvirus 4 [Epstein-Barr virus]
uggcaaagggcaugc

SEQ ID NO: 3971127 - RNA, 20 nt, Human herpesvirus 4 [Epstein-Barr virus]
uggcagaaucaccagagccc

SEQ ID NO: 3971128 - RNA, 14 nt, Human herpesvirus 4 [Epstein-Barr virus]
uggcauccuucaga

SEQ ID NO: 3971129 - RNA, 14 nt, Human herpesvirus 4 [Epstein-Barr virus]
uggcauucagauuu

SEQ ID NO: 3971130 - RNA, 22 nt, Human herpesvirus 4 [Epstein-Barr virus]
uggcauugcggguggauagccu

SEQ ID NO: 3971131 - RNA, 15 nt, Human herpesvirus 4 [Epstein-Barr virus]
uggccgccggauggc

SEQ ID NO: 3971132 - RNA, 17 nt, Human herpesvirus 4 [Epstein-Barr virus]
uggccgccguggccaac

SEQ ID NO: 3971133 - RNA, 21 nt, Human herpesvirus 4 [Epstein-Barr virus]
uggccgugcuggaugagguua

SEQ ID NO: 3971134 - RNA, 12 nt, Human herpesvirus 4 [Epstein-Barr virus]
uggccucaaagu

SEQ ID NO: 3971135 - RNA, 12 nt, Human herpesvirus 4 [Epstein-Barr virus]
uggccuggagag

SEQ ID NO: 3971136 - RNA, 12 nt, Human herpesvirus 4 [Epstein-Barr virus]
uggcggcccagc

SEQ ID NO: 3971137 - RNA, 23 nt, Human herpesvirus 4 [Epstein-Barr virus]
uggcuguacgccgccgccagcag

SEQ ID NO: 3971138 - RNA, 15 nt, Human herpesvirus 4 [Epstein-Barr virus]
uggcuguagccaccc

SEQ ID NO: 3971139 - RNA, 20 nt, Human herpesvirus 4 [Epstein-Barr virus]
ugggaacacggagaucucag

SEQ ID NO: 3971140 - RNA, 19 nt, Human herpesvirus 4 [Epstein-Barr virus]
ugggaagcucagcaguugu

SEQ ID NO: 3971141 - RNA, 15 nt, Human herpesvirus 4 [Epstein-Barr virus]
ugggagggagccugc

SEQ ID NO: 3971142 - RNA, 20 nt, Human herpesvirus 4 [Epstein-Barr virus]
ugggcaaaacucacaggaca

SEQ ID NO: 3971143 - RNA, 15 nt, Human herpesvirus 4 [Epstein-Barr virus]
ugggcgguccuccac

SEQ ID NO: 3971144 - RNA, 15 nt, Human herpesvirus 4 [Epstein-Barr virus]
uggggcaauggcgac

SEQ ID NO: 3971145 - RNA, 15 nt, Human herpesvirus 4 [Epstein-Barr virus]
uggggccauaguggc

SEQ ID NO: 3971146 - RNA, 17 nt, Human herpesvirus 4 [Epstein-Barr virus]
uggggucucaggccucc

SEQ ID NO: 3971147 - RNA, 19 nt, Human herpesvirus 4 [Epstein-Barr virus]
ugggucgccugacccucuu

SEQ ID NO: 3971148 - RNA, 22 nt, Human herpesvirus 4 [Epstein-Barr virus]
ugggugcaagaauuggggcugg

SEQ ID NO: 3971149 - RNA, 15 nt, Human herpesvirus 4 [Epstein-Barr virus]
ugguggcagcaggcg

SEQ ID NO: 3971150 - RNA, 15 nt, Human herpesvirus 4 [Epstein-Barr virus]
uggugggcuccuuag

SEQ ID NO: 3971151 - RNA, 19 nt, Human herpesvirus 4 [Epstein-Barr virus]
ugguggguguccucuacug

SEQ ID NO: 3971152 - RNA, 15 nt, Human herpesvirus 4 [Epstein-Barr virus]
ugguggguguggagc

SEQ ID NO: 3971153 - RNA, 19 nt, Human herpesvirus 4 [Epstein-Barr virus]
ugguuauuuugggccagga

SEQ ID NO: 3971154 - RNA, 21 nt, Human herpesvirus 4 [Epstein-Barr virus]
ugguuccccccaucuuugagg

SEQ ID NO: 3971155 - RNA, 12 nt, Human herpesvirus 4 [Epstein-Barr virus]
ugguugucuucc

SEQ ID NO: 3971156 - RNA, 22 nt, Human herpesvirus 4 [Epstein-Barr virus]
uguaacacuacuuguuucugga

SEQ ID NO: 3971157 - RNA, 19 nt, Human herpesvirus 4 [Epstein-Barr virus]
uguagccacccgucccggg

SEQ ID NO: 3971158 - RNA, 20 nt, Human herpesvirus 4 [Epstein-Barr virus]
uguaucccaaauaaauguua

SEQ ID NO: 3971159 - RNA, 22 nt, Human herpesvirus 4 [Epstein-Barr virus]
uguaucccaaauaaauguuacu

SEQ ID NO: 3971160 - RNA, 13 nt, Human herpesvirus 4 [Epstein-Barr virus]
uguccagaugucc

SEQ ID NO: 3971161 - RNA, 18 nt, Human herpesvirus 4 [Epstein-Barr virus]
ugucccccuagccccggg

SEQ ID NO: 3971162 - RNA, 17 nt, Human herpesvirus 4 [Epstein-Barr virus]
ugucccuuucagugguc

SEQ ID NO: 3971163 - RNA, 12 nt, Human herpesvirus 4 [Epstein-Barr virus]
uguccucccggg

SEQ ID NO: 3971164 - RNA, 16 nt, Human herpesvirus 4 [Epstein-Barr virus]
ugucggggcugcuggc

SEQ ID NO: 3971165 - RNA, 16 nt, Human herpesvirus 4 [Epstein-Barr virus]
ugucuccugacgccaa

SEQ ID NO: 3971166 - RNA, 19 nt, Human herpesvirus 4 [Epstein-Barr virus]
ugucuuccacaccauccac

SEQ ID NO: 3971167 - RNA, 22 nt, Human herpesvirus 4 [Epstein-Barr virus]
uguggaaaaucucgcucagagc

SEQ ID NO: 3971168 - RNA, 19 nt, Human herpesvirus 4 [Epstein-Barr virus]
uguggccuuccucugccug

SEQ ID NO: 3971169 - RNA, 12 nt, Human herpesvirus 4 [Epstein-Barr virus]
uguguacauaau

SEQ ID NO: 3971170 - RNA, 14 nt, Human herpesvirus 4 [Epstein-Barr virus]
ugugugcuguauuu

SEQ ID NO: 3971171 - RNA, 22 nt, Human herpesvirus 4 [Epstein-Barr virus]
uguucagggccgugcauggcag

SEQ ID NO: 3971172 - RNA, 13 nt, Human herpesvirus 4 [Epstein-Barr virus]
uguucuccgagag

SEQ ID NO: 3971173 - RNA, 16 nt, Human herpesvirus 4 [Epstein-Barr virus]
uguuucucagagagca

SEQ ID NO: 3971174 - RNA, 13 nt, Human herpesvirus 4 [Epstein-Barr virus]
uguuuuuggcaug

SEQ ID NO: 3971175 - RNA, 22 nt, Human herpesvirus 4 [Epstein-Barr virus]
uuaaaacaguagaagaacugca

SEQ ID NO: 3971176 - RNA, 23 nt, Human herpesvirus 4 [Epstein-Barr virus]
uuaacgggaagagaaguggggag

SEQ ID NO: 3971177 - RNA, 18 nt, Human herpesvirus 4 [Epstein-Barr virus]
uuaaggugguuauuuugg

SEQ ID NO: 3971178 - RNA, 14 nt, Human herpesvirus 4 [Epstein-Barr virus]
uuacaauaaaauga

SEQ ID NO: 3971179 - RNA, 17 nt, Human herpesvirus 4 [Epstein-Barr virus]
uuacccucauugugcug

SEQ ID NO: 3971180 - RNA, 16 nt, Human herpesvirus 4 [Epstein-Barr virus]
uuacuucuuuugcucu

SEQ ID NO: 3971181 - RNA, 16 nt, Human herpesvirus 4 [Epstein-Barr virus]
uuagacagguaacuca

SEQ ID NO: 3971182 - RNA, 15 nt, Human herpesvirus 4 [Epstein-Barr virus]
uuaggcacuggacac

SEQ ID NO: 3971183 - RNA, 18 nt, Human herpesvirus 4 [Epstein-Barr virus]
uucacuuccucugcuuuu

SEQ ID NO: 3971184 - RNA, 15 nt, Human herpesvirus 4 [Epstein-Barr virus]
uuccacccacugaua

SEQ ID NO: 3971185 - RNA, 17 nt, Human herpesvirus 4 [Epstein-Barr virus]
uuccgugccucgggccu

SEQ ID NO: 3971186 - RNA, 22 nt, Human herpesvirus 4 [Epstein-Barr virus]
uuccuagaaacugugccauggu

SEQ ID NO: 3971187 - RNA, 15 nt, Human herpesvirus 4 [Epstein-Barr virus]
uuccuucucaugcuc

SEQ ID NO: 3971188 - RNA, 14 nt, Human herpesvirus 4 [Epstein-Barr virus]
uuccuuuucaucau

SEQ ID NO: 3971189 - RNA, 13 nt, Human herpesvirus 4 [Epstein-Barr virus]
uucugaaggaacg

SEQ ID NO: 3971190 - RNA, 16 nt, Human herpesvirus 4 [Epstein-Barr virus]
uucugccccucagccu

SEQ ID NO: 3971191 - RNA, 22 nt, Human herpesvirus 4 [Epstein-Barr virus]
uucugcuccagugccuccgccu

SEQ ID NO: 3971192 - RNA, 13 nt, Human herpesvirus 4 [Epstein-Barr virus]
uucugucuguaaa

SEQ ID NO: 3971193 - RNA, 16 nt, Human herpesvirus 4 [Epstein-Barr virus]
uugaugugacuuguga

SEQ ID NO: 3971194 - RNA, 18 nt, Human herpesvirus 4 [Epstein-Barr virus]
uugcaaucccaaguacag

SEQ ID NO: 3971195 - RNA, 19 nt, Human herpesvirus 4 [Epstein-Barr virus]
uugccggccaccuuugcua

SEQ ID NO: 3971196 - RNA, 22 nt, Human herpesvirus 4 [Epstein-Barr virus]
uugccugaagcuugcuggggcg

SEQ ID NO: 3971197 - RNA, 19 nt, Human herpesvirus 4 [Epstein-Barr virus]
uugcgccgccuaaugcauc

SEQ ID NO: 3971198 - RNA, 20 nt, Human herpesvirus 4 [Epstein-Barr virus]
uugcucucagcacuuugcca

SEQ ID NO: 3971199 - RNA, 23 nt, Human herpesvirus 4 [Epstein-Barr virus]
uugggccugcggggaacugagcc

SEQ ID NO: 3971200 - RNA, 20 nt, Human herpesvirus 4 [Epstein-Barr virus]
uuggggguggugggcuccuu

SEQ ID NO: 3971201 - RNA, 11 nt, Human herpesvirus 4 [Epstein-Barr virus]
uugggguccuc

SEQ ID NO: 3971202 - RNA, 18 nt, Human herpesvirus 4 [Epstein-Barr virus]
uuggugcugccugggggc

SEQ ID NO: 3971203 - RNA, 17 nt, Human herpesvirus 4 [Epstein-Barr virus]
uugucacuuucuuugca

SEQ ID NO: 3971204 - RNA, 21 nt, Human herpesvirus 4 [Epstein-Barr virus]
uugucuucccagacucugcuu

SEQ ID NO: 3971205 - RNA, 14 nt, Human herpesvirus 4 [Epstein-Barr virus]
uugugcuccugaua

SEQ ID NO: 3971206 - RNA, 15 nt, Human herpesvirus 4 [Epstein-Barr virus]
uugugcuuguacuga

SEQ ID NO: 3971207 - RNA, 16 nt, Human herpesvirus 4 [Epstein-Barr virus]
uuguuggggaaaacac

SEQ ID NO: 3971208 - RNA, 15 nt, Human herpesvirus 4 [Epstein-Barr virus]
uuucagcaucacagg

SEQ ID NO: 3971209 - RNA, 18 nt, Human herpesvirus 4 [Epstein-Barr virus]
uuuccgauagaauagcug

SEQ ID NO: 3971210 - RNA, 13 nt, Human herpesvirus 4 [Epstein-Barr virus]
uuugacuguuugu

SEQ ID NO: 3971211 - RNA, 22 nt, Human herpesvirus 4 [Epstein-Barr virus]
uuugaucuuugacugacacaua

SEQ ID NO: 3971212 - RNA, 20 nt, Human herpesvirus 4 [Epstein-Barr virus]
uuugccaaccugcucucucu

SEQ ID NO: 3971213 - RNA, 20 nt, Human herpesvirus 4 [Epstein-Barr virus]
uuuuggugaaauaaaaacag

SEQ ID NO: 3971214 - RNA, 18 nt, Human herpesvirus 4 [Epstein-Barr virus]
gacacgcuccuucuuggc

SEQ ID NO: 3971215 - RNA, 18 nt, Human herpesvirus 4 [Epstein-Barr virus]
gacacuuuagagcucugg

SEQ ID NO: 3971216 - RNA, 20 nt, Human herpesvirus 4 [Epstein-Barr virus]
gacacuuuagagcucuggag

SEQ ID NO: 3971217 - RNA, 16 nt, Human herpesvirus 4 [Epstein-Barr virus]
gacaugcuauggugcc

SEQ ID NO: 3971218 - RNA, 19 nt, Human herpesvirus 4 [Epstein-Barr virus]
gacaugugcauggccuggg

SEQ ID NO: 3971219 - RNA, 18 nt, Human herpesvirus 4 [Epstein-Barr virus]
gacauuucucauaauggu

SEQ ID NO: 3971220 - RNA, 20 nt, Human herpesvirus 4 [Epstein-Barr virus]
gaccacauacaucccugucu

SEQ ID NO: 3971221 - RNA, 21 nt, Human herpesvirus 4 [Epstein-Barr virus]
gaccauggaugugaaugcccc

SEQ ID NO: 3971222 - RNA, 13 nt, Human herpesvirus 4 [Epstein-Barr virus]
gacccccccaagc

SEQ ID NO: 3971223 - RNA, 12 nt, Human herpesvirus 4 [Epstein-Barr virus]
gacccuucugcu

SEQ ID NO: 3971224 - RNA, 14 nt, Human herpesvirus 4 [Epstein-Barr virus]
gaccgcgcccuccu

SEQ ID NO: 3971225 - RNA, 14 nt, Human herpesvirus 4 [Epstein-Barr virus]
gaccucgggaggga

SEQ ID NO: 3971226 - RNA, 16 nt, Human herpesvirus 4 [Epstein-Barr virus]
gacgaggacggggaag

SEQ ID NO: 3971227 - RNA, 14 nt, Human herpesvirus 4 [Epstein-Barr virus]
gacgaggggccagg

SEQ ID NO: 3971228 - RNA, 20 nt, Human herpesvirus 4 [Epstein-Barr virus]
gacgcagaaugugcagggau

SEQ ID NO: 3971229 - RNA, 19 nt, Human herpesvirus 4 [Epstein-Barr virus]
gacgcgcagugccaagagc

SEQ ID NO: 3971230 - RNA, 14 nt, Human herpesvirus 4 [Epstein-Barr virus]
gacgcuccaggauc

SEQ ID NO: 3971231 - RNA, 13 nt, Human herpesvirus 4 [Epstein-Barr virus]
gacgcugcugcua

SEQ ID NO: 3971232 - RNA, 14 nt, Human herpesvirus 4 [Epstein-Barr virus]
gacguguguggcug

SEQ ID NO: 3971233 - RNA, 17 nt, Human herpesvirus 4 [Epstein-Barr virus]
gacguguguggcuguag

SEQ ID NO: 3971234 - RNA, 17 nt, Human herpesvirus 4 [Epstein-Barr virus]
gacuacaauguuccuuc

SEQ ID NO: 3971235 - RNA, 18 nt, Human herpesvirus 4 [Epstein-Barr virus]
gacuaucaaccacuagga

SEQ ID NO: 3971236 - RNA, 21 nt, Human herpesvirus 4 [Epstein-Barr virus]
gacugaggggguacggagagg

SEQ ID NO: 3971237 - RNA, 17 nt, Human herpesvirus 4 [Epstein-Barr virus]
gacugcgaucuggaccc

SEQ ID NO: 3971238 - RNA, 17 nt, Human herpesvirus 4 [Epstein-Barr virus]
gacuggcacgguggcuu

SEQ ID NO: 3971239 - RNA, 14 nt, Human herpesvirus 4 [Epstein-Barr virus]
gacuggcggcacug

SEQ ID NO: 3971240 - RNA, 18 nt, Human herpesvirus 4 [Epstein-Barr virus]
gacugggggcaaagccag

SEQ ID NO: 3971241 - RNA, 23 nt, Human herpesvirus 4 [Epstein-Barr virus]
gacuguuuguggcggcaucaugu

SEQ ID NO: 3971242 - RNA, 19 nt, Human herpesvirus 4 [Epstein-Barr virus]
gacuucauauguaugccuu

SEQ ID NO: 3971243 - RNA, 15 nt, Human herpesvirus 4 [Epstein-Barr virus]
gacuucugaagaugu

SEQ ID NO: 3971244 - RNA, 23 nt, Human herpesvirus 4 [Epstein-Barr virus]
gacuugaggugggcugacacaga

SEQ ID NO: 3971245 - RNA, 18 nt, Human herpesvirus 4 [Epstein-Barr virus]
gagaaccugaugugggac

SEQ ID NO: 3971246 - RNA, 16 nt, Human herpesvirus 4 [Epstein-Barr virus]
gagaagagaggcuucc

SEQ ID NO: 3971247 - RNA, 17 nt, Human herpesvirus 4 [Epstein-Barr virus]
gagacgagcugcgacag

SEQ ID NO: 3971248 - RNA, 18 nt, Human herpesvirus 4 [Epstein-Barr virus]
gucaauaauuucagugaa

SEQ ID NO: 3971249 - RNA, 18 nt, Human herpesvirus 4 [Epstein-Barr virus]
gucacauauccagagcug

SEQ ID NO: 3971250 - RNA, 17 nt, Human herpesvirus 4 [Epstein-Barr virus]
gucaggagggcagagag

SEQ ID NO: 3971251 - RNA, 16 nt, Human herpesvirus 4 [Epstein-Barr virus]
gucauggcggacugcg

SEQ ID NO: 3971252 - RNA, 15 nt, Human herpesvirus 4 [Epstein-Barr virus]
guccagauguccagg

SEQ ID NO: 3971253 - RNA, 16 nt, Human herpesvirus 4 [Epstein-Barr virus]
guccagcggggccgca

SEQ ID NO: 3971254 - RNA, 18 nt, Human herpesvirus 4 [Epstein-Barr virus]
guccaggagucugcugcg

SEQ ID NO: 3971255 - RNA, 11 nt, Human herpesvirus 4 [Epstein-Barr virus]
guccagugggg

SEQ ID NO: 3971256 - RNA, 22 nt, Human herpesvirus 4 [Epstein-Barr virus]
guccaguuuuuaugugccucgg

SEQ ID NO: 3971257 - RNA, 22 nt, Human herpesvirus 4 [Epstein-Barr virus]
gucccccuccauuccacccacu

SEQ ID NO: 3971258 - RNA, 23 nt, Human herpesvirus 4 [Epstein-Barr virus]
guccccguggaggaccgcccacc

SEQ ID NO: 3971259 - RNA, 14 nt, Human herpesvirus 4 [Epstein-Barr virus]
gucccggguacaag

SEQ ID NO: 3971260 - RNA, 12 nt, Human herpesvirus 4 [Epstein-Barr virus]
gucccuccucac

SEQ ID NO: 3971261 - RNA, 13 nt, Human herpesvirus 4 [Epstein-Barr virus]
gucccugcugccc

SEQ ID NO: 3971262 - RNA, 16 nt, Human herpesvirus 4 [Epstein-Barr virus]
guccgcuccuacacca

SEQ ID NO: 3971263 - RNA, 17 nt, Human herpesvirus 4 [Epstein-Barr virus]
guccuaggugggauaua

SEQ ID NO: 3971264 - RNA, 22 nt, Human herpesvirus 4 [Epstein-Barr virus]
guccucaaggauggcacgggca

SEQ ID NO: 3971265 - RNA, 19 nt, Human herpesvirus 4 [Epstein-Barr virus]
gucggacgaggaggaagag

SEQ ID NO: 3971266 - RNA, 18 nt, Human herpesvirus 4 [Epstein-Barr virus]
gucucacgagggucugcc

SEQ ID NO: 3971267 - RNA, 17 nt, Human herpesvirus 4 [Epstein-Barr virus]
gucuccccucgagcgcc

SEQ ID NO: 3971268 - RNA, 19 nt, Human herpesvirus 4 [Epstein-Barr virus]
gucuccccucugcagagag

SEQ ID NO: 3971269 - RNA, 21 nt, Human herpesvirus 4 [Epstein-Barr virus]
gucuccccucugcagagagcc

SEQ ID NO: 3971270 - RNA, 16 nt, Human herpesvirus 4 [Epstein-Barr virus]
gucucggccuccuggc

SEQ ID NO: 3971271 - RNA, 19 nt, Human herpesvirus 4 [Epstein-Barr virus]
gucugcaccccaguggaca

SEQ ID NO: 3971272 - RNA, 12 nt, Human herpesvirus 4 [Epstein-Barr virus]
gucugcugccau

SEQ ID NO: 3971273 - RNA, 23 nt, Human herpesvirus 4 [Epstein-Barr virus]
gucuuacugcccagccuacucuc

SEQ ID NO: 3971274 - RNA, 22 nt, Human herpesvirus 4 [Epstein-Barr virus]
gucuucggucaaguaccagcug

SEQ ID NO: 3971275 - RNA, 14 nt, Human herpesvirus 4 [Epstein-Barr virus]
gucuuguaaaacuu

SEQ ID NO: 3971276 - RNA, 13 nt, Human herpesvirus 4 [Epstein-Barr virus]
gugaggcccagcc

SEQ ID NO: 3971277 - RNA, 22 nt, Human herpesvirus 4 [Epstein-Barr virus]
gugagguggugcuugugaaggu

SEQ ID NO: 3971278 - RNA, 12 nt, Human herpesvirus 4 [Epstein-Barr virus]
gugagucagccu

SEQ ID NO: 3971279 - RNA, 18 nt, Human herpesvirus 4 [Epstein-Barr virus]
gugaguccagggcccugg

SEQ ID NO: 3971280 - RNA, 19 nt, Human herpesvirus 4 [Epstein-Barr virus]
gugaugguacggaugauca

SEQ ID NO: 3971281 - RNA, 13 nt, Human herpesvirus 4 [Epstein-Barr virus]
gugcacucucucc

SEQ ID NO: 3971282 - RNA, 22 nt, Human herpesvirus 4 [Epstein-Barr virus]
gugccagacucucuucagugac

SEQ ID NO: 3971283 - RNA, 21 nt, Human herpesvirus 4 [Epstein-Barr virus]
gugccagaugugccugggcua

SEQ ID NO: 3971284 - RNA, 18 nt, Human herpesvirus 4 [Epstein-Barr virus]
gugcccgagccccgccug

SEQ ID NO: 3971285 - RNA, 21 nt, Human herpesvirus 4 [Epstein-Barr virus]
gugccuaaacgugauggugcu

SEQ ID NO: 3971286 - RNA, 12 nt, Human herpesvirus 4 [Epstein-Barr virus]
gugccucagaua

SEQ ID NO: 3971287 - RNA, 15 nt, Human herpesvirus 4 [Epstein-Barr virus]
gugccucugggugcu

SEQ ID NO: 3971288 - RNA, 18 nt, Human herpesvirus 4 [Epstein-Barr virus]
gugccugacggugccgcu

SEQ ID NO: 3971289 - RNA, 18 nt, Human herpesvirus 4 [Epstein-Barr virus]
gugcgcaacgccggccug

SEQ ID NO: 3971290 - RNA, 12 nt, Human herpesvirus 4 [Epstein-Barr virus]
gugcucuucaug

SEQ ID NO: 3971291 - RNA, 21 nt, Human herpesvirus 4 [Epstein-Barr virus]
guggagguugucaaaaucaaa

SEQ ID NO: 3971292 - RNA, 16 nt, Human herpesvirus 4 [Epstein-Barr virus]
guggcagcaggcgcug

SEQ ID NO: 3971293 - RNA, 17 nt, Human herpesvirus 4 [Epstein-Barr virus]
guggcagccgcggccau

SEQ ID NO: 3971294 - RNA, 11 nt, Human herpesvirus 4 [Epstein-Barr virus]
guggcauugcg

SEQ ID NO: 3971295 - RNA, 15 nt, Human herpesvirus 4 [Epstein-Barr virus]
guggcauugcgggug

SEQ ID NO: 3971296 - RNA, 22 nt, Human herpesvirus 4 [Epstein-Barr virus]
guggcccucgguggugggcugc

SEQ ID NO: 3971297 - RNA, 14 nt, Human herpesvirus 4 [Epstein-Barr virus]
guggccugcucacc

SEQ ID NO: 3971298 - RNA, 12 nt, Human herpesvirus 4 [Epstein-Barr virus]
guggccugggag

SEQ ID NO: 3971299 - RNA, 21 nt, Human herpesvirus 4 [Epstein-Barr virus]
guggccuuccucugccuggcc

SEQ ID NO: 3971300 - RNA, 17 nt, Human herpesvirus 4 [Epstein-Barr virus]
gugggccucucuggcug

SEQ ID NO: 3971301 - RNA, 20 nt, Human herpesvirus 4 [Epstein-Barr virus]
gugggccucucuggcugugc

SEQ ID NO: 3971302 - RNA, 15 nt, Human herpesvirus 4 [Epstein-Barr virus]
guggggcugagacca

SEQ ID NO: 3971303 - RNA, 17 nt, Human herpesvirus 4 [Epstein-Barr virus]
guggguccccucugccg

SEQ ID NO: 3971304 - RNA, 17 nt, Human herpesvirus 4 [Epstein-Barr virus]
guggucaccgcgaccaa

SEQ ID NO: 3971305 - RNA, 18 nt, Human herpesvirus 4 [Epstein-Barr virus]
guggucuuagggcgccag

SEQ ID NO: 3971306 - RNA, 14 nt, Human herpesvirus 4 [Epstein-Barr virus]
guggugggcuccuu

SEQ ID NO: 3971307 - RNA, 22 nt, Human herpesvirus 4 [Epstein-Barr virus]
guggugggcuccuuagacugag

SEQ ID NO: 3971308 - RNA, 22 nt, Human herpesvirus 4 [Epstein-Barr virus]
gugguugucuucccagacucug

SEQ ID NO: 3971309 - RNA, 16 nt, Human herpesvirus 4 [Epstein-Barr virus]
gugguuucggacacac

SEQ ID NO: 3971310 - RNA, 15 nt, Human herpesvirus 4 [Epstein-Barr virus]
gugucauuuagaaac

SEQ ID NO: 3971311 - RNA, 17 nt, Human herpesvirus 4 [Epstein-Barr virus]
guguccagguguggaaa

SEQ ID NO: 3971312 - RNA, 13 nt, Human herpesvirus 4 [Epstein-Barr virus]
guguccugggcaa

SEQ ID NO: 3971313 - RNA, 19 nt, Human herpesvirus 4 [Epstein-Barr virus]
guguggcuguagccacccg

SEQ ID NO: 3971314 - RNA, 16 nt, Human herpesvirus 4 [Epstein-Barr virus]
guguguggcuguagcc

SEQ ID NO: 3971315 - RNA, 16 nt, Human herpesvirus 4 [Epstein-Barr virus]
guuaacauggacaugc

SEQ ID NO: 3971316 - RNA, 20 nt, Human herpesvirus 4 [Epstein-Barr virus]
guuaucaccguaccaugagu

SEQ ID NO: 3971317 - RNA, 22 nt, Human herpesvirus 4 [Epstein-Barr virus]
guucaguggacacccaccacac

SEQ ID NO: 3971318 - RNA, 19 nt, Human herpesvirus 4 [Epstein-Barr virus]
guucccuucucccacccug

SEQ ID NO: 3971319 - RNA, 21 nt, Human herpesvirus 4 [Epstein-Barr virus]
guucuccccacgggaaaaaga

SEQ ID NO: 3971320 - RNA, 15 nt, Human herpesvirus 4 [Epstein-Barr virus]
guucuggugaugcuu

SEQ ID NO: 3971321 - RNA, 15 nt, Human herpesvirus 4 [Epstein-Barr virus]
guugcaguauguaca

SEQ ID NO: 3971322 - RNA, 23 nt, Human herpesvirus 4 [Epstein-Barr virus]
guuggagagauucgagaggauga

SEQ ID NO: 3971323 - RNA, 13 nt, Human herpesvirus 4 [Epstein-Barr virus]
guuuaaggaauga

SEQ ID NO: 3971324 - RNA, 16 nt, Human herpesvirus 4 [Epstein-Barr virus]
uaaaaggggcagcaau

SEQ ID NO: 3971325 - RNA, 12 nt, Human herpesvirus 4 [Epstein-Barr virus]
uaaacaagcuga

SEQ ID NO: 3971326 - RNA, 24 nt, Human herpesvirus 4 [Epstein-Barr virus]
uaaacgccugauuuuuguccgcag

SEQ ID NO: 3971327 - RNA, 15 nt, Human herpesvirus 4 [Epstein-Barr virus]
uaaauaucuuccugu

SEQ ID NO: 3971328 - RNA, 18 nt, Human herpesvirus 4 [Epstein-Barr virus]
uaacccaauucccgccuc

SEQ ID NO: 3971329 - RNA, 22 nt, Human herpesvirus 4 [Epstein-Barr virus]
uaaggugguuauuuugggccag

SEQ ID NO: 3971330 - RNA, 14 nt, Human herpesvirus 4 [Epstein-Barr virus]
uaauaaauaucuuc

SEQ ID NO: 3971331 - RNA, 16 nt, Human herpesvirus 4 [Epstein-Barr virus]
uaauguccaguggggu

SEQ ID NO: 3971332 - RNA, 18 nt, Human herpesvirus 4 [Epstein-Barr virus]
uaauucucuucuguuugc

SEQ ID NO: 3971333 - RNA, 15 nt, Human herpesvirus 4 [Epstein-Barr virus]
uacaaacacuacaau

SEQ ID NO: 3971334 - RNA, 15 nt, Human herpesvirus 4 [Epstein-Barr virus]
uacaaacccaacaau

SEQ ID NO: 3971335 - RNA, 21 nt, Human herpesvirus 4 [Epstein-Barr virus]
uacacucuggggucucaggcc

SEQ ID NO: 3971336 - RNA, 22 nt, Human herpesvirus 4 [Epstein-Barr virus]
ggcggcagcggacgguggggcu

SEQ ID NO: 3971337 - RNA, 12 nt, Human herpesvirus 4 [Epstein-Barr virus]
ggcggcccagcc

SEQ ID NO: 3971338 - RNA, 12 nt, Human herpesvirus 4 [Epstein-Barr virus]
ggcggcugcugc

SEQ ID NO: 3971339 - RNA, 22 nt, Human herpesvirus 4 [Epstein-Barr virus]
ggcggguggagauagggaccag

SEQ ID NO: 3971340 - RNA, 14 nt, Human herpesvirus 4 [Epstein-Barr virus]
ggcucaccagggag

SEQ ID NO: 3971341 - RNA, 20 nt, Human herpesvirus 4 [Epstein-Barr virus]
ggcucaccagggaggccugg

SEQ ID NO: 3971342 - RNA, 16 nt, Human herpesvirus 4 [Epstein-Barr virus]
ggcucaggccgccgca

SEQ ID NO: 3971343 - RNA, 13 nt, Human herpesvirus 4 [Epstein-Barr virus]
ggcucauggaggg

SEQ ID NO: 3971344 - RNA, 12 nt, Human herpesvirus 4 [Epstein-Barr virus]
ggcucucuuuga

SEQ ID NO: 3971345 - RNA, 16 nt, Human herpesvirus 4 [Epstein-Barr virus]
ggcugcaaagggaccc

SEQ ID NO: 3971346 - RNA, 15 nt, Human herpesvirus 4 [Epstein-Barr virus]
ggcugcgguggugcg

SEQ ID NO: 3971347 - RNA, 23 nt, Human herpesvirus 4 [Epstein-Barr virus]
ggcuggacgucuuguccuuggug

SEQ ID NO: 3971348 - RNA, 23 nt, Human herpesvirus 4 [Epstein-Barr virus]
ggcugugagcgcacgugacagau

SEQ ID NO: 3971349 - RNA, 21 nt, Human herpesvirus 4 [Epstein-Barr virus]
ggcuuccagagaggcgcagcc

SEQ ID NO: 3971350 - RNA, 20 nt, Human herpesvirus 4 [Epstein-Barr virus]
gggaaagaggucccauguac

SEQ ID NO: 3971351 - RNA, 12 nt, Human herpesvirus 4 [Epstein-Barr virus]
gggacaccugca

SEQ ID NO: 3971352 - RNA, 13 nt, Human herpesvirus 4 [Epstein-Barr virus]
gggacaccugcac

SEQ ID NO: 3971353 - RNA, 16 nt, Human herpesvirus 4 [Epstein-Barr virus]
gggacaguaccacaag

SEQ ID NO: 3971354 - RNA, 18 nt, Human herpesvirus 4 [Epstein-Barr virus]
gggacgcagaaugugcag

SEQ ID NO: 3971355 - RNA, 22 nt, Human herpesvirus 4 [Epstein-Barr virus]
gggagcacauuccccccgccuu

SEQ ID NO: 3971356 - RNA, 16 nt, Human herpesvirus 4 [Epstein-Barr virus]
gggaggcccaggaccu

SEQ ID NO: 3971357 - RNA, 14 nt, Human herpesvirus 4 [Epstein-Barr virus]
gggagggagccugc

SEQ ID NO: 3971358 - RNA, 14 nt, Human herpesvirus 4 [Epstein-Barr virus]
gggaggggcaggag

SEQ ID NO: 3971359 - RNA, 14 nt, Human herpesvirus 4 [Epstein-Barr virus]
gggaguaaggccgc

SEQ ID NO: 3971360 - RNA, 23 nt, Human herpesvirus 4 [Epstein-Barr virus]
gggaguaaggccgcugccaggcc

SEQ ID NO: 3971361 - RNA, 15 nt, Human herpesvirus 4 [Epstein-Barr virus]
gggaugaacccuggg

SEQ ID NO: 3971362 - RNA, 21 nt, Human herpesvirus 4 [Epstein-Barr virus]
gggcacucucgagggugccug

SEQ ID NO: 3971363 - RNA, 14 nt, Human herpesvirus 4 [Epstein-Barr virus]
gggcaggagcagga

SEQ ID NO: 3971364 - RNA, 15 nt, Human herpesvirus 4 [Epstein-Barr virus]
gggcaggagcaggag

SEQ ID NO: 3971365 - RNA, 16 nt, Human herpesvirus 4 [Epstein-Barr virus]
gggcaugcuugggcau

SEQ ID NO: 3971366 - RNA, 20 nt, Human herpesvirus 4 [Epstein-Barr virus]
gggccagguacaggaccugg

SEQ ID NO: 3971367 - RNA, 19 nt, Human herpesvirus 4 [Epstein-Barr virus]
gggccgucacuccagccau

SEQ ID NO: 3971368 - RNA, 16 nt, Human herpesvirus 4 [Epstein-Barr virus]
gggccuuccagagcuc

SEQ ID NO: 3971369 - RNA, 14 nt, Human herpesvirus 4 [Epstein-Barr virus]
gggcgaaggguggg

SEQ ID NO: 3971370 - RNA, 18 nt, Human herpesvirus 4 [Epstein-Barr virus]
gggcugccccgggcccac

SEQ ID NO: 3971371 - RNA, 15 nt, Human herpesvirus 4 [Epstein-Barr virus]
gggcugguggccugg

SEQ ID NO: 3971372 - RNA, 16 nt, Human herpesvirus 4 [Epstein-Barr virus]
gggcugguggccuggg

SEQ ID NO: 3971373 - RNA, 18 nt, Human herpesvirus 4 [Epstein-Barr virus]
gggcugguggccugggag

SEQ ID NO: 3971374 - RNA, 21 nt, Human herpesvirus 4 [Epstein-Barr virus]
gggcugguuggggagcuacag

SEQ ID NO: 3971375 - RNA, 15 nt, Human herpesvirus 4 [Epstein-Barr virus]
ggggagagaaagaga

SEQ ID NO: 3971376 - RNA, 22 nt, Human herpesvirus 4 [Epstein-Barr virus]
ggggcacucucgagggugccug

SEQ ID NO: 3971377 - RNA, 19 nt, Human herpesvirus 4 [Epstein-Barr virus]
ggggccagguacaggaccu

SEQ ID NO: 3971378 - RNA, 15 nt, Human herpesvirus 4 [Epstein-Barr virus]
ggggcugguggccug

SEQ ID NO: 3971379 - RNA, 20 nt, Human herpesvirus 4 [Epstein-Barr virus]
gggguccggucuugcaggga

SEQ ID NO: 3971380 - RNA, 21 nt, Human herpesvirus 4 [Epstein-Barr virus]
gggguucuccaggcuccugga

SEQ ID NO: 3971381 - RNA, 13 nt, Human herpesvirus 4 [Epstein-Barr virus]
ggguaagaggagg

SEQ ID NO: 3971382 - RNA, 20 nt, Human herpesvirus 4 [Epstein-Barr virus]
gggucaagcaaacggccugg

SEQ ID NO: 3971383 - RNA, 20 nt, Human herpesvirus 4 [Epstein-Barr virus]
ggguccaagguugugcugua

SEQ ID NO: 3971384 - RNA, 20 nt, Human herpesvirus 4 [Epstein-Barr virus]
gggugaaagcuacuaucucc

SEQ ID NO: 3971385 - RNA, 14 nt, Human herpesvirus 4 [Epstein-Barr virus]
gggugcucccccug

SEQ ID NO: 3971386 - RNA, 23 nt, Human herpesvirus 4 [Epstein-Barr virus]
ggguggcagcccccuccuccagg

SEQ ID NO: 3971387 - RNA, 21 nt, Human herpesvirus 4 [Epstein-Barr virus]
gguacucuuggugcagcccuu

SEQ ID NO: 3971388 - RNA, 18 nt, Human herpesvirus 4 [Epstein-Barr virus]
gguagauagguggucgca

SEQ ID NO: 3971389 - RNA, 20 nt, Human herpesvirus 4 [Epstein-Barr virus]
gguauucucagaugcagugg

SEQ ID NO: 3971390 - RNA, 19 nt, Human herpesvirus 4 [Epstein-Barr virus]
ggucaaguaccagcuggug

SEQ ID NO: 3971391 - RNA, 20 nt, Human herpesvirus 4 [Epstein-Barr virus]
ggucccuagaaauggugcca

SEQ ID NO: 3971392 - RNA, 18 nt, Human herpesvirus 4 [Epstein-Barr virus]
gguccuccacggggacac

SEQ ID NO: 3971393 - RNA, 23 nt, Human herpesvirus 4 [Epstein-Barr virus]
gguccuccacggggacacgcucc

SEQ ID NO: 3971394 - RNA, 16 nt, Human herpesvirus 4 [Epstein-Barr virus]
ggucgcccccucugcc

SEQ ID NO: 3971395 - RNA, 20 nt, Human herpesvirus 4 [Epstein-Barr virus]
ggucgcccccucugccuccg

SEQ ID NO: 3971396 - RNA, 14 nt, Human herpesvirus 4 [Epstein-Barr virus]
ggucgggggcacuc

SEQ ID NO: 3971397 - RNA, 16 nt, Human herpesvirus 4 [Epstein-Barr virus]
ggugaccuggccaggc

SEQ ID NO: 3971398 - RNA, 13 nt, Human herpesvirus 4 [Epstein-Barr virus]
ggugaggcccagc

SEQ ID NO: 3971399 - RNA, 18 nt, Human herpesvirus 4 [Epstein-Barr virus]
ggugccuguggagauuag

SEQ ID NO: 3971400 - RNA, 10 nt, Human herpesvirus 4 [Epstein-Barr virus]
ggugcucccc

SEQ ID NO: 3971401 - RNA, 14 nt, Human herpesvirus 4 [Epstein-Barr virus]
ggugcuugugaagg

SEQ ID NO: 3971402 - RNA, 19 nt, Human herpesvirus 4 [Epstein-Barr virus]
gguggaacaggagcaggag

SEQ ID NO: 3971403 - RNA, 18 nt, Human herpesvirus 4 [Epstein-Barr virus]
gguggcccucgguggugg

SEQ ID NO: 3971404 - RNA, 17 nt, Human herpesvirus 4 [Epstein-Barr virus]
gguggccgcggcccagg

SEQ ID NO: 3971405 - RNA, 11 nt, Human herpesvirus 4 [Epstein-Barr virus]
ggugggcuggu

SEQ ID NO: 3971406 - RNA, 17 nt, Human herpesvirus 4 [Epstein-Barr virus]
gguguagccggggugga

SEQ ID NO: 3971407 - RNA, 16 nt, Human herpesvirus 4 [Epstein-Barr virus]
gguuagcguggacagu

SEQ ID NO: 3971408 - RNA, 24 nt, Human herpesvirus 4 [Epstein-Barr virus]
gguuggcaugguauuggucgucuu

SEQ ID NO: 3971409 - RNA, 23 nt, Human herpesvirus 4 [Epstein-Barr virus]
gguuucaauuuugggagcuccag

SEQ ID NO: 3971410 - RNA, 16 nt, Human herpesvirus 4 [Epstein-Barr virus]
guaaccuaugccugga

SEQ ID NO: 3971411 - RNA, 17 nt, Human herpesvirus 4 [Epstein-Barr virus]
guaauuguugcgcccua

SEQ ID NO: 3971412 - RNA, 12 nt, Human herpesvirus 4 [Epstein-Barr virus]
guaccagcuggu

SEQ ID NO: 3971413 - RNA, 23 nt, Human herpesvirus 4 [Epstein-Barr virus]
guacccuuucuaccaggggcgag

SEQ ID NO: 3971414 - RNA, 13 nt, Human herpesvirus 4 [Epstein-Barr virus]
guacgugccucag

SEQ ID NO: 3971415 - RNA, 16 nt, Human herpesvirus 4 [Epstein-Barr virus]
guagagaucaggccaa

SEQ ID NO: 3971416 - RNA, 17 nt, Human herpesvirus 4 [Epstein-Barr virus]
guagaggcucaggccau

SEQ ID NO: 3971417 - RNA, 19 nt, Human herpesvirus 4 [Epstein-Barr virus]
guaggcuugauagcaguga

SEQ ID NO: 3971418 - RNA, 19 nt, Human herpesvirus 4 [Epstein-Barr virus]
guaugaggaaggggccucg

SEQ ID NO: 3971419 - RNA, 20 nt, Human herpesvirus 4 [Epstein-Barr virus]
guauuccucaagcccuucuu

SEQ ID NO: 3971420 - RNA, 14 nt, Human herpesvirus 4 [Epstein-Barr virus]
gucaagcaaacggc

SEQ ID NO: 3971421 - RNA, 22 nt, Human herpesvirus 4 [Epstein-Barr virus]
gucaaggccaacucagaccccg

SEQ ID NO: 3971422 - RNA, 14 nt, Human herpesvirus 4 [Epstein-Barr virus]
gucaaguaccagcu

SEQ ID NO: 3971423 - RNA, 16 nt, Human herpesvirus 4 [Epstein-Barr virus]
gucaaguaccagcugg

SEQ ID NO: 3971424 - RNA, 15 nt, Human herpesvirus 4 [Epstein-Barr virus]
cuccauuccacccac

SEQ ID NO: 3971425 - RNA, 18 nt, Human herpesvirus 4 [Epstein-Barr virus]
cuccauuccacccacuga

SEQ ID NO: 3971426 - RNA, 12 nt, Human herpesvirus 4 [Epstein-Barr virus]
cucccaccaccc

SEQ ID NO: 3971427 - RNA, 12 nt, Human herpesvirus 4 [Epstein-Barr virus]
cucccacuguca

SEQ ID NO: 3971428 - RNA, 15 nt, Human herpesvirus 4 [Epstein-Barr virus]
cuccccagccacagc

SEQ ID NO: 3971429 - RNA, 13 nt, Human herpesvirus 4 [Epstein-Barr virus]
cucccccuggaca

SEQ ID NO: 3971430 - RNA, 19 nt, Human herpesvirus 4 [Epstein-Barr virus]
cucccgggcaaacagggca

SEQ ID NO: 3971431 - RNA, 16 nt, Human herpesvirus 4 [Epstein-Barr virus]
cuccgccaccuccggg

SEQ ID NO: 3971432 - RNA, 16 nt, Human herpesvirus 4 [Epstein-Barr virus]
cuccgccguccacucu

SEQ ID NO: 3971433 - RNA, 20 nt, Human herpesvirus 4 [Epstein-Barr virus]
cuccggacgcagaggccugc

SEQ ID NO: 3971434 - RNA, 21 nt, Human herpesvirus 4 [Epstein-Barr virus]
cuccggcggcaguggaccuca

SEQ ID NO: 3971435 - RNA, 12 nt, Human herpesvirus 4 [Epstein-Barr virus]
cuccggcugccc

SEQ ID NO: 3971436 - RNA, 19 nt, Human herpesvirus 4 [Epstein-Barr virus]
cuccggggguccagccggg

SEQ ID NO: 3971437 - RNA, 19 nt, Human herpesvirus 4 [Epstein-Barr virus]
cuccugccugccucugcuc

SEQ ID NO: 3971438 - RNA, 17 nt, Human herpesvirus 4 [Epstein-Barr virus]
cuccuggaucuggggcu

SEQ ID NO: 3971439 - RNA, 13 nt, Human herpesvirus 4 [Epstein-Barr virus]
cuccuugugcagc

SEQ ID NO: 3971440 - RNA, 13 nt, Human herpesvirus 4 [Epstein-Barr virus]
cucgaccagcacg

SEQ ID NO: 3971441 - RNA, 14 nt, Human herpesvirus 4 [Epstein-Barr virus]
cucgagagaggccu

SEQ ID NO: 3971442 - RNA, 16 nt, Human herpesvirus 4 [Epstein-Barr virus]
cucgagagaggccucu

SEQ ID NO: 3971443 - RNA, 21 nt, Human herpesvirus 4 [Epstein-Barr virus]
cucgaguaggugccuccagag

SEQ ID NO: 3971444 - RNA, 15 nt, Human herpesvirus 4 [Epstein-Barr virus]
cucgcagcuggagga

SEQ ID NO: 3971445 - RNA, 19 nt, Human herpesvirus 4 [Epstein-Barr virus]
cucgccuucuccucagccu

SEQ ID NO: 3971446 - RNA, 18 nt, Human herpesvirus 4 [Epstein-Barr virus]
cucgcggaagagcccaaa

SEQ ID NO: 3971447 - RNA, 12 nt, Human herpesvirus 4 [Epstein-Barr virus]
cucgcucagagc

SEQ ID NO: 3971448 - RNA, 17 nt, Human herpesvirus 4 [Epstein-Barr virus]
cucgcucagagcuggga

SEQ ID NO: 3971449 - RNA, 12 nt, Human herpesvirus 4 [Epstein-Barr virus]
cucggaggugcc

SEQ ID NO: 3971450 - RNA, 18 nt, Human herpesvirus 4 [Epstein-Barr virus]
cucguagagaucaggcca

SEQ ID NO: 3971451 - RNA, 22 nt, Human herpesvirus 4 [Epstein-Barr virus]
cucgugcaaccaggcccacugc

SEQ ID NO: 3971452 - RNA, 14 nt, Human herpesvirus 4 [Epstein-Barr virus]
cucuaaucccucug

SEQ ID NO: 3971453 - RNA, 16 nt, Human herpesvirus 4 [Epstein-Barr virus]
cucuaaucccucuggg

SEQ ID NO: 3971454 - RNA, 11 nt, Human herpesvirus 4 [Epstein-Barr virus]
cucucaggccu

SEQ ID NO: 3971455 - RNA, 19 nt, Human herpesvirus 4 [Epstein-Barr virus]
cucugauggccuggagagc

SEQ ID NO: 3971456 - RNA, 24 nt, Human herpesvirus 4 [Epstein-Barr virus]
cucugaugguggccggcagccugg

SEQ ID NO: 3971457 - RNA, 15 nt, Human herpesvirus 4 [Epstein-Barr virus]
cucuggacuuccaug

SEQ ID NO: 3971458 - RNA, 15 nt, Human herpesvirus 4 [Epstein-Barr virus]
cucuggcacugcuag

SEQ ID NO: 3971459 - RNA, 16 nt, Human herpesvirus 4 [Epstein-Barr virus]
cucugggguccaggag

SEQ ID NO: 3971460 - RNA, 18 nt, Human herpesvirus 4 [Epstein-Barr virus]
cucuggggucucaggccu

SEQ ID NO: 3971461 - RNA, 22 nt, Human herpesvirus 4 [Epstein-Barr virus]
cucuggucgcccccucugccuc

SEQ ID NO: 3971462 - RNA, 23 nt, Human herpesvirus 4 [Epstein-Barr virus]
cucuggucgcccccucugccucc

SEQ ID NO: 3971463 - RNA, 22 nt, Human herpesvirus 4 [Epstein-Barr virus]
cucuucauuagauucacguucc

SEQ ID NO: 3971464 - RNA, 16 nt, Human herpesvirus 4 [Epstein-Barr virus]
cucuucugggaacacc

SEQ ID NO: 3971465 - RNA, 16 nt, Human herpesvirus 4 [Epstein-Barr virus]
cucuuggcagcagugg

SEQ ID NO: 3971466 - RNA, 19 nt, Human herpesvirus 4 [Epstein-Barr virus]
cugaacaucucauccccag

SEQ ID NO: 3971467 - RNA, 14 nt, Human herpesvirus 4 [Epstein-Barr virus]
cugaaucuccaccu

SEQ ID NO: 3971468 - RNA, 19 nt, Human herpesvirus 4 [Epstein-Barr virus]
ccgggcccagcccuccuca

SEQ ID NO: 3971469 - RNA, 17 nt, Human herpesvirus 4 [Epstein-Barr virus]
ccggggguggaggcugc

SEQ ID NO: 3971470 - RNA, 21 nt, Human herpesvirus 4 [Epstein-Barr virus]
ccgggucaggucgcggaccag

SEQ ID NO: 3971471 - RNA, 14 nt, Human herpesvirus 4 [Epstein-Barr virus]
ccggguggugagga

SEQ ID NO: 3971472 - RNA, 21 nt, Human herpesvirus 4 [Epstein-Barr virus]
ccggugcugccagagccucug

SEQ ID NO: 3971473 - RNA, 23 nt, Human herpesvirus 4 [Epstein-Barr virus]
ccguaccaugagugccaugugug

SEQ ID NO: 3971474 - RNA, 22 nt, Human herpesvirus 4 [Epstein-Barr virus]
ccguccccugaccggcgcggga

SEQ ID NO: 3971475 - RNA, 22 nt, Human herpesvirus 4 [Epstein-Barr virus]
ccgucucggugcgcagacccca

SEQ ID NO: 3971476 - RNA, 19 nt, Human herpesvirus 4 [Epstein-Barr virus]
ccguguuucucccacuguc

SEQ ID NO: 3971477 - RNA, 23 nt, Human herpesvirus 4 [Epstein-Barr virus]
ccuaaacgugauggugcuggucu

SEQ ID NO: 3971478 - RNA, 13 nt, Human herpesvirus 4 [Epstein-Barr virus]
ccuaagcagcuga

SEQ ID NO: 3971479 - RNA, 22 nt, Human herpesvirus 4 [Epstein-Barr virus]
ccuagugguuucggacacaccg

SEQ ID NO: 3971480 - RNA, 15 nt, Human herpesvirus 4 [Epstein-Barr virus]
ccuaucauguuucaa

SEQ ID NO: 3971481 - RNA, 14 nt, Human herpesvirus 4 [Epstein-Barr virus]
ccuaugccuggaag

SEQ ID NO: 3971482 - RNA, 16 nt, Human herpesvirus 4 [Epstein-Barr virus]
ccuaugccuggaagaa

SEQ ID NO: 3971483 - RNA, 15 nt, Human herpesvirus 4 [Epstein-Barr virus]
ccucacgaccugugu

SEQ ID NO: 3971484 - RNA, 13 nt, Human herpesvirus 4 [Epstein-Barr virus]
ccucauccugcuc

SEQ ID NO: 3971485 - RNA, 21 nt, Human herpesvirus 4 [Epstein-Barr virus]
ccuccacuuacaaccaagcca

SEQ ID NO: 3971486 - RNA, 22 nt, Human herpesvirus 4 [Epstein-Barr virus]
ccuccccaauggggcuggcagu

SEQ ID NO: 3971487 - RNA, 13 nt, Human herpesvirus 4 [Epstein-Barr virus]
ccucccccugccc

SEQ ID NO: 3971488 - RNA, 13 nt, Human herpesvirus 4 [Epstein-Barr virus]
ccuccgccgccug

SEQ ID NO: 3971489 - RNA, 22 nt, Human herpesvirus 4 [Epstein-Barr virus]
ccucgaguaggugccuccagag

SEQ ID NO: 3971490 - RNA, 14 nt, Human herpesvirus 4 [Epstein-Barr virus]
cacuggaugcagga

SEQ ID NO: 3971491 - RNA, 15 nt, Human herpesvirus 4 [Epstein-Barr virus]
cacuggugguggagg

SEQ ID NO: 3971492 - RNA, 19 nt, Human herpesvirus 4 [Epstein-Barr virus]
cacuguauaaagaaugccc

SEQ ID NO: 3971493 - RNA, 24 nt, Human herpesvirus 4 [Epstein-Barr virus]
cacuuuguacagacuuuuggcaau

SEQ ID NO: 3971494 - RNA, 17 nt, Human herpesvirus 4 [Epstein-Barr virus]
cagaaaaucgcagcagg

SEQ ID NO: 3971495 - RNA, 15 nt, Human herpesvirus 4 [Epstein-Barr virus]
cagaaagaggcucug

SEQ ID NO: 3971496 - RNA, 13 nt, Human herpesvirus 4 [Epstein-Barr virus]
cagaaccaucagc

SEQ ID NO: 3971497 - RNA, 20 nt, Human herpesvirus 4 [Epstein-Barr virus]
cagaagacuccugccugaau

SEQ ID NO: 3971498 - RNA, 19 nt, Human herpesvirus 4 [Epstein-Barr virus]
cagaaucaccagagcccag

SEQ ID NO: 3971499 - RNA, 21 nt, Human herpesvirus 4 [Epstein-Barr virus]
cagagccccuuuugccccccu

SEQ ID NO: 3971500 - RNA, 22 nt, Human herpesvirus 4 [Epstein-Barr virus]
cagaggaaggccacaaagaggg

SEQ ID NO: 3971501 - RNA, 20 nt, Human herpesvirus 4 [Epstein-Barr virus]
cagaggccguguuucuccca

SEQ ID NO: 3971502 - RNA, 22 nt, Human herpesvirus 4 [Epstein-Barr virus]
cagagucuacucgaccagcacg

SEQ ID NO: 3971503 - RNA, 21 nt, Human herpesvirus 4 [Epstein-Barr virus]
cagaucccuacuacugcagca

SEQ ID NO: 3971504 - RNA, 22 nt, Human herpesvirus 4 [Epstein-Barr virus]
cagaugcaccgggaugagcugg

SEQ ID NO: 3971505 - RNA, 23 nt, Human herpesvirus 4 [Epstein-Barr virus]
cagauuuccgaaccuugucuuca

SEQ ID NO: 3971506 - RNA, 21 nt, Human herpesvirus 4 [Epstein-Barr virus]
cagcaaccaauguaucccaaa

SEQ ID NO: 3971507 - RNA, 15 nt, Human herpesvirus 4 [Epstein-Barr virus]
cagcaccugucccug

SEQ ID NO: 3971508 - RNA, 15 nt, Human herpesvirus 4 [Epstein-Barr virus]
cagcagacaaggaca

SEQ ID NO: 3971509 - RNA, 13 nt, Human herpesvirus 4 [Epstein-Barr virus]
cagcagcaguggu

SEQ ID NO: 3971510 - RNA, 18 nt, Human herpesvirus 4 [Epstein-Barr virus]
cagcagcccggccgaggc

SEQ ID NO: 3971511 - RNA, 14 nt, Human herpesvirus 4 [Epstein-Barr virus]
cagcagggcacaga

SEQ ID NO: 3971512 - RNA, 16 nt, Human herpesvirus 4 [Epstein-Barr virus]
cagccaccuccccugu

SEQ ID NO: 3971513 - RNA, 23 nt, Human herpesvirus 4 [Epstein-Barr virus]
cagccagguguacgcccuggcgg

SEQ ID NO: 3971514 - RNA, 10 nt, Human herpesvirus 4 [Epstein-Barr virus]
cagcccagcc

SEQ ID NO: 3971515 - RNA, 13 nt, Human herpesvirus 4 [Epstein-Barr virus]
cagcccccccugu

SEQ ID NO: 3971516 - RNA, 17 nt, Human herpesvirus 4 [Epstein-Barr virus]
cagccccgcccucccca

SEQ ID NO: 3971517 - RNA, 14 nt, Human herpesvirus 4 [Epstein-Barr virus]
cagccccucauccc

SEQ ID NO: 3971518 - RNA, 16 nt, Human herpesvirus 4 [Epstein-Barr virus]
cagccccucaucccug

SEQ ID NO: 3971519 - RNA, 12 nt, Human herpesvirus 4 [Epstein-Barr virus]
cagcccuccuca

SEQ ID NO: 3971520 - RNA, 13 nt, Human herpesvirus 4 [Epstein-Barr virus]
cagcccuccucag

SEQ ID NO: 3971521 - RNA, 21 nt, Human herpesvirus 4 [Epstein-Barr virus]
cagcccucgagaaccccagca

SEQ ID NO: 3971522 - RNA, 16 nt, Human herpesvirus 4 [Epstein-Barr virus]
cagcccuuaacacacc

SEQ ID NO: 3971523 - RNA, 21 nt, Human herpesvirus 4 [Epstein-Barr virus]
cagcccuuuuaacauuggcag

SEQ ID NO: 3971524 - RNA, 16 nt, Human herpesvirus 4 [Epstein-Barr virus]
cagccgcugaagccag

SEQ ID NO: 3971525 - RNA, 19 nt, Human herpesvirus 4 [Epstein-Barr virus]
cagccgcuucagacagccg

SEQ ID NO: 3971526 - RNA, 15 nt, Human herpesvirus 4 [Epstein-Barr virus]
cagccgggaggaaga

SEQ ID NO: 3971527 - RNA, 18 nt, Human herpesvirus 4 [Epstein-Barr virus]
cagccugcaccaguggcu

SEQ ID NO: 3971528 - RNA, 15 nt, Human herpesvirus 4 [Epstein-Barr virus]
cagcgccagcagggc

SEQ ID NO: 3971529 - RNA, 13 nt, Human herpesvirus 4 [Epstein-Barr virus]
cagcgccuccucg

SEQ ID NO: 3971530 - RNA, 15 nt, Human herpesvirus 4 [Epstein-Barr virus]
cagcgcggcagaggc

SEQ ID NO: 3971531 - RNA, 13 nt, Human herpesvirus 4 [Epstein-Barr virus]
cagcgcuggcucc

SEQ ID NO: 3971532 - RNA, 15 nt, Human herpesvirus 4 [Epstein-Barr virus]
cagcggacggugggg

SEQ ID NO: 3971533 - RNA, 15 nt, Human herpesvirus 4 [Epstein-Barr virus]
cagcggauggugggg

SEQ ID NO: 3971534 - RNA, 23 nt, Human herpesvirus 4 [Epstein-Barr virus]
cagcgucaggagagggccagaga

SEQ ID NO: 3971535 - RNA, 15 nt, Human herpesvirus 4 [Epstein-Barr virus]
cagcuaacaggacau

SEQ ID NO: 3971536 - RNA, 19 nt, Human herpesvirus 4 [Epstein-Barr virus]
cagcugacggugggcauga

SEQ ID NO: 3971537 - RNA, 17 nt, Human herpesvirus 4 [Epstein-Barr virus]
cagcugaguccccuccu

SEQ ID NO: 3971538 - RNA, 18 nt, Human herpesvirus 4 [Epstein-Barr virus]
cagcuguucccagucucc

SEQ ID NO: 3971539 - RNA, 17 nt, Human herpesvirus 4 [Epstein-Barr virus]
cagcuuuuggccuucuu

SEQ ID NO: 3971540 - RNA, 16 nt, Human herpesvirus 4 [Epstein-Barr virus]
caggaaguacagccgg

SEQ ID NO: 3971541 - RNA, 14 nt, Human herpesvirus 4 [Epstein-Barr virus]
caggacacgugaca

SEQ ID NO: 3971542 - RNA, 22 nt, Human herpesvirus 4 [Epstein-Barr virus]
caggagacacacguggcuucca

SEQ ID NO: 3971543 - RNA, 23 nt, Human herpesvirus 4 [Epstein-Barr virus]
caggagccccgggcggcucagga

SEQ ID NO: 3971544 - RNA, 18 nt, Human herpesvirus 4 [Epstein-Barr virus]
caggagcgggaggggcag

SEQ ID NO: 3971545 - RNA, 23 nt, Human herpesvirus 4 [Epstein-Barr virus]
caggagcgggaggggcaggagca

SEQ ID NO: 3971546 - RNA, 22 nt, Human herpesvirus 4 [Epstein-Barr virus]
caggaggaggggcaggagcagg

SEQ ID NO: 3971547 - RNA, 16 nt, Human herpesvirus 4 [Epstein-Barr virus]
caggaggggcaggagc

SEQ ID NO: 3971548 - RNA, 17 nt, Human herpesvirus 4 [Epstein-Barr virus]
caggaggggcaggagca

SEQ ID NO: 3971549 - RNA, 21 nt, Human herpesvirus 4 [Epstein-Barr virus]
caggaggggcaggaggggcag

SEQ ID NO: 3971550 - RNA, 16 nt, Human herpesvirus 4 [Epstein-Barr virus]
caggcacaucuggcac

SEQ ID NO: 3971551 - RNA, 13 nt, Human herpesvirus 4 [Epstein-Barr virus]
caggcagaggaag

SEQ ID NO: 3971552 - RNA, 13 nt, Human herpesvirus 4 [Epstein-Barr virus]
caggcagccuugc

SEQ ID NO: 3971553 - RNA, 13 nt, Human herpesvirus 4 [Epstein-Barr virus]
caggcccccagcu

SEQ ID NO: 3971554 - RNA, 14 nt, Human herpesvirus 4 [Epstein-Barr virus]
caggccgccaugcu

SEQ ID NO: 3971555 - RNA, 23 nt, Human herpesvirus 4 [Epstein-Barr virus]
caggccgccaugcucagggccac

SEQ ID NO: 3971556 - RNA, 19 nt, Human herpesvirus 4 [Epstein-Barr virus]
caggccucacgaucuucaa

SEQ ID NO: 3971557 - RNA, 11 nt, Human herpesvirus 4 [Epstein-Barr virus]
caggcuccugg

SEQ ID NO: 3971558 - RNA, 14 nt, Human herpesvirus 4 [Epstein-Barr virus]
caggcucggcaccu

SEQ ID NO: 3971559 - RNA, 23 nt, Human herpesvirus 4 [Epstein-Barr virus]
gacuacaaggcauuuacguucug

SEQ ID NO: 3971560 - RNA, 19 nt, Human herpesvirus 4 [Epstein-Barr virus]
gacuccggggguccagccg

SEQ ID NO: 3971561 - RNA, 22 nt, Human herpesvirus 4 [Epstein-Barr virus]
gacuccgugaccaaccggcacg

SEQ ID NO: 3971562 - RNA, 13 nt, Human herpesvirus 4 [Epstein-Barr virus]
gacucuugaagau

SEQ ID NO: 3971563 - RNA, 23 nt, Human herpesvirus 4 [Epstein-Barr virus]
gacugcaaacccuggccgccgga

SEQ ID NO: 3971564 - RNA, 15 nt, Human herpesvirus 4 [Epstein-Barr virus]
gacuggggugugaag

SEQ ID NO: 3971565 - RNA, 16 nt, Human herpesvirus 4 [Epstein-Barr virus]
gagacguguguggcug

SEQ ID NO: 3971566 - RNA, 14 nt, Human herpesvirus 4 [Epstein-Barr virus]
gagagcuccgccac

SEQ ID NO: 3971567 - RNA, 12 nt, Human herpesvirus 4 [Epstein-Barr virus]
gagaggccucug

SEQ ID NO: 3971568 - RNA, 20 nt, Human herpesvirus 4 [Epstein-Barr virus]
gagaugugcgcccugcucuc

SEQ ID NO: 3971569 - RNA, 13 nt, Human herpesvirus 4 [Epstein-Barr virus]
gagauuaggggua

SEQ ID NO: 3971570 - RNA, 14 nt, Human herpesvirus 4 [Epstein-Barr virus]
gagcagaaggccau

SEQ ID NO: 3971571 - RNA, 21 nt, Human herpesvirus 4 [Epstein-Barr virus]
gagcagaaggccauggagaac

SEQ ID NO: 3971572 - RNA, 12 nt, Human herpesvirus 4 [Epstein-Barr virus]
gagcaggagcag

SEQ ID NO: 3971573 - RNA, 15 nt, Human herpesvirus 4 [Epstein-Barr virus]
ccugggagggccauc

SEQ ID NO: 3971574 - RNA, 14 nt, Human herpesvirus 4 [Epstein-Barr virus]
ccugucggcucucu

SEQ ID NO: 3971575 - RNA, 18 nt, Human herpesvirus 4 [Epstein-Barr virus]
ccugucucuuucuggcca

SEQ ID NO: 3971576 - RNA, 13 nt, Human herpesvirus 4 [Epstein-Barr virus]
ccuuaacacacca

SEQ ID NO: 3971577 - RNA, 21 nt, Human herpesvirus 4 [Epstein-Barr virus]
ccuucggacccugguacagga

SEQ ID NO: 3971578 - RNA, 21 nt, Human herpesvirus 4 [Epstein-Barr virus]
ccuugaucuucuucucccuca

SEQ ID NO: 3971579 - RNA, 18 nt, Human herpesvirus 4 [Epstein-Barr virus]
ccuugcccccgccagcgc

SEQ ID NO: 3971580 - RNA, 17 nt, Human herpesvirus 4 [Epstein-Barr virus]
ccuugcccucuccagca

SEQ ID NO: 3971581 - RNA, 17 nt, Human herpesvirus 4 [Epstein-Barr virus]
ccuugcguggugcuguc

SEQ ID NO: 3971582 - RNA, 19 nt, Human herpesvirus 4 [Epstein-Barr virus]
ccuuggcaucaucagcgcc

SEQ ID NO: 3971583 - RNA, 17 nt, Human herpesvirus 4 [Epstein-Barr virus]
ccuuguccgcugggcca

SEQ ID NO: 3971584 - RNA, 15 nt, Human herpesvirus 4 [Epstein-Barr virus]
cgacaauaaaguuga

SEQ ID NO: 3971585 - RNA, 16 nt, Human herpesvirus 4 [Epstein-Barr virus]
cgacaucgccgcccca

SEQ ID NO: 3971586 - RNA, 18 nt, Human herpesvirus 4 [Epstein-Barr virus]
cgacauguuucuggugag

SEQ ID NO: 3971587 - RNA, 23 nt, Human herpesvirus 4 [Epstein-Barr virus]
cgaccagucaugucgagcaugag

SEQ ID NO: 3971588 - RNA, 16 nt, Human herpesvirus 4 [Epstein-Barr virus]
cgacgcggugcugacc

SEQ ID NO: 3971589 - RNA, 17 nt, Human herpesvirus 4 [Epstein-Barr virus]
cgacugccgccgccucc

SEQ ID NO: 3971590 - RNA, 19 nt, Human herpesvirus 4 [Epstein-Barr virus]
cgacugggggcaaagccag

SEQ ID NO: 3971591 - RNA, 13 nt, Human herpesvirus 4 [Epstein-Barr virus]
cgagaaggaggag

SEQ ID NO: 3971592 - RNA, 20 nt, Human herpesvirus 4 [Epstein-Barr virus]
cgagaauuggcagacaccuu

SEQ ID NO: 3971593 - RNA, 20 nt, Human herpesvirus 4 [Epstein-Barr virus]
cgagcagcgcggcagaggcc

SEQ ID NO: 3971594 - RNA, 22 nt, Human herpesvirus 4 [Epstein-Barr virus]
cgagcuccgugggcccagagug

SEQ ID NO: 3971595 - RNA, 18 nt, Human herpesvirus 4 [Epstein-Barr virus]
cgagggccucuggcacgc

SEQ ID NO: 3971596 - RNA, 17 nt, Human herpesvirus 4 [Epstein-Barr virus]
cgagggugaggcccagc

SEQ ID NO: 3971597 - RNA, 19 nt, Human herpesvirus 4 [Epstein-Barr virus]
cgaguaggugccuccagag

SEQ ID NO: 3971598 - RNA, 14 nt, Human herpesvirus 4 [Epstein-Barr virus]
cgaguggcagaauc

SEQ ID NO: 3971599 - RNA, 15 nt, Human herpesvirus 4 [Epstein-Barr virus]
cgaucccaggccuca

SEQ ID NO: 3971600 - RNA, 19 nt, Human herpesvirus 4 [Epstein-Barr virus]
cgaugauugagaaugccaa

SEQ ID NO: 3971601 - RNA, 13 nt, Human herpesvirus 4 [Epstein-Barr virus]
cgcaccaccgcag

SEQ ID NO: 3971602 - RNA, 12 nt, Human herpesvirus 4 [Epstein-Barr virus]
cgccaccugcag

SEQ ID NO: 3971603 - RNA, 16 nt, Human herpesvirus 4 [Epstein-Barr virus]
cgccagcagggcacag

SEQ ID NO: 3971604 - RNA, 19 nt, Human herpesvirus 4 [Epstein-Barr virus]
cgccagccaccccagacag

SEQ ID NO: 3971605 - RNA, 14 nt, Human herpesvirus 4 [Epstein-Barr virus]
cgccaggaccugga

SEQ ID NO: 3971606 - RNA, 20 nt, Human herpesvirus 4 [Epstein-Barr virus]
cgccaggugguuacaggaga

SEQ ID NO: 3971607 - RNA, 20 nt, Human herpesvirus 4 [Epstein-Barr virus]
cgccaucuacccaacagucu

SEQ ID NO: 3971608 - RNA, 19 nt, Human herpesvirus 4 [Epstein-Barr virus]
cgcccccucugccuccggc

SEQ ID NO: 3971609 - RNA, 14 nt, Human herpesvirus 4 [Epstein-Barr virus]
cgcccgggggccag

SEQ ID NO: 3971610 - RNA, 14 nt, Human herpesvirus 4 [Epstein-Barr virus]
cgccguccacucua

SEQ ID NO: 3971611 - RNA, 12 nt, Human herpesvirus 4 [Epstein-Barr virus]
cgccuagagcau

SEQ ID NO: 3971612 - RNA, 15 nt, Human herpesvirus 4 [Epstein-Barr virus]
cgccucguguuucac

SEQ ID NO: 3971613 - RNA, 15 nt, Human herpesvirus 4 [Epstein-Barr virus]
cgccugagcugccug

SEQ ID NO: 3971614 - RNA, 17 nt, Human herpesvirus 4 [Epstein-Barr virus]
cgccugcuucacgccuc

SEQ ID NO: 3971615 - RNA, 21 nt, Human herpesvirus 4 [Epstein-Barr virus]
cgcgcugcucgccccugguag

SEQ ID NO: 3971616 - RNA, 18 nt, Human herpesvirus 4 [Epstein-Barr virus]
cgcggacuccgugaccaa

SEQ ID NO: 3971617 - RNA, 19 nt, Human herpesvirus 4 [Epstein-Barr virus]
cuucuucaggggaaucucu

SEQ ID NO: 3971618 - RNA, 19 nt, Human herpesvirus 4 [Epstein-Barr virus]
cuugaagguggaggggggc

SEQ ID NO: 3971619 - RNA, 19 nt, Human herpesvirus 4 [Epstein-Barr virus]
cuugacuguaaucacuggc

SEQ ID NO: 3971620 - RNA, 15 nt, Human herpesvirus 4 [Epstein-Barr virus]
cuugcccucuccagc

SEQ ID NO: 3971621 - RNA, 11 nt, Human herpesvirus 4 [Epstein-Barr virus]
cuuggaccaag

SEQ ID NO: 3971622 - RNA, 18 nt, Human herpesvirus 4 [Epstein-Barr virus]
cuuggaccaagggcaggg

SEQ ID NO: 3971623 - RNA, 22 nt, Human herpesvirus 4 [Epstein-Barr virus]
cuuggaggcugcuaagccagga

SEQ ID NO: 3971624 - RNA, 23 nt, Human herpesvirus 4 [Epstein-Barr virus]
cuuggcagcaguggccagcucau

SEQ ID NO: 3971625 - RNA, 17 nt, Human herpesvirus 4 [Epstein-Barr virus]
cuuggccccuguguaca

SEQ ID NO: 3971626 - RNA, 18 nt, Human herpesvirus 4 [Epstein-Barr virus]
cuuggcccucucacuucu

SEQ ID NO: 3971627 - RNA, 19 nt, Human herpesvirus 4 [Epstein-Barr virus]
cuugggcaugcuguaccug

SEQ ID NO: 3971628 - RNA, 13 nt, Human herpesvirus 4 [Epstein-Barr virus]
cuuguuucucaga

SEQ ID NO: 3971629 - RNA, 23 nt, Human herpesvirus 4 [Epstein-Barr virus]
cuuguuucucagagagcauuuca

SEQ ID NO: 3971630 - RNA, 15 nt, Human herpesvirus 4 [Epstein-Barr virus]
cuuuaaaggggagau

SEQ ID NO: 3971631 - RNA, 20 nt, Human herpesvirus 4 [Epstein-Barr virus]
cuuuaggcguaacuugucua

SEQ ID NO: 3971632 - RNA, 23 nt, Human herpesvirus 4 [Epstein-Barr virus]
cuuuccuagaaacugugccaugg

SEQ ID NO: 3971633 - RNA, 13 nt, Human herpesvirus 4 [Epstein-Barr virus]
cuuucuaugccug

SEQ ID NO: 3971634 - RNA, 22 nt, Human herpesvirus 4 [Epstein-Barr virus]
cuuuuacagugguucuccugau

SEQ ID NO: 3971635 - RNA, 11 nt, Human herpesvirus 4 [Epstein-Barr virus]
gaaaaaccaga

SEQ ID NO: 3971636 - RNA, 13 nt, Human herpesvirus 4 [Epstein-Barr virus]
gaaaccccacgga

SEQ ID NO: 3971637 - RNA, 14 nt, Human herpesvirus 4 [Epstein-Barr virus]
gaaacccucaguca

SEQ ID NO: 3971638 - RNA, 16 nt, Human herpesvirus 4 [Epstein-Barr virus]
gaaagaggcucugcau

SEQ ID NO: 3971639 - RNA, 23 nt, Human herpesvirus 4 [Epstein-Barr virus]
gaaaggguuggcaguguggcccg

SEQ ID NO: 3971640 - RNA, 21 nt, Human herpesvirus 4 [Epstein-Barr virus]
gaacacggagaucucagaauu

SEQ ID NO: 3971641 - RNA, 20 nt, Human herpesvirus 4 [Epstein-Barr virus]
gaacauccugcguggcugga

SEQ ID NO: 3971642 - RNA, 13 nt, Human herpesvirus 4 [Epstein-Barr virus]
gaaccagaaagau

SEQ ID NO: 3971643 - RNA, 21 nt, Human herpesvirus 4 [Epstein-Barr virus]
gaaccugagccugagccacac

SEQ ID NO: 3971644 - RNA, 13 nt, Human herpesvirus 4 [Epstein-Barr virus]
gaacgguggccag

SEQ ID NO: 3971645 - RNA, 16 nt, Human herpesvirus 4 [Epstein-Barr virus]
gaagaggacgaggacg

SEQ ID NO: 3971646 - RNA, 18 nt, Human herpesvirus 4 [Epstein-Barr virus]
gaagaucgugaggccuga

SEQ ID NO: 3971647 - RNA, 15 nt, Human herpesvirus 4 [Epstein-Barr virus]
gaagauugucacagc

SEQ ID NO: 3971648 - RNA, 18 nt, Human herpesvirus 4 [Epstein-Barr virus]
gaagcccaagaagaagcc

SEQ ID NO: 3971649 - RNA, 21 nt, Human herpesvirus 4 [Epstein-Barr virus]
gaagcccaagaagaagcccac

SEQ ID NO: 3971650 - RNA, 20 nt, Human herpesvirus 4 [Epstein-Barr virus]
gaagcuggccaggcugguga

SEQ ID NO: 3971651 - RNA, 13 nt, Human herpesvirus 4 [Epstein-Barr virus]
gaagggcagggcu

SEQ ID NO: 3971652 - RNA, 12 nt, Human herpesvirus 4 [Epstein-Barr virus]
gaauaugaugag

SEQ ID NO: 3971653 - RNA, 20 nt, Human herpesvirus 4 [Epstein-Barr virus]
gaaucgguaaggaggggcuc

SEQ ID NO: 3971654 - RNA, 15 nt, Human herpesvirus 4 [Epstein-Barr virus]
gaaucugggcuggga

SEQ ID NO: 3971655 - RNA, 13 nt, Human herpesvirus 4 [Epstein-Barr virus]
gaaugugguaaca

SEQ ID NO: 3971656 - RNA, 23 nt, Human herpesvirus 4 [Epstein-Barr virus]
gacacaggacuaaccaugccauc

SEQ ID NO: 3971657 - RNA, 16 nt, Human herpesvirus 4 [Epstein-Barr virus]
gacagaaauuggguga

SEQ ID NO: 3971658 - RNA, 13 nt, Human herpesvirus 4 [Epstein-Barr virus]
gacaggcugcgcc

SEQ ID NO: 3971659 - RNA, 14 nt, Human herpesvirus 4 [Epstein-Barr virus]
gacaguaacacagg

SEQ ID NO: 3971660 - RNA, 14 nt, Human herpesvirus 4 [Epstein-Barr virus]
gacaguaccacaag

SEQ ID NO: 3971661 - RNA, 22 nt, Human herpesvirus 4 [Epstein-Barr virus]
gacauccccagacucaccccca

SEQ ID NO: 3971662 - RNA, 21 nt, Human herpesvirus 4 [Epstein-Barr virus]
gacauuucucauaauggugcc

SEQ ID NO: 3971663 - RNA, 15 nt, Human herpesvirus 4 [Epstein-Barr virus]
gaccaauacccagga

SEQ ID NO: 3971664 - RNA, 17 nt, Human herpesvirus 4 [Epstein-Barr virus]
gaccaaugccaaagcug

SEQ ID NO: 3971665 - RNA, 23 nt, Human herpesvirus 4 [Epstein-Barr virus]
gaccaaugccaaagcugaagaac

SEQ ID NO: 3971666 - RNA, 16 nt, Human herpesvirus 4 [Epstein-Barr virus]
gaccagcguguuucau

SEQ ID NO: 3971667 - RNA, 19 nt, Human herpesvirus 4 [Epstein-Barr virus]
gaccaggucgaccaccuca

SEQ ID NO: 3971668 - RNA, 18 nt, Human herpesvirus 4 [Epstein-Barr virus]
gacccaucugagggcagu

SEQ ID NO: 3971669 - RNA, 23 nt, Human herpesvirus 4 [Epstein-Barr virus]
gacccaucugagggcagugauag

SEQ ID NO: 3971670 - RNA, 14 nt, Human herpesvirus 4 [Epstein-Barr virus]
gaccggcgcgggag

SEQ ID NO: 3971671 - RNA, 16 nt, Human herpesvirus 4 [Epstein-Barr virus]
gaccuggcucaggucc

SEQ ID NO: 3971672 - RNA, 18 nt, Human herpesvirus 4 [Epstein-Barr virus]
gacgaagacccaucugag

SEQ ID NO: 3971673 - RNA, 19 nt, Human herpesvirus 4 [Epstein-Barr virus]
gacgcacacggaaaccaca

SEQ ID NO: 3971674 - RNA, 14 nt, Human herpesvirus 4 [Epstein-Barr virus]
gacgcagaggccug

SEQ ID NO: 3971675 - RNA, 18 nt, Human herpesvirus 4 [Epstein-Barr virus]
gacgccaaugccaacucc

SEQ ID NO: 3971676 - RNA, 21 nt, Human herpesvirus 4 [Epstein-Barr virus]
gacgccugcggacucaggcca

SEQ ID NO: 3971677 - RNA, 17 nt, Human herpesvirus 4 [Epstein-Barr virus]
gacggaaaucugcucuu

SEQ ID NO: 3971678 - RNA, 14 nt, Human herpesvirus 4 [Epstein-Barr virus]
gacgggguggugcc

SEQ ID NO: 3971679 - RNA, 18 nt, Human herpesvirus 4 [Epstein-Barr virus]
gacgggguggugccuggu

SEQ ID NO: 3971680 - RNA, 20 nt, Human herpesvirus 4 [Epstein-Barr virus]
gacggugggcaugacacagg

SEQ ID NO: 3971681 - RNA, 13 nt, Human herpesvirus 4 [Epstein-Barr virus]
gacguguguggcu

SEQ ID NO: 3971682 - RNA, 20 nt, Human herpesvirus 4 [Epstein-Barr virus]
gacguguguggcuguagcca

SEQ ID NO: 3971683 - RNA, 14 nt, Human herpesvirus 4 [Epstein-Barr virus]
gcagcggccuuacu

SEQ ID NO: 3971684 - RNA, 20 nt, Human herpesvirus 4 [Epstein-Barr virus]
gcagcucaccuauggucacu

SEQ ID NO: 3971685 - RNA, 18 nt, Human herpesvirus 4 [Epstein-Barr virus]
gcagcugaguccccuccu

SEQ ID NO: 3971686 - RNA, 22 nt, Human herpesvirus 4 [Epstein-Barr virus]
gcagcugugugcgcgccgccag

SEQ ID NO: 3971687 - RNA, 18 nt, Human herpesvirus 4 [Epstein-Barr virus]
gcaggaccuagaaugugg

SEQ ID NO: 3971688 - RNA, 19 nt, Human herpesvirus 4 [Epstein-Barr virus]
gcaggagcgggaggggcag

SEQ ID NO: 3971689 - RNA, 16 nt, Human herpesvirus 4 [Epstein-Barr virus]
gcaggaggaggggcag

SEQ ID NO: 3971690 - RNA, 18 nt, Human herpesvirus 4 [Epstein-Barr virus]
gcaggaggggcaggagca

SEQ ID NO: 3971691 - RNA, 18 nt, Human herpesvirus 4 [Epstein-Barr virus]
gcaggcauuuuuggugcu

SEQ ID NO: 3971692 - RNA, 19 nt, Human herpesvirus 4 [Epstein-Barr virus]
ucguccgccuacugguugu

SEQ ID NO: 3971693 - RNA, 15 nt, Human herpesvirus 4 [Epstein-Barr virus]
ucgugaguccagggc

SEQ ID NO: 3971694 - RNA, 18 nt, Human herpesvirus 4 [Epstein-Barr virus]
ucgugcaaccaggcccac

SEQ ID NO: 3971695 - RNA, 22 nt, Human herpesvirus 4 [Epstein-Barr virus]
ucuaacacgcuuuugucugccu

SEQ ID NO: 3971696 - RNA, 23 nt, Human herpesvirus 4 [Epstein-Barr virus]
ucuaacacgcuuuugucugccug

SEQ ID NO: 3971697 - RNA, 20 nt, Human herpesvirus 4 [Epstein-Barr virus]
ucuacaaccccuuccacgug

SEQ ID NO: 3971698 - RNA, 13 nt, Human herpesvirus 4 [Epstein-Barr virus]
ucuacuuuaaaaa

SEQ ID NO: 3971699 - RNA, 19 nt, Human herpesvirus 4 [Epstein-Barr virus]
ucuaggacgcuguccgcca

SEQ ID NO: 3971700 - RNA, 15 nt, Human herpesvirus 4 [Epstein-Barr virus]
ucuauccaggaggag

SEQ ID NO: 3971701 - RNA, 11 nt, Human herpesvirus 4 [Epstein-Barr virus]
ucucagggaca

SEQ ID NO: 3971702 - RNA, 14 nt, Human herpesvirus 4 [Epstein-Barr virus]
ucuccagcaaccaa

SEQ ID NO: 3971703 - RNA, 20 nt, Human herpesvirus 4 [Epstein-Barr virus]
ucuccugccugccucugcuc

SEQ ID NO: 3971704 - RNA, 16 nt, Human herpesvirus 4 [Epstein-Barr virus]
ucuccugugugacccc

SEQ ID NO: 3971705 - RNA, 15 nt, Human herpesvirus 4 [Epstein-Barr virus]
ucucgcccaagcugc

SEQ ID NO: 3971706 - RNA, 21 nt, Human herpesvirus 4 [Epstein-Barr virus]
ucucgccuuguuucucagaga

SEQ ID NO: 3971707 - RNA, 16 nt, Human herpesvirus 4 [Epstein-Barr virus]
ucucggccuacgaggc

SEQ ID NO: 3971708 - RNA, 17 nt, Human herpesvirus 4 [Epstein-Barr virus]
ucucuagagccaggcua

SEQ ID NO: 3971709 - RNA, 21 nt, Human herpesvirus 4 [Epstein-Barr virus]
ucugaggaccuguugcuucag

SEQ ID NO: 3971710 - RNA, 14 nt, Human herpesvirus 4 [Epstein-Barr virus]
ucugauuauagcuc

SEQ ID NO: 3971711 - RNA, 16 nt, Human herpesvirus 4 [Epstein-Barr virus]
ucuggcugugcugacc

SEQ ID NO: 3971712 - RNA, 18 nt, Human herpesvirus 4 [Epstein-Barr virus]
ucugggccgcccggccuc

SEQ ID NO: 3971713 - RNA, 22 nt, Human herpesvirus 4 [Epstein-Barr virus]
ucuggggcuggccugccuggau

SEQ ID NO: 3971714 - RNA, 21 nt, Human herpesvirus 4 [Epstein-Barr virus]
ucuguacaauggggccaggac

SEQ ID NO: 3971715 - RNA, 11 nt, Human herpesvirus 4 [Epstein-Barr virus]
ucuguggcagu

SEQ ID NO: 3971716 - RNA, 20 nt, Human herpesvirus 4 [Epstein-Barr virus]
ucuguuaaggcuguugacau

SEQ ID NO: 3971717 - RNA, 20 nt, Human herpesvirus 4 [Epstein-Barr virus]
ucuuacaccagaggccacaa

SEQ ID NO: 3971718 - RNA, 17 nt, Human herpesvirus 4 [Epstein-Barr virus]
ucuucaagauugggugg

SEQ ID NO: 3971719 - RNA, 13 nt, Human herpesvirus 4 [Epstein-Barr virus]
ucuucucugcucg

SEQ ID NO: 3971720 - RNA, 18 nt, Human herpesvirus 4 [Epstein-Barr virus]
ucuugauaaaacagguua
